United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 25

SEQ ID NO: 1085763 - RNA, 22 nt, Human
ggcagaggagcuggaaacaugg

SEQ ID NO: 1085764 - RNA, 22 nt, Human
aggcccuguuaugagccacugu

SEQ ID NO: 1085765 - RNA, 21 nt, Human
ccuggcugcacaguugcuggu

SEQ ID NO: 1085766 - RNA, 22 nt, Human
aacaucuucagagaagcuaagu

SEQ ID NO: 1085767 - RNA, 22 nt, Human
aaaugacaauaaaaguccaugc

SEQ ID NO: 1085768 - RNA, 22 nt, Human
ugggcuacucugggagccuaac

SEQ ID NO: 1085769 - RNA, 22 nt, Human
agcaugaaaggcgugccaacuu

SEQ ID NO: 1085770 - RNA, 22 nt, Human
guuuccuacacuguaguauuau

SEQ ID NO: 1085771 - RNA, 22 nt, Human
cucugcccucacuuggggccug

SEQ ID NO: 1085772 - RNA, 20 nt, Human
ugugggccuucggcgugcuc

SEQ ID NO: 1085773 - RNA, 22 nt, Human
aggugucuuugcggcccgccgc

SEQ ID NO: 1085774 - RNA, 23 nt, Human
auuuuuagccucucugagcugag

SEQ ID NO: 1085775 - RNA, 22 nt, Human
caguuauuaugaggucauuagg

SEQ ID NO: 1085776 - RNA, 20 nt, Human
aggcugccaggucucacauc

SEQ ID NO: 1085777 - RNA, 22 nt, Human
aaaacaguuuuugcuaacugcu

SEQ ID NO: 1085778 - RNA, 22 nt, Human
aauuuguuaaaagugagugaca

SEQ ID NO: 1085779 - RNA, 22 nt, Human
uccugagaggugugaggugcag

SEQ ID NO: 1085780 - RNA, 22 nt, Human
uuucuuuugcccuguggguuag

SEQ ID NO: 1085781 - RNA, 22 nt, Human
uuccugugccucaggucucagc

SEQ ID NO: 1085782 - RNA, 22 nt, Human
ugaggcucaagaaucugcauuu

SEQ ID NO: 1085783 - RNA, 22 nt, Human
caaggaaucccauuucuaacuc

SEQ ID NO: 1085784 - RNA, 21 nt, Human
gagcugcaccuugaccuguuu

SEQ ID NO: 1085785 - RNA, 20 nt, Human
cagaaugcuguaaucaagaa

SEQ ID NO: 1085786 - RNA, 22 nt, Human
ucacacagcagccccggguguu

SEQ ID NO: 1085787 - RNA, 22 nt, Human
aggcugcuucagcugcagggag

SEQ ID NO: 1085788 - RNA, 22 nt, Human
ccuggcucugccguaaccacca

SEQ ID NO: 1085789 - RNA, 22 nt, Human
augaguaagugaaucuccaaag

SEQ ID NO: 1085790 - RNA, 22 nt, Human
uugguucauugcaggcgccggg

SEQ ID NO: 1085791 - RNA, 22 nt, Human
aucuucaucaaguucacagugg

SEQ ID NO: 1085792 - RNA, 22 nt, Human
ugacuggauugucauuacgacg

SEQ ID NO: 1085793 - RNA, 22 nt, Human
uaaaaucaccaaaagcaggugg

SEQ ID NO: 1085794 - RNA, 22 nt, Human
ccugucugaaggcagggggaug

SEQ ID NO: 1085795 - RNA, 22 nt, Human
aagcacauuaaggaacauugaa

SEQ ID NO: 1085796 - RNA, 22 nt, Human
ugaguagggguagaaaguuuag

SEQ ID NO: 1085797 - RNA, 22 nt, Human
caagaauaaccagacaauagca

SEQ ID NO: 1085798 - RNA, 22 nt, Human
gagacugcauuguccaaggguu

SEQ ID NO: 1085799 - RNA, 22 nt, Human
uuucauaaacaguagaagacua

SEQ ID NO: 1085800 - RNA, 22 nt, Human
aaguguuucuuggaauguugcg

SEQ ID NO: 1085801 - RNA, 22 nt, Human
accccagcucugagccacacca

SEQ ID NO: 1085802 - RNA, 22 nt, Human
cuggggugucucgucugccauu

SEQ ID NO: 1085803 - RNA, 22 nt, Human
ucagauggaaagguuacugucc

SEQ ID NO: 1085804 - RNA, 22 nt, Human
caggaaaugggucguuuuauaa

SEQ ID NO: 1085805 - RNA, 21 nt, Human
cagagcuguccaaacccugac

SEQ ID NO: 1085806 - RNA, 20 nt, Human
accaauguuagcuuaguacu

SEQ ID NO: 1085807 - RNA, 22 nt, Human
cucagaagccuucagucuuggc

SEQ ID NO: 1085808 - RNA, 22 nt, Human
agugucugccaacugcaugguc

SEQ ID NO: 1085809 - RNA, 22 nt, Human
ugcuuuauuaagagagaaauuu

SEQ ID NO: 1085810 - RNA, 22 nt, Human
aaagucugaaagauaagaguga

SEQ ID NO: 1085811 - RNA, 22 nt, Human
ucacugcugcugccaugaugga

SEQ ID NO: 1085812 - RNA, 22 nt, Human
aaucuucacagagaaaauuagg

SEQ ID NO: 1085813 - RNA, 22 nt, Human
gcugucagcgcccaaggagcuc

SEQ ID NO: 1085814 - RNA, 22 nt, Human
ucccagagaaagucaaggucuu

SEQ ID NO: 1085815 - RNA, 22 nt, Human
uggcucagcauucacuggucuu

SEQ ID NO: 1085816 - RNA, 22 nt, Human
ugcuccauucucuagccagugc

SEQ ID NO: 1085817 - RNA, 22 nt, Human
guaauaaugguccccaaacacu

SEQ ID NO: 1085818 - RNA, 17 nt, Human
gcaguuaaauuaagaug

SEQ ID NO: 1085819 - RNA, 22 nt, Human
guuuuauaggcuguugcuauau

SEQ ID NO: 1085820 - RNA, 22 nt, Human
cacagaagaaucaugcuguguu

SEQ ID NO: 1085821 - RNA, 22 nt, Human
gcugugaguggaguucugugcu

SEQ ID NO: 1085822 - RNA, 22 nt, Human
ucucaggaucuaauacauggua

SEQ ID NO: 1085823 - RNA, 22 nt, Human
ccucagggucugaggagaccgu

SEQ ID NO: 1085824 - RNA, 22 nt, Human
auuuugauaaucauguuagaga

SEQ ID NO: 1085825 - RNA, 22 nt, Human
uugaagcaugguacuuguucaa

SEQ ID NO: 1085826 - RNA, 22 nt, Human
uggcucugcugaaccuagugca

SEQ ID NO: 1085827 - RNA, 22 nt, Human
auguccuuccauuuugaucugu

SEQ ID NO: 1085828 - RNA, 22 nt, Human
cccaggaaguugaugcagagga

SEQ ID NO: 1085829 - RNA, 22 nt, Human
ucccugggccacagcugugagc

SEQ ID NO: 1085830 - RNA, 22 nt, Human
ggccugugucugugccuguccu

SEQ ID NO: 1085831 - RNA, 22 nt, Human
ggaaagagcuaaaagggugaga

SEQ ID NO: 1085832 - RNA, 20 nt, Human
auacaaagagauugauguau

SEQ ID NO: 1085833 - RNA, 22 nt, Human
ggcaggaagcauuaaaacgauu

SEQ ID NO: 1085834 - RNA, 22 nt, Human
gguggccuccagggcauaggug

SEQ ID NO: 1085835 - RNA, 22 nt, Human
auaaacacuucuagggcacaca

SEQ ID NO: 1085836 - RNA, 22 nt, Human
ucucaauauuauaugucauaaa

SEQ ID NO: 1085837 - RNA, 22 nt, Human
aaguuuauguucuuugaaggca

SEQ ID NO: 1085838 - RNA, 22 nt, Human
agcuccagccucuucuggaggu

SEQ ID NO: 1085839 - RNA, 22 nt, Human
ugaggaugacgauggcaauggc

SEQ ID NO: 1085840 - RNA, 22 nt, Human
acacagagggcagaagauacau

SEQ ID NO: 1085841 - RNA, 22 nt, Human
gaaauauuucucuugagccccu

SEQ ID NO: 1085842 - RNA, 22 nt, Human
aucauacauacaugguccucag

SEQ ID NO: 1085843 - RNA, 22 nt, Human
cacaauuuguauuuugcaucca

SEQ ID NO: 1085844 - RNA, 22 nt, Human
guguguccaggcgggagucaag

SEQ ID NO: 1085845 - RNA, 22 nt, Human
cagggagggacaauugucaccu

SEQ ID NO: 1085846 - RNA, 22 nt, Human
uuuaaauuauaguuaaugucug

SEQ ID NO: 1085847 - RNA, 22 nt, Human
uccagggacagcgcuggagcua

SEQ ID NO: 1085848 - RNA, 22 nt, Human
gaaaucaugagaucucuuggac

SEQ ID NO: 1085849 - RNA, 19 nt, Human
aucccaucugguuuuuccc

SEQ ID NO: 1085850 - RNA, 22 nt, Human
uuuaauguauucuuuggaacca

SEQ ID NO: 1085851 - RNA, 22 nt, Human
cacagugacuggcacauaguaa

SEQ ID NO: 1085852 - RNA, 22 nt, Human
ucaaauaaugccauucaucauc

SEQ ID NO: 1085853 - RNA, 22 nt, Human
ucacaggacccugaggguggcg

SEQ ID NO: 1085854 - RNA, 22 nt, Human
uugugcaagaagccagcaccaa

SEQ ID NO: 1085855 - RNA, 22 nt, Human
agaauacuaggcuucagaaagg

SEQ ID NO: 1085856 - RNA, 22 nt, Human
uacccucacgagacuucaaguc

SEQ ID NO: 1085857 - RNA, 22 nt, Human
gcccaugcucucaggcgggccu

SEQ ID NO: 1085858 - RNA, 22 nt, Human
uauucacagcugccgcacucag

SEQ ID NO: 1085859 - RNA, 22 nt, Human
uagaaaucagcaggcauaugua

SEQ ID NO: 1085860 - RNA, 22 nt, Human
auaugauuccacuauuguaugg

SEQ ID NO: 1085861 - RNA, 15 nt, Human
gcuucuccagaugac

SEQ ID NO: 1085862 - RNA, 22 nt, Human
uaacagaagaugaaacuucuuu

SEQ ID NO: 1085863 - RNA, 22 nt, Human
auucuuuuguccuagcuugaua

SEQ ID NO: 1085864 - RNA, 19 nt, Human
uuuacaaguucuuuguaug

SEQ ID NO: 1085865 - RNA, 21 nt, Human
cagcagaguaaugcauucgua

SEQ ID NO: 1085866 - RNA, 22 nt, Human
auacacauauguguguauaugu

SEQ ID NO: 1085867 - RNA, 23 nt, Human
uugcuuucaucaugagaugcucc

SEQ ID NO: 1085868 - RNA, 22 nt, Human
caacauauugugggaugagaga

SEQ ID NO: 1085869 - RNA, 22 nt, Human
cagcuggcgggcagagccgcca

SEQ ID NO: 1085870 - RNA, 22 nt, Human
gcagggcuccccaggcccgagg

SEQ ID NO: 1085871 - RNA, 22 nt, Human
agaggggaaggaugugauguga

SEQ ID NO: 1085872 - RNA, 16 nt, Human
ggugggguaguuagaa

SEQ ID NO: 1085873 - RNA, 22 nt, Human
agcaauauuucagcuagcaggu

SEQ ID NO: 1085874 - RNA, 18 nt, Human
ucugucuguacaaguauc

SEQ ID NO: 1085875 - RNA, 22 nt, Human
gccugugccucagccugcagcc

SEQ ID NO: 1085876 - RNA, 22 nt, Human
cuuacagagaagaaaauguagu

SEQ ID NO: 1085877 - RNA, 22 nt, Human
uaaaaccauaaggcuggaagga

SEQ ID NO: 1085878 - RNA, 23 nt, Human
uuguuuaccguaggacuuuuaac

SEQ ID NO: 1085879 - RNA, 22 nt, Human
ucuccugugcacccucccugug

SEQ ID NO: 1085880 - RNA, 17 nt, Human
ggcaggugcggggccgc

SEQ ID NO: 1085881 - RNA, 17 nt, Human
auacaguuuauuuuaca

SEQ ID NO: 1085882 - RNA, 22 nt, Human
ugcugcucaaugagaugccauc

SEQ ID NO: 1085883 - RNA, 22 nt, Human
gcagggcaggauuugaacccag

SEQ ID NO: 1085884 - RNA, 22 nt, Human
ucauugcauuuauucacuggca

SEQ ID NO: 1085885 - RNA, 22 nt, Human
ugaagccacuuuccagaaucac

SEQ ID NO: 1085886 - RNA, 22 nt, Human
uucaaaaguaaucaguauuaga

SEQ ID NO: 1085887 - RNA, 22 nt, Human
gccuaggagacaagcgugaaag

SEQ ID NO: 1085888 - RNA, 22 nt, Human
uggcagggccuaccccaauauc

SEQ ID NO: 1085889 - RNA, 22 nt, Human
auuagaaugcaggguucauugu

SEQ ID NO: 1085890 - RNA, 22 nt, Human
auggacagauuaacacaguaga

SEQ ID NO: 1085891 - RNA, 22 nt, Human
ugggcucauguuucuuugagga

SEQ ID NO: 1085892 - RNA, 22 nt, Human
gggaaggacauucugggcucag

SEQ ID NO: 1085893 - RNA, 22 nt, Human
augaaacucuaacuuaacaagu

SEQ ID NO: 1085894 - RNA, 22 nt, Human
aagacauugcugcuuuuaauug

SEQ ID NO: 1085895 - RNA, 22 nt, Human
aacacugauggaaaguauguuu

SEQ ID NO: 1085896 - RNA, 22 nt, Human
uuuacaaggcaguuauuuuccu

SEQ ID NO: 1085897 - RNA, 22 nt, Human
cagaaauucccauuucagauuc

SEQ ID NO: 1085898 - RNA, 22 nt, Human
uugaucaucuaagaguaauagu

SEQ ID NO: 1085899 - RNA, 22 nt, Human
acacagauauuguacuugaucc

SEQ ID NO: 1085900 - RNA, 22 nt, Human
gcucccaacucaggccuccucc

SEQ ID NO: 1085901 - RNA, 19 nt, Human
ugcagagagaggcaaagaa

SEQ ID NO: 1085902 - RNA, 22 nt, Human
uuucacauauaggggaagcuac

SEQ ID NO: 1085903 - RNA, 22 nt, Human
agccuggcacugaggcagggcg

SEQ ID NO: 1085904 - RNA, 22 nt, Human
auauaaguguguggcuguuagu

SEQ ID NO: 1085905 - RNA, 22 nt, Human
acacuacaaucucagaacuaua

SEQ ID NO: 1085906 - RNA, 22 nt, Human
aaugguaauggagagaacuacu

SEQ ID NO: 1085907 - RNA, 22 nt, Human
gcugcucuacccaugcaucugu

SEQ ID NO: 1085908 - RNA, 22 nt, Human
auguauaugugaaagauguuua

SEQ ID NO: 1085909 - RNA, 22 nt, Human
ggucucagcuggaguccuuggu

SEQ ID NO: 1085910 - RNA, 22 nt, Human
uacagugucugcaacugcacac

SEQ ID NO: 1085911 - RNA, 22 nt, Human
gcagcaggcacggucucgacau

SEQ ID NO: 1085912 - RNA, 21 nt, Human
caguagugcgucgcagaggac

SEQ ID NO: 1085913 - RNA, 22 nt, Human
uagggaggcuacuucuuguagg

SEQ ID NO: 1085914 - RNA, 22 nt, Human
aauaagaucuuaaagguuauau

SEQ ID NO: 1085915 - RNA, 20 nt, Human
ugcguguguauuuauuuucu

SEQ ID NO: 1085916 - RNA, 22 nt, Human
gagggcugcaaugagacagaga

SEQ ID NO: 1085917 - RNA, 22 nt, Human
uccagccaagccuugguagcug

SEQ ID NO: 1085918 - RNA, 23 nt, Human
agaaggugggccugcugaguuau

SEQ ID NO: 1085919 - RNA, 23 nt, Human
ugaaggccuggaggacgcguugu

SEQ ID NO: 1085920 - RNA, 22 nt, Human
uggggugguaauacaccguucu

SEQ ID NO: 1085921 - RNA, 22 nt, Human
ucucugagguuguuuccagcac

SEQ ID NO: 1085922 - RNA, 22 nt, Human
ccaggagcagauauggacauaa

SEQ ID NO: 1085923 - RNA, 22 nt, Human
uccaguggguugcugagggagg

SEQ ID NO: 1085924 - RNA, 22 nt, Human
gggacaauggaggccucucucc

SEQ ID NO: 1085925 - RNA, 22 nt, Human
aaugccucuuggaagaagacuu

SEQ ID NO: 1085926 - RNA, 22 nt, Human
auacuuugcuacauuguacauu

SEQ ID NO: 1085927 - RNA, 22 nt, Human
gucaaacagccuccuguucuaa

SEQ ID NO: 1085928 - RNA, 22 nt, Human
aaagcagccacagagagagcgu

SEQ ID NO: 1085929 - RNA, 22 nt, Human
gauuuccuaauguggaucucug

SEQ ID NO: 1085930 - RNA, 22 nt, Human
uuacacaugaagguccaauguu

SEQ ID NO: 1085931 - RNA, 22 nt, Human
agaguguaauaagggcaagggc

SEQ ID NO: 1085932 - RNA, 22 nt, Human
uagacacaucaaguauaguuaa

SEQ ID NO: 1085933 - RNA, 22 nt, Human
gcuuuauggauuguaaacugca

SEQ ID NO: 1085934 - RNA, 19 nt, Human
aaaccuguuaguagagcac

SEQ ID NO: 1085935 - RNA, 22 nt, Human
aguggcaggcagaagcuucuca

SEQ ID NO: 1085936 - RNA, 22 nt, Human
cuggcagcauggagccugugcu

SEQ ID NO: 1085937 - RNA, 22 nt, Human
aggcacaggccucagcacccag

SEQ ID NO: 1085938 - RNA, 22 nt, Human
uucaacauuuaucaguuuauca

SEQ ID NO: 1085939 - RNA, 22 nt, Human
aagacgggagucaggugagcuc

SEQ ID NO: 1085940 - RNA, 22 nt, Human
cacauugaaccauauauuagug

SEQ ID NO: 1085941 - RNA, 22 nt, Human
auccuugaaugacucugcccuc

SEQ ID NO: 1085942 - RNA, 22 nt, Human
ggauccuuaacuaucacaguga

SEQ ID NO: 1085943 - RNA, 22 nt, Human
uugaaaucaccacuagcauuug

SEQ ID NO: 1085944 - RNA, 22 nt, Human
ccagggcaugggaagaacugaa

SEQ ID NO: 1085945 - RNA, 22 nt, Human
ugggacugcucuugcugggguc

SEQ ID NO: 1085946 - RNA, 22 nt, Human
ucaaaugcaggucuggucuugg

SEQ ID NO: 1085947 - RNA, 22 nt, Human
cuaggaauccuuuuagaguugg

SEQ ID NO: 1085948 - RNA, 22 nt, Human
aaagcacucuauccuuuguaga

SEQ ID NO: 1085949 - RNA, 22 nt, Human
agggccagaguacaucagggcu

SEQ ID NO: 1085950 - RNA, 22 nt, Human
gagagguccauuccccugucag

SEQ ID NO: 1085951 - RNA, 22 nt, Human
gcuggggucugugaggagggcu

SEQ ID NO: 1085952 - RNA, 22 nt, Human
ucugaacauccagcaaugcaca

SEQ ID NO: 1085953 - RNA, 22 nt, Human
uggagcagcaucacuuugagcu

SEQ ID NO: 1085954 - RNA, 22 nt, Human
agaggcacccaguuaagcugca

SEQ ID NO: 1085955 - RNA, 22 nt, Human
ccagccucacuggcaucaccua

SEQ ID NO: 1085956 - RNA, 22 nt, Human
gaggugggaugugugugcuacu

SEQ ID NO: 1085957 - RNA, 18 nt, Human
aaacuggcuuggccugug

SEQ ID NO: 1085958 - RNA, 18 nt, Human
uggcuucugcuagcugga

SEQ ID NO: 1085959 - RNA, 22 nt, Human
acuucauguaguccaucagguu

SEQ ID NO: 1085960 - RNA, 22 nt, Human
uggcucaguggcagccgcagcu

SEQ ID NO: 1085961 - RNA, 17 nt, Human
gugcagggaugaaggau

SEQ ID NO: 1085962 - RNA, 22 nt, Human
ccucuggggguccucagagucu

SEQ ID NO: 1085963 - RNA, 20 nt, Human
auguaaaauuauaaggcuga

SEQ ID NO: 1085964 - RNA, 22 nt, Human
auguuuuacccuuugcacaaac

SEQ ID NO: 1085965 - RNA, 18 nt, Human
uccccugcucuggugcuc

SEQ ID NO: 1085966 - RNA, 22 nt, Human
ccacagaguuacaaaacaguca

SEQ ID NO: 1085967 - RNA, 22 nt, Human
ccucccucccugcagaagccac

SEQ ID NO: 1085968 - RNA, 22 nt, Human
aucagaaucauuucaucccuau

SEQ ID NO: 1085969 - RNA, 22 nt, Human
ugccaggcccucccacagauua

SEQ ID NO: 1085970 - RNA, 22 nt, Human
aguuuuauguucacagaaggau

SEQ ID NO: 1085971 - RNA, 22 nt, Human
gccaguggcccucuggagaagg

SEQ ID NO: 1085972 - RNA, 22 nt, Human
uuuuucuacugcccacauugua

SEQ ID NO: 1085973 - RNA, 22 nt, Human
acaaacuucccagacaagcucc

SEQ ID NO: 1085974 - RNA, 22 nt, Human
gaggaaaaugggacaggcugua

SEQ ID NO: 1085975 - RNA, 22 nt, Human
acucuucacacaugcugcccuc

SEQ ID NO: 1085976 - RNA, 22 nt, Human
gucaggauuaaugggaguaugc

SEQ ID NO: 1085977 - RNA, 22 nt, Human
cugggccuucauugcucuccca

SEQ ID NO: 1085978 - RNA, 22 nt, Human
gggaauuauagcugucacaggc

SEQ ID NO: 1085979 - RNA, 22 nt, Human
gccauuaaagugcauguuuugc

SEQ ID NO: 1085980 - RNA, 22 nt, Human
aguggggacaaugagagcaggu

SEQ ID NO: 1085981 - RNA, 22 nt, Human
uuuacagaugaggaaacugaga

SEQ ID NO: 1085982 - RNA, 22 nt, Human
agagaacacgugcaucugcaau

SEQ ID NO: 1085983 - RNA, 22 nt, Human
gggaggugaaaggucaugugug

SEQ ID NO: 1085984 - RNA, 22 nt, Human
aaaucagagugguuggucaucc

SEQ ID NO: 1085985 - RNA, 22 nt, Human
guuuuuccuugcugaggacccg

SEQ ID NO: 1085986 - RNA, 22 nt, Human
uucucagggucuggauggccug

SEQ ID NO: 1085987 - RNA, 22 nt, Human
caggcacuggggaugcugggau

SEQ ID NO: 1085988 - RNA, 22 nt, Human
ggggaagaaauagaacauuuug

SEQ ID NO: 1085989 - RNA, 22 nt, Human
gugcuguauaugcaagaggaag

SEQ ID NO: 1085990 - RNA, 22 nt, Human
augaggcaugugaggagaaggg

SEQ ID NO: 1085991 - RNA, 22 nt, Human
ugucccaacccugagaagauuc

SEQ ID NO: 1085992 - RNA, 23 nt, Human
gcuucugccauuugcuagcugug

SEQ ID NO: 1085993 - RNA, 22 nt, Human
aguuaauaauggaaagacacau

SEQ ID NO: 1085994 - RNA, 22 nt, Human
aaggcagccgugugacugcaug

SEQ ID NO: 1085995 - RNA, 20 nt, Human
gaagcagcuucauguagaca

SEQ ID NO: 1085996 - RNA, 22 nt, Human
cccaggucgucagcaguguggu

SEQ ID NO: 1085997 - RNA, 22 nt, Human
uccuugaacagagggccugggu

SEQ ID NO: 1085998 - RNA, 21 nt, Human
guauucuuuaugaagugaaaa

SEQ ID NO: 1085999 - RNA, 22 nt, Human
ucauccaguucacauggugagu

SEQ ID NO: 1086000 - RNA, 22 nt, Human
cagcagcuccucugcggcuaug

SEQ ID NO: 1086001 - RNA, 22 nt, Human
gaugaggggucauuggcuggga

SEQ ID NO: 1086002 - RNA, 23 nt, Human
aggcgagcucuucuccagcacgu

SEQ ID NO: 1086003 - RNA, 22 nt, Human
augaaaugucuggaucuuuuuc

SEQ ID NO: 1086004 - RNA, 22 nt, Human
uugucucucauuccugcaacuc

SEQ ID NO: 1086005 - RNA, 22 nt, Human
uccagggaugccagccauguug

SEQ ID NO: 1086006 - RNA, 22 nt, Human
gaaacugugaggaucuuaacuu

SEQ ID NO: 1086007 - RNA, 22 nt, Human
ucaaauaugugauagaagcuaa

SEQ ID NO: 1086008 - RNA, 22 nt, Human
aaacacugcgugguggcaacuc

SEQ ID NO: 1086009 - RNA, 22 nt, Human
accugagggcccaaacuuggua

SEQ ID NO: 1086010 - RNA, 22 nt, Human
gagaggagguggcuaugacagc

SEQ ID NO: 1086011 - RNA, 22 nt, Human
ggggcagagaauaaaaaccuaa

SEQ ID NO: 1086012 - RNA, 22 nt, Human
ugcagccaggaaauauuugcug

SEQ ID NO: 1086013 - RNA, 22 nt, Human
gacuuugagggauacaaacauu

SEQ ID NO: 1086014 - RNA, 19 nt, Human
ugccagcauuaggcugaag

SEQ ID NO: 1086015 - RNA, 22 nt, Human
ccuugcaggggaacaggcagug

SEQ ID NO: 1086016 - RNA, 22 nt, Human
uagcagcuuccagagagggcag

SEQ ID NO: 1086017 - RNA, 22 nt, Human
uaagaagcuucugcuaaugccu

SEQ ID NO: 1086018 - RNA, 22 nt, Human
ugagauuuguuuuauaaaauag

SEQ ID NO: 1086019 - RNA, 22 nt, Human
uauguagaugucauauaaauug

SEQ ID NO: 1086020 - RNA, 22 nt, Human
uauuguacugaggaauaaagcu

SEQ ID NO: 1086021 - RNA, 22 nt, Human
ugcccacauucaaaaggugaug

SEQ ID NO: 1086022 - RNA, 22 nt, Human
auuccugacuguuagaguuugc

SEQ ID NO: 1086023 - RNA, 22 nt, Human
ucaaauuuuaacaugcauuaga

SEQ ID NO: 1086024 - RNA, 21 nt, Human
uaauauagguucacaacuagu

SEQ ID NO: 1086025 - RNA, 20 nt, Human
agagaauucccuuuggagau

SEQ ID NO: 1086026 - RNA, 22 nt, Human
uggcugaggcuggagugcagug

SEQ ID NO: 1086027 - RNA, 22 nt, Human
auacauguuguaccauauguuu

SEQ ID NO: 1086028 - RNA, 22 nt, Human
cccugcugucaggugcugggag

SEQ ID NO: 1086029 - RNA, 22 nt, Human
agauggagaccuuggaugaacu

SEQ ID NO: 1086030 - RNA, 22 nt, Human
ugaggggauacgguacacauug

SEQ ID NO: 1086031 - RNA, 22 nt, Human
agcagggcagugaucagaaagg

SEQ ID NO: 1086032 - RNA, 22 nt, Human
gugccuggcacacagaaggcaa

SEQ ID NO: 1086033 - RNA, 22 nt, Human
ggcuguggccagcggggcugag

SEQ ID NO: 1086034 - RNA, 22 nt, Human
auaaucaaaguccuaugacauc

SEQ ID NO: 1086035 - RNA, 22 nt, Human
aggcucagcaucugauucauau

SEQ ID NO: 1086036 - RNA, 22 nt, Human
uauauauucuuaaguaguguag

SEQ ID NO: 1086037 - RNA, 20 nt, Human
ucagaaggcuccagagcaga

SEQ ID NO: 1086038 - RNA, 22 nt, Human
ccuaggaacccccaggcuucug

SEQ ID NO: 1086039 - RNA, 22 nt, Human
aacucagcauccugcacagaga

SEQ ID NO: 1086040 - RNA, 17 nt, Human
ucaaauguacagaacua

SEQ ID NO: 1086041 - RNA, 22 nt, Human
uuucucaucuggaaacagugcu

SEQ ID NO: 1086042 - RNA, 22 nt, Human
aggaagagcuggaccagaggac

SEQ ID NO: 1086043 - RNA, 22 nt, Human
cugcuuuguguggucccuccag

SEQ ID NO: 1086044 - RNA, 22 nt, Human
cuggcaggcggcagagcccagg

SEQ ID NO: 1086045 - RNA, 22 nt, Human
accagggcugacaaucugaugg

SEQ ID NO: 1086046 - RNA, 22 nt, Human
cucacauuccacuugugccaac

SEQ ID NO: 1086047 - RNA, 22 nt, Human
auuuucuucucucccuggcugc

SEQ ID NO: 1086048 - RNA, 22 nt, Human
ugcaaagaagcaacauccuugu

SEQ ID NO: 1086049 - RNA, 22 nt, Human
aguacaaaggcccuugauuacu

SEQ ID NO: 1086050 - RNA, 21 nt, Human
aggaaaggccagcacguaggg

SEQ ID NO: 1086051 - RNA, 22 nt, Human
auguuuuaugcuucagaugagg

SEQ ID NO: 1086052 - RNA, 22 nt, Human
uauauaauuuguaaaagcaccu

SEQ ID NO: 1086053 - RNA, 22 nt, Human
agugaucuuuuaaaaagaagug

SEQ ID NO: 1086054 - RNA, 22 nt, Human
ugucucugccagcuagcagaau

SEQ ID NO: 1086055 - RNA, 22 nt, Human
uagcuuuccuuguugccugugc

SEQ ID NO: 1086056 - RNA, 22 nt, Human
caguuaucaaauacuaugaagg

SEQ ID NO: 1086057 - RNA, 22 nt, Human
aggcugggaaauguagucuucc

SEQ ID NO: 1086058 - RNA, 22 nt, Human
cagccagggagcaaagaguuga

SEQ ID NO: 1086059 - RNA, 22 nt, Human
uuuuauauugagugagaguucc

SEQ ID NO: 1086060 - RNA, 22 nt, Human
cagcaacugugccugacacaca

SEQ ID NO: 1086061 - RNA, 22 nt, Human
gcccugucccuuggcuucuagg

SEQ ID NO: 1086062 - RNA, 22 nt, Human
ucaaaguccuugcuuuuucugu

SEQ ID NO: 1086063 - RNA, 22 nt, Human
agauuucccacuccauguauug

SEQ ID NO: 1086064 - RNA, 22 nt, Human
ucacugcaaggaggcuucucaa

SEQ ID NO: 1086065 - RNA, 22 nt, Human
aagagcuggaagugaagauaac

SEQ ID NO: 1086066 - RNA, 22 nt, Human
ggggcugagucagugggaagag

SEQ ID NO: 1086067 - RNA, 22 nt, Human
cugcagaggguuugagcauccu

SEQ ID NO: 1086068 - RNA, 22 nt, Human
uuuucuguauuauugugcuuca

SEQ ID NO: 1086069 - RNA, 22 nt, Human
uugaaauauggauugaccuuga

SEQ ID NO: 1086070 - RNA, 22 nt, Human
auuuccaguacccagaacagag

SEQ ID NO: 1086071 - RNA, 22 nt, Human
aauucacaggagguauuugucc

SEQ ID NO: 1086072 - RNA, 22 nt, Human
uacaaaggaaacuucuuuuccc

SEQ ID NO: 1086073 - RNA, 22 nt, Human
cacagcugaaguagccaugugg

SEQ ID NO: 1086074 - RNA, 22 nt, Human
uucaaguagaaaguauugauga

SEQ ID NO: 1086075 - RNA, 22 nt, Human
gggagcugaauggcaauggaga

SEQ ID NO: 1086076 - RNA, 22 nt, Human
agagucaacaucgagccacugg

SEQ ID NO: 1086077 - RNA, 22 nt, Human
uguuuauagggucugucacuug

SEQ ID NO: 1086078 - RNA, 22 nt, Human
acacauaagaaacuacaaagag

SEQ ID NO: 1086079 - RNA, 22 nt, Human
aguguuaauaucuggcccuagg

SEQ ID NO: 1086080 - RNA, 22 nt, Human
uuauuuugagagaaugugugcu

SEQ ID NO: 1086081 - RNA, 22 nt, Human
augugcaacuucagcagaaagg

SEQ ID NO: 1086082 - RNA, 22 nt, Human
caggguggcacucagcgcaucu

SEQ ID NO: 1086083 - RNA, 22 nt, Human
ugcagccaauucauucauucuu

SEQ ID NO: 1086084 - RNA, 22 nt, Human
guuuacaacaucuuguccuuca

SEQ ID NO: 1086085 - RNA, 22 nt, Human
cucuugggagugcucuggagaa

SEQ ID NO: 1086086 - RNA, 22 nt, Human
uuugcauucuagaaaaauuucu

SEQ ID NO: 1086087 - RNA, 22 nt, Human
ccccacaacucauguugaaacu

SEQ ID NO: 1086088 - RNA, 22 nt, Human
uggagcagcauucauccagcag

SEQ ID NO: 1086089 - RNA, 22 nt, Human
ucuucacaggagccugccugcc

SEQ ID NO: 1086090 - RNA, 20 nt, Human
uucuuaaagaccucacuuug

SEQ ID NO: 1086091 - RNA, 22 nt, Human
ucagcucuaaguuuuaugcaaa

SEQ ID NO: 1086092 - RNA, 22 nt, Human
caggcagggagcuggaaaggau

SEQ ID NO: 1086093 - RNA, 22 nt, Human
cuggcagguuuggugucuggug

SEQ ID NO: 1086094 - RNA, 22 nt, Human
agcugcuaugacaacaccagcc

SEQ ID NO: 1086095 - RNA, 22 nt, Human
uggcauuuaguugcguauugca

SEQ ID NO: 1086096 - RNA, 22 nt, Human
ggagccaguauuuaguggucuu

SEQ ID NO: 1086097 - RNA, 23 nt, Human
aggcagagccaaggucaaaaccc

SEQ ID NO: 1086098 - RNA, 22 nt, Human
gaagcugggucgcugggauccu

SEQ ID NO: 1086099 - RNA, 21 nt, Human
uggagcugccacuugagcugc

SEQ ID NO: 1086100 - RNA, 22 nt, Human
cuguaaacuaggucauuuuuaa

SEQ ID NO: 1086101 - RNA, 22 nt, Human
acaaaugucuccucuuuuguua

SEQ ID NO: 1086102 - RNA, 22 nt, Human
cuuguuaaaaugcagauuccaa

SEQ ID NO: 1086103 - RNA, 22 nt, Human
gugauuucaaauauagagugag

SEQ ID NO: 1086104 - RNA, 22 nt, Human
acaugcuuucuagguccuucug

SEQ ID NO: 1086105 - RNA, 22 nt, Human
acauuugacuacauuuauauau

SEQ ID NO: 1086106 - RNA, 22 nt, Human
aaguucuugaagacuuuaaaua

SEQ ID NO: 1086107 - RNA, 19 nt, Human
cccucuugcacaaagcaaa

SEQ ID NO: 1086108 - RNA, 22 nt, Human
gaugcuuuggccccaucaugag

SEQ ID NO: 1086109 - RNA, 22 nt, Human
gggagagguuacccgagcaacu

SEQ ID NO: 1086110 - RNA, 22 nt, Human
cuggcagcuggaggcuagaggc

SEQ ID NO: 1086111 - RNA, 22 nt, Human
aagucauuaucucuucuaaucu

SEQ ID NO: 1086112 - RNA, 22 nt, Human
acugcacagaagaaacuaucaa

SEQ ID NO: 1086113 - RNA, 22 nt, Human
ucacacacauggauaguauuuu

SEQ ID NO: 1086114 - RNA, 19 nt, Human
gccugggaugggcagaacu

SEQ ID NO: 1086115 - RNA, 22 nt, Human
ugaaauguguucuaguguuuug

SEQ ID NO: 1086116 - RNA, 22 nt, Human
aaggaagacucgcaggucuaug

SEQ ID NO: 1086117 - RNA, 21 nt, Human
ugacuuuauauugugucagga

SEQ ID NO: 1086118 - RNA, 22 nt, Human
ugacaugcuuguuuuccuugaa

SEQ ID NO: 1086119 - RNA, 22 nt, Human
gcgcaggugaugcgucugccuu

SEQ ID NO: 1086120 - RNA, 22 nt, Human
aacuagaacgagaaagcugaac

SEQ ID NO: 1086121 - RNA, 19 nt, Human
ucugucacuggggguauuc

SEQ ID NO: 1086122 - RNA, 22 nt, Human
cauucuuacacaauauuuuaau

SEQ ID NO: 1086123 - RNA, 22 nt, Human
uguuugugcugccuggugggca

SEQ ID NO: 1086124 - RNA, 22 nt, Human
ggcagguggaaguuggcagagc

SEQ ID NO: 1086125 - RNA, 22 nt, Human
ggccucucuccuuggcuugcag

SEQ ID NO: 1086126 - RNA, 22 nt, Human
uuuguauuccauaucaugccau

SEQ ID NO: 1086127 - RNA, 22 nt, Human
ucuuccaaaauuagucucaguu

SEQ ID NO: 1086128 - RNA, 22 nt, Human
aauuucaaugcacucaugguug

SEQ ID NO: 1086129 - RNA, 22 nt, Human
caucagagugguggccuggugu

SEQ ID NO: 1086130 - RNA, 22 nt, Human
gaaaauuucugccacaugugug

SEQ ID NO: 1086131 - RNA, 22 nt, Human
uccuucaagaugccacagcuuu

SEQ ID NO: 1086132 - RNA, 22 nt, Human
agaguggggacagggccugucc

SEQ ID NO: 1086133 - RNA, 22 nt, Human
gcuggcuuccuucugcagcuag

SEQ ID NO: 1086134 - RNA, 22 nt, Human
ccaggauggggagcagauagaa

SEQ ID NO: 1086135 - RNA, 23 nt, Human
gccuggccaccccagggcugcuu

SEQ ID NO: 1086136 - RNA, 22 nt, Human
gucaaauauaugcaaaacuauu

SEQ ID NO: 1086137 - RNA, 22 nt, Human
agagcugaaaaagcugacccgg

SEQ ID NO: 1086138 - RNA, 22 nt, Human
ucagggcaggcgagcagcugcu

SEQ ID NO: 1086139 - RNA, 22 nt, Human
accugugcaaagacuggucagg

SEQ ID NO: 1086140 - RNA, 17 nt, Human
ugcuucuguauugcugg

SEQ ID NO: 1086141 - RNA, 22 nt, Human
uuuccuacccuuccaggcagag

SEQ ID NO: 1086142 - RNA, 22 nt, Human
uuuggaaauuucaucaauagcc

SEQ ID NO: 1086143 - RNA, 22 nt, Human
gagaaauagauucaugguagau

SEQ ID NO: 1086144 - RNA, 23 nt, Human
cacauauagcagccacuaagguc

SEQ ID NO: 1086145 - RNA, 22 nt, Human
aacaaaugauaccaguucucaa

SEQ ID NO: 1086146 - RNA, 22 nt, Human
agacacagguguaauuucugcu

SEQ ID NO: 1086147 - RNA, 22 nt, Human
aaucaagucaaccaucaugugc

SEQ ID NO: 1086148 - RNA, 22 nt, Human
cugccugugucuauuccuuuuu

SEQ ID NO: 1086149 - RNA, 22 nt, Human
ccacacuaaacugcucaaacca

SEQ ID NO: 1086150 - RNA, 22 nt, Human
caggccugaguguggaagucuu

SEQ ID NO: 1086151 - RNA, 22 nt, Human
aggcuguccucucuugcucagu

SEQ ID NO: 1086152 - RNA, 22 nt, Human
aggcagagcuggguuuugaaau

SEQ ID NO: 1086153 - RNA, 23 nt, Human
caguggagacucaugcuuccuua

SEQ ID NO: 1086154 - RNA, 22 nt, Human
agaggucauaucucagaagaga

SEQ ID NO: 1086155 - RNA, 22 nt, Human
uuucugaagucuucuaacagau

SEQ ID NO: 1086156 - RNA, 22 nt, Human
aaggaggaauucugaguucaug

SEQ ID NO: 1086157 - RNA, 22 nt, Human
aauaucugucucuaaugcauau

SEQ ID NO: 1086158 - RNA, 22 nt, Human
cuggugccauucuguggccuag

SEQ ID NO: 1086159 - RNA, 23 nt, Human
cagugccauuugucuugccuaug

SEQ ID NO: 1086160 - RNA, 22 nt, Human
auaugcauaugucaaaacuuau

SEQ ID NO: 1086161 - RNA, 22 nt, Human
uugcaaauauuguuuaccuuuc

SEQ ID NO: 1086162 - RNA, 22 nt, Human
cagggaggaugggcuguuuugc

SEQ ID NO: 1086163 - RNA, 22 nt, Human
acacuaaucuuuuauuugguuu

SEQ ID NO: 1086164 - RNA, 22 nt, Human
caaagcucaugcucuuagccau

SEQ ID NO: 1086165 - RNA, 21 nt, Human
cuuggaguugguugaggaugc

SEQ ID NO: 1086166 - RNA, 22 nt, Human
cugggaggcaccgcgucgugcu

SEQ ID NO: 1086167 - RNA, 22 nt, Human
gcugucaccaaagcaggcacug

SEQ ID NO: 1086168 - RNA, 22 nt, Human
ccuggagcaaaaaucuaaggag

SEQ ID NO: 1086169 - RNA, 22 nt, Human
ugaggccugggcacauaaccuc

SEQ ID NO: 1086170 - RNA, 22 nt, Human
ggacaggguaaguacuagugug

SEQ ID NO: 1086171 - RNA, 22 nt, Human
gcccucucuucugcagccucca

SEQ ID NO: 1086172 - RNA, 22 nt, Human
gucaccauugcccacuccaugg

SEQ ID NO: 1086173 - RNA, 22 nt, Human
ggcugcugguggaaugguaggc

SEQ ID NO: 1086174 - RNA, 22 nt, Human
guggccaauuuccaucuguaag

SEQ ID NO: 1086175 - RNA, 22 nt, Human
gcaaagcagaacccucucuauc

SEQ ID NO: 1086176 - RNA, 22 nt, Human
caguggguaggaaaggcucuuc

SEQ ID NO: 1086177 - RNA, 20 nt, Human
acaauacagguugugucuga

SEQ ID NO: 1086178 - RNA, 22 nt, Human
accaaggagacaaagguguauu

SEQ ID NO: 1086179 - RNA, 22 nt, Human
ugguggcuucugaggauggcga

SEQ ID NO: 1086180 - RNA, 20 nt, Human
aauuuacucacagaaugaau

SEQ ID NO: 1086181 - RNA, 22 nt, Human
uuucacaaguuucaggauucug

SEQ ID NO: 1086182 - RNA, 22 nt, Human
augaaacucuagcuuucagcac

SEQ ID NO: 1086183 - RNA, 20 nt, Human
ugccagggccagcagaggcu

SEQ ID NO: 1086184 - RNA, 18 nt, Human
agcaaauauuaagugcau

SEQ ID NO: 1086185 - RNA, 22 nt, Human
ucugagcuacgaugccugucac

SEQ ID NO: 1086186 - RNA, 22 nt, Human
uguggcuuaagaaugccuuuaa

SEQ ID NO: 1086187 - RNA, 22 nt, Human
caguaugagaguugaaucaagg

SEQ ID NO: 1086188 - RNA, 22 nt, Human
ucagacagauuuugacacuugc

SEQ ID NO: 1086189 - RNA, 22 nt, Human
ugacagaaugugacucucagau

SEQ ID NO: 1086190 - RNA, 22 nt, Human
caauguuuucaacugacaagua

SEQ ID NO: 1086191 - RNA, 22 nt, Human
uggcuccuaucaaggagugggu

SEQ ID NO: 1086192 - RNA, 22 nt, Human
agagcccuggagggcagucccg

SEQ ID NO: 1086193 - RNA, 22 nt, Human
gugaggcuacucagcuguccga

SEQ ID NO: 1086194 - RNA, 19 nt, Human
aggcuuggcuagauuuacu

SEQ ID NO: 1086195 - RNA, 22 nt, Human
gccaugccugugucuccaggcc

SEQ ID NO: 1086196 - RNA, 22 nt, Human
aggcaaggugcuacagacagug

SEQ ID NO: 1086197 - RNA, 22 nt, Human
uucaaaaagguauguucaaguc

SEQ ID NO: 1086198 - RNA, 22 nt, Human
ucugccuuccccauaaucugau

SEQ ID NO: 1086199 - RNA, 22 nt, Human
uccuucaacuuuuuacuugccc

SEQ ID NO: 1086200 - RNA, 22 nt, Human
cugcccugucugcagccuggcu

SEQ ID NO: 1086201 - RNA, 22 nt, Human
agggcuggcaagggauugaaau

SEQ ID NO: 1086202 - RNA, 22 nt, Human
uuucuuccuaaauaugauuucc

SEQ ID NO: 1086203 - RNA, 22 nt, Human
gaaacccaaacuaagacaguag

SEQ ID NO: 1086204 - RNA, 22 nt, Human
aauacaaucaaauucacuagca

SEQ ID NO: 1086205 - RNA, 22 nt, Human
acuguucacccagcacuagcag

SEQ ID NO: 1086206 - RNA, 22 nt, Human
ucuugauuuugugaauaaguug

SEQ ID NO: 1086207 - RNA, 22 nt, Human
aagggcuccaagagguagcugg

SEQ ID NO: 1086208 - RNA, 22 nt, Human
gaaagcagcuaagucuuaugau

SEQ ID NO: 1086209 - RNA, 21 nt, Human
uucaagucucuaggacuucuc

SEQ ID NO: 1086210 - RNA, 22 nt, Human
ugcaggugcugauaccuacucc

SEQ ID NO: 1086211 - RNA, 21 nt, Human
ccagacuggccuaugugguag

SEQ ID NO: 1086212 - RNA, 22 nt, Human
uuucaguggguuuauuucaugu

SEQ ID NO: 1086213 - RNA, 22 nt, Human
agugggagagaagcaaguagua

SEQ ID NO: 1086214 - RNA, 22 nt, Human
cccuggaggcaaagguugcagu

SEQ ID NO: 1086215 - RNA, 22 nt, Human
gccaggcacaguucuaggugcu

SEQ ID NO: 1086216 - RNA, 22 nt, Human
accagagcagacuacuggaggu

SEQ ID NO: 1086217 - RNA, 22 nt, Human
cagagcucagagcagggcacuc

SEQ ID NO: 1086218 - RNA, 22 nt, Human
aaaggcaguggguauguggauc

SEQ ID NO: 1086219 - RNA, 22 nt, Human
uguacauuuagagcucaauaga

SEQ ID NO: 1086220 - RNA, 22 nt, Human
acuguguccucauguggcagaa

SEQ ID NO: 1086221 - RNA, 22 nt, Human
gucaggauguuuauucuccagu

SEQ ID NO: 1086222 - RNA, 22 nt, Human
cuggagugcaguggcaugauca

SEQ ID NO: 1086223 - RNA, 22 nt, Human
caugacaauauguucuuucauu

SEQ ID NO: 1086224 - RNA, 22 nt, Human
ucucaaauuuguuagauaaaau

SEQ ID NO: 1086225 - RNA, 22 nt, Human
auucugaggacagagucuagca

SEQ ID NO: 1086226 - RNA, 23 nt, Human
ugaaauauucuuuugcaugagcu

SEQ ID NO: 1086227 - RNA, 22 nt, Human
uuuccaauaaagugucauuguu

SEQ ID NO: 1086228 - RNA, 22 nt, Human
cucaggaucgcuugcccuaggg

SEQ ID NO: 1086229 - RNA, 22 nt, Human
acccugccucugcuuccuguag

SEQ ID NO: 1086230 - RNA, 22 nt, Human
uuacuuugaugaucaaugagcg

SEQ ID NO: 1086231 - RNA, 22 nt, Human
acaaaugcagcauaaagugaac

SEQ ID NO: 1086232 - RNA, 22 nt, Human
uggcagaaguacacaagcaugc

SEQ ID NO: 1086233 - RNA, 22 nt, Human
cuggugcuuugcucauuugaua

SEQ ID NO: 1086234 - RNA, 22 nt, Human
uuuaacuugaucaguagagcau

SEQ ID NO: 1086235 - RNA, 22 nt, Human
agaaaaacuaagaguggguggu

SEQ ID NO: 1086236 - RNA, 17 nt, Human
ggaaaaggaugauacag

SEQ ID NO: 1086237 - RNA, 22 nt, Human
ccgcagggaaagccccaggaag

SEQ ID NO: 1086238 - RNA, 22 nt, Human
gccacugcacuccagcccaggc

SEQ ID NO: 1086239 - RNA, 22 nt, Human
agcagguguagggcucuuugua

SEQ ID NO: 1086240 - RNA, 22 nt, Human
ugggcucucaaagugcggcuug

SEQ ID NO: 1086241 - RNA, 22 nt, Human
gcugagcuagcuaucucagucu

SEQ ID NO: 1086242 - RNA, 21 nt, Human
uaugguaaccagacaagaaug

SEQ ID NO: 1086243 - RNA, 22 nt, Human
gucagcuaauaggguguguguc

SEQ ID NO: 1086244 - RNA, 22 nt, Human
gaaaucugcccagugcacuggu

SEQ ID NO: 1086245 - RNA, 22 nt, Human
auuuaaauuuucugauggagag

SEQ ID NO: 1086246 - RNA, 22 nt, Human
gaguccaguguuuaccaggggu

SEQ ID NO: 1086247 - RNA, 20 nt, Human
uggcccuguuuucuccaggc

SEQ ID NO: 1086248 - RNA, 22 nt, Human
aaagguuuauugauucugcucu

SEQ ID NO: 1086249 - RNA, 22 nt, Human
cuuucuucaagcuggucucaau

SEQ ID NO: 1086250 - RNA, 22 nt, Human
agcaggagcugugggaagaugg

SEQ ID NO: 1086251 - RNA, 22 nt, Human
gacagaggagaagaugcugugg

SEQ ID NO: 1086252 - RNA, 22 nt, Human
uuggaaaaauugccugaugucu

SEQ ID NO: 1086253 - RNA, 22 nt, Human
aaguacuuuaggauauguaacu

SEQ ID NO: 1086254 - RNA, 18 nt, Human
uucaccagugugaugggu

SEQ ID NO: 1086255 - RNA, 22 nt, Human
cucauggauauaagaacuguuu

SEQ ID NO: 1086256 - RNA, 22 nt, Human
uagcuggggcuuucauucuugc

SEQ ID NO: 1086257 - RNA, 22 nt, Human
uuccugggugguccugguagag

SEQ ID NO: 1086258 - RNA, 22 nt, Human
uaagaaacccaggaauuucuua

SEQ ID NO: 1086259 - RNA, 22 nt, Human
acaguuacauuccagcaacauc

SEQ ID NO: 1086260 - RNA, 22 nt, Human
cagcagagcuuauuaacuaaaa

SEQ ID NO: 1086261 - RNA, 22 nt, Human
cugauuucaugcuaucaauguu

SEQ ID NO: 1086262 - RNA, 22 nt, Human
ucugccugcuaacuccugcacc

SEQ ID NO: 1086263 - RNA, 22 nt, Human
cagcagugugcaggugugcugg

SEQ ID NO: 1086264 - RNA, 22 nt, Human
uuuacaaguacaccuaacagcu

SEQ ID NO: 1086265 - RNA, 22 nt, Human
guggggcugaguggagccagaa

SEQ ID NO: 1086266 - RNA, 21 nt, Human
acaguucaugauaacuccauc

SEQ ID NO: 1086267 - RNA, 22 nt, Human
cuuucaaagaguaggagguuuu

SEQ ID NO: 1086268 - RNA, 19 nt, Human
gguagaagggaaguguuuu

SEQ ID NO: 1086269 - RNA, 22 nt, Human
aggcuggagggcaauggcaaga

SEQ ID NO: 1086270 - RNA, 22 nt, Human
uauuuccaccuauuauuuucug

SEQ ID NO: 1086271 - RNA, 19 nt, Human
caagugaagccugggaugg

SEQ ID NO: 1086272 - RNA, 22 nt, Human
agucuauuucagucuuacuagu

SEQ ID NO: 1086273 - RNA, 22 nt, Human
gcagcugcaggcaggcuugcug

SEQ ID NO: 1086274 - RNA, 22 nt, Human
cacagacuugagaagcaccuua

SEQ ID NO: 1086275 - RNA, 19 nt, Human
agcagcguuuaaaaaaugc

SEQ ID NO: 1086276 - RNA, 20 nt, Human
aacauugcuucaauguaacc

SEQ ID NO: 1086277 - RNA, 22 nt, Human
agaggaacccagacagggcuuu

SEQ ID NO: 1086278 - RNA, 22 nt, Human
cacugcaggucugagauggggg

SEQ ID NO: 1086279 - RNA, 22 nt, Human
uuaacagacauauauauuugua

SEQ ID NO: 1086280 - RNA, 22 nt, Human
aauguacaccguggguuuuuua

SEQ ID NO: 1086281 - RNA, 22 nt, Human
ccuggcaggcuggggacagugc

SEQ ID NO: 1086282 - RNA, 22 nt, Human
ugcuggccaacaaggcuccaag

SEQ ID NO: 1086283 - RNA, 22 nt, Human
aauuucaaguggcaucuuugau

SEQ ID NO: 1086284 - RNA, 22 nt, Human
aucacauuguuagcauagacug

SEQ ID NO: 1086285 - RNA, 22 nt, Human
caguggccaugguggcaggggu

SEQ ID NO: 1086286 - RNA, 22 nt, Human
gugaaauuguauuuggcauuga

SEQ ID NO: 1086287 - RNA, 22 nt, Human
ccugggcugcucauggggauga

SEQ ID NO: 1086288 - RNA, 22 nt, Human
aauaggaaaauauuuaacaaga

SEQ ID NO: 1086289 - RNA, 22 nt, Human
agaagcugccuacaugaccagc

SEQ ID NO: 1086290 - RNA, 22 nt, Human
ggcugccugaggcagugagaga

SEQ ID NO: 1086291 - RNA, 22 nt, Human
caacuacaggaaaagucauuca

SEQ ID NO: 1086292 - RNA, 22 nt, Human
caugggcuugcucucugagcuc

SEQ ID NO: 1086293 - RNA, 22 nt, Human
gugcuuccugccuggugccuuu

SEQ ID NO: 1086294 - RNA, 20 nt, Human
guggccucucacauucugag

SEQ ID NO: 1086295 - RNA, 22 nt, Human
ugaaacauuaggaaaucauuau

SEQ ID NO: 1086296 - RNA, 22 nt, Human
cccaggaggcagagguugcagu

SEQ ID NO: 1086297 - RNA, 22 nt, Human
uccauuauacuucugauucaaa

SEQ ID NO: 1086298 - RNA, 22 nt, Human
ucugcuggugaugaccucauaa

SEQ ID NO: 1086299 - RNA, 22 nt, Human
aauucaaagacuagaauuuugc

SEQ ID NO: 1086300 - RNA, 21 nt, Human
cagaaauaugaaugaugguga

SEQ ID NO: 1086301 - RNA, 22 nt, Human
ggcaguggguggaucucaggga

SEQ ID NO: 1086302 - RNA, 22 nt, Human
guggagacgggacagaagcuaa

SEQ ID NO: 1086303 - RNA, 22 nt, Human
gcaaggcagcgcggaguagcua

SEQ ID NO: 1086304 - RNA, 22 nt, Human
gagguggcuuagucucuggaca

SEQ ID NO: 1086305 - RNA, 21 nt, Human
uccaauuuuuaagacuauggc

SEQ ID NO: 1086306 - RNA, 19 nt, Human
ugcuucuggaaccaugauc

SEQ ID NO: 1086307 - RNA, 22 nt, Human
caggcacaagaagcaaauguua

SEQ ID NO: 1086308 - RNA, 23 nt, Human
auugaugacuugauuacacuuuu

SEQ ID NO: 1086309 - RNA, 22 nt, Human
guccucugaaguugugcaaugc

SEQ ID NO: 1086310 - RNA, 22 nt, Human
ugcauguuaagaaaauauugag

SEQ ID NO: 1086311 - RNA, 22 nt, Human
acugaaggaaagccuuugcaug

SEQ ID NO: 1086312 - RNA, 22 nt, Human
ucacauuucugauuauaccaaa

SEQ ID NO: 1086313 - RNA, 22 nt, Human
uggcacagacagaucaggaguc

SEQ ID NO: 1086314 - RNA, 22 nt, Human
ccugggcucgcgcacuucaccc

SEQ ID NO: 1086315 - RNA, 22 nt, Human
ucaaaucuuuaacaugugcaaa

SEQ ID NO: 1086316 - RNA, 22 nt, Human
guuguacaaaauaucagugagg

SEQ ID NO: 1086317 - RNA, 22 nt, Human
cuuauucauaagucagacacac

SEQ ID NO: 1086318 - RNA, 22 nt, Human
ugcagggaaaguguuggcagca

SEQ ID NO: 1086319 - RNA, 22 nt, Human
aggucccagucugugaugacuc

SEQ ID NO: 1086320 - RNA, 19 nt, Human
ucccagagucuagagguug

SEQ ID NO: 1086321 - RNA, 19 nt, Human
uucuaugauuaacaugaga

SEQ ID NO: 1086322 - RNA, 22 nt, Human
auauauacuuugacacauucug

SEQ ID NO: 1086323 - RNA, 22 nt, Human
uuacaaguacugaauaugauuu

SEQ ID NO: 1086324 - RNA, 22 nt, Human
cugucaacacgggugugcgugc

SEQ ID NO: 1086325 - RNA, 21 nt, Human
uacugagaccucacagugugc

SEQ ID NO: 1086326 - RNA, 22 nt, Human
gcucugaggcugggagcacucu

SEQ ID NO: 1086327 - RNA, 22 nt, Human
acuuucaagcccucuagagaca

SEQ ID NO: 1086328 - RNA, 22 nt, Human
ugcaccauuuugucaggcuacu

SEQ ID NO: 1086329 - RNA, 22 nt, Human
cauucacaucuuguuccaucac

SEQ ID NO: 1086330 - RNA, 22 nt, Human
aaaaguugcaaaauugcucuuc

SEQ ID NO: 1086331 - RNA, 22 nt, Human
cacauuuaucucucuccgguga

SEQ ID NO: 1086332 - RNA, 22 nt, Human
accaguuuguaaccuguuuuca

SEQ ID NO: 1086333 - RNA, 18 nt, Human
cagucccaaaccuuagga

SEQ ID NO: 1086334 - RNA, 20 nt, Human
gcugcugagcuucccugggg

SEQ ID NO: 1086335 - RNA, 22 nt, Human
cagcugggagcuccauuagaua

SEQ ID NO: 1086336 - RNA, 22 nt, Human
uauauuaacacccacuugccuc

SEQ ID NO: 1086337 - RNA, 22 nt, Human
acacaguaugaaaagucuaguu

SEQ ID NO: 1086338 - RNA, 22 nt, Human
cugaggccucucuccugggcuu

SEQ ID NO: 1086339 - RNA, 22 nt, Human
caggguacagaguuuucuaaac

SEQ ID NO: 1086340 - RNA, 22 nt, Human
ccagaagacaagaauguucuua

SEQ ID NO: 1086341 - RNA, 22 nt, Human
acccugccgugggcugcuugug

SEQ ID NO: 1086342 - RNA, 22 nt, Human
ucacaguaguuguucucuguuu

SEQ ID NO: 1086343 - RNA, 22 nt, Human
ggccaggccaagaggguuggaa

SEQ ID NO: 1086344 - RNA, 22 nt, Human
cccucagucuggcugggaagac

SEQ ID NO: 1086345 - RNA, 22 nt, Human
ccugggcauaaaucacuccaag

SEQ ID NO: 1086346 - RNA, 22 nt, Human
gugaggacuaguggguuugugc

SEQ ID NO: 1086347 - RNA, 21 nt, Human
accagcaggagaucagaagga

SEQ ID NO: 1086348 - RNA, 16 nt, Human
gcagaggaaaggggag

SEQ ID NO: 1086349 - RNA, 22 nt, Human
gggggaagaaagaacauggcau

SEQ ID NO: 1086350 - RNA, 22 nt, Human
aaauuguaggaucacaugaccu

SEQ ID NO: 1086351 - RNA, 22 nt, Human
gggcacugcuggaggcucccug

SEQ ID NO: 1086352 - RNA, 22 nt, Human
caguaaaugugauuuuucuugu

SEQ ID NO: 1086353 - RNA, 22 nt, Human
ugaaacagucuccagacuugga

SEQ ID NO: 1086354 - RNA, 22 nt, Human
caucaaauaaagaaauuccuug

SEQ ID NO: 1086355 - RNA, 22 nt, Human
gugcauuugacgaauacucacu

SEQ ID NO: 1086356 - RNA, 22 nt, Human
ccaggaggaaauucuaaaggua

SEQ ID NO: 1086357 - RNA, 22 nt, Human
ggccuggcucuugcccagccug

SEQ ID NO: 1086358 - RNA, 22 nt, Human
gcaaugauauugaagugaugaa

SEQ ID NO: 1086359 - RNA, 22 nt, Human
auuaaaagagauaauguguguu

SEQ ID NO: 1086360 - RNA, 22 nt, Human
cucauuccauguguauuuugag

SEQ ID NO: 1086361 - RNA, 22 nt, Human
cuuaaaagagaugacggcaggg

SEQ ID NO: 1086362 - RNA, 22 nt, Human
augaaugcugggacaaauauau

SEQ ID NO: 1086363 - RNA, 22 nt, Human
agccucugugacucacagguca

SEQ ID NO: 1086364 - RNA, 22 nt, Human
caggguagacaguaggugucug

SEQ ID NO: 1086365 - RNA, 17 nt, Human
uagcuguguuucagcua

SEQ ID NO: 1086366 - RNA, 22 nt, Human
aacagcuuugcuucuggagaca

SEQ ID NO: 1086367 - RNA, 22 nt, Human
ucauuuaugucuuugccaucca

SEQ ID NO: 1086368 - RNA, 22 nt, Human
uacacauuucucuuagagacac

SEQ ID NO: 1086369 - RNA, 22 nt, Human
aggagggagcuuaagccaggca

SEQ ID NO: 1086370 - RNA, 20 nt, Human
cagaccugcacccacuucga

SEQ ID NO: 1086371 - RNA, 22 nt, Human
gcagcugggccccagccucucc

SEQ ID NO: 1086372 - RNA, 22 nt, Human
agcagccuuugaucaucuggga

SEQ ID NO: 1086373 - RNA, 22 nt, Human
aaagauuauggcauugaaauac

SEQ ID NO: 1086374 - RNA, 22 nt, Human
aagcugaugucccaguuugaag

SEQ ID NO: 1086375 - RNA, 22 nt, Human
uacacagaagccagaaggccug

SEQ ID NO: 1086376 - RNA, 23 nt, Human
cuccaaauacucccaauuguuuu

SEQ ID NO: 1086377 - RNA, 22 nt, Human
ugaguagagaauucagcuaagg

SEQ ID NO: 1086378 - RNA, 15 nt, Human
agcccccucagagga

SEQ ID NO: 1086379 - RNA, 22 nt, Human
gccaaucuuugacuauaugugu

SEQ ID NO: 1086380 - RNA, 22 nt, Human
ccucccugucuaccuguugugg

SEQ ID NO: 1086381 - RNA, 23 nt, Human
ugaagguauuaccugagaugcuc

SEQ ID NO: 1086382 - RNA, 22 nt, Human
gcccugugccagucacgcugug

SEQ ID NO: 1086383 - RNA, 22 nt, Human
auucacagggacaaugggagag

SEQ ID NO: 1086384 - RNA, 22 nt, Human
gggagggaaagcuugaucuguc

SEQ ID NO: 1086385 - RNA, 22 nt, Human
uucaggauccccuugaugggcu

SEQ ID NO: 1086386 - RNA, 22 nt, Human
acuucuuuucaaaucaugcaaa

SEQ ID NO: 1086387 - RNA, 22 nt, Human
gccuggugguauccuggcaaga

SEQ ID NO: 1086388 - RNA, 22 nt, Human
uucuuuuccuguggcucaucca

SEQ ID NO: 1086389 - RNA, 22 nt, Human
gggcagcagagcccugccgagu

SEQ ID NO: 1086390 - RNA, 16 nt, Human
aggcagagauuuaccc

SEQ ID NO: 1086391 - RNA, 22 nt, Human
ucugcccuggggucagccucca

SEQ ID NO: 1086392 - RNA, 22 nt, Human
uaaacgugcuucauauuuuuag

SEQ ID NO: 1086393 - RNA, 22 nt, Human
uuugcaguuucauugcugaaau

SEQ ID NO: 1086394 - RNA, 22 nt, Human
uaaagcaaugaaaguuuugcag

SEQ ID NO: 1086395 - RNA, 22 nt, Human
ucuggcaggcaaucggcucugg

SEQ ID NO: 1086396 - RNA, 22 nt, Human
ggcuucccagcagagggcgcac

SEQ ID NO: 1086397 - RNA, 22 nt, Human
uccuggugucgccuggucaguu

SEQ ID NO: 1086398 - RNA, 22 nt, Human
cuucagaaugggacuguguuug

SEQ ID NO: 1086399 - RNA, 22 nt, Human
gggagguucuguucgcacuuga

SEQ ID NO: 1086400 - RNA, 22 nt, Human
uggaguucucaggugagggcuu

SEQ ID NO: 1086401 - RNA, 22 nt, Human
ugggccuuguccccucagcugu

SEQ ID NO: 1086402 - RNA, 22 nt, Human
ugcucugguccucccucggcgc

SEQ ID NO: 1086403 - RNA, 22 nt, Human
agggcugacaguggcguggcgu

SEQ ID NO: 1086404 - RNA, 22 nt, Human
aagcaaaagguuacacuucugg

SEQ ID NO: 1086405 - RNA, 22 nt, Human
ugaaaugacaaagguuuuucuu

SEQ ID NO: 1086406 - RNA, 22 nt, Human
gugggccaggacccgcuguccg

SEQ ID NO: 1086407 - RNA, 22 nt, Human
cccagcuccagagccagaaaca

SEQ ID NO: 1086408 - RNA, 22 nt, Human
acauaauaaaaauaacagcuca

SEQ ID NO: 1086409 - RNA, 22 nt, Human
cuguucuuaucgucuuaauauc

SEQ ID NO: 1086410 - RNA, 22 nt, Human
cucagcuagggaagguuagcuu

SEQ ID NO: 1086411 - RNA, 20 nt, Human
augcaaacucacaaaauacc

SEQ ID NO: 1086412 - RNA, 21 nt, Human
uguuuaauacauauuugugga

SEQ ID NO: 1086413 - RNA, 22 nt, Human
ucagagaguuacacaaauuguu

SEQ ID NO: 1086414 - RNA, 22 nt, Human
ucugucaacaugucaaagggcu

SEQ ID NO: 1086415 - RNA, 22 nt, Human
uagauacauacauuuuaaaaug

SEQ ID NO: 1086416 - RNA, 22 nt, Human
cuuuucaaacgcugaugucagu

SEQ ID NO: 1086417 - RNA, 22 nt, Human
auucacagggcuuuccgcaugg

SEQ ID NO: 1086418 - RNA, 22 nt, Human
guuuguaauuacugcagcaugg

SEQ ID NO: 1086419 - RNA, 22 nt, Human
cugaagagcucuccuguccccu

SEQ ID NO: 1086420 - RNA, 22 nt, Human
cacugaaggcugcagcucagcc

SEQ ID NO: 1086421 - RNA, 22 nt, Human
cagaauuugaaguaauauucca

SEQ ID NO: 1086422 - RNA, 22 nt, Human
uuaaagcaaguagaagccugag

SEQ ID NO: 1086423 - RNA, 22 nt, Human
uacugcuuguuagcuguauuug

SEQ ID NO: 1086424 - RNA, 22 nt, Human
gagugugucggucagcguggcg

SEQ ID NO: 1086425 - RNA, 22 nt, Human
guacuuccagccaagugagaca

SEQ ID NO: 1086426 - RNA, 22 nt, Human
acagcucugcauggcaguuauu

SEQ ID NO: 1086427 - RNA, 22 nt, Human
uggaaagaaaaacaggccauga

SEQ ID NO: 1086428 - RNA, 22 nt, Human
ccaaggcacacucugcaagguu

SEQ ID NO: 1086429 - RNA, 22 nt, Human
uaccaaauguaaucauucuaau

SEQ ID NO: 1086430 - RNA, 22 nt, Human
uuccaacaauguguuauuguuc

SEQ ID NO: 1086431 - RNA, 22 nt, Human
gaggcuggaauauuagaaaugu

SEQ ID NO: 1086432 - RNA, 22 nt, Human
cacaguacgcacccgauacaug

SEQ ID NO: 1086433 - RNA, 22 nt, Human
ugccuggguccaggccaagccu

SEQ ID NO: 1086434 - RNA, 20 nt, Human
uucauuuguugagcaccuuc

SEQ ID NO: 1086435 - RNA, 21 nt, Human
agccuguugguuuacugcuca

SEQ ID NO: 1086436 - RNA, 22 nt, Human
guuugugucaaugacuucugca

SEQ ID NO: 1086437 - RNA, 22 nt, Human
aguggcaguagaugagcugguu

SEQ ID NO: 1086438 - RNA, 22 nt, Human
ggcagcaguggcugcuauuguc

SEQ ID NO: 1086439 - RNA, 22 nt, Human
gaguucaguaguuauagucuag

SEQ ID NO: 1086440 - RNA, 22 nt, Human
uccugcagagacagaggccuca

SEQ ID NO: 1086441 - RNA, 22 nt, Human
agucacuucuauucuauuaagu

SEQ ID NO: 1086442 - RNA, 22 nt, Human
ccugccucaucaacuugucgug

SEQ ID NO: 1086443 - RNA, 23 nt, Human
acacaaggguaacugccagccau

SEQ ID NO: 1086444 - RNA, 22 nt, Human
auaugguaagaguauauuuacu

SEQ ID NO: 1086445 - RNA, 22 nt, Human
caaagucuuggugaucaacuuu

SEQ ID NO: 1086446 - RNA, 22 nt, Human
aaagcaugguuaaagacagugg

SEQ ID NO: 1086447 - RNA, 22 nt, Human
ugcaaaugaugaaacuaacuuu

SEQ ID NO: 1086448 - RNA, 22 nt, Human
caggcugagcucuggccugggc

SEQ ID NO: 1086449 - RNA, 20 nt, Human
gccucagccaacccaugggg

SEQ ID NO: 1086450 - RNA, 22 nt, Human
agagcccucugcaaugccucag

SEQ ID NO: 1086451 - RNA, 22 nt, Human
cucugagcccgcugcagcccca

SEQ ID NO: 1086452 - RNA, 22 nt, Human
gagagugaugaaugguuaaaca

SEQ ID NO: 1086453 - RNA, 22 nt, Human
uugauuacuauguguugaaagc

SEQ ID NO: 1086454 - RNA, 22 nt, Human
uccaagcuuuccaugcccucac

SEQ ID NO: 1086455 - RNA, 22 nt, Human
acugggcuguaaagagaggcaa

SEQ ID NO: 1086456 - RNA, 22 nt, Human
gcagggacaucuuugucuagua

SEQ ID NO: 1086457 - RNA, 22 nt, Human
aaacuacacuuugggaccagca

SEQ ID NO: 1086458 - RNA, 22 nt, Human
agcugcaggcccaugcucaguc

SEQ ID NO: 1086459 - RNA, 22 nt, Human
caauguuuuguugaaugaauag

SEQ ID NO: 1086460 - RNA, 22 nt, Human
ccucuucauccuggaagcugcu

SEQ ID NO: 1086461 - RNA, 22 nt, Human
ggugcaaaaguaaucacaguuu

SEQ ID NO: 1086462 - RNA, 22 nt, Human
agaggggaaguaaugaaugaua

SEQ ID NO: 1086463 - RNA, 22 nt, Human
agggucaagucacugguucacg

SEQ ID NO: 1086464 - RNA, 22 nt, Human
ggagcagacauaaccuuacaga

SEQ ID NO: 1086465 - RNA, 22 nt, Human
agcucccagaagccagagucgg

SEQ ID NO: 1086466 - RNA, 22 nt, Human
ucccugcccugccuucaugguu

SEQ ID NO: 1086467 - RNA, 22 nt, Human
cuuuacauccuguuucccguuu

SEQ ID NO: 1086468 - RNA, 19 nt, Human
ugcccugcacgcuguccug

SEQ ID NO: 1086469 - RNA, 22 nt, Human
cagaguaaggagcugucaaacg

SEQ ID NO: 1086470 - RNA, 16 nt, Human
ggagguggguaaggug

SEQ ID NO: 1086471 - RNA, 22 nt, Human
uggcagcauguuauguaaggaa

SEQ ID NO: 1086472 - RNA, 22 nt, Human
cuucgauuuaauucuuaaccuu

SEQ ID NO: 1086473 - RNA, 22 nt, Human
gucagcuaugucuguuguugag

SEQ ID NO: 1086474 - RNA, 22 nt, Human
auucauuuagagggauuaagca

SEQ ID NO: 1086475 - RNA, 22 nt, Human
caaagcagaagguucuguggua

SEQ ID NO: 1086476 - RNA, 22 nt, Human
ugaacaaacugcauucuucacu

SEQ ID NO: 1086477 - RNA, 22 nt, Human
uaagaaacuauggagaagaacu

SEQ ID NO: 1086478 - RNA, 22 nt, Human
uucuaagauucaugaggacagg

SEQ ID NO: 1086479 - RNA, 22 nt, Human
ggugggcagcucuuggcaggca

SEQ ID NO: 1086480 - RNA, 18 nt, Human
ugaacacaguacaauucc

SEQ ID NO: 1086481 - RNA, 22 nt, Human
cugugcccaccuggcucugagg

SEQ ID NO: 1086482 - RNA, 22 nt, Human
aucugcuugaaacuucuuauac

SEQ ID NO: 1086483 - RNA, 22 nt, Human
aguggggccgcgguccugcccu

SEQ ID NO: 1086484 - RNA, 22 nt, Human
uggcugaguuacgaacagagca

SEQ ID NO: 1086485 - RNA, 20 nt, Human
ugaaggugacuccuuucuug

SEQ ID NO: 1086486 - RNA, 22 nt, Human
gcuggagccauuggcuuggccu

SEQ ID NO: 1086487 - RNA, 22 nt, Human
aggagcugagggagcgcccuug

SEQ ID NO: 1086488 - RNA, 22 nt, Human
ucccugcagacguccugcgggu

SEQ ID NO: 1086489 - RNA, 22 nt, Human
uaguggagaguuguuuugugca

SEQ ID NO: 1086490 - RNA, 22 nt, Human
gucucagauucagacaucuaca

SEQ ID NO: 1086491 - RNA, 22 nt, Human
cagcuggcauaccugggcccgg

SEQ ID NO: 1086492 - RNA, 22 nt, Human
gacauucacagguaaacauucc

SEQ ID NO: 1086493 - RNA, 22 nt, Human
cauuucacaguauauucaaaau

SEQ ID NO: 1086494 - RNA, 22 nt, Human
agaaaauuacuccagagacaag

SEQ ID NO: 1086495 - RNA, 22 nt, Human
ucaaguauaucuagucauuagg

SEQ ID NO: 1086496 - RNA, 19 nt, Human
gguguccuagagauaagag

SEQ ID NO: 1086497 - RNA, 22 nt, Human
cagaggguugucaggcgccuug

SEQ ID NO: 1086498 - RNA, 22 nt, Human
agaggcugcacuugcucaugau

SEQ ID NO: 1086499 - RNA, 22 nt, Human
auauacuguguuccauggacca

SEQ ID NO: 1086500 - RNA, 22 nt, Human
uuuguacauauauaaaaucugu

SEQ ID NO: 1086501 - RNA, 22 nt, Human
aacugugaggaugugcaaauuc

SEQ ID NO: 1086502 - RNA, 22 nt, Human
uaugaagugucuguuguaucug

SEQ ID NO: 1086503 - RNA, 22 nt, Human
ggggcugaaccuggaggugguc

SEQ ID NO: 1086504 - RNA, 22 nt, Human
cauguggagaauuaaaaaauac

SEQ ID NO: 1086505 - RNA, 22 nt, Human
gaacauuacugcuugggagagg

SEQ ID NO: 1086506 - RNA, 22 nt, Human
aacauuucauuggaagcuaugu

SEQ ID NO: 1086507 - RNA, 22 nt, Human
uggaaaaacugagacuuagaca

SEQ ID NO: 1086508 - RNA, 22 nt, Human
ugcuaaauaaguggaauagaca

SEQ ID NO: 1086509 - RNA, 22 nt, Human
cuggacagaaaaggccacugga

SEQ ID NO: 1086510 - RNA, 22 nt, Human
uucuuacagcccuauuacuaaa

SEQ ID NO: 1086511 - RNA, 22 nt, Human
gcucaggcuggauugcaguggc

SEQ ID NO: 1086512 - RNA, 20 nt, Human
uucugagaguucacagcccc

SEQ ID NO: 1086513 - RNA, 23 nt, Human
ucucugaguuguacuuucccuug

SEQ ID NO: 1086514 - RNA, 22 nt, Human
ucacagacaccuuggccacagu

SEQ ID NO: 1086515 - RNA, 22 nt, Human
cuuugcuagugauuuguuuagg

SEQ ID NO: 1086516 - RNA, 22 nt, Human
ucugucaaaugggcauaaggau

SEQ ID NO: 1086517 - RNA, 22 nt, Human
uuucaacaggaugauaauaggc

SEQ ID NO: 1086518 - RNA, 17 nt, Human
ccucacagggaccagac

SEQ ID NO: 1086519 - RNA, 22 nt, Human
aaaggucagacuuaggcugggc

SEQ ID NO: 1086520 - RNA, 22 nt, Human
cauggggagacaccuagggaaa

SEQ ID NO: 1086521 - RNA, 19 nt, Human
aggcucugagcuccuggag

SEQ ID NO: 1086522 - RNA, 22 nt, Human
agcagggccucuggcacugguc

SEQ ID NO: 1086523 - RNA, 22 nt, Human
agauacaugucaagagacuuau

SEQ ID NO: 1086524 - RNA, 21 nt, Human
aaaugcuuuguauauaucugu

SEQ ID NO: 1086525 - RNA, 22 nt, Human
cccuuuaaguagaauauauuau

SEQ ID NO: 1086526 - RNA, 22 nt, Human
aggcuggccagugcugcagugg

SEQ ID NO: 1086527 - RNA, 22 nt, Human
cuggaaagugucuccauccugg

SEQ ID NO: 1086528 - RNA, 22 nt, Human
ccaggcccugcuccucacacca

SEQ ID NO: 1086529 - RNA, 22 nt, Human
aggcaggaaaaucgcuugaacc

SEQ ID NO: 1086530 - RNA, 22 nt, Human
cugugcuuccaggauggcagcu

SEQ ID NO: 1086531 - RNA, 22 nt, Human
ucccacucccaggcaggccucu

SEQ ID NO: 1086532 - RNA, 22 nt, Human
gaggcucagggaguauaugaau

SEQ ID NO: 1086533 - RNA, 22 nt, Human
caguggcuguuucuggaaggca

SEQ ID NO: 1086534 - RNA, 23 nt, Human
aggagccaggugcagcccuugug

SEQ ID NO: 1086535 - RNA, 22 nt, Human
caagagcauuuaguuagcuggu

SEQ ID NO: 1086536 - RNA, 20 nt, Human
aagauucauuguaauuaggg

SEQ ID NO: 1086537 - RNA, 22 nt, Human
ggcagggcccugauuccugggg

SEQ ID NO: 1086538 - RNA, 22 nt, Human
gcucugggcugcccucuggaca

SEQ ID NO: 1086539 - RNA, 22 nt, Human
aagauucuacaguagguacauu

SEQ ID NO: 1086540 - RNA, 22 nt, Human
acugucugcuggccccugguua

SEQ ID NO: 1086541 - RNA, 22 nt, Human
cugcagggagaggggacagccu

SEQ ID NO: 1086542 - RNA, 21 nt, Human
gcacagcaugaguguuggcau

SEQ ID NO: 1086543 - RNA, 22 nt, Human
cugcagccuaggugcagcuggg

SEQ ID NO: 1086544 - RNA, 22 nt, Human
uggaacacuuucaguagcuauu

SEQ ID NO: 1086545 - RNA, 21 nt, Human
ucuuuccugcccaguugcccu

SEQ ID NO: 1086546 - RNA, 21 nt, Human
acaugcauagagagauuucug

SEQ ID NO: 1086547 - RNA, 19 nt, Human
caggaaugagguaauggcu

SEQ ID NO: 1086548 - RNA, 22 nt, Human
augggcaguuaggaggccagga

SEQ ID NO: 1086549 - RNA, 22 nt, Human
aggagggcaggcuggcugccua

SEQ ID NO: 1086550 - RNA, 20 nt, Human
ucccaggcugggcuccagcu

SEQ ID NO: 1086551 - RNA, 22 nt, Human
ucugggguuggugcuuacacca

SEQ ID NO: 1086552 - RNA, 22 nt, Human
ucccuggcagcuaagggugguc

SEQ ID NO: 1086553 - RNA, 22 nt, Human
gccuucccacccugcgaggcug

SEQ ID NO: 1086554 - RNA, 18 nt, Human
accugccuguucuucucu

SEQ ID NO: 1086555 - RNA, 19 nt, Human
ccugucugucuucagcuag

SEQ ID NO: 1086556 - RNA, 22 nt, Human
ucuuuuccuucccuacagaucu

SEQ ID NO: 1086557 - RNA, 22 nt, Human
agugcugaagacuggcuaggga

SEQ ID NO: 1086558 - RNA, 22 nt, Human
aggccucagugaucaucaucag

SEQ ID NO: 1086559 - RNA, 22 nt, Human
aagauggcuuagaguccuggug

SEQ ID NO: 1086560 - RNA, 22 nt, Human
gaugaaaaaagacgagcauaua

SEQ ID NO: 1086561 - RNA, 22 nt, Human
cuuucuucaucaagugccacgu

SEQ ID NO: 1086562 - RNA, 22 nt, Human
uggugggaguccgcugugcugc

SEQ ID NO: 1086563 - RNA, 22 nt, Human
agaacagcagcacgucaagcug

SEQ ID NO: 1086564 - RNA, 22 nt, Human
uuguaacaaucugucauaaaug

SEQ ID NO: 1086565 - RNA, 22 nt, Human
uguccugcaacugaaggagaag

SEQ ID NO: 1086566 - RNA, 22 nt, Human
gcagauggcgcaguggaaguuc

SEQ ID NO: 1086567 - RNA, 22 nt, Human
gccuggcauuggagccggggca

SEQ ID NO: 1086568 - RNA, 22 nt, Human
uuaccaaugugcuuuugcuaca

SEQ ID NO: 1086569 - RNA, 22 nt, Human
gccugaugagcuuccagcugag

SEQ ID NO: 1086570 - RNA, 22 nt, Human
ccugaauaauuugugaaaagau

SEQ ID NO: 1086571 - RNA, 22 nt, Human
ucacuucuucccuugcacauau

SEQ ID NO: 1086572 - RNA, 22 nt, Human
uaagaaucggucgcaacagagg

SEQ ID NO: 1086573 - RNA, 22 nt, Human
ccugggcuccacuccaagagca

SEQ ID NO: 1086574 - RNA, 19 nt, Human
aaacucauagacucauauu

SEQ ID NO: 1086575 - RNA, 21 nt, Human
agcaggugaaccuccaguaca

SEQ ID NO: 1086576 - RNA, 22 nt, Human
guguaaggccccagguucuuua

SEQ ID NO: 1086577 - RNA, 22 nt, Human
gagcuuaggccagggacaggga

SEQ ID NO: 1086578 - RNA, 23 nt, Human
gagcugggauacaggcuuacugc

SEQ ID NO: 1086579 - RNA, 19 nt, Human
cagaaauagcgaaguguaa

SEQ ID NO: 1086580 - RNA, 22 nt, Human
caguuacauauuuaguagguua

SEQ ID NO: 1086581 - RNA, 22 nt, Human
ugcucuggaguggcuugugcac

SEQ ID NO: 1086582 - RNA, 22 nt, Human
ggagcugggaauuggaucaucu

SEQ ID NO: 1086583 - RNA, 22 nt, Human
gccuggagagcacugugcgcuu

SEQ ID NO: 1086584 - RNA, 22 nt, Human
uucacagaugccugaugugugg

SEQ ID NO: 1086585 - RNA, 23 nt, Human
augcucugggcugugggaccugc

SEQ ID NO: 1086586 - RNA, 17 nt, Human
cgagggcuugcuggcuc

SEQ ID NO: 1086587 - RNA, 22 nt, Human
gcugcagcucgccuuccggccu

SEQ ID NO: 1086588 - RNA, 22 nt, Human
gcaggguauaauacuuagguga

SEQ ID NO: 1086589 - RNA, 22 nt, Human
ccugggcaggccggacgcuggg

SEQ ID NO: 1086590 - RNA, 22 nt, Human
gucucccaucguuugugaggaa

SEQ ID NO: 1086591 - RNA, 22 nt, Human
uucuuuccaaccagauauuggu

SEQ ID NO: 1086592 - RNA, 17 nt, Human
gucauucucagaaaaug

SEQ ID NO: 1086593 - RNA, 22 nt, Human
uagaaacaaaaucugaugacuc

SEQ ID NO: 1086594 - RNA, 22 nt, Human
uccuucagaaaaccucagucuu

SEQ ID NO: 1086595 - RNA, 22 nt, Human
cagagcugguaagugguagagg

SEQ ID NO: 1086596 - RNA, 22 nt, Human
caggauuucauacaucuuuacu

SEQ ID NO: 1086597 - RNA, 22 nt, Human
ucagaagaaagauguuauuacu

SEQ ID NO: 1086598 - RNA, 18 nt, Human
auccuugaugagaggucu

SEQ ID NO: 1086599 - RNA, 22 nt, Human
uuccauauuuguguggcaaaag

SEQ ID NO: 1086600 - RNA, 22 nt, Human
gagcaggcauucuaguggcuga

SEQ ID NO: 1086601 - RNA, 22 nt, Human
cagcucugggugacaggagggc

SEQ ID NO: 1086602 - RNA, 22 nt, Human
aucaacauaaagaaguccucag

SEQ ID NO: 1086603 - RNA, 22 nt, Human
aaaguucuuugcaucuuugcuc

SEQ ID NO: 1086604 - RNA, 22 nt, Human
ucucuggccgagagucccuggg

SEQ ID NO: 1086605 - RNA, 23 nt, Human
auuucccauugugucagcagagc

SEQ ID NO: 1086606 - RNA, 22 nt, Human
uccucacaagcaagcacaggua

SEQ ID NO: 1086607 - RNA, 22 nt, Human
agacaguguguguauauauggu

SEQ ID NO: 1086608 - RNA, 22 nt, Human
cagggcuccccgcaccgcagcc

SEQ ID NO: 1086609 - RNA, 22 nt, Human
aauuaccaggauuuuucaguau

SEQ ID NO: 1086610 - RNA, 22 nt, Human
ucacagaaugucuagcauaauu

SEQ ID NO: 1086611 - RNA, 22 nt, Human
acauacuuauguguauaugugu

SEQ ID NO: 1086612 - RNA, 22 nt, Human
ugaaggaaugagggaguggguc

SEQ ID NO: 1086613 - RNA, 22 nt, Human
ucacauuuucuacuacuguacg

SEQ ID NO: 1086614 - RNA, 22 nt, Human
augaaaugugaaugcuuuucau

SEQ ID NO: 1086615 - RNA, 22 nt, Human
gaucuuuucagaauuuaucagu

SEQ ID NO: 1086616 - RNA, 22 nt, Human
agacuuuaaugugcaaaugaaa

SEQ ID NO: 1086617 - RNA, 20 nt, Human
ugguccugucccacccacuc

SEQ ID NO: 1086618 - RNA, 22 nt, Human
agaggcugaaugaugucaucau

SEQ ID NO: 1086619 - RNA, 22 nt, Human
ccaggcugcagucaaggggcau

SEQ ID NO: 1086620 - RNA, 22 nt, Human
uccccacacuuucacuccuggc

SEQ ID NO: 1086621 - RNA, 17 nt, Human
ccaggugggaggugggg

SEQ ID NO: 1086622 - RNA, 22 nt, Human
aaaugcacugaauauuccaaau

SEQ ID NO: 1086623 - RNA, 22 nt, Human
acacauauucauauguacuuac

SEQ ID NO: 1086624 - RNA, 22 nt, Human
ugggaaggggagcuggaaagga

SEQ ID NO: 1086625 - RNA, 22 nt, Human
uucagagcaucucuaaagccag

SEQ ID NO: 1086626 - RNA, 22 nt, Human
uuucaucuaacacuacauaggg

SEQ ID NO: 1086627 - RNA, 22 nt, Human
augcugugauuguagaaauauu

SEQ ID NO: 1086628 - RNA, 22 nt, Human
cuacauuuguucuauagcuuuu

SEQ ID NO: 1086629 - RNA, 22 nt, Human
gccaccagccccaugcgcugug

SEQ ID NO: 1086630 - RNA, 22 nt, Human
ccacagaaagccugggaagugg

SEQ ID NO: 1086631 - RNA, 22 nt, Human
uggcucaguuucaguccugguu

SEQ ID NO: 1086632 - RNA, 19 nt, Human
cagcaauaaugccagaugg

SEQ ID NO: 1086633 - RNA, 22 nt, Human
gggugagagucaggcagagauu

SEQ ID NO: 1086634 - RNA, 22 nt, Human
ucaguuuugaaaacauugaaug

SEQ ID NO: 1086635 - RNA, 20 nt, Human
auugugcagcccuuggcaga

SEQ ID NO: 1086636 - RNA, 22 nt, Human
aaggcugaggagggccugcagg

SEQ ID NO: 1086637 - RNA, 22 nt, Human
cuuuuuauagcuauguccuaug

SEQ ID NO: 1086638 - RNA, 22 nt, Human
caauauauaaugaguacuuucc

SEQ ID NO: 1086639 - RNA, 23 nt, Human
gggcugcuccaggccaaggcugg

SEQ ID NO: 1086640 - RNA, 22 nt, Human
ugcaggugugugcaagggaggg

SEQ ID NO: 1086641 - RNA, 22 nt, Human
aggaaagguagcgugccagcag

SEQ ID NO: 1086642 - RNA, 22 nt, Human
guacauucagcuuagcacuucu

SEQ ID NO: 1086643 - RNA, 18 nt, Human
agggucagugucacuggc

SEQ ID NO: 1086644 - RNA, 22 nt, Human
ccaaaguccauaguuuacauua

SEQ ID NO: 1086645 - RNA, 22 nt, Human
gggcacuguacacugugcaugg

SEQ ID NO: 1086646 - RNA, 23 nt, Human
uuugaacauuucuagauuacaua

SEQ ID NO: 1086647 - RNA, 20 nt, Human
ccagauggucccugugaaaa

SEQ ID NO: 1086648 - RNA, 22 nt, Human
auauuauaaguuauuucaaguu

SEQ ID NO: 1086649 - RNA, 22 nt, Human
ggugcaugguggaggugacccu

SEQ ID NO: 1086650 - RNA, 22 nt, Human
gggcagggguagcauuccaagu

SEQ ID NO: 1086651 - RNA, 19 nt, Human
guuuuuaguuucugaacug

SEQ ID NO: 1086652 - RNA, 20 nt, Human
ggccauggguugccugaggu

SEQ ID NO: 1086653 - RNA, 22 nt, Human
aggagcuggguuccuuuggugg

SEQ ID NO: 1086654 - RNA, 22 nt, Human
ucagaggugguaaaggacagca

SEQ ID NO: 1086655 - RNA, 22 nt, Human
aguguugucaaacggcucagca

SEQ ID NO: 1086656 - RNA, 22 nt, Human
ccacucugcugugcuccaugau

SEQ ID NO: 1086657 - RNA, 22 nt, Human
gacauuuaugaaggagauaugc

SEQ ID NO: 1086658 - RNA, 22 nt, Human
accaggcuggagugcaguggcg

SEQ ID NO: 1086659 - RNA, 22 nt, Human
caggaacaugucuccaauuaga

SEQ ID NO: 1086660 - RNA, 22 nt, Human
auuguauuuccagcuugaaugu

SEQ ID NO: 1086661 - RNA, 22 nt, Human
aauaauacaugagauuaauguu

SEQ ID NO: 1086662 - RNA, 22 nt, Human
cagugcagguuuagggcugggg

SEQ ID NO: 1086663 - RNA, 22 nt, Human
cagggccagcgcccaggcccag

SEQ ID NO: 1086664 - RNA, 19 nt, Human
uggggucaagagaggcuuc

SEQ ID NO: 1086665 - RNA, 22 nt, Human
ggagagaaauugagguagcaag

SEQ ID NO: 1086666 - RNA, 22 nt, Human
uucacagcuuaauaaggcucag

SEQ ID NO: 1086667 - RNA, 22 nt, Human
acacauaucuaagauagaugac

SEQ ID NO: 1086668 - RNA, 20 nt, Human
caguccaaucagaggccacc

SEQ ID NO: 1086669 - RNA, 22 nt, Human
caucaaauggcaagugaaagcu

SEQ ID NO: 1086670 - RNA, 22 nt, Human
ggcugugcuugguguccuugga

SEQ ID NO: 1086671 - RNA, 22 nt, Human
gacagggccgcagauggagacu

SEQ ID NO: 1086672 - RNA, 22 nt, Human
acaagaguaucuuugacuuuag

SEQ ID NO: 1086673 - RNA, 18 nt, Human
acucaggaaaugaugaca

SEQ ID NO: 1086674 - RNA, 22 nt, Human
auaaggcaagcugucaguuugu

SEQ ID NO: 1086675 - RNA, 22 nt, Human
cuugccuucuuuuccuauagaa

SEQ ID NO: 1086676 - RNA, 22 nt, Human
gagcucuguguagccugagggu

SEQ ID NO: 1086677 - RNA, 22 nt, Human
ugugcccauuccacuugaguac

SEQ ID NO: 1086678 - RNA, 22 nt, Human
guggcuucugcggugugcgcag

SEQ ID NO: 1086679 - RNA, 22 nt, Human
uacacuaauguuuuugcaaagc

SEQ ID NO: 1086680 - RNA, 22 nt, Human
uguuuuuaaaauguccugguua

SEQ ID NO: 1086681 - RNA, 22 nt, Human
aguaacagagcauggguucaga

SEQ ID NO: 1086682 - RNA, 22 nt, Human
aaugagacacgugaagcagaug

SEQ ID NO: 1086683 - RNA, 22 nt, Human
aauucacaauguguagucaugc

SEQ ID NO: 1086684 - RNA, 22 nt, Human
uugccuuugacggugcagcagu

SEQ ID NO: 1086685 - RNA, 22 nt, Human
aguuaacaaguuggcaaucaac

SEQ ID NO: 1086686 - RNA, 22 nt, Human
uggaggaugagugugggcucug

SEQ ID NO: 1086687 - RNA, 22 nt, Human
gaaggccauuagagccugugcc

SEQ ID NO: 1086688 - RNA, 22 nt, Human
cugcccuggguuuuaugggagu

SEQ ID NO: 1086689 - RNA, 22 nt, Human
ggagaagggacagacucagcuu

SEQ ID NO: 1086690 - RNA, 21 nt, Human
acaguauauuagauauuugaa

SEQ ID NO: 1086691 - RNA, 22 nt, Human
ucaucaaaggauugcaugauuu

SEQ ID NO: 1086692 - RNA, 22 nt, Human
ccugggcaauauagugaggccc

SEQ ID NO: 1086693 - RNA, 22 nt, Human
ggccucugccccagccacaccu

SEQ ID NO: 1086694 - RNA, 23 nt, Human
aagcugccuucgcaguuggucug

SEQ ID NO: 1086695 - RNA, 18 nt, Human
gguccugaaugccugcua

SEQ ID NO: 1086696 - RNA, 22 nt, Human
agcucauggugcuaucucaggg

SEQ ID NO: 1086697 - RNA, 22 nt, Human
agaaacuaagucauaacucuuu

SEQ ID NO: 1086698 - RNA, 22 nt, Human
uucucacaggaaguaggacuuu

SEQ ID NO: 1086699 - RNA, 22 nt, Human
ugucuuccucuuggcuugagcu

SEQ ID NO: 1086700 - RNA, 21 nt, Human
aucugaaagguuaguguugag

SEQ ID NO: 1086701 - RNA, 23 nt, Human
auacauacagucuuacugacuuu

SEQ ID NO: 1086702 - RNA, 20 nt, Human
acacauauagcagcauaaac

SEQ ID NO: 1086703 - RNA, 22 nt, Human
cucuucaaaugauuuccuuagg

SEQ ID NO: 1086704 - RNA, 22 nt, Human
uguuaucugagcaacgucgacg

SEQ ID NO: 1086705 - RNA, 22 nt, Human
gggacuguccucugugucugug

SEQ ID NO: 1086706 - RNA, 22 nt, Human
acacauuugggcuccuacauaa

SEQ ID NO: 1086707 - RNA, 19 nt, Human
cgcagguggaaggagccgc

SEQ ID NO: 1086708 - RNA, 22 nt, Human
uuuaaaagggguauuaagucca

SEQ ID NO: 1086709 - RNA, 22 nt, Human
ucacugcagacaaccucaguca

SEQ ID NO: 1086710 - RNA, 22 nt, Human
accaucaguacuggaugcugac

SEQ ID NO: 1086711 - RNA, 22 nt, Human
uggcaauaaagaccaacagguu

SEQ ID NO: 1086712 - RNA, 22 nt, Human
gcuuccagaucccaugcucuua

SEQ ID NO: 1086713 - RNA, 18 nt, Human
auuuugaacaaugcugua

SEQ ID NO: 1086714 - RNA, 22 nt, Human
auacagaaguuuuccacuuauu

SEQ ID NO: 1086715 - RNA, 22 nt, Human
agccaacuuagaagaaauuuga

SEQ ID NO: 1086716 - RNA, 22 nt, Human
gaacagcuucuugggagcuggg

SEQ ID NO: 1086717 - RNA, 22 nt, Human
uaaaucacaaauuuucucauuu

SEQ ID NO: 1086718 - RNA, 22 nt, Human
aacaguaugugagauuuacaca

SEQ ID NO: 1086719 - RNA, 22 nt, Human
cacauccuucagcugagcccag

SEQ ID NO: 1086720 - RNA, 22 nt, Human
ucuuucaagggcccuaguuugg

SEQ ID NO: 1086721 - RNA, 22 nt, Human
auuuguuucagggccuugguau

SEQ ID NO: 1086722 - RNA, 22 nt, Human
uuuuucaugagacuagaaguca

SEQ ID NO: 1086723 - RNA, 22 nt, Human
ccagcuggagcucgcagauagg

SEQ ID NO: 1086724 - RNA, 22 nt, Human
gcuuuucuccuuagugucccug

SEQ ID NO: 1086725 - RNA, 22 nt, Human
agccaacuaauuaaacaacuuu

SEQ ID NO: 1086726 - RNA, 17 nt, Human
agggggaaccugggagg

SEQ ID NO: 1086727 - RNA, 18 nt, Human
agccagguggaauggaac

SEQ ID NO: 1086728 - RNA, 23 nt, Human
gggagccaggaccucgcgcccca

SEQ ID NO: 1086729 - RNA, 22 nt, Human
acauauauguaaaguacuuugu

SEQ ID NO: 1086730 - RNA, 20 nt, Human
aagaaacuugaaaguacaag

SEQ ID NO: 1086731 - RNA, 22 nt, Human
acauauaagggaucagugacag

SEQ ID NO: 1086732 - RNA, 22 nt, Human
gcugucugggaggccuccacuu

SEQ ID NO: 1086733 - RNA, 22 nt, Human
ugcagggcccucauuccugucc

SEQ ID NO: 1086734 - RNA, 22 nt, Human
auuagaaugaaguauaggauuu

SEQ ID NO: 1086735 - RNA, 23 nt, Human
acauacauggagauaaagugaug

SEQ ID NO: 1086736 - RNA, 22 nt, Human
gcuggcuggaggagggagguug

SEQ ID NO: 1086737 - RNA, 22 nt, Human
gaggguggggaauagacugcua

SEQ ID NO: 1086738 - RNA, 22 nt, Human
uuucccaagaccauagauggaa

SEQ ID NO: 1086739 - RNA, 22 nt, Human
uuuuccuucuagagcagauuuc

SEQ ID NO: 1086740 - RNA, 22 nt, Human
aaggugucaccagauuggcagg

SEQ ID NO: 1086741 - RNA, 22 nt, Human
guccaggcugaccccuagagga

SEQ ID NO: 1086742 - RNA, 22 nt, Human
uccagggcugacuugggagagg

SEQ ID NO: 1086743 - RNA, 22 nt, Human
agauggagaaugacaauuaagg

SEQ ID NO: 1086744 - RNA, 22 nt, Human
cagccagcugaauguaccauga

SEQ ID NO: 1086745 - RNA, 22 nt, Human
uaagcaaaguuuauaaggcucu

SEQ ID NO: 1086746 - RNA, 22 nt, Human
ugggccugagcucaccaggggc

SEQ ID NO: 1086747 - RNA, 22 nt, Human
ggagcuguaacgagccauugcu

SEQ ID NO: 1086748 - RNA, 22 nt, Human
gggcgccgugggaaacagccgg

SEQ ID NO: 1086749 - RNA, 22 nt, Human
aauagcaccugagguaguuugu

SEQ ID NO: 1086750 - RNA, 22 nt, Human
cagcaagauuaagggcagaaaa

SEQ ID NO: 1086751 - RNA, 22 nt, Human
ugugaaaucacaggcuauuuag

SEQ ID NO: 1086752 - RNA, 17 nt, Human
uucucugagcuguauug

SEQ ID NO: 1086753 - RNA, 22 nt, Human
ugaucuuugggccauuaauaaa

SEQ ID NO: 1086754 - RNA, 22 nt, Human
aggggugaaggcccgauaggag

SEQ ID NO: 1086755 - RNA, 20 nt, Human
ugaggcaggagaauggcaug

SEQ ID NO: 1086756 - RNA, 23 nt, Human
aacagccaacuuuagcggguggc

SEQ ID NO: 1086757 - RNA, 22 nt, Human
uccuggcccacuaugccagcau

SEQ ID NO: 1086758 - RNA, 22 nt, Human
gcuguucuuucagcccagggcu

SEQ ID NO: 1086759 - RNA, 22 nt, Human
gcucccucugcucaggcacuug

SEQ ID NO: 1086760 - RNA, 22 nt, Human
aucaaaguaucucaauauggua

SEQ ID NO: 1086761 - RNA, 22 nt, Human
cagccccucccucaggcaggug

SEQ ID NO: 1086762 - RNA, 22 nt, Human
aaggcagaaagggaugugagug

SEQ ID NO: 1086763 - RNA, 21 nt, Human
agaaauguaucauucuuuucc

SEQ ID NO: 1086764 - RNA, 19 nt, Human
aggguccagggagcggcuc

SEQ ID NO: 1086765 - RNA, 22 nt, Human
cuucuuaaugacagauuaaaau

SEQ ID NO: 1086766 - RNA, 22 nt, Human
aggcucagauccuuguguccug

SEQ ID NO: 1086767 - RNA, 22 nt, Human
uauuugucagcuguugaguuca

SEQ ID NO: 1086768 - RNA, 22 nt, Human
gccaugcuugguaugcugugag

SEQ ID NO: 1086769 - RNA, 21 nt, Human
agaggccuuacaggauagacc

SEQ ID NO: 1086770 - RNA, 22 nt, Human
uggucaaugaagauacacuauu

SEQ ID NO: 1086771 - RNA, 22 nt, Human
uucaaacaguugcacaacuuau

SEQ ID NO: 1086772 - RNA, 22 nt, Human
cugugucucuccuuacaagacu

SEQ ID NO: 1086773 - RNA, 19 nt, Human
cagugcccgacgcaggucu

SEQ ID NO: 1086774 - RNA, 23 nt, Human
agcugaggcagaggggcauucuc

SEQ ID NO: 1086775 - RNA, 22 nt, Human
cagaaacagacaugacgcagua

SEQ ID NO: 1086776 - RNA, 22 nt, Human
ugcaaagaugaaauauuaaagg

SEQ ID NO: 1086777 - RNA, 22 nt, Human
gcagguggauauugcuacuuga

SEQ ID NO: 1086778 - RNA, 22 nt, Human
ccaaagucuggagcagcagagc

SEQ ID NO: 1086779 - RNA, 22 nt, Human
cugccuuccaaccccagacucc

SEQ ID NO: 1086780 - RNA, 22 nt, Human
agggaguuagaaauccaggaua

SEQ ID NO: 1086781 - RNA, 22 nt, Human
ugaaaucauugccaaguauuga

SEQ ID NO: 1086782 - RNA, 22 nt, Human
aggucauuccuugucuucuugc

SEQ ID NO: 1086783 - RNA, 22 nt, Human
uggcccugccgccacgacgucu

SEQ ID NO: 1086784 - RNA, 22 nt, Human
uuuuuccuagugcuuucuggua

SEQ ID NO: 1086785 - RNA, 22 nt, Human
ugggccugggucuuugcugcca

SEQ ID NO: 1086786 - RNA, 22 nt, Human
auaaaucuauuggacaugugug

SEQ ID NO: 1086787 - RNA, 22 nt, Human
uagcagaguaucuugcaaauua

SEQ ID NO: 1086788 - RNA, 22 nt, Human
ggguacaguucuuccaguguca

SEQ ID NO: 1086789 - RNA, 22 nt, Human
gaggcucagagggacuuucaag

SEQ ID NO: 1086790 - RNA, 22 nt, Human
uugcaccauuucacuuccauua

SEQ ID NO: 1086791 - RNA, 22 nt, Human
uggcauuucaccuuucauuucc

SEQ ID NO: 1086792 - RNA, 22 nt, Human
cucuggaggccuaaggaagugg

SEQ ID NO: 1086793 - RNA, 22 nt, Human
gcucagggccuggcugcggacu

SEQ ID NO: 1086794 - RNA, 22 nt, Human
gcuaugcaggagccuaaugaca

SEQ ID NO: 1086795 - RNA, 22 nt, Human
ucauccagccucaucaggagcu

SEQ ID NO: 1086796 - RNA, 22 nt, Human
uuauuacacugaaagaauugcg

SEQ ID NO: 1086797 - RNA, 22 nt, Human
aggaaucccgcaccagcugcug

SEQ ID NO: 1086798 - RNA, 23 nt, Human
acagaaaguucugcuggacagag

SEQ ID NO: 1086799 - RNA, 22 nt, Human
ucaaugauaucagcaggaugug

SEQ ID NO: 1086800 - RNA, 22 nt, Human
ccaagcagucugcuaggaguuu

SEQ ID NO: 1086801 - RNA, 22 nt, Human
aaaaggcuagcuaguaacagaa

SEQ ID NO: 1086802 - RNA, 22 nt, Human
gcucugggguuggaaagugauc

SEQ ID NO: 1086803 - RNA, 22 nt, Human
aaaagucugcucucauuucaga

SEQ ID NO: 1086804 - RNA, 22 nt, Human
accuucaagauugugggucaau

SEQ ID NO: 1086805 - RNA, 22 nt, Human
ugccaggcuuuggucaaaggcu

SEQ ID NO: 1086806 - RNA, 23 nt, Human
gcugccucuguuggucuucaguu

SEQ ID NO: 1086807 - RNA, 22 nt, Human
caggaaagagcugccaggcagg

SEQ ID NO: 1086808 - RNA, 22 nt, Human
cagaggcucaccagccuuucac

SEQ ID NO: 1086809 - RNA, 22 nt, Human
ucuucagacuguuguucuuuug

SEQ ID NO: 1086810 - RNA, 22 nt, Human
guggucagcagcagugggagug

SEQ ID NO: 1086811 - RNA, 22 nt, Human
caggcuggagugaguguagugg

SEQ ID NO: 1086812 - RNA, 22 nt, Human
ugucucugauaaguaguucagu

SEQ ID NO: 1086813 - RNA, 22 nt, Human
cuugggcucagacuugaggaca

SEQ ID NO: 1086814 - RNA, 22 nt, Human
auaacagacuuagaguuacaag

SEQ ID NO: 1086815 - RNA, 22 nt, Human
cagggccaccguguuugcugcu

SEQ ID NO: 1086816 - RNA, 22 nt, Human
ucugucucuuuguucugugagu

SEQ ID NO: 1086817 - RNA, 20 nt, Human
aggcucugccugcaggccca

SEQ ID NO: 1086818 - RNA, 22 nt, Human
aggguauaaagagcaagcagaa

SEQ ID NO: 1086819 - RNA, 22 nt, Human
cauuuugugcuagacacuaugg

SEQ ID NO: 1086820 - RNA, 22 nt, Human
ugagccagaguggagugugccu

SEQ ID NO: 1086821 - RNA, 22 nt, Human
uauuuguuccagagauaaaaau

SEQ ID NO: 1086822 - RNA, 22 nt, Human
cccagcuccuuacagggccgaa

SEQ ID NO: 1086823 - RNA, 22 nt, Human
cugcugagagccccagcugaga

SEQ ID NO: 1086824 - RNA, 22 nt, Human
ccagggugugagaaggaaguag

SEQ ID NO: 1086825 - RNA, 22 nt, Human
acuacagaagucuuauuagaga

SEQ ID NO: 1086826 - RNA, 22 nt, Human
ccugccugucuuuauccccugu

SEQ ID NO: 1086827 - RNA, 22 nt, Human
agugggcugguggcagggagaa

SEQ ID NO: 1086828 - RNA, 22 nt, Human
gcaagaugguuauaaaaaaugu

SEQ ID NO: 1086829 - RNA, 22 nt, Human
aacaaauguguggcaguguggg

SEQ ID NO: 1086830 - RNA, 23 nt, Human
ugcaggugauuaauccaguuuca

SEQ ID NO: 1086831 - RNA, 22 nt, Human
cagccucuaagcacagccucuc

SEQ ID NO: 1086832 - RNA, 22 nt, Human
guacuucccugggaggcaagca

SEQ ID NO: 1086833 - RNA, 19 nt, Human
uuucuuccaaagacuaugg

SEQ ID NO: 1086834 - RNA, 22 nt, Human
gccagcaguccugcugugugcc

SEQ ID NO: 1086835 - RNA, 22 nt, Human
agagacugcgugucagcgcugg

SEQ ID NO: 1086836 - RNA, 22 nt, Human
aauuucagauauuaaagaauga

SEQ ID NO: 1086837 - RNA, 19 nt, Human
gcuggcuggaggagggaca

SEQ ID NO: 1086838 - RNA, 18 nt, Human
agagcagcggcaucacac

SEQ ID NO: 1086839 - RNA, 22 nt, Human
uacaguuacugcauuucuaaua

SEQ ID NO: 1086840 - RNA, 22 nt, Human
augcaagacauaaauaaucuuu

SEQ ID NO: 1086841 - RNA, 22 nt, Human
ccuccuggcccugggccuggaa

SEQ ID NO: 1086842 - RNA, 18 nt, Human
ccuggaccugucuccuuu

SEQ ID NO: 1086843 - RNA, 22 nt, Human
gauaauauuagaagauacaaau

SEQ ID NO: 1086844 - RNA, 22 nt, Human
cgagcagaauggagggugccga

SEQ ID NO: 1086845 - RNA, 22 nt, Human
cugauucucugacucuuggcuu

SEQ ID NO: 1086846 - RNA, 22 nt, Human
agcuccugaaaagcgcuugcuu

SEQ ID NO: 1086847 - RNA, 22 nt, Human
ucaaauucagugugacaacauu

SEQ ID NO: 1086848 - RNA, 22 nt, Human
aggcucugcagugcuggaggac

SEQ ID NO: 1086849 - RNA, 22 nt, Human
agcugcugagagucugccgggc

SEQ ID NO: 1086850 - RNA, 22 nt, Human
agcacagggcccagccuaggcc

SEQ ID NO: 1086851 - RNA, 22 nt, Human
uggcucagccuggcccuuucau

SEQ ID NO: 1086852 - RNA, 22 nt, Human
cuacugaugcuauacuucucag

SEQ ID NO: 1086853 - RNA, 22 nt, Human
uugggaguuccuacugcgguuu

SEQ ID NO: 1086854 - RNA, 23 nt, Human
cagcccuuccugcauguuuuugu

SEQ ID NO: 1086855 - RNA, 22 nt, Human
ucuuccucccuacagagcucag

SEQ ID NO: 1086856 - RNA, 22 nt, Human
uuccucaugggguuccuucaga

SEQ ID NO: 1086857 - RNA, 21 nt, Human
gcucccugcucagcuccuggg

SEQ ID NO: 1086858 - RNA, 22 nt, Human
uggguggaauaaaucaguucug

SEQ ID NO: 1086859 - RNA, 22 nt, Human
uuucacagcaacacugucugca

SEQ ID NO: 1086860 - RNA, 22 nt, Human
cagcugugcuguauuaagcucu

SEQ ID NO: 1086861 - RNA, 22 nt, Human
aacaguuuguggauagcuugua

SEQ ID NO: 1086862 - RNA, 22 nt, Human
ucucacugcaaauauuauguau

SEQ ID NO: 1086863 - RNA, 22 nt, Human
cuccaggccagggaaguggaca

SEQ ID NO: 1086864 - RNA, 22 nt, Human
ugcccugccugagagacaguaa

SEQ ID NO: 1086865 - RNA, 22 nt, Human
ugucaaagccugaaucacauag

SEQ ID NO: 1086866 - RNA, 22 nt, Human
uguccucuuccagugcuccuuc

SEQ ID NO: 1086867 - RNA, 22 nt, Human
agggaauguagcaagaugccaa

SEQ ID NO: 1086868 - RNA, 22 nt, Human
cagccaucaguaaagacagcuu

SEQ ID NO: 1086869 - RNA, 22 nt, Human
cauagcaacagcaucaagucaa

SEQ ID NO: 1086870 - RNA, 20 nt, Human
gagggcaggcacccauuuca

SEQ ID NO: 1086871 - RNA, 20 nt, Human
uaaggcuguuuuguauuccu

SEQ ID NO: 1086872 - RNA, 22 nt, Human
gcagccugaggcccuuucuggc

SEQ ID NO: 1086873 - RNA, 22 nt, Human
agucauaauuauaaacaucagu

SEQ ID NO: 1086874 - RNA, 22 nt, Human
aaugggaggauuuucucucuug

SEQ ID NO: 1086875 - RNA, 21 nt, Human
aguuucacagaggggccgucc

SEQ ID NO: 1086876 - RNA, 22 nt, Human
cacuuaaaucuguugagaaaaa

SEQ ID NO: 1086877 - RNA, 22 nt, Human
ugaaugaauccuaacaaagaca

SEQ ID NO: 1086878 - RNA, 20 nt, Human
gagauuuccaaucaugccca

SEQ ID NO: 1086879 - RNA, 22 nt, Human
auuccaaagccugaauaaugga

SEQ ID NO: 1086880 - RNA, 22 nt, Human
uaccagggaacagggauauuaa

SEQ ID NO: 1086881 - RNA, 22 nt, Human
cugggcucaagaagucuucccu

SEQ ID NO: 1086882 - RNA, 22 nt, Human
ucccucagcucauauuuaugcc

SEQ ID NO: 1086883 - RNA, 22 nt, Human
gcagccaggaaagcuggacccu

SEQ ID NO: 1086884 - RNA, 22 nt, Human
agcaggcacaagaaagggaggu

SEQ ID NO: 1086885 - RNA, 22 nt, Human
ucaggcaggcagagggcaaaug

SEQ ID NO: 1086886 - RNA, 22 nt, Human
cucugagaugauaccuucugga

SEQ ID NO: 1086887 - RNA, 22 nt, Human
agugcaaauuauuuaccugauu

SEQ ID NO: 1086888 - RNA, 22 nt, Human
gcuggccaguguggugaccacc

SEQ ID NO: 1086889 - RNA, 21 nt, Human
aagagcuggaucaaggauaag

SEQ ID NO: 1086890 - RNA, 22 nt, Human
aauaagugaguuuagcaaguuu

SEQ ID NO: 1086891 - RNA, 22 nt, Human
gugucccagccccacaggccug

SEQ ID NO: 1086892 - RNA, 22 nt, Human
ucaucuugcugccauugcuuua

SEQ ID NO: 1086893 - RNA, 22 nt, Human
accuuuuauguaaauauauguu

SEQ ID NO: 1086894 - RNA, 22 nt, Human
agggaacaaaacucuaaaauuc

SEQ ID NO: 1086895 - RNA, 22 nt, Human
ugagcuuacgugggaacagacu

SEQ ID NO: 1086896 - RNA, 22 nt, Human
caggccuggguucaaaucccuu

SEQ ID NO: 1086897 - RNA, 22 nt, Human
ucaauacuuaagcuuaauucua

SEQ ID NO: 1086898 - RNA, 18 nt, Human
acagggagggcgcugggg

SEQ ID NO: 1086899 - RNA, 22 nt, Human
acauguacauacacauauguaa

SEQ ID NO: 1086900 - RNA, 22 nt, Human
agugcaaagaaaucagcuuugu

SEQ ID NO: 1086901 - RNA, 22 nt, Human
cuuuacaaccuaaguugaagcu

SEQ ID NO: 1086902 - RNA, 22 nt, Human
gcuucucaauucucacccucca

SEQ ID NO: 1086903 - RNA, 22 nt, Human
ugggcuggagcuuguugcuucc

SEQ ID NO: 1086904 - RNA, 22 nt, Human
aaagucacuuacagcucuuuug

SEQ ID NO: 1086905 - RNA, 21 nt, Human
cgacaggagaggcagccagcc

SEQ ID NO: 1086906 - RNA, 22 nt, Human
uauuauuaugcauagcaugaaa

SEQ ID NO: 1086907 - RNA, 22 nt, Human
ggcucagcacagggcuggcauc

SEQ ID NO: 1086908 - RNA, 22 nt, Human
acucaggaaaugaagacugguu

SEQ ID NO: 1086909 - RNA, 22 nt, Human
acagcugugauuucuaucauga

SEQ ID NO: 1086910 - RNA, 22 nt, Human
auauucuugaagggagauuaua

SEQ ID NO: 1086911 - RNA, 22 nt, Human
ucaggaacagaauuuucuaaaa

SEQ ID NO: 1086912 - RNA, 20 nt, Human
auucuaaagcucugcucuuu

SEQ ID NO: 1086913 - RNA, 22 nt, Human
uucuaacucuguuauguguuuc

SEQ ID NO: 1086914 - RNA, 22 nt, Human
uugugaguagugccgcaauaaa

SEQ ID NO: 1086915 - RNA, 22 nt, Human
uguggccuugcagccuggaggu

SEQ ID NO: 1086916 - RNA, 22 nt, Human
gccugcuggacauuggccggcc

SEQ ID NO: 1086917 - RNA, 22 nt, Human
gagcugcacgcagcauccaaga

SEQ ID NO: 1086918 - RNA, 18 nt, Human
cucaccauucugcccaau

SEQ ID NO: 1086919 - RNA, 22 nt, Human
guccugucccccaaggcugugg

SEQ ID NO: 1086920 - RNA, 22 nt, Human
uucuucaaaguccuuauuccuu

SEQ ID NO: 1086921 - RNA, 22 nt, Human
acagaugaggaauuuauuuggu

SEQ ID NO: 1086922 - RNA, 22 nt, Human
ggcugccacgucgaggguccaa

SEQ ID NO: 1086923 - RNA, 22 nt, Human
uggaggagaauuuauggucgaa

SEQ ID NO: 1086924 - RNA, 22 nt, Human
ccugggcaucucaugcaccugc

SEQ ID NO: 1086925 - RNA, 22 nt, Human
ccagcuccaggacugggagcug

SEQ ID NO: 1086926 - RNA, 22 nt, Human
aguauuucaguuacuuuaaaau

SEQ ID NO: 1086927 - RNA, 22 nt, Human
gagcugaaauaugaagccaauu

SEQ ID NO: 1086928 - RNA, 22 nt, Human
aggugcugccccgagaaggaug

SEQ ID NO: 1086929 - RNA, 22 nt, Human
ggugaagguggaacgcagagca

SEQ ID NO: 1086930 - RNA, 21 nt, Human
acaggcuuuagaaaaugacuc

SEQ ID NO: 1086931 - RNA, 22 nt, Human
uggcaggaggaugaggcggcua

SEQ ID NO: 1086932 - RNA, 22 nt, Human
ugcugccagagagacagggacu

SEQ ID NO: 1086933 - RNA, 22 nt, Human
agcaggguuuggggauuggcac

SEQ ID NO: 1086934 - RNA, 22 nt, Human
aagggcagggaguuugugucua

SEQ ID NO: 1086935 - RNA, 22 nt, Human
ugaggaagccaaacagcuacac

SEQ ID NO: 1086936 - RNA, 22 nt, Human
aaugugaggccuugguaguuau

SEQ ID NO: 1086937 - RNA, 22 nt, Human
cuuuuuuaagguagcuccuccu

SEQ ID NO: 1086938 - RNA, 22 nt, Human
gaugcacugcaguauauacugu

SEQ ID NO: 1086939 - RNA, 22 nt, Human
uauugaugcuuggauugggcca

SEQ ID NO: 1086940 - RNA, 22 nt, Human
acagcuguauccccagagcuca

SEQ ID NO: 1086941 - RNA, 22 nt, Human
acagucuugagcaucagccaga

SEQ ID NO: 1086942 - RNA, 22 nt, Human
ggcaggugugagaucgaggcca

SEQ ID NO: 1086943 - RNA, 22 nt, Human
ccaggcucuaucccuccuucuu

SEQ ID NO: 1086944 - RNA, 22 nt, Human
uccugccuuagagcaaggaaaa

SEQ ID NO: 1086945 - RNA, 22 nt, Human
aggggacacggcuucuccaggg

SEQ ID NO: 1086946 - RNA, 22 nt, Human
gccugccuagaauugcagcuuu

SEQ ID NO: 1086947 - RNA, 22 nt, Human
agugggcaggcagggugcgcag

SEQ ID NO: 1086948 - RNA, 22 nt, Human
acagugaaaagaauauuagaau

SEQ ID NO: 1086949 - RNA, 22 nt, Human
ucagcccugggacccagggaug

SEQ ID NO: 1086950 - RNA, 22 nt, Human
cugacucccaaagaggacgcgu

SEQ ID NO: 1086951 - RNA, 22 nt, Human
cacauuugaaggaauuagcauu

SEQ ID NO: 1086952 - RNA, 21 nt, Human
aggacaggaacuggcugaaua

SEQ ID NO: 1086953 - RNA, 22 nt, Human
caucagaaucugagucucugcc

SEQ ID NO: 1086954 - RNA, 22 nt, Human
ucagucucaucaacucuauucc

SEQ ID NO: 1086955 - RNA, 22 nt, Human
uuccaaauuaaaauguacaaug

SEQ ID NO: 1086956 - RNA, 22 nt, Human
uaaagucauaagaguggauccg

SEQ ID NO: 1086957 - RNA, 22 nt, Human
uugguuuacuaggauucaaauu

SEQ ID NO: 1086958 - RNA, 22 nt, Human
ugcagugggccggaggccaggg

SEQ ID NO: 1086959 - RNA, 22 nt, Human
ugcagaugagagggaguuuuua

SEQ ID NO: 1086960 - RNA, 19 nt, Human
aaccuuuagaucauucucc

SEQ ID NO: 1086961 - RNA, 22 nt, Human
aagccaggguuuguggaucuau

SEQ ID NO: 1086962 - RNA, 22 nt, Human
guuucacagauggggagacacg

SEQ ID NO: 1086963 - RNA, 21 nt, Human
ugcaggcaggcagagaugcug

SEQ ID NO: 1086964 - RNA, 21 nt, Human
uccuccuggccaggcggcccc

SEQ ID NO: 1086965 - RNA, 22 nt, Human
aaaguuggauuucauccucaug

SEQ ID NO: 1086966 - RNA, 22 nt, Human
cuguucaugcugauucuguaug

SEQ ID NO: 1086967 - RNA, 22 nt, Human
aauguuuuaaaagagauugaga

SEQ ID NO: 1086968 - RNA, 22 nt, Human
uaugaucuuuauaaccuaucuu

SEQ ID NO: 1086969 - RNA, 22 nt, Human
ugcagucuuccagcugcacaaa

SEQ ID NO: 1086970 - RNA, 22 nt, Human
ucaguguuuuuaaagcaauaua

SEQ ID NO: 1086971 - RNA, 22 nt, Human
aaacauuccauauauaccuugu

SEQ ID NO: 1086972 - RNA, 22 nt, Human
uugcaaaggggaauaaagcaau

SEQ ID NO: 1086973 - RNA, 22 nt, Human
ccuuccaggugcaggcaagccu

SEQ ID NO: 1086974 - RNA, 22 nt, Human
guuguauagagggcaugaaucu

SEQ ID NO: 1086975 - RNA, 22 nt, Human
ccaagcugacugugcuguugug

SEQ ID NO: 1086976 - RNA, 22 nt, Human
aggaacacaucuuuguagcagg

SEQ ID NO: 1086977 - RNA, 22 nt, Human
aggaggugcguggugauccccu

SEQ ID NO: 1086978 - RNA, 22 nt, Human
uccugggcugugugccacucug

SEQ ID NO: 1086979 - RNA, 22 nt, Human
augaaacaaggguauuuucucu

SEQ ID NO: 1086980 - RNA, 22 nt, Human
ucacguuuuacugagugagaua

SEQ ID NO: 1086981 - RNA, 22 nt, Human
gcuuuacagggcacaaagggag

SEQ ID NO: 1086982 - RNA, 22 nt, Human
uucacaggcuuggagguggggg

SEQ ID NO: 1086983 - RNA, 22 nt, Human
aaaauacuacugucuucuuccc

SEQ ID NO: 1086984 - RNA, 22 nt, Human
agccagugcaacagcagugaag

SEQ ID NO: 1086985 - RNA, 23 nt, Human
agugaucuguguuugaagaaugc

SEQ ID NO: 1086986 - RNA, 22 nt, Human
gaagagcugugauucaggcuua

SEQ ID NO: 1086987 - RNA, 22 nt, Human
cuggcaggucucgcugacgugu

SEQ ID NO: 1086988 - RNA, 22 nt, Human
guggcugcaucggggugaccag

SEQ ID NO: 1086989 - RNA, 22 nt, Human
caggccugucugcacaugaggc

SEQ ID NO: 1086990 - RNA, 22 nt, Human
cuggccaggcucucacgugguc

SEQ ID NO: 1086991 - RNA, 22 nt, Human
aaaggccaugguuggaguguuu

SEQ ID NO: 1086992 - RNA, 17 nt, Human
gcugcagcgguaggcag

SEQ ID NO: 1086993 - RNA, 22 nt, Human
uuuuaguuuggauuucuaaagc

SEQ ID NO: 1086994 - RNA, 22 nt, Human
agaugaaaauacgugacuuuaa

SEQ ID NO: 1086995 - RNA, 22 nt, Human
agcucugcuucuugggaagaug

SEQ ID NO: 1086996 - RNA, 22 nt, Human
ccagaugggcuuuagcaaauga

SEQ ID NO: 1086997 - RNA, 22 nt, Human
aggcagaggagaaugaucuucc

SEQ ID NO: 1086998 - RNA, 22 nt, Human
gagagaagaauguuccgaggcc

SEQ ID NO: 1086999 - RNA, 22 nt, Human
acccugagggguauagcagaag

SEQ ID NO: 1087000 - RNA, 22 nt, Human
uaggauuucucuuuuugcaacu

SEQ ID NO: 1087001 - RNA, 16 nt, Human
ccaggaacacacagcu

SEQ ID NO: 1087002 - RNA, 22 nt, Human
uucaaauuaccacauuugcuua

SEQ ID NO: 1087003 - RNA, 22 nt, Human
aaugacuuugaaauauuugagu

SEQ ID NO: 1087004 - RNA, 21 nt, Human
gcagcaguguucuagaauacu

SEQ ID NO: 1087005 - RNA, 22 nt, Human
aaacagugacugguacauaaua

SEQ ID NO: 1087006 - RNA, 22 nt, Human
ccugagggcgccgagcucccag

SEQ ID NO: 1087007 - RNA, 22 nt, Human
ucagggaaauagcagggcugaa

SEQ ID NO: 1087008 - RNA, 22 nt, Human
ucaaaaauggucuuugagcugc

SEQ ID NO: 1087009 - RNA, 17 nt, Human
aaaauucuguaaagagg

SEQ ID NO: 1087010 - RNA, 22 nt, Human
uggcagucuuguaggcaucucc

SEQ ID NO: 1087011 - RNA, 22 nt, Human
ggccugugucggccccggguuc

SEQ ID NO: 1087012 - RNA, 22 nt, Human
uaaacauggauucugaucacag

SEQ ID NO: 1087013 - RNA, 22 nt, Human
uugcuaaaaauggaauuauagg

SEQ ID NO: 1087014 - RNA, 22 nt, Human
uccucuugggaauaccuuucua

SEQ ID NO: 1087015 - RNA, 22 nt, Human
gcuccaggagagggaagcagau

SEQ ID NO: 1087016 - RNA, 22 nt, Human
cucugcugucucagaugggcca

SEQ ID NO: 1087017 - RNA, 22 nt, Human
cugggcucuguguuucaguuuc

SEQ ID NO: 1087018 - RNA, 22 nt, Human
aaugggaagccagaagacaagg

SEQ ID NO: 1087019 - RNA, 21 nt, Human
gcagcagaggcuugacagaca

SEQ ID NO: 1087020 - RNA, 22 nt, Human
uuucugacugguguauaauagg

SEQ ID NO: 1087021 - RNA, 22 nt, Human
uaaaguguuguacaaauguaug

SEQ ID NO: 1087022 - RNA, 22 nt, Human
uuucuuucucguaaacuuaguu

SEQ ID NO: 1087023 - RNA, 22 nt, Human
uuuaauagggcccaaugagacu

SEQ ID NO: 1087024 - RNA, 22 nt, Human
cuucacagucuuuauuuccucc

SEQ ID NO: 1087025 - RNA, 22 nt, Human
aauaauaagauacuaagggagu

SEQ ID NO: 1087026 - RNA, 22 nt, Human
agcuggagcuucaagcagguaa

SEQ ID NO: 1087027 - RNA, 20 nt, Human
uacaaauuuuccauguuucc

SEQ ID NO: 1087028 - RNA, 22 nt, Human
acccucagacagcuguggccag

SEQ ID NO: 1087029 - RNA, 22 nt, Human
aggagguguugauagaagguuu

SEQ ID NO: 1087030 - RNA, 22 nt, Human
aucagcuggaacaagugucuga

SEQ ID NO: 1087031 - RNA, 18 nt, Human
uaggaaccacuugcagag

SEQ ID NO: 1087032 - RNA, 22 nt, Human
agacaucuugcacacauauacu

SEQ ID NO: 1087033 - RNA, 22 nt, Human
ugcuuugggucucucuaguuuc

SEQ ID NO: 1087034 - RNA, 22 nt, Human
aucaaaaugcuccagugauggu

SEQ ID NO: 1087035 - RNA, 22 nt, Human
ucuucucaaaaaauguaggugg

SEQ ID NO: 1087036 - RNA, 22 nt, Human
ugaaggccagcagagugaaggc

SEQ ID NO: 1087037 - RNA, 22 nt, Human
cagcuguuacucugaguaaaug

SEQ ID NO: 1087038 - RNA, 22 nt, Human
cagggcagaaggcacucuacuc

SEQ ID NO: 1087039 - RNA, 22 nt, Human
uauuuuacaugauccagaguug

SEQ ID NO: 1087040 - RNA, 22 nt, Human
gaagaaucugaggacagucauu

SEQ ID NO: 1087041 - RNA, 22 nt, Human
gaggcgagaagcuggagauggu

SEQ ID NO: 1087042 - RNA, 22 nt, Human
cuuucaaugugccugccuuggg

SEQ ID NO: 1087043 - RNA, 22 nt, Human
ggcaggugcaccugagccaucu

SEQ ID NO: 1087044 - RNA, 22 nt, Human
ugcaggugaaaauuaugaggau

SEQ ID NO: 1087045 - RNA, 22 nt, Human
guggcagcaaaauccugcauuc

SEQ ID NO: 1087046 - RNA, 22 nt, Human
gaggcagagacuccaccuucag

SEQ ID NO: 1087047 - RNA, 22 nt, Human
gagcuggcaggaggcuccccga

SEQ ID NO: 1087048 - RNA, 23 nt, Human
cccuggccuuggggcacaggcug

SEQ ID NO: 1087049 - RNA, 20 nt, Human
cagcugccuggcucugggau

SEQ ID NO: 1087050 - RNA, 22 nt, Human
cugaggagagaucacguggugu

SEQ ID NO: 1087051 - RNA, 22 nt, Human
uagcagagguaaguguggcaau

SEQ ID NO: 1087052 - RNA, 22 nt, Human
uacuuuucuuugucaugcaucu

SEQ ID NO: 1087053 - RNA, 22 nt, Human
agagcugggugguggugacuca

SEQ ID NO: 1087054 - RNA, 22 nt, Human
caggagacaaguuagcagcuga

SEQ ID NO: 1087055 - RNA, 23 nt, Human
uuucaacuccugccauuauuucu

SEQ ID NO: 1087056 - RNA, 22 nt, Human
ugagccuggccugcagagacca

SEQ ID NO: 1087057 - RNA, 22 nt, Human
aggcugagcaaagggccuuacc

SEQ ID NO: 1087058 - RNA, 22 nt, Human
agguaaugcauauaaagugcuu

SEQ ID NO: 1087059 - RNA, 22 nt, Human
agaggcugucccuugcuauucc

SEQ ID NO: 1087060 - RNA, 20 nt, Human
agaagaggauacaaccaggc

SEQ ID NO: 1087061 - RNA, 22 nt, Human
acaggugggcuuaagagucggc

SEQ ID NO: 1087062 - RNA, 22 nt, Human
ugguuccuucugcauuuucagc

SEQ ID NO: 1087063 - RNA, 22 nt, Human
aucuuguuauaagagauaaugg

SEQ ID NO: 1087064 - RNA, 22 nt, Human
uuaguagagagucauguuuuua

SEQ ID NO: 1087065 - RNA, 22 nt, Human
cuccaaauauaaucacauugga

SEQ ID NO: 1087066 - RNA, 22 nt, Human
uauuuaauuugcucauugugau

SEQ ID NO: 1087067 - RNA, 22 nt, Human
uugauuuuaaaauagugacacu

SEQ ID NO: 1087068 - RNA, 16 nt, Human
uaacauuuuuaaaagg

SEQ ID NO: 1087069 - RNA, 22 nt, Human
auucaacuguaaacuuguucac

SEQ ID NO: 1087070 - RNA, 22 nt, Human
auaucuuuuagagcaagcuugu

SEQ ID NO: 1087071 - RNA, 22 nt, Human
cucugagcuccuggaagcgugc

SEQ ID NO: 1087072 - RNA, 20 nt, Human
uuucaagucagcaauucuca

SEQ ID NO: 1087073 - RNA, 22 nt, Human
ugaggccuggacucugcaugga

SEQ ID NO: 1087074 - RNA, 22 nt, Human
ggcucugcugguaagaugccuc

SEQ ID NO: 1087075 - RNA, 22 nt, Human
ugccugucuucaggagugucac

SEQ ID NO: 1087076 - RNA, 22 nt, Human
uguuuuaagggucaacugucac

SEQ ID NO: 1087077 - RNA, 23 nt, Human
gccuucagcucgggaaggcuccc

SEQ ID NO: 1087078 - RNA, 22 nt, Human
acugucuugcuaugagcuccca

SEQ ID NO: 1087079 - RNA, 22 nt, Human
uuuacuuuugguaaggucauuu

SEQ ID NO: 1087080 - RNA, 19 nt, Human
aaaagucuauucaauuaca

SEQ ID NO: 1087081 - RNA, 22 nt, Human
caggaaaaugucaauggaaagc

SEQ ID NO: 1087082 - RNA, 22 nt, Human
agccaggggagucagcugcugg

SEQ ID NO: 1087083 - RNA, 22 nt, Human
uucuuucagaacacaagugauu

SEQ ID NO: 1087084 - RNA, 22 nt, Human
ccuugaggaguccauaguauca

SEQ ID NO: 1087085 - RNA, 22 nt, Human
aggcugggaaaccugaaguugu

SEQ ID NO: 1087086 - RNA, 22 nt, Human
aggcugugcacagggcaccugc

SEQ ID NO: 1087087 - RNA, 22 nt, Human
ccugggagcuguggaaaggcug

SEQ ID NO: 1087088 - RNA, 22 nt, Human
ggaagccaagguggccucuauu

SEQ ID NO: 1087089 - RNA, 23 nt, Human
acagaauaccauugacuaggugu

SEQ ID NO: 1087090 - RNA, 22 nt, Human
agccaacuaggagauuaaggua

SEQ ID NO: 1087091 - RNA, 22 nt, Human
cuacacaguucugccuaauggc

SEQ ID NO: 1087092 - RNA, 22 nt, Human
cauuaaaauaucucaugguguu

SEQ ID NO: 1087093 - RNA, 22 nt, Human
uccugaaaauaauuucacaaga

SEQ ID NO: 1087094 - RNA, 22 nt, Human
augggaggaugcucgggugcuc

SEQ ID NO: 1087095 - RNA, 22 nt, Human
agaaucaaagagaaauacuuug

SEQ ID NO: 1087096 - RNA, 22 nt, Human
aacaaagcaccacugagucagu

SEQ ID NO: 1087097 - RNA, 23 nt, Human
uucaaaacuggaaaaucagaugc

SEQ ID NO: 1087098 - RNA, 22 nt, Human
caggggaguuuuaugcaacaga

SEQ ID NO: 1087099 - RNA, 22 nt, Human
ccagagccccugagcuucccug

SEQ ID NO: 1087100 - RNA, 22 nt, Human
cccaggaacagcacagaacagc

SEQ ID NO: 1087101 - RNA, 22 nt, Human
gaggcacagagcccuaggagcu

SEQ ID NO: 1087102 - RNA, 22 nt, Human
gccugcugaaccucaugcaguc

SEQ ID NO: 1087103 - RNA, 22 nt, Human
ccccuuccgucucuugaguguc

SEQ ID NO: 1087104 - RNA, 22 nt, Human
ggcuucugaaaucucugugcgu

SEQ ID NO: 1087105 - RNA, 17 nt, Human
ucagcaggggccaagcu

SEQ ID NO: 1087106 - RNA, 20 nt, Human
ggcaggcaggagguuuccag

SEQ ID NO: 1087107 - RNA, 22 nt, Human
auucucagaucuuagaggaaua

SEQ ID NO: 1087108 - RNA, 19 nt, Human
cucugcuugguccauaugc

SEQ ID NO: 1087109 - RNA, 18 nt, Human
cccacggugcuguagggc

SEQ ID NO: 1087110 - RNA, 20 nt, Human
auucacaggcacaaaacccu

SEQ ID NO: 1087111 - RNA, 22 nt, Human
ucuuccucaugaauucucguau

SEQ ID NO: 1087112 - RNA, 22 nt, Human
aagauuguuuuggaugcuaacu

SEQ ID NO: 1087113 - RNA, 22 nt, Human
ucucuucuaacacuagaaauuc

SEQ ID NO: 1087114 - RNA, 22 nt, Human
uaacauguuaagaaauuagaua

SEQ ID NO: 1087115 - RNA, 21 nt, Human
cuuugcaucuauauguucuca

SEQ ID NO: 1087116 - RNA, 22 nt, Human
ggagcagccacgucucagggca

SEQ ID NO: 1087117 - RNA, 22 nt, Human
agaguguuauuugcucuguauu

SEQ ID NO: 1087118 - RNA, 22 nt, Human
aaugcaauaccuuuuuaugcug

SEQ ID NO: 1087119 - RNA, 22 nt, Human
acauacaaauagagcuguagua

SEQ ID NO: 1087120 - RNA, 22 nt, Human
ggcccagaauacuuuguaaaau

SEQ ID NO: 1087121 - RNA, 22 nt, Human
gggcuaggcuuggccagcacug

SEQ ID NO: 1087122 - RNA, 18 nt, Human
cgaggcaggcggaucacg

SEQ ID NO: 1087123 - RNA, 22 nt, Human
gcugccucccccauggcuggaa

SEQ ID NO: 1087124 - RNA, 22 nt, Human
uaccaaaaagugagccccagag

SEQ ID NO: 1087125 - RNA, 22 nt, Human
aauucagcaaaaagauacagga

SEQ ID NO: 1087126 - RNA, 22 nt, Human
ccuuuuauacucuguccucugg

SEQ ID NO: 1087127 - RNA, 22 nt, Human
ccugggcaaauuauguuacuca

SEQ ID NO: 1087128 - RNA, 22 nt, Human
aggugcuugguaaauauuuuag

SEQ ID NO: 1087129 - RNA, 22 nt, Human
cccagcacaggcaauuccauac

SEQ ID NO: 1087130 - RNA, 22 nt, Human
agccaccuucuccaaggccuag

SEQ ID NO: 1087131 - RNA, 22 nt, Human
caagauauguccuguuacuaag

SEQ ID NO: 1087132 - RNA, 22 nt, Human
gaaacugugaucguguucuggg

SEQ ID NO: 1087133 - RNA, 22 nt, Human
cuucucagcaugguuacuguga

SEQ ID NO: 1087134 - RNA, 22 nt, Human
uacauguaggugacauuuuaau

SEQ ID NO: 1087135 - RNA, 22 nt, Human
ucuucagcagggccucucugag

SEQ ID NO: 1087136 - RNA, 22 nt, Human
ucaggcugccuaucagacugug

SEQ ID NO: 1087137 - RNA, 22 nt, Human
acugggcugccugguucuucua

SEQ ID NO: 1087138 - RNA, 22 nt, Human
gcugccugucugcugacccagg

SEQ ID NO: 1087139 - RNA, 22 nt, Human
acugagccucucuucccaccuc

SEQ ID NO: 1087140 - RNA, 23 nt, Human
caugauauuuaucuucccugggu

SEQ ID NO: 1087141 - RNA, 22 nt, Human
cugagcccaggcgggagcugag

SEQ ID NO: 1087142 - RNA, 22 nt, Human
aauaaaguguauucuuugucau

SEQ ID NO: 1087143 - RNA, 22 nt, Human
ucccaggguuacagccagggca

SEQ ID NO: 1087144 - RNA, 20 nt, Human
gcacugaagguuccagggga

SEQ ID NO: 1087145 - RNA, 22 nt, Human
gccucugcugcaagccugguug

SEQ ID NO: 1087146 - RNA, 22 nt, Human
cagcugugcuagaagccacgaa

SEQ ID NO: 1087147 - RNA, 22 nt, Human
gcaggaugggagcuucacucug

SEQ ID NO: 1087148 - RNA, 22 nt, Human
cagcugugagcagccaguugcc

SEQ ID NO: 1087149 - RNA, 22 nt, Human
cuucauuuggagaacugugcuu

SEQ ID NO: 1087150 - RNA, 22 nt, Human
aauguauuugauguauuagccu

SEQ ID NO: 1087151 - RNA, 22 nt, Human
cuuucacacacauacauuugga

SEQ ID NO: 1087152 - RNA, 22 nt, Human
cuucuucagaggccagccucug

SEQ ID NO: 1087153 - RNA, 20 nt, Human
accaggaaucuuuucugagc

SEQ ID NO: 1087154 - RNA, 22 nt, Human
uggagcugguaaacagugacau

SEQ ID NO: 1087155 - RNA, 22 nt, Human
ugaggccugucauugucuuguu

SEQ ID NO: 1087156 - RNA, 22 nt, Human
cauacauugcucauucaguauc

SEQ ID NO: 1087157 - RNA, 22 nt, Human
gauuuuaucgucauccuucugg

SEQ ID NO: 1087158 - RNA, 22 nt, Human
agaaaugcauuagcacauauag

SEQ ID NO: 1087159 - RNA, 22 nt, Human
ggcuccagaggccuuaccugca

SEQ ID NO: 1087160 - RNA, 22 nt, Human
gcaaacaagcugccugaagauu

SEQ ID NO: 1087161 - RNA, 22 nt, Human
caagacaagaucuaagcaugcu

SEQ ID NO: 1087162 - RNA, 18 nt, Human
aggaaagaaaggcaggug

SEQ ID NO: 1087163 - RNA, 22 nt, Human
cugaagcaggaacagcgagauu

SEQ ID NO: 1087164 - RNA, 22 nt, Human
acacaggagauauguaauggcu

SEQ ID NO: 1087165 - RNA, 22 nt, Human
ugcuucuguuacauaccagaac

SEQ ID NO: 1087166 - RNA, 22 nt, Human
aggcagcagacuguuaaucaga

SEQ ID NO: 1087167 - RNA, 22 nt, Human
gggcugaggaacauauuuuguu

SEQ ID NO: 1087168 - RNA, 22 nt, Human
ccuggcugcuuccucugccaug

SEQ ID NO: 1087169 - RNA, 22 nt, Human
agugguucaguuuuggucuggc

SEQ ID NO: 1087170 - RNA, 21 nt, Human
ccauaauuuuguuucagaagu

SEQ ID NO: 1087171 - RNA, 22 nt, Human
agaaaucaauaucuauauguug

SEQ ID NO: 1087172 - RNA, 22 nt, Human
acaggaaccaggcaggucgauu

SEQ ID NO: 1087173 - RNA, 22 nt, Human
uuccuguauuuugcgaauuuuc

SEQ ID NO: 1087174 - RNA, 22 nt, Human
gcugggccgaccugggcugcag

SEQ ID NO: 1087175 - RNA, 22 nt, Human
aaauuuuguauucuaguucuag

SEQ ID NO: 1087176 - RNA, 22 nt, Human
cagugaggcucugcugagcggu

SEQ ID NO: 1087177 - RNA, 22 nt, Human
gugcuuuuaaaggcaauuagua

SEQ ID NO: 1087178 - RNA, 22 nt, Human
aaagcacagggugcuagagagu

SEQ ID NO: 1087179 - RNA, 22 nt, Human
cucugagagagcuggugagcac

SEQ ID NO: 1087180 - RNA, 22 nt, Human
auuuaauuuucucaacagugcu

SEQ ID NO: 1087181 - RNA, 22 nt, Human
cccucuggcucuucucaggccg

SEQ ID NO: 1087182 - RNA, 22 nt, Human
cuucccacuaguaucacagagc

SEQ ID NO: 1087183 - RNA, 22 nt, Human
aaaugcagaaugauuucaucua

SEQ ID NO: 1087184 - RNA, 22 nt, Human
augcaacaaaugcuacgaaucg

SEQ ID NO: 1087185 - RNA, 22 nt, Human
ugcugccacaaauucagcugcc

SEQ ID NO: 1087186 - RNA, 22 nt, Human
gcaaagucucaagacccaagug

SEQ ID NO: 1087187 - RNA, 22 nt, Human
ugaggcaaggcugaaugaaggc

SEQ ID NO: 1087188 - RNA, 22 nt, Human
aaaucucuggcagaaauaaacu

SEQ ID NO: 1087189 - RNA, 19 nt, Human
aggugagugugggaaaggg

SEQ ID NO: 1087190 - RNA, 22 nt, Human
ucagggcacauucugcaguggc

SEQ ID NO: 1087191 - RNA, 22 nt, Human
ugggcagggagcuggaaccaca

SEQ ID NO: 1087192 - RNA, 22 nt, Human
aacagacagaaaaaugugaucu

SEQ ID NO: 1087193 - RNA, 22 nt, Human
aggugaguccugggcacaggua

SEQ ID NO: 1087194 - RNA, 22 nt, Human
acucugagcaucccaagucuua

SEQ ID NO: 1087195 - RNA, 22 nt, Human
uucaaagaguugggugucuggg

SEQ ID NO: 1087196 - RNA, 22 nt, Human
aaaggccaauaaagacaagcug

SEQ ID NO: 1087197 - RNA, 22 nt, Human
agaaagcuuaugaaugggcaag

SEQ ID NO: 1087198 - RNA, 22 nt, Human
uaacauugaguccacuaaacag

SEQ ID NO: 1087199 - RNA, 22 nt, Human
agaucacaguggcaacucccuu

SEQ ID NO: 1087200 - RNA, 22 nt, Human
uggugagauguauggaggguug

SEQ ID NO: 1087201 - RNA, 22 nt, Human
uggcaugggcaaaccagggaaa

SEQ ID NO: 1087202 - RNA, 22 nt, Human
aaaccuuugugugucugugccu

SEQ ID NO: 1087203 - RNA, 22 nt, Human
ucaagucauuugacuguguguu

SEQ ID NO: 1087204 - RNA, 22 nt, Human
ggccucugguucacagggagga

SEQ ID NO: 1087205 - RNA, 22 nt, Human
ucucaagcuuguugguauguuu

SEQ ID NO: 1087206 - RNA, 22 nt, Human
uggagcagaggaagaaggcuuu

SEQ ID NO: 1087207 - RNA, 17 nt, Human
gcucccugaggacagcu

SEQ ID NO: 1087208 - RNA, 22 nt, Human
ugaggccagucucaucacaggc

SEQ ID NO: 1087209 - RNA, 22 nt, Human
cugggacuuuacccuguggccc

SEQ ID NO: 1087210 - RNA, 22 nt, Human
uacaagauaagaauuggcaagg

SEQ ID NO: 1087211 - RNA, 22 nt, Human
ccagggcuccauugcucauccu

SEQ ID NO: 1087212 - RNA, 22 nt, Human
agccuccaguagcugaagagac

SEQ ID NO: 1087213 - RNA, 21 nt, Human
gggcucaguggaaaagagugu

SEQ ID NO: 1087214 - RNA, 20 nt, Human
gcccaagguccagaaggggg

SEQ ID NO: 1087215 - RNA, 22 nt, Human
cugagcccauugggugcuguua

SEQ ID NO: 1087216 - RNA, 22 nt, Human
gugaauuucugacuaaaagugc

SEQ ID NO: 1087217 - RNA, 22 nt, Human
cagggacugagauccagacugu

SEQ ID NO: 1087218 - RNA, 22 nt, Human
acuggggaauggaacugggaau

SEQ ID NO: 1087219 - RNA, 22 nt, Human
cagccagggagggcaaaugaga

SEQ ID NO: 1087220 - RNA, 22 nt, Human
ccagaaagaaugaacugaaccc

SEQ ID NO: 1087221 - RNA, 22 nt, Human
ugcuggggauccguaccaaccc

SEQ ID NO: 1087222 - RNA, 22 nt, Human
aagauacauuuucuucagagaa

SEQ ID NO: 1087223 - RNA, 22 nt, Human
ugaggcaggaggauugcaggau

SEQ ID NO: 1087224 - RNA, 22 nt, Human
uaauaauuggcaauguugagca

SEQ ID NO: 1087225 - RNA, 22 nt, Human
gagggcugaagauuguggcccc

SEQ ID NO: 1087226 - RNA, 22 nt, Human
guuuacaugcaugcaagaauga

SEQ ID NO: 1087227 - RNA, 22 nt, Human
cuuauggccugcccacaguagu

SEQ ID NO: 1087228 - RNA, 22 nt, Human
cccagagccucauucuguuggg

SEQ ID NO: 1087229 - RNA, 22 nt, Human
gagggacagcuaaagagaaauu

SEQ ID NO: 1087230 - RNA, 22 nt, Human
uuggagcccugaggaucuggau

SEQ ID NO: 1087231 - RNA, 19 nt, Human
uaaagcacauagcaaaagu

SEQ ID NO: 1087232 - RNA, 22 nt, Human
ugcucccaaacgaccuacugug

SEQ ID NO: 1087233 - RNA, 20 nt, Human
caguuaaugacuaggcauca

SEQ ID NO: 1087234 - RNA, 22 nt, Human
uauagaagagacaugugcauag

SEQ ID NO: 1087235 - RNA, 22 nt, Human
augagacacaugugacuucuuu

SEQ ID NO: 1087236 - RNA, 22 nt, Human
cugggccugguagggcuugaaa

SEQ ID NO: 1087237 - RNA, 22 nt, Human
gccucugcaugcucagcaccca

SEQ ID NO: 1087238 - RNA, 23 nt, Human
aggcacugaaugugucagugagu

SEQ ID NO: 1087239 - RNA, 22 nt, Human
agucucugagguucagaugccu

SEQ ID NO: 1087240 - RNA, 22 nt, Human
aaugaaaugaagauaugaucag

SEQ ID NO: 1087241 - RNA, 22 nt, Human
ggcuucuggugggagcaugacu

SEQ ID NO: 1087242 - RNA, 22 nt, Human
uccaggaacugaagccaggugu

SEQ ID NO: 1087243 - RNA, 20 nt, Human
agauguuuugaagucuugga

SEQ ID NO: 1087244 - RNA, 22 nt, Human
gccucccuguagaggccagccu

SEQ ID NO: 1087245 - RNA, 22 nt, Human
ucucugagaagcugaggcuggg

SEQ ID NO: 1087246 - RNA, 22 nt, Human
uaacauucccuuugugccaagg

SEQ ID NO: 1087247 - RNA, 22 nt, Human
uucacugaauuaaaaagaguau

SEQ ID NO: 1087248 - RNA, 22 nt, Human
ggcagaggugaaguucacaagg

SEQ ID NO: 1087249 - RNA, 22 nt, Human
aaggagaagucuguugagauug

SEQ ID NO: 1087250 - RNA, 22 nt, Human
gcaggccugacuguagggggca

SEQ ID NO: 1087251 - RNA, 22 nt, Human
aagccagggucaggggccuccu

SEQ ID NO: 1087252 - RNA, 22 nt, Human
ucaggaagucucaauuagcuac

SEQ ID NO: 1087253 - RNA, 22 nt, Human
uuuauaaacaguaccacggugc

SEQ ID NO: 1087254 - RNA, 22 nt, Human
cugugccuuggcgcugugccac

SEQ ID NO: 1087255 - RNA, 22 nt, Human
auuuucauuuugcagggugaga

SEQ ID NO: 1087256 - RNA, 22 nt, Human
agguccaguugccagaauggcc

SEQ ID NO: 1087257 - RNA, 22 nt, Human
agcugugguucugggcagcgac

SEQ ID NO: 1087258 - RNA, 22 nt, Human
cccaccccuggacaggugagug

SEQ ID NO: 1087259 - RNA, 22 nt, Human
uaacaucuugcaguagcagaac

SEQ ID NO: 1087260 - RNA, 22 nt, Human
gagaagaacuugggcaaaguca

SEQ ID NO: 1087261 - RNA, 22 nt, Human
cugggcucuucucacccuguuu

SEQ ID NO: 1087262 - RNA, 22 nt, Human
ucuguaaaacaauauuguauuc

SEQ ID NO: 1087263 - RNA, 22 nt, Human
gugucaugcacacucaguguug

SEQ ID NO: 1087264 - RNA, 22 nt, Human
cagaaagugauuugcuauucca

SEQ ID NO: 1087265 - RNA, 22 nt, Human
gccucacugcagccccaggaag

SEQ ID NO: 1087266 - RNA, 22 nt, Human
uggcccugccacucacugcuga

SEQ ID NO: 1087267 - RNA, 22 nt, Human
gggcugagacgauggggucuuc

SEQ ID NO: 1087268 - RNA, 22 nt, Human
gcugccugaucauacaccaggg

SEQ ID NO: 1087269 - RNA, 22 nt, Human
agggccaguaccaggugggugg

SEQ ID NO: 1087270 - RNA, 18 nt, Human
cuuguucuucucuuggcg

SEQ ID NO: 1087271 - RNA, 22 nt, Human
uuacuuuucuauucgauaugug

SEQ ID NO: 1087272 - RNA, 22 nt, Human
acagugucugacacauuguagc

SEQ ID NO: 1087273 - RNA, 22 nt, Human
ucacagaaauaagauaguuauu

SEQ ID NO: 1087274 - RNA, 22 nt, Human
uuucacagaaagaagcuaguuu

SEQ ID NO: 1087275 - RNA, 22 nt, Human
agccauugaguuuuaugugcua

SEQ ID NO: 1087276 - RNA, 22 nt, Human
aggggugugcauccuggaggau

SEQ ID NO: 1087277 - RNA, 22 nt, Human
auuuccauguccaaaaauuagu

SEQ ID NO: 1087278 - RNA, 22 nt, Human
gacuuuaaagccugacauuuua

SEQ ID NO: 1087279 - RNA, 22 nt, Human
uuuccaaaggaggaaccaguuu

SEQ ID NO: 1087280 - RNA, 22 nt, Human
ugauuuccaugaagcugaaggc

SEQ ID NO: 1087281 - RNA, 22 nt, Human
agggcuggcuccguuaccuuga

SEQ ID NO: 1087282 - RNA, 22 nt, Human
aagcuggaacaucuugaggaag

SEQ ID NO: 1087283 - RNA, 22 nt, Human
gcuguggccuggcgcagagcug

SEQ ID NO: 1087284 - RNA, 23 nt, Human
uuugaaguugacugccuuccaga

SEQ ID NO: 1087285 - RNA, 22 nt, Human
ccaggcuuucccagccucucca

SEQ ID NO: 1087286 - RNA, 22 nt, Human
cagccaggacagggaaacuagu

SEQ ID NO: 1087287 - RNA, 22 nt, Human
uuauaugauugaagugcauaag

SEQ ID NO: 1087288 - RNA, 22 nt, Human
gggugggaucuguggagccuca

SEQ ID NO: 1087289 - RNA, 22 nt, Human
uaaggaaaauggacaucaaaca

SEQ ID NO: 1087290 - RNA, 22 nt, Human
ccgcccacacuaaauaugagcg

SEQ ID NO: 1087291 - RNA, 22 nt, Human
gaacauuuccagaaaggaacua

SEQ ID NO: 1087292 - RNA, 22 nt, Human
aaucuauucccuuucuguaaaa

SEQ ID NO: 1087293 - RNA, 22 nt, Human
uccaggaagcagcuacagaucc

SEQ ID NO: 1087294 - RNA, 22 nt, Human
cuggcccauggugagcucuggg

SEQ ID NO: 1087295 - RNA, 21 nt, Human
cuggaacaaauacuagcaaac

SEQ ID NO: 1087296 - RNA, 22 nt, Human
ugcacauucacuuagguauugu

SEQ ID NO: 1087297 - RNA, 23 nt, Human
ugaguguguucccugugagauuu

SEQ ID NO: 1087298 - RNA, 22 nt, Human
gauuucuugauaaguaguguga

SEQ ID NO: 1087299 - RNA, 22 nt, Human
gggagggaaggaggcgccgugu

SEQ ID NO: 1087300 - RNA, 22 nt, Human
cccuggagguggagguugcagg

SEQ ID NO: 1087301 - RNA, 22 nt, Human
caaagaugcugauguuggauca

SEQ ID NO: 1087302 - RNA, 22 nt, Human
cugcagggcccgccugagcccu

SEQ ID NO: 1087303 - RNA, 22 nt, Human
uaaagcacaguaugagcauugg

SEQ ID NO: 1087304 - RNA, 22 nt, Human
auauuucucucagacauggaag

SEQ ID NO: 1087305 - RNA, 22 nt, Human
ggugucuguugccuccugguua

SEQ ID NO: 1087306 - RNA, 22 nt, Human
ugacagcauuacuaauacaugu

SEQ ID NO: 1087307 - RNA, 18 nt, Human
acaucaguuaccaggcca

SEQ ID NO: 1087308 - RNA, 22 nt, Human
agggcaugugggagaggagccu

SEQ ID NO: 1087309 - RNA, 22 nt, Human
uccugccucaggcucuggagua

SEQ ID NO: 1087310 - RNA, 22 nt, Human
gggugggguucaggaaucuuca

SEQ ID NO: 1087311 - RNA, 22 nt, Human
ucucugaguucuccuccagccc

SEQ ID NO: 1087312 - RNA, 22 nt, Human
aaauucauauguugaaaugcua

SEQ ID NO: 1087313 - RNA, 19 nt, Human
caguggagauuggaggagg

SEQ ID NO: 1087314 - RNA, 19 nt, Human
gcauuucaggcauguuugc

SEQ ID NO: 1087315 - RNA, 22 nt, Human
guccuggggaauacagaagccg

SEQ ID NO: 1087316 - RNA, 21 nt, Human
gcugccugccccucgggggcu

SEQ ID NO: 1087317 - RNA, 22 nt, Human
ccuggcugcaguuuuugcagaa

SEQ ID NO: 1087318 - RNA, 22 nt, Human
gcuccugcagagauguuccaug

SEQ ID NO: 1087319 - RNA, 22 nt, Human
auguucuguuucuuaaucuuga

SEQ ID NO: 1087320 - RNA, 22 nt, Human
uuccuaaucacgaacauuauuu

SEQ ID NO: 1087321 - RNA, 22 nt, Human
cgcccagggcaggaggccgcuc

SEQ ID NO: 1087322 - RNA, 22 nt, Human
agggcucaggggccccaagcug

SEQ ID NO: 1087323 - RNA, 22 nt, Human
gaaccaaguaggauacaaggag

SEQ ID NO: 1087324 - RNA, 22 nt, Human
agggcugacaguaaaaguauga

SEQ ID NO: 1087325 - RNA, 22 nt, Human
ucugccugccagucugguccuc

SEQ ID NO: 1087326 - RNA, 22 nt, Human
cauuucaccuuagagaauuauu

SEQ ID NO: 1087327 - RNA, 22 nt, Human
ucuguccucuuugaagcugcuc

SEQ ID NO: 1087328 - RNA, 22 nt, Human
ugcaggugucuccagggcaggu

SEQ ID NO: 1087329 - RNA, 22 nt, Human
cagcccucagguccucagcagc

SEQ ID NO: 1087330 - RNA, 22 nt, Human
agccuggaauuaaggaaaugca

SEQ ID NO: 1087331 - RNA, 22 nt, Human
cccaggcagucuggcucuaaag

SEQ ID NO: 1087332 - RNA, 22 nt, Human
uuuguuaaauauuuauugagug

SEQ ID NO: 1087333 - RNA, 22 nt, Human
aaauuccauuuugugacuauuc

SEQ ID NO: 1087334 - RNA, 22 nt, Human
uggcccugucugcacacaggau

SEQ ID NO: 1087335 - RNA, 22 nt, Human
ccugcaccaggcccagcauggu

SEQ ID NO: 1087336 - RNA, 22 nt, Human
aaggugguugcaauuaccauaa

SEQ ID NO: 1087337 - RNA, 22 nt, Human
acaguucuuaaaacuugaauua

SEQ ID NO: 1087338 - RNA, 22 nt, Human
uuuccucugaugcugacuugga

SEQ ID NO: 1087339 - RNA, 22 nt, Human
uugucuguaaagacggccacca

SEQ ID NO: 1087340 - RNA, 22 nt, Human
acagggucaagggugcuacaag

SEQ ID NO: 1087341 - RNA, 22 nt, Human
aucucaacuaagccuaacuuuu

SEQ ID NO: 1087342 - RNA, 22 nt, Human
aagcugaggcccauggcaaggu

SEQ ID NO: 1087343 - RNA, 22 nt, Human
cggggagaacacuguguccuuc

SEQ ID NO: 1087344 - RNA, 22 nt, Human
uacugaaaaagaauccagaccu

SEQ ID NO: 1087345 - RNA, 22 nt, Human
uugcauugaugucuauacgcug

SEQ ID NO: 1087346 - RNA, 22 nt, Human
cuuaagauuugagauaccuaau

SEQ ID NO: 1087347 - RNA, 22 nt, Human
ggucccaggaagugcggcggcg

SEQ ID NO: 1087348 - RNA, 22 nt, Human
cuguggcuaggaagcuguggga

SEQ ID NO: 1087349 - RNA, 22 nt, Human
gcagcuaguccaguuauguggc

SEQ ID NO: 1087350 - RNA, 20 nt, Human
acugcuucuuucucugaccu

SEQ ID NO: 1087351 - RNA, 22 nt, Human
gccugugaccccuccaucugcu

SEQ ID NO: 1087352 - RNA, 22 nt, Human
gacaggugcuaagggaccuggc

SEQ ID NO: 1087353 - RNA, 22 nt, Human
cuggggggagcugcguccagca

SEQ ID NO: 1087354 - RNA, 22 nt, Human
uacugaaacucuuguaaauauc

SEQ ID NO: 1087355 - RNA, 22 nt, Human
uggaguuccuuugaaaggcucu

SEQ ID NO: 1087356 - RNA, 22 nt, Human
ccugggucuugguucaugcucu

SEQ ID NO: 1087357 - RNA, 22 nt, Human
cacagcuggugcacuagcucug

SEQ ID NO: 1087358 - RNA, 22 nt, Human
gggccucagcucugcucugcaa

SEQ ID NO: 1087359 - RNA, 22 nt, Human
cuguuauucaagacaaaggcag

SEQ ID NO: 1087360 - RNA, 22 nt, Human
cugggcucagaugagaggaagg

SEQ ID NO: 1087361 - RNA, 22 nt, Human
aguucuuugucaucucuggagu

SEQ ID NO: 1087362 - RNA, 22 nt, Human
aaggcucucugauggcagcagu

SEQ ID NO: 1087363 - RNA, 22 nt, Human
cuuccuggccauugccauggca

SEQ ID NO: 1087364 - RNA, 22 nt, Human
gguguccuugcagaaggcggcg

SEQ ID NO: 1087365 - RNA, 22 nt, Human
ucaggaaggcacuugguguguu

SEQ ID NO: 1087366 - RNA, 22 nt, Human
uccccacacagauacagaguag

SEQ ID NO: 1087367 - RNA, 22 nt, Human
auauaacucuuguucuuauagu

SEQ ID NO: 1087368 - RNA, 22 nt, Human
cagcugagcucccaggccauca

SEQ ID NO: 1087369 - RNA, 22 nt, Human
augcuguggccagaguucaacu

SEQ ID NO: 1087370 - RNA, 22 nt, Human
uucucucauucaaauuaaagug

SEQ ID NO: 1087371 - RNA, 22 nt, Human
aggcagucuaucucuggagccu

SEQ ID NO: 1087372 - RNA, 22 nt, Human
gaggggaaagugugaggcugcg

SEQ ID NO: 1087373 - RNA, 22 nt, Human
agcagcuaaguagcgcaguuaa

SEQ ID NO: 1087374 - RNA, 21 nt, Human
ccaggcuccugaggcugguca

SEQ ID NO: 1087375 - RNA, 21 nt, Human
auauuucucauaagguuaugg

SEQ ID NO: 1087376 - RNA, 22 nt, Human
gaagcagccacggggagacaga

SEQ ID NO: 1087377 - RNA, 22 nt, Human
auuuucuagauagaugaugcau

SEQ ID NO: 1087378 - RNA, 22 nt, Human
aauagacuuuguauaauuuccc

SEQ ID NO: 1087379 - RNA, 17 nt, Human
cugaggcccagggccca

SEQ ID NO: 1087380 - RNA, 22 nt, Human
agacaacaccaaaugcuagugu

SEQ ID NO: 1087381 - RNA, 22 nt, Human
ugaguccaauaggggccuggaa

SEQ ID NO: 1087382 - RNA, 22 nt, Human
uagaaacaagggagaggauucu

SEQ ID NO: 1087383 - RNA, 22 nt, Human
cagggaguuuuuguuccucuag

SEQ ID NO: 1087384 - RNA, 22 nt, Human
uagugaaauuuaugcacagcua

SEQ ID NO: 1087385 - RNA, 22 nt, Human
uaguauuuauaaucaugcuuaa

SEQ ID NO: 1087386 - RNA, 23 nt, Human
gacacaggagcacccagcugagc

SEQ ID NO: 1087387 - RNA, 23 nt, Human
uguaaaccauuuugcaucccaug

SEQ ID NO: 1087388 - RNA, 22 nt, Human
uggaggcaccacuggcugcccg

SEQ ID NO: 1087389 - RNA, 22 nt, Human
agcuugccucuuaaucaccuca

SEQ ID NO: 1087390 - RNA, 22 nt, Human
ugucacauguguggcauuuuuc

SEQ ID NO: 1087391 - RNA, 22 nt, Human
caccugccucauuugucccugc

SEQ ID NO: 1087392 - RNA, 22 nt, Human
agaagugccauacuguggucca

SEQ ID NO: 1087393 - RNA, 22 nt, Human
aaugaauggguuuaauauuuua

SEQ ID NO: 1087394 - RNA, 22 nt, Human
uaaagcaguguugggucggacg

SEQ ID NO: 1087395 - RNA, 23 nt, Human
uugcaaauuucaguuaguucaug

SEQ ID NO: 1087396 - RNA, 22 nt, Human
ggccucgagcaauacucccauc

SEQ ID NO: 1087397 - RNA, 22 nt, Human
gcagggcagcugaagcuaggug

SEQ ID NO: 1087398 - RNA, 22 nt, Human
guccuuugaaggcaaaaggaga

SEQ ID NO: 1087399 - RNA, 18 nt, Human
ggagagugagaucaaaca

SEQ ID NO: 1087400 - RNA, 22 nt, Human
ggacagacagugugagugaggc

SEQ ID NO: 1087401 - RNA, 22 nt, Human
cuuagcaugugguguccuugua

SEQ ID NO: 1087402 - RNA, 22 nt, Human
aauguguuuucacugaagauuc

SEQ ID NO: 1087403 - RNA, 22 nt, Human
gugggcaaggucccugccagcu

SEQ ID NO: 1087404 - RNA, 22 nt, Human
uucagcuaaggaguuucacugu

SEQ ID NO: 1087405 - RNA, 22 nt, Human
gcucccagguucuugggccuug

SEQ ID NO: 1087406 - RNA, 18 nt, Human
gugcugugggcaguggcc

SEQ ID NO: 1087407 - RNA, 22 nt, Human
aggaacugauuuauaacuuuag

SEQ ID NO: 1087408 - RNA, 22 nt, Human
caguggcacccacgggcugggc

SEQ ID NO: 1087409 - RNA, 22 nt, Human
auggaaaaggcugauuucauua

SEQ ID NO: 1087410 - RNA, 21 nt, Human
ugaggcucuguugugccugca

SEQ ID NO: 1087411 - RNA, 22 nt, Human
gaggugucccgcaguccccaag

SEQ ID NO: 1087412 - RNA, 22 nt, Human
auaauuuacuaagcucuaccuu

SEQ ID NO: 1087413 - RNA, 22 nt, Human
agcagggcuugccgcuuguccu

SEQ ID NO: 1087414 - RNA, 22 nt, Human
ugcucugguaacucacuuccau

SEQ ID NO: 1087415 - RNA, 22 nt, Human
cuggcaggcaaauuggugggag

SEQ ID NO: 1087416 - RNA, 22 nt, Human
auuuucucucaaaccuuaaaau

SEQ ID NO: 1087417 - RNA, 22 nt, Human
aguggacucuucccagugcuug

SEQ ID NO: 1087418 - RNA, 22 nt, Human
cuggagccggaccagggacggu

SEQ ID NO: 1087419 - RNA, 22 nt, Human
aaguaacaggugcuuaguuuau

SEQ ID NO: 1087420 - RNA, 22 nt, Human
gagcucauccccaugguccguc

SEQ ID NO: 1087421 - RNA, 21 nt, Human
gggccacaccuucugcagacc

SEQ ID NO: 1087422 - RNA, 19 nt, Human
agcagagcccugaagaucc

SEQ ID NO: 1087423 - RNA, 22 nt, Human
cuguugucuucauugucauauc

SEQ ID NO: 1087424 - RNA, 22 nt, Human
cuggcuccauccuugagcucug

SEQ ID NO: 1087425 - RNA, 22 nt, Human
uauacugagagcaaauacauuc

SEQ ID NO: 1087426 - RNA, 22 nt, Human
caagucauuacugaaaugucac

SEQ ID NO: 1087427 - RNA, 22 nt, Human
ggaagagagaucccauagaugu

SEQ ID NO: 1087428 - RNA, 22 nt, Human
gcagaugcuuggcacugacagu

SEQ ID NO: 1087429 - RNA, 22 nt, Human
auuuguugaauaaauuaguauu

SEQ ID NO: 1087430 - RNA, 22 nt, Human
gcaggcagagucaauuugaucc

SEQ ID NO: 1087431 - RNA, 18 nt, Human
cucugcuaaugggcagcu

SEQ ID NO: 1087432 - RNA, 22 nt, Human
ggcucugcaugugagugggugg

SEQ ID NO: 1087433 - RNA, 22 nt, Human
ugaauccagagcuauuucgucc

SEQ ID NO: 1087434 - RNA, 22 nt, Human
aauaagaacuccauuuacucgu

SEQ ID NO: 1087435 - RNA, 22 nt, Human
aaagccagcaaggugaguuuca

SEQ ID NO: 1087436 - RNA, 22 nt, Human
cugucuccuccacugcauggga

SEQ ID NO: 1087437 - RNA, 22 nt, Human
uugaucucuuguguaugguaga

SEQ ID NO: 1087438 - RNA, 17 nt, Human
ucaaaguauucugaugc

SEQ ID NO: 1087439 - RNA, 20 nt, Human
ccucaguguccuggacuggg

SEQ ID NO: 1087440 - RNA, 22 nt, Human
acugggaagacaagaaagauag

SEQ ID NO: 1087441 - RNA, 22 nt, Human
auuaaugacgcagauaauaauu

SEQ ID NO: 1087442 - RNA, 22 nt, Human
acaacacagcaaaaccccaucu

SEQ ID NO: 1087443 - RNA, 21 nt, Human
auaugaguuucagauguugcu

SEQ ID NO: 1087444 - RNA, 20 nt, Human
aggggccuggaacaggccuu

SEQ ID NO: 1087445 - RNA, 22 nt, Human
auuauaaauauuuucuaggggu

SEQ ID NO: 1087446 - RNA, 22 nt, Human
uggagaagucaaagugaacagg

SEQ ID NO: 1087447 - RNA, 22 nt, Human
gaacaguacuaagagcuuuaca

SEQ ID NO: 1087448 - RNA, 22 nt, Human
ugggccuuacuuggggcugacu

SEQ ID NO: 1087449 - RNA, 23 nt, Human
ccagggccccuacaccacugucc

SEQ ID NO: 1087450 - RNA, 22 nt, Human
accagagcucuucagcacagga

SEQ ID NO: 1087451 - RNA, 22 nt, Human
ucucagagaacaguuggugcuu

SEQ ID NO: 1087452 - RNA, 22 nt, Human
ugugugacccccagugaagccu

SEQ ID NO: 1087453 - RNA, 22 nt, Human
uuaaugcuugucuagaucuucu

SEQ ID NO: 1087454 - RNA, 22 nt, Human
caucugaauuugccuuaguuuc

SEQ ID NO: 1087455 - RNA, 22 nt, Human
aacaucuacagugagauguuag

SEQ ID NO: 1087456 - RNA, 22 nt, Human
gcugugaguggaggaggcugag

SEQ ID NO: 1087457 - RNA, 22 nt, Human
ucaaauaguugacauuaacuug

SEQ ID NO: 1087458 - RNA, 20 nt, Human
cugggcucaagugagccucc

SEQ ID NO: 1087459 - RNA, 22 nt, Human
acauacacaagcguacaugaac

SEQ ID NO: 1087460 - RNA, 22 nt, Human
cccugcagacgucuugaugccu

SEQ ID NO: 1087461 - RNA, 22 nt, Human
cacauuuaaaaaauccacgauc

SEQ ID NO: 1087462 - RNA, 22 nt, Human
uggcaggguuggccaccuuacc

SEQ ID NO: 1087463 - RNA, 22 nt, Human
aagaagcugcgugguaugugaa

SEQ ID NO: 1087464 - RNA, 22 nt, Human
cugccucucagccugaccgcca

SEQ ID NO: 1087465 - RNA, 22 nt, Human
gcccaugguggcguucggugca

SEQ ID NO: 1087466 - RNA, 22 nt, Human
aauuccugucuuaacaguucug

SEQ ID NO: 1087467 - RNA, 22 nt, Human
uauccaauucaccauugauggg

SEQ ID NO: 1087468 - RNA, 22 nt, Human
cucccucaggccuuagcccugc

SEQ ID NO: 1087469 - RNA, 22 nt, Human
ccugucugagccagggugggca

SEQ ID NO: 1087470 - RNA, 22 nt, Human
aagcagagcaagcguauuuauu

SEQ ID NO: 1087471 - RNA, 19 nt, Human
ggggccugugauggucaca

SEQ ID NO: 1087472 - RNA, 22 nt, Human
cuuggcagcuuuuggaggagcc

SEQ ID NO: 1087473 - RNA, 22 nt, Human
aauuaugagguagauaucacau

SEQ ID NO: 1087474 - RNA, 23 nt, Human
guggagccacaucacaggcuccu

SEQ ID NO: 1087475 - RNA, 22 nt, Human
uuuagcauauccuauaaaacua

SEQ ID NO: 1087476 - RNA, 22 nt, Human
ccugggcagugcuggaguugaa

SEQ ID NO: 1087477 - RNA, 22 nt, Human
ugcuuuuaagaacaaugcugcu

SEQ ID NO: 1087478 - RNA, 22 nt, Human
acagaagauaaugcugccuugg

SEQ ID NO: 1087479 - RNA, 22 nt, Human
acauuaaauuucauagugauua

SEQ ID NO: 1087480 - RNA, 22 nt, Human
cugcauguuuacauuuuugaga

SEQ ID NO: 1087481 - RNA, 19 nt, Human
ccagcuggccugggaccuc

SEQ ID NO: 1087482 - RNA, 22 nt, Human
ucugcaucauuuuucagagccg

SEQ ID NO: 1087483 - RNA, 22 nt, Human
aguauacuccccauccuagaaa

SEQ ID NO: 1087484 - RNA, 22 nt, Human
aagagcauauuaauaguggaga

SEQ ID NO: 1087485 - RNA, 22 nt, Human
aaucaacaggaugugcauugua

SEQ ID NO: 1087486 - RNA, 22 nt, Human
aagcaccugcaguugacaaaaa

SEQ ID NO: 1087487 - RNA, 22 nt, Human
uggggcugaggagccucacucu

SEQ ID NO: 1087488 - RNA, 22 nt, Human
cacagugugacugaccuucagc

SEQ ID NO: 1087489 - RNA, 22 nt, Human
ugcagcagucagucaggccugg

SEQ ID NO: 1087490 - RNA, 22 nt, Human
aaagcucucccacuguaugaag

SEQ ID NO: 1087491 - RNA, 22 nt, Human
guggaggacaaaagaagccuuu

SEQ ID NO: 1087492 - RNA, 21 nt, Human
agcugagcccagaagacuggu

SEQ ID NO: 1087493 - RNA, 22 nt, Human
uguaaguacauugaaacaucuu

SEQ ID NO: 1087494 - RNA, 22 nt, Human
ugagaaaauccagaggcuaguu

SEQ ID NO: 1087495 - RNA, 22 nt, Human
ggugggguauuugguacuugua

SEQ ID NO: 1087496 - RNA, 22 nt, Human
gcuccacuugcagcuaggcuug

SEQ ID NO: 1087497 - RNA, 22 nt, Human
guaguucugcagugucaccuga

SEQ ID NO: 1087498 - RNA, 22 nt, Human
aagagcaaguggguagugaagc

SEQ ID NO: 1087499 - RNA, 22 nt, Human
gucucagauaacauguauucua

SEQ ID NO: 1087500 - RNA, 22 nt, Human
agugaaauagcauuuaugaagc

SEQ ID NO: 1087501 - RNA, 22 nt, Human
ccucccuccauugccaucgucu

SEQ ID NO: 1087502 - RNA, 21 nt, Human
cccaagggaggcaggauaagg

SEQ ID NO: 1087503 - RNA, 22 nt, Human
gcagagccccucaagccagccu

SEQ ID NO: 1087504 - RNA, 20 nt, Human
uuuauuggccuuucaggaac

SEQ ID NO: 1087505 - RNA, 22 nt, Human
cgccugggaguccacaccugcu

SEQ ID NO: 1087506 - RNA, 22 nt, Human
ugaggcucuccaagcagaugag

SEQ ID NO: 1087507 - RNA, 22 nt, Human
uggcagagacuccuccugggag

SEQ ID NO: 1087508 - RNA, 22 nt, Human
cuggacagaaaccaguccuggg

SEQ ID NO: 1087509 - RNA, 22 nt, Human
gcucuguguccacagcuggaaa

SEQ ID NO: 1087510 - RNA, 22 nt, Human
caggggccaggcugucugcugu

SEQ ID NO: 1087511 - RNA, 22 nt, Human
ccaggcucugcaaaaucaggcu

SEQ ID NO: 1087512 - RNA, 22 nt, Human
uggcucagcagguuagaaacua

SEQ ID NO: 1087513 - RNA, 23 nt, Human
agggcacugaagcuggaauuggg

SEQ ID NO: 1087514 - RNA, 20 nt, Human
aggagcugaauuagaggguu

SEQ ID NO: 1087515 - RNA, 22 nt, Human
uauuaaagggaaguuaugcaug

SEQ ID NO: 1087516 - RNA, 22 nt, Human
uguucuuuggcuuccuuuccgu

SEQ ID NO: 1087517 - RNA, 22 nt, Human
gaggcuguucaguguccagcuu

SEQ ID NO: 1087518 - RNA, 22 nt, Human
acagcagccagccacugugagc

SEQ ID NO: 1087519 - RNA, 22 nt, Human
uaugaaauugccauuuuuaugg

SEQ ID NO: 1087520 - RNA, 22 nt, Human
gcacccaggcuugggcagcaac

SEQ ID NO: 1087521 - RNA, 22 nt, Human
aggccagggcacugcucuuuag

SEQ ID NO: 1087522 - RNA, 22 nt, Human
aauauuuuugaggcccuguuau

SEQ ID NO: 1087523 - RNA, 22 nt, Human
agagcugcaauuucauguggug

SEQ ID NO: 1087524 - RNA, 22 nt, Human
aaaugucuuugaguauuucugc

SEQ ID NO: 1087525 - RNA, 22 nt, Human
aaugaaacuaguagaaucuuug

SEQ ID NO: 1087526 - RNA, 22 nt, Human
gacagcugcauccucagacaca

SEQ ID NO: 1087527 - RNA, 22 nt, Human
aaagccagcucugagcugcacc

SEQ ID NO: 1087528 - RNA, 22 nt, Human
ugcauuuuugagguuaacucaa

SEQ ID NO: 1087529 - RNA, 22 nt, Human
uuacagaaggaacacuacucag

SEQ ID NO: 1087530 - RNA, 22 nt, Human
ccagggugggguccaggaacca

SEQ ID NO: 1087531 - RNA, 21 nt, Human
gcaguuaauagcagagcacac

SEQ ID NO: 1087532 - RNA, 20 nt, Human
ucuggggaugaggucuagga

SEQ ID NO: 1087533 - RNA, 22 nt, Human
cugggccuuaugaguaccugga

SEQ ID NO: 1087534 - RNA, 22 nt, Human
uucaaagauggagggauagauu

SEQ ID NO: 1087535 - RNA, 22 nt, Human
ccaaagucagugcucagucguc

SEQ ID NO: 1087536 - RNA, 22 nt, Human
auucugaucauucaagauguca

SEQ ID NO: 1087537 - RNA, 22 nt, Human
aguucaauagaaaaauauauua

SEQ ID NO: 1087538 - RNA, 22 nt, Human
acuuucaaaagagaagucauga

SEQ ID NO: 1087539 - RNA, 22 nt, Human
ugcauacacuucaaaugagcau

SEQ ID NO: 1087540 - RNA, 22 nt, Human
uuugugcacauugcuuuucuau

SEQ ID NO: 1087541 - RNA, 22 nt, Human
ggucccugaagaugccugagga

SEQ ID NO: 1087542 - RNA, 22 nt, Human
ugggcugccggcaggcucugcc

SEQ ID NO: 1087543 - RNA, 22 nt, Human
gggaggagugaagauucaccug

SEQ ID NO: 1087544 - RNA, 22 nt, Human
cuggcucaccuccgcuccagca

SEQ ID NO: 1087545 - RNA, 22 nt, Human
ucacauuuguguuuuauuagag

SEQ ID NO: 1087546 - RNA, 22 nt, Human
agugugagccuacaggccaaag

SEQ ID NO: 1087547 - RNA, 22 nt, Human
agcagagcuauucuugugcaau

SEQ ID NO: 1087548 - RNA, 23 nt, Human
acugagcauuaguauuuuuauaa

SEQ ID NO: 1087549 - RNA, 22 nt, Human
uguacaguuaaucuuaagccau

SEQ ID NO: 1087550 - RNA, 22 nt, Human
aucuggcuauugacauguuaua

SEQ ID NO: 1087551 - RNA, 22 nt, Human
uugcccagagucacccagcuca

SEQ ID NO: 1087552 - RNA, 22 nt, Human
aguuuucugcuaaaccagcuaa

SEQ ID NO: 1087553 - RNA, 22 nt, Human
gguuugcacgauauuuccaugg

SEQ ID NO: 1087554 - RNA, 22 nt, Human
ucaagucuugaugagacaaacc

SEQ ID NO: 1087555 - RNA, 22 nt, Human
cauacauuuauacacaucuaug

SEQ ID NO: 1087556 - RNA, 22 nt, Human
aaaaguaauugcaauuuuguag

SEQ ID NO: 1087557 - RNA, 22 nt, Human
aaugauuuccccuacacagaag

SEQ ID NO: 1087558 - RNA, 22 nt, Human
gaggaaaauaacaacuaagggc

SEQ ID NO: 1087559 - RNA, 22 nt, Human
agucaauucuuuucaacucaag

SEQ ID NO: 1087560 - RNA, 22 nt, Human
ucugucacuuuuauuuacugaa

SEQ ID NO: 1087561 - RNA, 22 nt, Human
uggagcugacucacaccagcua

SEQ ID NO: 1087562 - RNA, 22 nt, Human
gucaauaucgccaagugucucu

SEQ ID NO: 1087563 - RNA, 22 nt, Human
gucagagcccccagcggcgcgg

SEQ ID NO: 1087564 - RNA, 22 nt, Human
ugagcccaggaguaugaggcug

SEQ ID NO: 1087565 - RNA, 22 nt, Human
cugagauggaguuuugcucuug

SEQ ID NO: 1087566 - RNA, 22 nt, Human
ccugggagagccaucuguggcc

SEQ ID NO: 1087567 - RNA, 22 nt, Human
caagaacauugugaucacuuca

SEQ ID NO: 1087568 - RNA, 22 nt, Human
ucagcaguguaguuuaucauuc

SEQ ID NO: 1087569 - RNA, 22 nt, Human
uuggaauugcucauaagagaga

SEQ ID NO: 1087570 - RNA, 22 nt, Human
aaggcaggagcuguaucuuauu

SEQ ID NO: 1087571 - RNA, 22 nt, Human
uuucuucuaggacuaauaagag

SEQ ID NO: 1087572 - RNA, 21 nt, Human
ccagcagcucaaggaucucuu

SEQ ID NO: 1087573 - RNA, 22 nt, Human
gcagggucugaggccacagagg

SEQ ID NO: 1087574 - RNA, 22 nt, Human
gacaucaauucagcauuuuaag

SEQ ID NO: 1087575 - RNA, 22 nt, Human
aacaggagaguaaauauaugau

SEQ ID NO: 1087576 - RNA, 22 nt, Human
ugggcuccucgucacucgcugu

SEQ ID NO: 1087577 - RNA, 22 nt, Human
gccuacuuaguagcugggauua

SEQ ID NO: 1087578 - RNA, 22 nt, Human
uucaaagugcuuuuaaccuuua

SEQ ID NO: 1087579 - RNA, 22 nt, Human
ucaguguuuccugugguacagc

SEQ ID NO: 1087580 - RNA, 22 nt, Human
uuuggcucucacuugcacucag

SEQ ID NO: 1087581 - RNA, 22 nt, Human
cuaagucauggaaagugugugu

SEQ ID NO: 1087582 - RNA, 22 nt, Human
cucugguguccuuuagaauuua

SEQ ID NO: 1087583 - RNA, 22 nt, Human
cagaaacacuuguagagaaguu

SEQ ID NO: 1087584 - RNA, 20 nt, Human
cagcccuccaguggaggcag

SEQ ID NO: 1087585 - RNA, 22 nt, Human
cugaggccucuguucaccagaa

SEQ ID NO: 1087586 - RNA, 22 nt, Human
ccuggagggcgccgcacagucc

SEQ ID NO: 1087587 - RNA, 22 nt, Human
agaaaugacaagacugaucagg

SEQ ID NO: 1087588 - RNA, 22 nt, Human
gucuuuauuugagauugucauu

SEQ ID NO: 1087589 - RNA, 22 nt, Human
agcagggaauagcggaaagaau

SEQ ID NO: 1087590 - RNA, 22 nt, Human
gaugcacuugccccuccucaga

SEQ ID NO: 1087591 - RNA, 20 nt, Human
cucugcuuuaggagagucag

SEQ ID NO: 1087592 - RNA, 22 nt, Human
aucaacauaugcaugggaaagu

SEQ ID NO: 1087593 - RNA, 22 nt, Human
cucuggaguucucaugaggaac

SEQ ID NO: 1087594 - RNA, 22 nt, Human
uguuagcauagcucagaaggag

SEQ ID NO: 1087595 - RNA, 22 nt, Human
aaucagaauuuauugaaucuuu

SEQ ID NO: 1087596 - RNA, 22 nt, Human
gaaggagggugcggaucugagc

SEQ ID NO: 1087597 - RNA, 22 nt, Human
aggggcaggugcugcacuuaga

SEQ ID NO: 1087598 - RNA, 22 nt, Human
ucaaaugcacguagagaaaaua

SEQ ID NO: 1087599 - RNA, 20 nt, Human
uuucuugucggcuguugcug

SEQ ID NO: 1087600 - RNA, 22 nt, Human
uuucauaauacuguacaugaaa

SEQ ID NO: 1087601 - RNA, 21 nt, Human
ugcagugaggggagcugucag

SEQ ID NO: 1087602 - RNA, 22 nt, Human
ccugccugccugcuggccggga

SEQ ID NO: 1087603 - RNA, 21 nt, Human
ugccaggccugagcugggguc

SEQ ID NO: 1087604 - RNA, 22 nt, Human
acagaagugucuuuuucauuca

SEQ ID NO: 1087605 - RNA, 22 nt, Human
uugucuuuggaaauuuaauguu

SEQ ID NO: 1087606 - RNA, 22 nt, Human
ucccuggccauuccucuaggcc

SEQ ID NO: 1087607 - RNA, 22 nt, Human
ccuggcugguggcagcgacaag

SEQ ID NO: 1087608 - RNA, 22 nt, Human
aauauauagaaguacccguugu

SEQ ID NO: 1087609 - RNA, 22 nt, Human
ucccaggugaugcugaggccac

SEQ ID NO: 1087610 - RNA, 22 nt, Human
ucaaaugcuucuacuccuaaga

SEQ ID NO: 1087611 - RNA, 22 nt, Human
ccucacucuuguccuggcaggu

SEQ ID NO: 1087612 - RNA, 22 nt, Human
gucuccugagccuugacugcaa

SEQ ID NO: 1087613 - RNA, 22 nt, Human
cagagccagaacuagaccuugu

SEQ ID NO: 1087614 - RNA, 22 nt, Human
cuauuucaaggcccagauauga

SEQ ID NO: 1087615 - RNA, 22 nt, Human
gccuggagcucggcugagggcg

SEQ ID NO: 1087616 - RNA, 22 nt, Human
ucacauuuuccuugguaucugu

SEQ ID NO: 1087617 - RNA, 22 nt, Human
aaauguauugcauaggauauuu

SEQ ID NO: 1087618 - RNA, 22 nt, Human
gauuucuuugcaagcuguguuc

SEQ ID NO: 1087619 - RNA, 22 nt, Human
gcagaggggaagcugaggaauu

SEQ ID NO: 1087620 - RNA, 22 nt, Human
uuucugaacuugguacuggagc

SEQ ID NO: 1087621 - RNA, 22 nt, Human
aauaauuuugagagccuggaaa

SEQ ID NO: 1087622 - RNA, 22 nt, Human
agcaggugucggcgagggucuu

SEQ ID NO: 1087623 - RNA, 22 nt, Human
gugguaauagagcuccaaacua

SEQ ID NO: 1087624 - RNA, 22 nt, Human
uuucacaacguuguggugagag

SEQ ID NO: 1087625 - RNA, 22 nt, Human
ucacagaacaagccugguggag

SEQ ID NO: 1087626 - RNA, 22 nt, Human
guuugcauuucuugaacuauau

SEQ ID NO: 1087627 - RNA, 22 nt, Human
gauuucuucauucauuagaugg

SEQ ID NO: 1087628 - RNA, 22 nt, Human
cagagcuggguuugggaaaccu

SEQ ID NO: 1087629 - RNA, 22 nt, Human
gagaaacuaacaucugaaggug

SEQ ID NO: 1087630 - RNA, 22 nt, Human
uaccaaaagcuuguuucauaca

SEQ ID NO: 1087631 - RNA, 22 nt, Human
uacauacauguauguguguauu

SEQ ID NO: 1087632 - RNA, 22 nt, Human
cuaggaccacuguaacaaagua

SEQ ID NO: 1087633 - RNA, 22 nt, Human
ccugggcaggaugggcccggug

SEQ ID NO: 1087634 - RNA, 23 nt, Human
ugcuuauucaaaaggugcuuuca

SEQ ID NO: 1087635 - RNA, 22 nt, Human
guggcccucugauagggucagg

SEQ ID NO: 1087636 - RNA, 22 nt, Human
gagcacacacuuugaaauuagg

SEQ ID NO: 1087637 - RNA, 22 nt, Human
uuugaucagcaagauaaauaga

SEQ ID NO: 1087638 - RNA, 22 nt, Human
cuguggggagcugaucagauca

SEQ ID NO: 1087639 - RNA, 22 nt, Human
ugcuucugaguugcaggacuug

SEQ ID NO: 1087640 - RNA, 22 nt, Human
cugauucuccucaagacuuucg

SEQ ID NO: 1087641 - RNA, 22 nt, Human
uaaaaugaucucucauguucuu

SEQ ID NO: 1087642 - RNA, 22 nt, Human
caucagcacuaugauuaaagua

SEQ ID NO: 1087643 - RNA, 22 nt, Human
ccugaggacacacgcugcagga

SEQ ID NO: 1087644 - RNA, 22 nt, Human
cugagagccuccuguuggcuag

SEQ ID NO: 1087645 - RNA, 22 nt, Human
augugaggcagcacggagauua

SEQ ID NO: 1087646 - RNA, 22 nt, Human
uaguggaggccuguugugugca

SEQ ID NO: 1087647 - RNA, 22 nt, Human
ugggcagagucauacaggagac

SEQ ID NO: 1087648 - RNA, 22 nt, Human
cacaaaugacugaaacgacugu

SEQ ID NO: 1087649 - RNA, 22 nt, Human
cagccaggggcuggcguguuga

SEQ ID NO: 1087650 - RNA, 22 nt, Human
cugucaggggcggguggagcgg

SEQ ID NO: 1087651 - RNA, 22 nt, Human
gcaccugcaggaugagccaggg

SEQ ID NO: 1087652 - RNA, 21 nt, Human
aggugggagaccauguagguc

SEQ ID NO: 1087653 - RNA, 21 nt, Human
agaaaaacacgauauaagccc

SEQ ID NO: 1087654 - RNA, 22 nt, Human
aaauucuucagguaauuuugau

SEQ ID NO: 1087655 - RNA, 22 nt, Human
ggagcuggccgccuaugugcag

SEQ ID NO: 1087656 - RNA, 22 nt, Human
gcuguauuuaacaacuggcuca

SEQ ID NO: 1087657 - RNA, 22 nt, Human
gggcaggaugcaguuucagaga

SEQ ID NO: 1087658 - RNA, 22 nt, Human
acaaaugacucaaacaccacuu

SEQ ID NO: 1087659 - RNA, 22 nt, Human
uaauuguaaaguaguaguacag

SEQ ID NO: 1087660 - RNA, 22 nt, Human
caacaucuguaucauuaguaca

SEQ ID NO: 1087661 - RNA, 21 nt, Human
uggcucugcucagagcagucc

SEQ ID NO: 1087662 - RNA, 22 nt, Human
cugagcugggacucaguagcaa

SEQ ID NO: 1087663 - RNA, 22 nt, Human
ugaggcaggagaauggcgggaa

SEQ ID NO: 1087664 - RNA, 22 nt, Human
agauguuucaguaauuuaucuu

SEQ ID NO: 1087665 - RNA, 22 nt, Human
aaauauaccaguugccugcauc

SEQ ID NO: 1087666 - RNA, 22 nt, Human
gcugauguaagacuuuugguuu

SEQ ID NO: 1087667 - RNA, 22 nt, Human
uggcaaaggcgcucacaugccu

SEQ ID NO: 1087668 - RNA, 22 nt, Human
uugucacauucaaguuuuauau

SEQ ID NO: 1087669 - RNA, 22 nt, Human
caaaaacugcaauuacuuuuac

SEQ ID NO: 1087670 - RNA, 22 nt, Human
agggucuguggaugcaucuggg

SEQ ID NO: 1087671 - RNA, 22 nt, Human
ucccugcccucagugcacccgg

SEQ ID NO: 1087672 - RNA, 22 nt, Human
ggucaucuugaauuuccauucu

SEQ ID NO: 1087673 - RNA, 22 nt, Human
aguauaauuuacauuugguauu

SEQ ID NO: 1087674 - RNA, 22 nt, Human
aguuugaaggaguugaaucacc

SEQ ID NO: 1087675 - RNA, 18 nt, Human
ugcagcaagugcuaaaua

SEQ ID NO: 1087676 - RNA, 22 nt, Human
cugugauuguuaguuccuauac

SEQ ID NO: 1087677 - RNA, 22 nt, Human
cuucacaaauggccuagaguuc

SEQ ID NO: 1087678 - RNA, 22 nt, Human
ugccauuucucaaauaugacua

SEQ ID NO: 1087679 - RNA, 22 nt, Human
auuucacucauucauguuacuu

SEQ ID NO: 1087680 - RNA, 22 nt, Human
agugcagccgagaucaggugcu

SEQ ID NO: 1087681 - RNA, 22 nt, Human
cacaaauggccguguucaaaga

SEQ ID NO: 1087682 - RNA, 22 nt, Human
aauguguagcauuuaaugcagu

SEQ ID NO: 1087683 - RNA, 22 nt, Human
gcaagcugugauuuaugugaau

SEQ ID NO: 1087684 - RNA, 21 nt, Human
ugggccugauucccaggguca

SEQ ID NO: 1087685 - RNA, 22 nt, Human
gugcugugucuaucaggaauaa

SEQ ID NO: 1087686 - RNA, 22 nt, Human
uauguguuugacacccugcaag

SEQ ID NO: 1087687 - RNA, 22 nt, Human
agcaguggcugaagauguuccu

SEQ ID NO: 1087688 - RNA, 20 nt, Human
ucucaggccccaguuuucuu

SEQ ID NO: 1087689 - RNA, 22 nt, Human
gaagggagaagguugggugacg

SEQ ID NO: 1087690 - RNA, 22 nt, Human
auacaugucaucauauguuugu

SEQ ID NO: 1087691 - RNA, 22 nt, Human
agaagcagacucugaggcaagg

SEQ ID NO: 1087692 - RNA, 22 nt, Human
uccuccaguggcccaguccuuc

SEQ ID NO: 1087693 - RNA, 22 nt, Human
uauuagguuggugcaaaaguca

SEQ ID NO: 1087694 - RNA, 22 nt, Human
auggacaggcugagcuuccuca

SEQ ID NO: 1087695 - RNA, 22 nt, Human
uugugaauagugccgcaauaaa

SEQ ID NO: 1087696 - RNA, 22 nt, Human
uaaggcacgcauaagagggggc

SEQ ID NO: 1087697 - RNA, 22 nt, Human
aggggccuggcacugagcuggc

SEQ ID NO: 1087698 - RNA, 22 nt, Human
gagagugaaggcuucccagcaa

SEQ ID NO: 1087699 - RNA, 22 nt, Human
gcuucaugcuugcuccaaagcu

SEQ ID NO: 1087700 - RNA, 22 nt, Human
agccaggccuuagggagaggca

SEQ ID NO: 1087701 - RNA, 22 nt, Human
ugaguggagacuguguguagag

SEQ ID NO: 1087702 - RNA, 23 nt, Human
uuagagaugauuaaaaaaucuug

SEQ ID NO: 1087703 - RNA, 22 nt, Human
uggcaggaaaaacauuggagau

SEQ ID NO: 1087704 - RNA, 22 nt, Human
cugaggcucugggugucacugu

SEQ ID NO: 1087705 - RNA, 22 nt, Human
uuuuauacacaugaacaugcag

SEQ ID NO: 1087706 - RNA, 22 nt, Human
uugaaauacugcauuguucagu

SEQ ID NO: 1087707 - RNA, 22 nt, Human
accucugcuucccggguucaag

SEQ ID NO: 1087708 - RNA, 19 nt, Human
cugggccagagcuguccuc

SEQ ID NO: 1087709 - RNA, 20 nt, Human
ugagaaaguagagacucagg

SEQ ID NO: 1087710 - RNA, 17 nt, Human
gccagggagaggaagcc

SEQ ID NO: 1087711 - RNA, 19 nt, Human
uuuaaugugugcugcaauc

SEQ ID NO: 1087712 - RNA, 22 nt, Human
cuucucuuccuuugucaacuga

SEQ ID NO: 1087713 - RNA, 22 nt, Human
agggaagagcuugcaagaaacc

SEQ ID NO: 1087714 - RNA, 22 nt, Human
ucugucacugagcucaggauuc

SEQ ID NO: 1087715 - RNA, 22 nt, Human
gcaauauaaccaguugucaugc

SEQ ID NO: 1087716 - RNA, 22 nt, Human
cauugcacuucugcuuuuccuc

SEQ ID NO: 1087717 - RNA, 22 nt, Human
agauaacuuuuggguauucaug

SEQ ID NO: 1087718 - RNA, 22 nt, Human
aaguucaagagugacauauuag

SEQ ID NO: 1087719 - RNA, 22 nt, Human
aaacucuaagacacuguacaau

SEQ ID NO: 1087720 - RNA, 17 nt, Human
uucucuuccuggauagu

SEQ ID NO: 1087721 - RNA, 22 nt, Human
auguacauuuguaguaauauca

SEQ ID NO: 1087722 - RNA, 22 nt, Human
ucaaagcaugguuuugaaagac

SEQ ID NO: 1087723 - RNA, 22 nt, Human
gcugggcucauuugugugucug

SEQ ID NO: 1087724 - RNA, 22 nt, Human
cccucagcuucucccugcagcu

SEQ ID NO: 1087725 - RNA, 17 nt, Human
caggcagacauguaagc

SEQ ID NO: 1087726 - RNA, 23 nt, Human
acugggcuuaugaggaggcuugu

SEQ ID NO: 1087727 - RNA, 22 nt, Human
ugucaugcuuauguuacauacu

SEQ ID NO: 1087728 - RNA, 22 nt, Human
auacaugaggcucauuuauguc

SEQ ID NO: 1087729 - RNA, 22 nt, Human
uggcccugcuguaucaucugcu

SEQ ID NO: 1087730 - RNA, 22 nt, Human
gcacacaggcaguuuccagcca

SEQ ID NO: 1087731 - RNA, 22 nt, Human
ccucugcugcuguugagcaccg

SEQ ID NO: 1087732 - RNA, 22 nt, Human
cccuugcacauuugucuuuaau

SEQ ID NO: 1087733 - RNA, 22 nt, Human
uccugggagagugggacuguau

SEQ ID NO: 1087734 - RNA, 22 nt, Human
gcuccucucccagagcugcagg

SEQ ID NO: 1087735 - RNA, 22 nt, Human
auuucucucauuguuagcuagg

SEQ ID NO: 1087736 - RNA, 22 nt, Human
aagaaauaagacuucucugucc

SEQ ID NO: 1087737 - RNA, 22 nt, Human
gacgccucuucccugcugcacu

SEQ ID NO: 1087738 - RNA, 23 nt, Human
uacauuguggauggaguccuggg

SEQ ID NO: 1087739 - RNA, 22 nt, Human
gcauucuugguggagugcuaaa

SEQ ID NO: 1087740 - RNA, 22 nt, Human
uauaucaccaaaaacaguucug

SEQ ID NO: 1087741 - RNA, 22 nt, Human
aggcagcagccacaaggccuga

SEQ ID NO: 1087742 - RNA, 22 nt, Human
ccugggcagguguggcuucccc

SEQ ID NO: 1087743 - RNA, 22 nt, Human
uguucauucugugaccugguuc

SEQ ID NO: 1087744 - RNA, 22 nt, Human
uacauuuacagagccuucucug

SEQ ID NO: 1087745 - RNA, 22 nt, Human
gcuccucuucucccacugaaug

SEQ ID NO: 1087746 - RNA, 22 nt, Human
uaaagcauguacugugugcuag

SEQ ID NO: 1087747 - RNA, 22 nt, Human
uuuucuggucacauguuauuaa

SEQ ID NO: 1087748 - RNA, 22 nt, Human
ugugugccagccuacgaggagc

SEQ ID NO: 1087749 - RNA, 22 nt, Human
cagggugacaaguggcaaggag

SEQ ID NO: 1087750 - RNA, 22 nt, Human
uuacauucaaggaacucauucu

SEQ ID NO: 1087751 - RNA, 22 nt, Human
gggugagacagaaagagcaaaa

SEQ ID NO: 1087752 - RNA, 22 nt, Human
uucaagauggccccagugagcc

SEQ ID NO: 1087753 - RNA, 22 nt, Human
cagugcagaacacauggaaaau

SEQ ID NO: 1087754 - RNA, 22 nt, Human
cagggugccaaagaacaaauau

SEQ ID NO: 1087755 - RNA, 22 nt, Human
uggagcaggaaacaucuagagg

SEQ ID NO: 1087756 - RNA, 22 nt, Human
ucaggaaggcgccccaucagga

SEQ ID NO: 1087757 - RNA, 22 nt, Human
gugugaaaugguucucuuuguu

SEQ ID NO: 1087758 - RNA, 22 nt, Human
uuuuuuaguuaggucagaaugu

SEQ ID NO: 1087759 - RNA, 22 nt, Human
ggcuggagugggcuccagaguu

SEQ ID NO: 1087760 - RNA, 22 nt, Human
ugcagguggauaucucaucaga

SEQ ID NO: 1087761 - RNA, 22 nt, Human
uuucaaauagaaucuuuccaaa

SEQ ID NO: 1087762 - RNA, 22 nt, Human
uuccaagagccuuucuucuaga

SEQ ID NO: 1087763 - RNA, 22 nt, Human
uuaaaucaggcaucauuucagu

SEQ ID NO: 1087764 - RNA, 22 nt, Human
uucaucaauguguuuaauaaug

SEQ ID NO: 1087765 - RNA, 22 nt, Human
uaucuuuauuaugucuaucugc

SEQ ID NO: 1087766 - RNA, 22 nt, Human
ucuauuuuguuuccagcucuac

SEQ ID NO: 1087767 - RNA, 23 nt, Human
cagugcagggcaacucagacucc

SEQ ID NO: 1087768 - RNA, 22 nt, Human
cuggugggagcagcaggcagcu

SEQ ID NO: 1087769 - RNA, 22 nt, Human
gaggcagcagggcugguuccuu

SEQ ID NO: 1087770 - RNA, 22 nt, Human
caauuauucagugacuuaagag

SEQ ID NO: 1087771 - RNA, 22 nt, Human
acuccagggcugaacgaggccc

SEQ ID NO: 1087772 - RNA, 22 nt, Human
uggggacagggcucagcaauuu

SEQ ID NO: 1087773 - RNA, 22 nt, Human
cccugggagaaguugagggcug

SEQ ID NO: 1087774 - RNA, 22 nt, Human
ggggcacuuccaggcugaggcu

SEQ ID NO: 1087775 - RNA, 22 nt, Human
accagcucagaagccagaaaga

SEQ ID NO: 1087776 - RNA, 17 nt, Human
ugggguguugaaggguu

SEQ ID NO: 1087777 - RNA, 22 nt, Human
aggccuggcaugagaccugaga

SEQ ID NO: 1087778 - RNA, 22 nt, Human
uuauuugugaaucauuuaucua

SEQ ID NO: 1087779 - RNA, 22 nt, Human
cagcaggcucugaguggcugcc

SEQ ID NO: 1087780 - RNA, 22 nt, Human
gucugagaaucuugcauaucau

SEQ ID NO: 1087781 - RNA, 22 nt, Human
agcagguggaaaauucuuauca

SEQ ID NO: 1087782 - RNA, 22 nt, Human
uggccucaagucugagggccuu

SEQ ID NO: 1087783 - RNA, 21 nt, Human
gaugaagcaaucuuucuguug

SEQ ID NO: 1087784 - RNA, 22 nt, Human
uucuuaagacugcaaaucaacc

SEQ ID NO: 1087785 - RNA, 22 nt, Human
ggcaggagaaaggucucuucuu

SEQ ID NO: 1087786 - RNA, 22 nt, Human
acugagagucaagauagcaugg

SEQ ID NO: 1087787 - RNA, 22 nt, Human
cuacaccuugaucuaacauuuu

SEQ ID NO: 1087788 - RNA, 22 nt, Human
gggugacauuucccaaugagcc

SEQ ID NO: 1087789 - RNA, 22 nt, Human
agguuuucagcuguauccugag

SEQ ID NO: 1087790 - RNA, 22 nt, Human
agcuggguggagggcccacggu

SEQ ID NO: 1087791 - RNA, 22 nt, Human
cagcagcugcgugcccaggccg

SEQ ID NO: 1087792 - RNA, 22 nt, Human
agggagagguugaaaccucagu

SEQ ID NO: 1087793 - RNA, 22 nt, Human
ucaggcaggacaauuauuuagg

SEQ ID NO: 1087794 - RNA, 22 nt, Human
agcugagccagcagcaacagga

SEQ ID NO: 1087795 - RNA, 22 nt, Human
guacauguugguuguuuccagu

SEQ ID NO: 1087796 - RNA, 22 nt, Human
caaauacugagcacgcaaucaa

SEQ ID NO: 1087797 - RNA, 22 nt, Human
cagggccagccgcagcauccac

SEQ ID NO: 1087798 - RNA, 22 nt, Human
auacaacagaaaaugauuauuc

SEQ ID NO: 1087799 - RNA, 22 nt, Human
uuaauuuucucaucugugaaau

SEQ ID NO: 1087800 - RNA, 22 nt, Human
ccccagggucaguguguggagg

SEQ ID NO: 1087801 - RNA, 22 nt, Human
ucugguaaccuuuaucccuccu

SEQ ID NO: 1087802 - RNA, 22 nt, Human
uucuucaaacaaaaguggcaug

SEQ ID NO: 1087803 - RNA, 22 nt, Human
ccagggcucaggcucccagugg

SEQ ID NO: 1087804 - RNA, 22 nt, Human
acauuuauauaacucacuagga

SEQ ID NO: 1087805 - RNA, 22 nt, Human
gcacccagccagcaucucagag

SEQ ID NO: 1087806 - RNA, 22 nt, Human
ccagagccagagaggugccugc

SEQ ID NO: 1087807 - RNA, 22 nt, Human
uaaagucaagguacuguuucac

SEQ ID NO: 1087808 - RNA, 22 nt, Human
aaagagcccuuccaugacucuu

SEQ ID NO: 1087809 - RNA, 22 nt, Human
ucagacaggcuucuuucucccu

SEQ ID NO: 1087810 - RNA, 22 nt, Human
cuucuguguagaaagguagccc

SEQ ID NO: 1087811 - RNA, 22 nt, Human
ucaaaaauguuuuauauuggua

SEQ ID NO: 1087812 - RNA, 22 nt, Human
uuggcuucuugugaaaucugag

SEQ ID NO: 1087813 - RNA, 22 nt, Human
aaaugcagcagcuaauugaaaa

SEQ ID NO: 1087814 - RNA, 22 nt, Human
uaaugcuucaauuuccuugauu

SEQ ID NO: 1087815 - RNA, 22 nt, Human
uuaacacagggggagacaaagu

SEQ ID NO: 1087816 - RNA, 22 nt, Human
acagcuguggucuccuuagugu

SEQ ID NO: 1087817 - RNA, 22 nt, Human
agcaaauauuuuguugaagugc

SEQ ID NO: 1087818 - RNA, 22 nt, Human
auuugaaaucccuucuacugua

SEQ ID NO: 1087819 - RNA, 22 nt, Human
cuccucuggaaauuccucugcc

SEQ ID NO: 1087820 - RNA, 22 nt, Human
gggagguguuccaguguuggua

SEQ ID NO: 1087821 - RNA, 22 nt, Human
gggcugggauugcuugcuguga

SEQ ID NO: 1087822 - RNA, 22 nt, Human
uaauucuagauugacauuuuga

SEQ ID NO: 1087823 - RNA, 22 nt, Human
uccugagagguuuauaacgcag

SEQ ID NO: 1087824 - RNA, 22 nt, Human
gaaacuuacuuacucacauuuc

SEQ ID NO: 1087825 - RNA, 22 nt, Human
gcagagugguuucagaguugag

SEQ ID NO: 1087826 - RNA, 22 nt, Human
guuucuggagugacuauaacug

SEQ ID NO: 1087827 - RNA, 22 nt, Human
acaaugaauuuaauaccuuauu

SEQ ID NO: 1087828 - RNA, 22 nt, Human
cugcagcuauauuuucccacag

SEQ ID NO: 1087829 - RNA, 22 nt, Human
gacccuguuucuacaaauaauu

SEQ ID NO: 1087830 - RNA, 22 nt, Human
gcagauggacuguaugaccuga

SEQ ID NO: 1087831 - RNA, 22 nt, Human
ggcacacagcggaauuugcucu

SEQ ID NO: 1087832 - RNA, 22 nt, Human
agaaguuaauuccugaaauucu

SEQ ID NO: 1087833 - RNA, 22 nt, Human
uugaaagucacaauggcauuaa

SEQ ID NO: 1087834 - RNA, 22 nt, Human
cuuucuaauucucccauagucu

SEQ ID NO: 1087835 - RNA, 22 nt, Human
uucaguuucagucuugcaaaaa

SEQ ID NO: 1087836 - RNA, 22 nt, Human
cugccuggccugaucuccacgc

SEQ ID NO: 1087837 - RNA, 17 nt, Human
cucuccuuccucugagg

SEQ ID NO: 1087838 - RNA, 22 nt, Human
ugcagggcuauaacuccauucu

SEQ ID NO: 1087839 - RNA, 22 nt, Human
ccaggguuuaaauucugacuau

SEQ ID NO: 1087840 - RNA, 22 nt, Human
ccucccuggccagagcagcagc

SEQ ID NO: 1087841 - RNA, 22 nt, Human
cauuugcucugugucaguggca

SEQ ID NO: 1087842 - RNA, 22 nt, Human
acaaaugacuauuugguacagg

SEQ ID NO: 1087843 - RNA, 22 nt, Human
acacaucagaaauaugaaugag

SEQ ID NO: 1087844 - RNA, 22 nt, Human
aagggaaaucauauggugcagu

SEQ ID NO: 1087845 - RNA, 22 nt, Human
aaagcauauuaggacugaauua

SEQ ID NO: 1087846 - RNA, 22 nt, Human
gggcagguuggcaucccgggca

SEQ ID NO: 1087847 - RNA, 22 nt, Human
ugcaggugauucugaugcaguu

SEQ ID NO: 1087848 - RNA, 20 nt, Human
caccacagaauuggggacag

SEQ ID NO: 1087849 - RNA, 18 nt, Human
cucaggccuuucccugug

SEQ ID NO: 1087850 - RNA, 22 nt, Human
gcagugcuuuagucuguccuuu

SEQ ID NO: 1087851 - RNA, 22 nt, Human
gucaccagugcuaagaggugga

SEQ ID NO: 1087852 - RNA, 22 nt, Human
acaguguccuuguggucccugu

SEQ ID NO: 1087853 - RNA, 22 nt, Human
ucagcuggcaguucagaggcug

SEQ ID NO: 1087854 - RNA, 22 nt, Human
uauauugcuagugguacuguaa

SEQ ID NO: 1087855 - RNA, 22 nt, Human
cagaguggcagucccaggccca

SEQ ID NO: 1087856 - RNA, 22 nt, Human
ggugaaggaggaagcugaugga

SEQ ID NO: 1087857 - RNA, 22 nt, Human
agggacagaugaaugacugagu

SEQ ID NO: 1087858 - RNA, 22 nt, Human
caggaggaggugagguagaacu

SEQ ID NO: 1087859 - RNA, 23 nt, Human
cuggaagugcuuuuauagcuuug

SEQ ID NO: 1087860 - RNA, 22 nt, Human
gagcugagaucgugccauugca

SEQ ID NO: 1087861 - RNA, 22 nt, Human
cccacucuggcucccuucuagu

SEQ ID NO: 1087862 - RNA, 22 nt, Human
aguuucacagaggguuagacgc

SEQ ID NO: 1087863 - RNA, 22 nt, Human
cccagggucccugcucucugug

SEQ ID NO: 1087864 - RNA, 17 nt, Human
gcacugaacaauccugu

SEQ ID NO: 1087865 - RNA, 22 nt, Human
uggaccacucuggugcccaugu

SEQ ID NO: 1087866 - RNA, 22 nt, Human
ugggggagauugugcaucucua

SEQ ID NO: 1087867 - RNA, 22 nt, Human
cagaggcaggauaagaacugcg

SEQ ID NO: 1087868 - RNA, 22 nt, Human
uaauuuaauuucaugccagccu

SEQ ID NO: 1087869 - RNA, 22 nt, Human
cagcccuguccagcagagggug

SEQ ID NO: 1087870 - RNA, 22 nt, Human
uugaggcauuacuguaaugaga

SEQ ID NO: 1087871 - RNA, 22 nt, Human
cagaguguaucuguguaagcau

SEQ ID NO: 1087872 - RNA, 22 nt, Human
cuggguggaucgcagccccagg

SEQ ID NO: 1087873 - RNA, 22 nt, Human
guuugaaaugucugcaagggaa

SEQ ID NO: 1087874 - RNA, 22 nt, Human
acaguauauauagucuaaaagc

SEQ ID NO: 1087875 - RNA, 22 nt, Human
aaaauagccucacauaauugcu

SEQ ID NO: 1087876 - RNA, 22 nt, Human
aguucuuuugugaacauaugcu

SEQ ID NO: 1087877 - RNA, 22 nt, Human
ucuuggagacucuuguauauuu

SEQ ID NO: 1087878 - RNA, 22 nt, Human
ugaacucuccaggcaaaugauc

SEQ ID NO: 1087879 - RNA, 22 nt, Human
gccacagcggggccgcuagagc

SEQ ID NO: 1087880 - RNA, 22 nt, Human
uaauuauagccgcuauuuugcu

SEQ ID NO: 1087881 - RNA, 22 nt, Human
ucuggaaguuagaggaggaaag

SEQ ID NO: 1087882 - RNA, 22 nt, Human
aagaucaagugcuggcaguguu

SEQ ID NO: 1087883 - RNA, 22 nt, Human
agggagcucaguuggaagcggu

SEQ ID NO: 1087884 - RNA, 22 nt, Human
gggacagaaggaagugagcaca

SEQ ID NO: 1087885 - RNA, 22 nt, Human
augaaauaucuugaagaaauuc

SEQ ID NO: 1087886 - RNA, 22 nt, Human
gugagcaggauaggggcucccu

SEQ ID NO: 1087887 - RNA, 20 nt, Human
ucagugauuuugaagaggaa

SEQ ID NO: 1087888 - RNA, 22 nt, Human
uccagggagagccgcugcucca

SEQ ID NO: 1087889 - RNA, 22 nt, Human
ccuggacucaggcugugggcac

SEQ ID NO: 1087890 - RNA, 22 nt, Human
cagucuuugaugcauccuagcc

SEQ ID NO: 1087891 - RNA, 22 nt, Human
gagcacugauuuauuuuugucu

SEQ ID NO: 1087892 - RNA, 22 nt, Human
ugagcagaggccagcaccuggg

SEQ ID NO: 1087893 - RNA, 22 nt, Human
ucagaguccuuuggccugacag

SEQ ID NO: 1087894 - RNA, 22 nt, Human
uugaaaggguuaaagugguaaa

SEQ ID NO: 1087895 - RNA, 22 nt, Human
auacuuacuuuucuucagacua

SEQ ID NO: 1087896 - RNA, 22 nt, Human
cugaaccaucucuguucuguau

SEQ ID NO: 1087897 - RNA, 22 nt, Human
gcugcuggagagcgagacuguu

SEQ ID NO: 1087898 - RNA, 22 nt, Human
acaagcuuccaggugaugcuga

SEQ ID NO: 1087899 - RNA, 17 nt, Human
agcuccugcccauggcu

SEQ ID NO: 1087900 - RNA, 22 nt, Human
uucuguauuucaaugucuuuau

SEQ ID NO: 1087901 - RNA, 22 nt, Human
gcccucaggcagggagucuuuc

SEQ ID NO: 1087902 - RNA, 22 nt, Human
agcuccugucucaagggagccu

SEQ ID NO: 1087903 - RNA, 21 nt, Human
ugaggcuguuguaccagggag

SEQ ID NO: 1087904 - RNA, 22 nt, Human
agguggggugagcugcagacua

SEQ ID NO: 1087905 - RNA, 22 nt, Human
gccugcugaagccagagugugu

SEQ ID NO: 1087906 - RNA, 22 nt, Human
agucucugugagcucccaaugg

SEQ ID NO: 1087907 - RNA, 22 nt, Human
gagugguaguuucuagaggugu

SEQ ID NO: 1087908 - RNA, 22 nt, Human
cucacugcaaguuccaccuacc

SEQ ID NO: 1087909 - RNA, 22 nt, Human
uauaagaaacaaggcaaauuuu

SEQ ID NO: 1087910 - RNA, 22 nt, Human
ucuccucaccaccagcagcaga

SEQ ID NO: 1087911 - RNA, 22 nt, Human
cagcugugaauugucuuaucua

SEQ ID NO: 1087912 - RNA, 22 nt, Human
acaauacuauuuucaguauccu

SEQ ID NO: 1087913 - RNA, 22 nt, Human
cauucaaacauuaauuuauuca

SEQ ID NO: 1087914 - RNA, 22 nt, Human
uacuacauacagaauuuagaga

SEQ ID NO: 1087915 - RNA, 22 nt, Human
ggugagaggcagaggacagcuu

SEQ ID NO: 1087916 - RNA, 22 nt, Human
uuaaauauuuucagcaggguca

SEQ ID NO: 1087917 - RNA, 22 nt, Human
gucuggaggaggaagaaggcac

SEQ ID NO: 1087918 - RNA, 22 nt, Human
agcucccagucuccucuccaug

SEQ ID NO: 1087919 - RNA, 22 nt, Human
gacauuuguuccucuaagugac

SEQ ID NO: 1087920 - RNA, 22 nt, Human
ccagagccucaacacagguccu

SEQ ID NO: 1087921 - RNA, 22 nt, Human
ucaccccuacauuucccuugcu

SEQ ID NO: 1087922 - RNA, 22 nt, Human
cuagaacagaaaguacaggaaa

SEQ ID NO: 1087923 - RNA, 22 nt, Human
gggagagagaaaacguggcgca

SEQ ID NO: 1087924 - RNA, 22 nt, Human
ugaacacauauuaggugcucau

SEQ ID NO: 1087925 - RNA, 22 nt, Human
cuuuuaaugggagcaguauuug

SEQ ID NO: 1087926 - RNA, 22 nt, Human
uagugaaacaguuaucaaucug

SEQ ID NO: 1087927 - RNA, 22 nt, Human
uuuuuauaccaccucucacuua

SEQ ID NO: 1087928 - RNA, 22 nt, Human
auacaaguggccacuugaauuc

SEQ ID NO: 1087929 - RNA, 22 nt, Human
auuugauuagcuguguaauuuu

SEQ ID NO: 1087930 - RNA, 22 nt, Human
ucuggggagcagcccuggugag

SEQ ID NO: 1087931 - RNA, 22 nt, Human
cugaaugucgaucagcuugggu

SEQ ID NO: 1087932 - RNA, 20 nt, Human
cuaggaacuauggucuggcu

SEQ ID NO: 1087933 - RNA, 19 nt, Human
uccauaaugaagauagagg

SEQ ID NO: 1087934 - RNA, 22 nt, Human
ugggaaagcugcagaaauucuc

SEQ ID NO: 1087935 - RNA, 22 nt, Human
uccugcagaccucagucagguc

SEQ ID NO: 1087936 - RNA, 19 nt, Human
uaugucccuuucccccauu

SEQ ID NO: 1087937 - RNA, 17 nt, Human
gucaauauuguugacag

SEQ ID NO: 1087938 - RNA, 22 nt, Human
ugauacuuuggagacuugagua

SEQ ID NO: 1087939 - RNA, 22 nt, Human
agacaucaaugaucagagguag

SEQ ID NO: 1087940 - RNA, 22 nt, Human
aggaaaacagaccaaggagcuc

SEQ ID NO: 1087941 - RNA, 22 nt, Human
acaggggaccuaggacccucgg

SEQ ID NO: 1087942 - RNA, 22 nt, Human
agcucagggcgaucugucucgg

SEQ ID NO: 1087943 - RNA, 22 nt, Human
ugcugugcuggcggcagaggcc

SEQ ID NO: 1087944 - RNA, 22 nt, Human
gcgucucaaggcccccaggcca

SEQ ID NO: 1087945 - RNA, 22 nt, Human
uaucacaggugugauuuacauu

SEQ ID NO: 1087946 - RNA, 22 nt, Human
cagagcuggagaaguggauuua

SEQ ID NO: 1087947 - RNA, 22 nt, Human
agucuccuuggccucaaugccu

SEQ ID NO: 1087948 - RNA, 22 nt, Human
ggcuuaaguccugaauuuaugc

SEQ ID NO: 1087949 - RNA, 22 nt, Human
gggccccuuguaucucuggcuc

SEQ ID NO: 1087950 - RNA, 22 nt, Human
agcuaagacuuagugacuuagu

SEQ ID NO: 1087951 - RNA, 22 nt, Human
ggauaagaaaauuguaauaacu

SEQ ID NO: 1087952 - RNA, 20 nt, Human
guuuuucucucuugccacua

SEQ ID NO: 1087953 - RNA, 22 nt, Human
gggcugagucugcugccuguca

SEQ ID NO: 1087954 - RNA, 22 nt, Human
ucuggagcuggagggcaaggca

SEQ ID NO: 1087955 - RNA, 18 nt, Human
uuugggcugauguugggc

SEQ ID NO: 1087956 - RNA, 22 nt, Human
aggcuucuacguggucccaggg

SEQ ID NO: 1087957 - RNA, 22 nt, Human
cugagcugaaacuugagaggcu

SEQ ID NO: 1087958 - RNA, 22 nt, Human
ucagaugguacuaauuuaagga

SEQ ID NO: 1087959 - RNA, 22 nt, Human
gcagacaggcccaguggaggga

SEQ ID NO: 1087960 - RNA, 22 nt, Human
cuggaggaccacagaagcuggu

SEQ ID NO: 1087961 - RNA, 22 nt, Human
augcugugagugugccgcagag

SEQ ID NO: 1087962 - RNA, 22 nt, Human
ccgggcgggggcucucgucacc

SEQ ID NO: 1087963 - RNA, 22 nt, Human
agaggaggcucugggaucgucc

SEQ ID NO: 1087964 - RNA, 22 nt, Human
caguacuuggucaaggaagcag

SEQ ID NO: 1087965 - RNA, 22 nt, Human
uucauuagcaaggucuucaagu

SEQ ID NO: 1087966 - RNA, 22 nt, Human
gcaagcaagcagguagagcuga

SEQ ID NO: 1087967 - RNA, 22 nt, Human
augggaggaagagaagaugucu

SEQ ID NO: 1087968 - RNA, 22 nt, Human
gcaggugggagccgcugccuga

SEQ ID NO: 1087969 - RNA, 22 nt, Human
guguuuccucuagaagccaugg

SEQ ID NO: 1087970 - RNA, 22 nt, Human
ucagggaagagagaucuccuag

SEQ ID NO: 1087971 - RNA, 21 nt, Human
agaagggauugugguaaagau

SEQ ID NO: 1087972 - RNA, 22 nt, Human
gggcagugaauauuggugggaa

SEQ ID NO: 1087973 - RNA, 22 nt, Human
agcagagguuuguuggaaaccu

SEQ ID NO: 1087974 - RNA, 22 nt, Human
cacagaacauuuuuagaugcag

SEQ ID NO: 1087975 - RNA, 22 nt, Human
acugcuuuuagaaaucuauaga

SEQ ID NO: 1087976 - RNA, 22 nt, Human
ggcgaggccgggacaggcugga

SEQ ID NO: 1087977 - RNA, 21 nt, Human
gccacguuucagucuucucag

SEQ ID NO: 1087978 - RNA, 22 nt, Human
gcauccagucuuggcuccugga

SEQ ID NO: 1087979 - RNA, 22 nt, Human
uuuccuuuccaaaauucugccu

SEQ ID NO: 1087980 - RNA, 22 nt, Human
uuaguuguaaaauggaauuugu

SEQ ID NO: 1087981 - RNA, 22 nt, Human
gugcaguugauaguuuuaguga

SEQ ID NO: 1087982 - RNA, 22 nt, Human
ucucaguguuguucugcagaug

SEQ ID NO: 1087983 - RNA, 21 nt, Human
aagggagauaggaaucaggcc

SEQ ID NO: 1087984 - RNA, 20 nt, Human
acacacagagacaugcgcau

SEQ ID NO: 1087985 - RNA, 22 nt, Human
aucuggcuuucuuaaugacuua

SEQ ID NO: 1087986 - RNA, 22 nt, Human
ugucugguggguugacaggcag

SEQ ID NO: 1087987 - RNA, 22 nt, Human
cugccucacauuggcuguguga

SEQ ID NO: 1087988 - RNA, 22 nt, Human
cccaggacucggcacucuccuu

SEQ ID NO: 1087989 - RNA, 22 nt, Human
gcagagccagaauggccaggac

SEQ ID NO: 1087990 - RNA, 22 nt, Human
acagccuggacuggcucucugc

SEQ ID NO: 1087991 - RNA, 22 nt, Human
gagcucaggagcaucagaagaa

SEQ ID NO: 1087992 - RNA, 22 nt, Human
uccaugugccaaggggcagagg

SEQ ID NO: 1087993 - RNA, 22 nt, Human
agagcugggugaagugccauca

SEQ ID NO: 1087994 - RNA, 22 nt, Human
uggcaguggcucagagugcaga

SEQ ID NO: 1087995 - RNA, 20 nt, Human
gcaaggcacagugaggaggg

SEQ ID NO: 1087996 - RNA, 22 nt, Human
uagcauuuggacauugucaccu

SEQ ID NO: 1087997 - RNA, 22 nt, Human
gaagaaggugcuacacagggca

SEQ ID NO: 1087998 - RNA, 22 nt, Human
cuaguauuuaaaggcuaugauu

SEQ ID NO: 1087999 - RNA, 22 nt, Human
cuggcagcguguuuaugaacau

SEQ ID NO: 1088000 - RNA, 22 nt, Human
cagcaggguauacagggaauuu

SEQ ID NO: 1088001 - RNA, 22 nt, Human
aagggcuggaucucucugagca

SEQ ID NO: 1088002 - RNA, 22 nt, Human
cugcugaucagggcaaagcaaa

SEQ ID NO: 1088003 - RNA, 22 nt, Human
cuguugcaucauggcucuuaau

SEQ ID NO: 1088004 - RNA, 22 nt, Human
uuuccuuuuggcuaggugugaa

SEQ ID NO: 1088005 - RNA, 22 nt, Human
ugaggggagcuagcaugccuug

SEQ ID NO: 1088006 - RNA, 22 nt, Human
cuacaaaaguaauugugguuuu

SEQ ID NO: 1088007 - RNA, 22 nt, Human
aucugcuucagugauaugugaa

SEQ ID NO: 1088008 - RNA, 18 nt, Human
gggaagccgggaagccgg

SEQ ID NO: 1088009 - RNA, 22 nt, Human
gagggcaguagccucguacccu

SEQ ID NO: 1088010 - RNA, 19 nt, Human
uucuccagccugaccugag

SEQ ID NO: 1088011 - RNA, 22 nt, Human
acaguggaauuuguagaugugu

SEQ ID NO: 1088012 - RNA, 21 nt, Human
agagaagaggacuuucucaca

SEQ ID NO: 1088013 - RNA, 22 nt, Human
aaacacagauuucuuuguccca

SEQ ID NO: 1088014 - RNA, 22 nt, Human
aggcuucuuagauuggcuggag

SEQ ID NO: 1088015 - RNA, 20 nt, Human
accaggagauggaggcaggg

SEQ ID NO: 1088016 - RNA, 22 nt, Human
aagcugccacacggugaguacu

SEQ ID NO: 1088017 - RNA, 22 nt, Human
ugcuauaagaauuauauuacuc

SEQ ID NO: 1088018 - RNA, 22 nt, Human
ugucucaguacacuccgauguu

SEQ ID NO: 1088019 - RNA, 22 nt, Human
ccaguccagugccaugcauggc

SEQ ID NO: 1088020 - RNA, 22 nt, Human
auauucguggucaaguaaggcc

SEQ ID NO: 1088021 - RNA, 22 nt, Human
ugggcagggaucucuuuugcaa

SEQ ID NO: 1088022 - RNA, 22 nt, Human
uagugcuugagucucuccguac

SEQ ID NO: 1088023 - RNA, 22 nt, Human
ggcugccuucagacuccagcuu

SEQ ID NO: 1088024 - RNA, 22 nt, Human
guccaggaagcaauaaauagaa

SEQ ID NO: 1088025 - RNA, 19 nt, Human
augagcaauaguuuuaauc

SEQ ID NO: 1088026 - RNA, 22 nt, Human
ccaggcaacggagcccacugcc

SEQ ID NO: 1088027 - RNA, 22 nt, Human
acacauagaaaauaaauaguua

SEQ ID NO: 1088028 - RNA, 22 nt, Human
cagaauaugacaagauuuuccu

SEQ ID NO: 1088029 - RNA, 20 nt, Human
cugcucugcuuugcaggugg

SEQ ID NO: 1088030 - RNA, 22 nt, Human
ucaagugagcguagcugaaugg

SEQ ID NO: 1088031 - RNA, 22 nt, Human
ggcuucaagucguauauuuggg

SEQ ID NO: 1088032 - RNA, 22 nt, Human
aggacccugaggucuccuguga

SEQ ID NO: 1088033 - RNA, 22 nt, Human
gagaaggcuggucuuaagucga

SEQ ID NO: 1088034 - RNA, 22 nt, Human
caguggaggcucaagugugcuu

SEQ ID NO: 1088035 - RNA, 23 nt, Human
aggauguaggauguauggcagag

SEQ ID NO: 1088036 - RNA, 22 nt, Human
aggcacugcagauuacaggcgc

SEQ ID NO: 1088037 - RNA, 22 nt, Human
ugcagaaggccugacauugcac

SEQ ID NO: 1088038 - RNA, 22 nt, Human
uaaagcauuuuugaaauuauga

SEQ ID NO: 1088039 - RNA, 22 nt, Human
ggagguggagguugcaaugagc

SEQ ID NO: 1088040 - RNA, 22 nt, Human
gucccucugugucccugcaguc

SEQ ID NO: 1088041 - RNA, 22 nt, Human
aggccuguuccaggccccuuuu

SEQ ID NO: 1088042 - RNA, 22 nt, Human
uuggcagggccaggcucucucu

SEQ ID NO: 1088043 - RNA, 22 nt, Human
cacuauuuucucuucagauggc

SEQ ID NO: 1088044 - RNA, 22 nt, Human
agagcuguggauaguccuggau

SEQ ID NO: 1088045 - RNA, 22 nt, Human
ugauuucucuccguuauuucag

SEQ ID NO: 1088046 - RNA, 22 nt, Human
aaaguaaccuaguaauaguguc

SEQ ID NO: 1088047 - RNA, 22 nt, Human
uacacaaucuguuuuuccauuu

SEQ ID NO: 1088048 - RNA, 22 nt, Human
cagacacacaagcaaucuaagu

SEQ ID NO: 1088049 - RNA, 22 nt, Human
aggaagccuggaguccugccca

SEQ ID NO: 1088050 - RNA, 22 nt, Human
guuucuuauuugcagguugcuu

SEQ ID NO: 1088051 - RNA, 22 nt, Human
uugacagcuauuuugcuuugau

SEQ ID NO: 1088052 - RNA, 22 nt, Human
aucugggaauggaagccuucug

SEQ ID NO: 1088053 - RNA, 22 nt, Human
gcccugccggguauuuugugcu

SEQ ID NO: 1088054 - RNA, 22 nt, Human
cuacauaaauuuaucacagacu

SEQ ID NO: 1088055 - RNA, 22 nt, Human
agcugucuccagauacaggauu

SEQ ID NO: 1088056 - RNA, 22 nt, Human
ccugggcauucuuugaguucuc

SEQ ID NO: 1088057 - RNA, 22 nt, Human
ucccaggaaaacacucgaggac

SEQ ID NO: 1088058 - RNA, 22 nt, Human
aagugggaauagaaaugaaggu

SEQ ID NO: 1088059 - RNA, 22 nt, Human
gggcuggaggugagcaggacag

SEQ ID NO: 1088060 - RNA, 22 nt, Human
auagacuugaggauauaaugaa

SEQ ID NO: 1088061 - RNA, 22 nt, Human
ucuucauguuaguuggguuuuc

SEQ ID NO: 1088062 - RNA, 22 nt, Human
uaggcuggaggaagcagugccu

SEQ ID NO: 1088063 - RNA, 23 nt, Human
uccucccaaauuucagccucauu

SEQ ID NO: 1088064 - RNA, 22 nt, Human
gugugcaugcauagacaccaca

SEQ ID NO: 1088065 - RNA, 22 nt, Human
uuugugugugcucacauagaug

SEQ ID NO: 1088066 - RNA, 22 nt, Human
aaauagacaggcuuaaauagga

SEQ ID NO: 1088067 - RNA, 22 nt, Human
auuucuuaucugaggucuacau

SEQ ID NO: 1088068 - RNA, 22 nt, Human
ucuggccugaaaguccaugcuu

SEQ ID NO: 1088069 - RNA, 22 nt, Human
cgggcaguguggcuccagaguc

SEQ ID NO: 1088070 - RNA, 19 nt, Human
ccugggaggcggagguugc

SEQ ID NO: 1088071 - RNA, 22 nt, Human
aaagaaauaccuuucucagcuu

SEQ ID NO: 1088072 - RNA, 22 nt, Human
aaucacaguggguacuagauug

SEQ ID NO: 1088073 - RNA, 20 nt, Human
gcccugugaugucuugaccu

SEQ ID NO: 1088074 - RNA, 22 nt, Human
gcucagugcagccuuucuguau

SEQ ID NO: 1088075 - RNA, 17 nt, Human
aggugcuggagcaucag

SEQ ID NO: 1088076 - RNA, 22 nt, Human
uuucucugcugccugugucgau

SEQ ID NO: 1088077 - RNA, 22 nt, Human
ucauuuauaaggaugcaauuaa

SEQ ID NO: 1088078 - RNA, 22 nt, Human
acuuuugguucuguaacuguga

SEQ ID NO: 1088079 - RNA, 22 nt, Human
aggagccaggaaaccugcucug

SEQ ID NO: 1088080 - RNA, 22 nt, Human
ggaaaaauagaguauacuuuaa

SEQ ID NO: 1088081 - RNA, 21 nt, Human
aaaauguagacuuuucccuga

SEQ ID NO: 1088082 - RNA, 22 nt, Human
cugaaggauucaaaauggcagg

SEQ ID NO: 1088083 - RNA, 22 nt, Human
aaugcuuuuugcgaaaugugca

SEQ ID NO: 1088084 - RNA, 22 nt, Human
cuggggcucacuccagcccugg

SEQ ID NO: 1088085 - RNA, 22 nt, Human
ccuuuugcucucccauccagaa

SEQ ID NO: 1088086 - RNA, 22 nt, Human
acacaugagaaacaucaguugu

SEQ ID NO: 1088087 - RNA, 22 nt, Human
gcuguauuccugcacuguauag

SEQ ID NO: 1088088 - RNA, 19 nt, Human
uugaaauuguuugauaugg

SEQ ID NO: 1088089 - RNA, 22 nt, Human
ggagcagucuggugauacucag

SEQ ID NO: 1088090 - RNA, 22 nt, Human
gaaaugacaaggacauuccugu

SEQ ID NO: 1088091 - RNA, 22 nt, Human
auuuuaauaagauccauuuggu

SEQ ID NO: 1088092 - RNA, 22 nt, Human
gcucuguacgcaggaugagggg

SEQ ID NO: 1088093 - RNA, 22 nt, Human
agccacgucccugucaggguca

SEQ ID NO: 1088094 - RNA, 19 nt, Human
caugugcaugagcacagga

SEQ ID NO: 1088095 - RNA, 22 nt, Human
ccuggcacaagagcagcauugg

SEQ ID NO: 1088096 - RNA, 22 nt, Human
ucagagcuuaucucuugcugga

SEQ ID NO: 1088097 - RNA, 22 nt, Human
caaucaugguauaauuccuuuu

SEQ ID NO: 1088098 - RNA, 22 nt, Human
gaugguuuggaaugaaguagcu

SEQ ID NO: 1088099 - RNA, 22 nt, Human
cagcaagacaguuuccuaagug

SEQ ID NO: 1088100 - RNA, 22 nt, Human
ggggccagguccagcuuccaaa

SEQ ID NO: 1088101 - RNA, 22 nt, Human
acagaucacuugacuaaaauga

SEQ ID NO: 1088102 - RNA, 22 nt, Human
ucuggcuccugaguccaugcuc

SEQ ID NO: 1088103 - RNA, 22 nt, Human
ucagcaguggcucucaugcagu

SEQ ID NO: 1088104 - RNA, 22 nt, Human
agggugcagucacaggaaaugu

SEQ ID NO: 1088105 - RNA, 22 nt, Human
agagucuuccaggcagccugag

SEQ ID NO: 1088106 - RNA, 22 nt, Human
aaguaugacauuuaagacaauu

SEQ ID NO: 1088107 - RNA, 22 nt, Human
ucagaagccggaagugcuccuc

SEQ ID NO: 1088108 - RNA, 22 nt, Human
auuucaucucuggaacauaacu

SEQ ID NO: 1088109 - RNA, 22 nt, Human
gagcugaggcucaggcuggcgu

SEQ ID NO: 1088110 - RNA, 17 nt, Human
cacaggugugguuugag

SEQ ID NO: 1088111 - RNA, 17 nt, Human
caguggucugagguaug

SEQ ID NO: 1088112 - RNA, 22 nt, Human
gcucugagaggaugcugagcag

SEQ ID NO: 1088113 - RNA, 22 nt, Human
cacugccuccccaggcuccaca

SEQ ID NO: 1088114 - RNA, 22 nt, Human
gauuauuuugugcaauaaucgg

SEQ ID NO: 1088115 - RNA, 22 nt, Human
ucucuucucuagugagcaacug

SEQ ID NO: 1088116 - RNA, 22 nt, Human
aaagguuuauuuaaucagggag

SEQ ID NO: 1088117 - RNA, 22 nt, Human
uucugucugauggugccagaac

SEQ ID NO: 1088118 - RNA, 22 nt, Human
uaugaagcugauaaucacugau

SEQ ID NO: 1088119 - RNA, 22 nt, Human
caccagggcagcagccuagucu

SEQ ID NO: 1088120 - RNA, 22 nt, Human
cauguccauuuaugcacagaaa

SEQ ID NO: 1088121 - RNA, 22 nt, Human
uacacaguaaaugguaaauaca

SEQ ID NO: 1088122 - RNA, 22 nt, Human
cauucuaaaguguuuuauaccu

SEQ ID NO: 1088123 - RNA, 22 nt, Human
uccugcagagccgcccucaggu

SEQ ID NO: 1088124 - RNA, 22 nt, Human
ugugccugaguuggcugaguac

SEQ ID NO: 1088125 - RNA, 22 nt, Human
cacacuagucuauccauuagcu

SEQ ID NO: 1088126 - RNA, 22 nt, Human
uccaggcagcccuuccugacuc

SEQ ID NO: 1088127 - RNA, 22 nt, Human
ucugucacuauuggccagaaca

SEQ ID NO: 1088128 - RNA, 19 nt, Human
gucuucugaauguggcugc

SEQ ID NO: 1088129 - RNA, 22 nt, Human
cugugcaagcccaagauaaaac

SEQ ID NO: 1088130 - RNA, 21 nt, Human
ggccucugucauccugggaag

SEQ ID NO: 1088131 - RNA, 22 nt, Human
gcugggcucuuaucaccuguac

SEQ ID NO: 1088132 - RNA, 22 nt, Human
cagagcccuuggcuggagccca

SEQ ID NO: 1088133 - RNA, 22 nt, Human
ggcugcugggaauaugccagcu

SEQ ID NO: 1088134 - RNA, 22 nt, Human
gcagaggcaaucagguaugugg

SEQ ID NO: 1088135 - RNA, 22 nt, Human
gggcucugggaugcucuuagag

SEQ ID NO: 1088136 - RNA, 22 nt, Human
guugaaaguagaugcuauuugg

SEQ ID NO: 1088137 - RNA, 22 nt, Human
cuaguggaaacuaacuggaauu

SEQ ID NO: 1088138 - RNA, 22 nt, Human
ggaaaaggccauuguuucucug

SEQ ID NO: 1088139 - RNA, 22 nt, Human
caucaucaccugcuauacgauc

SEQ ID NO: 1088140 - RNA, 22 nt, Human
agaaauguugaauacacaaaau

SEQ ID NO: 1088141 - RNA, 22 nt, Human
cauuucacaaauggccacauca

SEQ ID NO: 1088142 - RNA, 21 nt, Human
agaauaaugguaucauuugcu

SEQ ID NO: 1088143 - RNA, 22 nt, Human
uguacauacauagauauacaca

SEQ ID NO: 1088144 - RNA, 22 nt, Human
ucaggcagaauuaucaaaagau

SEQ ID NO: 1088145 - RNA, 22 nt, Human
uaagcagagcccucuuuauuag

SEQ ID NO: 1088146 - RNA, 22 nt, Human
aaaucacagggucucuaaguau

SEQ ID NO: 1088147 - RNA, 22 nt, Human
acuucuguaaagggaagacagu

SEQ ID NO: 1088148 - RNA, 21 nt, Human
gcagaugggaagagacgaggc

SEQ ID NO: 1088149 - RNA, 19 nt, Human
uuugaauauaaugcagcua

SEQ ID NO: 1088150 - RNA, 22 nt, Human
cccuggcagaaugucucugggc

SEQ ID NO: 1088151 - RNA, 22 nt, Human
uaucuuuaaugcuuggagguua

SEQ ID NO: 1088152 - RNA, 22 nt, Human
cuuucuucaaccucauucugca

SEQ ID NO: 1088153 - RNA, 22 nt, Human
cagcauuuggaggagaggcuuu

SEQ ID NO: 1088154 - RNA, 22 nt, Human
uguugagacacagacacaagcc

SEQ ID NO: 1088155 - RNA, 22 nt, Human
ucugagcuggagcccaucaccu

SEQ ID NO: 1088156 - RNA, 19 nt, Human
cccagagcauccugaacuu

SEQ ID NO: 1088157 - RNA, 22 nt, Human
aaacaauuuccaccucuccuga

SEQ ID NO: 1088158 - RNA, 18 nt, Human
ggccucuggacuggcagc

SEQ ID NO: 1088159 - RNA, 22 nt, Human
cucugaagggagggccaagccc

SEQ ID NO: 1088160 - RNA, 22 nt, Human
ucugagacuccauaaguugaaa

SEQ ID NO: 1088161 - RNA, 22 nt, Human
aacuuccaggccuugaauuauu

SEQ ID NO: 1088162 - RNA, 22 nt, Human
gauuuaaaguagaccuuuguuu

SEQ ID NO: 1088163 - RNA, 22 nt, Human
gagcagcuguucugacuugucu

SEQ ID NO: 1088164 - RNA, 22 nt, Human
cagggacaggggagaaaagaug

SEQ ID NO: 1088165 - RNA, 22 nt, Human
acccaggacuuggcaaccucau

SEQ ID NO: 1088166 - RNA, 20 nt, Human
cugaaccaaggcuuucucag

SEQ ID NO: 1088167 - RNA, 22 nt, Human
augacaguucuacacuuaaucu

SEQ ID NO: 1088168 - RNA, 22 nt, Human
ccuccugggacaggcuggcaca

SEQ ID NO: 1088169 - RNA, 22 nt, Human
agguauuuuauagauaaguaaa

SEQ ID NO: 1088170 - RNA, 22 nt, Human
gagaaacaacacuugaugccuu

SEQ ID NO: 1088171 - RNA, 22 nt, Human
acagagccuccaggagugcugg

SEQ ID NO: 1088172 - RNA, 22 nt, Human
guguaaguaucuuuguaucuuu

SEQ ID NO: 1088173 - RNA, 22 nt, Human
gggaagggagggccuccaguca

SEQ ID NO: 1088174 - RNA, 22 nt, Human
aaacaucucaaagagguauuug

SEQ ID NO: 1088175 - RNA, 22 nt, Human
gaaggcugagcagacaggccaa

SEQ ID NO: 1088176 - RNA, 22 nt, Human
uucagucagugacuaagcaguu

SEQ ID NO: 1088177 - RNA, 22 nt, Human
uuugaauaucacaaacuuucaa

SEQ ID NO: 1088178 - RNA, 22 nt, Human
acccagaggugucuagcaagcu

SEQ ID NO: 1088179 - RNA, 22 nt, Human
uguuacaauauuaucaacugag

SEQ ID NO: 1088180 - RNA, 20 nt, Human
acacacuuugaucuugagcc

SEQ ID NO: 1088181 - RNA, 22 nt, Human
acaggaaauuggcauaucaguu

SEQ ID NO: 1088182 - RNA, 20 nt, Human
gugggcagaugugugcaugg

SEQ ID NO: 1088183 - RNA, 22 nt, Human
uguacauugucacucaucaagu

SEQ ID NO: 1088184 - RNA, 22 nt, Human
aaguaaauaucuguagucuuua

SEQ ID NO: 1088185 - RNA, 22 nt, Human
ccuacauucucugaguuuuccu

SEQ ID NO: 1088186 - RNA, 22 nt, Human
ugaaacuuauaagaauaugaau

SEQ ID NO: 1088187 - RNA, 22 nt, Human
ggcugagccuggagcaucuggu

SEQ ID NO: 1088188 - RNA, 22 nt, Human
gucucugucuuaggccaggccu

SEQ ID NO: 1088189 - RNA, 22 nt, Human
augcaagauguauagaagacuu

SEQ ID NO: 1088190 - RNA, 22 nt, Human
uuugugaacuuaggcaauuagg

SEQ ID NO: 1088191 - RNA, 22 nt, Human
acgcagaagggccuggcgugcc

SEQ ID NO: 1088192 - RNA, 22 nt, Human
aggcuggcgacaucuggcgggc

SEQ ID NO: 1088193 - RNA, 18 nt, Human
uuguuuuaagacucuguc

SEQ ID NO: 1088194 - RNA, 22 nt, Human
ggcucugccacuucuuggcugu

SEQ ID NO: 1088195 - RNA, 22 nt, Human
guggagccaggaucuccgcaca

SEQ ID NO: 1088196 - RNA, 21 nt, Human
agcugccacccuagcuucuga

SEQ ID NO: 1088197 - RNA, 22 nt, Human
aguggcuuggcugcacuacagg

SEQ ID NO: 1088198 - RNA, 22 nt, Human
ucagauggaaugaugccacugc

SEQ ID NO: 1088199 - RNA, 22 nt, Human
caagaaauucuguucagauagc

SEQ ID NO: 1088200 - RNA, 17 nt, Human
acacagccagguucucc

SEQ ID NO: 1088201 - RNA, 22 nt, Human
uuugcuuguucaagauuucugu

SEQ ID NO: 1088202 - RNA, 22 nt, Human
acaacugucaguaaagaauauu

SEQ ID NO: 1088203 - RNA, 22 nt, Human
acugugugggccgcucacuggg

SEQ ID NO: 1088204 - RNA, 22 nt, Human
uugccauuuaguaugcuuguau

SEQ ID NO: 1088205 - RNA, 22 nt, Human
cagcuguuccuggaaggagacc

SEQ ID NO: 1088206 - RNA, 22 nt, Human
ggcaaaaaguucccaucagugu

SEQ ID NO: 1088207 - RNA, 19 nt, Human
gcccucaggcagcuccauc

SEQ ID NO: 1088208 - RNA, 22 nt, Human
ggccugcugacccaaguccugu

SEQ ID NO: 1088209 - RNA, 22 nt, Human
uuuucacaugcuuggggacuua

SEQ ID NO: 1088210 - RNA, 22 nt, Human
cuuccagucuagagcuaucugu

SEQ ID NO: 1088211 - RNA, 22 nt, Human
auacagaugggucagauuucau

SEQ ID NO: 1088212 - RNA, 22 nt, Human
agcacuuuaagcaacagaucaa

SEQ ID NO: 1088213 - RNA, 21 nt, Human
ugaacacagauuugucugauu

SEQ ID NO: 1088214 - RNA, 22 nt, Human
uugaagagucuuucuuuccccc

SEQ ID NO: 1088215 - RNA, 22 nt, Human
gccuggaaugcaaugugacgaa

SEQ ID NO: 1088216 - RNA, 22 nt, Human
ugcugucccccgugucugggcu

SEQ ID NO: 1088217 - RNA, 22 nt, Human
auucaguucuaaggucagugcc

SEQ ID NO: 1088218 - RNA, 20 nt, Human
ggcagcaggaguuuccucuu

SEQ ID NO: 1088219 - RNA, 22 nt, Human
ccagcuggcacuguggcugccc

SEQ ID NO: 1088220 - RNA, 22 nt, Human
auacagaaaaugaugcagaguu

SEQ ID NO: 1088221 - RNA, 22 nt, Human
uucaacaaguauuuauugagca

SEQ ID NO: 1088222 - RNA, 22 nt, Human
cuguugucuccucucagauuau

SEQ ID NO: 1088223 - RNA, 22 nt, Human
agucugccuuuccaaucccgug

SEQ ID NO: 1088224 - RNA, 22 nt, Human
acagccaggagccaugggcagg

SEQ ID NO: 1088225 - RNA, 22 nt, Human
ccugcagaccacacucaguccu

SEQ ID NO: 1088226 - RNA, 22 nt, Human
caggaacaauaucuguccuggu

SEQ ID NO: 1088227 - RNA, 22 nt, Human
ucuuugaacuuuuuguaaguua

SEQ ID NO: 1088228 - RNA, 22 nt, Human
ccuccugcacuugcuuuccuuc

SEQ ID NO: 1088229 - RNA, 22 nt, Human
gcagggacugugaucucacaga

SEQ ID NO: 1088230 - RNA, 22 nt, Human
ucucaaacuaacaaugauuaua

SEQ ID NO: 1088231 - RNA, 22 nt, Human
gguaacaguuacaguaacagua

SEQ ID NO: 1088232 - RNA, 20 nt, Human
gagauccucaucuguaaagu

SEQ ID NO: 1088233 - RNA, 22 nt, Human
augggcagacagggagcucacg

SEQ ID NO: 1088234 - RNA, 22 nt, Human
auuuuuuagaaccuggccugau

SEQ ID NO: 1088235 - RNA, 22 nt, Human
aucagaaggggagguaaagaag

SEQ ID NO: 1088236 - RNA, 19 nt, Human
gaauuuaucucuucagucc

SEQ ID NO: 1088237 - RNA, 22 nt, Human
gagcagagucuauuuccacacu

SEQ ID NO: 1088238 - RNA, 22 nt, Human
uucaccacuuugcaccaggccu

SEQ ID NO: 1088239 - RNA, 22 nt, Human
aacauacuuauacuaaauaaug

SEQ ID NO: 1088240 - RNA, 22 nt, Human
cugcuuugaaaauaaacuuguc

SEQ ID NO: 1088241 - RNA, 22 nt, Human
ggcuccugggagaaguuuuauu

SEQ ID NO: 1088242 - RNA, 22 nt, Human
ccagucccaggcagaaauccag

SEQ ID NO: 1088243 - RNA, 22 nt, Human
uucugagagugccagaaguucu

SEQ ID NO: 1088244 - RNA, 22 nt, Human
uuggaagaucuaacagaggcau

SEQ ID NO: 1088245 - RNA, 20 nt, Human
cccucugcuacacugggagc

SEQ ID NO: 1088246 - RNA, 22 nt, Human
uguucuuagcaggagcaucuau

SEQ ID NO: 1088247 - RNA, 22 nt, Human
ccugaagagcacucuagaguug

SEQ ID NO: 1088248 - RNA, 22 nt, Human
gaccagagaaaggcacuggaag

SEQ ID NO: 1088249 - RNA, 22 nt, Human
aagggcagcugacagaugcuua

SEQ ID NO: 1088250 - RNA, 22 nt, Human
gacuggaaagccuguccucaga

SEQ ID NO: 1088251 - RNA, 18 nt, Human
agaugaaagcaaaugaca

SEQ ID NO: 1088252 - RNA, 18 nt, Human
ucauuuugucugccuuug

SEQ ID NO: 1088253 - RNA, 22 nt, Human
cccagaguggacgguggccccu

SEQ ID NO: 1088254 - RNA, 22 nt, Human
guggauggauuuugaggaaugg

SEQ ID NO: 1088255 - RNA, 22 nt, Human
caguggaaacuaugcugcugga

SEQ ID NO: 1088256 - RNA, 22 nt, Human
acugaaggguaaugugggagcc

SEQ ID NO: 1088257 - RNA, 22 nt, Human
guuccaauuccaaauuccaagg

SEQ ID NO: 1088258 - RNA, 22 nt, Human
gcagcaggcuuuucauaccuug

SEQ ID NO: 1088259 - RNA, 22 nt, Human
uggcagucuggguuggcaguua

SEQ ID NO: 1088260 - RNA, 22 nt, Human
gaacaaagacauggaggaggau

SEQ ID NO: 1088261 - RNA, 22 nt, Human
ggcugaggcucaugccaucuug

SEQ ID NO: 1088262 - RNA, 23 nt, Human
auaucacacccaguacagucucc

SEQ ID NO: 1088263 - RNA, 22 nt, Human
agucaguuaaccucacagcauc

SEQ ID NO: 1088264 - RNA, 22 nt, Human
cuauuucugccuaaugaccugu

SEQ ID NO: 1088265 - RNA, 22 nt, Human
auaauaacaccugaauaggaaa

SEQ ID NO: 1088266 - RNA, 22 nt, Human
aaggcagaaauucaacuacugg

SEQ ID NO: 1088267 - RNA, 22 nt, Human
guguggcuagaagugucuuguu

SEQ ID NO: 1088268 - RNA, 22 nt, Human
acagcagaugacaacuauuuau

SEQ ID NO: 1088269 - RNA, 22 nt, Human
agggaaggaaaagcugucgcuu

SEQ ID NO: 1088270 - RNA, 23 nt, Human
gauguguagggaaagucagacuc

SEQ ID NO: 1088271 - RNA, 22 nt, Human
uuacaucugcacuccaggacag

SEQ ID NO: 1088272 - RNA, 22 nt, Human
cugcagaggccucgccuccucu

SEQ ID NO: 1088273 - RNA, 22 nt, Human
guauacauagaugaugaacaag

SEQ ID NO: 1088274 - RNA, 22 nt, Human
uggagcaggacggggaguggua

SEQ ID NO: 1088275 - RNA, 22 nt, Human
uuucacauggaagcucucgaga

SEQ ID NO: 1088276 - RNA, 22 nt, Human
aaaugguaugaaaagagauuuc

SEQ ID NO: 1088277 - RNA, 22 nt, Human
uuucacaggggcaaccuccaug

SEQ ID NO: 1088278 - RNA, 22 nt, Human
agcacagagauuauuuacaaga

SEQ ID NO: 1088279 - RNA, 22 nt, Human
gugcccugugaacuguaaggaa

SEQ ID NO: 1088280 - RNA, 22 nt, Human
augagcccagggaauuccuuuc

SEQ ID NO: 1088281 - RNA, 22 nt, Human
aggagucagauaugggaaaguu

SEQ ID NO: 1088282 - RNA, 22 nt, Human
acuucagugugguauaaaacgu

SEQ ID NO: 1088283 - RNA, 22 nt, Human
cagaagcauuccagcaaauagu

SEQ ID NO: 1088284 - RNA, 22 nt, Human
uccugagaugagacagugcugc

SEQ ID NO: 1088285 - RNA, 22 nt, Human
acagagucuuacguggugauaa

SEQ ID NO: 1088286 - RNA, 22 nt, Human
ucagaagcauguggggagccug

SEQ ID NO: 1088287 - RNA, 22 nt, Human
agucagugaaggcauugcucaa

SEQ ID NO: 1088288 - RNA, 20 nt, Human
gucuuauuuaacacaugacu

SEQ ID NO: 1088289 - RNA, 22 nt, Human
auguguagaacuguaaugccca

SEQ ID NO: 1088290 - RNA, 22 nt, Human
guuucuuaaguuacaaaaucuu

SEQ ID NO: 1088291 - RNA, 22 nt, Human
gggcugagcacauacugacagc

SEQ ID NO: 1088292 - RNA, 22 nt, Human
caugcuuuucaaucuaucuuaa

SEQ ID NO: 1088293 - RNA, 22 nt, Human
cagccaggagccucugcaacua

SEQ ID NO: 1088294 - RNA, 22 nt, Human
uuguuuugcuaaagggucauca

SEQ ID NO: 1088295 - RNA, 22 nt, Human
acauacaugguucucagcccuu

SEQ ID NO: 1088296 - RNA, 22 nt, Human
agcccugcauagaagggaacac

SEQ ID NO: 1088297 - RNA, 22 nt, Human
aggacaggauugagcugaacug

SEQ ID NO: 1088298 - RNA, 22 nt, Human
uaguaacacauugaacgaucgc

SEQ ID NO: 1088299 - RNA, 22 nt, Human
gcaugagggggguuaggaaguu

SEQ ID NO: 1088300 - RNA, 22 nt, Human
aagauggaguaguguaaugguu

SEQ ID NO: 1088301 - RNA, 19 nt, Human
ccauauaaccagcaagugu

SEQ ID NO: 1088302 - RNA, 22 nt, Human
uuuguucaaauuuuccuaucug

SEQ ID NO: 1088303 - RNA, 22 nt, Human
aucaaagagugagauuuuuacu

SEQ ID NO: 1088304 - RNA, 22 nt, Human
uuuaaaaucagaugggaguugg

SEQ ID NO: 1088305 - RNA, 22 nt, Human
uguggcuguguccaccugcugc

SEQ ID NO: 1088306 - RNA, 20 nt, Human
ggcacuggaagcacacagga

SEQ ID NO: 1088307 - RNA, 22 nt, Human
gaggcagcauucgcauagacag

SEQ ID NO: 1088308 - RNA, 22 nt, Human
uggaacacugaucauugccuuu

SEQ ID NO: 1088309 - RNA, 22 nt, Human
aaccaggaacuuuugugagagc

SEQ ID NO: 1088310 - RNA, 22 nt, Human
gaaggcugaguggguacggagg

SEQ ID NO: 1088311 - RNA, 22 nt, Human
uggccuuccuggugacucauga

SEQ ID NO: 1088312 - RNA, 22 nt, Human
aggagggcuaggaaaaccagga

SEQ ID NO: 1088313 - RNA, 22 nt, Human
uauuuggaaaagggaagggaca

SEQ ID NO: 1088314 - RNA, 22 nt, Human
gggcaugccugcgcagugcaug

SEQ ID NO: 1088315 - RNA, 14 nt, Human
gcagguggaucacu

SEQ ID NO: 1088316 - RNA, 22 nt, Human
ggcacuuuccagucuauagagc

SEQ ID NO: 1088317 - RNA, 22 nt, Human
aggcccagacucagcggggcgg

SEQ ID NO: 1088318 - RNA, 22 nt, Human
ugcaccauacccauuccccucu

SEQ ID NO: 1088319 - RNA, 22 nt, Human
gcaggcuccaaggccugggaga

SEQ ID NO: 1088320 - RNA, 22 nt, Human
ucucuggggauggaccugggag

SEQ ID NO: 1088321 - RNA, 22 nt, Human
gcagggcugggugggagacaga

SEQ ID NO: 1088322 - RNA, 22 nt, Human
agcugggucuugggccaggaga

SEQ ID NO: 1088323 - RNA, 22 nt, Human
cuugccuguggcuaguuggcuc

SEQ ID NO: 1088324 - RNA, 22 nt, Human
aagccacuauggugauucucaa

SEQ ID NO: 1088325 - RNA, 21 nt, Human
cuggagucauuuucugaguag

SEQ ID NO: 1088326 - RNA, 22 nt, Human
uuucaaauaccauaaaccuaau

SEQ ID NO: 1088327 - RNA, 22 nt, Human
uccaauauuucucauauaugga

SEQ ID NO: 1088328 - RNA, 22 nt, Human
uaauacugaaaggaguaucagc

SEQ ID NO: 1088329 - RNA, 22 nt, Human
ucacuucacacccacuaucaug

SEQ ID NO: 1088330 - RNA, 22 nt, Human
cuggagcugcuguccuugggug

SEQ ID NO: 1088331 - RNA, 22 nt, Human
uuuuuccuaagcaguggagcug

SEQ ID NO: 1088332 - RNA, 22 nt, Human
ugaaaugagagcacagaauaaa

SEQ ID NO: 1088333 - RNA, 17 nt, Human
gucugggcuuuagagac

SEQ ID NO: 1088334 - RNA, 22 nt, Human
gcagggcagcuuagucccuguc

SEQ ID NO: 1088335 - RNA, 22 nt, Human
cagaccugagguugaguaccag

SEQ ID NO: 1088336 - RNA, 22 nt, Human
uuuuccaaaguaccaugucccu

SEQ ID NO: 1088337 - RNA, 22 nt, Human
aauauuuguuaguguuuuaaug

SEQ ID NO: 1088338 - RNA, 21 nt, Human
aucagcaaaugccugucuccc

SEQ ID NO: 1088339 - RNA, 22 nt, Human
ccuggccaaucuagggcuguua

SEQ ID NO: 1088340 - RNA, 22 nt, Human
agauguuuuagaguuugacuug

SEQ ID NO: 1088341 - RNA, 23 nt, Human
ugcagagggacugaagccagcuu

SEQ ID NO: 1088342 - RNA, 15 nt, Human
ggcagguggaucacu

SEQ ID NO: 1088343 - RNA, 22 nt, Human
acauacauauguuuaaaugcau

SEQ ID NO: 1088344 - RNA, 22 nt, Human
cuggccuggucuggccucucca

SEQ ID NO: 1088345 - RNA, 22 nt, Human
aggaggaauacaauccagcagc

SEQ ID NO: 1088346 - RNA, 22 nt, Human
ucaccuaauugaagucaggagu

SEQ ID NO: 1088347 - RNA, 22 nt, Human
guccuggguccccgcaggucag

SEQ ID NO: 1088348 - RNA, 22 nt, Human
agacacagaacacaaaagcaua

SEQ ID NO: 1088349 - RNA, 22 nt, Human
gucaugccagcggagcucggga

SEQ ID NO: 1088350 - RNA, 19 nt, Human
caucucugcaaggagcugc

SEQ ID NO: 1088351 - RNA, 20 nt, Human
agcugaggcaccugagguua

SEQ ID NO: 1088352 - RNA, 22 nt, Human
acacugaaagaagccagcuugu

SEQ ID NO: 1088353 - RNA, 21 nt, Human
uguaaguuucaucugaauugg

SEQ ID NO: 1088354 - RNA, 22 nt, Human
uuccaaauuccaauccccugaa

SEQ ID NO: 1088355 - RNA, 22 nt, Human
uugcaaauucauggaucugaau

SEQ ID NO: 1088356 - RNA, 22 nt, Human
aauuauguggaagaggauuaaa

SEQ ID NO: 1088357 - RNA, 22 nt, Human
guuucacauaauuuuaaauugu

SEQ ID NO: 1088358 - RNA, 22 nt, Human
auucuucauguugaagcuguca

SEQ ID NO: 1088359 - RNA, 22 nt, Human
aagcacauuauagcuaucuagg

SEQ ID NO: 1088360 - RNA, 22 nt, Human
acaucacagagcccagauaaag

SEQ ID NO: 1088361 - RNA, 22 nt, Human
ucugccugagaaguggggugcc

SEQ ID NO: 1088362 - RNA, 22 nt, Human
gagccuucaucgcagccuuguu

SEQ ID NO: 1088363 - RNA, 22 nt, Human
caaaugauagagccgauuauca

SEQ ID NO: 1088364 - RNA, 22 nt, Human
cuggacagugggcagaggagac

SEQ ID NO: 1088365 - RNA, 22 nt, Human
uccagggaucuuuagagucuuu

SEQ ID NO: 1088366 - RNA, 22 nt, Human
gggcuugcugauuugggcagga

SEQ ID NO: 1088367 - RNA, 22 nt, Human
cuuccugcauugugccagaguu

SEQ ID NO: 1088368 - RNA, 22 nt, Human
agccuggacagcuacggagaac

SEQ ID NO: 1088369 - RNA, 22 nt, Human
acaagaaagguaggauucaggu

SEQ ID NO: 1088370 - RNA, 22 nt, Human
ucugcagauuuaucagcagcug

SEQ ID NO: 1088371 - RNA, 22 nt, Human
cagaagagaugaaauaguauua

SEQ ID NO: 1088372 - RNA, 22 nt, Human
caggaaggcccaccuguccugu

SEQ ID NO: 1088373 - RNA, 19 nt, Human
cucuccagcuccaguagcu

SEQ ID NO: 1088374 - RNA, 22 nt, Human
ugccucagaguugucccuacca

SEQ ID NO: 1088375 - RNA, 22 nt, Human
aguucuggcccaggguuucuug

SEQ ID NO: 1088376 - RNA, 22 nt, Human
ggagagcuagugccugccagua

SEQ ID NO: 1088377 - RNA, 22 nt, Human
gagcaggcuugcagagaagggg

SEQ ID NO: 1088378 - RNA, 22 nt, Human
aaacaugagcacuugcuucaua

SEQ ID NO: 1088379 - RNA, 22 nt, Human
ccuggcccacauggcuucuccc

SEQ ID NO: 1088380 - RNA, 19 nt, Human
accaggaacuucccuaggc

SEQ ID NO: 1088381 - RNA, 22 nt, Human
agcuuaggaggaugaugaacau

SEQ ID NO: 1088382 - RNA, 22 nt, Human
uccagccaugcaugacaaucac

SEQ ID NO: 1088383 - RNA, 22 nt, Human
uucacaaagcuggagcauuucc

SEQ ID NO: 1088384 - RNA, 22 nt, Human
acaaaguuucuucuaacaucug

SEQ ID NO: 1088385 - RNA, 20 nt, Human
gcuaggaaggggaaaaagug

SEQ ID NO: 1088386 - RNA, 22 nt, Human
aacaggcaaacugugggauccc

SEQ ID NO: 1088387 - RNA, 22 nt, Human
ucucaggggauucacuggcacc

SEQ ID NO: 1088388 - RNA, 22 nt, Human
auucagcaguuccugcuucagu

SEQ ID NO: 1088389 - RNA, 22 nt, Human
auaacagaugugaagugcuaau

SEQ ID NO: 1088390 - RNA, 22 nt, Human
cagcccuggcuagggcgagggc

SEQ ID NO: 1088391 - RNA, 20 nt, Human
agagagaccuaggccuaguc

SEQ ID NO: 1088392 - RNA, 21 nt, Human
ugcugaaucugccauauuuuc

SEQ ID NO: 1088393 - RNA, 22 nt, Human
ugggccaggggccucuucugau

SEQ ID NO: 1088394 - RNA, 22 nt, Human
uagucuuuugagaaguauaucu

SEQ ID NO: 1088395 - RNA, 22 nt, Human
ugacaccacaacuagccauuga

SEQ ID NO: 1088396 - RNA, 22 nt, Human
ccaguugguuucaaugggacag

SEQ ID NO: 1088397 - RNA, 22 nt, Human
aggaugggccugggauaugcuu

SEQ ID NO: 1088398 - RNA, 22 nt, Human
augaaauauuucagagcagagu

SEQ ID NO: 1088399 - RNA, 22 nt, Human
aagaaaaucaguucuggucagu

SEQ ID NO: 1088400 - RNA, 22 nt, Human
uagauaaauuagaaaguuuacu

SEQ ID NO: 1088401 - RNA, 22 nt, Human
aauuaacagagggcuuauuacu

SEQ ID NO: 1088402 - RNA, 20 nt, Human
cagaggcauuuucagacucu

SEQ ID NO: 1088403 - RNA, 22 nt, Human
caaguuauuucauuggaacaau

SEQ ID NO: 1088404 - RNA, 22 nt, Human
uucaugccagcccuguguggua

SEQ ID NO: 1088405 - RNA, 22 nt, Human
agaggcugagaaacccucuucu

SEQ ID NO: 1088406 - RNA, 22 nt, Human
gugcaggugaccuaauccaugu

SEQ ID NO: 1088407 - RNA, 22 nt, Human
uuauacauguuuauaagguuga

SEQ ID NO: 1088408 - RNA, 22 nt, Human
gcagaagaccaugguggaaaga

SEQ ID NO: 1088409 - RNA, 22 nt, Human
gcuggagguuucaccugaguuu

SEQ ID NO: 1088410 - RNA, 22 nt, Human
ggagucagaacccaggcuucua

SEQ ID NO: 1088411 - RNA, 22 nt, Human
gcaggaguuaggcgucguggau

SEQ ID NO: 1088412 - RNA, 22 nt, Human
gaccauuucuaggaaucagacu

SEQ ID NO: 1088413 - RNA, 22 nt, Human
aucaggauuauuaaaucuggau

SEQ ID NO: 1088414 - RNA, 22 nt, Human
aggccuggccuuuauguucaag

SEQ ID NO: 1088415 - RNA, 22 nt, Human
cucaacauuuaacagugaaaaa

SEQ ID NO: 1088416 - RNA, 22 nt, Human
gacauguacuucaauuucucuu

SEQ ID NO: 1088417 - RNA, 22 nt, Human
ccugauuauuguaaauauauuu

SEQ ID NO: 1088418 - RNA, 22 nt, Human
aggcagcauuugaauccagguc

SEQ ID NO: 1088419 - RNA, 22 nt, Human
aggggcuccucucugagaguag

SEQ ID NO: 1088420 - RNA, 22 nt, Human
cuauugaauagcccaaaucauu

SEQ ID NO: 1088421 - RNA, 15 nt, Human
aaucuggcggcaagu

SEQ ID NO: 1088422 - RNA, 22 nt, Human
gcacuaaaccaacauguaauaa

SEQ ID NO: 1088423 - RNA, 22 nt, Human
uuccauaauuaaguggagagaa

SEQ ID NO: 1088424 - RNA, 22 nt, Human
aggugggguucagucucagccg

SEQ ID NO: 1088425 - RNA, 22 nt, Human
uuacacaacaucuguauuauua

SEQ ID NO: 1088426 - RNA, 22 nt, Human
uauauuaaagugcuuugcagug

SEQ ID NO: 1088427 - RNA, 23 nt, Human
gcacugggcucucagcaaggugu

SEQ ID NO: 1088428 - RNA, 22 nt, Human
gcuggccaggugcuuugguucu

SEQ ID NO: 1088429 - RNA, 22 nt, Human
augcuuuggccaaugagaagug

SEQ ID NO: 1088430 - RNA, 22 nt, Human
gugucccaggccucuggaauua

SEQ ID NO: 1088431 - RNA, 22 nt, Human
ggccuuggggaggauggugucc

SEQ ID NO: 1088432 - RNA, 22 nt, Human
caagaugggcaccccagcaccu

SEQ ID NO: 1088433 - RNA, 22 nt, Human
aaagagcaagcugagauuugaa

SEQ ID NO: 1088434 - RNA, 22 nt, Human
ggaaggaagugcagacuuuaaa

SEQ ID NO: 1088435 - RNA, 22 nt, Human
agcacagaaaguauugacugaa

SEQ ID NO: 1088436 - RNA, 22 nt, Human
aggagaguaccauugggccgca

SEQ ID NO: 1088437 - RNA, 22 nt, Human
gggggcuggaauauccaucaac

SEQ ID NO: 1088438 - RNA, 22 nt, Human
gagaagcaauuuccaacugugc

SEQ ID NO: 1088439 - RNA, 22 nt, Human
cagcuuuugcagacuucuugcc

SEQ ID NO: 1088440 - RNA, 22 nt, Human
uggcugccuagugucugagcag

SEQ ID NO: 1088441 - RNA, 22 nt, Human
auugucuucugucuuauaguuc

SEQ ID NO: 1088442 - RNA, 22 nt, Human
cugggcacauuuugacuagugu

SEQ ID NO: 1088443 - RNA, 22 nt, Human
ugaccaaagacuuuagauguuc

SEQ ID NO: 1088444 - RNA, 18 nt, Human
uuucugaaugucuauuuc

SEQ ID NO: 1088445 - RNA, 22 nt, Human
agugugugcaugcauucgugca

SEQ ID NO: 1088446 - RNA, 22 nt, Human
uaaggccauuauggugggcccg

SEQ ID NO: 1088447 - RNA, 20 nt, Human
aagauucugauuuguagcgu

SEQ ID NO: 1088448 - RNA, 22 nt, Human
cuuccuguugucacagucugcg

SEQ ID NO: 1088449 - RNA, 22 nt, Human
uauuuggaaaugauaaaguacu

SEQ ID NO: 1088450 - RNA, 22 nt, Human
gcagggccagggcucaggcugu

SEQ ID NO: 1088451 - RNA, 22 nt, Human
ugauuauauucuaacuucauaa

SEQ ID NO: 1088452 - RNA, 22 nt, Human
auucaaagagcugccagaacug

SEQ ID NO: 1088453 - RNA, 22 nt, Human
gggaccugcgccacucacuguc

SEQ ID NO: 1088454 - RNA, 22 nt, Human
ggcagggaaacagcugauccca

SEQ ID NO: 1088455 - RNA, 22 nt, Human
ccucuggcuguaccacuggcac

SEQ ID NO: 1088456 - RNA, 22 nt, Human
gaagcagaaguacgauuuacua

SEQ ID NO: 1088457 - RNA, 21 nt, Human
gauugaaaccauggcagugag

SEQ ID NO: 1088458 - RNA, 22 nt, Human
uagcuguuuuuugugaggaaau

SEQ ID NO: 1088459 - RNA, 22 nt, Human
uugugcaauccccucauuuuau

SEQ ID NO: 1088460 - RNA, 22 nt, Human
agagaagacuuacagccacagu

SEQ ID NO: 1088461 - RNA, 22 nt, Human
aucagcaaggcaaucacugcag

SEQ ID NO: 1088462 - RNA, 22 nt, Human
auuuugaaauacuugaaggaaa

SEQ ID NO: 1088463 - RNA, 22 nt, Human
caggaaagaaaugagaacacca

SEQ ID NO: 1088464 - RNA, 22 nt, Human
ccaggaggcucugacuggaccc

SEQ ID NO: 1088465 - RNA, 22 nt, Human
agcagaacauuuucagggcugu

SEQ ID NO: 1088466 - RNA, 22 nt, Human
agaucaaaaacuuaauggcuuu

SEQ ID NO: 1088467 - RNA, 22 nt, Human
caggccuuaguaggugcucccu

SEQ ID NO: 1088468 - RNA, 22 nt, Human
gucccagaugucuggaacuccc

SEQ ID NO: 1088469 - RNA, 22 nt, Human
ccagcuggugggucuuucucug

SEQ ID NO: 1088470 - RNA, 22 nt, Human
aggcagagcuaggaagaauugu

SEQ ID NO: 1088471 - RNA, 21 nt, Human
gggugcuguggucaugcagga

SEQ ID NO: 1088472 - RNA, 22 nt, Human
uuacaaagauuauauucaguua

SEQ ID NO: 1088473 - RNA, 20 nt, Human
ccaaauguggagaaaaagua

SEQ ID NO: 1088474 - RNA, 21 nt, Human
gccugccugcgugacccucuu

SEQ ID NO: 1088475 - RNA, 22 nt, Human
uugaaacugcuuauugaauuug

SEQ ID NO: 1088476 - RNA, 22 nt, Human
uacauaguguuuugaagaauua

SEQ ID NO: 1088477 - RNA, 22 nt, Human
ggauauaugcauguuaucauuu

SEQ ID NO: 1088478 - RNA, 22 nt, Human
ucauuuguacuugugugcuugu

SEQ ID NO: 1088479 - RNA, 22 nt, Human
auauuuguuuggcagaguucag

SEQ ID NO: 1088480 - RNA, 22 nt, Human
acucugccaucccaggugcugu

SEQ ID NO: 1088481 - RNA, 22 nt, Human
uaacuuugaagggaauuuuacu

SEQ ID NO: 1088482 - RNA, 22 nt, Human
ugcugcuguaucaugccuucau

SEQ ID NO: 1088483 - RNA, 22 nt, Human
aggacagauuuuuggccaccag

SEQ ID NO: 1088484 - RNA, 22 nt, Human
uaaggucauggugaauaauaag

SEQ ID NO: 1088485 - RNA, 22 nt, Human
acaucuuuuuucucuaauugug

SEQ ID NO: 1088486 - RNA, 21 nt, Human
auuuucauuaauucagugugg

SEQ ID NO: 1088487 - RNA, 22 nt, Human
cuucuggguugcaggucuuggc

SEQ ID NO: 1088488 - RNA, 22 nt, Human
cucagugguugagagccugggc

SEQ ID NO: 1088489 - RNA, 22 nt, Human
uagagcugcuggacuguaacag

SEQ ID NO: 1088490 - RNA, 22 nt, Human
caagagagaugcagcucacuca

SEQ ID NO: 1088491 - RNA, 22 nt, Human
guggccagaagacugcaaugcu

SEQ ID NO: 1088492 - RNA, 22 nt, Human
gucugcccugcagacaugccuc

SEQ ID NO: 1088493 - RNA, 22 nt, Human
gcccacacaccagcucaggagg

SEQ ID NO: 1088494 - RNA, 22 nt, Human
cagggcuguggcuuugugcugu

SEQ ID NO: 1088495 - RNA, 22 nt, Human
uucauuugugugccugaugcaa

SEQ ID NO: 1088496 - RNA, 22 nt, Human
cugggccugucagggcuuuuug

SEQ ID NO: 1088497 - RNA, 23 nt, Human
cagggcugguagggaagagcgug

SEQ ID NO: 1088498 - RNA, 22 nt, Human
ugcagcucauugcuggggucug

SEQ ID NO: 1088499 - RNA, 22 nt, Human
cucccagguuccgacgccucuu

SEQ ID NO: 1088500 - RNA, 22 nt, Human
uucagagccacuucaagucuaa

SEQ ID NO: 1088501 - RNA, 22 nt, Human
cugcucugugcacuuguucagg

SEQ ID NO: 1088502 - RNA, 22 nt, Human
cagaaacuuuugaugaguguau

SEQ ID NO: 1088503 - RNA, 22 nt, Human
uccuggaggcaaaugagcacau

SEQ ID NO: 1088504 - RNA, 22 nt, Human
gagcuguccgccccugggccga

SEQ ID NO: 1088505 - RNA, 22 nt, Human
gagagugaggccugggaaucua

SEQ ID NO: 1088506 - RNA, 22 nt, Human
cagcaaagguagaagcacagga

SEQ ID NO: 1088507 - RNA, 22 nt, Human
accaggaagcugugagaccuuu

SEQ ID NO: 1088508 - RNA, 20 nt, Human
caagcccucuuuagccugcc

SEQ ID NO: 1088509 - RNA, 22 nt, Human
cacucugagaaguacaagcucc

SEQ ID NO: 1088510 - RNA, 21 nt, Human
agagucugcauuucugacaag

SEQ ID NO: 1088511 - RNA, 22 nt, Human
uuuccauauuuggucuuuggga

SEQ ID NO: 1088512 - RNA, 22 nt, Human
uacauacagccaaguaugaagu

SEQ ID NO: 1088513 - RNA, 22 nt, Human
uuugaauaaucacugggcauua

SEQ ID NO: 1088514 - RNA, 22 nt, Human
cacaggagguuaggaagugguc

SEQ ID NO: 1088515 - RNA, 22 nt, Human
ucaggaguccugccugcagccu

SEQ ID NO: 1088516 - RNA, 22 nt, Human
aaaaugaugcuguaauuuggca

SEQ ID NO: 1088517 - RNA, 22 nt, Human
cagcugccacaggacuuucuga

SEQ ID NO: 1088518 - RNA, 22 nt, Human
agcagggggaguuagacuagau

SEQ ID NO: 1088519 - RNA, 19 nt, Human
aaaaggagagaucagaguu

SEQ ID NO: 1088520 - RNA, 22 nt, Human
cuggccacaugugugcugagca

SEQ ID NO: 1088521 - RNA, 22 nt, Human
auuuaauggguagacauuguua

SEQ ID NO: 1088522 - RNA, 22 nt, Human
auaaacucaugccaagaaauga

SEQ ID NO: 1088523 - RNA, 22 nt, Human
uaucuagcaaguaacaugcuga

SEQ ID NO: 1088524 - RNA, 22 nt, Human
uuacacaauauaugguacuugg

SEQ ID NO: 1088525 - RNA, 22 nt, Human
gcucugagcacugugcggcugg

SEQ ID NO: 1088526 - RNA, 22 nt, Human
uguacaaagaguauagcuuuga

SEQ ID NO: 1088527 - RNA, 22 nt, Human
cuuauucaaugcuggaaauguu

SEQ ID NO: 1088528 - RNA, 22 nt, Human
gaaaguuuucucacacaguaau

SEQ ID NO: 1088529 - RNA, 17 nt, Human
gagugcugguggagcuc

SEQ ID NO: 1088530 - RNA, 22 nt, Human
ucagcaguuuuauaugcagcuu

SEQ ID NO: 1088531 - RNA, 22 nt, Human
cugcccugccuggccagugugg

SEQ ID NO: 1088532 - RNA, 19 nt, Human
aguguuaacccaguguugg

SEQ ID NO: 1088533 - RNA, 22 nt, Human
acuucauguuguuuacaacuua

SEQ ID NO: 1088534 - RNA, 22 nt, Human
uaacacuucagaugauuuuguu

SEQ ID NO: 1088535 - RNA, 22 nt, Human
acuuuuuaguuuccucaaacau

SEQ ID NO: 1088536 - RNA, 22 nt, Human
gugggacagcuggagggucccu

SEQ ID NO: 1088537 - RNA, 22 nt, Human
uagcagaguaauacuuuggagc

SEQ ID NO: 1088538 - RNA, 22 nt, Human
agcugggcagacugcagugguu

SEQ ID NO: 1088539 - RNA, 22 nt, Human
ugggaagaugaggugccauggg

SEQ ID NO: 1088540 - RNA, 22 nt, Human
caucuuuaacaauuuacaaugu

SEQ ID NO: 1088541 - RNA, 22 nt, Human
gaaggcuggaaggcaaguagga

SEQ ID NO: 1088542 - RNA, 22 nt, Human
uccagggguaccggccaggcag

SEQ ID NO: 1088543 - RNA, 22 nt, Human
gggcaggaacaaaucaaaugau

SEQ ID NO: 1088544 - RNA, 22 nt, Human
caacauuugugaugagcaaacu

SEQ ID NO: 1088545 - RNA, 20 nt, Human
ugcuggggacauacagggug

SEQ ID NO: 1088546 - RNA, 22 nt, Human
uucagaaaaaacuucaauaagu

SEQ ID NO: 1088547 - RNA, 22 nt, Human
accugucugcaugaucuaaaac

SEQ ID NO: 1088548 - RNA, 22 nt, Human
cacagauagaccuuaugagauu

SEQ ID NO: 1088549 - RNA, 22 nt, Human
acauugcugcauucuccuuccc

SEQ ID NO: 1088550 - RNA, 22 nt, Human
aacagcaguggcaggagaaggc

SEQ ID NO: 1088551 - RNA, 22 nt, Human
auuuauuaugggauuuggcuca

SEQ ID NO: 1088552 - RNA, 20 nt, Human
ucagccuugaaugcuugaaa

SEQ ID NO: 1088553 - RNA, 22 nt, Human
ucacuguaauagguuugaagau

SEQ ID NO: 1088554 - RNA, 22 nt, Human
cacagagacaugaugucauugc

SEQ ID NO: 1088555 - RNA, 22 nt, Human
cagguccccuccccuaccaggc

SEQ ID NO: 1088556 - RNA, 22 nt, Human
aggcugaggcuggcagcuccag

SEQ ID NO: 1088557 - RNA, 22 nt, Human
gcccugcccugagccguagacc

SEQ ID NO: 1088558 - RNA, 22 nt, Human
ugugaaugucuagguuuuaugu

SEQ ID NO: 1088559 - RNA, 22 nt, Human
ucaacacucuuuggcacaguua

SEQ ID NO: 1088560 - RNA, 22 nt, Human
uccaggaacagaauguuagugc

SEQ ID NO: 1088561 - RNA, 22 nt, Human
ccaggccagccuggagcauggc

SEQ ID NO: 1088562 - RNA, 21 nt, Human
uuacaaagcaagugcuguguc

SEQ ID NO: 1088563 - RNA, 22 nt, Human
ugcaugcaaaaaaaucugcauu

SEQ ID NO: 1088564 - RNA, 22 nt, Human
auagcaaaaggcaccagaguga

SEQ ID NO: 1088565 - RNA, 22 nt, Human
aggaggugagcggucauguggu

SEQ ID NO: 1088566 - RNA, 20 nt, Human
ggaaaucaccaggcuccacc

SEQ ID NO: 1088567 - RNA, 22 nt, Human
ccuuccuggagcccaugcagau

SEQ ID NO: 1088568 - RNA, 22 nt, Human
aguuuguaugccaacagcaaag

SEQ ID NO: 1088569 - RNA, 22 nt, Human
ucaggcugguggucagauggcu

SEQ ID NO: 1088570 - RNA, 22 nt, Human
agugaaauaugcccauugcugu

SEQ ID NO: 1088571 - RNA, 22 nt, Human
cugucucugucuuaacucccag

SEQ ID NO: 1088572 - RNA, 22 nt, Human
cacaggaaucgucacuuagcgc

SEQ ID NO: 1088573 - RNA, 22 nt, Human
aucaggaugcugucaguuacca

SEQ ID NO: 1088574 - RNA, 22 nt, Human
cauuacaaccccaaauuacaaa

SEQ ID NO: 1088575 - RNA, 22 nt, Human
cugaagaagucucuaggcuauu

SEQ ID NO: 1088576 - RNA, 22 nt, Human
gcacacagaacauuuggauccu

SEQ ID NO: 1088577 - RNA, 22 nt, Human
uuucacagauauaagauuucac

SEQ ID NO: 1088578 - RNA, 22 nt, Human
guuuauuaacugucaagugauu

SEQ ID NO: 1088579 - RNA, 22 nt, Human
gccucugcugacaagauggaca

SEQ ID NO: 1088580 - RNA, 22 nt, Human
ugugaaaugaguauauuugaau

SEQ ID NO: 1088581 - RNA, 22 nt, Human
cucugcaaggcccuccaguagc

SEQ ID NO: 1088582 - RNA, 21 nt, Human
agcugcuccagggagcucagg

SEQ ID NO: 1088583 - RNA, 22 nt, Human
gaaaaggaaauuuauagagauc

SEQ ID NO: 1088584 - RNA, 22 nt, Human
uauuuugacuauuaaaccaaca

SEQ ID NO: 1088585 - RNA, 22 nt, Human
gcccucucggcauagcaggggc

SEQ ID NO: 1088586 - RNA, 22 nt, Human
ggccagagaauaugccuuacgu

SEQ ID NO: 1088587 - RNA, 22 nt, Human
ucucccaagugaccaggaaaga

SEQ ID NO: 1088588 - RNA, 22 nt, Human
uacacaacugacaaccauucug

SEQ ID NO: 1088589 - RNA, 22 nt, Human
uacauugcuagaaauguauuuu

SEQ ID NO: 1088590 - RNA, 22 nt, Human
cuacagaaaaucagccacaggc

SEQ ID NO: 1088591 - RNA, 22 nt, Human
uccugggcccaggcugccaggg

SEQ ID NO: 1088592 - RNA, 22 nt, Human
ucuuuucuucuuaaugguuaau

SEQ ID NO: 1088593 - RNA, 22 nt, Human
uuuugugagcccauaaaugcca

SEQ ID NO: 1088594 - RNA, 22 nt, Human
ggcucugcccagaugaagagga

SEQ ID NO: 1088595 - RNA, 23 nt, Human
ggccucagcgcacagaaacugcu

SEQ ID NO: 1088596 - RNA, 22 nt, Human
uuuuacaggugaaaaaugaaga

SEQ ID NO: 1088597 - RNA, 22 nt, Human
caaaacauucucugcagcaggg

SEQ ID NO: 1088598 - RNA, 22 nt, Human
cauguuauuuauccauuaaaca

SEQ ID NO: 1088599 - RNA, 22 nt, Human
cugugcagugugggguaggccu

SEQ ID NO: 1088600 - RNA, 22 nt, Human
caaauacuuuauauacuucaaa

SEQ ID NO: 1088601 - RNA, 22 nt, Human
cagggccaguucucgcagcagu

SEQ ID NO: 1088602 - RNA, 22 nt, Human
acaaauaugguacucggagaaa

SEQ ID NO: 1088603 - RNA, 22 nt, Human
aggaacacacugagcaacuccu

SEQ ID NO: 1088604 - RNA, 22 nt, Human
gccugccuuuuggaggcacauu

SEQ ID NO: 1088605 - RNA, 22 nt, Human
uugaggaguguuuagggugagg

SEQ ID NO: 1088606 - RNA, 22 nt, Human
uuugcaaacacuuaagaagaga

SEQ ID NO: 1088607 - RNA, 22 nt, Human
aaaaacagaaugugucuaacuc

SEQ ID NO: 1088608 - RNA, 22 nt, Human
gcagcugggacacugaggccag

SEQ ID NO: 1088609 - RNA, 22 nt, Human
uuuuuuccaacuuaagacuuca

SEQ ID NO: 1088610 - RNA, 22 nt, Human
uagaacuuauuuggcauuauuu

SEQ ID NO: 1088611 - RNA, 22 nt, Human
agcuggugcugaagcucuugag

SEQ ID NO: 1088612 - RNA, 22 nt, Human
gaggaggcuguuucucugcauu

SEQ ID NO: 1088613 - RNA, 22 nt, Human
ugaauacaggaaaauauacuga

SEQ ID NO: 1088614 - RNA, 22 nt, Human
cugagcacugggcacauagcug

SEQ ID NO: 1088615 - RNA, 22 nt, Human
uuugaagacagaucaauauaag

SEQ ID NO: 1088616 - RNA, 22 nt, Human
acagggcagcaacuuugugccu

SEQ ID NO: 1088617 - RNA, 22 nt, Human
gccugagcaggcguggaccaug

SEQ ID NO: 1088618 - RNA, 22 nt, Human
ugggaaggacgugucaguggca

SEQ ID NO: 1088619 - RNA, 22 nt, Human
gcauggcaaauaucgagggcag

SEQ ID NO: 1088620 - RNA, 22 nt, Human
aaaaucucauuaucaggaaggg

SEQ ID NO: 1088621 - RNA, 21 nt, Human
uucagcaguccucuagagaua

SEQ ID NO: 1088622 - RNA, 22 nt, Human
ucagugcuucggcgagcaccua

SEQ ID NO: 1088623 - RNA, 22 nt, Human
gaacacucauggaagaguuuuu

SEQ ID NO: 1088624 - RNA, 18 nt, Human
gcagcugcaguuguagcu

SEQ ID NO: 1088625 - RNA, 22 nt, Human
guggccugggguuuguucugag

SEQ ID NO: 1088626 - RNA, 22 nt, Human
cagcuguuucaguagcguuacu

SEQ ID NO: 1088627 - RNA, 22 nt, Human
ggccaccucugcccuacugagu

SEQ ID NO: 1088628 - RNA, 22 nt, Human
cuggucaggaagguggggacag

SEQ ID NO: 1088629 - RNA, 22 nt, Human
uccucuucaaaauagcucugaa

SEQ ID NO: 1088630 - RNA, 22 nt, Human
ucauucagguugggcaaguguc

SEQ ID NO: 1088631 - RNA, 22 nt, Human
cugcaggucucugugugcauuc

SEQ ID NO: 1088632 - RNA, 22 nt, Human
gggcuccuggcagucaugcuca

SEQ ID NO: 1088633 - RNA, 22 nt, Human
ggcauuuaggcagauaacagac

SEQ ID NO: 1088634 - RNA, 22 nt, Human
uuagcaaaaauaucucauauua

SEQ ID NO: 1088635 - RNA, 22 nt, Human
uuggaauuaaaaggagaacuuc

SEQ ID NO: 1088636 - RNA, 22 nt, Human
aggaguguggccagggcucugg

SEQ ID NO: 1088637 - RNA, 22 nt, Human
agaggccagcagugccuaucug

SEQ ID NO: 1088638 - RNA, 20 nt, Human
acaguguaauauucacauuc

SEQ ID NO: 1088639 - RNA, 22 nt, Human
auacaugugggucuaaacauau

SEQ ID NO: 1088640 - RNA, 23 nt, Human
ucugggcaccuuguugacaugau

SEQ ID NO: 1088641 - RNA, 22 nt, Human
aaagaauaguuaaguuuagggc

SEQ ID NO: 1088642 - RNA, 22 nt, Human
ucaugaaaauagaucagaaauu

SEQ ID NO: 1088643 - RNA, 22 nt, Human
aucaguuucuaccauguggaau

SEQ ID NO: 1088644 - RNA, 22 nt, Human
ggaaggagggcggcaaugauga

SEQ ID NO: 1088645 - RNA, 22 nt, Human
acauuauaguugcuacagagua

SEQ ID NO: 1088646 - RNA, 22 nt, Human
auucucauuugcuggcuauaug

SEQ ID NO: 1088647 - RNA, 22 nt, Human
uuccuuaggcuguuugcagugc

SEQ ID NO: 1088648 - RNA, 22 nt, Human
uauuacaguucgaguuucuagg

SEQ ID NO: 1088649 - RNA, 22 nt, Human
ucuacugcacuggugucucauc

SEQ ID NO: 1088650 - RNA, 22 nt, Human
uuuggcauuuaauaggugauca

SEQ ID NO: 1088651 - RNA, 22 nt, Human
ugguaugaccguggugcaagca

SEQ ID NO: 1088652 - RNA, 22 nt, Human
uagcagaggaaaagagaacauu

SEQ ID NO: 1088653 - RNA, 22 nt, Human
uuauuuguuuucugagaaguau

SEQ ID NO: 1088654 - RNA, 22 nt, Human
ucugcagaauucgaggaagaaa

SEQ ID NO: 1088655 - RNA, 22 nt, Human
gucucccaaccccugugcccag

SEQ ID NO: 1088656 - RNA, 22 nt, Human
agguccuguguccaggggccug

SEQ ID NO: 1088657 - RNA, 21 nt, Human
gcagcuggucucagagcuugc

SEQ ID NO: 1088658 - RNA, 21 nt, Human
ccagggaagaaaugagggcag

SEQ ID NO: 1088659 - RNA, 22 nt, Human
aguuaacuaaacugugaguaaa

SEQ ID NO: 1088660 - RNA, 22 nt, Human
cugaggcaggggcagcuggaga

SEQ ID NO: 1088661 - RNA, 22 nt, Human
cuggauuuaggacuaguccaag

SEQ ID NO: 1088662 - RNA, 22 nt, Human
ugggcugaguguggaacuaguu

SEQ ID NO: 1088663 - RNA, 22 nt, Human
ccagccaguccagcauuggugu

SEQ ID NO: 1088664 - RNA, 22 nt, Human
gaagccacaacuuuuucuuagc

SEQ ID NO: 1088665 - RNA, 18 nt, Human
ugacagaaccuggagccu

SEQ ID NO: 1088666 - RNA, 22 nt, Human
uucagaaugcuauuucugaaau

SEQ ID NO: 1088667 - RNA, 22 nt, Human
aaguaacaaugcuguugaauug

SEQ ID NO: 1088668 - RNA, 21 nt, Human
ugaaaguuggagucaaaugua

SEQ ID NO: 1088669 - RNA, 22 nt, Human
uuugaaagaaaccagugaguga

SEQ ID NO: 1088670 - RNA, 22 nt, Human
cuuccuuugguuggagcgccgu

SEQ ID NO: 1088671 - RNA, 22 nt, Human
uggcugaggucuggggcuucug

SEQ ID NO: 1088672 - RNA, 22 nt, Human
acccucagcuucuuggauuaau

SEQ ID NO: 1088673 - RNA, 22 nt, Human
gauccuugcacuugacuuggca

SEQ ID NO: 1088674 - RNA, 22 nt, Human
ggagauaguccaggugaaggga

SEQ ID NO: 1088675 - RNA, 16 nt, Human
acccucagaaacugcu

SEQ ID NO: 1088676 - RNA, 22 nt, Human
ggaagaaagguggacaacaggu

SEQ ID NO: 1088677 - RNA, 22 nt, Human
agagccacggcaggccuaggaa

SEQ ID NO: 1088678 - RNA, 22 nt, Human
gcuuuuucaaaugaaagcuggu

SEQ ID NO: 1088679 - RNA, 22 nt, Human
guauacauacuucuagauuaaa

SEQ ID NO: 1088680 - RNA, 22 nt, Human
cuuuacauuaauuucuacugau

SEQ ID NO: 1088681 - RNA, 22 nt, Human
cucuccucugaaguggugaccc

SEQ ID NO: 1088682 - RNA, 22 nt, Human
ccagguguagcacugcucacag

SEQ ID NO: 1088683 - RNA, 19 nt, Human
aggugcaggucacagggga

SEQ ID NO: 1088684 - RNA, 22 nt, Human
gccugcugcauccaggcuauug

SEQ ID NO: 1088685 - RNA, 22 nt, Human
ggcugugggaugcauaggagcu

SEQ ID NO: 1088686 - RNA, 22 nt, Human
gcaaagcaaaugccugaaggcg

SEQ ID NO: 1088687 - RNA, 22 nt, Human
ucccacuauuauccuauguggg

SEQ ID NO: 1088688 - RNA, 22 nt, Human
aaacacaucauucaugucguca

SEQ ID NO: 1088689 - RNA, 22 nt, Human
gaaggaaaucugugauuuaugc

SEQ ID NO: 1088690 - RNA, 22 nt, Human
uaagcaaauaaugcaucaaggg

SEQ ID NO: 1088691 - RNA, 22 nt, Human
augguuuguguggcccagauga

SEQ ID NO: 1088692 - RNA, 23 nt, Human
cagaggcaucggauucaacauca

SEQ ID NO: 1088693 - RNA, 22 nt, Human
ucacagaaagcuguguccugac

SEQ ID NO: 1088694 - RNA, 22 nt, Human
cucugcccacgucuugcccaga

SEQ ID NO: 1088695 - RNA, 22 nt, Human
aagggagcuuaggagaucaggc

SEQ ID NO: 1088696 - RNA, 22 nt, Human
uuuaagacuuagauuuauuggg

SEQ ID NO: 1088697 - RNA, 22 nt, Human
acaguaaaaagccuuagaauuu

SEQ ID NO: 1088698 - RNA, 22 nt, Human
gcugccugcaguguuuucccag

SEQ ID NO: 1088699 - RNA, 22 nt, Human
uggcagaaagaaccaugugcaa

SEQ ID NO: 1088700 - RNA, 22 nt, Human
gcagcugaauguccauugcugc

SEQ ID NO: 1088701 - RNA, 22 nt, Human
guuccuuuccuauuuggauaag

SEQ ID NO: 1088702 - RNA, 22 nt, Human
ugggugaggaugaugaggcagc

SEQ ID NO: 1088703 - RNA, 22 nt, Human
gcuggcuccucuguccucacgg

SEQ ID NO: 1088704 - RNA, 22 nt, Human
gagagcugauagaugagcuacu

SEQ ID NO: 1088705 - RNA, 20 nt, Human
agcaggaaugaugcuuucau

SEQ ID NO: 1088706 - RNA, 22 nt, Human
ggcuugggagcaggcaugugac

SEQ ID NO: 1088707 - RNA, 23 nt, Human
agggccugauggcucccgcuggc

SEQ ID NO: 1088708 - RNA, 22 nt, Human
agagugggacacgggcgcuguc

SEQ ID NO: 1088709 - RNA, 22 nt, Human
aaagguuugccgaccucugcuu

SEQ ID NO: 1088710 - RNA, 22 nt, Human
gucauuuuugacuuugaaguga

SEQ ID NO: 1088711 - RNA, 22 nt, Human
ggaagggcaauaaaaucucagg

SEQ ID NO: 1088712 - RNA, 22 nt, Human
uuacuacaagauucuguuuuau

SEQ ID NO: 1088713 - RNA, 22 nt, Human
cacauauuguaguucaccagga

SEQ ID NO: 1088714 - RNA, 22 nt, Human
ugaguccaagagccagugggaa

SEQ ID NO: 1088715 - RNA, 22 nt, Human
uucaaacucugaguaguucugc

SEQ ID NO: 1088716 - RNA, 22 nt, Human
uccucuacucgcuugcccuuug

SEQ ID NO: 1088717 - RNA, 22 nt, Human
agcagccauagauagcaugcaa

SEQ ID NO: 1088718 - RNA, 22 nt, Human
ggaugcaugugcauuuugaaaa

SEQ ID NO: 1088719 - RNA, 22 nt, Human
aaguauauuuuuugaagcauau

SEQ ID NO: 1088720 - RNA, 22 nt, Human
cauaaaagguagcaguuugaaa

SEQ ID NO: 1088721 - RNA, 20 nt, Human
acaguuuauccaguuagcag

SEQ ID NO: 1088722 - RNA, 22 nt, Human
agaagccacuggagguugagau

SEQ ID NO: 1088723 - RNA, 18 nt, Human
acaaggucaauugguuac

SEQ ID NO: 1088724 - RNA, 22 nt, Human
uauuugaagggagaaagugcca

SEQ ID NO: 1088725 - RNA, 23 nt, Human
cuguggcugaguccuguuggagu

SEQ ID NO: 1088726 - RNA, 22 nt, Human
cagcuugcuaauuuugacuuca

SEQ ID NO: 1088727 - RNA, 22 nt, Human
ggaggagacaguaaaaagcacg

SEQ ID NO: 1088728 - RNA, 22 nt, Human
uaugagaaauugcugauauuug

SEQ ID NO: 1088729 - RNA, 22 nt, Human
caggaggaaaugugacccugcu

SEQ ID NO: 1088730 - RNA, 22 nt, Human
accuucaaguaugugggcugaa

SEQ ID NO: 1088731 - RNA, 22 nt, Human
gcaucuucacacaaagccagug

SEQ ID NO: 1088732 - RNA, 22 nt, Human
aauauccuuuccagaguacagu

SEQ ID NO: 1088733 - RNA, 17 nt, Human
uggcucugaggcugaau

SEQ ID NO: 1088734 - RNA, 22 nt, Human
gacauuuagguagcuuccaguu

SEQ ID NO: 1088735 - RNA, 16 nt, Human
caggaaccugucuggc

SEQ ID NO: 1088736 - RNA, 20 nt, Human
cuguccccgaggucaccagg

SEQ ID NO: 1088737 - RNA, 22 nt, Human
cugggguggugcaggccucaug

SEQ ID NO: 1088738 - RNA, 22 nt, Human
gagcuggcuaauacugacuuau

SEQ ID NO: 1088739 - RNA, 22 nt, Human
caggguggcaggcaccauggcc

SEQ ID NO: 1088740 - RNA, 22 nt, Human
aucuucaaggaaaaaauacagu

SEQ ID NO: 1088741 - RNA, 22 nt, Human
ugggcuccagcaccugugcucu

SEQ ID NO: 1088742 - RNA, 22 nt, Human
auuuaucucuggaaacuaagca

SEQ ID NO: 1088743 - RNA, 22 nt, Human
uauuagguuggugcaaaauuaa

SEQ ID NO: 1088744 - RNA, 22 nt, Human
uauuagguuguugcaaaaguaa

SEQ ID NO: 1088745 - RNA, 22 nt, Human
gggcuggcaucaguugccgaga

SEQ ID NO: 1088746 - RNA, 22 nt, Human
agaagccaugguaugcaacuac

SEQ ID NO: 1088747 - RNA, 22 nt, Human
acuggcagccacaacuggcagg

SEQ ID NO: 1088748 - RNA, 21 nt, Human
uggcucugagccucauggcug

SEQ ID NO: 1088749 - RNA, 19 nt, Human
uccuucagucagaucuggg

SEQ ID NO: 1088750 - RNA, 22 nt, Human
uuucuuauacuauauugucauc

SEQ ID NO: 1088751 - RNA, 22 nt, Human
ccaggaaaauaccaagcuuuaa

SEQ ID NO: 1088752 - RNA, 22 nt, Human
cagcuauugguccacagguaug

SEQ ID NO: 1088753 - RNA, 22 nt, Human
cuguacaucccgagagccagua

SEQ ID NO: 1088754 - RNA, 22 nt, Human
cucacauucacaggacagaagg

SEQ ID NO: 1088755 - RNA, 22 nt, Human
acagagcauauaaagugcuuug

SEQ ID NO: 1088756 - RNA, 22 nt, Human
uagcaaguggcaccacauuucu

SEQ ID NO: 1088757 - RNA, 22 nt, Human
gaagauuucuuuaugaaagaug

SEQ ID NO: 1088758 - RNA, 22 nt, Human
cagcagagcauuugguaggagg

SEQ ID NO: 1088759 - RNA, 22 nt, Human
ggcagggcuugucucugugaug

SEQ ID NO: 1088760 - RNA, 22 nt, Human
ugggcugcggauaggccucgga

SEQ ID NO: 1088761 - RNA, 22 nt, Human
ugcagcugccuagggcuggcuu

SEQ ID NO: 1088762 - RNA, 22 nt, Human
caccaggaugggcagguagguc

SEQ ID NO: 1088763 - RNA, 22 nt, Human
gcucugcucuaacauuccugac

SEQ ID NO: 1088764 - RNA, 22 nt, Human
acuaaauacacacauuuguuca

SEQ ID NO: 1088765 - RNA, 22 nt, Human
aggcuuaacuuuacuguuaugc

SEQ ID NO: 1088766 - RNA, 22 nt, Human
auccuucagcugcccuguuacc

SEQ ID NO: 1088767 - RNA, 22 nt, Human
ucccagagcccaaguuggagag

SEQ ID NO: 1088768 - RNA, 22 nt, Human
uugugaauggugccgcaauaaa

SEQ ID NO: 1088769 - RNA, 22 nt, Human
ugacaucacguccuuucagaga

SEQ ID NO: 1088770 - RNA, 23 nt, Human
cacugggcccaggguguggaggc

SEQ ID NO: 1088771 - RNA, 22 nt, Human
uacuuucauggguuuucuuuau

SEQ ID NO: 1088772 - RNA, 22 nt, Human
ugcugggcuugaaagcugcuaa

SEQ ID NO: 1088773 - RNA, 22 nt, Human
ugaagauuuccaccaaaucaca

SEQ ID NO: 1088774 - RNA, 22 nt, Human
uccagggaaggugugaggcugg

SEQ ID NO: 1088775 - RNA, 22 nt, Human
aagcagaaaaacugagcuccaa

SEQ ID NO: 1088776 - RNA, 22 nt, Human
gauuuauuuuuaaucagcaggg

SEQ ID NO: 1088777 - RNA, 22 nt, Human
ugcaggagcagagauggcugga

SEQ ID NO: 1088778 - RNA, 22 nt, Human
ucuggcagggguucugcacuug

SEQ ID NO: 1088779 - RNA, 20 nt, Human
ccugaggguuuguguucuuu

SEQ ID NO: 1088780 - RNA, 22 nt, Human
uccuucaaagcuccuagugagc

SEQ ID NO: 1088781 - RNA, 23 nt, Human
ucuucaugcccaggccuuggugc

SEQ ID NO: 1088782 - RNA, 22 nt, Human
gaagcagcgaaguggaagggac

SEQ ID NO: 1088783 - RNA, 22 nt, Human
caaggaaaaagcgagcucgggg

SEQ ID NO: 1088784 - RNA, 22 nt, Human
uaagucauagauuaauggccac

SEQ ID NO: 1088785 - RNA, 22 nt, Human
aaguuuuacugaggacacaugu

SEQ ID NO: 1088786 - RNA, 22 nt, Human
aucuagauuagguauaagagcu

SEQ ID NO: 1088787 - RNA, 20 nt, Human
auauuucagguagugugccc

SEQ ID NO: 1088788 - RNA, 22 nt, Human
ugaaauguagugaagcauggaa

SEQ ID NO: 1088789 - RNA, 22 nt, Human
uagacacaagagaaggguauaa

SEQ ID NO: 1088790 - RNA, 20 nt, Human
ccucugccccggggcugcua

SEQ ID NO: 1088791 - RNA, 22 nt, Human
aucuccagcaauggggagcucu

SEQ ID NO: 1088792 - RNA, 22 nt, Human
aggcuggggaauugaauuugcu

SEQ ID NO: 1088793 - RNA, 22 nt, Human
gugauuccuauuaguacaugca

SEQ ID NO: 1088794 - RNA, 22 nt, Human
uagggcuauaagagaauaagac

SEQ ID NO: 1088795 - RNA, 22 nt, Human
cacagcuucaguuucugacuug

SEQ ID NO: 1088796 - RNA, 22 nt, Human
cccuggagggauuucucaauca

SEQ ID NO: 1088797 - RNA, 22 nt, Human
uuuauugagcacccguugugcg

SEQ ID NO: 1088798 - RNA, 21 nt, Human
cagagcagcguucugcugugg

SEQ ID NO: 1088799 - RNA, 22 nt, Human
caggaaaauggaaucaccugua

SEQ ID NO: 1088800 - RNA, 22 nt, Human
uggcaguccucuuccucgggcg

SEQ ID NO: 1088801 - RNA, 22 nt, Human
auuaauuuccaggcacugugcu

SEQ ID NO: 1088802 - RNA, 22 nt, Human
ugcucagcuggugccagggucc

SEQ ID NO: 1088803 - RNA, 22 nt, Human
ccaggccugcauucccucucag

SEQ ID NO: 1088804 - RNA, 22 nt, Human
gugcccugacacaccuggugug

SEQ ID NO: 1088805 - RNA, 22 nt, Human
aaauugcauuuuaaagguagau

SEQ ID NO: 1088806 - RNA, 17 nt, Human
gcccucagcuuuaacca

SEQ ID NO: 1088807 - RNA, 22 nt, Human
ucacgugagggaccugugucug

SEQ ID NO: 1088808 - RNA, 22 nt, Human
ggcagucuaguguccuugggcc

SEQ ID NO: 1088809 - RNA, 22 nt, Human
aggccugacuugaauuuagggc

SEQ ID NO: 1088810 - RNA, 22 nt, Human
agaggagugggaagcagugcaa

SEQ ID NO: 1088811 - RNA, 22 nt, Human
gcagccuuccugaccucuaccc

SEQ ID NO: 1088812 - RNA, 22 nt, Human
aagauuucugcuuuuggaggca

SEQ ID NO: 1088813 - RNA, 22 nt, Human
cucaggaugaaagucaugguga

SEQ ID NO: 1088814 - RNA, 22 nt, Human
ucuucaugucuugccugauaua

SEQ ID NO: 1088815 - RNA, 22 nt, Human
gcuggucagggagggcacccau

SEQ ID NO: 1088816 - RNA, 22 nt, Human
aagcacuuagaagagugccugc

SEQ ID NO: 1088817 - RNA, 22 nt, Human
aggagccuccuucucaugugca

SEQ ID NO: 1088818 - RNA, 23 nt, Human
acugggaaguuuggagagacgca

SEQ ID NO: 1088819 - RNA, 22 nt, Human
gcagagcaccaaagugaaagau

SEQ ID NO: 1088820 - RNA, 22 nt, Human
uucaaaguaccguacuuaaugg

SEQ ID NO: 1088821 - RNA, 22 nt, Human
cagggccuuuuagcaucuucuc

SEQ ID NO: 1088822 - RNA, 22 nt, Human
gaaauuaagcaggggucugugg

SEQ ID NO: 1088823 - RNA, 22 nt, Human
uuaagaauggaaugaggaauuu

SEQ ID NO: 1088824 - RNA, 22 nt, Human
ccagagggccuuuggaguuauc

SEQ ID NO: 1088825 - RNA, 22 nt, Human
agggcaaggguugaagauaaga

SEQ ID NO: 1088826 - RNA, 22 nt, Human
aaggcugauuagacugauagcu

SEQ ID NO: 1088827 - RNA, 22 nt, Human
cugucaucacaguugagcagcc

SEQ ID NO: 1088828 - RNA, 20 nt, Human
agacagaaucagagauaaag

SEQ ID NO: 1088829 - RNA, 22 nt, Human
uggggaaggcggagcuugcagc

SEQ ID NO: 1088830 - RNA, 22 nt, Human
aucucagggcuggagcccugga

SEQ ID NO: 1088831 - RNA, 22 nt, Human
caggaagagguggggcuaaagu

SEQ ID NO: 1088832 - RNA, 17 nt, Human
gagagcugcugcuuccg

SEQ ID NO: 1088833 - RNA, 22 nt, Human
aagcagaauuucccacuaguug

SEQ ID NO: 1088834 - RNA, 22 nt, Human
aaagaaguguugaauuugcaag

SEQ ID NO: 1088835 - RNA, 22 nt, Human
agggaaggaggccauguguccc

SEQ ID NO: 1088836 - RNA, 22 nt, Human
gugauuucuaaucaucugaaug

SEQ ID NO: 1088837 - RNA, 22 nt, Human
acugucacuccaacugagucgu

SEQ ID NO: 1088838 - RNA, 22 nt, Human
guggcagcggcccaggccgucu

SEQ ID NO: 1088839 - RNA, 22 nt, Human
uuguuacaucuuauguaagugg

SEQ ID NO: 1088840 - RNA, 22 nt, Human
agauauauuuccugcccaaggc

SEQ ID NO: 1088841 - RNA, 22 nt, Human
aacgucauugauugaugguagu

SEQ ID NO: 1088842 - RNA, 23 nt, Human
caugggagugagaaugccagcuc

SEQ ID NO: 1088843 - RNA, 22 nt, Human
ccauguggcuagcgugccugca

SEQ ID NO: 1088844 - RNA, 22 nt, Human
uaggaacccgcagcaguccgag

SEQ ID NO: 1088845 - RNA, 22 nt, Human
gugucccacucuggaggugaag

SEQ ID NO: 1088846 - RNA, 22 nt, Human
cggcagggcuccaugcauuucu

SEQ ID NO: 1088847 - RNA, 22 nt, Human
agugcagugguuaggagccagg

SEQ ID NO: 1088848 - RNA, 22 nt, Human
ugggccugacacuuacuaggga

SEQ ID NO: 1088849 - RNA, 22 nt, Human
cacugcagaucagaggcugaga

SEQ ID NO: 1088850 - RNA, 22 nt, Human
gccuuccugcagcucugagcgu

SEQ ID NO: 1088851 - RNA, 22 nt, Human
cucugcaggggaggcaugcacu

SEQ ID NO: 1088852 - RNA, 22 nt, Human
ggcaguguccuugcagcucuac

SEQ ID NO: 1088853 - RNA, 22 nt, Human
aaggcacauuccugaaaacaau

SEQ ID NO: 1088854 - RNA, 22 nt, Human
caaaugcaugagaaauaagagg

SEQ ID NO: 1088855 - RNA, 22 nt, Human
guucuuugacuccaagaaagua

SEQ ID NO: 1088856 - RNA, 22 nt, Human
uagcagggccaggcugggaacc

SEQ ID NO: 1088857 - RNA, 22 nt, Human
auucuccagcucacuguccaua

SEQ ID NO: 1088858 - RNA, 22 nt, Human
acacacuggcccccaguacuga

SEQ ID NO: 1088859 - RNA, 22 nt, Human
auacaucucauguaagagauaa

SEQ ID NO: 1088860 - RNA, 22 nt, Human
agauaugacuagaagcucauuu

SEQ ID NO: 1088861 - RNA, 22 nt, Human
gcugcagcccggcgcgccugag

SEQ ID NO: 1088862 - RNA, 22 nt, Human
acaacaaaaugaggaagugguc

SEQ ID NO: 1088863 - RNA, 22 nt, Human
aguuuuauguagacaauucauu

SEQ ID NO: 1088864 - RNA, 22 nt, Human
ucagagcuuuggagaccaggaa

SEQ ID NO: 1088865 - RNA, 22 nt, Human
cagagacagggcagggagugug

SEQ ID NO: 1088866 - RNA, 22 nt, Human
uucucagauauuuacugagcau

SEQ ID NO: 1088867 - RNA, 22 nt, Human
agucccagacuccaguuuucug

SEQ ID NO: 1088868 - RNA, 22 nt, Human
cagcucuggcgucagggagcga

SEQ ID NO: 1088869 - RNA, 22 nt, Human
acugugugacuguuauuacugu

SEQ ID NO: 1088870 - RNA, 22 nt, Human
gaggggccggcaugugccucuc

SEQ ID NO: 1088871 - RNA, 22 nt, Human
gguaugaaaugauuccauguua

SEQ ID NO: 1088872 - RNA, 22 nt, Human
aguguuauuuauuguuucauaa

SEQ ID NO: 1088873 - RNA, 22 nt, Human
uuugacaugcaaagcacuuuag

SEQ ID NO: 1088874 - RNA, 22 nt, Human
ccuuccucauccauuucucuug

SEQ ID NO: 1088875 - RNA, 22 nt, Human
ucaaaggaauuugauuuugaug

SEQ ID NO: 1088876 - RNA, 20 nt, Human
acauagcuauagaaagucga

SEQ ID NO: 1088877 - RNA, 22 nt, Human
guccucagagugggcagguccu

SEQ ID NO: 1088878 - RNA, 22 nt, Human
ucaggcugguccccacagugga

SEQ ID NO: 1088879 - RNA, 22 nt, Human
aaagguuuucaucacagcaaga

SEQ ID NO: 1088880 - RNA, 22 nt, Human
cagagacauuaagugccaugau

SEQ ID NO: 1088881 - RNA, 22 nt, Human
gauauuuucauucggaugcuca

SEQ ID NO: 1088882 - RNA, 19 nt, Human
ucaaaggcuuuuaggagac

SEQ ID NO: 1088883 - RNA, 22 nt, Human
ucaugucaguuucuucuauaaa

SEQ ID NO: 1088884 - RNA, 22 nt, Human
gcugagcugcuguucauccugc

SEQ ID NO: 1088885 - RNA, 22 nt, Human
cugcccuggucccauggcugau

SEQ ID NO: 1088886 - RNA, 22 nt, Human
aagagucagcuucuguaugggu

SEQ ID NO: 1088887 - RNA, 22 nt, Human
caaaugcauagaaagaugaaac

SEQ ID NO: 1088888 - RNA, 22 nt, Human
ccuggagcuuggucacgcugcg

SEQ ID NO: 1088889 - RNA, 22 nt, Human
uugagaaauguuuuuuaagcug

SEQ ID NO: 1088890 - RNA, 22 nt, Human
aaacauuguuaugauaaauuac

SEQ ID NO: 1088891 - RNA, 22 nt, Human
ucacauucucagcaucuauaca

SEQ ID NO: 1088892 - RNA, 22 nt, Human
cagguuggggacuuaggaugac

SEQ ID NO: 1088893 - RNA, 22 nt, Human
cagagcaguaaaucuggggcac

SEQ ID NO: 1088894 - RNA, 19 nt, Human
agccagggugagaaggagc

SEQ ID NO: 1088895 - RNA, 22 nt, Human
uaccacagacagauuucaguaa

SEQ ID NO: 1088896 - RNA, 22 nt, Human
ugagagcagaggugggcagccu

SEQ ID NO: 1088897 - RNA, 22 nt, Human
ccucauggaccucagacugucc

SEQ ID NO: 1088898 - RNA, 22 nt, Human
ugcccuggcacacacacagcug

SEQ ID NO: 1088899 - RNA, 22 nt, Human
ugcuggggguagcucugcguag

SEQ ID NO: 1088900 - RNA, 22 nt, Human
ucuuuucugccagcugagcccu

SEQ ID NO: 1088901 - RNA, 22 nt, Human
aggaccuguaccucagcaucua

SEQ ID NO: 1088902 - RNA, 22 nt, Human
aaagaugaccguaugucagagc

SEQ ID NO: 1088903 - RNA, 22 nt, Human
cuggaaagugcuuuucugagag

SEQ ID NO: 1088904 - RNA, 20 nt, Human
cugccaugauugauagagug

SEQ ID NO: 1088905 - RNA, 21 nt, Human
cugcugcuggggucugggcag

SEQ ID NO: 1088906 - RNA, 22 nt, Human
gagcucagcacuaaaaucaugu

SEQ ID NO: 1088907 - RNA, 22 nt, Human
ugaggcagaaauuccuguuuuc

SEQ ID NO: 1088908 - RNA, 22 nt, Human
ggcccugcugaagccgggucua

SEQ ID NO: 1088909 - RNA, 22 nt, Human
ucacaguuuccauaggucagca

SEQ ID NO: 1088910 - RNA, 22 nt, Human
gugcauuuaggucacaugaugu

SEQ ID NO: 1088911 - RNA, 22 nt, Human
uggccucucuaccaggcagccu

SEQ ID NO: 1088912 - RNA, 22 nt, Human
aagaucagcucccgagucugag

SEQ ID NO: 1088913 - RNA, 22 nt, Human
uuuccucugucaugacagcuga

SEQ ID NO: 1088914 - RNA, 22 nt, Human
aagaaggcggaccagaagggag

SEQ ID NO: 1088915 - RNA, 22 nt, Human
uggcagcuuccugcucauagga

SEQ ID NO: 1088916 - RNA, 22 nt, Human
uuuauuauagugguggggacug

SEQ ID NO: 1088917 - RNA, 22 nt, Human
agucaaacaaauguuuauugag

SEQ ID NO: 1088918 - RNA, 19 nt, Human
gcagaugaugaggcugguc

SEQ ID NO: 1088919 - RNA, 22 nt, Human
ccuggcagacugugagggcagg

SEQ ID NO: 1088920 - RNA, 19 nt, Human
aggcagcacccaguccuug

SEQ ID NO: 1088921 - RNA, 22 nt, Human
ucauggaaacagcaaugcuaau

SEQ ID NO: 1088922 - RNA, 22 nt, Human
aguuuacaacaguagcuaugga

SEQ ID NO: 1088923 - RNA, 22 nt, Human
ggcuguggcagcuggaaguggu

SEQ ID NO: 1088924 - RNA, 22 nt, Human
ccugucuggccaccagggcgau

SEQ ID NO: 1088925 - RNA, 22 nt, Human
auccagucaaaauuaguaaggu

SEQ ID NO: 1088926 - RNA, 22 nt, Human
agcaccugcacaguggaggaaa

SEQ ID NO: 1088927 - RNA, 22 nt, Human
gcuggccugaccagccacaggc

SEQ ID NO: 1088928 - RNA, 22 nt, Human
ggcaggaggaagaguuagcacc

SEQ ID NO: 1088929 - RNA, 22 nt, Human
aaaguucugagaagcaguuuac

SEQ ID NO: 1088930 - RNA, 22 nt, Human
cuuuggcaaggguuuuaauugu

SEQ ID NO: 1088931 - RNA, 22 nt, Human
caggaaauucuuuuguuugugc

SEQ ID NO: 1088932 - RNA, 22 nt, Human
uucauguuguaguauguaucag

SEQ ID NO: 1088933 - RNA, 22 nt, Human
gcuggugagcaaaggagaagga

SEQ ID NO: 1088934 - RNA, 22 nt, Human
uuaaauuuuagaaacagacucu

SEQ ID NO: 1088935 - RNA, 22 nt, Human
agguggagugaaggaaaggcag

SEQ ID NO: 1088936 - RNA, 22 nt, Human
ggcugcugaguuggccaggaga

SEQ ID NO: 1088937 - RNA, 22 nt, Human
cuuuauggagugacacaauggg

SEQ ID NO: 1088938 - RNA, 22 nt, Human
guuauauugccaaguauauugu

SEQ ID NO: 1088939 - RNA, 22 nt, Human
agaggggcucauauccugucau

SEQ ID NO: 1088940 - RNA, 22 nt, Human
cccagcauccucagggagcggg

SEQ ID NO: 1088941 - RNA, 22 nt, Human
cgcaggcugcagccaagaagag

SEQ ID NO: 1088942 - RNA, 22 nt, Human
gcugucacucuccggccuuccc

SEQ ID NO: 1088943 - RNA, 22 nt, Human
auuuaugacuggugaauagaac

SEQ ID NO: 1088944 - RNA, 22 nt, Human
gucccugcccuccugggacuca

SEQ ID NO: 1088945 - RNA, 22 nt, Human
cugucccagauguucucagcac

SEQ ID NO: 1088946 - RNA, 22 nt, Human
uggcuccuucauucuccugcca

SEQ ID NO: 1088947 - RNA, 22 nt, Human
uagcuuaucuauacagacuuuu

SEQ ID NO: 1088948 - RNA, 22 nt, Human
cucccugguguccccuccagga

SEQ ID NO: 1088949 - RNA, 22 nt, Human
cccuccagagcuugaccugcug

SEQ ID NO: 1088950 - RNA, 22 nt, Human
ucuggagcgaggucccugucug

SEQ ID NO: 1088951 - RNA, 20 nt, Human
cccuggagagaagcuccacg

SEQ ID NO: 1088952 - RNA, 22 nt, Human
uaauacacugcuuuuuguaacu

SEQ ID NO: 1088953 - RNA, 22 nt, Human
cugggccuuggauugacacugu

SEQ ID NO: 1088954 - RNA, 23 nt, Human
cggacaaccauuguuuuaguauc

SEQ ID NO: 1088955 - RNA, 22 nt, Human
cacauacauacguauguauaca

SEQ ID NO: 1088956 - RNA, 22 nt, Human
uuuauuagauuaucaaagaggu

SEQ ID NO: 1088957 - RNA, 22 nt, Human
ccagggugggaggcugaaggcg

SEQ ID NO: 1088958 - RNA, 22 nt, Human
augcccugugacucuccuggac

SEQ ID NO: 1088959 - RNA, 22 nt, Human
cuggaaagauuuacacggggaa

SEQ ID NO: 1088960 - RNA, 20 nt, Human
agcauuugaaauaugacuau

SEQ ID NO: 1088961 - RNA, 22 nt, Human
ugugaaaugcuauuuccaugag

SEQ ID NO: 1088962 - RNA, 22 nt, Human
uaaaggagugugaugaaaggga

SEQ ID NO: 1088963 - RNA, 22 nt, Human
agggccuggcgcguggccgccg

SEQ ID NO: 1088964 - RNA, 22 nt, Human
gggcugagccauuugaaccuug

SEQ ID NO: 1088965 - RNA, 23 nt, Human
auuuuaaccuugacuaacaugca

SEQ ID NO: 1088966 - RNA, 22 nt, Human
uccaauuuuacgucuguauaaa

SEQ ID NO: 1088967 - RNA, 22 nt, Human
uauuuccagcaguaagaagaca

SEQ ID NO: 1088968 - RNA, 22 nt, Human
cuuucuggcacagccgcgggau

SEQ ID NO: 1088969 - RNA, 22 nt, Human
ucucugguuauuaacuaacucc

SEQ ID NO: 1088970 - RNA, 22 nt, Human
gcuggcugaggucuagcucuuu

SEQ ID NO: 1088971 - RNA, 22 nt, Human
caggggaaggagccuugaaacu

SEQ ID NO: 1088972 - RNA, 22 nt, Human
ggcugggcaggucugcacaggg

SEQ ID NO: 1088973 - RNA, 22 nt, Human
ucagaaaucuugucaaggcauc

SEQ ID NO: 1088974 - RNA, 22 nt, Human
gcugagagcaaagcaugucuag

SEQ ID NO: 1088975 - RNA, 18 nt, Human
ggcucagcaggcucucuc

SEQ ID NO: 1088976 - RNA, 23 nt, Human
caacagcuguuagauaugggcuu

SEQ ID NO: 1088977 - RNA, 22 nt, Human
uaauaccuagagaugauacaaa

SEQ ID NO: 1088978 - RNA, 22 nt, Human
gaagcacugccauaauucagac

SEQ ID NO: 1088979 - RNA, 22 nt, Human
ccugagagccagugccugccca

SEQ ID NO: 1088980 - RNA, 21 nt, Human
ucagggcagcugcucuucaga

SEQ ID NO: 1088981 - RNA, 22 nt, Human
agggccugacacccuugccagc

SEQ ID NO: 1088982 - RNA, 22 nt, Human
ugagaucauauguacaaggucu

SEQ ID NO: 1088983 - RNA, 22 nt, Human
aagacuuucaaguaugcaugca

SEQ ID NO: 1088984 - RNA, 22 nt, Human
aaauaugacuagaaugccaggu

SEQ ID NO: 1088985 - RNA, 22 nt, Human
uccuucaugaugcuuagcagag

SEQ ID NO: 1088986 - RNA, 22 nt, Human
agcaggcugccuuccaaagccu

SEQ ID NO: 1088987 - RNA, 22 nt, Human
aaacuucaguaggagccaaccu

SEQ ID NO: 1088988 - RNA, 22 nt, Human
uuaguucuugggugaacuuuug

SEQ ID NO: 1088989 - RNA, 22 nt, Human
ccaggacuuuaaguccagcacu

SEQ ID NO: 1088990 - RNA, 22 nt, Human
cgugggcugcgcccaguucuuc

SEQ ID NO: 1088991 - RNA, 22 nt, Human
gagaagcaaucgugacaucucc

SEQ ID NO: 1088992 - RNA, 22 nt, Human
acugugaaucacuacuaguaga

SEQ ID NO: 1088993 - RNA, 22 nt, Human
gcccuuccuuagacagcaggau

SEQ ID NO: 1088994 - RNA, 22 nt, Human
ugagagcugccacgugaccaug

SEQ ID NO: 1088995 - RNA, 22 nt, Human
caaugucagaauuacaguugau

SEQ ID NO: 1088996 - RNA, 22 nt, Human
aucuuuuacauuacugcccaga

SEQ ID NO: 1088997 - RNA, 22 nt, Human
ccugggcucugucagaauuggg

SEQ ID NO: 1088998 - RNA, 22 nt, Human
acagagucauucacugaugaag

SEQ ID NO: 1088999 - RNA, 23 nt, Human
cuguccuuggucuuggcugagug

SEQ ID NO: 1089000 - RNA, 22 nt, Human
gcugcccaguucugcugcugcc

SEQ ID NO: 1089001 - RNA, 22 nt, Human
auuucauggcagacuuuaaccc

SEQ ID NO: 1089002 - RNA, 22 nt, Human
ggaagccagaaagugagaauau

SEQ ID NO: 1089003 - RNA, 20 nt, Human
aaggcacuaugucugcuagc

SEQ ID NO: 1089004 - RNA, 22 nt, Human
ggguggggccaggcaauuugca

SEQ ID NO: 1089005 - RNA, 22 nt, Human
auguccuucuccucuuaccugc

SEQ ID NO: 1089006 - RNA, 22 nt, Human
augaacuaagagucauuagugu

SEQ ID NO: 1089007 - RNA, 22 nt, Human
aaagguuuucuaggguugaggg

SEQ ID NO: 1089008 - RNA, 22 nt, Human
uuugucuugaggcuggggaagu

SEQ ID NO: 1089009 - RNA, 22 nt, Human
aaugcuuugagggaagaugaaa

SEQ ID NO: 1089010 - RNA, 22 nt, Human
gcaaaugaguuguaacauaaaa

SEQ ID NO: 1089011 - RNA, 22 nt, Human
gcugucccgcugacuuccagcu

SEQ ID NO: 1089012 - RNA, 22 nt, Human
aauaugaauuauuguuacaagu

SEQ ID NO: 1089013 - RNA, 22 nt, Human
uagauuccucuacaauaaauga

SEQ ID NO: 1089014 - RNA, 22 nt, Human
uuggcuuccaggaucucagcag

SEQ ID NO: 1089015 - RNA, 18 nt, Human
cucucuuuccacucuuug

SEQ ID NO: 1089016 - RNA, 20 nt, Human
ucucccaggcucagggaaga

SEQ ID NO: 1089017 - RNA, 22 nt, Human
caaaguaacugccuuuccaauu

SEQ ID NO: 1089018 - RNA, 22 nt, Human
gcaggaacuugggugaagucag

SEQ ID NO: 1089019 - RNA, 22 nt, Human
guuacauuuggugauuuggugc

SEQ ID NO: 1089020 - RNA, 22 nt, Human
acagguggcuuccauuuucuaa

SEQ ID NO: 1089021 - RNA, 19 nt, Human
uuuuaaguccucucuauuc

SEQ ID NO: 1089022 - RNA, 22 nt, Human
gugagcagcucaggguggucuc

SEQ ID NO: 1089023 - RNA, 22 nt, Human
ucccaggcaaaggcagcucauu

SEQ ID NO: 1089024 - RNA, 22 nt, Human
guuucuaagggagagcugccag

SEQ ID NO: 1089025 - RNA, 22 nt, Human
aauacaguagguaauaguucau

SEQ ID NO: 1089026 - RNA, 22 nt, Human
gaggcagccagagguucucauu

SEQ ID NO: 1089027 - RNA, 22 nt, Human
ggaggcagaauagagugugggu

SEQ ID NO: 1089028 - RNA, 22 nt, Human
uguaugaagguuuaccugcugu

SEQ ID NO: 1089029 - RNA, 22 nt, Human
acugugugcccugacgccaggg

SEQ ID NO: 1089030 - RNA, 21 nt, Human
gaaaggucuuaacuuacagag

SEQ ID NO: 1089031 - RNA, 22 nt, Human
ugggcaaguaucggacucugag

SEQ ID NO: 1089032 - RNA, 22 nt, Human
aggcucagcugguggugaucgc

SEQ ID NO: 1089033 - RNA, 21 nt, Human
augggcagaggcagagaggcu

SEQ ID NO: 1089034 - RNA, 22 nt, Human
uugaaaguuuauggagucugca

SEQ ID NO: 1089035 - RNA, 22 nt, Human
uagagcuggccgggacagcugg

SEQ ID NO: 1089036 - RNA, 22 nt, Human
ucuuugaugggagaucugagag

SEQ ID NO: 1089037 - RNA, 22 nt, Human
gcagggacaccuuugugaagcu

SEQ ID NO: 1089038 - RNA, 22 nt, Human
cccuguccuggaugggagcacu

SEQ ID NO: 1089039 - RNA, 21 nt, Human
agcugcuuucagcuccuagag

SEQ ID NO: 1089040 - RNA, 22 nt, Human
uauuuuagguaauauccauugu

SEQ ID NO: 1089041 - RNA, 22 nt, Human
ggcuggagauaugucuggaaca

SEQ ID NO: 1089042 - RNA, 22 nt, Human
aguaaacauuucagauuuauuu

SEQ ID NO: 1089043 - RNA, 22 nt, Human
uaaagcauguuucaguaagguu

SEQ ID NO: 1089044 - RNA, 22 nt, Human
acauaacauaguugacauuuuu

SEQ ID NO: 1089045 - RNA, 22 nt, Human
ugggaaggcguggaaguagaag

SEQ ID NO: 1089046 - RNA, 22 nt, Human
ucucauucauccaaggauuuau

SEQ ID NO: 1089047 - RNA, 22 nt, Human
augcugugguagacagcauucc

SEQ ID NO: 1089048 - RNA, 22 nt, Human
gguggagcuguggacaggaagg

SEQ ID NO: 1089049 - RNA, 22 nt, Human
aacacaaagaagcugcaggauc

SEQ ID NO: 1089050 - RNA, 22 nt, Human
ccaggcucugucuggucagaag

SEQ ID NO: 1089051 - RNA, 22 nt, Human
gucagaggggcagcugccaggc

SEQ ID NO: 1089052 - RNA, 22 nt, Human
agcacagaaagcacauuugaaa

SEQ ID NO: 1089053 - RNA, 22 nt, Human
cagcauggggcuuggagucagc

SEQ ID NO: 1089054 - RNA, 22 nt, Human
agugcugucuccuucccccggg

SEQ ID NO: 1089055 - RNA, 22 nt, Human
aauaacuucauguaacauuuaa

SEQ ID NO: 1089056 - RNA, 22 nt, Human
agggcugcccagugugagagcu

SEQ ID NO: 1089057 - RNA, 22 nt, Human
cugauuuacauauacaaaagau

SEQ ID NO: 1089058 - RNA, 22 nt, Human
uaguuuguagaaaucuagaaau

SEQ ID NO: 1089059 - RNA, 22 nt, Human
uguuacuuaucucacgugaugc

SEQ ID NO: 1089060 - RNA, 22 nt, Human
auucaaguccagcuucucuaca

SEQ ID NO: 1089061 - RNA, 22 nt, Human
uauaagaaugcuuguuuggggu

SEQ ID NO: 1089062 - RNA, 22 nt, Human
ggggcagauggaacagagcaca

SEQ ID NO: 1089063 - RNA, 22 nt, Human
aagagacaaugucuuuuggaua

SEQ ID NO: 1089064 - RNA, 22 nt, Human
acagagauggcacagagaaggu

SEQ ID NO: 1089065 - RNA, 22 nt, Human
caccugagugucaguauucuca

SEQ ID NO: 1089066 - RNA, 22 nt, Human
guagcuuauuagggauaauagu

SEQ ID NO: 1089067 - RNA, 22 nt, Human
aaaguaacaauaagguucuauu

SEQ ID NO: 1089068 - RNA, 22 nt, Human
cagaggccucacuuccagccag

SEQ ID NO: 1089069 - RNA, 22 nt, Human
caauuuuacucuuccucuucca

SEQ ID NO: 1089070 - RNA, 22 nt, Human
ccaccuccaccuauugccagcc

SEQ ID NO: 1089071 - RNA, 22 nt, Human
uccauuuuagaagaaaauccac

SEQ ID NO: 1089072 - RNA, 22 nt, Human
caucaguuuuagaggggugaaa

SEQ ID NO: 1089073 - RNA, 17 nt, Human
aaguccagccugcagcu

SEQ ID NO: 1089074 - RNA, 22 nt, Human
gccugagaaggauaggaagcga

SEQ ID NO: 1089075 - RNA, 22 nt, Human
cagcuugcaguacuuguuuuug

SEQ ID NO: 1089076 - RNA, 22 nt, Human
gccuuuuuuguugcucugucac

SEQ ID NO: 1089077 - RNA, 22 nt, Human
guguuuccucacuucucugacu

SEQ ID NO: 1089078 - RNA, 22 nt, Human
aagagcaguguuuuacucagcu

SEQ ID NO: 1089079 - RNA, 22 nt, Human
agggcagcucucaccucuggcc

SEQ ID NO: 1089080 - RNA, 22 nt, Human
uuacaguaauguauuauuuaac

SEQ ID NO: 1089081 - RNA, 22 nt, Human
cuguaugaaauugucauuuuua

SEQ ID NO: 1089082 - RNA, 22 nt, Human
ucuucucccaucuccaggcagg

SEQ ID NO: 1089083 - RNA, 22 nt, Human
acugggcucauaaugucauaga

SEQ ID NO: 1089084 - RNA, 22 nt, Human
ccuucuucuguguggcccaaga

SEQ ID NO: 1089085 - RNA, 22 nt, Human
aggcaguuguagagagggcucu

SEQ ID NO: 1089086 - RNA, 21 nt, Human
cugcuguggcccccgacaugc

SEQ ID NO: 1089087 - RNA, 22 nt, Human
aagcagcagaccugauuuugaa

SEQ ID NO: 1089088 - RNA, 22 nt, Human
caaaagaagcucuuggggcuag

SEQ ID NO: 1089089 - RNA, 22 nt, Human
aauuuugugugggaucaaagga

SEQ ID NO: 1089090 - RNA, 21 nt, Human
agguggggcugcaccucugcu

SEQ ID NO: 1089091 - RNA, 22 nt, Human
uuuccuuucuagaagccuaaau

SEQ ID NO: 1089092 - RNA, 22 nt, Human
gccuuguuucauuacacguggu

SEQ ID NO: 1089093 - RNA, 22 nt, Human
cuuccuccgaagaaguugcugg

SEQ ID NO: 1089094 - RNA, 22 nt, Human
guggcugguuuccugcaugcaa

SEQ ID NO: 1089095 - RNA, 22 nt, Human
ucagaccauccugcuguuagug

SEQ ID NO: 1089096 - RNA, 22 nt, Human
acugcccucccaucuauugcaa

SEQ ID NO: 1089097 - RNA, 22 nt, Human
cuucaguguucccaucuguaaa

SEQ ID NO: 1089098 - RNA, 19 nt, Human
uggcauugguccagauaaa

SEQ ID NO: 1089099 - RNA, 22 nt, Human
acuucaaaugugacaaugugaa

SEQ ID NO: 1089100 - RNA, 18 nt, Human
cccagcccaccauuucuc

SEQ ID NO: 1089101 - RNA, 22 nt, Human
cccuggcugccagucaccagac

SEQ ID NO: 1089102 - RNA, 20 nt, Human
agagagcacaggcaggaaag

SEQ ID NO: 1089103 - RNA, 22 nt, Human
ugcagugguguccagguguacu

SEQ ID NO: 1089104 - RNA, 17 nt, Human
ugauucaacuagaaacu

SEQ ID NO: 1089105 - RNA, 22 nt, Human
gccaccaggagcccaguccaaa

SEQ ID NO: 1089106 - RNA, 22 nt, Human
uuacagaugggguugcaauaaa

SEQ ID NO: 1089107 - RNA, 22 nt, Human
ucacauuuaaacaggaggauua

SEQ ID NO: 1089108 - RNA, 22 nt, Human
gcagagugccgagauggaagcg

SEQ ID NO: 1089109 - RNA, 22 nt, Human
uuuaauguuaaauuuguagaug

SEQ ID NO: 1089110 - RNA, 22 nt, Human
acaugcuuccaaauuauguugg

SEQ ID NO: 1089111 - RNA, 22 nt, Human
ccgaggaauuuuuauaagaucu

SEQ ID NO: 1089112 - RNA, 21 nt, Human
uuuauguacuucauagaguag

SEQ ID NO: 1089113 - RNA, 22 nt, Human
guauuuuauggcaugcaguggc

SEQ ID NO: 1089114 - RNA, 22 nt, Human
gagugcagaugaacagaagauu

SEQ ID NO: 1089115 - RNA, 22 nt, Human
ugaaagcaaccuguaacaguga

SEQ ID NO: 1089116 - RNA, 22 nt, Human
aacuuccaccaaauaguauaua

SEQ ID NO: 1089117 - RNA, 22 nt, Human
gccagaagggguggauccaggc

SEQ ID NO: 1089118 - RNA, 22 nt, Human
caagugucuauaucagugcuug

SEQ ID NO: 1089119 - RNA, 22 nt, Human
ucuuggcaguggaauaccagga

SEQ ID NO: 1089120 - RNA, 22 nt, Human
ggcagaagugaugggauauaac

SEQ ID NO: 1089121 - RNA, 22 nt, Human
cccuggagcuagucugagcaga

SEQ ID NO: 1089122 - RNA, 22 nt, Human
gggcucagggacacaugugugu

SEQ ID NO: 1089123 - RNA, 22 nt, Human
gcccagccuccaagcuccaagg

SEQ ID NO: 1089124 - RNA, 22 nt, Human
ccaggccaguguuugguccagg

SEQ ID NO: 1089125 - RNA, 22 nt, Human
ccacagggccuuuccugcuggc

SEQ ID NO: 1089126 - RNA, 22 nt, Human
guggcccugucccaggccuccu

SEQ ID NO: 1089127 - RNA, 19 nt, Human
gagguggguccccgcagcc

SEQ ID NO: 1089128 - RNA, 22 nt, Human
ucccagccuuccagucugguuu

SEQ ID NO: 1089129 - RNA, 22 nt, Human
uuuuuccaccguacuuccugag

SEQ ID NO: 1089130 - RNA, 22 nt, Human
acagcuauagacgauguauaga

SEQ ID NO: 1089131 - RNA, 22 nt, Human
aaacuguaaacacagcaguaca

SEQ ID NO: 1089132 - RNA, 22 nt, Human
auuuagcaaaaaaugaugaagc

SEQ ID NO: 1089133 - RNA, 22 nt, Human
ggccugaggcaauagucagaca

SEQ ID NO: 1089134 - RNA, 21 nt, Human
ucuggcagcaguuuguugagu

SEQ ID NO: 1089135 - RNA, 22 nt, Human
acuuccagcuagguucugcuaa

SEQ ID NO: 1089136 - RNA, 22 nt, Human
cauuuguaauacugacuugcag

SEQ ID NO: 1089137 - RNA, 22 nt, Human
aguggagugaguggcagaagga

SEQ ID NO: 1089138 - RNA, 22 nt, Human
auuucucaguguacauuauguu

SEQ ID NO: 1089139 - RNA, 22 nt, Human
uugaauaguuuuggauagcaua

SEQ ID NO: 1089140 - RNA, 22 nt, Human
gauuucuugaccccugucucag

SEQ ID NO: 1089141 - RNA, 22 nt, Human
cugggcgugucuuccagcuggc

SEQ ID NO: 1089142 - RNA, 19 nt, Human
gaaaggcugcugcuaccug

SEQ ID NO: 1089143 - RNA, 19 nt, Human
ucugaauuauuuauguacc

SEQ ID NO: 1089144 - RNA, 22 nt, Human
cagagcugcacauucuaugaug

SEQ ID NO: 1089145 - RNA, 18 nt, Human
cuaacagggaaaauagaa

SEQ ID NO: 1089146 - RNA, 22 nt, Human
gcagugaaacaauaggaucaaa

SEQ ID NO: 1089147 - RNA, 22 nt, Human
ugcaagagcccaaacuauauac

SEQ ID NO: 1089148 - RNA, 22 nt, Human
ugcuggcucuaggcugagacag

SEQ ID NO: 1089149 - RNA, 17 nt, Human
agcaaaaguaucaaagc

SEQ ID NO: 1089150 - RNA, 19 nt, Human
acucuuuuccuuuugaauc

SEQ ID NO: 1089151 - RNA, 21 nt, Human
uuauuucacauggacuuccag

SEQ ID NO: 1089152 - RNA, 23 nt, Human
caagucauggauuggaguuucag

SEQ ID NO: 1089153 - RNA, 22 nt, Human
gccaggaguucagaugcauguu

SEQ ID NO: 1089154 - RNA, 22 nt, Human
agcugccauccgaggugucaga

SEQ ID NO: 1089155 - RNA, 22 nt, Human
gaggaagcugcguggcauuuca

SEQ ID NO: 1089156 - RNA, 22 nt, Human
caucagaccugccagacuaggu

SEQ ID NO: 1089157 - RNA, 22 nt, Human
uacuuccuguuuccaugucugu

SEQ ID NO: 1089158 - RNA, 22 nt, Human
ucaguguuacauuauauagaac

SEQ ID NO: 1089159 - RNA, 22 nt, Human
uggcccugucccuggagccugg

SEQ ID NO: 1089160 - RNA, 22 nt, Human
agaucacagagccaagauucca

SEQ ID NO: 1089161 - RNA, 22 nt, Human
gcccauggcuucccuaggcaca

SEQ ID NO: 1089162 - RNA, 22 nt, Human
augccaggccccacgcugggca

SEQ ID NO: 1089163 - RNA, 22 nt, Human
ccagaacacaguggaagaauau

SEQ ID NO: 1089164 - RNA, 18 nt, Human
acagaggcagacauguau

SEQ ID NO: 1089165 - RNA, 22 nt, Human
ucagucauuguccuuaaaacac

SEQ ID NO: 1089166 - RNA, 22 nt, Human
aaaugacacuaggcuuuuugca

SEQ ID NO: 1089167 - RNA, 22 nt, Human
uggagguggcaucugacagcug

SEQ ID NO: 1089168 - RNA, 22 nt, Human
uuucagaauaucgauucaguga

SEQ ID NO: 1089169 - RNA, 22 nt, Human
auguaugaugcuaggcucucag

SEQ ID NO: 1089170 - RNA, 22 nt, Human
ggcagcuggguuggccagaaac

SEQ ID NO: 1089171 - RNA, 22 nt, Human
acuucaaacaauuaacagagaa

SEQ ID NO: 1089172 - RNA, 22 nt, Human
ugcuucuggaguaacaggguga

SEQ ID NO: 1089173 - RNA, 22 nt, Human
aaacacagguacugcagaagug

SEQ ID NO: 1089174 - RNA, 22 nt, Human
uguuaagaagaggcaguacuua

SEQ ID NO: 1089175 - RNA, 22 nt, Human
uuaggaguccagaugucuuggg

SEQ ID NO: 1089176 - RNA, 22 nt, Human
ucccagggacugggcuaggcuu

SEQ ID NO: 1089177 - RNA, 21 nt, Human
gaggccacuaauaggggcaga

SEQ ID NO: 1089178 - RNA, 22 nt, Human
ugcuggcucaguuugcagacuc

SEQ ID NO: 1089179 - RNA, 22 nt, Human
uucagaaucuaugugccagcuc

SEQ ID NO: 1089180 - RNA, 22 nt, Human
caagagcuggguggcaagcuag

SEQ ID NO: 1089181 - RNA, 21 nt, Human
gggugggaggacacagcaggc

SEQ ID NO: 1089182 - RNA, 22 nt, Human
gcugcgguggcuggcgauggga

SEQ ID NO: 1089183 - RNA, 21 nt, Human
gcagagccggggcgagaaggc

SEQ ID NO: 1089184 - RNA, 22 nt, Human
acauuucauguuuuccagagca

SEQ ID NO: 1089185 - RNA, 22 nt, Human
agcucccagcagagcuggccac

SEQ ID NO: 1089186 - RNA, 23 nt, Human
gcuuuuaaaccugugacugccgc

SEQ ID NO: 1089187 - RNA, 22 nt, Human
cacucucacugagcucaugcca

SEQ ID NO: 1089188 - RNA, 22 nt, Human
acaaagauucauuugcauuauu

SEQ ID NO: 1089189 - RNA, 22 nt, Human
ggagaagccacacauugggugu

SEQ ID NO: 1089190 - RNA, 21 nt, Human
uuagaguagagaacaugaucc

SEQ ID NO: 1089191 - RNA, 22 nt, Human
aagacccuauacucagugaccc

SEQ ID NO: 1089192 - RNA, 22 nt, Human
ccaagggcugcugaggugucca

SEQ ID NO: 1089193 - RNA, 22 nt, Human
uagauaauuuggcaucauauug

SEQ ID NO: 1089194 - RNA, 20 nt, Human
gugcccugugggcuauuuuc

SEQ ID NO: 1089195 - RNA, 22 nt, Human
acauaccauacauggugagaug

SEQ ID NO: 1089196 - RNA, 22 nt, Human
uucuuguauguaugcaaaauca

SEQ ID NO: 1089197 - RNA, 22 nt, Human
aaagagacugguggcauuuugc

SEQ ID NO: 1089198 - RNA, 22 nt, Human
caaaagauacuugcaucuaacu

SEQ ID NO: 1089199 - RNA, 22 nt, Human
uggcauuuauaucccaguuuau

SEQ ID NO: 1089200 - RNA, 22 nt, Human
agugggcuuacugagggagugu

SEQ ID NO: 1089201 - RNA, 22 nt, Human
uuugaaacccgucacuuugagu

SEQ ID NO: 1089202 - RNA, 22 nt, Human
uucuuauagaagcaaccauugu

SEQ ID NO: 1089203 - RNA, 17 nt, Human
auuuccucagggcugag

SEQ ID NO: 1089204 - RNA, 22 nt, Human
aucuacaggauaguuuaauauu

SEQ ID NO: 1089205 - RNA, 22 nt, Human
agagacaggauaucugcucaug

SEQ ID NO: 1089206 - RNA, 22 nt, Human
gaaagcacaguucaugagacaa

SEQ ID NO: 1089207 - RNA, 22 nt, Human
aaaaaauuccauucugugccuu

SEQ ID NO: 1089208 - RNA, 22 nt, Human
agagcugugaaaaugagguuug

SEQ ID NO: 1089209 - RNA, 22 nt, Human
uuucugaaacauggucuuugua

SEQ ID NO: 1089210 - RNA, 22 nt, Human
gcucugcugagauaucugggag

SEQ ID NO: 1089211 - RNA, 22 nt, Human
ugucagagcaaugagguucagc

SEQ ID NO: 1089212 - RNA, 22 nt, Human
guucauguuuguguauugcuca

SEQ ID NO: 1089213 - RNA, 22 nt, Human
ugcaguggcgccaucucagcuc

SEQ ID NO: 1089214 - RNA, 22 nt, Human
acuccaggcaucugcuucugcu

SEQ ID NO: 1089215 - RNA, 22 nt, Human
cagggcagagccaggauuucaa

SEQ ID NO: 1089216 - RNA, 21 nt, Human
agccaggcaagcacccccacu

SEQ ID NO: 1089217 - RNA, 22 nt, Human
cuccuuccugccccagugauaa

SEQ ID NO: 1089218 - RNA, 22 nt, Human
ggggcagagagaaggaagcuug

SEQ ID NO: 1089219 - RNA, 22 nt, Human
uucaggauccccaccgcguuua

SEQ ID NO: 1089220 - RNA, 22 nt, Human
ugagaagcugcugacuuagccu

SEQ ID NO: 1089221 - RNA, 22 nt, Human
ugaaacauuauagaauauuuau

SEQ ID NO: 1089222 - RNA, 22 nt, Human
agaagcagcuuucaaggugauu

SEQ ID NO: 1089223 - RNA, 22 nt, Human
cugguucagugaaaggcauggg

SEQ ID NO: 1089224 - RNA, 22 nt, Human
ucauccaguuguggagagggaa

SEQ ID NO: 1089225 - RNA, 22 nt, Human
guguccagggccguguugucuu

SEQ ID NO: 1089226 - RNA, 22 nt, Human
cauacauauguggaugucauau

SEQ ID NO: 1089227 - RNA, 22 nt, Human
uugcauccgggcuacuuccaca

SEQ ID NO: 1089228 - RNA, 22 nt, Human
ugucaugccaggaaauaguccc

SEQ ID NO: 1089229 - RNA, 22 nt, Human
acagaugaugugcacagauaga

SEQ ID NO: 1089230 - RNA, 22 nt, Human
ccugcucagagcgucuugugug

SEQ ID NO: 1089231 - RNA, 22 nt, Human
ucuaggagaaccaucagggagg

SEQ ID NO: 1089232 - RNA, 22 nt, Human
aaucacuuagaacccaggaagu

SEQ ID NO: 1089233 - RNA, 17 nt, Human
cacaacuggcugauuga

SEQ ID NO: 1089234 - RNA, 22 nt, Human
uauacagaacugcacgugcacg

SEQ ID NO: 1089235 - RNA, 22 nt, Human
aggcuggcuuggcucuccugug

SEQ ID NO: 1089236 - RNA, 22 nt, Human
aaugugagccaaugcccguggg

SEQ ID NO: 1089237 - RNA, 22 nt, Human
ccuuggcccuagccucaggcaa

SEQ ID NO: 1089238 - RNA, 22 nt, Human
gcuuuacauuuuggaaagguga

SEQ ID NO: 1089239 - RNA, 22 nt, Human
ggacagcauuccuaguuccaaa

SEQ ID NO: 1089240 - RNA, 20 nt, Human
cuagccuggccuugcucugg

SEQ ID NO: 1089241 - RNA, 22 nt, Human
uaaaugaagaaauggagauugu

SEQ ID NO: 1089242 - RNA, 22 nt, Human
agcucugugaagccagcaguuc

SEQ ID NO: 1089243 - RNA, 22 nt, Human
cuggcucaugugaugagggcaa

SEQ ID NO: 1089244 - RNA, 18 nt, Human
gcagaucauuagauaauu

SEQ ID NO: 1089245 - RNA, 22 nt, Human
cuucuggguaauucuucuucau

SEQ ID NO: 1089246 - RNA, 22 nt, Human
gccuggagggcucuagagaggc

SEQ ID NO: 1089247 - RNA, 22 nt, Human
ugaggcagauauuuauuggguu

SEQ ID NO: 1089248 - RNA, 22 nt, Human
gccaggaacacaaugccaagcu

SEQ ID NO: 1089249 - RNA, 22 nt, Human
caagacuuagagcaucuugaaa

SEQ ID NO: 1089250 - RNA, 18 nt, Human
ggaaaccacaggguucug

SEQ ID NO: 1089251 - RNA, 22 nt, Human
agagaacaaauuaaaggugguu

SEQ ID NO: 1089252 - RNA, 22 nt, Human
auggaauuucuccggcuccacc

SEQ ID NO: 1089253 - RNA, 22 nt, Human
gccugguguccagaggcgagug

SEQ ID NO: 1089254 - RNA, 22 nt, Human
ccaguggacaauuucugaggaa

SEQ ID NO: 1089255 - RNA, 22 nt, Human
agucuuuagagucuuaguguuu

SEQ ID NO: 1089256 - RNA, 22 nt, Human
caagggccuccaccuugcucgu

SEQ ID NO: 1089257 - RNA, 22 nt, Human
uccuggcagagagcaugaggcc

SEQ ID NO: 1089258 - RNA, 22 nt, Human
ugaguaggauaggguggggcuu

SEQ ID NO: 1089259 - RNA, 22 nt, Human
gagggcuuccauggggagcccc

SEQ ID NO: 1089260 - RNA, 22 nt, Human
guacaaaaguuauugcgguuuu

SEQ ID NO: 1089261 - RNA, 22 nt, Human
uccuuaaaugugaucuagauuu

SEQ ID NO: 1089262 - RNA, 22 nt, Human
agacagaacagaauaauuguug

SEQ ID NO: 1089263 - RNA, 22 nt, Human
ugagcuguagcagaugcuguug

SEQ ID NO: 1089264 - RNA, 18 nt, Human
ugagaggcagguagagga

SEQ ID NO: 1089265 - RNA, 22 nt, Human
aaauucucuaaagaaaacauga

SEQ ID NO: 1089266 - RNA, 22 nt, Human
acuguagaauggaaccaauugu

SEQ ID NO: 1089267 - RNA, 22 nt, Human
aaagaucagucugaagcaacau

SEQ ID NO: 1089268 - RNA, 22 nt, Human
uaaacauuuguuauucuuguuu

SEQ ID NO: 1089269 - RNA, 22 nt, Human
aucuggcuccuacacuugaaga

SEQ ID NO: 1089270 - RNA, 22 nt, Human
ggagccagaggcugcugcugug

SEQ ID NO: 1089271 - RNA, 22 nt, Human
ucaguguugugcacauacaaaa

SEQ ID NO: 1089272 - RNA, 22 nt, Human
gcagggcucauucuaguacaau

SEQ ID NO: 1089273 - RNA, 22 nt, Human
guauuuguaguagcauagaauu

SEQ ID NO: 1089274 - RNA, 22 nt, Human
uauugaaauucuucauguccuc

SEQ ID NO: 1089275 - RNA, 22 nt, Human
gcuggccuccugcuagauggaa

SEQ ID NO: 1089276 - RNA, 22 nt, Human
ucucaggcuaccuugcacaagg

SEQ ID NO: 1089277 - RNA, 22 nt, Human
agugcuuuauguuguugugcaa

SEQ ID NO: 1089278 - RNA, 22 nt, Human
caggagcaugcugaugccagaa

SEQ ID NO: 1089279 - RNA, 22 nt, Human
gcucaggaaacagcagggcuug

SEQ ID NO: 1089280 - RNA, 22 nt, Human
ucaggagucugugcaguuccac

SEQ ID NO: 1089281 - RNA, 22 nt, Human
aucaggaaauacuuauuuauaa

SEQ ID NO: 1089282 - RNA, 22 nt, Human
auggaauauuugacacauaggg

SEQ ID NO: 1089283 - RNA, 22 nt, Human
uggcucugggaaucuguugcuu

SEQ ID NO: 1089284 - RNA, 22 nt, Human
aggcuuaaugaguuaaaucacu

SEQ ID NO: 1089285 - RNA, 22 nt, Human
cugccugccacguucagcugua

SEQ ID NO: 1089286 - RNA, 22 nt, Human
cuaggaacaguucaacaguuua

SEQ ID NO: 1089287 - RNA, 20 nt, Human
cccucccagaugcuucccaa

SEQ ID NO: 1089288 - RNA, 22 nt, Human
agacuuuagaaucagauagccu

SEQ ID NO: 1089289 - RNA, 22 nt, Human
uucuucagcccauaucuuccag

SEQ ID NO: 1089290 - RNA, 22 nt, Human
ccagagucccuugcagcucagu

SEQ ID NO: 1089291 - RNA, 22 nt, Human
auauacuugauuuaacugagca

SEQ ID NO: 1089292 - RNA, 22 nt, Human
agcaggugccagguguacccgc

SEQ ID NO: 1089293 - RNA, 22 nt, Human
ggcugcagauagccagccacca

SEQ ID NO: 1089294 - RNA, 22 nt, Human
aggugcuggcgccccaggagac

SEQ ID NO: 1089295 - RNA, 22 nt, Human
gugcagagcaagggcugagggc

SEQ ID NO: 1089296 - RNA, 22 nt, Human
ggcaagaguugaagcuccagga

SEQ ID NO: 1089297 - RNA, 20 nt, Human
gccuggcacccggggcuggc

SEQ ID NO: 1089298 - RNA, 22 nt, Human
agcagccaauuggaggaugaag

SEQ ID NO: 1089299 - RNA, 22 nt, Human
acugggaggcaaagagcaagga

SEQ ID NO: 1089300 - RNA, 22 nt, Human
cuccagucauagucugucuugu

SEQ ID NO: 1089301 - RNA, 22 nt, Human
cugagaggcggagcuugcagug

SEQ ID NO: 1089302 - RNA, 22 nt, Human
auugacaaggaaacuauaccag

SEQ ID NO: 1089303 - RNA, 22 nt, Human
uucauacauuuuuacuaacagc

SEQ ID NO: 1089304 - RNA, 22 nt, Human
ugcaggugguccuuccucugcu

SEQ ID NO: 1089305 - RNA, 22 nt, Human
agcugagcugcagaugacugua

SEQ ID NO: 1089306 - RNA, 20 nt, Human
cucuuuucacucucaguggu

SEQ ID NO: 1089307 - RNA, 22 nt, Human
cagaggcuaagaugagugggug

SEQ ID NO: 1089308 - RNA, 22 nt, Human
uucauuugugguuauuuacaau

SEQ ID NO: 1089309 - RNA, 22 nt, Human
cugaagcagggagugaugaagu

SEQ ID NO: 1089310 - RNA, 22 nt, Human
gcugggcuggccgccgagaucg

SEQ ID NO: 1089311 - RNA, 22 nt, Human
agggccugugaauucucccugc

SEQ ID NO: 1089312 - RNA, 22 nt, Human
cagacagaaggcuccuugaggu

SEQ ID NO: 1089313 - RNA, 22 nt, Human
aaaugguccauccuaaagaagu

SEQ ID NO: 1089314 - RNA, 22 nt, Human
aauaggaagcaccaaauucucc

SEQ ID NO: 1089315 - RNA, 22 nt, Human
augggcagaguggggacaggaa

SEQ ID NO: 1089316 - RNA, 22 nt, Human
aagggcaggcagagaucauaua

SEQ ID NO: 1089317 - RNA, 22 nt, Human
auuucacaggccaguggugggg

SEQ ID NO: 1089318 - RNA, 22 nt, Human
uuuuacaggugugagccaccau

SEQ ID NO: 1089319 - RNA, 22 nt, Human
cguggggcggguggacacuugc

SEQ ID NO: 1089320 - RNA, 22 nt, Human
cuuccucacggugcaacaggaa

SEQ ID NO: 1089321 - RNA, 22 nt, Human
auuugaaccacucagaacucau

SEQ ID NO: 1089322 - RNA, 23 nt, Human
caugcaaacacuauugcauuugg

SEQ ID NO: 1089323 - RNA, 22 nt, Human
gcuguggcuguacagagaccau

SEQ ID NO: 1089324 - RNA, 22 nt, Human
ucuacugugguccuuguaacca

SEQ ID NO: 1089325 - RNA, 22 nt, Human
auuaagacuauugauauuuaca

SEQ ID NO: 1089326 - RNA, 22 nt, Human
auucuucauggcugugaguccu

SEQ ID NO: 1089327 - RNA, 22 nt, Human
ugcuugagacacauaugaauuu

SEQ ID NO: 1089328 - RNA, 22 nt, Human
gaugcugaagugaagugaucuu

SEQ ID NO: 1089329 - RNA, 22 nt, Human
ccugcagaggucaggccagaaa

SEQ ID NO: 1089330 - RNA, 22 nt, Human
ugggaagggagaguguccugga

SEQ ID NO: 1089331 - RNA, 22 nt, Human
gagcccagguucugcuuccagc

SEQ ID NO: 1089332 - RNA, 22 nt, Human
gaguccaggcaucccucccaua

SEQ ID NO: 1089333 - RNA, 22 nt, Human
agaggggaggcgaaccagaguc

SEQ ID NO: 1089334 - RNA, 22 nt, Human
cagaguguuucuuugggugggu

SEQ ID NO: 1089335 - RNA, 22 nt, Human
cgugggccccagccacucccuc

SEQ ID NO: 1089336 - RNA, 22 nt, Human
gccugagagacccauggggcaa

SEQ ID NO: 1089337 - RNA, 22 nt, Human
caggaaugaggucguaaguguc

SEQ ID NO: 1089338 - RNA, 22 nt, Human
uuugauaucuugguauacagau

SEQ ID NO: 1089339 - RNA, 22 nt, Human
ucauggagacuuugagccuguu

SEQ ID NO: 1089340 - RNA, 22 nt, Human
ugggccaggauuucaagacccu

SEQ ID NO: 1089341 - RNA, 22 nt, Human
uguuucuuacguuuuuagaggc

SEQ ID NO: 1089342 - RNA, 22 nt, Human
ucacugaauuucaagcuagugg

SEQ ID NO: 1089343 - RNA, 19 nt, Human
uacccucagggccucauuu

SEQ ID NO: 1089344 - RNA, 22 nt, Human
augaagauuucccagagacaug

SEQ ID NO: 1089345 - RNA, 22 nt, Human
cuguaugaggaucagacuggac

SEQ ID NO: 1089346 - RNA, 22 nt, Human
aacauucuuaagauuugugucu

SEQ ID NO: 1089347 - RNA, 22 nt, Human
auuauaaagaacaugugugugg

SEQ ID NO: 1089348 - RNA, 22 nt, Human
ggagcacccugcucagccaagc

SEQ ID NO: 1089349 - RNA, 22 nt, Human
uacauguggccagaaauuugag

SEQ ID NO: 1089350 - RNA, 22 nt, Human
cagaaauggagcccaggaaucu

SEQ ID NO: 1089351 - RNA, 22 nt, Human
ucagcugaaguggagaagcaga

SEQ ID NO: 1089352 - RNA, 22 nt, Human
ucccagccuuucuuuucugcug

SEQ ID NO: 1089353 - RNA, 22 nt, Human
caaugacauggauaaucauauu

SEQ ID NO: 1089354 - RNA, 22 nt, Human
aagcugccaccagcccagggca

SEQ ID NO: 1089355 - RNA, 22 nt, Human
cuuuguuuuacucagaggcaug

SEQ ID NO: 1089356 - RNA, 22 nt, Human
acagaacuuccagggaacauac

SEQ ID NO: 1089357 - RNA, 22 nt, Human
auucucaaacaagugguuugau

SEQ ID NO: 1089358 - RNA, 22 nt, Human
augcagaaggagccaugcuugc

SEQ ID NO: 1089359 - RNA, 18 nt, Human
cuuucagauggauaugcu

SEQ ID NO: 1089360 - RNA, 22 nt, Human
uuacacaguauccaagguucuu

SEQ ID NO: 1089361 - RNA, 19 nt, Human
gccugccuggguuucugag

SEQ ID NO: 1089362 - RNA, 22 nt, Human
uuagcuuuggauugcauuuagu

SEQ ID NO: 1089363 - RNA, 22 nt, Human
uccacuguggucccuugcugcc

SEQ ID NO: 1089364 - RNA, 22 nt, Human
uauuacguaacuacuuaaauug

SEQ ID NO: 1089365 - RNA, 22 nt, Human
uucaguuggccauaccccuaga

SEQ ID NO: 1089366 - RNA, 22 nt, Human
aaacugaaguagauucugaaau

SEQ ID NO: 1089367 - RNA, 22 nt, Human
ugguuugcccacucgagugauu

SEQ ID NO: 1089368 - RNA, 22 nt, Human
agaguguuuuucugucaaggac

SEQ ID NO: 1089369 - RNA, 22 nt, Human
aggaaggagggcagauauuaag

SEQ ID NO: 1089370 - RNA, 22 nt, Human
gcugaguugaaagcagaggaua

SEQ ID NO: 1089371 - RNA, 22 nt, Human
auugucuuuggugcuuccagga

SEQ ID NO: 1089372 - RNA, 22 nt, Human
uuagaaaugucacagaucugau

SEQ ID NO: 1089373 - RNA, 19 nt, Human
ucugcagaaggcauacaug

SEQ ID NO: 1089374 - RNA, 22 nt, Human
gaugguuuaugauagaugggaa

SEQ ID NO: 1089375 - RNA, 22 nt, Human
caaacuauuguucacaagacaa

SEQ ID NO: 1089376 - RNA, 22 nt, Human
uuauuagagugcuuugagaaag

SEQ ID NO: 1089377 - RNA, 22 nt, Human
acuguagcugccacuggaugca

SEQ ID NO: 1089378 - RNA, 22 nt, Human
ugaguggacgugaggcugagua

SEQ ID NO: 1089379 - RNA, 22 nt, Human
ucaaaauuagugaccaaaggca

SEQ ID NO: 1089380 - RNA, 22 nt, Human
gccugagagucuccagaccuug

SEQ ID NO: 1089381 - RNA, 22 nt, Human
gaguggggcguggauccagcgu

SEQ ID NO: 1089382 - RNA, 22 nt, Human
gugagacaagauuuguaggcag

SEQ ID NO: 1089383 - RNA, 22 nt, Human
ugaugaaaauaugauucugagg

SEQ ID NO: 1089384 - RNA, 22 nt, Human
ugcuggaggccugacuguguuu

SEQ ID NO: 1089385 - RNA, 19 nt, Human
guggccagggcaggggcug

SEQ ID NO: 1089386 - RNA, 20 nt, Human
guuuuaugccaguucugugu

SEQ ID NO: 1089387 - RNA, 22 nt, Human
ugaagggguucagcaugggggu

SEQ ID NO: 1089388 - RNA, 22 nt, Human
guaauagguuuucuugcuccag

SEQ ID NO: 1089389 - RNA, 22 nt, Human
cagcuggcgccuggggaccaga

SEQ ID NO: 1089390 - RNA, 20 nt, Human
aaagagaagccucaccuugu

SEQ ID NO: 1089391 - RNA, 22 nt, Human
cagcauuuagaauuugaagugu

SEQ ID NO: 1089392 - RNA, 22 nt, Human
ugagcuucaaaauaugugaauc

SEQ ID NO: 1089393 - RNA, 22 nt, Human
caauacuauucggaccaucucu

SEQ ID NO: 1089394 - RNA, 22 nt, Human
ugagcuggcacuuuuccuggga

SEQ ID NO: 1089395 - RNA, 22 nt, Human
uugaagacacagacauauagag

SEQ ID NO: 1089396 - RNA, 18 nt, Human
cccagcuccacuucccuc

SEQ ID NO: 1089397 - RNA, 22 nt, Human
ggaagccagagugcugggcagg

SEQ ID NO: 1089398 - RNA, 20 nt, Human
cccuuuaagcuuuaguaugc

SEQ ID NO: 1089399 - RNA, 22 nt, Human
gcugccagcucacucuccugag

SEQ ID NO: 1089400 - RNA, 22 nt, Human
uuuugcaaaguacauuaucagg

SEQ ID NO: 1089401 - RNA, 22 nt, Human
gugccuggagcuaauguguaua

SEQ ID NO: 1089402 - RNA, 22 nt, Human
uggagguggggcucaggaaucu

SEQ ID NO: 1089403 - RNA, 22 nt, Human
aacuugaauucugccauucaga

SEQ ID NO: 1089404 - RNA, 22 nt, Human
uuacacaaacacauuccagaua

SEQ ID NO: 1089405 - RNA, 22 nt, Human
gagaaaugagugauucacuuuu

SEQ ID NO: 1089406 - RNA, 22 nt, Human
aacaguuaucucacauauggaa

SEQ ID NO: 1089407 - RNA, 22 nt, Human
ugcagggcagcuagggagcuuu

SEQ ID NO: 1089408 - RNA, 22 nt, Human
ccaugggcgcacaggccuggag

SEQ ID NO: 1089409 - RNA, 22 nt, Human
accaaucuccuauuuuguuuca

SEQ ID NO: 1089410 - RNA, 22 nt, Human
aauauuugcaucauuagcuauu

SEQ ID NO: 1089411 - RNA, 22 nt, Human
ugaaaucugucccacuuuagcu

SEQ ID NO: 1089412 - RNA, 22 nt, Human
aguguccccuccaagggccugg

SEQ ID NO: 1089413 - RNA, 22 nt, Human
uguuucauguggacauaguugu

SEQ ID NO: 1089414 - RNA, 21 nt, Human
cagaaguaaggguaacuucuc

SEQ ID NO: 1089415 - RNA, 22 nt, Human
agagugaaguaauuguuaggau

SEQ ID NO: 1089416 - RNA, 22 nt, Human
agcuguuuuuuccucaccacuu

SEQ ID NO: 1089417 - RNA, 22 nt, Human
uguuuccaaagucuuuucuuaa

SEQ ID NO: 1089418 - RNA, 22 nt, Human
aguuuuuccguggcuacgauaa

SEQ ID NO: 1089419 - RNA, 22 nt, Human
ucaaaguaccauuaucagugga

SEQ ID NO: 1089420 - RNA, 21 nt, Human
acaggcucacgauccauuucu

SEQ ID NO: 1089421 - RNA, 22 nt, Human
gcuggagccaagcugcucuugg

SEQ ID NO: 1089422 - RNA, 22 nt, Human
gcuggccugaccugaggcuggg

SEQ ID NO: 1089423 - RNA, 22 nt, Human
cauuuagagucuugcaauuuua

SEQ ID NO: 1089424 - RNA, 22 nt, Human
aggcagugcagaguccucuucu

SEQ ID NO: 1089425 - RNA, 22 nt, Human
gagagcccugcuccuaucccag

SEQ ID NO: 1089426 - RNA, 22 nt, Human
acaggaacuguuaucucagaug

SEQ ID NO: 1089427 - RNA, 22 nt, Human
ccagagucuuuauauuccugaa

SEQ ID NO: 1089428 - RNA, 22 nt, Human
gcuccuggucuggagcuucaag

SEQ ID NO: 1089429 - RNA, 22 nt, Human
caacucauguccaacuuucuuu

SEQ ID NO: 1089430 - RNA, 22 nt, Human
cugggcugagccugggcugugu

SEQ ID NO: 1089431 - RNA, 22 nt, Human
guuacaaaggaagcuucacugc

SEQ ID NO: 1089432 - RNA, 22 nt, Human
gagcagcuguccccaaagcuuc

SEQ ID NO: 1089433 - RNA, 22 nt, Human
gcaggccuccccugcuggagcu

SEQ ID NO: 1089434 - RNA, 22 nt, Human
uacuacaaggccgaagcucuca

SEQ ID NO: 1089435 - RNA, 22 nt, Human
uugcucuguaauaaucuggggu

SEQ ID NO: 1089436 - RNA, 22 nt, Human
uuucccaagugaagugaagcca

SEQ ID NO: 1089437 - RNA, 22 nt, Human
aagaggugccagggguuuugua

SEQ ID NO: 1089438 - RNA, 22 nt, Human
cccaggcucccaggugggacaa

SEQ ID NO: 1089439 - RNA, 22 nt, Human
gagggugguggcuuaaggugcu

SEQ ID NO: 1089440 - RNA, 22 nt, Human
uguaugaaugggaaaaggaaac

SEQ ID NO: 1089441 - RNA, 19 nt, Human
guuccaaaggccagaccuu

SEQ ID NO: 1089442 - RNA, 18 nt, Human
gagaggagccagaauuuu

SEQ ID NO: 1089443 - RNA, 22 nt, Human
gccaggaugacuauacaacagc

SEQ ID NO: 1089444 - RNA, 22 nt, Human
gcugagcuagaaaaggaccaca

SEQ ID NO: 1089445 - RNA, 22 nt, Human
uuacaagugucagguacuggca

SEQ ID NO: 1089446 - RNA, 22 nt, Human
agcuuccugaugcaagagggcu

SEQ ID NO: 1089447 - RNA, 22 nt, Human
uuuagagaguguaaaaauauau

SEQ ID NO: 1089448 - RNA, 22 nt, Human
ugagaggccccagcucuuggcc

SEQ ID NO: 1089449 - RNA, 22 nt, Human
uuucaucaccccaaaucuaugg

SEQ ID NO: 1089450 - RNA, 22 nt, Human
gaauuugucccuugauauaaaa

SEQ ID NO: 1089451 - RNA, 22 nt, Human
cagacagaccugcaagggcaca

SEQ ID NO: 1089452 - RNA, 22 nt, Human
ugccuuuuaccuuguaauucug

SEQ ID NO: 1089453 - RNA, 22 nt, Human
aauacuuugccaaguucgaaga

SEQ ID NO: 1089454 - RNA, 22 nt, Human
ccuggcugaaccaaugaagugg

SEQ ID NO: 1089455 - RNA, 22 nt, Human
gccuggaguagcauggcaagcc

SEQ ID NO: 1089456 - RNA, 22 nt, Human
agcgggugcugugucagcccuc

SEQ ID NO: 1089457 - RNA, 19 nt, Human
gcugugggacagcagggug

SEQ ID NO: 1089458 - RNA, 19 nt, Human
uggcaucuguaaaauggug

SEQ ID NO: 1089459 - RNA, 22 nt, Human
aacaauuacuaccaaggccugu

SEQ ID NO: 1089460 - RNA, 22 nt, Human
gugcccuggcucacagugucuc

SEQ ID NO: 1089461 - RNA, 22 nt, Human
uggcccugccgcacuauccuca

SEQ ID NO: 1089462 - RNA, 22 nt, Human
auaauucaugggccuuucaccu

SEQ ID NO: 1089463 - RNA, 22 nt, Human
accaggaagcaucccuuuguaa

SEQ ID NO: 1089464 - RNA, 22 nt, Human
ugccugggggacuaaggccaaa

SEQ ID NO: 1089465 - RNA, 22 nt, Human
uccuucagggcugaccacaggc

SEQ ID NO: 1089466 - RNA, 22 nt, Human
caucuggcuagcuaucauugug

SEQ ID NO: 1089467 - RNA, 22 nt, Human
aaggagucugggccauucagag

SEQ ID NO: 1089468 - RNA, 22 nt, Human
acuguggaugccaaaggggagg

SEQ ID NO: 1089469 - RNA, 22 nt, Human
acuuccagcuuuauaauucagu

SEQ ID NO: 1089470 - RNA, 22 nt, Human
aguauaauuagauaucaaaagu

SEQ ID NO: 1089471 - RNA, 22 nt, Human
gcggcaggaagagcgcagcccc

SEQ ID NO: 1089472 - RNA, 22 nt, Human
agacagcaggggagucugguuu

SEQ ID NO: 1089473 - RNA, 22 nt, Human
ugaguccauugauggauaguga

SEQ ID NO: 1089474 - RNA, 22 nt, Human
gucacacagggccuccaaauca

SEQ ID NO: 1089475 - RNA, 22 nt, Human
ggcaggagggcggacaaugacc

SEQ ID NO: 1089476 - RNA, 22 nt, Human
caaauguuuuuauucuacaaca

SEQ ID NO: 1089477 - RNA, 23 nt, Human
ccuccugggcacaggccugaugg

SEQ ID NO: 1089478 - RNA, 22 nt, Human
ucugucugcgcuugcccuggug

SEQ ID NO: 1089479 - RNA, 22 nt, Human
aaguauuucuggccugugaaag

SEQ ID NO: 1089480 - RNA, 22 nt, Human
aaauuucuguuguuuugagcca

SEQ ID NO: 1089481 - RNA, 22 nt, Human
ggcuuugggcccucaagucucc

SEQ ID NO: 1089482 - RNA, 22 nt, Human
gugccagcucuccccacaucug

SEQ ID NO: 1089483 - RNA, 21 nt, Human
agcugcagcccaaaggccugu

SEQ ID NO: 1089484 - RNA, 22 nt, Human
cuggagccccagacagggagag

SEQ ID NO: 1089485 - RNA, 22 nt, Human
gggauucaucaacuguuuuaca

SEQ ID NO: 1089486 - RNA, 22 nt, Human
acaugcaugucuaugggcaggu

SEQ ID NO: 1089487 - RNA, 22 nt, Human
uggaagauaugcugauucucug

SEQ ID NO: 1089488 - RNA, 22 nt, Human
augcacaagguagauuauuauu

SEQ ID NO: 1089489 - RNA, 18 nt, Human
gucacuguguuucugagc

SEQ ID NO: 1089490 - RNA, 22 nt, Human
uucugugaaucuuuuuucccac

SEQ ID NO: 1089491 - RNA, 22 nt, Human
cagaggcacagcuucuuuuaau

SEQ ID NO: 1089492 - RNA, 22 nt, Human
ucugccuguugcuagaauguca

SEQ ID NO: 1089493 - RNA, 22 nt, Human
caaaaaacaccugugugaguau

SEQ ID NO: 1089494 - RNA, 22 nt, Human
cacacugaccugaacuuagcau

SEQ ID NO: 1089495 - RNA, 22 nt, Human
gcaagcuguccuuuugcauggc

SEQ ID NO: 1089496 - RNA, 22 nt, Human
caguggagugggacuggucuga

SEQ ID NO: 1089497 - RNA, 22 nt, Human
gagcucugggaaacaaagugua

SEQ ID NO: 1089498 - RNA, 19 nt, Human
augucccaccgccccugag

SEQ ID NO: 1089499 - RNA, 22 nt, Human
agaaauacaaaguacuaagaua

SEQ ID NO: 1089500 - RNA, 22 nt, Human
ucuuagaugaauaaaaaguuau

SEQ ID NO: 1089501 - RNA, 22 nt, Human
gccuggcccagggcucuuguug

SEQ ID NO: 1089502 - RNA, 22 nt, Human
agguaggccugacgcuggggug

SEQ ID NO: 1089503 - RNA, 22 nt, Human
cccaggcuggagugcaauggug

SEQ ID NO: 1089504 - RNA, 17 nt, Human
uagagcugguucaggag

SEQ ID NO: 1089505 - RNA, 22 nt, Human
uaauuauuaugacaacaauugc

SEQ ID NO: 1089506 - RNA, 22 nt, Human
acagggcagguggcuacugguc

SEQ ID NO: 1089507 - RNA, 22 nt, Human
gcacagccagcaucugagggau

SEQ ID NO: 1089508 - RNA, 22 nt, Human
uuguuugaggucacugauauuu

SEQ ID NO: 1089509 - RNA, 22 nt, Human
ucaguuuuguauguuguaaguc

SEQ ID NO: 1089510 - RNA, 22 nt, Human
ucucugucugagccuggcagac

SEQ ID NO: 1089511 - RNA, 22 nt, Human
caaggcagucccuacucccugc

SEQ ID NO: 1089512 - RNA, 22 nt, Human
cccagguggguuggccucuguc

SEQ ID NO: 1089513 - RNA, 22 nt, Human
aaaucaguuaagaugaggccau

SEQ ID NO: 1089514 - RNA, 22 nt, Human
ucaggugguccuaagugccauc

SEQ ID NO: 1089515 - RNA, 22 nt, Human
cuuccaaaauuuauauguugaa

SEQ ID NO: 1089516 - RNA, 22 nt, Human
ugggcugcugucugcacaugcu

SEQ ID NO: 1089517 - RNA, 22 nt, Human
aaaggucagcugccaucguucu

SEQ ID NO: 1089518 - RNA, 22 nt, Human
uccuuagagauacugucuugaa

SEQ ID NO: 1089519 - RNA, 22 nt, Human
agccuccacagaugcaaagggc

SEQ ID NO: 1089520 - RNA, 22 nt, Human
agagcugcccacacagcagauu

SEQ ID NO: 1089521 - RNA, 22 nt, Human
gaggcuguguuucagugaggcc

SEQ ID NO: 1089522 - RNA, 22 nt, Human
cagucucucugaaguauuaaga

SEQ ID NO: 1089523 - RNA, 22 nt, Human
agcagccagaaauccagaggug

SEQ ID NO: 1089524 - RNA, 22 nt, Human
agggcagagacaugcuuccuga

SEQ ID NO: 1089525 - RNA, 22 nt, Human
cacaucagguagaccuacagag

SEQ ID NO: 1089526 - RNA, 23 nt, Human
cuuuuaacuugaucugagaccag

SEQ ID NO: 1089527 - RNA, 22 nt, Human
acagagcaacuuuauuucaugg

SEQ ID NO: 1089528 - RNA, 22 nt, Human
uccaagaucuacagcaguuuag

SEQ ID NO: 1089529 - RNA, 22 nt, Human
acaucacacgccuuccaggagg

SEQ ID NO: 1089530 - RNA, 22 nt, Human
caugcuuucuguccaaauguua

SEQ ID NO: 1089531 - RNA, 19 nt, Human
uugguucauggaugcccaa

SEQ ID NO: 1089532 - RNA, 22 nt, Human
ucaaagauggguuuuguuugau

SEQ ID NO: 1089533 - RNA, 22 nt, Human
ccucugaguccuuugggcucuc

SEQ ID NO: 1089534 - RNA, 22 nt, Human
cugugcugauucagcacaggcc

SEQ ID NO: 1089535 - RNA, 22 nt, Human
agccuucagcaguucaggugcc

SEQ ID NO: 1089536 - RNA, 22 nt, Human
ugagcagauggaggcuucugca

SEQ ID NO: 1089537 - RNA, 22 nt, Human
agaaaucacaggaggcagaagg

SEQ ID NO: 1089538 - RNA, 22 nt, Human
ggacuggccggcgcugaggccc

SEQ ID NO: 1089539 - RNA, 22 nt, Human
ggucccugcugaagccuuggug

SEQ ID NO: 1089540 - RNA, 22 nt, Human
ggcacagagcccagcuuccuag

SEQ ID NO: 1089541 - RNA, 22 nt, Human
guguccaucagcagccacugug

SEQ ID NO: 1089542 - RNA, 22 nt, Human
uucaaacaacucauuuaugcaa

SEQ ID NO: 1089543 - RNA, 22 nt, Human
agcagugaugcaugacagccua

SEQ ID NO: 1089544 - RNA, 22 nt, Human
ucuaguuuaagaucuguuaguc

SEQ ID NO: 1089545 - RNA, 22 nt, Human
aacuacuaccacagucaagaca

SEQ ID NO: 1089546 - RNA, 22 nt, Human
cuguaugaaauuaaguaaacag

SEQ ID NO: 1089547 - RNA, 22 nt, Human
uauaaagcugacucaugaaacu

SEQ ID NO: 1089548 - RNA, 22 nt, Human
uucuagauugccuguaaguaaa

SEQ ID NO: 1089549 - RNA, 21 nt, Human
aucaacauugaaagagcugga

SEQ ID NO: 1089550 - RNA, 22 nt, Human
uggugagagcugaccgugcgag

SEQ ID NO: 1089551 - RNA, 22 nt, Human
ugcccugcccuugcuauuucua

SEQ ID NO: 1089552 - RNA, 22 nt, Human
agaucugaguggcugcauguaa

SEQ ID NO: 1089553 - RNA, 22 nt, Human
gucauuccuauccauuugauac

SEQ ID NO: 1089554 - RNA, 19 nt, Human
agcuguggaugugggauuu

SEQ ID NO: 1089555 - RNA, 22 nt, Human
guuuggaccucugcuagaugga

SEQ ID NO: 1089556 - RNA, 22 nt, Human
ugaaguccuagaacuccuggua

SEQ ID NO: 1089557 - RNA, 22 nt, Human
ugggcuggcccaccacaccucg

SEQ ID NO: 1089558 - RNA, 22 nt, Human
uccuugaauauaauaacaguag

SEQ ID NO: 1089559 - RNA, 22 nt, Human
acuucauguacuguucaaggcc

SEQ ID NO: 1089560 - RNA, 22 nt, Human
gggccuugccauggagccugag

SEQ ID NO: 1089561 - RNA, 22 nt, Human
aagugauuuucuucuuaguuau

SEQ ID NO: 1089562 - RNA, 22 nt, Human
ccuccucugggaagauucagag

SEQ ID NO: 1089563 - RNA, 22 nt, Human
ugugcucuggaguugccuucac

SEQ ID NO: 1089564 - RNA, 22 nt, Human
cucagaguccauaguuuacagu

SEQ ID NO: 1089565 - RNA, 22 nt, Human
ccucagaggcagaugguaagaa

SEQ ID NO: 1089566 - RNA, 22 nt, Human
cauucccacguguucuuugcuu

SEQ ID NO: 1089567 - RNA, 22 nt, Human
agccacagcuccuugguggaga

SEQ ID NO: 1089568 - RNA, 22 nt, Human
augcccugaaagauucaaaggc

SEQ ID NO: 1089569 - RNA, 20 nt, Human
ucaggaugugcugagugaag

SEQ ID NO: 1089570 - RNA, 22 nt, Human
ugaggcugagauaucagggagg

SEQ ID NO: 1089571 - RNA, 22 nt, Human
ucagacagggcuucucaaacuu

SEQ ID NO: 1089572 - RNA, 22 nt, Human
cacagugucugugcuucagugu

SEQ ID NO: 1089573 - RNA, 21 nt, Human
ccuaaacaagacugacacaca

SEQ ID NO: 1089574 - RNA, 22 nt, Human
ugggcagaggcagcagaaaccu

SEQ ID NO: 1089575 - RNA, 19 nt, Human
uauauuugagugugcaugc

SEQ ID NO: 1089576 - RNA, 21 nt, Human
cagcccagcccauugacagug

SEQ ID NO: 1089577 - RNA, 22 nt, Human
agcagggcucugccaugggccc

SEQ ID NO: 1089578 - RNA, 22 nt, Human
ccuuccaggagucucugcaggu

SEQ ID NO: 1089579 - RNA, 22 nt, Human
aaacuucaaggauuugcaaauc

SEQ ID NO: 1089580 - RNA, 22 nt, Human
ucauccaaggauuuuauugcau

SEQ ID NO: 1089581 - RNA, 22 nt, Human
aaagaggauggaguagucagcu

SEQ ID NO: 1089582 - RNA, 22 nt, Human
ugaaaugaucaguuugguuacu

SEQ ID NO: 1089583 - RNA, 22 nt, Human
caggugcuguccugcacauguc

SEQ ID NO: 1089584 - RNA, 22 nt, Human
cagccucuugcacuuugaaggc

SEQ ID NO: 1089585 - RNA, 20 nt, Human
uguucacaguaguugcugcu

SEQ ID NO: 1089586 - RNA, 22 nt, Human
acaggcugacuuccugccaugu

SEQ ID NO: 1089587 - RNA, 22 nt, Human
uucuuuucccaauauuuugcug

SEQ ID NO: 1089588 - RNA, 22 nt, Human
gaagcacugcauuucaagauca

SEQ ID NO: 1089589 - RNA, 22 nt, Human
cugggcacugcaggguguugag

SEQ ID NO: 1089590 - RNA, 22 nt, Human
gcugaagggagugcugagucug

SEQ ID NO: 1089591 - RNA, 19 nt, Human
cucagcuguagcucaugug

SEQ ID NO: 1089592 - RNA, 22 nt, Human
ggccuuugcguccacgccgcuu

SEQ ID NO: 1089593 - RNA, 22 nt, Human
auuugucuucaguagguucuuc

SEQ ID NO: 1089594 - RNA, 22 nt, Human
ucucagugacacucuucauaca

SEQ ID NO: 1089595 - RNA, 22 nt, Human
gcuuuacacagcugguucuugu

SEQ ID NO: 1089596 - RNA, 19 nt, Human
ugaagcaauaccauuuuug

SEQ ID NO: 1089597 - RNA, 22 nt, Human
cugggcugcuguccacuagggu

SEQ ID NO: 1089598 - RNA, 22 nt, Human
accgaaggaaacuggaaccguu

SEQ ID NO: 1089599 - RNA, 22 nt, Human
cagggcagugaagaacacacgu

SEQ ID NO: 1089600 - RNA, 22 nt, Human
uaauaccuggccuugauacagu

SEQ ID NO: 1089601 - RNA, 22 nt, Human
aaggucauuuaacaauuuauga

SEQ ID NO: 1089602 - RNA, 22 nt, Human
cuucuggauuuauucauuccuu

SEQ ID NO: 1089603 - RNA, 22 nt, Human
uucuuauaaguuaauauuucca

SEQ ID NO: 1089604 - RNA, 20 nt, Human
cuuucucuaauuuauaagua

SEQ ID NO: 1089605 - RNA, 22 nt, Human
ucuggccuuaucuguccaagcc

SEQ ID NO: 1089606 - RNA, 22 nt, Human
auuuugcugugguacauuagga

SEQ ID NO: 1089607 - RNA, 22 nt, Human
uggcacuggcgcaggauggcgg

SEQ ID NO: 1089608 - RNA, 22 nt, Human
uaagcaaaagucgagugugagc

SEQ ID NO: 1089609 - RNA, 19 nt, Human
cuugcugggugguuucugc

SEQ ID NO: 1089610 - RNA, 22 nt, Human
acuaaacacaugagauuccugc

SEQ ID NO: 1089611 - RNA, 22 nt, Human
gcaggcugugaggcucagaugg

SEQ ID NO: 1089612 - RNA, 22 nt, Human
uuggaccaugguagggaacuug

SEQ ID NO: 1089613 - RNA, 22 nt, Human
ugaaagggguugaguuacagcu

SEQ ID NO: 1089614 - RNA, 22 nt, Human
cagaccuggaaaacaggcuugc

SEQ ID NO: 1089615 - RNA, 22 nt, Human
cccaggacucuucacugcagcc

SEQ ID NO: 1089616 - RNA, 22 nt, Human
gcucugcugucuucuugcaggc

SEQ ID NO: 1089617 - RNA, 22 nt, Human
cuuguaaaauauccaguuaagg

SEQ ID NO: 1089618 - RNA, 22 nt, Human
gagucuuugguaaagucugcug

SEQ ID NO: 1089619 - RNA, 21 nt, Human
ccagccucagaucagggagcu

SEQ ID NO: 1089620 - RNA, 22 nt, Human
caagcagagagguuagaacaca

SEQ ID NO: 1089621 - RNA, 22 nt, Human
ccugggcugggcgucucauggg

SEQ ID NO: 1089622 - RNA, 20 nt, Human
uggaggcaccuguggagauc

SEQ ID NO: 1089623 - RNA, 22 nt, Human
aggccucugcuggaaagaguug

SEQ ID NO: 1089624 - RNA, 22 nt, Human
ucaaagagcucuaucuucaaaa

SEQ ID NO: 1089625 - RNA, 22 nt, Human
gugccugugccaggggugugcu

SEQ ID NO: 1089626 - RNA, 22 nt, Human
auucuuuuaaauggcaguagua

SEQ ID NO: 1089627 - RNA, 22 nt, Human
aggcaggagcaagcccuacaag

SEQ ID NO: 1089628 - RNA, 22 nt, Human
ggaaaaggccacagggacacau

SEQ ID NO: 1089629 - RNA, 22 nt, Human
ugcugccuugaccuccugggcu

SEQ ID NO: 1089630 - RNA, 22 nt, Human
uaagagaacuggauagauagga

SEQ ID NO: 1089631 - RNA, 22 nt, Human
cacguuuuaugacagaagaagc

SEQ ID NO: 1089632 - RNA, 22 nt, Human
agcagggcuggggcacgagcca

SEQ ID NO: 1089633 - RNA, 22 nt, Human
ucugcuguucauucuuuuagcu

SEQ ID NO: 1089634 - RNA, 22 nt, Human
ugcagcuccucuggcugccuga

SEQ ID NO: 1089635 - RNA, 22 nt, Human
uagauuuugcauuucuaacaag

SEQ ID NO: 1089636 - RNA, 22 nt, Human
ucagcaaugagaacuggcauuu

SEQ ID NO: 1089637 - RNA, 22 nt, Human
aaaguucuccuggauugugcug

SEQ ID NO: 1089638 - RNA, 22 nt, Human
ugcaauaaagugcuauaaaucc

SEQ ID NO: 1089639 - RNA, 22 nt, Human
ccugggaggcggagguugcagu

SEQ ID NO: 1089640 - RNA, 22 nt, Human
ucauacauaacuuguacaguga

SEQ ID NO: 1089641 - RNA, 22 nt, Human
ugaaaugaagggcuuguucugg

SEQ ID NO: 1089642 - RNA, 23 nt, Human
auuuccuacuauaaaagagguaa

SEQ ID NO: 1089643 - RNA, 22 nt, Human
gauuucuuuagcucaucagauc

SEQ ID NO: 1089644 - RNA, 22 nt, Human
gauguaauagauauagauugcu

SEQ ID NO: 1089645 - RNA, 22 nt, Human
ggaggggcagccauggaacucc

SEQ ID NO: 1089646 - RNA, 22 nt, Human
caguuacaugcucaugucauca

SEQ ID NO: 1089647 - RNA, 22 nt, Human
ucuggcucuuugggugauugua

SEQ ID NO: 1089648 - RNA, 22 nt, Human
acagugaugagggaauuuugug

SEQ ID NO: 1089649 - RNA, 19 nt, Human
uugugugucagucagaguu

SEQ ID NO: 1089650 - RNA, 22 nt, Human
gggucaggcucagcagggcagc

SEQ ID NO: 1089651 - RNA, 18 nt, Human
acugccuggcgaagauag

SEQ ID NO: 1089652 - RNA, 22 nt, Human
acagaaauugcuaauagcucau

SEQ ID NO: 1089653 - RNA, 22 nt, Human
ggccaguggcucugugcuuggg

SEQ ID NO: 1089654 - RNA, 22 nt, Human
cagcugagaaaggcaggcucac

SEQ ID NO: 1089655 - RNA, 22 nt, Human
ugugaccucaucuuaacuggaa

SEQ ID NO: 1089656 - RNA, 22 nt, Human
gcugcagcagcugcaggguugu

SEQ ID NO: 1089657 - RNA, 22 nt, Human
ggcucuggucagugaggggccu

SEQ ID NO: 1089658 - RNA, 22 nt, Human
cuacaaauauaaaacacagaua

SEQ ID NO: 1089659 - RNA, 22 nt, Human
ucagccucagguguucagauuu

SEQ ID NO: 1089660 - RNA, 18 nt, Human
uggcagccagcugcuccu

SEQ ID NO: 1089661 - RNA, 22 nt, Human
cccacucccugcacgccugccg

SEQ ID NO: 1089662 - RNA, 22 nt, Human
ugcucuguaaggucagaaaagg

SEQ ID NO: 1089663 - RNA, 23 nt, Human
ggcugcgagugccugggccugug

SEQ ID NO: 1089664 - RNA, 22 nt, Human
uggagucugugaugcucugggu

SEQ ID NO: 1089665 - RNA, 22 nt, Human
ucugccugaaucucuuagaaca

SEQ ID NO: 1089666 - RNA, 22 nt, Human
ccagagagcuacaaggcauaaa

SEQ ID NO: 1089667 - RNA, 22 nt, Human
ucuucauuccguagauauuuau

SEQ ID NO: 1089668 - RNA, 22 nt, Human
aauuauauguuaaucuucaauu

SEQ ID NO: 1089669 - RNA, 22 nt, Human
aggugagguuugggagguguca

SEQ ID NO: 1089670 - RNA, 19 nt, Human
ucauaaggagagaggaaau

SEQ ID NO: 1089671 - RNA, 22 nt, Human
uauauucauuuuaaagccaucu

SEQ ID NO: 1089672 - RNA, 22 nt, Human
cacugcaguuccccagugcgca

SEQ ID NO: 1089673 - RNA, 22 nt, Human
aaaagucuugucaagguuccca

SEQ ID NO: 1089674 - RNA, 22 nt, Human
uuguuacacauaauaacauuuu

SEQ ID NO: 1089675 - RNA, 22 nt, Human
cucuucaggaauaugucaguca

SEQ ID NO: 1089676 - RNA, 22 nt, Human
uuuuauuaguggcuagaugggg

SEQ ID NO: 1089677 - RNA, 22 nt, Human
gaguuauuucagaaggaaagau

SEQ ID NO: 1089678 - RNA, 22 nt, Human
aagggcagagggaaucccacau

SEQ ID NO: 1089679 - RNA, 21 nt, Human
agcugccugcucuggaccugg

SEQ ID NO: 1089680 - RNA, 22 nt, Human
agcugucugucuccugaggaga

SEQ ID NO: 1089681 - RNA, 22 nt, Human
gauucccauccucagcagcagc

SEQ ID NO: 1089682 - RNA, 22 nt, Human
cagucauuuuauuugaaaauua

SEQ ID NO: 1089683 - RNA, 22 nt, Human
gcagcgagugcggcugccacag

SEQ ID NO: 1089684 - RNA, 22 nt, Human
uaacagaagagcaggcagcccu

SEQ ID NO: 1089685 - RNA, 22 nt, Human
gaguggggcccacugcugggug

SEQ ID NO: 1089686 - RNA, 22 nt, Human
ggcucagcuuaucugggcaggc

SEQ ID NO: 1089687 - RNA, 22 nt, Human
uuauuucauguaaaauuuaugu

SEQ ID NO: 1089688 - RNA, 22 nt, Human
uugaaaggugacauuguuagag

SEQ ID NO: 1089689 - RNA, 22 nt, Human
uugguuuaggaacuggcuugga

SEQ ID NO: 1089690 - RNA, 22 nt, Human
gaaugaguagaguauaaacaaa

SEQ ID NO: 1089691 - RNA, 22 nt, Human
cccagcaucccagugggcagca

SEQ ID NO: 1089692 - RNA, 22 nt, Human
cacuuugauuugugaugugaga

SEQ ID NO: 1089693 - RNA, 22 nt, Human
ccacccuggacaggccucugag

SEQ ID NO: 1089694 - RNA, 22 nt, Human
guggaggguuugcaaugugcag

SEQ ID NO: 1089695 - RNA, 22 nt, Human
aaaggcagugugauacuguggu

SEQ ID NO: 1089696 - RNA, 22 nt, Human
uuaaagcaucacacuauuaauu

SEQ ID NO: 1089697 - RNA, 22 nt, Human
uuuguaacuuuagaauugaucc

SEQ ID NO: 1089698 - RNA, 22 nt, Human
gcacauaacugaccacaucuaa

SEQ ID NO: 1089699 - RNA, 22 nt, Human
aagacaagcaucaaaucaggca

SEQ ID NO: 1089700 - RNA, 22 nt, Human
uucaagucauguuaacugcuuc

SEQ ID NO: 1089701 - RNA, 19 nt, Human
acagauggaggaaucuggg

SEQ ID NO: 1089702 - RNA, 22 nt, Human
agaggcccucucucuccugaug

SEQ ID NO: 1089703 - RNA, 22 nt, Human
ugcagggcaguuuguuucggca

SEQ ID NO: 1089704 - RNA, 22 nt, Human
guaauaauacuagucagccuug

SEQ ID NO: 1089705 - RNA, 22 nt, Human
gacagggcaagacucugucuaa

SEQ ID NO: 1089706 - RNA, 22 nt, Human
uguccucacaggaaugaacuuu

SEQ ID NO: 1089707 - RNA, 22 nt, Human
gugaaaucugaggcccaugaug

SEQ ID NO: 1089708 - RNA, 22 nt, Human
cagucacacaaguggacuuggg

SEQ ID NO: 1089709 - RNA, 22 nt, Human
ucccagcauaacaaacugcccg

SEQ ID NO: 1089710 - RNA, 22 nt, Human
auuugaagucuucaugauuucu

SEQ ID NO: 1089711 - RNA, 22 nt, Human
agccaggauggucucgaucggc

SEQ ID NO: 1089712 - RNA, 22 nt, Human
uaaggccagcaugaaugcagca

SEQ ID NO: 1089713 - RNA, 22 nt, Human
acagaacugcaggaggaaaagc

SEQ ID NO: 1089714 - RNA, 22 nt, Human
gaugguuugguaaaaguauguu

SEQ ID NO: 1089715 - RNA, 22 nt, Human
acagcaacuccugcuucugagu

SEQ ID NO: 1089716 - RNA, 22 nt, Human
caguggaggccuugggaccuuu

SEQ ID NO: 1089717 - RNA, 22 nt, Human
auuucucacugagcagauaaaa

SEQ ID NO: 1089718 - RNA, 21 nt, Human
ucucugguuggaguugugcca

SEQ ID NO: 1089719 - RNA, 22 nt, Human
uggcuggggccugaauccugca

SEQ ID NO: 1089720 - RNA, 22 nt, Human
ucuggagagucacagugccaga

SEQ ID NO: 1089721 - RNA, 22 nt, Human
acacacuucacccuugagcuaa

SEQ ID NO: 1089722 - RNA, 22 nt, Human
uucauguuugccuauuugacuu

SEQ ID NO: 1089723 - RNA, 22 nt, Human
acagugauuuuaggauagaugg

SEQ ID NO: 1089724 - RNA, 22 nt, Human
aaggccugaacaugaggagaug

SEQ ID NO: 1089725 - RNA, 22 nt, Human
gcccucugcacagcucugagca

SEQ ID NO: 1089726 - RNA, 22 nt, Human
agccuccaaaugucaggucccg

SEQ ID NO: 1089727 - RNA, 22 nt, Human
ugggcucucuggcaggaaggcu

SEQ ID NO: 1089728 - RNA, 19 nt, Human
cuaaggcaagaaacuggac

SEQ ID NO: 1089729 - RNA, 22 nt, Human
cucuggaguggguggccgggag

SEQ ID NO: 1089730 - RNA, 22 nt, Human
augacuuuccuggcaaaaguug

SEQ ID NO: 1089731 - RNA, 22 nt, Human
auuccaggauuccaggacaaau

SEQ ID NO: 1089732 - RNA, 22 nt, Human
uaaagcaggugcucagugacca

SEQ ID NO: 1089733 - RNA, 22 nt, Human
aaugagguuggcauaauuaaau

SEQ ID NO: 1089734 - RNA, 22 nt, Human
uaaagcaguaugauggaaggau

SEQ ID NO: 1089735 - RNA, 22 nt, Human
gggaccuggacaugugugugcu

SEQ ID NO: 1089736 - RNA, 22 nt, Human
ucugccuggauuccauucucca

SEQ ID NO: 1089737 - RNA, 22 nt, Human
ugcagguggcuccagggacugc

SEQ ID NO: 1089738 - RNA, 22 nt, Human
caguguaagcucuagacuagaa

SEQ ID NO: 1089739 - RNA, 22 nt, Human
acauaauaggugccugaauauu

SEQ ID NO: 1089740 - RNA, 22 nt, Human
agccugugugaagcccucagag

SEQ ID NO: 1089741 - RNA, 22 nt, Human
gguggcagugcuugcgggucua

SEQ ID NO: 1089742 - RNA, 20 nt, Human
cuguggcaucugucauggug

SEQ ID NO: 1089743 - RNA, 21 nt, Human
uugggccuuuucugguagcuu

SEQ ID NO: 1089744 - RNA, 23 nt, Human
aguggggaaucaacagauucuuu

SEQ ID NO: 1089745 - RNA, 20 nt, Human
cccugagaccagagagcagc

SEQ ID NO: 1089746 - RNA, 22 nt, Human
aauaaaucaauccuauugguag

SEQ ID NO: 1089747 - RNA, 22 nt, Human
cagaaguaagauuacugugagu

SEQ ID NO: 1089748 - RNA, 22 nt, Human
gcuuucugauugcgaaaacaaa

SEQ ID NO: 1089749 - RNA, 22 nt, Human
gcauuucagaagcaugcccucu

SEQ ID NO: 1089750 - RNA, 17 nt, Human
gcagugaaaagagauca

SEQ ID NO: 1089751 - RNA, 22 nt, Human
cugaaauuccauuucagccaca

SEQ ID NO: 1089752 - RNA, 20 nt, Human
acaaaguauugaggacaagu

SEQ ID NO: 1089753 - RNA, 22 nt, Human
uacaaagugagcaaccucuuuu

SEQ ID NO: 1089754 - RNA, 22 nt, Human
ucacacacauuugcugucugau

SEQ ID NO: 1089755 - RNA, 22 nt, Human
ugggcugaguggcagccagagu

SEQ ID NO: 1089756 - RNA, 22 nt, Human
uaggcuggaacuuaggcagagg

SEQ ID NO: 1089757 - RNA, 23 nt, Human
ggagccuggcauaugagacgcau

SEQ ID NO: 1089758 - RNA, 22 nt, Human
uuuucuaacuuuacacucgaaa

SEQ ID NO: 1089759 - RNA, 22 nt, Human
gggcaguagcuucguaggcauc

SEQ ID NO: 1089760 - RNA, 22 nt, Human
ugcuccugaacacagcccuaug

SEQ ID NO: 1089761 - RNA, 22 nt, Human
acuguucugcauguaccugagg

SEQ ID NO: 1089762 - RNA, 22 nt, Human
aacuuuuacaaauugucaucau

SEQ ID NO: 1089763 - RNA, 22 nt, Human
aauacuuuugaacugaaaggca

SEQ ID NO: 1089764 - RNA, 23 nt, Human
gcaucuuaaaaccuacauaugug

SEQ ID NO: 1089765 - RNA, 22 nt, Human
uggcaguggugucugcacaggc

SEQ ID NO: 1089766 - RNA, 22 nt, Human
ucuuauaugcacauacauuggg

SEQ ID NO: 1089767 - RNA, 22 nt, Human
caggccugcaggaaaggcuccc

SEQ ID NO: 1089768 - RNA, 22 nt, Human
aaaugaacaucaagaauagccu

SEQ ID NO: 1089769 - RNA, 22 nt, Human
uggagccaggagccugggaguc

SEQ ID NO: 1089770 - RNA, 21 nt, Human
ucuuccuccacagcgugccac

SEQ ID NO: 1089771 - RNA, 23 nt, Human
gggaccugguaggaggugauugg

SEQ ID NO: 1089772 - RNA, 22 nt, Human
agaauucuuggugguuagaaua

SEQ ID NO: 1089773 - RNA, 22 nt, Human
gaggcagagucacaaagagucu

SEQ ID NO: 1089774 - RNA, 22 nt, Human
ugccuguguaugugcaugcaca

SEQ ID NO: 1089775 - RNA, 22 nt, Human
gaggaugugucuggucugggca

SEQ ID NO: 1089776 - RNA, 22 nt, Human
ggcaggugcccagagagcacga

SEQ ID NO: 1089777 - RNA, 22 nt, Human
ugagagcuguccaccuguggga

SEQ ID NO: 1089778 - RNA, 22 nt, Human
uagcagagcugggacuagauua

SEQ ID NO: 1089779 - RNA, 22 nt, Human
uuuuuggcagcucagaaacuuc

SEQ ID NO: 1089780 - RNA, 22 nt, Human
augaggcaaucaugguccaguu

SEQ ID NO: 1089781 - RNA, 22 nt, Human
ugucagugauuuguagggaauu

SEQ ID NO: 1089782 - RNA, 22 nt, Human
gucucagaguccuacuuauucc

SEQ ID NO: 1089783 - RNA, 19 nt, Human
ccagcagcuuugauucucu

SEQ ID NO: 1089784 - RNA, 22 nt, Human
ucccacaccugucuauuccuag

SEQ ID NO: 1089785 - RNA, 23 nt, Human
uaauuauggaauaauuugcaacg

SEQ ID NO: 1089786 - RNA, 22 nt, Human
cagcuuaccucccacagcucuc

SEQ ID NO: 1089787 - RNA, 22 nt, Human
gggccaguagcaccugugugga

SEQ ID NO: 1089788 - RNA, 22 nt, Human
gucaggauuauuuuauuaaaag

SEQ ID NO: 1089789 - RNA, 22 nt, Human
aaauaaaggaacuguuuuccca

SEQ ID NO: 1089790 - RNA, 22 nt, Human
ucccacugugccuguuguaauc

SEQ ID NO: 1089791 - RNA, 20 nt, Human
ucaguuaggaagaggcacuc

SEQ ID NO: 1089792 - RNA, 22 nt, Human
aacccgggaggcagagguugug

SEQ ID NO: 1089793 - RNA, 22 nt, Human
ccucucuguaagggucccuccc

SEQ ID NO: 1089794 - RNA, 22 nt, Human
ccagcuccaaguuugggcauca

SEQ ID NO: 1089795 - RNA, 22 nt, Human
uccucacagaguggcaggcaau

SEQ ID NO: 1089796 - RNA, 22 nt, Human
uuuuuccaggguuagauguuua

SEQ ID NO: 1089797 - RNA, 22 nt, Human
cugggcacacagugacucugca

SEQ ID NO: 1089798 - RNA, 22 nt, Human
auuacacauagacauucguuca

SEQ ID NO: 1089799 - RNA, 22 nt, Human
gcucccagauuucagccuugug

SEQ ID NO: 1089800 - RNA, 22 nt, Human
gaguuauuaauggcugaguuug

SEQ ID NO: 1089801 - RNA, 22 nt, Human
ggcuccugauaggagaaugcgg

SEQ ID NO: 1089802 - RNA, 22 nt, Human
cucacugucuguacuagcugau

SEQ ID NO: 1089803 - RNA, 22 nt, Human
acaguauagggcuuauauugua

SEQ ID NO: 1089804 - RNA, 22 nt, Human
ugaagcagagaauuugacaguc

SEQ ID NO: 1089805 - RNA, 22 nt, Human
gaagagaagcaucaauagguaa

SEQ ID NO: 1089806 - RNA, 22 nt, Human
cagcaaaagccagcauaagcuc

SEQ ID NO: 1089807 - RNA, 22 nt, Human
ggcauguguugggaacagcaug

SEQ ID NO: 1089808 - RNA, 22 nt, Human
augcugugccuucucugugcca

SEQ ID NO: 1089809 - RNA, 22 nt, Human
acaggcuuacaggcugcaagua

SEQ ID NO: 1089810 - RNA, 22 nt, Human
gaaggccuaggaaggaagccuu

SEQ ID NO: 1089811 - RNA, 22 nt, Human
cagauaaaauuaauauuaccaa

SEQ ID NO: 1089812 - RNA, 22 nt, Human
cacagaguggaggcuuggccug

SEQ ID NO: 1089813 - RNA, 22 nt, Human
acugccuuauaugcugugugug

SEQ ID NO: 1089814 - RNA, 22 nt, Human
uauuuuaaagugaagggucuug

SEQ ID NO: 1089815 - RNA, 22 nt, Human
ucagggacugcagagggaagcu

SEQ ID NO: 1089816 - RNA, 22 nt, Human
uuuaucuuuaggacuuugcaga

SEQ ID NO: 1089817 - RNA, 22 nt, Human
gaggcagcaggcugaggaggau

SEQ ID NO: 1089818 - RNA, 22 nt, Human
gcaaauguucuauauuugcugu

SEQ ID NO: 1089819 - RNA, 22 nt, Human
uugaaacucccuuuugucuagu

SEQ ID NO: 1089820 - RNA, 22 nt, Human
ugagcugggcugggcugagcug

SEQ ID NO: 1089821 - RNA, 22 nt, Human
ugucugugaccucuuaggcaag

SEQ ID NO: 1089822 - RNA, 22 nt, Human
agacaaguucugugggucaccu

SEQ ID NO: 1089823 - RNA, 21 nt, Human
ucacauuucucauggguaaau

SEQ ID NO: 1089824 - RNA, 22 nt, Human
gguggccucugcaggccucgac

SEQ ID NO: 1089825 - RNA, 22 nt, Human
ggcacugagcugccuuggggca

SEQ ID NO: 1089826 - RNA, 22 nt, Human
aaggccaggacaccaggggacu

SEQ ID NO: 1089827 - RNA, 22 nt, Human
uaugaagugaguuaugguugcu

SEQ ID NO: 1089828 - RNA, 22 nt, Human
ccugagagcagcuuccugcuua

SEQ ID NO: 1089829 - RNA, 22 nt, Human
aguguucauuuauucauucacu

SEQ ID NO: 1089830 - RNA, 22 nt, Human
agcagagcggggccuccggaag

SEQ ID NO: 1089831 - RNA, 22 nt, Human
aucugguuuggggauccuugug

SEQ ID NO: 1089832 - RNA, 22 nt, Human
gagcaguggucacagggaggga

SEQ ID NO: 1089833 - RNA, 22 nt, Human
ugccuguguugauuacuuuguc

SEQ ID NO: 1089834 - RNA, 22 nt, Human
uugugguuaaccgcacauuuuu

SEQ ID NO: 1089835 - RNA, 22 nt, Human
gcacacagcuagauuaccauuc

SEQ ID NO: 1089836 - RNA, 22 nt, Human
cucaaguaauuagcaacaaaua

SEQ ID NO: 1089837 - RNA, 22 nt, Human
gaaaggugccccauaggcagga

SEQ ID NO: 1089838 - RNA, 22 nt, Human
ugcuucugcaggagcuccugau

SEQ ID NO: 1089839 - RNA, 22 nt, Human
caggcagaugcugacaagaguu

SEQ ID NO: 1089840 - RNA, 22 nt, Human
ggcaggagaauggcgugaacuc

SEQ ID NO: 1089841 - RNA, 22 nt, Human
uuaugcuaguugaaauaacaca

SEQ ID NO: 1089842 - RNA, 22 nt, Human
ucuggggaccauggcaucuaaa

SEQ ID NO: 1089843 - RNA, 22 nt, Human
cuuuuuuccuaaggcaacauga

SEQ ID NO: 1089844 - RNA, 22 nt, Human
uugugcaugacugugaauagcu

SEQ ID NO: 1089845 - RNA, 22 nt, Human
cacagcuaccugcaugccugcu

SEQ ID NO: 1089846 - RNA, 22 nt, Human
gcugccuguggcccuucugggu

SEQ ID NO: 1089847 - RNA, 15 nt, Human
cacacagacagcuug

SEQ ID NO: 1089848 - RNA, 22 nt, Human
uagaggcugggaauuauuuuca

SEQ ID NO: 1089849 - RNA, 22 nt, Human
gagcugccaguguaugaauucu

SEQ ID NO: 1089850 - RNA, 22 nt, Human
ucccagagccucugccacucug

SEQ ID NO: 1089851 - RNA, 22 nt, Human
cuuacauugucucuugcugagc

SEQ ID NO: 1089852 - RNA, 22 nt, Human
ugaggggagcccgcccuggacg

SEQ ID NO: 1089853 - RNA, 22 nt, Human
ucagugucuugggcuugaaugc

SEQ ID NO: 1089854 - RNA, 22 nt, Human
uuucaucucucuaaaagacagu

SEQ ID NO: 1089855 - RNA, 22 nt, Human
ccuccacaggagcugcagugcu

SEQ ID NO: 1089856 - RNA, 22 nt, Human
agcugugauuauccacuggaau

SEQ ID NO: 1089857 - RNA, 22 nt, Human
gaaaucuacuuuggguuagaca

SEQ ID NO: 1089858 - RNA, 22 nt, Human
caguuuuacccaagcuuauuuu

SEQ ID NO: 1089859 - RNA, 22 nt, Human
uggcagagugcagaagaggcau

SEQ ID NO: 1089860 - RNA, 22 nt, Human
guccuucauggaguuacagccu

SEQ ID NO: 1089861 - RNA, 22 nt, Human
ugaagaauguugcagugagcau

SEQ ID NO: 1089862 - RNA, 22 nt, Human
ugggcucagucugcaccugcgg

SEQ ID NO: 1089863 - RNA, 22 nt, Human
aaaaggaucagauuuugagcag

SEQ ID NO: 1089864 - RNA, 22 nt, Human
ccagagucaggagcucauguga

SEQ ID NO: 1089865 - RNA, 22 nt, Human
ggaggugggcuaaggacucucu

SEQ ID NO: 1089866 - RNA, 22 nt, Human
agcucagguagacucagcaucu

SEQ ID NO: 1089867 - RNA, 22 nt, Human
uuacaguacagaaaauaacaga

SEQ ID NO: 1089868 - RNA, 17 nt, Human
gcuguaguuugauaaga

SEQ ID NO: 1089869 - RNA, 22 nt, Human
cuagagaaaggcaguggagcaa

SEQ ID NO: 1089870 - RNA, 22 nt, Human
ugauuuguuuagugccaaguuu

SEQ ID NO: 1089871 - RNA, 22 nt, Human
aagcccagaugagaucccugga

SEQ ID NO: 1089872 - RNA, 20 nt, Human
cugcccagccacugagggau

SEQ ID NO: 1089873 - RNA, 20 nt, Human
ccaggccugggccugcucua

SEQ ID NO: 1089874 - RNA, 22 nt, Human
cucugggcacauuuuccaggac

SEQ ID NO: 1089875 - RNA, 22 nt, Human
ugagaagcagcuuacagguguc

SEQ ID NO: 1089876 - RNA, 22 nt, Human
uuucacagauguuuuggagucu

SEQ ID NO: 1089877 - RNA, 22 nt, Human
ucugucugacaggguaugaacu

SEQ ID NO: 1089878 - RNA, 22 nt, Human
augaaaacggaccagagcuauu

SEQ ID NO: 1089879 - RNA, 22 nt, Human
aacacucuacgugcagcuccua

SEQ ID NO: 1089880 - RNA, 21 nt, Human
ucauaaacuaguaucaaaguu

SEQ ID NO: 1089881 - RNA, 22 nt, Human
cccaggaagcccagaauucugg

SEQ ID NO: 1089882 - RNA, 22 nt, Human
uaacaguauagccuaacauuuc

SEQ ID NO: 1089883 - RNA, 22 nt, Human
ugaguaggugguuaagcaugga

SEQ ID NO: 1089884 - RNA, 22 nt, Human
guccucugggcagcugccccac

SEQ ID NO: 1089885 - RNA, 22 nt, Human
uucuggaguauuccuggcagcc

SEQ ID NO: 1089886 - RNA, 22 nt, Human
ugaagugaccuggggcagugua

SEQ ID NO: 1089887 - RNA, 22 nt, Human
aagacuuucucccaaauccuca

SEQ ID NO: 1089888 - RNA, 22 nt, Human
uuguucaugguuguaaguuuga

SEQ ID NO: 1089889 - RNA, 21 nt, Human
uacacaaagcgugguccagag

SEQ ID NO: 1089890 - RNA, 22 nt, Human
aucuuugugaaucucaacuugg

SEQ ID NO: 1089891 - RNA, 22 nt, Human
gaggcaggcagauugcuugagg

SEQ ID NO: 1089892 - RNA, 22 nt, Human
aguggcuggaauugcaggugcg

SEQ ID NO: 1089893 - RNA, 22 nt, Human
caaaagcaaagucccugaaugu

SEQ ID NO: 1089894 - RNA, 22 nt, Human
ccugggaggcggagguugcagg

SEQ ID NO: 1089895 - RNA, 22 nt, Human
ucagugccaguuugcuccuucu

SEQ ID NO: 1089896 - RNA, 22 nt, Human
gcuggagcugcagccugggccu

SEQ ID NO: 1089897 - RNA, 22 nt, Human
agacauuuccuagacaucaaug

SEQ ID NO: 1089898 - RNA, 22 nt, Human
gggcccuggcuuuccuguucuu

SEQ ID NO: 1089899 - RNA, 22 nt, Human
uuccagaaaucuuucagcucaa

SEQ ID NO: 1089900 - RNA, 22 nt, Human
uucaacacaggaacaugauaua

SEQ ID NO: 1089901 - RNA, 22 nt, Human
auucuucaucagagaugcacua

SEQ ID NO: 1089902 - RNA, 22 nt, Human
ccugccaggcuuugggcuucug

SEQ ID NO: 1089903 - RNA, 23 nt, Human
caaauucuaggcaggcucuuuug

SEQ ID NO: 1089904 - RNA, 22 nt, Human
gaguucaauuuccagcuguucu

SEQ ID NO: 1089905 - RNA, 22 nt, Human
gacacuucaccuuucccagccu

SEQ ID NO: 1089906 - RNA, 22 nt, Human
gccaggcagccacccucugcga

SEQ ID NO: 1089907 - RNA, 22 nt, Human
acaguagauggcucagagacag

SEQ ID NO: 1089908 - RNA, 22 nt, Human
gcugccugaaauguugccuagc

SEQ ID NO: 1089909 - RNA, 22 nt, Human
aagggaaauggccaggcagaga

SEQ ID NO: 1089910 - RNA, 22 nt, Human
ucacagaaguguguuucaggag

SEQ ID NO: 1089911 - RNA, 22 nt, Human
ucagagaggcaauacuguuuaa

SEQ ID NO: 1089912 - RNA, 22 nt, Human
uuuuuccuuagggguuacucac

SEQ ID NO: 1089913 - RNA, 22 nt, Human
ucagacagaaggacuauuugaa

SEQ ID NO: 1089914 - RNA, 22 nt, Human
uuccucagccagcacuuagggg

SEQ ID NO: 1089915 - RNA, 22 nt, Human
uguccucuaauuggccucuugc

SEQ ID NO: 1089916 - RNA, 22 nt, Human
agggagguaggagcuucuagcu

SEQ ID NO: 1089917 - RNA, 21 nt, Human
ggccugaguauaggacaggcc

SEQ ID NO: 1089918 - RNA, 22 nt, Human
uugaaaggugcugugugcugau

SEQ ID NO: 1089919 - RNA, 22 nt, Human
cauuuaaagguuguggguaaaa

SEQ ID NO: 1089920 - RNA, 22 nt, Human
cccagucauccugcaggugaaa

SEQ ID NO: 1089921 - RNA, 22 nt, Human
ccacagaagauggggagagugg

SEQ ID NO: 1089922 - RNA, 22 nt, Human
ugccugugguuccaguuuuuuc

SEQ ID NO: 1089923 - RNA, 21 nt, Human
auucuaaccaggagaggcuga

SEQ ID NO: 1089924 - RNA, 22 nt, Human
cccccaaggccaggcugagacc

SEQ ID NO: 1089925 - RNA, 22 nt, Human
accaucuuaaggggacuucuua

SEQ ID NO: 1089926 - RNA, 22 nt, Human
aagcaggaagcucagguccuug

SEQ ID NO: 1089927 - RNA, 22 nt, Human
aaauuuaaggaggugcucacuu

SEQ ID NO: 1089928 - RNA, 22 nt, Human
agugaccaacaaugcugagaag

SEQ ID NO: 1089929 - RNA, 22 nt, Human
aaauuacagaucaccaaugcau

SEQ ID NO: 1089930 - RNA, 22 nt, Human
ccucucaucauuaucgcuuugu

SEQ ID NO: 1089931 - RNA, 22 nt, Human
cuggaggagaacuugaggaagg

SEQ ID NO: 1089932 - RNA, 22 nt, Human
aggccugucuggggcucagcca

SEQ ID NO: 1089933 - RNA, 22 nt, Human
ucuuuucaucauuuaauaggua

SEQ ID NO: 1089934 - RNA, 22 nt, Human
caguagaauuauuauaaaacau

SEQ ID NO: 1089935 - RNA, 22 nt, Human
caggggcucugggugaugugag

SEQ ID NO: 1089936 - RNA, 22 nt, Human
uuccaaagaaauugaccaagac

SEQ ID NO: 1089937 - RNA, 22 nt, Human
uuuauuagugcuuguaucacug

SEQ ID NO: 1089938 - RNA, 22 nt, Human
aaauacuggcaagugcuaauuc

SEQ ID NO: 1089939 - RNA, 22 nt, Human
gcaggcuggucugaccaucccu

SEQ ID NO: 1089940 - RNA, 22 nt, Human
aacauguaaccagcauucaucu

SEQ ID NO: 1089941 - RNA, 21 nt, Human
agauuauaaagaaccuucuua

SEQ ID NO: 1089942 - RNA, 22 nt, Human
ucuggagugaaugaaguagugu

SEQ ID NO: 1089943 - RNA, 22 nt, Human
ugcugcuguauccuuaguguca

SEQ ID NO: 1089944 - RNA, 22 nt, Human
ucuuugaacucuguguauuaac

SEQ ID NO: 1089945 - RNA, 22 nt, Human
ugcugaggucaccuugcugcua

SEQ ID NO: 1089946 - RNA, 22 nt, Human
uagcagcugugaguaaaagcca

SEQ ID NO: 1089947 - RNA, 20 nt, Human
cugcuguguuauuguagaac

SEQ ID NO: 1089948 - RNA, 22 nt, Human
ugcacacacaugcagagggaga

SEQ ID NO: 1089949 - RNA, 22 nt, Human
aucuagaaguggcaugaauuac

SEQ ID NO: 1089950 - RNA, 17 nt, Human
aggcugcugggccaggg

SEQ ID NO: 1089951 - RNA, 22 nt, Human
aguacauauaguaauuuagcca

SEQ ID NO: 1089952 - RNA, 22 nt, Human
gcugccuuuugcuccucccacc

SEQ ID NO: 1089953 - RNA, 18 nt, Human
aauuucuuugacaacuua

SEQ ID NO: 1089954 - RNA, 22 nt, Human
acauguuagaaaugcagaaucu

SEQ ID NO: 1089955 - RNA, 22 nt, Human
uagagucagagaaucauuacag

SEQ ID NO: 1089956 - RNA, 19 nt, Human
ucaaggcucccugagggau

SEQ ID NO: 1089957 - RNA, 22 nt, Human
aagagcaacuuggaaacacuca

SEQ ID NO: 1089958 - RNA, 22 nt, Human
auugacaaucuacuauguucug

SEQ ID NO: 1089959 - RNA, 22 nt, Human
uccagccuaggggaacagcugc

SEQ ID NO: 1089960 - RNA, 22 nt, Human
ccacaucauggauacaguuaug

SEQ ID NO: 1089961 - RNA, 22 nt, Human
uauguacauaacaugaaaugca

SEQ ID NO: 1089962 - RNA, 22 nt, Human
ugugggcuguacugagggcagg

SEQ ID NO: 1089963 - RNA, 22 nt, Human
ucugugacugauggaggcuuuu

SEQ ID NO: 1089964 - RNA, 21 nt, Human
ucaccuggcuucugaccuggc

SEQ ID NO: 1089965 - RNA, 21 nt, Human
uguauacacacauauauguac

SEQ ID NO: 1089966 - RNA, 22 nt, Human
gggagggaggugaugcuuggcu

SEQ ID NO: 1089967 - RNA, 22 nt, Human
gugauuuugagaccuauauagu

SEQ ID NO: 1089968 - RNA, 21 nt, Human
gagacagacuuucguccccug

SEQ ID NO: 1089969 - RNA, 22 nt, Human
ugaggcuccagccaggccagca

SEQ ID NO: 1089970 - RNA, 22 nt, Human
aauuucaauuacuuuugcacca

SEQ ID NO: 1089971 - RNA, 22 nt, Human
gagcaggauggcacuucuguga

SEQ ID NO: 1089972 - RNA, 19 nt, Human
caaaguaccuggcacagug

SEQ ID NO: 1089973 - RNA, 19 nt, Human
uucaacaugcugaggcagc

SEQ ID NO: 1089974 - RNA, 22 nt, Human
ggcugaaguguaguggcucacu

SEQ ID NO: 1089975 - RNA, 22 nt, Human
ggagacacauauacagaaagag

SEQ ID NO: 1089976 - RNA, 22 nt, Human
caguuucagaaucaaaacauca

SEQ ID NO: 1089977 - RNA, 22 nt, Human
ugcuuucaugaagucuauagag

SEQ ID NO: 1089978 - RNA, 22 nt, Human
gcugccugcccugggucaucug

SEQ ID NO: 1089979 - RNA, 22 nt, Human
ucugcccacagccuccugucca

SEQ ID NO: 1089980 - RNA, 22 nt, Human
acucuucacacuugucuccagg

SEQ ID NO: 1089981 - RNA, 20 nt, Human
augauuuugcacuaacuuca

SEQ ID NO: 1089982 - RNA, 22 nt, Human
uauucaugggaggucacaacuu

SEQ ID NO: 1089983 - RNA, 22 nt, Human
gaggcacauauauacagagccc

SEQ ID NO: 1089984 - RNA, 22 nt, Human
ugggcacaggggaauggaugaa

SEQ ID NO: 1089985 - RNA, 22 nt, Human
aacucuauuuacccuacuaaac

SEQ ID NO: 1089986 - RNA, 22 nt, Human
gggcugccaagccugccugccu

SEQ ID NO: 1089987 - RNA, 22 nt, Human
aaugugaacuuugucauguaac

SEQ ID NO: 1089988 - RNA, 22 nt, Human
aagugaugcuacgacuuugaca

SEQ ID NO: 1089989 - RNA, 22 nt, Human
caacaguguugcaaucugaaaa

SEQ ID NO: 1089990 - RNA, 22 nt, Human
uuuuuguagucauuagaagagg

SEQ ID NO: 1089991 - RNA, 22 nt, Human
uccauugucuuugguccuagcc

SEQ ID NO: 1089992 - RNA, 22 nt, Human
ggaaggggccuugagcaaacug

SEQ ID NO: 1089993 - RNA, 22 nt, Human
gcucaggacuggaggagcgggg

SEQ ID NO: 1089994 - RNA, 22 nt, Human
cagaagcagugagagaugugca

SEQ ID NO: 1089995 - RNA, 20 nt, Human
ccuaggcaugcugagucucc

SEQ ID NO: 1089996 - RNA, 22 nt, Human
ucugaaaugaacucuugaacuu

SEQ ID NO: 1089997 - RNA, 22 nt, Human
cagccuucugaaugaacguacu

SEQ ID NO: 1089998 - RNA, 22 nt, Human
uuaccaaaucccgugcacauuc

SEQ ID NO: 1089999 - RNA, 22 nt, Human
uugaacaguccuaagagacccu

SEQ ID NO: 1090000 - RNA, 22 nt, Human
aaacuuaguagaguucauauua

SEQ ID NO: 1090001 - RNA, 21 nt, Human
auucaacuagaugauuauuuc

SEQ ID NO: 1090002 - RNA, 21 nt, Human
ugccagcauuaaacagucauu

SEQ ID NO: 1090003 - RNA, 22 nt, Human
ucaggguugcugugaucagucc

SEQ ID NO: 1090004 - RNA, 22 nt, Human
uugaagcauuucuuugagcuuc

SEQ ID NO: 1090005 - RNA, 22 nt, Human
agaggggcucaagcaguggucu

SEQ ID NO: 1090006 - RNA, 22 nt, Human
cagugagguagacagcuuuuuc

SEQ ID NO: 1090007 - RNA, 22 nt, Human
cagcucugcugggaggaugcag

SEQ ID NO: 1090008 - RNA, 22 nt, Human
uuuuccuacugauaaacaguua

SEQ ID NO: 1090009 - RNA, 21 nt, Human
uagaauacagguauuuuggau

SEQ ID NO: 1090010 - RNA, 21 nt, Human
caguugauagagaucuugagc

SEQ ID NO: 1090011 - RNA, 22 nt, Human
ucaguuuucaauuucaucagag

SEQ ID NO: 1090012 - RNA, 22 nt, Human
ugcaagguccaguauaacuuaa

SEQ ID NO: 1090013 - RNA, 22 nt, Human
acauucuguuuccccaaagaga

SEQ ID NO: 1090014 - RNA, 22 nt, Human
cagcugugauuccugcugucca

SEQ ID NO: 1090015 - RNA, 22 nt, Human
aacuuuacuugaaagaacaugu

SEQ ID NO: 1090016 - RNA, 19 nt, Human
uggcaggcccaggauggac

SEQ ID NO: 1090017 - RNA, 22 nt, Human
uucuuugcccauguuuccuaag

SEQ ID NO: 1090018 - RNA, 22 nt, Human
uugaaggacauccuauuucuag

SEQ ID NO: 1090019 - RNA, 20 nt, Human
ucagaugggagugagccauc

SEQ ID NO: 1090020 - RNA, 22 nt, Human
ucuagaaucuaaacuauaguuu

SEQ ID NO: 1090021 - RNA, 23 nt, Human
cccaggaagccaaagaaauauag

SEQ ID NO: 1090022 - RNA, 22 nt, Human
uuccucuccucccaccagguga

SEQ ID NO: 1090023 - RNA, 22 nt, Human
gccucauuacagccaggaagca

SEQ ID NO: 1090024 - RNA, 22 nt, Human
gccgaagcugccgucugguccu

SEQ ID NO: 1090025 - RNA, 22 nt, Human
gcuuggcauugaccauuaucau

SEQ ID NO: 1090026 - RNA, 22 nt, Human
gcucugugccacaugcaguguu

SEQ ID NO: 1090027 - RNA, 22 nt, Human
ggucccugguucccucugagcu

SEQ ID NO: 1090028 - RNA, 22 nt, Human
cuaggaaucaccaagauucuag

SEQ ID NO: 1090029 - RNA, 22 nt, Human
aaagggaggggcgauaagccgg

SEQ ID NO: 1090030 - RNA, 22 nt, Human
ccagcugagaaguguaaaguga

SEQ ID NO: 1090031 - RNA, 22 nt, Human
ugcuccugccguggucgggacu

SEQ ID NO: 1090032 - RNA, 22 nt, Human
ucucuuucuauugcaccaugcu

SEQ ID NO: 1090033 - RNA, 22 nt, Human
ucauuugguccucccaacaagc

SEQ ID NO: 1090034 - RNA, 22 nt, Human
uugaaagaggcaaaguuugauc

SEQ ID NO: 1090035 - RNA, 22 nt, Human
ucuuuaaugugauuguaauuau

SEQ ID NO: 1090036 - RNA, 22 nt, Human
aggcaggaacccugugugcgcc

SEQ ID NO: 1090037 - RNA, 22 nt, Human
ucagaggguggcugggagcauc

SEQ ID NO: 1090038 - RNA, 22 nt, Human
aucaggaagaagaauguguugg

SEQ ID NO: 1090039 - RNA, 22 nt, Human
ggagccagagggaugcaguuga

SEQ ID NO: 1090040 - RNA, 22 nt, Human
uggcugaguaaguugugauaug

SEQ ID NO: 1090041 - RNA, 22 nt, Human
ucagccucucugaguccagacc

SEQ ID NO: 1090042 - RNA, 22 nt, Human
guuaaagaagaauaguuccuuu

SEQ ID NO: 1090043 - RNA, 21 nt, Human
gcaggaacaggucaugaucug

SEQ ID NO: 1090044 - RNA, 22 nt, Human
uggccuccccuaacagccucuu

SEQ ID NO: 1090045 - RNA, 22 nt, Human
auggccugggcccgcuucagau

SEQ ID NO: 1090046 - RNA, 22 nt, Human
uugcugagucucuagguaugau

SEQ ID NO: 1090047 - RNA, 18 nt, Human
cuucaguggcugcucugc

SEQ ID NO: 1090048 - RNA, 22 nt, Human
caggaaagguagucacaaugua

SEQ ID NO: 1090049 - RNA, 22 nt, Human
ggagugaguacuggaguagcug

SEQ ID NO: 1090050 - RNA, 17 nt, Human
ugggggcccuguguaga

SEQ ID NO: 1090051 - RNA, 22 nt, Human
uuauauguuucuguuuggaggc

SEQ ID NO: 1090052 - RNA, 22 nt, Human
aauauuugaacagucacugagu

SEQ ID NO: 1090053 - RNA, 22 nt, Human
cugagggcccugaagcuuggca

SEQ ID NO: 1090054 - RNA, 22 nt, Human
aaggcaguagguguuucaaacu

SEQ ID NO: 1090055 - RNA, 22 nt, Human
gccugucugcgucacgcuuauu

SEQ ID NO: 1090056 - RNA, 22 nt, Human
ucaggcacugcuuucugauaug

SEQ ID NO: 1090057 - RNA, 22 nt, Human
gggagccagcagggcauggagc

SEQ ID NO: 1090058 - RNA, 18 nt, Human
cugucaccgccaccacac

SEQ ID NO: 1090059 - RNA, 22 nt, Human
gcacauacccacugucaagcac

SEQ ID NO: 1090060 - RNA, 22 nt, Human
gcugagucuugagcacugagca

SEQ ID NO: 1090061 - RNA, 22 nt, Human
ugucaugcagguuuguuauaga

SEQ ID NO: 1090062 - RNA, 22 nt, Human
gaagcagcagcuggggacaguu

SEQ ID NO: 1090063 - RNA, 18 nt, Human
gcuggcugcacuucugcu

SEQ ID NO: 1090064 - RNA, 22 nt, Human
gggagaaguggaaaucucauua

SEQ ID NO: 1090065 - RNA, 22 nt, Human
ugcagaguaaaagcagaugcua

SEQ ID NO: 1090066 - RNA, 22 nt, Human
cacaggcuccggccuugcagcc

SEQ ID NO: 1090067 - RNA, 22 nt, Human
aagacaaugaguccugauggga

SEQ ID NO: 1090068 - RNA, 18 nt, Human
gguggccuugacuucucu

SEQ ID NO: 1090069 - RNA, 22 nt, Human
gguaacaaacuucugacuuaag

SEQ ID NO: 1090070 - RNA, 22 nt, Human
cacaugaauaaggcuuuauugu

SEQ ID NO: 1090071 - RNA, 22 nt, Human
ggcugcugcccaccccugcaug

SEQ ID NO: 1090072 - RNA, 22 nt, Human
cauuugcuuccugggucuugaa

SEQ ID NO: 1090073 - RNA, 22 nt, Human
uguggcucucagauccuccaau

SEQ ID NO: 1090074 - RNA, 22 nt, Human
gucagcuaggcagcugugaugg

SEQ ID NO: 1090075 - RNA, 22 nt, Human
uuugacauuggcuuauucuguu

SEQ ID NO: 1090076 - RNA, 22 nt, Human
gucccacaccuugaggggucuu

SEQ ID NO: 1090077 - RNA, 22 nt, Human
uucaugaacgaacauauguaua

SEQ ID NO: 1090078 - RNA, 22 nt, Human
uggccagguugggcuuugcagc

SEQ ID NO: 1090079 - RNA, 22 nt, Human
ucccagagcucugacaccagcu

SEQ ID NO: 1090080 - RNA, 22 nt, Human
cugcagcuccucucugugcccc

SEQ ID NO: 1090081 - RNA, 22 nt, Human
gcugagacuggcagcaggaagu

SEQ ID NO: 1090082 - RNA, 23 nt, Human
ggccucuguguucugcccacaug

SEQ ID NO: 1090083 - RNA, 22 nt, Human
ccucagaugucuuaaggcacug

SEQ ID NO: 1090084 - RNA, 22 nt, Human
uugaaaaccgugggaggcugaa

SEQ ID NO: 1090085 - RNA, 22 nt, Human
aggcugagugcuccccuagaug

SEQ ID NO: 1090086 - RNA, 22 nt, Human
aggccugaaguguggagugggg

SEQ ID NO: 1090087 - RNA, 21 nt, Human
guccucagcugaugggagcug

SEQ ID NO: 1090088 - RNA, 22 nt, Human
acacagaggcuccagagauaga

SEQ ID NO: 1090089 - RNA, 22 nt, Human
gaggcucaguuauuuuagccug

SEQ ID NO: 1090090 - RNA, 22 nt, Human
ugcugccuuugggaccuggccu

SEQ ID NO: 1090091 - RNA, 19 nt, Human
ggagccuggagcacgugcc

SEQ ID NO: 1090092 - RNA, 22 nt, Human
aauguuacaguuuuaauucuga

SEQ ID NO: 1090093 - RNA, 22 nt, Human
ggacuggacucucaggcucaca

SEQ ID NO: 1090094 - RNA, 20 nt, Human
uucuggaggcuacaagucug

SEQ ID NO: 1090095 - RNA, 22 nt, Human
cauuaagauuuuuuucuacugg

SEQ ID NO: 1090096 - RNA, 22 nt, Human
guuucacagguuggagccagca

SEQ ID NO: 1090097 - RNA, 20 nt, Human
caggaaccaaagaggacucc

SEQ ID NO: 1090098 - RNA, 22 nt, Human
ugcauguuccaacuccaucacu

SEQ ID NO: 1090099 - RNA, 22 nt, Human
uuucuaaguaagauuaacuucu

SEQ ID NO: 1090100 - RNA, 22 nt, Human
uauagguacuuggaaaauaagg

SEQ ID NO: 1090101 - RNA, 22 nt, Human
aaacuucauggauaauauaaag

SEQ ID NO: 1090102 - RNA, 22 nt, Human
cugcccuguggcucugagucau

SEQ ID NO: 1090103 - RNA, 22 nt, Human
uucaaagugugaccugacaagc

SEQ ID NO: 1090104 - RNA, 22 nt, Human
cccaggaaaugaacuucugauu

SEQ ID NO: 1090105 - RNA, 22 nt, Human
augaagcuaaacccugcagcca

SEQ ID NO: 1090106 - RNA, 22 nt, Human
uaguccauuuucacacugcuga

SEQ ID NO: 1090107 - RNA, 22 nt, Human
aagaacagguucuagaaccauu

SEQ ID NO: 1090108 - RNA, 22 nt, Human
ugugugcauucacaugcaugcc

SEQ ID NO: 1090109 - RNA, 22 nt, Human
ucaggagcagcaugggugagag

SEQ ID NO: 1090110 - RNA, 22 nt, Human
aguggcuguuuauaggugggua

SEQ ID NO: 1090111 - RNA, 22 nt, Human
agccucuguagaaagcagugug

SEQ ID NO: 1090112 - RNA, 22 nt, Human
uacauacaagcauucaauuuua

SEQ ID NO: 1090113 - RNA, 22 nt, Human
ucauuuaauugguuuugcucgu

SEQ ID NO: 1090114 - RNA, 22 nt, Human
cuggcagcuuccuuugcaucug

SEQ ID NO: 1090115 - RNA, 22 nt, Human
cacagcuuaugccacugauugg

SEQ ID NO: 1090116 - RNA, 23 nt, Human
uggcugagcccacuaucuuggcc

SEQ ID NO: 1090117 - RNA, 22 nt, Human
agugacaaggugguaaugaagc

SEQ ID NO: 1090118 - RNA, 22 nt, Human
cugggccuuugggaguucggug

SEQ ID NO: 1090119 - RNA, 22 nt, Human
caaggccacguucugcaugcgg

SEQ ID NO: 1090120 - RNA, 21 nt, Human
augcacaaaaagacucuuucu

SEQ ID NO: 1090121 - RNA, 22 nt, Human
ggaggccacgguuuagcaccga

SEQ ID NO: 1090122 - RNA, 22 nt, Human
ugcaggcugggaagagggacaa

SEQ ID NO: 1090123 - RNA, 22 nt, Human
ugucauuuaaagcuuuccagau

SEQ ID NO: 1090124 - RNA, 22 nt, Human
ccugccuggagcugagugugga

SEQ ID NO: 1090125 - RNA, 17 nt, Human
ggccugcaagaacgaga

SEQ ID NO: 1090126 - RNA, 22 nt, Human
acagacauauuuggcccauagc

SEQ ID NO: 1090127 - RNA, 22 nt, Human
ucauugucuugauaugauuguc

SEQ ID NO: 1090128 - RNA, 22 nt, Human
uuuuagaaggaaugcuauggug

SEQ ID NO: 1090129 - RNA, 22 nt, Human
agagcccucuucacugccccuu

SEQ ID NO: 1090130 - RNA, 23 nt, Human
acuuccaguuauaggaacucuuc

SEQ ID NO: 1090131 - RNA, 22 nt, Human
ggugguggagccagcugggagu

SEQ ID NO: 1090132 - RNA, 22 nt, Human
agcccugccauucucuggagcu

SEQ ID NO: 1090133 - RNA, 22 nt, Human
gaaaucugaacaacagcuguca

SEQ ID NO: 1090134 - RNA, 22 nt, Human
cccagacuccucuggcuggugg

SEQ ID NO: 1090135 - RNA, 22 nt, Human
uggagaagcuguagguggacuc

SEQ ID NO: 1090136 - RNA, 22 nt, Human
uaugagaagguauggugacuug

SEQ ID NO: 1090137 - RNA, 22 nt, Human
uacagcuugauguuuguguguu

SEQ ID NO: 1090138 - RNA, 17 nt, Human
uucagcuacucaacaca

SEQ ID NO: 1090139 - RNA, 22 nt, Human
uuuucuuaugugcagcuauaug

SEQ ID NO: 1090140 - RNA, 22 nt, Human
gggaaauugucaacacucucaa

SEQ ID NO: 1090141 - RNA, 22 nt, Human
gaaggaagacugguuuaaaugu

SEQ ID NO: 1090142 - RNA, 22 nt, Human
gcagagccaggcuggggcaggu

SEQ ID NO: 1090143 - RNA, 22 nt, Human
agucccagugacuuggccagaa

SEQ ID NO: 1090144 - RNA, 22 nt, Human
aagagaaggauucugagccugg

SEQ ID NO: 1090145 - RNA, 22 nt, Human
acaggcucucagccaguuggca

SEQ ID NO: 1090146 - RNA, 22 nt, Human
uaagauuuuuaaaauguccuca

SEQ ID NO: 1090147 - RNA, 22 nt, Human
ugggugcaggaugagugcuggc

SEQ ID NO: 1090148 - RNA, 17 nt, Human
uggcuucccugggccac

SEQ ID NO: 1090149 - RNA, 22 nt, Human
agcaggagagcagugcgugguc

SEQ ID NO: 1090150 - RNA, 22 nt, Human
agugacugacaccuguaauccc

SEQ ID NO: 1090151 - RNA, 22 nt, Human
uaauauuucuacccugcugccu

SEQ ID NO: 1090152 - RNA, 22 nt, Human
cagcuugggucaggugccugcu

SEQ ID NO: 1090153 - RNA, 23 nt, Human
aucuaauuucuccaaaucucuac

SEQ ID NO: 1090154 - RNA, 22 nt, Human
ccuggcucucugcagauccugg

SEQ ID NO: 1090155 - RNA, 21 nt, Human
gugcugggacacagccaggcu

SEQ ID NO: 1090156 - RNA, 22 nt, Human
ggugcagaggagccagcugggg

SEQ ID NO: 1090157 - RNA, 22 nt, Human
ugagcccugaggaucuguucgg

SEQ ID NO: 1090158 - RNA, 22 nt, Human
aggggagccccugguccuggug

SEQ ID NO: 1090159 - RNA, 22 nt, Human
uaaggguucagaaugcaguggu

SEQ ID NO: 1090160 - RNA, 21 nt, Human
gcacagugccaggcacacagu

SEQ ID NO: 1090161 - RNA, 22 nt, Human
ccacagggcacagacaggaagc

SEQ ID NO: 1090162 - RNA, 22 nt, Human
uuggcagucagucuuggugcuu

SEQ ID NO: 1090163 - RNA, 22 nt, Human
uuuccuuugggagcaugaauuu

SEQ ID NO: 1090164 - RNA, 21 nt, Human
ccucuggcuugugcugugccc

SEQ ID NO: 1090165 - RNA, 22 nt, Human
ggggcagagucuggacuguugu

SEQ ID NO: 1090166 - RNA, 22 nt, Human
caggugccucaggaugagacaa

SEQ ID NO: 1090167 - RNA, 22 nt, Human
ccugccugcaccuucucugggg

SEQ ID NO: 1090168 - RNA, 22 nt, Human
ccagcucugcauguuucccuug

SEQ ID NO: 1090169 - RNA, 23 nt, Human
cugcauguccacugguguaaaug

SEQ ID NO: 1090170 - RNA, 22 nt, Human
uuuaacagguaaaguaaaugug

SEQ ID NO: 1090171 - RNA, 22 nt, Human
aaaggcauguggucaaggcuca

SEQ ID NO: 1090172 - RNA, 22 nt, Human
uugcuuugguagcagcuauaga

SEQ ID NO: 1090173 - RNA, 22 nt, Human
agucagagcaaacuggacagac

SEQ ID NO: 1090174 - RNA, 22 nt, Human
ucaggcugaaucauccuagcuu

SEQ ID NO: 1090175 - RNA, 22 nt, Human
cuggaguggccggugcuguggc

SEQ ID NO: 1090176 - RNA, 17 nt, Human
ucagagggaugagcagg

SEQ ID NO: 1090177 - RNA, 22 nt, Human
uuccucuccucacaugagucac

SEQ ID NO: 1090178 - RNA, 22 nt, Human
cagcagggaagcugugcuguuu

SEQ ID NO: 1090179 - RNA, 22 nt, Human
aauuugaaacauagucaccacu

SEQ ID NO: 1090180 - RNA, 22 nt, Human
auaguauuuaauaguuagcuca

SEQ ID NO: 1090181 - RNA, 22 nt, Human
agcuggaggauaacucacuucu

SEQ ID NO: 1090182 - RNA, 22 nt, Human
ugcagaagcugcaggucagugg

SEQ ID NO: 1090183 - RNA, 22 nt, Human
uuugcucugcuguugccaggug

SEQ ID NO: 1090184 - RNA, 22 nt, Human
ugcugucccuaagucucuucaa

SEQ ID NO: 1090185 - RNA, 22 nt, Human
uuaacaguggcuaagacugagg

SEQ ID NO: 1090186 - RNA, 22 nt, Human
aaaagagucuuaggcagucaua

SEQ ID NO: 1090187 - RNA, 22 nt, Human
uuccuucucagcccucgaggau

SEQ ID NO: 1090188 - RNA, 19 nt, Human
cuuugucagaacaugcuuc

SEQ ID NO: 1090189 - RNA, 22 nt, Human
agcaggcugagcacccaggggg

SEQ ID NO: 1090190 - RNA, 22 nt, Human
gcaagaccuaucuaguugcugu

SEQ ID NO: 1090191 - RNA, 22 nt, Human
ugcagggcacggugcgcguggg

SEQ ID NO: 1090192 - RNA, 22 nt, Human
cugaccuguaacuguaagagac

SEQ ID NO: 1090193 - RNA, 22 nt, Human
aucaggaugacuauaaggcugc

SEQ ID NO: 1090194 - RNA, 22 nt, Human
caaacuuucaguuauaacauga

SEQ ID NO: 1090195 - RNA, 22 nt, Human
ucaagaauuuuuaaugugacug

SEQ ID NO: 1090196 - RNA, 22 nt, Human
ugaacuucagugauuugcugca

SEQ ID NO: 1090197 - RNA, 22 nt, Human
auguguaugagugugcuucuuu

SEQ ID NO: 1090198 - RNA, 22 nt, Human
aaaguguugauaugugacaucc

SEQ ID NO: 1090199 - RNA, 20 nt, Human
cugcugagagccuggcuugc

SEQ ID NO: 1090200 - RNA, 22 nt, Human
gcucccacugcagcccugagcc

SEQ ID NO: 1090201 - RNA, 22 nt, Human
aggcagggucuugcuauguugc

SEQ ID NO: 1090202 - RNA, 22 nt, Human
gcugagcugaggcagggcuggg

SEQ ID NO: 1090203 - RNA, 16 nt, Human
gagggcagaggcggaa

SEQ ID NO: 1090204 - RNA, 22 nt, Human
uccaagaaguuuauguuguuuc

SEQ ID NO: 1090205 - RNA, 22 nt, Human
gcuccccauugaucugcaggcu

SEQ ID NO: 1090206 - RNA, 22 nt, Human
caggagcaaauccaaaagaauu

SEQ ID NO: 1090207 - RNA, 22 nt, Human
ucuguaaacaccauguuagagu

SEQ ID NO: 1090208 - RNA, 22 nt, Human
cacaauuuccaagucauguuau

SEQ ID NO: 1090209 - RNA, 22 nt, Human
ugggcaagucacuucugucuuu

SEQ ID NO: 1090210 - RNA, 22 nt, Human
agucucugcaugccugcugugc

SEQ ID NO: 1090211 - RNA, 22 nt, Human
ggcagggugccuggcuccuguu

SEQ ID NO: 1090212 - RNA, 22 nt, Human
agaaacuauuaugguaaacaaa

SEQ ID NO: 1090213 - RNA, 23 nt, Human
ucccaucuauugugaucaaugcc

SEQ ID NO: 1090214 - RNA, 22 nt, Human
auagggccuaaaaaguauugcu

SEQ ID NO: 1090215 - RNA, 22 nt, Human
cucucugagugagggacaagcu

SEQ ID NO: 1090216 - RNA, 22 nt, Human
gaccacacuuuggaaaucacga

SEQ ID NO: 1090217 - RNA, 21 nt, Human
agggaaagaaaaugagcuaau

SEQ ID NO: 1090218 - RNA, 20 nt, Human
ugaggcucagagagguugag

SEQ ID NO: 1090219 - RNA, 22 nt, Human
uuuccucauuuaucugcuggga

SEQ ID NO: 1090220 - RNA, 22 nt, Human
ucugauuagcuccauuugcuaa

SEQ ID NO: 1090221 - RNA, 22 nt, Human
uuucuaaguguguuucauagga

SEQ ID NO: 1090222 - RNA, 22 nt, Human
auguuuuugagauacaaacaga

SEQ ID NO: 1090223 - RNA, 22 nt, Human
auacaaagcuaaauaugguuuc

SEQ ID NO: 1090224 - RNA, 22 nt, Human
uuuauacuucauaaugucuauu

SEQ ID NO: 1090225 - RNA, 22 nt, Human
ggagguggagcuggaaguucca

SEQ ID NO: 1090226 - RNA, 21 nt, Human
augacagaugcugcagaucgu

SEQ ID NO: 1090227 - RNA, 22 nt, Human
uucuguuugccauauauaguag

SEQ ID NO: 1090228 - RNA, 22 nt, Human
gaaaaaugagcugaugucaggg

SEQ ID NO: 1090229 - RNA, 22 nt, Human
ggcugugaguuuguccuccaug

SEQ ID NO: 1090230 - RNA, 22 nt, Human
cagucucuuuauccaccaagcc

SEQ ID NO: 1090231 - RNA, 22 nt, Human
acagugaaaauaauaucuucaa

SEQ ID NO: 1090232 - RNA, 22 nt, Human
auuugucuuuggaccugugaga

SEQ ID NO: 1090233 - RNA, 22 nt, Human
cugggccucauccucagaguuu

SEQ ID NO: 1090234 - RNA, 20 nt, Human
ucauccaggacaggaguggc

SEQ ID NO: 1090235 - RNA, 23 nt, Human
gcccaugcuguugggcccgagca

SEQ ID NO: 1090236 - RNA, 22 nt, Human
cauuugcuggggucuugggagu

SEQ ID NO: 1090237 - RNA, 22 nt, Human
ggaugcaggacggcauggaugu

SEQ ID NO: 1090238 - RNA, 22 nt, Human
gaaauacaggaaugccacacag

SEQ ID NO: 1090239 - RNA, 22 nt, Human
agcagcauucucugguaugggg

SEQ ID NO: 1090240 - RNA, 22 nt, Human
uccaggccaauguagcaggccc

SEQ ID NO: 1090241 - RNA, 22 nt, Human
ucucccacuggccuuguaugau

SEQ ID NO: 1090242 - RNA, 21 nt, Human
cacacagugaucuauccacau

SEQ ID NO: 1090243 - RNA, 22 nt, Human
uggugcaaaacuaauugcgguu

SEQ ID NO: 1090244 - RNA, 22 nt, Human
aguacaauuuaaugaagauagc

SEQ ID NO: 1090245 - RNA, 22 nt, Human
caauauauaggaacaacuuagg

SEQ ID NO: 1090246 - RNA, 22 nt, Human
augcugugcuggcuaaccaugg

SEQ ID NO: 1090247 - RNA, 22 nt, Human
guccaagucuuccuucccaaac

SEQ ID NO: 1090248 - RNA, 22 nt, Human
aauguguuuaguuaaugaguug

SEQ ID NO: 1090249 - RNA, 19 nt, Human
ggccccucucacaggaguu

SEQ ID NO: 1090250 - RNA, 21 nt, Human
acaguuuuaaggagcacaugg

SEQ ID NO: 1090251 - RNA, 22 nt, Human
uuugaguuuuaccuguauuacu

SEQ ID NO: 1090252 - RNA, 22 nt, Human
cuucacaggcaagucuguuuuu

SEQ ID NO: 1090253 - RNA, 22 nt, Human
uccuucagcugcuaggaaauga

SEQ ID NO: 1090254 - RNA, 22 nt, Human
agcaggagacauggggguggug

SEQ ID NO: 1090255 - RNA, 18 nt, Human
ugggauggagaguaacug

SEQ ID NO: 1090256 - RNA, 22 nt, Human
aaggcccuggcaggaagcagga

SEQ ID NO: 1090257 - RNA, 22 nt, Human
gccagggaacccaagggccuca

SEQ ID NO: 1090258 - RNA, 22 nt, Human
auuggaaauacaguagaaaaau

SEQ ID NO: 1090259 - RNA, 23 nt, Human
aaauaugucugagggcaaagaau

SEQ ID NO: 1090260 - RNA, 22 nt, Human
ucuauauuccagauacagauua

SEQ ID NO: 1090261 - RNA, 22 nt, Human
ucaggaugguccuuuaugagaa

SEQ ID NO: 1090262 - RNA, 22 nt, Human
ugucauuuuagugcaucacuca

SEQ ID NO: 1090263 - RNA, 22 nt, Human
uguggcaggaagagcuucugag

SEQ ID NO: 1090264 - RNA, 22 nt, Human
uagcagaagaacaacaugaucu

SEQ ID NO: 1090265 - RNA, 22 nt, Human
uggcucugggcaccguguccac

SEQ ID NO: 1090266 - RNA, 22 nt, Human
uagguagcuuuggcguuucuug

SEQ ID NO: 1090267 - RNA, 22 nt, Human
uagcagcauccuguggugaugg

SEQ ID NO: 1090268 - RNA, 22 nt, Human
uggcugggccgggccuugugcc

SEQ ID NO: 1090269 - RNA, 22 nt, Human
auuuucagugaucauagcacac

SEQ ID NO: 1090270 - RNA, 22 nt, Human
cuucuggguguggagugaggac

SEQ ID NO: 1090271 - RNA, 22 nt, Human
gcagcuggacccacacggcuua

SEQ ID NO: 1090272 - RNA, 22 nt, Human
cugggaguugacgaggcuugua

SEQ ID NO: 1090273 - RNA, 22 nt, Human
ugcaggcuggaggagggacuaa

SEQ ID NO: 1090274 - RNA, 22 nt, Human
gacccagcuuaagucacauguu

SEQ ID NO: 1090275 - RNA, 22 nt, Human
ggcugagcacuuuaggcaggag

SEQ ID NO: 1090276 - RNA, 22 nt, Human
ugugaagaguagacauguggug

SEQ ID NO: 1090277 - RNA, 22 nt, Human
aucaguuuaaaugggcuguugg

SEQ ID NO: 1090278 - RNA, 22 nt, Human
ucaggacagccagggugcagac

SEQ ID NO: 1090279 - RNA, 22 nt, Human
aggcagccuuuagacagucugc

SEQ ID NO: 1090280 - RNA, 22 nt, Human
cagggacaugacuggucucugu

SEQ ID NO: 1090281 - RNA, 22 nt, Human
cuucugaaaugugagcaaaauc

SEQ ID NO: 1090282 - RNA, 22 nt, Human
cuuauauuugucaacuuuacaa

SEQ ID NO: 1090283 - RNA, 21 nt, Human
uccaggccaugguggggaggc

SEQ ID NO: 1090284 - RNA, 21 nt, Human
uaguguagcugcagcagcaga

SEQ ID NO: 1090285 - RNA, 22 nt, Human
ucacaggguaucugggauggau

SEQ ID NO: 1090286 - RNA, 22 nt, Human
cucuggagggaggcugagcugg

SEQ ID NO: 1090287 - RNA, 20 nt, Human
auaauuauuuacuuuugugc

SEQ ID NO: 1090288 - RNA, 22 nt, Human
aaacaacaugguggguguguag

SEQ ID NO: 1090289 - RNA, 22 nt, Human
aaggcagauauaaagacuagag

SEQ ID NO: 1090290 - RNA, 22 nt, Human
cucaggauucucgacacucaca

SEQ ID NO: 1090291 - RNA, 22 nt, Human
gagagcugcauucucagacaca

SEQ ID NO: 1090292 - RNA, 22 nt, Human
uuaaagcaugcugcuuuuccau

SEQ ID NO: 1090293 - RNA, 22 nt, Human
uggcaggguggcaacuuuuggu

SEQ ID NO: 1090294 - RNA, 22 nt, Human
ugcccugccaagaccaaguggu

SEQ ID NO: 1090295 - RNA, 22 nt, Human
cugggcuacguguugacagcau

SEQ ID NO: 1090296 - RNA, 22 nt, Human
ucagaaaaugaaauggacucuc

SEQ ID NO: 1090297 - RNA, 22 nt, Human
gagcugaguuaccuccagauca

SEQ ID NO: 1090298 - RNA, 22 nt, Human
aucagcuauuaugugaagaaag

SEQ ID NO: 1090299 - RNA, 22 nt, Human
cccuggccagcucaugucugag

SEQ ID NO: 1090300 - RNA, 22 nt, Human
acucaggaaaaauguagugaua

SEQ ID NO: 1090301 - RNA, 22 nt, Human
cagccuccugggacacucaccg

SEQ ID NO: 1090302 - RNA, 22 nt, Human
gaugcagggcuggcaggagcuu

SEQ ID NO: 1090303 - RNA, 22 nt, Human
uucacagcuccuuuuacucaac

SEQ ID NO: 1090304 - RNA, 20 nt, Human
uuguguaggucuaaugcaua

SEQ ID NO: 1090305 - RNA, 18 nt, Human
aagaggaggagcagguug

SEQ ID NO: 1090306 - RNA, 20 nt, Human
ggagagcagggaagacagua

SEQ ID NO: 1090307 - RNA, 22 nt, Human
caugaaauugcuccuuuggugc

SEQ ID NO: 1090308 - RNA, 22 nt, Human
agcugccacagagccuggccag

SEQ ID NO: 1090309 - RNA, 22 nt, Human
gggcagcugcagggauggugac

SEQ ID NO: 1090310 - RNA, 22 nt, Human
gaaaucugucuuuguuugaaua

SEQ ID NO: 1090311 - RNA, 22 nt, Human
uuuaauuguuguggguacauag

SEQ ID NO: 1090312 - RNA, 22 nt, Human
ggcuucuccccuuugagucuuc

SEQ ID NO: 1090313 - RNA, 22 nt, Human
guggggcuuccuggggcaaguu

SEQ ID NO: 1090314 - RNA, 22 nt, Human
ucaagaguuggucaaauccaaa

SEQ ID NO: 1090315 - RNA, 22 nt, Human
agugucugugcuuugcagcaaa

SEQ ID NO: 1090316 - RNA, 22 nt, Human
ucuuugaaaagauauuccuccu

SEQ ID NO: 1090317 - RNA, 22 nt, Human
ucugagaggauuccugucccga

SEQ ID NO: 1090318 - RNA, 22 nt, Human
uugucccauugcgaaugugagu

SEQ ID NO: 1090319 - RNA, 22 nt, Human
ucugcagaaggaaucagcugag

SEQ ID NO: 1090320 - RNA, 22 nt, Human
cccagggaaugacucuggccuu

SEQ ID NO: 1090321 - RNA, 22 nt, Human
cuggcaggaagaggaaagguca

SEQ ID NO: 1090322 - RNA, 22 nt, Human
aaaacaguuuaggcaucacagu

SEQ ID NO: 1090323 - RNA, 22 nt, Human
acaaaugugauuguuucugaaa

SEQ ID NO: 1090324 - RNA, 22 nt, Human
ggugggcacccgagacuggauc

SEQ ID NO: 1090325 - RNA, 19 nt, Human
uucauucuuucuacuuacc

SEQ ID NO: 1090326 - RNA, 19 nt, Human
agaggccucagcagcuggc

SEQ ID NO: 1090327 - RNA, 22 nt, Human
agaguucugcucuucucaguga

SEQ ID NO: 1090328 - RNA, 22 nt, Human
agcauuuaugacuaauguaaaa

SEQ ID NO: 1090329 - RNA, 22 nt, Human
gcuaucuaccacaucagccagg

SEQ ID NO: 1090330 - RNA, 22 nt, Human
ugaaaucaauugcaauguuuau

SEQ ID NO: 1090331 - RNA, 22 nt, Human
aagcagcaugauuguaauacua

SEQ ID NO: 1090332 - RNA, 22 nt, Human
uucaggaugcagagguuguagu

SEQ ID NO: 1090333 - RNA, 22 nt, Human
cgugaaaugaguugaauuauug

SEQ ID NO: 1090334 - RNA, 20 nt, Human
uacuugaauguugcagcagu

SEQ ID NO: 1090335 - RNA, 22 nt, Human
uucuccgcuaaguucucugcag

SEQ ID NO: 1090336 - RNA, 22 nt, Human
cuagucacucagcacugacaaa

SEQ ID NO: 1090337 - RNA, 22 nt, Human
aguuuuauuccaaugugcagca

SEQ ID NO: 1090338 - RNA, 22 nt, Human
gccagggcucgcggucccucgu

SEQ ID NO: 1090339 - RNA, 22 nt, Human
auggaauaauuguuucacagaa

SEQ ID NO: 1090340 - RNA, 22 nt, Human
auuuaggaauguucugcacaaa

SEQ ID NO: 1090341 - RNA, 22 nt, Human
agaugcugugaggaagcuagga

SEQ ID NO: 1090342 - RNA, 22 nt, Human
aaacagcuacuucuguauaaug

SEQ ID NO: 1090343 - RNA, 22 nt, Human
uuguaauuuguucccaagcaga

SEQ ID NO: 1090344 - RNA, 22 nt, Human
gcucaguguuucugguagaaaa

SEQ ID NO: 1090345 - RNA, 22 nt, Human
uagauggcguccauggccgcag

SEQ ID NO: 1090346 - RNA, 22 nt, Human
ugauucaguugguuuuguucag

SEQ ID NO: 1090347 - RNA, 22 nt, Human
aaacaaacauagguuugaaagu

SEQ ID NO: 1090348 - RNA, 22 nt, Human
gagccuguguuuccuguagcca

SEQ ID NO: 1090349 - RNA, 22 nt, Human
gaagcagcugccagagaugucu

SEQ ID NO: 1090350 - RNA, 22 nt, Human
cuucuggcaaaacaggcagaaa

SEQ ID NO: 1090351 - RNA, 20 nt, Human
auaaaauaacugccacaaga

SEQ ID NO: 1090352 - RNA, 22 nt, Human
agcugagagguggcaagcugua

SEQ ID NO: 1090353 - RNA, 22 nt, Human
uccaggaaucugugccuagccc

SEQ ID NO: 1090354 - RNA, 22 nt, Human
gcuggcugcacaggggcucacu

SEQ ID NO: 1090355 - RNA, 18 nt, Human
cacaggcucccagugagg

SEQ ID NO: 1090356 - RNA, 22 nt, Human
ugagguguguccccagggaggu

SEQ ID NO: 1090357 - RNA, 22 nt, Human
cagcagagguuuugcuccauga

SEQ ID NO: 1090358 - RNA, 22 nt, Human
ucagagucaggaaugcuugauu

SEQ ID NO: 1090359 - RNA, 22 nt, Human
acugcccuguaacugccaggua

SEQ ID NO: 1090360 - RNA, 22 nt, Human
ucauuuguuacagccacauacc

SEQ ID NO: 1090361 - RNA, 22 nt, Human
auacagaacucucaguuguaua

SEQ ID NO: 1090362 - RNA, 22 nt, Human
uccuucagucuucugagccaua

SEQ ID NO: 1090363 - RNA, 22 nt, Human
gagucacauacuauguaauaga

SEQ ID NO: 1090364 - RNA, 22 nt, Human
cccuaagcuuucgggcugagag

SEQ ID NO: 1090365 - RNA, 22 nt, Human
ucucagagagcuguguuuuccu

SEQ ID NO: 1090366 - RNA, 22 nt, Human
guugaaagagcauggacuugaa

SEQ ID NO: 1090367 - RNA, 22 nt, Human
cuuaaaaucuggcaguuagcua

SEQ ID NO: 1090368 - RNA, 23 nt, Human
ucccagccucuucucuugcauac

SEQ ID NO: 1090369 - RNA, 22 nt, Human
uugaaaguuaucuagauucuga

SEQ ID NO: 1090370 - RNA, 22 nt, Human
uccaggcuggccucgcgugaca

SEQ ID NO: 1090371 - RNA, 22 nt, Human
aacagaauugcugcugccaaug

SEQ ID NO: 1090372 - RNA, 22 nt, Human
acucagagcagagcagccugag

SEQ ID NO: 1090373 - RNA, 22 nt, Human
gaacaauacaggcuuuauuccu

SEQ ID NO: 1090374 - RNA, 22 nt, Human
uauuuauuggacaguguugcug

SEQ ID NO: 1090375 - RNA, 22 nt, Human
uagaauguuaagaauauguaua

SEQ ID NO: 1090376 - RNA, 22 nt, Human
gcagagucagguccaaggacug

SEQ ID NO: 1090377 - RNA, 22 nt, Human
agugauggugagugagaagcuc

SEQ ID NO: 1090378 - RNA, 22 nt, Human
agccucucuguuagucacuggg

SEQ ID NO: 1090379 - RNA, 22 nt, Human
cagcaacuccuauauugaaagc

SEQ ID NO: 1090380 - RNA, 22 nt, Human
ggggauggugggaaggcaaucu

SEQ ID NO: 1090381 - RNA, 22 nt, Human
ggugcagcugcagccugggagc

SEQ ID NO: 1090382 - RNA, 22 nt, Human
caguggcaugguugacugcagu

SEQ ID NO: 1090383 - RNA, 22 nt, Human
ugugggcccuaggcaccuuguc

SEQ ID NO: 1090384 - RNA, 22 nt, Human
agcuaccuggcuuaucacuguc

SEQ ID NO: 1090385 - RNA, 22 nt, Human
uuaagauuuucuucaguauuau

SEQ ID NO: 1090386 - RNA, 22 nt, Human
aggcauuuaaagauguaagacu

SEQ ID NO: 1090387 - RNA, 22 nt, Human
ucaggauguuaauauagcauua

SEQ ID NO: 1090388 - RNA, 22 nt, Human
caugagugugccagucugauau

SEQ ID NO: 1090389 - RNA, 22 nt, Human
aauuuguuacacagcaauauaa

SEQ ID NO: 1090390 - RNA, 22 nt, Human
ccugggcucaggcuugggcagc

SEQ ID NO: 1090391 - RNA, 22 nt, Human
uagggcaguuucauguuaucuu

SEQ ID NO: 1090392 - RNA, 22 nt, Human
aaagcacuuugagacugacagg

SEQ ID NO: 1090393 - RNA, 22 nt, Human
cagggcugcuggccgugcccuc

SEQ ID NO: 1090394 - RNA, 22 nt, Human
uacauauacugagugauuugcu

SEQ ID NO: 1090395 - RNA, 22 nt, Human
uggagcagagaugguggccuuc

SEQ ID NO: 1090396 - RNA, 22 nt, Human
aaaguaauugcaguuucugcca

SEQ ID NO: 1090397 - RNA, 22 nt, Human
cuggguggcuguccagccagcc

SEQ ID NO: 1090398 - RNA, 22 nt, Human
guuuuuaucuaauagcaguuau

SEQ ID NO: 1090399 - RNA, 22 nt, Human
ccugccugcggcccgcggggag

SEQ ID NO: 1090400 - RNA, 16 nt, Human
agcagccagcacugga

SEQ ID NO: 1090401 - RNA, 22 nt, Human
gauccuugcaacucugugaggu

SEQ ID NO: 1090402 - RNA, 22 nt, Human
agggaaaggcugaugcuguggg

SEQ ID NO: 1090403 - RNA, 21 nt, Human
aucugaaaugucaaagcagau

SEQ ID NO: 1090404 - RNA, 22 nt, Human
ucauaacaggcugagaggauuu

SEQ ID NO: 1090405 - RNA, 22 nt, Human
ucagaguguggugagaugugca

SEQ ID NO: 1090406 - RNA, 22 nt, Human
ucacaguagacuucucaagagc

SEQ ID NO: 1090407 - RNA, 22 nt, Human
auauuuucacagaacuugcaaa

SEQ ID NO: 1090408 - RNA, 22 nt, Human
cuucagaggggacucaaaguca

SEQ ID NO: 1090409 - RNA, 22 nt, Human
caaguagaaggaugugauugua

SEQ ID NO: 1090410 - RNA, 22 nt, Human
ugcuuuggccacuagaauucag

SEQ ID NO: 1090411 - RNA, 21 nt, Human
ugugucacuaacuagaggcua

SEQ ID NO: 1090412 - RNA, 19 nt, Human
ugaagcaggcagagaagau

SEQ ID NO: 1090413 - RNA, 22 nt, Human
cacaauuuccuugcuucacuuu

SEQ ID NO: 1090414 - RNA, 22 nt, Human
gaacgcacuuuguaaacuguaa

SEQ ID NO: 1090415 - RNA, 22 nt, Human
gcugccugcuucaugugggaga

SEQ ID NO: 1090416 - RNA, 22 nt, Human
gaguggagcaaaagagguagau

SEQ ID NO: 1090417 - RNA, 22 nt, Human
uuucuggaacaguaauugaaga

SEQ ID NO: 1090418 - RNA, 22 nt, Human
uucuuuuuaucuucccauaaga

SEQ ID NO: 1090419 - RNA, 22 nt, Human
gcuggcucuucaguggagauag

SEQ ID NO: 1090420 - RNA, 22 nt, Human
auauauuuuuugagacagaguc

SEQ ID NO: 1090421 - RNA, 22 nt, Human
cagggccagcgucucgggcuau

SEQ ID NO: 1090422 - RNA, 22 nt, Human
ccagcuggaacggcagcccagc

SEQ ID NO: 1090423 - RNA, 22 nt, Human
agacauaagugcuaugacauug

SEQ ID NO: 1090424 - RNA, 22 nt, Human
guuuuucuagaaaucuccuccu

SEQ ID NO: 1090425 - RNA, 22 nt, Human
ucagagagccucaggcacugcc

SEQ ID NO: 1090426 - RNA, 22 nt, Human
gcagagcucuguucuuaucucc

SEQ ID NO: 1090427 - RNA, 22 nt, Human
uauuuuguauuuaugcaagaaa

SEQ ID NO: 1090428 - RNA, 19 nt, Human
cagaccuguccagccugug

SEQ ID NO: 1090429 - RNA, 22 nt, Human
acuuauuucauggaucauaaug

SEQ ID NO: 1090430 - RNA, 20 nt, Human
uuacagaaaugauguuauuu

SEQ ID NO: 1090431 - RNA, 22 nt, Human
ucuccaagcagggcugcaaggc

SEQ ID NO: 1090432 - RNA, 22 nt, Human
cacaucaagcauccaugaguuu

SEQ ID NO: 1090433 - RNA, 22 nt, Human
accagagaugucuaauaggggc

SEQ ID NO: 1090434 - RNA, 22 nt, Human
cucagagucccuucccucgugg

SEQ ID NO: 1090435 - RNA, 23 nt, Human
ggcagagagcauggcuggggccc

SEQ ID NO: 1090436 - RNA, 22 nt, Human
acuuccagcaacuuggugcuau

SEQ ID NO: 1090437 - RNA, 22 nt, Human
gcccugggauuggguggaggcu

SEQ ID NO: 1090438 - RNA, 20 nt, Human
agcuggccuguccuaggccu

SEQ ID NO: 1090439 - RNA, 22 nt, Human
agaaaucauuuuaggcuugaug

SEQ ID NO: 1090440 - RNA, 19 nt, Human
aaaggcaguggguggcgug

SEQ ID NO: 1090441 - RNA, 18 nt, Human
gaugggagcaagagaaga

SEQ ID NO: 1090442 - RNA, 22 nt, Human
ggcuucagugagcugagcucac

SEQ ID NO: 1090443 - RNA, 22 nt, Human
ucccauggucuauauagaggca

SEQ ID NO: 1090444 - RNA, 20 nt, Human
ucuuuguuaauuuuaucucc

SEQ ID NO: 1090445 - RNA, 22 nt, Human
auaaauaucacuguugucccuc

SEQ ID NO: 1090446 - RNA, 20 nt, Human
ccacaggaguccagucgacc

SEQ ID NO: 1090447 - RNA, 22 nt, Human
ucacagcaacacuggggcagac

SEQ ID NO: 1090448 - RNA, 22 nt, Human
ggcagccagagggcagcuggau

SEQ ID NO: 1090449 - RNA, 22 nt, Human
cugucagaggcucucuguugcc

SEQ ID NO: 1090450 - RNA, 18 nt, Human
gcucugcccaggcugccc

SEQ ID NO: 1090451 - RNA, 19 nt, Human
uggcagaggacaaggacuu

SEQ ID NO: 1090452 - RNA, 22 nt, Human
cuuggaggaaaggcagggagac

SEQ ID NO: 1090453 - RNA, 22 nt, Human
ccaggacaauucgucacuuucu

SEQ ID NO: 1090454 - RNA, 22 nt, Human
gggccaggucggugaaugguca

SEQ ID NO: 1090455 - RNA, 22 nt, Human
uguaugaauauguuggggaggu

SEQ ID NO: 1090456 - RNA, 22 nt, Human
gugguaauuuaauccuacacug

SEQ ID NO: 1090457 - RNA, 22 nt, Human
gccuggcaaggcccuguugacu

SEQ ID NO: 1090458 - RNA, 22 nt, Human
ugcugcaggaauucucaaggga

SEQ ID NO: 1090459 - RNA, 22 nt, Human
cucaggaggugguagaggcccu

SEQ ID NO: 1090460 - RNA, 22 nt, Human
uuucacagaaaggauaacauua

SEQ ID NO: 1090461 - RNA, 22 nt, Human
acauuguaaauaccuuuaucac

SEQ ID NO: 1090462 - RNA, 22 nt, Human
ugcaugcacuaucuagaugaug

SEQ ID NO: 1090463 - RNA, 22 nt, Human
agagugauggguugugcugacc

SEQ ID NO: 1090464 - RNA, 22 nt, Human
cuuugaauugccguuucaucug

SEQ ID NO: 1090465 - RNA, 22 nt, Human
auuucauguuucaucuaccuaa

SEQ ID NO: 1090466 - RNA, 22 nt, Human
uuucuaaaggguagauuuggcc

SEQ ID NO: 1090467 - RNA, 22 nt, Human
gcuucuggugaggccucaggaa

SEQ ID NO: 1090468 - RNA, 22 nt, Human
caucuuuaauuugugacaacua

SEQ ID NO: 1090469 - RNA, 22 nt, Human
uuucacauucucugguuaucga

SEQ ID NO: 1090470 - RNA, 22 nt, Human
agagccuugaagaucuggaaaa

SEQ ID NO: 1090471 - RNA, 22 nt, Human
guuucuuagacauaugccauga

SEQ ID NO: 1090472 - RNA, 22 nt, Human
ugaaaggugacauuucuuggau

SEQ ID NO: 1090473 - RNA, 19 nt, Human
gcgaggaagucacuguggu

SEQ ID NO: 1090474 - RNA, 22 nt, Human
agccugucugucuccaaagcug

SEQ ID NO: 1090475 - RNA, 22 nt, Human
cuuccagcugauuggcauccag

SEQ ID NO: 1090476 - RNA, 22 nt, Human
uuugucuuuccccuccucauug

SEQ ID NO: 1090477 - RNA, 22 nt, Human
ggcaauaaugacauuuuaaaaa

SEQ ID NO: 1090478 - RNA, 22 nt, Human
aagagagaacucccuucgccag

SEQ ID NO: 1090479 - RNA, 22 nt, Human
aaaguauucuugacuguuuuuc

SEQ ID NO: 1090480 - RNA, 22 nt, Human
gacaaaggaucagagguuggga

SEQ ID NO: 1090481 - RNA, 22 nt, Human
agcccaaggcuucccugcuggc

SEQ ID NO: 1090482 - RNA, 22 nt, Human
caagaugaucccugaaggcagc

SEQ ID NO: 1090483 - RNA, 22 nt, Human
cuugaaaauaagaaagacuuuc

SEQ ID NO: 1090484 - RNA, 22 nt, Human
cagugggaagggcagaggcuuu

SEQ ID NO: 1090485 - RNA, 22 nt, Human
cugauuccugauucaugcucuu

SEQ ID NO: 1090486 - RNA, 22 nt, Human
ccaggaugacccccacuuuccu

SEQ ID NO: 1090487 - RNA, 22 nt, Human
caggaaauucuuuuuaacagaa

SEQ ID NO: 1090488 - RNA, 22 nt, Human
agggccagcugaugagaaugag

SEQ ID NO: 1090489 - RNA, 21 nt, Human
acuagcuuucuggagaagugu

SEQ ID NO: 1090490 - RNA, 22 nt, Human
acagcuaaucccccuagauucu

SEQ ID NO: 1090491 - RNA, 21 nt, Human
ugugaaauagcuaugcuacau

SEQ ID NO: 1090492 - RNA, 22 nt, Human
agagccaggacugugucucacu

SEQ ID NO: 1090493 - RNA, 22 nt, Human
uuauuuguggcauaugagacga

SEQ ID NO: 1090494 - RNA, 22 nt, Human
gcaucugauccaauagauauau

SEQ ID NO: 1090495 - RNA, 22 nt, Human
uagaaggaggacuggcaguguu

SEQ ID NO: 1090496 - RNA, 22 nt, Human
acauuucacuguucacagcagg

SEQ ID NO: 1090497 - RNA, 22 nt, Human
aggcacagagaaugcccuccau

SEQ ID NO: 1090498 - RNA, 22 nt, Human
aauguuuggcuagauagaugga

SEQ ID NO: 1090499 - RNA, 22 nt, Human
cuggccagccugucgaugcccu

SEQ ID NO: 1090500 - RNA, 19 nt, Human
aucuuuagcaacuuucaaa

SEQ ID NO: 1090501 - RNA, 18 nt, Human
cugaggcccagagagggc

SEQ ID NO: 1090502 - RNA, 22 nt, Human
ucugaaauuccuuccagacuuu

SEQ ID NO: 1090503 - RNA, 19 nt, Human
ggcucagggcgcugccgcc

SEQ ID NO: 1090504 - RNA, 22 nt, Human
caaagcagacgcaguaagggua

SEQ ID NO: 1090505 - RNA, 22 nt, Human
ucauggauggccgggaggugau

SEQ ID NO: 1090506 - RNA, 22 nt, Human
gaaaugucuuugacaagagagg

SEQ ID NO: 1090507 - RNA, 22 nt, Human
acuguguggaaauuugugaggg

SEQ ID NO: 1090508 - RNA, 22 nt, Human
uccagggccaagucauggaacc

SEQ ID NO: 1090509 - RNA, 22 nt, Human
gaagcagaagguuuggacgugc

SEQ ID NO: 1090510 - RNA, 22 nt, Human
uaauguuugagauguuggauuu

SEQ ID NO: 1090511 - RNA, 22 nt, Human
ugcaucuguucagagcugucga

SEQ ID NO: 1090512 - RNA, 22 nt, Human
cuaagaaaauagaagcaugcua

SEQ ID NO: 1090513 - RNA, 22 nt, Human
uggcagagcuggcugcggauga

SEQ ID NO: 1090514 - RNA, 22 nt, Human
acagagucucaaaccuacaaag

SEQ ID NO: 1090515 - RNA, 22 nt, Human
acagaauugaagcugaguaaau

SEQ ID NO: 1090516 - RNA, 21 nt, Human
auggagggaccagggaagcag

SEQ ID NO: 1090517 - RNA, 22 nt, Human
ccagcccuccuccaucagagga

SEQ ID NO: 1090518 - RNA, 22 nt, Human
uggagagcgugcuuagcacucu

SEQ ID NO: 1090519 - RNA, 22 nt, Human
uucuccccugacccugaugagg

SEQ ID NO: 1090520 - RNA, 22 nt, Human
ugcacacaccgugcuucacuga

SEQ ID NO: 1090521 - RNA, 22 nt, Human
agcagcucuguuuaccuggagg

SEQ ID NO: 1090522 - RNA, 22 nt, Human
agugggccaaauggaggcaagu

SEQ ID NO: 1090523 - RNA, 18 nt, Human
aucugaugcaauucaaua

SEQ ID NO: 1090524 - RNA, 22 nt, Human
cugaauaucauuuacauuugga

SEQ ID NO: 1090525 - RNA, 22 nt, Human
gagacguggccuuugccugagc

SEQ ID NO: 1090526 - RNA, 21 nt, Human
acauacauaccuuaccaccuu

SEQ ID NO: 1090527 - RNA, 22 nt, Human
uucuuuauccuauuuguaggug

SEQ ID NO: 1090528 - RNA, 22 nt, Human
aggcugaggcggguagaucacc

SEQ ID NO: 1090529 - RNA, 22 nt, Human
uuucugaacaaagccauuauca

SEQ ID NO: 1090530 - RNA, 22 nt, Human
acuuccugggcaugcagagucc

SEQ ID NO: 1090531 - RNA, 22 nt, Human
ggugcccuggaagcugcugcau

SEQ ID NO: 1090532 - RNA, 22 nt, Human
uucacaggugacuggggauaac

SEQ ID NO: 1090533 - RNA, 22 nt, Human
aagauuacuacggaacaugacc

SEQ ID NO: 1090534 - RNA, 22 nt, Human
gagcucauucauucauugccug

SEQ ID NO: 1090535 - RNA, 22 nt, Human
ugaggccaaugacccugggcag

SEQ ID NO: 1090536 - RNA, 21 nt, Human
cuccugggcuaagauauagug

SEQ ID NO: 1090537 - RNA, 22 nt, Human
ccacugccagcuuuguccuccc

SEQ ID NO: 1090538 - RNA, 22 nt, Human
uuucuacagaagauacacugcu

SEQ ID NO: 1090539 - RNA, 22 nt, Human
aaguaagucuuacauucacauu

SEQ ID NO: 1090540 - RNA, 22 nt, Human
aagcugccuugcugaggagaaa

SEQ ID NO: 1090541 - RNA, 22 nt, Human
uuuuaucugcuucauuaguuga

SEQ ID NO: 1090542 - RNA, 22 nt, Human
cugccagcacugccuccugagg

SEQ ID NO: 1090543 - RNA, 22 nt, Human
caaauguuugguggcauuuugu

SEQ ID NO: 1090544 - RNA, 22 nt, Human
uccugggcugcagggaagagca

SEQ ID NO: 1090545 - RNA, 22 nt, Human
uggaacacagugauugauagcg

SEQ ID NO: 1090546 - RNA, 22 nt, Human
aaggcacugaacuuaaauucug

SEQ ID NO: 1090547 - RNA, 22 nt, Human
aucaguuuggaacauucaggcc

SEQ ID NO: 1090548 - RNA, 22 nt, Human
uuucuuaguccuagagugauuu

SEQ ID NO: 1090549 - RNA, 22 nt, Human
auuuuauccccacuggauuaca

SEQ ID NO: 1090550 - RNA, 22 nt, Human
cagcuuggcuuccgcuuuacug

SEQ ID NO: 1090551 - RNA, 21 nt, Human
uccucugcucucauaccacaa

SEQ ID NO: 1090552 - RNA, 22 nt, Human
gcuguucuuugcaucucuggug

SEQ ID NO: 1090553 - RNA, 22 nt, Human
acuugguugcuucugaaaugac

SEQ ID NO: 1090554 - RNA, 22 nt, Human
gcagaggccuagguggaaggcc

SEQ ID NO: 1090555 - RNA, 22 nt, Human
cagagccccccuucugaucaca

SEQ ID NO: 1090556 - RNA, 21 nt, Human
cacagcaggguuccugggcuc

SEQ ID NO: 1090557 - RNA, 22 nt, Human
acuggggaguugaagcacuuuc

SEQ ID NO: 1090558 - RNA, 22 nt, Human
gcaccugggacccagaggcacc

SEQ ID NO: 1090559 - RNA, 22 nt, Human
ccaggacacugcuucacagcag

SEQ ID NO: 1090560 - RNA, 23 nt, Human
uggaagcaguuccagcacaaaua

SEQ ID NO: 1090561 - RNA, 19 nt, Human
cuuauacagauuuucucau

SEQ ID NO: 1090562 - RNA, 22 nt, Human
uguacagagacuaccauuaaua

SEQ ID NO: 1090563 - RNA, 22 nt, Human
ugcagugagaagcaguuaugau

SEQ ID NO: 1090564 - RNA, 22 nt, Human
cucaucugauaaaucacucuua

SEQ ID NO: 1090565 - RNA, 22 nt, Human
cacaggaaggccuucucacaau

SEQ ID NO: 1090566 - RNA, 22 nt, Human
cuuuccaaugucacuaugaauc

SEQ ID NO: 1090567 - RNA, 22 nt, Human
gugauuuucuccuccuagaagu

SEQ ID NO: 1090568 - RNA, 22 nt, Human
caguggaauauauaggggauuu

SEQ ID NO: 1090569 - RNA, 22 nt, Human
cagcagggcccccgggugcgcc

SEQ ID NO: 1090570 - RNA, 22 nt, Human
acugcuuacaaaaggaaagaau

SEQ ID NO: 1090571 - RNA, 22 nt, Human
gccagagcagaauagaguggcc

SEQ ID NO: 1090572 - RNA, 22 nt, Human
cagguggcuaacggccucauag

SEQ ID NO: 1090573 - RNA, 22 nt, Human
cucaggacccgguccagguggg

SEQ ID NO: 1090574 - RNA, 22 nt, Human
agaagcaguuauuuuuugcaca

SEQ ID NO: 1090575 - RNA, 22 nt, Human
auuuccaauuucauccaugucc

SEQ ID NO: 1090576 - RNA, 22 nt, Human
acagguggucuuugcuccuuuu

SEQ ID NO: 1090577 - RNA, 22 nt, Human
gagcaggaugggagcuggggcc

SEQ ID NO: 1090578 - RNA, 22 nt, Human
ccuggagugacagguguagccu

SEQ ID NO: 1090579 - RNA, 22 nt, Human
agcuuccaauuucuccaagaga

SEQ ID NO: 1090580 - RNA, 22 nt, Human
uucccagaccuguaggaucaga

SEQ ID NO: 1090581 - RNA, 22 nt, Human
gaggccucugucccgccaggga

SEQ ID NO: 1090582 - RNA, 22 nt, Human
uuacuuuguucucaagauaugu

SEQ ID NO: 1090583 - RNA, 22 nt, Human
cagcucuguucauagauggugc

SEQ ID NO: 1090584 - RNA, 22 nt, Human
aauagcauaagaugucaaauag

SEQ ID NO: 1090585 - RNA, 22 nt, Human
ggagcacuauaauagagauuuu

SEQ ID NO: 1090586 - RNA, 22 nt, Human
gcuggccauauauuuugcuguu

SEQ ID NO: 1090587 - RNA, 19 nt, Human
ugagcugccgucuucccug

SEQ ID NO: 1090588 - RNA, 22 nt, Human
aguguuuuuacaagcacucugg

SEQ ID NO: 1090589 - RNA, 22 nt, Human
gucauuguguggacauggagaa

SEQ ID NO: 1090590 - RNA, 22 nt, Human
augucuucuaagcucuaagcug

SEQ ID NO: 1090591 - RNA, 22 nt, Human
gggugggccugucuggccaugu

SEQ ID NO: 1090592 - RNA, 22 nt, Human
gcuuggaaguaggauugggaga

SEQ ID NO: 1090593 - RNA, 22 nt, Human
ugagaaaauuacuauaauuguc

SEQ ID NO: 1090594 - RNA, 23 nt, Human
ugauuuuaaaaaguaaguuauca

SEQ ID NO: 1090595 - RNA, 22 nt, Human
agaaggguagggacuuauccaa

SEQ ID NO: 1090596 - RNA, 22 nt, Human
aguguuucuggcaaaugaaagu

SEQ ID NO: 1090597 - RNA, 22 nt, Human
ucucucagaggccaggguccug

SEQ ID NO: 1090598 - RNA, 22 nt, Human
ucccaagacuauguucugugug

SEQ ID NO: 1090599 - RNA, 22 nt, Human
ggcagcugaccuagcaccaucc

SEQ ID NO: 1090600 - RNA, 22 nt, Human
auaacccucuggauaggacagg

SEQ ID NO: 1090601 - RNA, 22 nt, Human
ccuccaagcugguccucugugu

SEQ ID NO: 1090602 - RNA, 21 nt, Human
aagcaggaacuucaaagggac

SEQ ID NO: 1090603 - RNA, 22 nt, Human
uggcuccuaggauggugccugg

SEQ ID NO: 1090604 - RNA, 22 nt, Human
ucaaaacacuauuaccuuuaau

SEQ ID NO: 1090605 - RNA, 22 nt, Human
guguggcugauugacaugguca

SEQ ID NO: 1090606 - RNA, 22 nt, Human
ugggaagggaguuucuuggagu

SEQ ID NO: 1090607 - RNA, 22 nt, Human
uucuggagaucugccuauggga

SEQ ID NO: 1090608 - RNA, 22 nt, Human
cagggccauaucuugugcacca

SEQ ID NO: 1090609 - RNA, 22 nt, Human
uggggccugagguggagcugca

SEQ ID NO: 1090610 - RNA, 23 nt, Human
uacauucuguauuuuuauagagu

SEQ ID NO: 1090611 - RNA, 22 nt, Human
uuucuggacccuucugugagug

SEQ ID NO: 1090612 - RNA, 22 nt, Human
gucuguaucagaggagugaaug

SEQ ID NO: 1090613 - RNA, 20 nt, Human
ugcagagcuggcuggcuccu

SEQ ID NO: 1090614 - RNA, 22 nt, Human
aucccugcccucauggagcuua

SEQ ID NO: 1090615 - RNA, 22 nt, Human
aggcucagauucacauuugguu

SEQ ID NO: 1090616 - RNA, 22 nt, Human
gaagaacugacaaacuagauca

SEQ ID NO: 1090617 - RNA, 22 nt, Human
gcugguccacucccuggaggcu

SEQ ID NO: 1090618 - RNA, 22 nt, Human
aacaaaucuuaaaguaauucaa

SEQ ID NO: 1090619 - RNA, 19 nt, Human
ugcuuccucaccaucuccc

SEQ ID NO: 1090620 - RNA, 22 nt, Human
ugggcagacauugaguuuguuc

SEQ ID NO: 1090621 - RNA, 22 nt, Human
gauuuucauuauagcuaguuuc

SEQ ID NO: 1090622 - RNA, 22 nt, Human
aaaggcaauuucuucuuccuga

SEQ ID NO: 1090623 - RNA, 22 nt, Human
gucccugggaugcccuucuggg

SEQ ID NO: 1090624 - RNA, 22 nt, Human
ugagcccaggaguuggagaccg

SEQ ID NO: 1090625 - RNA, 22 nt, Human
uuacagaagagaaagaauucag

SEQ ID NO: 1090626 - RNA, 22 nt, Human
agcaugcacaugacuggcuuaa

SEQ ID NO: 1090627 - RNA, 22 nt, Human
agcuggcuccagaaggagucgu

SEQ ID NO: 1090628 - RNA, 22 nt, Human
uguuugacaccucaguguuucu

SEQ ID NO: 1090629 - RNA, 22 nt, Human
agauggggcugaaaguuccaau

SEQ ID NO: 1090630 - RNA, 22 nt, Human
ugaggccuuuucugucuggcua

SEQ ID NO: 1090631 - RNA, 22 nt, Human
cuguguccucccgcugcaccca

SEQ ID NO: 1090632 - RNA, 22 nt, Human
uguacaaugccagggaacacca

SEQ ID NO: 1090633 - RNA, 22 nt, Human
aguggaaggcugggaaaugcgg

SEQ ID NO: 1090634 - RNA, 22 nt, Human
cugggccugccaccaucuuagg

SEQ ID NO: 1090635 - RNA, 19 nt, Human
ccuggcugcugugggaugc

SEQ ID NO: 1090636 - RNA, 22 nt, Human
gcucaagagagaugcaguucuu

SEQ ID NO: 1090637 - RNA, 22 nt, Human
uucaagauggcugcaaauacuu

SEQ ID NO: 1090638 - RNA, 22 nt, Human
uuucaacucaugcuaaaggaag

SEQ ID NO: 1090639 - RNA, 22 nt, Human
uccugagagcagaguccaggug

SEQ ID NO: 1090640 - RNA, 22 nt, Human
agggcagauggaacuuccccga

SEQ ID NO: 1090641 - RNA, 22 nt, Human
uuugggaaacuuaggggucaga

SEQ ID NO: 1090642 - RNA, 22 nt, Human
uauggucauuuguuagugcuuu

SEQ ID NO: 1090643 - RNA, 22 nt, Human
aucuggcucacuuagucuagga

SEQ ID NO: 1090644 - RNA, 22 nt, Human
gcuuuauuuugugagggauuac

SEQ ID NO: 1090645 - RNA, 22 nt, Human
cagccugcagggcugccuguug

SEQ ID NO: 1090646 - RNA, 22 nt, Human
uaggaacacacauguguagcug

SEQ ID NO: 1090647 - RNA, 19 nt, Human
uggcugggcgugccuccgu

SEQ ID NO: 1090648 - RNA, 22 nt, Human
uaagucauuuggagccacugga

SEQ ID NO: 1090649 - RNA, 22 nt, Human
agauaauaaauguuuuagguuu

SEQ ID NO: 1090650 - RNA, 17 nt, Human
ggcugcugugcuggugc

SEQ ID NO: 1090651 - RNA, 22 nt, Human
ggccucaggguugggcccauua

SEQ ID NO: 1090652 - RNA, 22 nt, Human
ucaaaucuuugaccacuuaugu

SEQ ID NO: 1090653 - RNA, 22 nt, Human
gauacaaauucaugucugaauu

SEQ ID NO: 1090654 - RNA, 22 nt, Human
guucuccacugcagagucucuc

SEQ ID NO: 1090655 - RNA, 22 nt, Human
cagauuucuauuucaaauacau

SEQ ID NO: 1090656 - RNA, 22 nt, Human
gaggccagaaugagcugaaugc

SEQ ID NO: 1090657 - RNA, 22 nt, Human
uuugagaaggugacaaauucua

SEQ ID NO: 1090658 - RNA, 22 nt, Human
augguacuggggucccggaguu

SEQ ID NO: 1090659 - RNA, 22 nt, Human
uuuggaaugacagauaucaaua

SEQ ID NO: 1090660 - RNA, 22 nt, Human
ugaaaucugcaugcaaaguccu

SEQ ID NO: 1090661 - RNA, 22 nt, Human
ggaaggaggaugcucuggccuu

SEQ ID NO: 1090662 - RNA, 22 nt, Human
auggggcucugcggcugcuccc

SEQ ID NO: 1090663 - RNA, 22 nt, Human
uaagaaacaugauuaauggcag

SEQ ID NO: 1090664 - RNA, 22 nt, Human
ucacacagcugcucuguuuuau

SEQ ID NO: 1090665 - RNA, 17 nt, Human
ggagccaggagcccacc

SEQ ID NO: 1090666 - RNA, 22 nt, Human
cugcugcugcuaucuacccagg

SEQ ID NO: 1090667 - RNA, 20 nt, Human
agccugccagcuggcccaga

SEQ ID NO: 1090668 - RNA, 22 nt, Human
uuuagcagcaaauaaguagugc

SEQ ID NO: 1090669 - RNA, 22 nt, Human
uggcagggccugcucaucaucc

SEQ ID NO: 1090670 - RNA, 22 nt, Human
gugcauacuuuauuuuaauacu

SEQ ID NO: 1090671 - RNA, 22 nt, Human
cugagcagcaacccagagccuc

SEQ ID NO: 1090672 - RNA, 22 nt, Human
acaguacugcuguucuuguccu

SEQ ID NO: 1090673 - RNA, 22 nt, Human
auauaauuaauuuagcugccuc

SEQ ID NO: 1090674 - RNA, 22 nt, Human
gaaugauauuauuucgugcugg

SEQ ID NO: 1090675 - RNA, 20 nt, Human
ucaaagaagauucagcucaa

SEQ ID NO: 1090676 - RNA, 22 nt, Human
cauuugaauggcauuucacuuu

SEQ ID NO: 1090677 - RNA, 23 nt, Human
uucuuuguggauaaucuccagug

SEQ ID NO: 1090678 - RNA, 22 nt, Human
uggcccugagggcucggagcca

SEQ ID NO: 1090679 - RNA, 22 nt, Human
ccaggccuccugugaguggacc

SEQ ID NO: 1090680 - RNA, 22 nt, Human
aaagguaacugggguuuugcca

SEQ ID NO: 1090681 - RNA, 22 nt, Human
gggcuccaacggugagcaugga

SEQ ID NO: 1090682 - RNA, 22 nt, Human
cauccugcggggagcagagggc

SEQ ID NO: 1090683 - RNA, 22 nt, Human
ucuaagaaagauuaagaaauuu

SEQ ID NO: 1090684 - RNA, 20 nt, Human
uugcaacuguaagaagcagg

SEQ ID NO: 1090685 - RNA, 22 nt, Human
aagggcucuucuauuuauggcc

SEQ ID NO: 1090686 - RNA, 22 nt, Human
aacaaagucguugccuagaaga

SEQ ID NO: 1090687 - RNA, 22 nt, Human
cuacauuguuaucuguaagugu

SEQ ID NO: 1090688 - RNA, 22 nt, Human
acagaguacauucagagacuau

SEQ ID NO: 1090689 - RNA, 22 nt, Human
aagcccagcaucccugcaccag

SEQ ID NO: 1090690 - RNA, 22 nt, Human
augacuuuuaggagcagugcuc

SEQ ID NO: 1090691 - RNA, 22 nt, Human
cagcucugugggagcguaugug

SEQ ID NO: 1090692 - RNA, 18 nt, Human
acagacacuuaguaugag

SEQ ID NO: 1090693 - RNA, 22 nt, Human
gcugucugcaucucuagagcuu

SEQ ID NO: 1090694 - RNA, 20 nt, Human
gaguuccccauuucuccugg

SEQ ID NO: 1090695 - RNA, 22 nt, Human
uguauuaggagauuccauguuu

SEQ ID NO: 1090696 - RNA, 22 nt, Human
cugaggugagcuucccugggcu

SEQ ID NO: 1090697 - RNA, 22 nt, Human
agcccaggucuggcccagccug

SEQ ID NO: 1090698 - RNA, 18 nt, Human
ggagcugggccugguucc

SEQ ID NO: 1090699 - RNA, 22 nt, Human
cggggccuaccgcugcguggcc

SEQ ID NO: 1090700 - RNA, 22 nt, Human
ggaggggaacuaaucccgugac

SEQ ID NO: 1090701 - RNA, 22 nt, Human
ugcaagaggauuguaucaauaa

SEQ ID NO: 1090702 - RNA, 19 nt, Human
aucugccuguuaucacaua

SEQ ID NO: 1090703 - RNA, 22 nt, Human
acagacaguaaauaguguggcu

SEQ ID NO: 1090704 - RNA, 22 nt, Human
gugugccaccagucaaggugaa

SEQ ID NO: 1090705 - RNA, 22 nt, Human
acacugaaucagaaauuguugg

SEQ ID NO: 1090706 - RNA, 22 nt, Human
gggcagaggggcgcuucccucu

SEQ ID NO: 1090707 - RNA, 22 nt, Human
acaggaaagagcuaggcauagg

SEQ ID NO: 1090708 - RNA, 22 nt, Human
aggccuagaggaauggccaggg

SEQ ID NO: 1090709 - RNA, 22 nt, Human
uaagauaugguaggaaguuugg

SEQ ID NO: 1090710 - RNA, 22 nt, Human
aaaauuauagaucuagugccug

SEQ ID NO: 1090711 - RNA, 22 nt, Human
accacccucagcagagcugaaa

SEQ ID NO: 1090712 - RNA, 22 nt, Human
gggcacagcugcuacccagugc

SEQ ID NO: 1090713 - RNA, 22 nt, Human
uugcucaggcuuagagcuacua

SEQ ID NO: 1090714 - RNA, 19 nt, Human
gcuucccaccagccagccc

SEQ ID NO: 1090715 - RNA, 22 nt, Human
uggugagaugcagcaacagaca

SEQ ID NO: 1090716 - RNA, 22 nt, Human
uggcugagguuaugcugguugu

SEQ ID NO: 1090717 - RNA, 22 nt, Human
auagacauauggcuuuguuucu

SEQ ID NO: 1090718 - RNA, 19 nt, Human
cacaucagcagggcugugg

SEQ ID NO: 1090719 - RNA, 20 nt, Human
ccugcuguuuccauggggcc

SEQ ID NO: 1090720 - RNA, 22 nt, Human
agggucaacaggagucaagaug

SEQ ID NO: 1090721 - RNA, 23 nt, Human
acaaaguaauuccugcuuccaaa

SEQ ID NO: 1090722 - RNA, 22 nt, Human
ggcaggucagguccaugaccaa

SEQ ID NO: 1090723 - RNA, 22 nt, Human
cauaaaguguauaagugaagaa

SEQ ID NO: 1090724 - RNA, 22 nt, Human
agaggguggugaggccugguuc

SEQ ID NO: 1090725 - RNA, 22 nt, Human
ucuccugguauguaugcaccug

SEQ ID NO: 1090726 - RNA, 22 nt, Human
aguguuuaaacugaagugauga

SEQ ID NO: 1090727 - RNA, 22 nt, Human
ccuucaugauggaaaggguuca

SEQ ID NO: 1090728 - RNA, 22 nt, Human
gggugggagucuggcccucaaa

SEQ ID NO: 1090729 - RNA, 22 nt, Human
ugugggaaugacgaggaagagg

SEQ ID NO: 1090730 - RNA, 22 nt, Human
agcuggcccucgagagccaauu

SEQ ID NO: 1090731 - RNA, 22 nt, Human
uuuguaacaaguugaucuggua

SEQ ID NO: 1090732 - RNA, 22 nt, Human
caguuuuaaauuguuagauaau

SEQ ID NO: 1090733 - RNA, 22 nt, Human
cagggcuggcuguggcaaucuc

SEQ ID NO: 1090734 - RNA, 22 nt, Human
agggcugaccuaagcuccacuu

SEQ ID NO: 1090735 - RNA, 22 nt, Human
aagcccaguuucacacugagac

SEQ ID NO: 1090736 - RNA, 22 nt, Human
agggcuggagccacagcuggga

SEQ ID NO: 1090737 - RNA, 22 nt, Human
aucuagcaguguuauaauugga

SEQ ID NO: 1090738 - RNA, 22 nt, Human
uucugaaaacacacuuugcagc

SEQ ID NO: 1090739 - RNA, 22 nt, Human
guuggccugaauggucaagagg

SEQ ID NO: 1090740 - RNA, 22 nt, Human
acucagaggcagcugcucaccc

SEQ ID NO: 1090741 - RNA, 22 nt, Human
uuaaagcugcugaauccuauuu

SEQ ID NO: 1090742 - RNA, 22 nt, Human
cacagggcagugauuguccaca

SEQ ID NO: 1090743 - RNA, 22 nt, Human
gacagggcgcccagccuguuuc

SEQ ID NO: 1090744 - RNA, 22 nt, Human
acaucuuuguuucuuaguguau

SEQ ID NO: 1090745 - RNA, 22 nt, Human
ucauguaaguauagaaagcagu

SEQ ID NO: 1090746 - RNA, 22 nt, Human
aaaucugggucaagguggagug

SEQ ID NO: 1090747 - RNA, 22 nt, Human
cuucagcugcaguuauguuuag

SEQ ID NO: 1090748 - RNA, 22 nt, Human
cugugugugucugcagcauacu

SEQ ID NO: 1090749 - RNA, 22 nt, Human
agcacuuugugcauuucugaag

SEQ ID NO: 1090750 - RNA, 22 nt, Human
caggugggccaugaaaaaugac

SEQ ID NO: 1090751 - RNA, 22 nt, Human
cagaggcugaugugggaugggc

SEQ ID NO: 1090752 - RNA, 22 nt, Human
uuaguuaggaaacaaaguuguu

SEQ ID NO: 1090753 - RNA, 22 nt, Human
uguacuugaacuugacuguaga

SEQ ID NO: 1090754 - RNA, 22 nt, Human
acauuuaaguuaaaaccucagu

SEQ ID NO: 1090755 - RNA, 22 nt, Human
gagcucagauucuggugucaga

SEQ ID NO: 1090756 - RNA, 22 nt, Human
uaaggcuucuuggaauacugca

SEQ ID NO: 1090757 - RNA, 22 nt, Human
cuccagcuucccucagcugugg

SEQ ID NO: 1090758 - RNA, 22 nt, Human
ccagucugaggccuggugaggg

SEQ ID NO: 1090759 - RNA, 22 nt, Human
ucaauuauuuuggcuaugcuaa

SEQ ID NO: 1090760 - RNA, 22 nt, Human
ccuuuauucaauuaguccuaau

SEQ ID NO: 1090761 - RNA, 22 nt, Human
ucccagccuccugacaguuuug

SEQ ID NO: 1090762 - RNA, 22 nt, Human
acacauuucuaaauuuuuaccg

SEQ ID NO: 1090763 - RNA, 22 nt, Human
auuugguagugauugaaauuau

SEQ ID NO: 1090764 - RNA, 22 nt, Human
cagaaccaggaacugauggaga

SEQ ID NO: 1090765 - RNA, 22 nt, Human
uccaggaaacacucaagccaug

SEQ ID NO: 1090766 - RNA, 22 nt, Human
acuaaacauucuugucucucaa

SEQ ID NO: 1090767 - RNA, 22 nt, Human
ugaagccauuacuguguuaggg

SEQ ID NO: 1090768 - RNA, 22 nt, Human
auacaaauuuauagaugcauuu

SEQ ID NO: 1090769 - RNA, 22 nt, Human
agggacacacuccaguguuauu

SEQ ID NO: 1090770 - RNA, 22 nt, Human
uuccagcuaacucacaucccuu

SEQ ID NO: 1090771 - RNA, 22 nt, Human
ugaggcuggcaaggcugguauu

SEQ ID NO: 1090772 - RNA, 22 nt, Human
gcuguucugcgucccaggcugg

SEQ ID NO: 1090773 - RNA, 22 nt, Human
auuauuuuaugugcggccugau

SEQ ID NO: 1090774 - RNA, 20 nt, Human
ggggggcuucagggccugug

SEQ ID NO: 1090775 - RNA, 22 nt, Human
uuuaucuggacugugauauaaa

SEQ ID NO: 1090776 - RNA, 22 nt, Human
uuugaaaauuuaagugcuacac

SEQ ID NO: 1090777 - RNA, 22 nt, Human
auuauuaggugcucucugacaa

SEQ ID NO: 1090778 - RNA, 22 nt, Human
agauggugauagagcugggauu

SEQ ID NO: 1090779 - RNA, 20 nt, Human
cucuuuugacucuuugcaag

SEQ ID NO: 1090780 - RNA, 22 nt, Human
accaggaagaacaggcaaggca

SEQ ID NO: 1090781 - RNA, 22 nt, Human
cuucucucugcauaggcauggg

SEQ ID NO: 1090782 - RNA, 22 nt, Human
ccaaaaauuagauacacauaua

SEQ ID NO: 1090783 - RNA, 22 nt, Human
aaguacaaauuuugaagagcuu

SEQ ID NO: 1090784 - RNA, 22 nt, Human
ucccauauauguuuauauugga

SEQ ID NO: 1090785 - RNA, 22 nt, Human
acauacauaugacaacuuuccu

SEQ ID NO: 1090786 - RNA, 22 nt, Human
ucuuccugaaacccuguuccag

SEQ ID NO: 1090787 - RNA, 22 nt, Human
guugaaagaucauguggcugcc

SEQ ID NO: 1090788 - RNA, 22 nt, Human
ggccagagagccgcuguuagga

SEQ ID NO: 1090789 - RNA, 22 nt, Human
agcaucuggucaugagugagaa

SEQ ID NO: 1090790 - RNA, 22 nt, Human
agcucagcuuccucuccaugcu

SEQ ID NO: 1090791 - RNA, 22 nt, Human
ugggcuggcugaggcauucacu

SEQ ID NO: 1090792 - RNA, 22 nt, Human
ggggauggaggcgugugguccu

SEQ ID NO: 1090793 - RNA, 22 nt, Human
ucagagaaaugaaguagggauu

SEQ ID NO: 1090794 - RNA, 22 nt, Human
cugggcucaccuguggcuggca

SEQ ID NO: 1090795 - RNA, 22 nt, Human
cugguccuugacgcgugggagg

SEQ ID NO: 1090796 - RNA, 22 nt, Human
aggaggccccuccuggguugcu

SEQ ID NO: 1090797 - RNA, 21 nt, Human
gcugcaucaaucuacccaggg

SEQ ID NO: 1090798 - RNA, 22 nt, Human
gcugaaauucagauuccuaggc

SEQ ID NO: 1090799 - RNA, 22 nt, Human
uuguggcucgugagauguuagg

SEQ ID NO: 1090800 - RNA, 22 nt, Human
aggaggggcauagaaauguaau

SEQ ID NO: 1090801 - RNA, 22 nt, Human
gcugucugagaacaugguggaa

SEQ ID NO: 1090802 - RNA, 22 nt, Human
ggccagcccagugguccucucu

SEQ ID NO: 1090803 - RNA, 22 nt, Human
uacaugaacaaaauagcagaaa

SEQ ID NO: 1090804 - RNA, 22 nt, Human
uuauaucagaaggugagauuga

SEQ ID NO: 1090805 - RNA, 22 nt, Human
acaaagcacgagugccauggac

SEQ ID NO: 1090806 - RNA, 22 nt, Human
ggccucucaugcccagagccaa

SEQ ID NO: 1090807 - RNA, 22 nt, Human
uguauacauuuaacuagauaga

SEQ ID NO: 1090808 - RNA, 22 nt, Human
ccacucugauuuuggcuccacu

SEQ ID NO: 1090809 - RNA, 22 nt, Human
uuucagcugguaaaggaguagc

SEQ ID NO: 1090810 - RNA, 22 nt, Human
agcucccagagcucgagaguaa

SEQ ID NO: 1090811 - RNA, 22 nt, Human
gaacauuuggauuuguaaauuu

SEQ ID NO: 1090812 - RNA, 22 nt, Human
cagcugucuaaguugagcagga

SEQ ID NO: 1090813 - RNA, 22 nt, Human
gguuggacacuagguaggagcg

SEQ ID NO: 1090814 - RNA, 22 nt, Human
uguaaacauauguauguaugua

SEQ ID NO: 1090815 - RNA, 22 nt, Human
caaaauuagaaaugcagcuguu

SEQ ID NO: 1090816 - RNA, 22 nt, Human
uggaaagagguagaggaucugg

SEQ ID NO: 1090817 - RNA, 22 nt, Human
uaugcuuugauuuccucagcug

SEQ ID NO: 1090818 - RNA, 22 nt, Human
uuugcauuucuaaugagcuccg

SEQ ID NO: 1090819 - RNA, 22 nt, Human
uuugcauuguaauauuuaguuc

SEQ ID NO: 1090820 - RNA, 22 nt, Human
aauaugcauuaacuguguacau

SEQ ID NO: 1090821 - RNA, 22 nt, Human
caaauucucacccuguuugauu

SEQ ID NO: 1090822 - RNA, 22 nt, Human
cugggcuuugguacugugauua

SEQ ID NO: 1090823 - RNA, 22 nt, Human
cugggaaagcaagguuguggau

SEQ ID NO: 1090824 - RNA, 18 nt, Human
cagcucuucuccaguaac

SEQ ID NO: 1090825 - RNA, 22 nt, Human
agcaucugcuuaauggcuuaac

SEQ ID NO: 1090826 - RNA, 22 nt, Human
agcugggcaaaaugugagguug

SEQ ID NO: 1090827 - RNA, 22 nt, Human
gcagaggagcaaguugcuacag

SEQ ID NO: 1090828 - RNA, 22 nt, Human
ccaaaugugccuguuucaacaa

SEQ ID NO: 1090829 - RNA, 22 nt, Human
gauggggaugagaagugagcag

SEQ ID NO: 1090830 - RNA, 22 nt, Human
caggcccaucugcucccaggcu

SEQ ID NO: 1090831 - RNA, 22 nt, Human
acacuuuuguuugaagucucca

SEQ ID NO: 1090832 - RNA, 22 nt, Human
cagagcccuaguccugauggcc

SEQ ID NO: 1090833 - RNA, 22 nt, Human
ugcuggagaggaaggugggguc

SEQ ID NO: 1090834 - RNA, 22 nt, Human
cagcugccuguauuguccucau

SEQ ID NO: 1090835 - RNA, 22 nt, Human
ggugccaggcucccagcucagg

SEQ ID NO: 1090836 - RNA, 22 nt, Human
uuuccaaaguugccauaagcuu

SEQ ID NO: 1090837 - RNA, 22 nt, Human
auguucaaacuuuuuacacacc

SEQ ID NO: 1090838 - RNA, 23 nt, Human
ucggugggcguggaggccgaggc

SEQ ID NO: 1090839 - RNA, 22 nt, Human
augcaucuauucccaagggcag

SEQ ID NO: 1090840 - RNA, 22 nt, Human
aggugacugguuuaucuggcag

SEQ ID NO: 1090841 - RNA, 22 nt, Human
ugaggcagugugagauaauaaa

SEQ ID NO: 1090842 - RNA, 22 nt, Human
aucagaagaaauggaugugacu

SEQ ID NO: 1090843 - RNA, 22 nt, Human
uuuacacugugaaacagguauc

SEQ ID NO: 1090844 - RNA, 22 nt, Human
cagagguagaaggcaugcagug

SEQ ID NO: 1090845 - RNA, 22 nt, Human
ucuuuagaaacuuuucuucaug

SEQ ID NO: 1090846 - RNA, 23 nt, Human
aucaagauaauccagaugaccua

SEQ ID NO: 1090847 - RNA, 22 nt, Human
cagggccaggcugauggccugg

SEQ ID NO: 1090848 - RNA, 22 nt, Human
ccugccaggagcuggugcugca

SEQ ID NO: 1090849 - RNA, 22 nt, Human
aggauacacggggauuuaugua

SEQ ID NO: 1090850 - RNA, 22 nt, Human
ucucccagugucuggcagucag

SEQ ID NO: 1090851 - RNA, 18 nt, Human
gaaaggagagacaguagg

SEQ ID NO: 1090852 - RNA, 22 nt, Human
agaaaguuaucacaaaauugag

SEQ ID NO: 1090853 - RNA, 23 nt, Human
uuucugaaguugagauggacuuu

SEQ ID NO: 1090854 - RNA, 22 nt, Human
ugcaggcugaggcuggcucaac

SEQ ID NO: 1090855 - RNA, 22 nt, Human
aagugcaaaucuguggcugaaa

SEQ ID NO: 1090856 - RNA, 22 nt, Human
gaauacaaagcagaacucauac

SEQ ID NO: 1090857 - RNA, 22 nt, Human
uugcccugucuuaagcuggcaa

SEQ ID NO: 1090858 - RNA, 22 nt, Human
uuauuuucagcuaggaaagcca

SEQ ID NO: 1090859 - RNA, 22 nt, Human
cagcaccauuugcagccucuuu

SEQ ID NO: 1090860 - RNA, 22 nt, Human
auaauacaugguugaucuuuuc

SEQ ID NO: 1090861 - RNA, 22 nt, Human
aaacuuuaagacaguccucaag

SEQ ID NO: 1090862 - RNA, 22 nt, Human
gcagagcccuggggguauggug

SEQ ID NO: 1090863 - RNA, 22 nt, Human
uucaauuugugcuaaggcaccg

SEQ ID NO: 1090864 - RNA, 22 nt, Human
aaggagugcaugacucagagua

SEQ ID NO: 1090865 - RNA, 22 nt, Human
gggagggacacaaagaguuccc

SEQ ID NO: 1090866 - RNA, 22 nt, Human
uguggccagagguacuauuuua

SEQ ID NO: 1090867 - RNA, 22 nt, Human
uaaaugagggcugacaugauug

SEQ ID NO: 1090868 - RNA, 22 nt, Human
ccuggcaguuuugcccaggauu

SEQ ID NO: 1090869 - RNA, 22 nt, Human
gugcuaggauuacaggcauggg

SEQ ID NO: 1090870 - RNA, 22 nt, Human
aggccuggugaaugaaguaucu

SEQ ID NO: 1090871 - RNA, 22 nt, Human
ccagugccugugggcauggugc

SEQ ID NO: 1090872 - RNA, 22 nt, Human
gugucucuaucuaugccugaag

SEQ ID NO: 1090873 - RNA, 22 nt, Human
gcagggacaacugugcaccuga

SEQ ID NO: 1090874 - RNA, 22 nt, Human
cucccaggguagggagagacua

SEQ ID NO: 1090875 - RNA, 22 nt, Human
guaauuaggaauaaaaugggaa

SEQ ID NO: 1090876 - RNA, 22 nt, Human
ggcugcaggaugcccagccgug

SEQ ID NO: 1090877 - RNA, 22 nt, Human
auuugcuuguaaauguaugccu

SEQ ID NO: 1090878 - RNA, 22 nt, Human
cagaaaugugauguacacacac

SEQ ID NO: 1090879 - RNA, 22 nt, Human
cuguccugggggugguccuugc

SEQ ID NO: 1090880 - RNA, 19 nt, Human
agggcuaggcacauagggc

SEQ ID NO: 1090881 - RNA, 22 nt, Human
uucuacagacuauaacugugau

SEQ ID NO: 1090882 - RNA, 22 nt, Human
uguccacaucacucacuuguca

SEQ ID NO: 1090883 - RNA, 22 nt, Human
ggcuggccuguguggccgccac

SEQ ID NO: 1090884 - RNA, 22 nt, Human
aaacacugugggacaucuuacu

SEQ ID NO: 1090885 - RNA, 22 nt, Human
guaugaaguaagauauuguuca

SEQ ID NO: 1090886 - RNA, 22 nt, Human
ccaggaguuggagguugcagug

SEQ ID NO: 1090887 - RNA, 22 nt, Human
ucuuccucaauguaacaacccc

SEQ ID NO: 1090888 - RNA, 22 nt, Human
uugcaagggauaccauacuaag

SEQ ID NO: 1090889 - RNA, 22 nt, Human
uauuuccacccucaguaaggaa

SEQ ID NO: 1090890 - RNA, 22 nt, Human
uccucugcuggaagggcaagag

SEQ ID NO: 1090891 - RNA, 22 nt, Human
uuacaggggacauuggggacau

SEQ ID NO: 1090892 - RNA, 22 nt, Human
aggcagcuggcagcacccaggg

SEQ ID NO: 1090893 - RNA, 20 nt, Human
cugggcagguguuugaucuc

SEQ ID NO: 1090894 - RNA, 22 nt, Human
gcucuguaugagggugagagau

SEQ ID NO: 1090895 - RNA, 22 nt, Human
ccugagagcccuagccaggcgc

SEQ ID NO: 1090896 - RNA, 22 nt, Human
uagccucucuccuccacaaccu

SEQ ID NO: 1090897 - RNA, 20 nt, Human
uucuauggaccaguauauuu

SEQ ID NO: 1090898 - RNA, 22 nt, Human
guucuuaaagauucaucaagca

SEQ ID NO: 1090899 - RNA, 22 nt, Human
agaaucuaaguacacagacaga

SEQ ID NO: 1090900 - RNA, 22 nt, Human
agaaugcuccagagcugaaaga

SEQ ID NO: 1090901 - RNA, 22 nt, Human
acagaaggacuugagaaagaca

SEQ ID NO: 1090902 - RNA, 22 nt, Human
uucauauauaugcacuacguac

SEQ ID NO: 1090903 - RNA, 22 nt, Human
aggcuggcgucaggggcuguac

SEQ ID NO: 1090904 - RNA, 22 nt, Human
ugucccagacauaaguggacau

SEQ ID NO: 1090905 - RNA, 22 nt, Human
uggcuggcgccgggcuagccac

SEQ ID NO: 1090906 - RNA, 22 nt, Human
auauucaaauuacauuuacuaa

SEQ ID NO: 1090907 - RNA, 22 nt, Human
ccuuuuucaauauagaauugca

SEQ ID NO: 1090908 - RNA, 22 nt, Human
ucaccuuaacaaucugaccauc

SEQ ID NO: 1090909 - RNA, 22 nt, Human
cucaggaggaggaaguucauug

SEQ ID NO: 1090910 - RNA, 22 nt, Human
caggacaaagcccuuugagaaa

SEQ ID NO: 1090911 - RNA, 22 nt, Human
cccugugccuaguuggccuaaa

SEQ ID NO: 1090912 - RNA, 22 nt, Human
ggagcuggucagccuugagcau

SEQ ID NO: 1090913 - RNA, 22 nt, Human
ucacagaaaaguggagagccua

SEQ ID NO: 1090914 - RNA, 20 nt, Human
cacaagagaauacacacugg

SEQ ID NO: 1090915 - RNA, 22 nt, Human
auugcuguaaauuaucuuauua

SEQ ID NO: 1090916 - RNA, 22 nt, Human
cuuccuuucagaggaaggccug

SEQ ID NO: 1090917 - RNA, 20 nt, Human
acuuuacagagaagacugac

SEQ ID NO: 1090918 - RNA, 22 nt, Human
uugaaaggcacaggcaccuggg

SEQ ID NO: 1090919 - RNA, 22 nt, Human
caguuucuacgaaggucaaccc

SEQ ID NO: 1090920 - RNA, 22 nt, Human
cucagagaagauggaugaggua

SEQ ID NO: 1090921 - RNA, 22 nt, Human
gccacguugccacccgggugac

SEQ ID NO: 1090922 - RNA, 22 nt, Human
guuuacauugcuguuugugucu

SEQ ID NO: 1090923 - RNA, 22 nt, Human
uuguagauuggagaguguguga

SEQ ID NO: 1090924 - RNA, 22 nt, Human
acaaggaacaagcauguaguuu

SEQ ID NO: 1090925 - RNA, 21 nt, Human
ccacucaugacuccacucacc

SEQ ID NO: 1090926 - RNA, 22 nt, Human
ucccagcagagccagcaagccg

SEQ ID NO: 1090927 - RNA, 22 nt, Human
aggccucacauugggcuucaag

SEQ ID NO: 1090928 - RNA, 22 nt, Human
cuggccuuuaaaaugaccuuau

SEQ ID NO: 1090929 - RNA, 22 nt, Human
ccugggaggcagagguugcagu

SEQ ID NO: 1090930 - RNA, 22 nt, Human
cucucuguuaugcuuucaugaa

SEQ ID NO: 1090931 - RNA, 16 nt, Human
agccaggcugccucgg

SEQ ID NO: 1090932 - RNA, 22 nt, Human
aauguaaacagcaagagaaggg

SEQ ID NO: 1090933 - RNA, 22 nt, Human
aucagaauggagcccacauggu

SEQ ID NO: 1090934 - RNA, 22 nt, Human
agagccacugggagacagagca

SEQ ID NO: 1090935 - RNA, 22 nt, Human
acauucuaacauuguacagaua

SEQ ID NO: 1090936 - RNA, 22 nt, Human
ugaagcaggaaacuucuuguuu

SEQ ID NO: 1090937 - RNA, 22 nt, Human
guccucugacucagccuuggga

SEQ ID NO: 1090938 - RNA, 22 nt, Human
cuuugaaaggaagccacacagc

SEQ ID NO: 1090939 - RNA, 22 nt, Human
gugcugugcgcuuuuucuguau

SEQ ID NO: 1090940 - RNA, 22 nt, Human
ugauugauggaggugauuuacc

SEQ ID NO: 1090941 - RNA, 22 nt, Human
uacauguaagacaugagacucu

SEQ ID NO: 1090942 - RNA, 22 nt, Human
gcauuucaugcuccuuggaacc

SEQ ID NO: 1090943 - RNA, 22 nt, Human
cuauaucauaaaucugaagagg

SEQ ID NO: 1090944 - RNA, 22 nt, Human
cccagugccaggcacaggcagc

SEQ ID NO: 1090945 - RNA, 22 nt, Human
gcugggagugggcaagaugaga

SEQ ID NO: 1090946 - RNA, 16 nt, Human
ucacauacuuccuugc

SEQ ID NO: 1090947 - RNA, 22 nt, Human
cuuugcuacugugaauagugcc

SEQ ID NO: 1090948 - RNA, 22 nt, Human
gaagaaggugccagaggcuuac

SEQ ID NO: 1090949 - RNA, 22 nt, Human
agaauauucaucuguauucuua

SEQ ID NO: 1090950 - RNA, 22 nt, Human
gcuggcaggauagaagucuaau

SEQ ID NO: 1090951 - RNA, 22 nt, Human
ugucucugaggugagggucagc

SEQ ID NO: 1090952 - RNA, 19 nt, Human
cuccaaauacuuuucccuu

SEQ ID NO: 1090953 - RNA, 22 nt, Human
guggucaggcagugggagagaa

SEQ ID NO: 1090954 - RNA, 22 nt, Human
cagguggguacaucacagagac

SEQ ID NO: 1090955 - RNA, 17 nt, Human
gccuuccuuccuccaca

SEQ ID NO: 1090956 - RNA, 22 nt, Human
uggaaaaaacccagacucuaga

SEQ ID NO: 1090957 - RNA, 18 nt, Human
agagaugggaguuggaaa

SEQ ID NO: 1090958 - RNA, 22 nt, Human
uuugcauuucucguaaggaaac

SEQ ID NO: 1090959 - RNA, 22 nt, Human
ggagugacucacagcugggaca

SEQ ID NO: 1090960 - RNA, 22 nt, Human
uccagggaagagcagaggcuac

SEQ ID NO: 1090961 - RNA, 22 nt, Human
ggccugagcuugggcagcguau

SEQ ID NO: 1090962 - RNA, 22 nt, Human
cuuaagcaaaauauucuuucac

SEQ ID NO: 1090963 - RNA, 22 nt, Human
gccagagcugagacacgagucc

SEQ ID NO: 1090964 - RNA, 22 nt, Human
uuucugaagggcagcagacucu

SEQ ID NO: 1090965 - RNA, 22 nt, Human
uaacagaaaagaacugaguuug

SEQ ID NO: 1090966 - RNA, 23 nt, Human
uugggcuggcucucgaugccucu

SEQ ID NO: 1090967 - RNA, 22 nt, Human
ucugaggcuauguucaggcuaa

SEQ ID NO: 1090968 - RNA, 22 nt, Human
auacaucauuucccaucaaucg

SEQ ID NO: 1090969 - RNA, 22 nt, Human
caaagcaguauuggauucuuua

SEQ ID NO: 1090970 - RNA, 22 nt, Human
gccccaggugguaaaccuaaga

SEQ ID NO: 1090971 - RNA, 22 nt, Human
auuacugaggcaaaguaguuuu

SEQ ID NO: 1090972 - RNA, 22 nt, Human
augaaaugcugagaggugcuuc

SEQ ID NO: 1090973 - RNA, 22 nt, Human
ugggucuccaguucagggcagg

SEQ ID NO: 1090974 - RNA, 22 nt, Human
uccugugugcuuucuuuagguu

SEQ ID NO: 1090975 - RNA, 22 nt, Human
caagucugaccucugggugaag

SEQ ID NO: 1090976 - RNA, 22 nt, Human
gauacauuuuaucuccuaacag

SEQ ID NO: 1090977 - RNA, 22 nt, Human
acacauuuuggcuagguggaga

SEQ ID NO: 1090978 - RNA, 22 nt, Human
gaggcucaguuaugucaucagg

SEQ ID NO: 1090979 - RNA, 22 nt, Human
uaaaauugcggugaauauuucc

SEQ ID NO: 1090980 - RNA, 22 nt, Human
cagggaagagccgaugcugcag

SEQ ID NO: 1090981 - RNA, 22 nt, Human
agccuauucaucugaucuugaa

SEQ ID NO: 1090982 - RNA, 22 nt, Human
cuuucuaaauguuccuugauua

SEQ ID NO: 1090983 - RNA, 22 nt, Human
agauauuuaaaucagacaaaga

SEQ ID NO: 1090984 - RNA, 22 nt, Human
augaggcagguggaggcugcca

SEQ ID NO: 1090985 - RNA, 22 nt, Human
cuggcugcaggaugaggcugcc

SEQ ID NO: 1090986 - RNA, 22 nt, Human
uucaaguagcuaaauuagcugc

SEQ ID NO: 1090987 - RNA, 22 nt, Human
ccuggcagcgugccgagcugcg

SEQ ID NO: 1090988 - RNA, 22 nt, Human
uggcugagaccuucccaaauuc

SEQ ID NO: 1090989 - RNA, 22 nt, Human
ugaggcagaaaauagcaguuca

SEQ ID NO: 1090990 - RNA, 22 nt, Human
uguggggaggcugcagugcugc

SEQ ID NO: 1090991 - RNA, 22 nt, Human
auuguguaauuuucagcucaua

SEQ ID NO: 1090992 - RNA, 22 nt, Human
uuuagagaauuagaacaguacu

SEQ ID NO: 1090993 - RNA, 22 nt, Human
ggccucuguuuggagccaggau

SEQ ID NO: 1090994 - RNA, 22 nt, Human
gcagaggccaggccaccagcaa

SEQ ID NO: 1090995 - RNA, 19 nt, Human
ccuggcugugaagccugca

SEQ ID NO: 1090996 - RNA, 22 nt, Human
ucuuuauuuuaugcuugugcaa

SEQ ID NO: 1090997 - RNA, 22 nt, Human
uuguccuuggaugaagcuggga

SEQ ID NO: 1090998 - RNA, 22 nt, Human
ggaagagagggcugggccucaa

SEQ ID NO: 1090999 - RNA, 19 nt, Human
uguagcaguuuaaaacaac

SEQ ID NO: 1091000 - RNA, 22 nt, Human
uggcuggcuguccagcugggca

SEQ ID NO: 1091001 - RNA, 22 nt, Human
gcucugucuucagcacacagua

SEQ ID NO: 1091002 - RNA, 22 nt, Human
gggauggcuuuguggcugacuc

SEQ ID NO: 1091003 - RNA, 18 nt, Human
caggucagccuggccuca

SEQ ID NO: 1091004 - RNA, 22 nt, Human
gacuuucugagucaaagaaagg

SEQ ID NO: 1091005 - RNA, 22 nt, Human
ggaggugggauuaggaccuaaa

SEQ ID NO: 1091006 - RNA, 22 nt, Human
cuggccagacuacacaugugug

SEQ ID NO: 1091007 - RNA, 22 nt, Human
gugccugguuuggggaguguuc

SEQ ID NO: 1091008 - RNA, 22 nt, Human
agaagugccgaaaggaagacag

SEQ ID NO: 1091009 - RNA, 22 nt, Human
gcaugucaugucauguaggaau

SEQ ID NO: 1091010 - RNA, 22 nt, Human
acaguggaugacauccuuuugc

SEQ ID NO: 1091011 - RNA, 22 nt, Human
caugggcucuucuggacugcac

SEQ ID NO: 1091012 - RNA, 22 nt, Human
agcgugaaggcgggcagucggc

SEQ ID NO: 1091013 - RNA, 22 nt, Human
gcucccagcuggagccucaaca

SEQ ID NO: 1091014 - RNA, 22 nt, Human
gaggaagagcauggccaguuuc

SEQ ID NO: 1091015 - RNA, 22 nt, Human
cugagagaaucaugcugcaggu

SEQ ID NO: 1091016 - RNA, 22 nt, Human
gaggaagaauugguuauuggag

SEQ ID NO: 1091017 - RNA, 22 nt, Human
augaagcguucgagauagguag

SEQ ID NO: 1091018 - RNA, 22 nt, Human
auggagcacacgccaucacaua

SEQ ID NO: 1091019 - RNA, 22 nt, Human
gcagggugaaggucacauagaa

SEQ ID NO: 1091020 - RNA, 17 nt, Human
cagugcagagcccuuuc

SEQ ID NO: 1091021 - RNA, 22 nt, Human
acauuugaggauguuaagaaug

SEQ ID NO: 1091022 - RNA, 22 nt, Human
gccacaugucaugugcucagua

SEQ ID NO: 1091023 - RNA, 22 nt, Human
uguaaacaugcugaggcuggag

SEQ ID NO: 1091024 - RNA, 22 nt, Human
cgcagagggcaggcagugcugg

SEQ ID NO: 1091025 - RNA, 22 nt, Human
aggcugagagcaacgugucaga

SEQ ID NO: 1091026 - RNA, 22 nt, Human
caggccuccacuccacgcagac

SEQ ID NO: 1091027 - RNA, 22 nt, Human
gagcagcuggacaggccucccu

SEQ ID NO: 1091028 - RNA, 22 nt, Human
ucugccugugcuguguuuucau

SEQ ID NO: 1091029 - RNA, 22 nt, Human
ggacucuguuuuccugaucacu

SEQ ID NO: 1091030 - RNA, 22 nt, Human
acaguuaaucaaauggcauaug

SEQ ID NO: 1091031 - RNA, 22 nt, Human
guggagccaggggcuguaggua

SEQ ID NO: 1091032 - RNA, 22 nt, Human
ucugggcugcugugcagugacc

SEQ ID NO: 1091033 - RNA, 22 nt, Human
uggagcaagcuggagagaacau

SEQ ID NO: 1091034 - RNA, 22 nt, Human
ccuccaaguuugacucaggaca

SEQ ID NO: 1091035 - RNA, 22 nt, Human
ucuccuuuaagauuuccucagg

SEQ ID NO: 1091036 - RNA, 22 nt, Human
uggcugaaggaagauucuucua

SEQ ID NO: 1091037 - RNA, 18 nt, Human
gucaccuggaucagauua

SEQ ID NO: 1091038 - RNA, 22 nt, Human
gcuuccaaugcuucuaucacau

SEQ ID NO: 1091039 - RNA, 22 nt, Human
uguuacagucauuguuuucuga

SEQ ID NO: 1091040 - RNA, 22 nt, Human
cuauugaaaguguacaauucaa

SEQ ID NO: 1091041 - RNA, 22 nt, Human
acaucucaugaaugauaaauca

SEQ ID NO: 1091042 - RNA, 22 nt, Human
auauccuuuguguaggcaauuu

SEQ ID NO: 1091043 - RNA, 22 nt, Human
uacuuuggggacaauauggaau

SEQ ID NO: 1091044 - RNA, 22 nt, Human
caagauaucaaugacauaguau

SEQ ID NO: 1091045 - RNA, 22 nt, Human
acaucuguuugagaaaaagaag

SEQ ID NO: 1091046 - RNA, 22 nt, Human
uaaauuaugucacaugacucug

SEQ ID NO: 1091047 - RNA, 22 nt, Human
cuuaggaacgcucugccuagug

SEQ ID NO: 1091048 - RNA, 22 nt, Human
cagcuucccuuggcugagcaga

SEQ ID NO: 1091049 - RNA, 22 nt, Human
cagcagcagacauuugaucuuc

SEQ ID NO: 1091050 - RNA, 22 nt, Human
auucauuccaggucagucagac

SEQ ID NO: 1091051 - RNA, 22 nt, Human
gagacagagaucuugcugaguc

SEQ ID NO: 1091052 - RNA, 19 nt, Human
uucuaccuuacuguaggcu

SEQ ID NO: 1091053 - RNA, 22 nt, Human
ugcacagugaccccuggugacu

SEQ ID NO: 1091054 - RNA, 22 nt, Human
uggacagguugaguaggaggag

SEQ ID NO: 1091055 - RNA, 22 nt, Human
ggcugugaacacucuuagcauc

SEQ ID NO: 1091056 - RNA, 22 nt, Human
agccauggcgccacuagaggga

SEQ ID NO: 1091057 - RNA, 22 nt, Human
cucugggcaggaccaguggacc

SEQ ID NO: 1091058 - RNA, 22 nt, Human
gcugagguaggagguugcagug

SEQ ID NO: 1091059 - RNA, 22 nt, Human
agauggguaacuggagucugcu

SEQ ID NO: 1091060 - RNA, 22 nt, Human
cccuguacagucucuguggcac

SEQ ID NO: 1091061 - RNA, 22 nt, Human
acuucuugggacccuggcaccg

SEQ ID NO: 1091062 - RNA, 22 nt, Human
gaaaugaaacaggcuuuuaagg

SEQ ID NO: 1091063 - RNA, 22 nt, Human
uaaggcacuucaauguuuagaa

SEQ ID NO: 1091064 - RNA, 22 nt, Human
acugucuuuauuagaaucuuau

SEQ ID NO: 1091065 - RNA, 22 nt, Human
agucuuugguuauaagagacag

SEQ ID NO: 1091066 - RNA, 22 nt, Human
gcucucugggugugucuagaua

SEQ ID NO: 1091067 - RNA, 22 nt, Human
ucuuucucucuaaucaagcaca

SEQ ID NO: 1091068 - RNA, 22 nt, Human
agccacagucaaccuguccaua

SEQ ID NO: 1091069 - RNA, 22 nt, Human
uuuacauuucccucugucaguu

SEQ ID NO: 1091070 - RNA, 22 nt, Human
uuugugugguggauacugggua

SEQ ID NO: 1091071 - RNA, 22 nt, Human
auguuuaugcaaacaugugagu

SEQ ID NO: 1091072 - RNA, 22 nt, Human
aauucuagcauugugaaaauau

SEQ ID NO: 1091073 - RNA, 22 nt, Human
uuauuauugugaccugagaaug

SEQ ID NO: 1091074 - RNA, 22 nt, Human
uguaaauaauuccuaggcuuuu

SEQ ID NO: 1091075 - RNA, 18 nt, Human
uacaugcauaaaugaagc

SEQ ID NO: 1091076 - RNA, 22 nt, Human
augauuuccaguuguugcuaag

SEQ ID NO: 1091077 - RNA, 18 nt, Human
gaggauggaaggagaugc

SEQ ID NO: 1091078 - RNA, 23 nt, Human
ucuggcucuaugugacagcucuc

SEQ ID NO: 1091079 - RNA, 22 nt, Human
auauauaaccuggauaaggcuu

SEQ ID NO: 1091080 - RNA, 22 nt, Human
acuuugaaggggaacauuuuaa

SEQ ID NO: 1091081 - RNA, 16 nt, Human
gcacacacaucaauga

SEQ ID NO: 1091082 - RNA, 22 nt, Human
cuggcaugccuugggugccucu

SEQ ID NO: 1091083 - RNA, 23 nt, Human
ugauuuccagugagucaguggga

SEQ ID NO: 1091084 - RNA, 22 nt, Human
augaggcauucacagaaggcac

SEQ ID NO: 1091085 - RNA, 22 nt, Human
uuugaaaguucuucugacacua

SEQ ID NO: 1091086 - RNA, 22 nt, Human
uaugaagaaaucuuugaaaauc

SEQ ID NO: 1091087 - RNA, 22 nt, Human
cucagagucugcauuucuguca

SEQ ID NO: 1091088 - RNA, 22 nt, Human
gggaggugauuaggaccaugua

SEQ ID NO: 1091089 - RNA, 22 nt, Human
uaguaaaucucagaaaaagauc

SEQ ID NO: 1091090 - RNA, 22 nt, Human
ccaaagucugcauuuuaacaug

SEQ ID NO: 1091091 - RNA, 22 nt, Human
cagaagcacuaggaggaaacgu

SEQ ID NO: 1091092 - RNA, 22 nt, Human
cagacagguagggacagaacau

SEQ ID NO: 1091093 - RNA, 22 nt, Human
uuucuccugcuagaacaaggag

SEQ ID NO: 1091094 - RNA, 22 nt, Human
aaaucaaaagacauguguuuua

SEQ ID NO: 1091095 - RNA, 22 nt, Human
ggagcuguucaggacugcuuca

SEQ ID NO: 1091096 - RNA, 22 nt, Human
acauucuuucaccuugugucca

SEQ ID NO: 1091097 - RNA, 22 nt, Human
uugauguugcucuuaacaguau

SEQ ID NO: 1091098 - RNA, 22 nt, Human
agaauaaaauagucugaagaug

SEQ ID NO: 1091099 - RNA, 22 nt, Human
cuguccucaccuuggcaggggg

SEQ ID NO: 1091100 - RNA, 20 nt, Human
aagcaauauagugcaaaugu

SEQ ID NO: 1091101 - RNA, 21 nt, Human
cugccuugaaugguacuggga

SEQ ID NO: 1091102 - RNA, 22 nt, Human
agggccagaugaagccacaagc

SEQ ID NO: 1091103 - RNA, 22 nt, Human
agcucuggcuaagcugauaaau

SEQ ID NO: 1091104 - RNA, 22 nt, Human
uggagcagcuaagccucugaga

SEQ ID NO: 1091105 - RNA, 22 nt, Human
cuuccaaacccaggguaugggc

SEQ ID NO: 1091106 - RNA, 22 nt, Human
gcuuugccuugaacucucaugu

SEQ ID NO: 1091107 - RNA, 22 nt, Human
ugcaauaaggaguaauaguaaa

SEQ ID NO: 1091108 - RNA, 23 nt, Human
augacaaacaggacaucuugugc

SEQ ID NO: 1091109 - RNA, 22 nt, Human
ugugguggcuauucuggucuca

SEQ ID NO: 1091110 - RNA, 22 nt, Human
caauaaagaagauuuuugcaau

SEQ ID NO: 1091111 - RNA, 22 nt, Human
cccaggaagaaauucugauuug

SEQ ID NO: 1091112 - RNA, 22 nt, Human
uccauuuucuaaguaucacuua

SEQ ID NO: 1091113 - RNA, 22 nt, Human
cucuggcuucuaccuugcaguu

SEQ ID NO: 1091114 - RNA, 22 nt, Human
cagcugaacauguagagcaucu

SEQ ID NO: 1091115 - RNA, 22 nt, Human
augcuuaauacacuguuaaagg

SEQ ID NO: 1091116 - RNA, 22 nt, Human
agaaagaacguugguuaucuua

SEQ ID NO: 1091117 - RNA, 22 nt, Human
cagcagagguuggaacaguucu

SEQ ID NO: 1091118 - RNA, 19 nt, Human
cugaggcccauguaccaug

SEQ ID NO: 1091119 - RNA, 22 nt, Human
agaaaaggcuugaagagguuuu

SEQ ID NO: 1091120 - RNA, 22 nt, Human
ggcagauggaagaggcuggguc

SEQ ID NO: 1091121 - RNA, 22 nt, Human
ucuggggagugccuaaguggaa

SEQ ID NO: 1091122 - RNA, 22 nt, Human
auuuacagugugccuacuauau

SEQ ID NO: 1091123 - RNA, 22 nt, Human
augcuguggaugccuugcccca

SEQ ID NO: 1091124 - RNA, 22 nt, Human
ucauacaauucaaucucugauu

SEQ ID NO: 1091125 - RNA, 22 nt, Human
acauguuuaaguuuaaugaaaa

SEQ ID NO: 1091126 - RNA, 22 nt, Human
cacccagcagcacuuaagacua

SEQ ID NO: 1091127 - RNA, 22 nt, Human
gacuuuaaaaguuugugcuugg

SEQ ID NO: 1091128 - RNA, 22 nt, Human
cagacagacagccguggccacc

SEQ ID NO: 1091129 - RNA, 22 nt, Human
cucaggauagcugcgcagccug

SEQ ID NO: 1091130 - RNA, 22 nt, Human
agaggcugggaaggguccccgg

SEQ ID NO: 1091131 - RNA, 20 nt, Human
uacugggcaagcccacagac

SEQ ID NO: 1091132 - RNA, 22 nt, Human
agggccaccucucuggguuccc

SEQ ID NO: 1091133 - RNA, 22 nt, Human
auuucauguugaucuuucgagg

SEQ ID NO: 1091134 - RNA, 22 nt, Human
agaauaaaugcuaccuaucaca

SEQ ID NO: 1091135 - RNA, 22 nt, Human
cagauggaacacagaaaggaga

SEQ ID NO: 1091136 - RNA, 22 nt, Human
acagaauauugguuacuguugc

SEQ ID NO: 1091137 - RNA, 22 nt, Human
uguaugaaguuacugagccucu

SEQ ID NO: 1091138 - RNA, 22 nt, Human
cagcaucaccgccauuucugau

SEQ ID NO: 1091139 - RNA, 20 nt, Human
acucuugagaaauucucugu

SEQ ID NO: 1091140 - RNA, 23 nt, Human
ugugaagguggguccaagggcug

SEQ ID NO: 1091141 - RNA, 22 nt, Human
ggagugaggcauuuguagcuga

SEQ ID NO: 1091142 - RNA, 22 nt, Human
uguuuucagucauauagcaggu

SEQ ID NO: 1091143 - RNA, 22 nt, Human
uaagacacauucauaucugucu

SEQ ID NO: 1091144 - RNA, 22 nt, Human
uuccuguaugucagugaagagc

SEQ ID NO: 1091145 - RNA, 22 nt, Human
cuucugggauuuuugaagacuc

SEQ ID NO: 1091146 - RNA, 22 nt, Human
ugcucuguugugcaugugggau

SEQ ID NO: 1091147 - RNA, 22 nt, Human
uuccauuuauucuuguccagau

SEQ ID NO: 1091148 - RNA, 22 nt, Human
ggacacagcugcagccacaccc

SEQ ID NO: 1091149 - RNA, 22 nt, Human
ggagagcaggguccugagauac

SEQ ID NO: 1091150 - RNA, 22 nt, Human
aucuguuguuuguuugcuaaag

SEQ ID NO: 1091151 - RNA, 22 nt, Human
gcugcuggcaucuagggggugg

SEQ ID NO: 1091152 - RNA, 22 nt, Human
uucagcagugcagacacccagu

SEQ ID NO: 1091153 - RNA, 22 nt, Human
auuugcagagcucugaauuuug

SEQ ID NO: 1091154 - RNA, 22 nt, Human
uuucacagugcucuguaaguau

SEQ ID NO: 1091155 - RNA, 22 nt, Human
gcuggcaggagccuuucccuuu

SEQ ID NO: 1091156 - RNA, 22 nt, Human
aacagcuguauacuguagcugu

SEQ ID NO: 1091157 - RNA, 19 nt, Human
cgcaggcuucgggucgcuc

SEQ ID NO: 1091158 - RNA, 21 nt, Human
ugguuugcggccaaaguuaaa

SEQ ID NO: 1091159 - RNA, 22 nt, Human
ucucauuuacuuccacaggcug

SEQ ID NO: 1091160 - RNA, 22 nt, Human
aggaaagguucagugauugaaa

SEQ ID NO: 1091161 - RNA, 22 nt, Human
uggaagaaggcagagaggcauu

SEQ ID NO: 1091162 - RNA, 22 nt, Human
gccucugcucucagguagccuc

SEQ ID NO: 1091163 - RNA, 21 nt, Human
uggcagagugcagucuauaca

SEQ ID NO: 1091164 - RNA, 22 nt, Human
ggccugcucugcagccucuaca

SEQ ID NO: 1091165 - RNA, 22 nt, Human
ucugaaaucuaaugcucugugg

SEQ ID NO: 1091166 - RNA, 22 nt, Human
aucuacagccagucugguuugu

SEQ ID NO: 1091167 - RNA, 22 nt, Human
uaauacugacuaaagauaucaa

SEQ ID NO: 1091168 - RNA, 22 nt, Human
cagaacugggcucgcucugguu

SEQ ID NO: 1091169 - RNA, 22 nt, Human
cugcuguguuccuccugcaucu

SEQ ID NO: 1091170 - RNA, 22 nt, Human
agagggcaugcuugguggccug

SEQ ID NO: 1091171 - RNA, 22 nt, Human
uggcagaguucgcuccuauuca

SEQ ID NO: 1091172 - RNA, 22 nt, Human
gcugccugauguccagcaggac

SEQ ID NO: 1091173 - RNA, 22 nt, Human
cuguuuguuggcuauugacagu

SEQ ID NO: 1091174 - RNA, 22 nt, Human
ugggcuguggagcaccuuugca

SEQ ID NO: 1091175 - RNA, 22 nt, Human
ugggaagaggcgggaggcuguu

SEQ ID NO: 1091176 - RNA, 22 nt, Human
uccucaggcugccuggaagacu

SEQ ID NO: 1091177 - RNA, 22 nt, Human
agcagcaggagccgugggguga

SEQ ID NO: 1091178 - RNA, 22 nt, Human
auuucuagaggcagcuucuagg

SEQ ID NO: 1091179 - RNA, 19 nt, Human
gauauugcuugaguaacug

SEQ ID NO: 1091180 - RNA, 22 nt, Human
uggagcagagaugggagcccaa

SEQ ID NO: 1091181 - RNA, 23 nt, Human
aggaacugaggccuagggaggua

SEQ ID NO: 1091182 - RNA, 21 nt, Human
ccaugucagaugugggcugug

SEQ ID NO: 1091183 - RNA, 22 nt, Human
acagaugagauucauugaccac

SEQ ID NO: 1091184 - RNA, 22 nt, Human
acaugauauaugggaaaugcuu

SEQ ID NO: 1091185 - RNA, 22 nt, Human
uaaugacuaagcaucauuaaac

SEQ ID NO: 1091186 - RNA, 22 nt, Human
ccagggcauccucacaucgcag

SEQ ID NO: 1091187 - RNA, 17 nt, Human
uuggaccagauucuaaa

SEQ ID NO: 1091188 - RNA, 22 nt, Human
agugcugucccgacaacugagg

SEQ ID NO: 1091189 - RNA, 22 nt, Human
ccaggaaugaaauguagauaaa

SEQ ID NO: 1091190 - RNA, 22 nt, Human
ucuguuuucauuugucuugaga

SEQ ID NO: 1091191 - RNA, 22 nt, Human
ugacaugaaacuguguugcuac

SEQ ID NO: 1091192 - RNA, 22 nt, Human
auuaauauuugcaccuucuguc

SEQ ID NO: 1091193 - RNA, 22 nt, Human
cucacugacgaggaagcugaga

SEQ ID NO: 1091194 - RNA, 22 nt, Human
cuugaaagcacuuaguaaauua

SEQ ID NO: 1091195 - RNA, 22 nt, Human
gacaggguacgggcuaggcaca

SEQ ID NO: 1091196 - RNA, 22 nt, Human
aagcuaauuguacuucucacag

SEQ ID NO: 1091197 - RNA, 22 nt, Human
agaguggggaagguguugagaa

SEQ ID NO: 1091198 - RNA, 22 nt, Human
agagcugaggauccagcugagc

SEQ ID NO: 1091199 - RNA, 22 nt, Human
aauacuggcugucaaagaugga

SEQ ID NO: 1091200 - RNA, 22 nt, Human
cacuagaaccaaugacauuucu

SEQ ID NO: 1091201 - RNA, 22 nt, Human
aggcccaguagugcugccuuua

SEQ ID NO: 1091202 - RNA, 19 nt, Human
aggugaggggcaccauguc

SEQ ID NO: 1091203 - RNA, 22 nt, Human
ugcccaaggucaccuaguuagu

SEQ ID NO: 1091204 - RNA, 22 nt, Human
acagugauugguuuggggguga

SEQ ID NO: 1091205 - RNA, 22 nt, Human
ggcucugaccucccaggcaguu

SEQ ID NO: 1091206 - RNA, 22 nt, Human
acccagcucuuugauggucuug

SEQ ID NO: 1091207 - RNA, 22 nt, Human
gagaggccaaaaucccugcccc

SEQ ID NO: 1091208 - RNA, 22 nt, Human
cucagagaggcaguggaaguca

SEQ ID NO: 1091209 - RNA, 22 nt, Human
cugucaccuguucacugcagca

SEQ ID NO: 1091210 - RNA, 22 nt, Human
cagauggcugccaagaugggcu

SEQ ID NO: 1091211 - RNA, 18 nt, Human
uauauuucacacauauuc

SEQ ID NO: 1091212 - RNA, 22 nt, Human
gaggcuggcagaaaagcacagg

SEQ ID NO: 1091213 - RNA, 22 nt, Human
auuuauuaccucggaguuucug

SEQ ID NO: 1091214 - RNA, 16 nt, Human
uuuccaaagggcagcu

SEQ ID NO: 1091215 - RNA, 22 nt, Human
augauuuuuucuaacacagucg

SEQ ID NO: 1091216 - RNA, 22 nt, Human
cuccaaauacaauauuguuguu

SEQ ID NO: 1091217 - RNA, 22 nt, Human
gaggcucaaaccuggacagagc

SEQ ID NO: 1091218 - RNA, 22 nt, Human
ccuuggaggacugcugcuucuu

SEQ ID NO: 1091219 - RNA, 22 nt, Human
ucagggacauuuagacacugau

SEQ ID NO: 1091220 - RNA, 22 nt, Human
ccaggagcaccaggccugugcc

SEQ ID NO: 1091221 - RNA, 22 nt, Human
aacacaguuuuccaaaauagag

SEQ ID NO: 1091222 - RNA, 22 nt, Human
cccagcaguuguuggugcacau

SEQ ID NO: 1091223 - RNA, 22 nt, Human
gacuuucuaaugcucuguagau

SEQ ID NO: 1091224 - RNA, 22 nt, Human
ggcaggcuggcuuuguuccagg

SEQ ID NO: 1091225 - RNA, 22 nt, Human
cugccugggccggccacccucu

SEQ ID NO: 1091226 - RNA, 22 nt, Human
guuugcaaagaucauuuucucc

SEQ ID NO: 1091227 - RNA, 22 nt, Human
aggaaaaauaaggcagcagggc

SEQ ID NO: 1091228 - RNA, 22 nt, Human
gcuggccagggcugcucgcgga

SEQ ID NO: 1091229 - RNA, 22 nt, Human
cuguacagaagcuagagcaaau

SEQ ID NO: 1091230 - RNA, 22 nt, Human
aaggccagaguacuagaggcug

SEQ ID NO: 1091231 - RNA, 23 nt, Human
auucuaagaugugaucuuauaac

SEQ ID NO: 1091232 - RNA, 22 nt, Human
uuauaacaucaaucagaguuaa

SEQ ID NO: 1091233 - RNA, 22 nt, Human
ucucaguggacgugucugucuu

SEQ ID NO: 1091234 - RNA, 22 nt, Human
ucugccugaaccacucuuggag

SEQ ID NO: 1091235 - RNA, 22 nt, Human
cccucugaccuccugccacagu

SEQ ID NO: 1091236 - RNA, 20 nt, Human
agccaauacagcaaaauuug

SEQ ID NO: 1091237 - RNA, 22 nt, Human
agccaggauuggcugagccuua

SEQ ID NO: 1091238 - RNA, 22 nt, Human
ugaggccugaagccuggagccu

SEQ ID NO: 1091239 - RNA, 22 nt, Human
ucccugccuccuggcagugcca

SEQ ID NO: 1091240 - RNA, 22 nt, Human
ucacugggagaugugggaaggg

SEQ ID NO: 1091241 - RNA, 22 nt, Human
cucugggcaaagaugccucauc

SEQ ID NO: 1091242 - RNA, 22 nt, Human
ugggaagcuacucaugcaggca

SEQ ID NO: 1091243 - RNA, 22 nt, Human
gagaaaaucuugggucaagaau

SEQ ID NO: 1091244 - RNA, 22 nt, Human
uacaguaaucuggacaugauuu

SEQ ID NO: 1091245 - RNA, 22 nt, Human
cugccucuggccucaggcccag

SEQ ID NO: 1091246 - RNA, 22 nt, Human
ccuggcugagggaccucgggua

SEQ ID NO: 1091247 - RNA, 22 nt, Human
auacuuccugcuucccugaucu

SEQ ID NO: 1091248 - RNA, 22 nt, Human
agcugggaugauaaccucaguc

SEQ ID NO: 1091249 - RNA, 22 nt, Human
augggcagcagcugccauucau

SEQ ID NO: 1091250 - RNA, 19 nt, Human
acugccugcagguguuggg

SEQ ID NO: 1091251 - RNA, 22 nt, Human
gggaagggagggaccucagucu

SEQ ID NO: 1091252 - RNA, 22 nt, Human
ccaggagagcauugcacagagg

SEQ ID NO: 1091253 - RNA, 22 nt, Human
ucacacaucucagguguuuaau

SEQ ID NO: 1091254 - RNA, 22 nt, Human
aagaaagauaagguuugcuugg

SEQ ID NO: 1091255 - RNA, 22 nt, Human
gccugccucaaaaucccaguuc

SEQ ID NO: 1091256 - RNA, 22 nt, Human
aauuucacauaaggcucauugg

SEQ ID NO: 1091257 - RNA, 20 nt, Human
cucagcuaaacaacacugac

SEQ ID NO: 1091258 - RNA, 22 nt, Human
ucagagucauugcaaguagaag

SEQ ID NO: 1091259 - RNA, 19 nt, Human
ucaguggagaaaggggaag

SEQ ID NO: 1091260 - RNA, 22 nt, Human
auuuuuuguuaacucaggauag

SEQ ID NO: 1091261 - RNA, 22 nt, Human
aaauuguccuuuuaagaaacag

SEQ ID NO: 1091262 - RNA, 21 nt, Human
uguucacauggagcagaaugu

SEQ ID NO: 1091263 - RNA, 22 nt, Human
auuccugauuaacgaccuuuca

SEQ ID NO: 1091264 - RNA, 22 nt, Human
gggcugccugagcaucuccucc

SEQ ID NO: 1091265 - RNA, 22 nt, Human
gcguaaggccucuggucucgga

SEQ ID NO: 1091266 - RNA, 22 nt, Human
gaagucugcugcucaggaguuu

SEQ ID NO: 1091267 - RNA, 22 nt, Human
ggcagcagggcugucucccuac

SEQ ID NO: 1091268 - RNA, 22 nt, Human
uaaagcagucuguguaugugaa

SEQ ID NO: 1091269 - RNA, 22 nt, Human
uuucuaagugaacauucaaguu

SEQ ID NO: 1091270 - RNA, 22 nt, Human
uuacaaagugcugcaccauuuu

SEQ ID NO: 1091271 - RNA, 22 nt, Human
uuucacauguggaaugccaggu

SEQ ID NO: 1091272 - RNA, 17 nt, Human
ggugaguguccaggugg

SEQ ID NO: 1091273 - RNA, 20 nt, Human
auguagaugaaagcaaaggc

SEQ ID NO: 1091274 - RNA, 22 nt, Human
cagcucucacacccuccuccca

SEQ ID NO: 1091275 - RNA, 22 nt, Human
ggggcagaaguagugccccuga

SEQ ID NO: 1091276 - RNA, 22 nt, Human
acacugaauguuuaagaacuug

SEQ ID NO: 1091277 - RNA, 22 nt, Human
ccagagccggcucccucagcuu

SEQ ID NO: 1091278 - RNA, 22 nt, Human
acauucaccacacuuauagggc

SEQ ID NO: 1091279 - RNA, 22 nt, Human
ucucagugcagagaggcuaucu

SEQ ID NO: 1091280 - RNA, 17 nt, Human
gcuuccucaugcaguuc

SEQ ID NO: 1091281 - RNA, 22 nt, Human
uuuacuaagcccaguuauaugc

SEQ ID NO: 1091282 - RNA, 22 nt, Human
gcuggcaucacuggcuucggug

SEQ ID NO: 1091283 - RNA, 22 nt, Human
ucauuuaaaauguaccaggauu

SEQ ID NO: 1091284 - RNA, 22 nt, Human
gugcagugagcagugcagcacc

SEQ ID NO: 1091285 - RNA, 22 nt, Human
aguggcagagccaagauaugau

SEQ ID NO: 1091286 - RNA, 22 nt, Human
gugcuuucugcugcauuccucu

SEQ ID NO: 1091287 - RNA, 22 nt, Human
ccaggcagagggauccccaucc

SEQ ID NO: 1091288 - RNA, 22 nt, Human
caggggcugugggcggagccuc

SEQ ID NO: 1091289 - RNA, 21 nt, Human
uccuguaagcuuggguggcuc

SEQ ID NO: 1091290 - RNA, 22 nt, Human
gcacugcaucuacuggcaagua

SEQ ID NO: 1091291 - RNA, 22 nt, Human
cagauuuugaugaauguggaaa

SEQ ID NO: 1091292 - RNA, 22 nt, Human
ccagcuggggaaguggggcaua

SEQ ID NO: 1091293 - RNA, 22 nt, Human
gcaggagcaaacugcagugugg

SEQ ID NO: 1091294 - RNA, 22 nt, Human
cuccuuaaagggagcagcagcu

SEQ ID NO: 1091295 - RNA, 22 nt, Human
gagcagcugagcuggaaugaga

SEQ ID NO: 1091296 - RNA, 22 nt, Human
agcuggcagggguucacacugc

SEQ ID NO: 1091297 - RNA, 22 nt, Human
gagucugagucuaauggcccca

SEQ ID NO: 1091298 - RNA, 22 nt, Human
uuucucuggccucaguuuaaca

SEQ ID NO: 1091299 - RNA, 22 nt, Human
aggagcugugaaugggaggggu

SEQ ID NO: 1091300 - RNA, 22 nt, Human
aggauacaagucucagaaugcu

SEQ ID NO: 1091301 - RNA, 22 nt, Human
ggagucagaauggcaggguggu

SEQ ID NO: 1091302 - RNA, 22 nt, Human
guguuuggucagacguccgggg

SEQ ID NO: 1091303 - RNA, 22 nt, Human
aucaggaugacaacugcugggu

SEQ ID NO: 1091304 - RNA, 22 nt, Human
gcagccagggagagaaccaggg

SEQ ID NO: 1091305 - RNA, 22 nt, Human
acaauuucugaucagugaauuu

SEQ ID NO: 1091306 - RNA, 22 nt, Human
ugccuaggaaaccucaugcuuc

SEQ ID NO: 1091307 - RNA, 22 nt, Human
ccagcuccucuucccaguguca

SEQ ID NO: 1091308 - RNA, 18 nt, Human
ugucauugccagggaagc

SEQ ID NO: 1091309 - RNA, 22 nt, Human
uauuugaagacagggucuuuaa

SEQ ID NO: 1091310 - RNA, 22 nt, Human
cagucccagacccagaaggugg

SEQ ID NO: 1091311 - RNA, 22 nt, Human
uucuaaaaccaauucugcuucu

SEQ ID NO: 1091312 - RNA, 22 nt, Human
ugcugcugacauuuggggcuug

SEQ ID NO: 1091313 - RNA, 21 nt, Human
gcagccagccgagaccaugcc

SEQ ID NO: 1091314 - RNA, 22 nt, Human
uuucuucaauugcuaacaagga

SEQ ID NO: 1091315 - RNA, 22 nt, Human
uggcugagagcaauugacucug

SEQ ID NO: 1091316 - RNA, 22 nt, Human
cuguccuguggaccugaggacg

SEQ ID NO: 1091317 - RNA, 22 nt, Human
cacuguccaauagauacauaau

SEQ ID NO: 1091318 - RNA, 22 nt, Human
uuaugacaggaaaaucacagaa

SEQ ID NO: 1091319 - RNA, 22 nt, Human
gcuaucuucauggaaauacagg

SEQ ID NO: 1091320 - RNA, 22 nt, Human
uugugaaacauucauggauuug

SEQ ID NO: 1091321 - RNA, 22 nt, Human
caugggcugaaaaucugcaaac

SEQ ID NO: 1091322 - RNA, 22 nt, Human
ucuagaaaaaaacugcugugga

SEQ ID NO: 1091323 - RNA, 22 nt, Human
gaggcugggaaguccaagacca

SEQ ID NO: 1091324 - RNA, 22 nt, Human
auuuauugaagcuuauuacguu

SEQ ID NO: 1091325 - RNA, 22 nt, Human
uuuccaaauaaggucacauucu

SEQ ID NO: 1091326 - RNA, 22 nt, Human
uuggaaaugcauuuguuauuau

SEQ ID NO: 1091327 - RNA, 22 nt, Human
uagagcuagcuucaaaaugcga

SEQ ID NO: 1091328 - RNA, 22 nt, Human
cagcuguugucaccucacaucc

SEQ ID NO: 1091329 - RNA, 22 nt, Human
uuucuauaugaggagcuaaagu

SEQ ID NO: 1091330 - RNA, 22 nt, Human
accuucaauuauuuuuguucca

SEQ ID NO: 1091331 - RNA, 22 nt, Human
ugcuuucaaaggcuuucuagau

SEQ ID NO: 1091332 - RNA, 22 nt, Human
gggaaggagccugcuugcuaga

SEQ ID NO: 1091333 - RNA, 22 nt, Human
ugcuagaauaccuaccuggagg

SEQ ID NO: 1091334 - RNA, 22 nt, Human
guaugaaggcgagagcccacua

SEQ ID NO: 1091335 - RNA, 22 nt, Human
ccaggcucagcgcgcacgucug

SEQ ID NO: 1091336 - RNA, 22 nt, Human
gaaauacaauuuugucccagcu

SEQ ID NO: 1091337 - RNA, 22 nt, Human
auggagggugucagagagcgaa

SEQ ID NO: 1091338 - RNA, 22 nt, Human
augaaaauacugugguugauag

SEQ ID NO: 1091339 - RNA, 22 nt, Human
uuacacaaguucuuuaaccuau

SEQ ID NO: 1091340 - RNA, 22 nt, Human
ggccaggcugguuccuugaccu

SEQ ID NO: 1091341 - RNA, 16 nt, Human
cauauugcugaaagag

SEQ ID NO: 1091342 - RNA, 22 nt, Human
gcagugggaagguuggcacaug

SEQ ID NO: 1091343 - RNA, 22 nt, Human
ggcagccagcaaugagaaguuu

SEQ ID NO: 1091344 - RNA, 22 nt, Human
acagagcaguaagaacacagcu

SEQ ID NO: 1091345 - RNA, 22 nt, Human
agcccugcacaggucuguggcu

SEQ ID NO: 1091346 - RNA, 22 nt, Human
agugacagcugggaaggugaaa

SEQ ID NO: 1091347 - RNA, 22 nt, Human
agauucuacucuagauccaugg

SEQ ID NO: 1091348 - RNA, 22 nt, Human
acaauguucucugaguugugug

SEQ ID NO: 1091349 - RNA, 18 nt, Human
uggcucagauggcuuuaa

SEQ ID NO: 1091350 - RNA, 22 nt, Human
ugccccugaccucaggcgaagg

SEQ ID NO: 1091351 - RNA, 22 nt, Human
aagcaugcaaucugugauaagg

SEQ ID NO: 1091352 - RNA, 22 nt, Human
agaagccaauucugugugaguc

SEQ ID NO: 1091353 - RNA, 22 nt, Human
uucuucuucuggcugcaccugg

SEQ ID NO: 1091354 - RNA, 22 nt, Human
ccaaaggccaggcacugagguu

SEQ ID NO: 1091355 - RNA, 22 nt, Human
agcaccugucacaagcagaagg

SEQ ID NO: 1091356 - RNA, 23 nt, Human
agccacuucuaucuugcuccugg

SEQ ID NO: 1091357 - RNA, 22 nt, Human
ccaggguggggcaggcccacug

SEQ ID NO: 1091358 - RNA, 22 nt, Human
aggcugcagaacagucaggugc

SEQ ID NO: 1091359 - RNA, 22 nt, Human
aaauaauugaguuggucaauau

SEQ ID NO: 1091360 - RNA, 22 nt, Human
uugcaaggguguuuugaggugu

SEQ ID NO: 1091361 - RNA, 22 nt, Human
auacuguuuugugacuuaucuu

SEQ ID NO: 1091362 - RNA, 22 nt, Human
agcaggagcccuuaucaccagg

SEQ ID NO: 1091363 - RNA, 22 nt, Human
ugucuguaagguguuuauguua

SEQ ID NO: 1091364 - RNA, 22 nt, Human
ccugccuggcugucagcagagc

SEQ ID NO: 1091365 - RNA, 22 nt, Human
gcugagggcuguaacagcagag

SEQ ID NO: 1091366 - RNA, 22 nt, Human
ggcugucaauucauaggucaga

SEQ ID NO: 1091367 - RNA, 22 nt, Human
acuggcagcuguaggaugcaug

SEQ ID NO: 1091368 - RNA, 22 nt, Human
ggcugggagcuggacaggccgg

SEQ ID NO: 1091369 - RNA, 22 nt, Human
aguaaaacagagaaaucacuca

SEQ ID NO: 1091370 - RNA, 22 nt, Human
aggaucaaguugguugagcuuu

SEQ ID NO: 1091371 - RNA, 23 nt, Human
gggaaguggggauuugaagucau

SEQ ID NO: 1091372 - RNA, 22 nt, Human
ugcuucagaggaaaggcaaaag

SEQ ID NO: 1091373 - RNA, 22 nt, Human
acagcaggauuuggcgauguug

SEQ ID NO: 1091374 - RNA, 22 nt, Human
ucaaagcagcacauucgcaagc

SEQ ID NO: 1091375 - RNA, 22 nt, Human
agcaguggagcgagauguuuaa

SEQ ID NO: 1091376 - RNA, 23 nt, Human
uguaucuguacuauuccugccuc

SEQ ID NO: 1091377 - RNA, 22 nt, Human
ugcuucuguuuguuucugucau

SEQ ID NO: 1091378 - RNA, 22 nt, Human
gcuccugggcucuaccuugcua

SEQ ID NO: 1091379 - RNA, 22 nt, Human
gaaguuagucauugaagcccca

SEQ ID NO: 1091380 - RNA, 19 nt, Human
ucugugcugggaggcagca

SEQ ID NO: 1091381 - RNA, 20 nt, Human
cccagccccuaccuguugcc

SEQ ID NO: 1091382 - RNA, 22 nt, Human
cccuggagcaucucugcugucu

SEQ ID NO: 1091383 - RNA, 22 nt, Human
ucagaaucugcauuuaacaaaa

SEQ ID NO: 1091384 - RNA, 22 nt, Human
aggcaagggggcgccaccuucc

SEQ ID NO: 1091385 - RNA, 22 nt, Human
uccucuuuaaaugcuuuuaucu

SEQ ID NO: 1091386 - RNA, 22 nt, Human
gccugccuuugugaggaagcgg

SEQ ID NO: 1091387 - RNA, 22 nt, Human
gagagucuaggaaccucauaua

SEQ ID NO: 1091388 - RNA, 22 nt, Human
aucuuucaguuucauaccaauu

SEQ ID NO: 1091389 - RNA, 21 nt, Human
gcagccacagccaccaagcua

SEQ ID NO: 1091390 - RNA, 22 nt, Human
agugcccuggcccagcuggacc

SEQ ID NO: 1091391 - RNA, 22 nt, Human
uggcuuccuggacagaugcggu

SEQ ID NO: 1091392 - RNA, 21 nt, Human
agcaggcuuuggaguggggcu

SEQ ID NO: 1091393 - RNA, 22 nt, Human
cagcugauuugagaaagaauga

SEQ ID NO: 1091394 - RNA, 22 nt, Human
augaagcuguuuauuuuagcag

SEQ ID NO: 1091395 - RNA, 22 nt, Human
ccuaggccuuacuuuccugugc

SEQ ID NO: 1091396 - RNA, 22 nt, Human
cugggcugcgguucucugaagc

SEQ ID NO: 1091397 - RNA, 22 nt, Human
acacugaaugcuguuuagaaau

SEQ ID NO: 1091398 - RNA, 22 nt, Human
agacugaauaacaagcaaauaa

SEQ ID NO: 1091399 - RNA, 22 nt, Human
aguguuucccaguaggaugaaa

SEQ ID NO: 1091400 - RNA, 18 nt, Human
gaaaugugauucuagggc

SEQ ID NO: 1091401 - RNA, 22 nt, Human
cugccuggggaaugugaggauu

SEQ ID NO: 1091402 - RNA, 22 nt, Human
cugagccuguguuucucuggca

SEQ ID NO: 1091403 - RNA, 22 nt, Human
uccacugcagcuucugauggaa

SEQ ID NO: 1091404 - RNA, 22 nt, Human
uaaaucaagaauaucagcuugu

SEQ ID NO: 1091405 - RNA, 22 nt, Human
gagcagcugguaggugaaccca

SEQ ID NO: 1091406 - RNA, 22 nt, Human
gauauugcaccucuaauacauu

SEQ ID NO: 1091407 - RNA, 22 nt, Human
uucugucuguaaacuucucaau

SEQ ID NO: 1091408 - RNA, 22 nt, Human
agcucacaguguccuuccucaa

SEQ ID NO: 1091409 - RNA, 22 nt, Human
aaggagaaggcaucauucaagu

SEQ ID NO: 1091410 - RNA, 22 nt, Human
uaagcauucaaugcuuagcacu

SEQ ID NO: 1091411 - RNA, 20 nt, Human
gcaggcagggaaugggggug

SEQ ID NO: 1091412 - RNA, 22 nt, Human
gaagaagggagugcguguaaua

SEQ ID NO: 1091413 - RNA, 22 nt, Human
gucaggagauagggcaagcuuc

SEQ ID NO: 1091414 - RNA, 22 nt, Human
agugaaaaccuaaucaugcagu

SEQ ID NO: 1091415 - RNA, 22 nt, Human
uuucaugauccauuuacaaaau

SEQ ID NO: 1091416 - RNA, 22 nt, Human
uguuuauugcugcaauugugcc

SEQ ID NO: 1091417 - RNA, 17 nt, Human
cauaaaacaguucuauu

SEQ ID NO: 1091418 - RNA, 22 nt, Human
acuuuauuuccuauugcaucca

SEQ ID NO: 1091419 - RNA, 22 nt, Human
gaggcagaaguugcagugagca

SEQ ID NO: 1091420 - RNA, 22 nt, Human
acuaggaaguggcaaaacugga

SEQ ID NO: 1091421 - RNA, 22 nt, Human
uuuugguaauuaaguagauauu

SEQ ID NO: 1091422 - RNA, 22 nt, Human
uguuugaauaacuuggauauau

SEQ ID NO: 1091423 - RNA, 21 nt, Human
ggcagaaguagcauggacggg

SEQ ID NO: 1091424 - RNA, 22 nt, Human
aaguacauauauuuaugauucu

SEQ ID NO: 1091425 - RNA, 22 nt, Human
guguggggucuucucuuggccu

SEQ ID NO: 1091426 - RNA, 22 nt, Human
aggcacuuuaggaucagguuga

SEQ ID NO: 1091427 - RNA, 22 nt, Human
uucuaaaauaaguuuaucuggu

SEQ ID NO: 1091428 - RNA, 22 nt, Human
cuauucagguguccauuaaucc

SEQ ID NO: 1091429 - RNA, 22 nt, Human
ccugccugaaggucagccaccc

SEQ ID NO: 1091430 - RNA, 22 nt, Human
gauuccuuggcucugucucagg

SEQ ID NO: 1091431 - RNA, 22 nt, Human
cacauguuuggcaugucaccaa

SEQ ID NO: 1091432 - RNA, 22 nt, Human
ucuccucucuuaccugguacaa

SEQ ID NO: 1091433 - RNA, 22 nt, Human
gucuggaguggggccugagaau

SEQ ID NO: 1091434 - RNA, 22 nt, Human
gaagccaguguuugaagaauuu

SEQ ID NO: 1091435 - RNA, 22 nt, Human
uauugacagagggucagaagag

SEQ ID NO: 1091436 - RNA, 22 nt, Human
agaaacaacuuguuucucuugc

SEQ ID NO: 1091437 - RNA, 22 nt, Human
acaugaagcaagaaagaugcua

SEQ ID NO: 1091438 - RNA, 22 nt, Human
uauuuucuggggagagugaacc

SEQ ID NO: 1091439 - RNA, 22 nt, Human
ucacagaaacagaauggcacag

SEQ ID NO: 1091440 - RNA, 22 nt, Human
ucuaauccuugcuaccugggug

SEQ ID NO: 1091441 - RNA, 22 nt, Human
gucccuggaauggacucugcgc

SEQ ID NO: 1091442 - RNA, 22 nt, Human
gucugcccucacgccagcuggg

SEQ ID NO: 1091443 - RNA, 22 nt, Human
caggcaggugcagauuccucuu

SEQ ID NO: 1091444 - RNA, 22 nt, Human
uuaagcuaauuaguuccagcau

SEQ ID NO: 1091445 - RNA, 20 nt, Human
cuucaggacccauccucccc

SEQ ID NO: 1091446 - RNA, 22 nt, Human
ugaaggagcugauguaaggggu

SEQ ID NO: 1091447 - RNA, 22 nt, Human
auuguuaaaguaauaaccaugg

SEQ ID NO: 1091448 - RNA, 22 nt, Human
acagucucuccacacugcaggg

SEQ ID NO: 1091449 - RNA, 22 nt, Human
ucacuguaaaguaauacuguca

SEQ ID NO: 1091450 - RNA, 23 nt, Human
aaaaucuucugccuaugaagaaa

SEQ ID NO: 1091451 - RNA, 22 nt, Human
gcacugaacuuuaaucauuucu

SEQ ID NO: 1091452 - RNA, 22 nt, Human
ccaggaggcagagguuacagug

SEQ ID NO: 1091453 - RNA, 17 nt, Human
agggucaggugaaguuc

SEQ ID NO: 1091454 - RNA, 22 nt, Human
aaccaacauaggaaugcagaga

SEQ ID NO: 1091455 - RNA, 22 nt, Human
uggcacugccaaccugcuaggu

SEQ ID NO: 1091456 - RNA, 22 nt, Human
cagagaccccgcugcccuucug

SEQ ID NO: 1091457 - RNA, 22 nt, Human
caguaacagugaucaccugugg

SEQ ID NO: 1091458 - RNA, 22 nt, Human
auauaaagaaguggaaaaugag

SEQ ID NO: 1091459 - RNA, 20 nt, Human
cuaucuccuggcgugccuuc

SEQ ID NO: 1091460 - RNA, 22 nt, Human
aggagccaagcagaacuaagga

SEQ ID NO: 1091461 - RNA, 22 nt, Human
ucaggagaaucagggcuguccu

SEQ ID NO: 1091462 - RNA, 22 nt, Human
aacuaaaacugguuuguucucu

SEQ ID NO: 1091463 - RNA, 22 nt, Human
ccuggcuguuugagcggggaau

SEQ ID NO: 1091464 - RNA, 22 nt, Human
auucccaucgucaacuucacug

SEQ ID NO: 1091465 - RNA, 22 nt, Human
gggcucucgauuagacccuggg

SEQ ID NO: 1091466 - RNA, 22 nt, Human
uuuuccagauggauacuagaau

SEQ ID NO: 1091467 - RNA, 22 nt, Human
auuauauugaguauaaccagag

SEQ ID NO: 1091468 - RNA, 22 nt, Human
uuuuauucaaauaguucacacu

SEQ ID NO: 1091469 - RNA, 22 nt, Human
gcuucugggguucuggcaugcu

SEQ ID NO: 1091470 - RNA, 22 nt, Human
gcagggcagcucacugugguuc

SEQ ID NO: 1091471 - RNA, 22 nt, Human
acaaggcucuaauuucauugaa

SEQ ID NO: 1091472 - RNA, 22 nt, Human
uguuaccaaaaucuuguauauc

SEQ ID NO: 1091473 - RNA, 19 nt, Human
uaaaaugucuguggucagu

SEQ ID NO: 1091474 - RNA, 22 nt, Human
ucuuuucuagcaaauccaggag

SEQ ID NO: 1091475 - RNA, 22 nt, Human
uccucuuccuucuguccaaaug

SEQ ID NO: 1091476 - RNA, 22 nt, Human
cuggggcagagcccagcaauuu

SEQ ID NO: 1091477 - RNA, 22 nt, Human
acagacauucagcuaagucuau

SEQ ID NO: 1091478 - RNA, 22 nt, Human
auucauaacggcaaaugucacc

SEQ ID NO: 1091479 - RNA, 23 nt, Human
cagaccuggcagucauccucaac

SEQ ID NO: 1091480 - RNA, 22 nt, Human
ugccugcagcgucuccagcagg

SEQ ID NO: 1091481 - RNA, 22 nt, Human
agcucccauuaucuucugaaac

SEQ ID NO: 1091482 - RNA, 22 nt, Human
auuuggacauuuacaauaguga

SEQ ID NO: 1091483 - RNA, 22 nt, Human
gcacagaaccagacaugaggca

SEQ ID NO: 1091484 - RNA, 22 nt, Human
ucacagaacacaaaugccacuu

SEQ ID NO: 1091485 - RNA, 22 nt, Human
gcaggcuccaacuggaggaguu

SEQ ID NO: 1091486 - RNA, 22 nt, Human
ccagggugugggcgucggcacg

SEQ ID NO: 1091487 - RNA, 17 nt, Human
ucuucgggcgcuaggua

SEQ ID NO: 1091488 - RNA, 22 nt, Human
ucagaguccaugguacuuaauu

SEQ ID NO: 1091489 - RNA, 22 nt, Human
uggcccugacacgugguacugg

SEQ ID NO: 1091490 - RNA, 22 nt, Human
agcaggcuuguuaugucugaga

SEQ ID NO: 1091491 - RNA, 22 nt, Human
ugcagcaauuuuuuaggcauuc

SEQ ID NO: 1091492 - RNA, 22 nt, Human
cuuugcaugggucugaaggcuu

SEQ ID NO: 1091493 - RNA, 22 nt, Human
uuccugaugcacacagucauuu

SEQ ID NO: 1091494 - RNA, 22 nt, Human
uguggagacuauagccauaaca

SEQ ID NO: 1091495 - RNA, 22 nt, Human
ugggaauacaaguuauucaccu

SEQ ID NO: 1091496 - RNA, 22 nt, Human
caguuuuaggacauguggaugu

SEQ ID NO: 1091497 - RNA, 22 nt, Human
uucugagaaggcuguggacaca

SEQ ID NO: 1091498 - RNA, 22 nt, Human
gucauuucuguuucuucagugc

SEQ ID NO: 1091499 - RNA, 17 nt, Human
agcagcuggguugaucu

SEQ ID NO: 1091500 - RNA, 22 nt, Human
aaacacagggauauauauucca

SEQ ID NO: 1091501 - RNA, 22 nt, Human
cuauaaaucuacccagcauugg

SEQ ID NO: 1091502 - RNA, 22 nt, Human
acuacauuucucaguaccugaa

SEQ ID NO: 1091503 - RNA, 22 nt, Human
acugggcuuauuucuugugaac

SEQ ID NO: 1091504 - RNA, 22 nt, Human
uucauuuggccucugcuuaaaa

SEQ ID NO: 1091505 - RNA, 22 nt, Human
caacaucaguccucaugagaca

SEQ ID NO: 1091506 - RNA, 22 nt, Human
aauuaaaagauaacccaugagu

SEQ ID NO: 1091507 - RNA, 22 nt, Human
acugucucucuagcaguucagg

SEQ ID NO: 1091508 - RNA, 22 nt, Human
cugccaggcacgugcagcauca

SEQ ID NO: 1091509 - RNA, 22 nt, Human
ucccaagagggguuauuaugcc

SEQ ID NO: 1091510 - RNA, 22 nt, Human
ccaggugucaugcgugugaccc

SEQ ID NO: 1091511 - RNA, 22 nt, Human
cuuccuaaaagcuucaagagaa

SEQ ID NO: 1091512 - RNA, 22 nt, Human
uucacacagaaucugaggagcu

SEQ ID NO: 1091513 - RNA, 22 nt, Human
uuuauucaagaugagguucaug

SEQ ID NO: 1091514 - RNA, 22 nt, Human
ucagggcucaccagccucugcc

SEQ ID NO: 1091515 - RNA, 23 nt, Human
uucaugaguuggacaagacuggg

SEQ ID NO: 1091516 - RNA, 22 nt, Human
agcccuuuccaauuugauuuau

SEQ ID NO: 1091517 - RNA, 22 nt, Human
caggaacaaucuuacuacuauu

SEQ ID NO: 1091518 - RNA, 23 nt, Human
uuuauuuauuuaggcugagggau

SEQ ID NO: 1091519 - RNA, 22 nt, Human
gugcucugaucugucugacauc

SEQ ID NO: 1091520 - RNA, 22 nt, Human
cuggcagcucuacucagagccu

SEQ ID NO: 1091521 - RNA, 22 nt, Human
uuccauaauaggcuuaagugaa

SEQ ID NO: 1091522 - RNA, 22 nt, Human
gugggcagcaccagggaagugu

SEQ ID NO: 1091523 - RNA, 22 nt, Human
uuauuuguaaagguccauagua

SEQ ID NO: 1091524 - RNA, 22 nt, Human
ggagcugagcagcgauggcgga

SEQ ID NO: 1091525 - RNA, 21 nt, Human
caucagauuuagaaguucuau

SEQ ID NO: 1091526 - RNA, 22 nt, Human
ggcauggcucggagucagaaca

SEQ ID NO: 1091527 - RNA, 22 nt, Human
gucaggggaugugcugguggcc

SEQ ID NO: 1091528 - RNA, 22 nt, Human
gaaacaauacuuguccucacua

SEQ ID NO: 1091529 - RNA, 22 nt, Human
cacauacaaugguguuauuugg

SEQ ID NO: 1091530 - RNA, 22 nt, Human
uaccugggcccaccagugccug

SEQ ID NO: 1091531 - RNA, 22 nt, Human
gggcaaaaccugggcaucauga

SEQ ID NO: 1091532 - RNA, 22 nt, Human
cucuggaauguuuacaugcccu

SEQ ID NO: 1091533 - RNA, 20 nt, Human
auguaaaagacagggaguag

SEQ ID NO: 1091534 - RNA, 21 nt, Human
aacauuucugggagaacucac

SEQ ID NO: 1091535 - RNA, 22 nt, Human
aauuacugggucugagauuaau

SEQ ID NO: 1091536 - RNA, 22 nt, Human
ucuaaacauaacuuugugugau

SEQ ID NO: 1091537 - RNA, 23 nt, Human
guaaaauacgcagugcaguguga

SEQ ID NO: 1091538 - RNA, 22 nt, Human
cccagcucccauguucuccaau

SEQ ID NO: 1091539 - RNA, 21 nt, Human
gaccccagaccagcagacaca

SEQ ID NO: 1091540 - RNA, 22 nt, Human
cacauaagaaaugaauaugaga

SEQ ID NO: 1091541 - RNA, 22 nt, Human
cugaggccggagcacugaagag

SEQ ID NO: 1091542 - RNA, 22 nt, Human
gggaccuggcgagggucacaca

SEQ ID NO: 1091543 - RNA, 22 nt, Human
aaccauuugccauuaucuuaag

SEQ ID NO: 1091544 - RNA, 22 nt, Human
aggcuggcuggcaggggacaca

SEQ ID NO: 1091545 - RNA, 22 nt, Human
ugacauuuuuaaaaccacuagu

SEQ ID NO: 1091546 - RNA, 22 nt, Human
agcagcugaccagugaguccug

SEQ ID NO: 1091547 - RNA, 23 nt, Human
gcugagguacauuuacaggaaga

SEQ ID NO: 1091548 - RNA, 17 nt, Human
uagcuagaccgagucuc

SEQ ID NO: 1091549 - RNA, 22 nt, Human
uucagugucaauuuuuaaauau

SEQ ID NO: 1091550 - RNA, 22 nt, Human
agcaaagcucaugacauuacag

SEQ ID NO: 1091551 - RNA, 22 nt, Human
ccaggaaccgaugaucagaggg

SEQ ID NO: 1091552 - RNA, 22 nt, Human
caguguucccugaacauauguu

SEQ ID NO: 1091553 - RNA, 22 nt, Human
aaacaucuauuaugugcugagc

SEQ ID NO: 1091554 - RNA, 22 nt, Human
ucuucccagcugcugcgaugcc

SEQ ID NO: 1091555 - RNA, 22 nt, Human
ugauaugcauguaagggagaca

SEQ ID NO: 1091556 - RNA, 22 nt, Human
caaaguaaacuaccacuguuuc

SEQ ID NO: 1091557 - RNA, 22 nt, Human
cuggggacuuugguucuccaug

SEQ ID NO: 1091558 - RNA, 22 nt, Human
aacugaaaccaaacacuuuagg

SEQ ID NO: 1091559 - RNA, 22 nt, Human
auuccaaacuuaccccagagga

SEQ ID NO: 1091560 - RNA, 22 nt, Human
auuuuucucuuuccacugagau

SEQ ID NO: 1091561 - RNA, 22 nt, Human
ucuggcuccacaccucacugca

SEQ ID NO: 1091562 - RNA, 22 nt, Human
ugccaggcaggacccuagaacc

SEQ ID NO: 1091563 - RNA, 22 nt, Human
uccuugaagaaugauucuugga

SEQ ID NO: 1091564 - RNA, 22 nt, Human
uggguagagacacagucugggg

SEQ ID NO: 1091565 - RNA, 22 nt, Human
agacacauuuuacauuaacugu

SEQ ID NO: 1091566 - RNA, 22 nt, Human
ucucagagcucacaccuccugg

SEQ ID NO: 1091567 - RNA, 22 nt, Human
uaguuuuagcagcaaugggaug

SEQ ID NO: 1091568 - RNA, 22 nt, Human
cucuucaaaagucuaauccuua

SEQ ID NO: 1091569 - RNA, 22 nt, Human
ucuggcucccagccugcucuca

SEQ ID NO: 1091570 - RNA, 22 nt, Human
ugggcaggggcccugcuuccgu

SEQ ID NO: 1091571 - RNA, 22 nt, Human
cugccuggagcauucugaaggu

SEQ ID NO: 1091572 - RNA, 22 nt, Human
agagacuguacguggcaaguau

SEQ ID NO: 1091573 - RNA, 19 nt, Human
acuuucuccaggaccuguu

SEQ ID NO: 1091574 - RNA, 22 nt, Human
cagaagcaaaugccuugcugag

SEQ ID NO: 1091575 - RNA, 22 nt, Human
uaggaacaaagagccucacauu

SEQ ID NO: 1091576 - RNA, 22 nt, Human
gcagggcugagucaugugugcc

SEQ ID NO: 1091577 - RNA, 22 nt, Human
cagggcagagggaaacuccuuu

SEQ ID NO: 1091578 - RNA, 22 nt, Human
caauuucucgaacucuaaucca

SEQ ID NO: 1091579 - RNA, 22 nt, Human
uagcacaucuucuuggccugca

SEQ ID NO: 1091580 - RNA, 22 nt, Human
caggagaagucucuagggggug

SEQ ID NO: 1091581 - RNA, 19 nt, Human
gccagcagaaugaugaggc

SEQ ID NO: 1091582 - RNA, 22 nt, Human
ggcugugagcaggcagaaugcu

SEQ ID NO: 1091583 - RNA, 22 nt, Human
gucuuuuuuacaccuuacauca

SEQ ID NO: 1091584 - RNA, 22 nt, Human
gcugucugccgcaggcugccac

SEQ ID NO: 1091585 - RNA, 22 nt, Human
uuugcaaaaugaggugaagagu

SEQ ID NO: 1091586 - RNA, 22 nt, Human
ccugcccuguguuuggggacua

SEQ ID NO: 1091587 - RNA, 22 nt, Human
cugcugcccagugugcauuggg

SEQ ID NO: 1091588 - RNA, 22 nt, Human
ggccaggcugcccugggagcag

SEQ ID NO: 1091589 - RNA, 22 nt, Human
uucccacaguguugaauccucu

SEQ ID NO: 1091590 - RNA, 22 nt, Human
uggagccuguguuucugcccag

SEQ ID NO: 1091591 - RNA, 22 nt, Human
uaauaauagcaguagcugccac

SEQ ID NO: 1091592 - RNA, 22 nt, Human
agggcagagagaugaaugggau

SEQ ID NO: 1091593 - RNA, 22 nt, Human
acacucuuucugugggucacau

SEQ ID NO: 1091594 - RNA, 22 nt, Human
uccuuuucccugaagguauuua

SEQ ID NO: 1091595 - RNA, 22 nt, Human
ccucugcucccuggugucugag

SEQ ID NO: 1091596 - RNA, 22 nt, Human
gagcuagaguuuguaggguaga

SEQ ID NO: 1091597 - RNA, 22 nt, Human
aaauguaccuugauaguuuggu

SEQ ID NO: 1091598 - RNA, 22 nt, Human
uggcucagaggggaagugguuu

SEQ ID NO: 1091599 - RNA, 22 nt, Human
cgaaaucaaacuugggcuucug

SEQ ID NO: 1091600 - RNA, 22 nt, Human
aaacugauaaaauaaguacauu

SEQ ID NO: 1091601 - RNA, 22 nt, Human
aguggcagagugcacucaggca

SEQ ID NO: 1091602 - RNA, 22 nt, Human
cugggccucauccccagaguuu

SEQ ID NO: 1091603 - RNA, 22 nt, Human
uuucacaugguacugccuguuu

SEQ ID NO: 1091604 - RNA, 22 nt, Human
gauuuugucaaauuccaaaugu

SEQ ID NO: 1091605 - RNA, 22 nt, Human
cacuggcaaagccuguuccuua

SEQ ID NO: 1091606 - RNA, 22 nt, Human
uauugcagaagaaaugaaugaa

SEQ ID NO: 1091607 - RNA, 22 nt, Human
gagcacagccaaaguaagaagg

SEQ ID NO: 1091608 - RNA, 22 nt, Human
ucauuucacuucucuagggaga

SEQ ID NO: 1091609 - RNA, 22 nt, Human
gaggcucacugggcaaagacuc

SEQ ID NO: 1091610 - RNA, 18 nt, Human
ucccucccugcuguggcc

SEQ ID NO: 1091611 - RNA, 20 nt, Human
gccugagcuccgccuccugu

SEQ ID NO: 1091612 - RNA, 22 nt, Human
gaggccuguagucauggaugua

SEQ ID NO: 1091613 - RNA, 22 nt, Human
uugauuaaacaggcauauucaa

SEQ ID NO: 1091614 - RNA, 22 nt, Human
ggcugcaggcaggguauccacu

SEQ ID NO: 1091615 - RNA, 22 nt, Human
aauaauuuuagcucagaguugu

SEQ ID NO: 1091616 - RNA, 22 nt, Human
cagacccucuucuauugguggg

SEQ ID NO: 1091617 - RNA, 22 nt, Human
auguuacaauccaacaaaauua

SEQ ID NO: 1091618 - RNA, 22 nt, Human
ugaaggaaaugacggcagaaga

SEQ ID NO: 1091619 - RNA, 18 nt, Human
gcugaaauucuaaacaaa

SEQ ID NO: 1091620 - RNA, 21 nt, Human
acauuuucuguuuuaggaagu

SEQ ID NO: 1091621 - RNA, 22 nt, Human
uguuaacauacugcuuucuaau

SEQ ID NO: 1091622 - RNA, 22 nt, Human
uucacagauuucccugcacaug

SEQ ID NO: 1091623 - RNA, 17 nt, Human
gcccugccugcugcccu

SEQ ID NO: 1091624 - RNA, 22 nt, Human
gccugccuggagcuugagguga

SEQ ID NO: 1091625 - RNA, 22 nt, Human
gaaguuagucuugaaguuaguc

SEQ ID NO: 1091626 - RNA, 20 nt, Human
uuacucaguuccugccaugc

SEQ ID NO: 1091627 - RNA, 22 nt, Human
gaguaaaaguuggauuacaaag

SEQ ID NO: 1091628 - RNA, 22 nt, Human
uuucacagucaauuuggaguca

SEQ ID NO: 1091629 - RNA, 19 nt, Human
acuguucuaacuugcagcu

SEQ ID NO: 1091630 - RNA, 22 nt, Human
ucaacauuuaugaagcuguggc

SEQ ID NO: 1091631 - RNA, 22 nt, Human
cuuuugcagccauuauugcugc

SEQ ID NO: 1091632 - RNA, 22 nt, Human
uuccucucucuugccagaaugu

SEQ ID NO: 1091633 - RNA, 20 nt, Human
agagagagguaaauugagca

SEQ ID NO: 1091634 - RNA, 22 nt, Human
gccuucugauugcuggacugac

SEQ ID NO: 1091635 - RNA, 22 nt, Human
ccucaguguuaggauaagagaa

SEQ ID NO: 1091636 - RNA, 22 nt, Human
ugcauguuauuguggcaagaau

SEQ ID NO: 1091637 - RNA, 22 nt, Human
auuguaaguagaaauguuaugg

SEQ ID NO: 1091638 - RNA, 22 nt, Human
aacagcaugcuggguaacauug

SEQ ID NO: 1091639 - RNA, 22 nt, Human
gugggcucaggccucugugggg

SEQ ID NO: 1091640 - RNA, 22 nt, Human
caugaacaccaggcaugaacaa

SEQ ID NO: 1091641 - RNA, 22 nt, Human
ccagcaccuugaucuuggaguu

SEQ ID NO: 1091642 - RNA, 22 nt, Human
aacuucugaccucaagaacugu

SEQ ID NO: 1091643 - RNA, 22 nt, Human
uacaaagaguuuggucucuaga

SEQ ID NO: 1091644 - RNA, 22 nt, Human
caagaauauauauggaguggag

SEQ ID NO: 1091645 - RNA, 23 nt, Human
agcuuuggugaugugacagauaa

SEQ ID NO: 1091646 - RNA, 22 nt, Human
augugguugaagaauuacaucu

SEQ ID NO: 1091647 - RNA, 22 nt, Human
ugaggcucaagaauagacagua

SEQ ID NO: 1091648 - RNA, 18 nt, Human
ggagccagucugucucug

SEQ ID NO: 1091649 - RNA, 21 nt, Human
guggcccugguguggcugcac

SEQ ID NO: 1091650 - RNA, 22 nt, Human
uuuuaagugcaaucugaaugcg

SEQ ID NO: 1091651 - RNA, 22 nt, Human
aaaucuaggcucauccuggucc

SEQ ID NO: 1091652 - RNA, 22 nt, Human
uagaaacuacuagaauaagaga

SEQ ID NO: 1091653 - RNA, 17 nt, Human
gcuuuggaaggguagac

SEQ ID NO: 1091654 - RNA, 22 nt, Human
gugcaauccaguugauuuuuac

SEQ ID NO: 1091655 - RNA, 22 nt, Human
cagcagcaaaucuagaagagga

SEQ ID NO: 1091656 - RNA, 22 nt, Human
uuguacagggaaguaauacaag

SEQ ID NO: 1091657 - RNA, 22 nt, Human
cuugaaagcuuugcgucuucua

SEQ ID NO: 1091658 - RNA, 22 nt, Human
gccaggcuggucuugaacuccu

SEQ ID NO: 1091659 - RNA, 22 nt, Human
uacauucccccaauuaccaaug

SEQ ID NO: 1091660 - RNA, 22 nt, Human
guggcacagugggagagcccca

SEQ ID NO: 1091661 - RNA, 22 nt, Human
uagcacauaacuuagaauaguu

SEQ ID NO: 1091662 - RNA, 22 nt, Human
ugcaggagcccuugggcucugg

SEQ ID NO: 1091663 - RNA, 22 nt, Human
agagugaaggccagguuacagu

SEQ ID NO: 1091664 - RNA, 22 nt, Human
caaguccaacaguuuuucagac

SEQ ID NO: 1091665 - RNA, 22 nt, Human
uggccagucuguggaagccagg

SEQ ID NO: 1091666 - RNA, 22 nt, Human
uucuggagcuaaaguccacucu

SEQ ID NO: 1091667 - RNA, 22 nt, Human
cccaaccagaaauugacagaga

SEQ ID NO: 1091668 - RNA, 22 nt, Human
gccaguggucacugaggaagaa

SEQ ID NO: 1091669 - RNA, 22 nt, Human
uugcauuuaaguagauguuaca

SEQ ID NO: 1091670 - RNA, 22 nt, Human
augggcugcuuggcuuccaccc

SEQ ID NO: 1091671 - RNA, 22 nt, Human
uuuauauguuuguacaauuaag

SEQ ID NO: 1091672 - RNA, 22 nt, Human
agauuccuaaaguaagauauca

SEQ ID NO: 1091673 - RNA, 21 nt, Human
uccacaaguuagaaggaaauu

SEQ ID NO: 1091674 - RNA, 22 nt, Human
gggggccuuauucaucugccag

SEQ ID NO: 1091675 - RNA, 22 nt, Human
acagauuuauugaagcugcugc

SEQ ID NO: 1091676 - RNA, 22 nt, Human
ugagaggcagaauggugccugc

SEQ ID NO: 1091677 - RNA, 18 nt, Human
auauguuaauuagguagg

SEQ ID NO: 1091678 - RNA, 22 nt, Human
agcccccucccuagugacugga

SEQ ID NO: 1091679 - RNA, 22 nt, Human
gaagaucaagugucauucugug

SEQ ID NO: 1091680 - RNA, 22 nt, Human
ggccuugggcagacacgucaca

SEQ ID NO: 1091681 - RNA, 22 nt, Human
ucaggaacacaggggcccaugc

SEQ ID NO: 1091682 - RNA, 22 nt, Human
ugucucaggggcauugaaauaa

SEQ ID NO: 1091683 - RNA, 22 nt, Human
ggccagagagcagccaggauuc

SEQ ID NO: 1091684 - RNA, 22 nt, Human
cuaggaaugguaccucuuacaa

SEQ ID NO: 1091685 - RNA, 22 nt, Human
ccaguguuuccccagaagagag

SEQ ID NO: 1091686 - RNA, 22 nt, Human
aacuuucugucugagcugcaga

SEQ ID NO: 1091687 - RNA, 22 nt, Human
gccaggagaaugcuagcagagg

SEQ ID NO: 1091688 - RNA, 22 nt, Human
cagcaguggccaucuguguggu

SEQ ID NO: 1091689 - RNA, 22 nt, Human
cuuauuagaaagaaaagacaug

SEQ ID NO: 1091690 - RNA, 22 nt, Human
ccagcugagguugaagaaagag

SEQ ID NO: 1091691 - RNA, 22 nt, Human
cugccuggaccggcagcccucc

SEQ ID NO: 1091692 - RNA, 22 nt, Human
ugguccaggguguaguacagag

SEQ ID NO: 1091693 - RNA, 22 nt, Human
ccucugagagaaggccuucagc

SEQ ID NO: 1091694 - RNA, 22 nt, Human
ucucugggugauggcagggcac

SEQ ID NO: 1091695 - RNA, 22 nt, Human
guauuuuuagguaaggaaagua

SEQ ID NO: 1091696 - RNA, 22 nt, Human
auagaaauguauuuuggacuag

SEQ ID NO: 1091697 - RNA, 22 nt, Human
aaucagaaagaggucauguugc

SEQ ID NO: 1091698 - RNA, 22 nt, Human
acacaccaugauuuauuuaccc

SEQ ID NO: 1091699 - RNA, 22 nt, Human
ucccagagccaagcuauggaug

SEQ ID NO: 1091700 - RNA, 22 nt, Human
cccugagagugagugccaccuu

SEQ ID NO: 1091701 - RNA, 22 nt, Human
gaacacagugguuguuuggagg

SEQ ID NO: 1091702 - RNA, 22 nt, Human
ggggaccuucccagagcaguug

SEQ ID NO: 1091703 - RNA, 22 nt, Human
uggaagggggaagacagcucug

SEQ ID NO: 1091704 - RNA, 22 nt, Human
aauguuugcaucuauucacaug

SEQ ID NO: 1091705 - RNA, 22 nt, Human
cucugugauuuugugagccaga

SEQ ID NO: 1091706 - RNA, 22 nt, Human
aguuuuauugucccagagguga

SEQ ID NO: 1091707 - RNA, 17 nt, Human
acagggcagaaacagcu

SEQ ID NO: 1091708 - RNA, 20 nt, Human
agcaagaguaaggacagcga

SEQ ID NO: 1091709 - RNA, 20 nt, Human
ugcugucguguuuucugcuu

SEQ ID NO: 1091710 - RNA, 22 nt, Human
uggcucaggugugagcugaaga

SEQ ID NO: 1091711 - RNA, 20 nt, Human
agcuuugguuaagccagugg

SEQ ID NO: 1091712 - RNA, 22 nt, Human
cagaaguggccucagagggagu

SEQ ID NO: 1091713 - RNA, 21 nt, Human
auuauuauuucuguguccagc

SEQ ID NO: 1091714 - RNA, 22 nt, Human
aucaguguauucauagggaaua

SEQ ID NO: 1091715 - RNA, 22 nt, Human
cugacuuugacuuggucauuga

SEQ ID NO: 1091716 - RNA, 22 nt, Human
uauuccuuggcaaaaaauauau

SEQ ID NO: 1091717 - RNA, 22 nt, Human
cgaugguucuggcugcuuguau

SEQ ID NO: 1091718 - RNA, 20 nt, Human
aauguuucugaacagguagu

SEQ ID NO: 1091719 - RNA, 22 nt, Human
accuggccauccagcuggcauc

SEQ ID NO: 1091720 - RNA, 22 nt, Human
uucauuugcacuggauuacugg

SEQ ID NO: 1091721 - RNA, 22 nt, Human
ccugugucuuccccacuggugu

SEQ ID NO: 1091722 - RNA, 22 nt, Human
agcuuguuagaaauguagacuc

SEQ ID NO: 1091723 - RNA, 22 nt, Human
ccagaggaaaaauaucucccua

SEQ ID NO: 1091724 - RNA, 22 nt, Human
ugcugccagccaggccauggag

SEQ ID NO: 1091725 - RNA, 22 nt, Human
agggccugcucuaucacucuca

SEQ ID NO: 1091726 - RNA, 22 nt, Human
uuugaaaaaggccuuugguaug

SEQ ID NO: 1091727 - RNA, 22 nt, Human
ugaagggggagauauaugugug

SEQ ID NO: 1091728 - RNA, 22 nt, Human
uucacaggaggguggaugcaug

SEQ ID NO: 1091729 - RNA, 22 nt, Human
aaaugugaguuauagcaauaga

SEQ ID NO: 1091730 - RNA, 22 nt, Human
uucaugcugugucuacaacuua

SEQ ID NO: 1091731 - RNA, 19 nt, Human
gaacacuuacuauauuucu

SEQ ID NO: 1091732 - RNA, 22 nt, Human
auuauuauuguugauguuaggg

SEQ ID NO: 1091733 - RNA, 22 nt, Human
acccggagucggagguugcagu

SEQ ID NO: 1091734 - RNA, 18 nt, Human
uuugcaaaggaaguaugg

SEQ ID NO: 1091735 - RNA, 22 nt, Human
auugcaaagcguagacucuaaa

SEQ ID NO: 1091736 - RNA, 22 nt, Human
agcagccaguucucugugguag

SEQ ID NO: 1091737 - RNA, 22 nt, Human
aggugacaucccggcagcagag

SEQ ID NO: 1091738 - RNA, 22 nt, Human
ccacacagucaguuuccaagaa

SEQ ID NO: 1091739 - RNA, 22 nt, Human
ucucagagauucagggagaagu

SEQ ID NO: 1091740 - RNA, 22 nt, Human
ugaaauguuugaagaccacuga

SEQ ID NO: 1091741 - RNA, 22 nt, Human
ugcaacaguggggcaugcugaa

SEQ ID NO: 1091742 - RNA, 22 nt, Human
acagauaauaggauguacccug

SEQ ID NO: 1091743 - RNA, 22 nt, Human
cagagcagggugcaccuugggc

SEQ ID NO: 1091744 - RNA, 19 nt, Human
uucacauuggaagaaguag

SEQ ID NO: 1091745 - RNA, 18 nt, Human
uccugccugcgggcuccc

SEQ ID NO: 1091746 - RNA, 22 nt, Human
gcucccaccaggcagaccuacc

SEQ ID NO: 1091747 - RNA, 22 nt, Human
agccuucaguaaauccacugug

SEQ ID NO: 1091748 - RNA, 22 nt, Human
ugaaaucaugagauagugucac

SEQ ID NO: 1091749 - RNA, 23 nt, Human
agcuuuuagguggaaauggcacu

SEQ ID NO: 1091750 - RNA, 22 nt, Human
ugaggcuggaugggaugccucc

SEQ ID NO: 1091751 - RNA, 22 nt, Human
ugggcagacgggagcuugccuu

SEQ ID NO: 1091752 - RNA, 22 nt, Human
aaauucugcaauuugacaagau

SEQ ID NO: 1091753 - RNA, 22 nt, Human
gaaauucacuguauuucuuggg

SEQ ID NO: 1091754 - RNA, 22 nt, Human
gcuauacaaguguagaauagag

SEQ ID NO: 1091755 - RNA, 22 nt, Human
agggcugaaacauaauccuucu

SEQ ID NO: 1091756 - RNA, 22 nt, Human
uaacuagauauagacuuucuac

SEQ ID NO: 1091757 - RNA, 18 nt, Human
gcugccugcauuccucac

SEQ ID NO: 1091758 - RNA, 22 nt, Human
aaaaugacauuccagugauauu

SEQ ID NO: 1091759 - RNA, 22 nt, Human
cuggcaagugguugggauggau

SEQ ID NO: 1091760 - RNA, 22 nt, Human
gcacacaguacuauaugcuaca

SEQ ID NO: 1091761 - RNA, 22 nt, Human
ccugagugccaugagagcaccc

SEQ ID NO: 1091762 - RNA, 22 nt, Human
auggggggaugaaggaguccaa

SEQ ID NO: 1091763 - RNA, 22 nt, Human
gggaaggccgguccagucaggu

SEQ ID NO: 1091764 - RNA, 17 nt, Human
ugaaggccaugaccacg

SEQ ID NO: 1091765 - RNA, 22 nt, Human
cauauuucagucuaagaugugu

SEQ ID NO: 1091766 - RNA, 22 nt, Human
ugaaacaaaccaguaauuuugu

SEQ ID NO: 1091767 - RNA, 22 nt, Human
uugucaaguaaggcugacauuu

SEQ ID NO: 1091768 - RNA, 22 nt, Human
uuaauacacuauaugaucacau

SEQ ID NO: 1091769 - RNA, 22 nt, Human
ugaaacuugaguauauauggau

SEQ ID NO: 1091770 - RNA, 22 nt, Human
ucucaggguuuguacaagugua

SEQ ID NO: 1091771 - RNA, 22 nt, Human
uuuaauauucugcauucuccuu

SEQ ID NO: 1091772 - RNA, 22 nt, Human
uuccucagagggcgcuggggaa

SEQ ID NO: 1091773 - RNA, 19 nt, Human
ucauucaggaccaguggau

SEQ ID NO: 1091774 - RNA, 22 nt, Human
uuuccuuuaugacaucaccacu

SEQ ID NO: 1091775 - RNA, 22 nt, Human
accauuaaucucacaaggauaa

SEQ ID NO: 1091776 - RNA, 22 nt, Human
ugcugagacaguggauaggggc

SEQ ID NO: 1091777 - RNA, 22 nt, Human
gcucaggaaauaguuuaguguu

SEQ ID NO: 1091778 - RNA, 22 nt, Human
cuggcaggaaguuagaugguaa

SEQ ID NO: 1091779 - RNA, 22 nt, Human
cuuguacauagagaagaagccu

SEQ ID NO: 1091780 - RNA, 22 nt, Human
aguucugguuaaccugcaaccu

SEQ ID NO: 1091781 - RNA, 22 nt, Human
acagagucaugguagucaaagg

SEQ ID NO: 1091782 - RNA, 22 nt, Human
cugcugggccuggucucugagg

SEQ ID NO: 1091783 - RNA, 22 nt, Human
gccuggcaguugacaguuugcu

SEQ ID NO: 1091784 - RNA, 21 nt, Human
aggaaguggccagauugggaa

SEQ ID NO: 1091785 - RNA, 22 nt, Human
aaacaagcugcagacaagccau

SEQ ID NO: 1091786 - RNA, 22 nt, Human
ucuuggccagguguggugccuc

SEQ ID NO: 1091787 - RNA, 22 nt, Human
ggcagccaugucccagggcuuc

SEQ ID NO: 1091788 - RNA, 22 nt, Human
aaaauagauaaugccaggguca

SEQ ID NO: 1091789 - RNA, 22 nt, Human
acagagauguggaugagggauu

SEQ ID NO: 1091790 - RNA, 22 nt, Human
ucagaggacuaccuucuccagu

SEQ ID NO: 1091791 - RNA, 22 nt, Human
gacaauaaagugauacauggga

SEQ ID NO: 1091792 - RNA, 22 nt, Human
cucuccucagaacaggcccucu

SEQ ID NO: 1091793 - RNA, 22 nt, Human
ggcagaccucuccagccccaca

SEQ ID NO: 1091794 - RNA, 22 nt, Human
cugggcucugcaguugauguuu

SEQ ID NO: 1091795 - RNA, 22 nt, Human
uagcaggguaaauguagaugga

SEQ ID NO: 1091796 - RNA, 18 nt, Human
acagaaauagcugugccu

SEQ ID NO: 1091797 - RNA, 22 nt, Human
cuaauauuuuuagaaaucacga

SEQ ID NO: 1091798 - RNA, 22 nt, Human
ugcacacacaggagucuccucc

SEQ ID NO: 1091799 - RNA, 22 nt, Human
gugugcaguagagaaagagcag

SEQ ID NO: 1091800 - RNA, 22 nt, Human
aagaagcauggcuguagauucc

SEQ ID NO: 1091801 - RNA, 20 nt, Human
auauagagucaaaauggcuu

SEQ ID NO: 1091802 - RNA, 22 nt, Human
gggcagagguucaacuucaaca

SEQ ID NO: 1091803 - RNA, 22 nt, Human
ugaggcagguaagcaaguuuug

SEQ ID NO: 1091804 - RNA, 22 nt, Human
agcuugauaguggcuaucaagc

SEQ ID NO: 1091805 - RNA, 19 nt, Human
cuucuggauccgcagggcc

SEQ ID NO: 1091806 - RNA, 22 nt, Human
auuaauaucccccgccguucug

SEQ ID NO: 1091807 - RNA, 22 nt, Human
ggcucuggugcccuggcuccca

SEQ ID NO: 1091808 - RNA, 22 nt, Human
gucuacaaagcauauaaaagag

SEQ ID NO: 1091809 - RNA, 22 nt, Human
gacuacaggugugugccaccau

SEQ ID NO: 1091810 - RNA, 22 nt, Human
aggguggagggagucccugagc

SEQ ID NO: 1091811 - RNA, 22 nt, Human
agucagugaaaacuagaauguu

SEQ ID NO: 1091812 - RNA, 22 nt, Human
agggagcccugaaccagagggu

SEQ ID NO: 1091813 - RNA, 22 nt, Human
agaaaugaagcaggaguuauua

SEQ ID NO: 1091814 - RNA, 18 nt, Human
gcaggagauggguggggu

SEQ ID NO: 1091815 - RNA, 22 nt, Human
gggcugagcuaagcuggguuga

SEQ ID NO: 1091816 - RNA, 22 nt, Human
aguggggaagagcaugggcccu

SEQ ID NO: 1091817 - RNA, 22 nt, Human
ucugucaaaugagcaaguaacu

SEQ ID NO: 1091818 - RNA, 22 nt, Human
ccacugcccaccccgacgucua

SEQ ID NO: 1091819 - RNA, 22 nt, Human
cugggcugcagcgggagcgacg

SEQ ID NO: 1091820 - RNA, 22 nt, Human
gccucuggucccucaugcugug

SEQ ID NO: 1091821 - RNA, 22 nt, Human
ccugggagguggagguugcagu

SEQ ID NO: 1091822 - RNA, 22 nt, Human
ccagagagaaaauggagggcca

SEQ ID NO: 1091823 - RNA, 22 nt, Human
ugaaaucaugaacaagguaggu

SEQ ID NO: 1091824 - RNA, 22 nt, Human
gccacuggcgcugugcagagug

SEQ ID NO: 1091825 - RNA, 22 nt, Human
uagggcuguuuaaaagugaggu

SEQ ID NO: 1091826 - RNA, 19 nt, Human
gcaucagagcagaaggggu

SEQ ID NO: 1091827 - RNA, 20 nt, Human
agcaaaaugcaagauuuuca

SEQ ID NO: 1091828 - RNA, 22 nt, Human
cagccuguggcagaggucuaau

SEQ ID NO: 1091829 - RNA, 22 nt, Human
cuguccuccagacgacaguccc

SEQ ID NO: 1091830 - RNA, 22 nt, Human
gaaggccacaagagaaguuaag

SEQ ID NO: 1091831 - RNA, 21 nt, Human
ccuucuccacagggucuccgg

SEQ ID NO: 1091832 - RNA, 22 nt, Human
uuuuagauaguuuaacugcacu

SEQ ID NO: 1091833 - RNA, 20 nt, Human
ugcagcugcaggaggguggg

SEQ ID NO: 1091834 - RNA, 22 nt, Human
ggagcugcacgcucugaagccu

SEQ ID NO: 1091835 - RNA, 22 nt, Human
uaacauuuaaauuuuucacaua

SEQ ID NO: 1091836 - RNA, 21 nt, Human
cccagggaagccgcagucacc

SEQ ID NO: 1091837 - RNA, 15 nt, Human
uucaggauaugacuc

SEQ ID NO: 1091838 - RNA, 22 nt, Human
uucuuaaguuuagcaacuugug

SEQ ID NO: 1091839 - RNA, 22 nt, Human
cucaauaugccagaggggaaag

SEQ ID NO: 1091840 - RNA, 18 nt, Human
aggcuucuuggcucaguc

SEQ ID NO: 1091841 - RNA, 22 nt, Human
uguggcucucaugcacucccag

SEQ ID NO: 1091842 - RNA, 22 nt, Human
cuauauauaucaucuuccaguu

SEQ ID NO: 1091843 - RNA, 22 nt, Human
uagcagcaccuuucuaaucuga

SEQ ID NO: 1091844 - RNA, 22 nt, Human
auugaaaggcaaaguaggaagc

SEQ ID NO: 1091845 - RNA, 22 nt, Human
gcugagaggcagccagacccuc

SEQ ID NO: 1091846 - RNA, 22 nt, Human
acugaaaaagacaucuugguaa

SEQ ID NO: 1091847 - RNA, 21 nt, Human
gcagaugggagucaucaggcu

SEQ ID NO: 1091848 - RNA, 22 nt, Human
uacaaagugcuuuagaaaugaa

SEQ ID NO: 1091849 - RNA, 22 nt, Human
gggaugucguggguggcagcug

SEQ ID NO: 1091850 - RNA, 22 nt, Human
gcugagagaucaaggcaggauu

SEQ ID NO: 1091851 - RNA, 22 nt, Human
caggcacaggggaaugucuuuu

SEQ ID NO: 1091852 - RNA, 22 nt, Human
aucuuuaguagaggaauauauu

SEQ ID NO: 1091853 - RNA, 22 nt, Human
aucaguuuuuauuaauguagcu

SEQ ID NO: 1091854 - RNA, 22 nt, Human
acaguaccugcucucaagcaaa

SEQ ID NO: 1091855 - RNA, 19 nt, Human
gcacugaagaguuggucac

SEQ ID NO: 1091856 - RNA, 22 nt, Human
ucccaggcuggggccaggugac

SEQ ID NO: 1091857 - RNA, 22 nt, Human
caucagaacgugagcuccuugu

SEQ ID NO: 1091858 - RNA, 22 nt, Human
agugcuuuaccuagauaauguu

SEQ ID NO: 1091859 - RNA, 22 nt, Human
ugcauucugaacguaaauguga

SEQ ID NO: 1091860 - RNA, 22 nt, Human
uuccaaaugcccaucuacacag

SEQ ID NO: 1091861 - RNA, 22 nt, Human
ccuugaaucucugcucuagaac

SEQ ID NO: 1091862 - RNA, 21 nt, Human
uucauucauggcauaauauag

SEQ ID NO: 1091863 - RNA, 17 nt, Human
aaacaaugcagacaagc

SEQ ID NO: 1091864 - RNA, 22 nt, Human
gcucugagauugagccuuuggu

SEQ ID NO: 1091865 - RNA, 22 nt, Human
agaaaucaaugaagucugcuaa

SEQ ID NO: 1091866 - RNA, 22 nt, Human
uucuccagagggcucugcagga

SEQ ID NO: 1091867 - RNA, 22 nt, Human
ugccucgugucugagucuguuc

SEQ ID NO: 1091868 - RNA, 22 nt, Human
cucugcugaucucagcugggcu

SEQ ID NO: 1091869 - RNA, 22 nt, Human
cugugucuucaauguacuggga

SEQ ID NO: 1091870 - RNA, 22 nt, Human
ccugagagugagugccaccuua

SEQ ID NO: 1091871 - RNA, 22 nt, Human
ugcaauuuucagaaauuccaaa

SEQ ID NO: 1091872 - RNA, 22 nt, Human
acagaagcucaagagagcagug

SEQ ID NO: 1091873 - RNA, 22 nt, Human
uuugcaacagacucaucauuga

SEQ ID NO: 1091874 - RNA, 22 nt, Human
caauacaucaggucaaaaugug

SEQ ID NO: 1091875 - RNA, 22 nt, Human
uuuuaagaaauguaugacuguc

SEQ ID NO: 1091876 - RNA, 18 nt, Human
agcagagcccaugcauuc

SEQ ID NO: 1091877 - RNA, 22 nt, Human
ugaggcaguauucuccauucca

SEQ ID NO: 1091878 - RNA, 19 nt, Human
ggauccagaggaucugcca

SEQ ID NO: 1091879 - RNA, 22 nt, Human
cagugucuccagaugcuccaau

SEQ ID NO: 1091880 - RNA, 22 nt, Human
agccugcaggaugggcagcacc

SEQ ID NO: 1091881 - RNA, 22 nt, Human
auuucucaaguaaaugagucau

SEQ ID NO: 1091882 - RNA, 22 nt, Human
caucaguuccugccccugcccc

SEQ ID NO: 1091883 - RNA, 17 nt, Human
auguauauuaacucuga

SEQ ID NO: 1091884 - RNA, 20 nt, Human
uuuuagcacuuguuauggug

SEQ ID NO: 1091885 - RNA, 22 nt, Human
uuuacacauuauuuucagugug

SEQ ID NO: 1091886 - RNA, 22 nt, Human
gggcaguugauggaggucugga

SEQ ID NO: 1091887 - RNA, 22 nt, Human
cuguggcauugccgaggcuggc

SEQ ID NO: 1091888 - RNA, 22 nt, Human
uuacuaaguuuuaugcaacuua

SEQ ID NO: 1091889 - RNA, 22 nt, Human
uuguugucauuguagaggauuu

SEQ ID NO: 1091890 - RNA, 22 nt, Human
gagaaacacuguuaguuuauua

SEQ ID NO: 1091891 - RNA, 22 nt, Human
augagacuaccuguaauguggc

SEQ ID NO: 1091892 - RNA, 22 nt, Human
ugcauuguugaugaguugaaua

SEQ ID NO: 1091893 - RNA, 22 nt, Human
agugcagcucccucaccugcuu

SEQ ID NO: 1091894 - RNA, 22 nt, Human
cuccagggagcugcgggagcca

SEQ ID NO: 1091895 - RNA, 22 nt, Human
uuuacacaaaagauagcacacc

SEQ ID NO: 1091896 - RNA, 20 nt, Human
ugcucugucuaaaacuuccc

SEQ ID NO: 1091897 - RNA, 21 nt, Human
guggccugauuaugaaugggu

SEQ ID NO: 1091898 - RNA, 23 nt, Human
ugcugggguaguuuguggcacag

SEQ ID NO: 1091899 - RNA, 22 nt, Human
agcugccacugagggugcacag

SEQ ID NO: 1091900 - RNA, 22 nt, Human
agcugccaucagccuuuggaug

SEQ ID NO: 1091901 - RNA, 22 nt, Human
acugugugcuggacaugauguu

SEQ ID NO: 1091902 - RNA, 22 nt, Human
acuccugguuuguguccuggcu

SEQ ID NO: 1091903 - RNA, 22 nt, Human
ugaccugggcauuacaggugca

SEQ ID NO: 1091904 - RNA, 22 nt, Human
caccagcuacagacuacugugu

SEQ ID NO: 1091905 - RNA, 22 nt, Human
ccuccuuccugggacagagcug

SEQ ID NO: 1091906 - RNA, 22 nt, Human
uuacaugaauacauaaccauuc

SEQ ID NO: 1091907 - RNA, 22 nt, Human
ugagccuggggccugggcagcg

SEQ ID NO: 1091908 - RNA, 22 nt, Human
accauuugaaggaaucauugac

SEQ ID NO: 1091909 - RNA, 16 nt, Human
ccacagggcaaggggc

SEQ ID NO: 1091910 - RNA, 22 nt, Human
ccucagagguuuucauucugua

SEQ ID NO: 1091911 - RNA, 22 nt, Human
gaauacaugauacaugaacugc

SEQ ID NO: 1091912 - RNA, 22 nt, Human
gcugcagcuguaggacacaauu

SEQ ID NO: 1091913 - RNA, 18 nt, Human
aaacuguauuucuuucua

SEQ ID NO: 1091914 - RNA, 22 nt, Human
gcaggcuggaggcuguucuggg

SEQ ID NO: 1091915 - RNA, 22 nt, Human
gggcugucacgccccugcaccu

SEQ ID NO: 1091916 - RNA, 22 nt, Human
gccuuaggggucagacagagcu

SEQ ID NO: 1091917 - RNA, 22 nt, Human
gcacagccuugcccugugcccu

SEQ ID NO: 1091918 - RNA, 22 nt, Human
cagguggcuucucccuaggcca

SEQ ID NO: 1091919 - RNA, 22 nt, Human
gugaaaaaucaucaugacuuga

SEQ ID NO: 1091920 - RNA, 22 nt, Human
uauagccauuuccaguggcauc

SEQ ID NO: 1091921 - RNA, 22 nt, Human
cucagcuacuugggaagcuuag

SEQ ID NO: 1091922 - RNA, 22 nt, Human
ucacacagggucggaaagagug

SEQ ID NO: 1091923 - RNA, 22 nt, Human
uucagaaaggauaauuggaagg

SEQ ID NO: 1091924 - RNA, 22 nt, Human
aaaggugacacucugccagcug

SEQ ID NO: 1091925 - RNA, 22 nt, Human
uaacaguaccauuaacuuugau

SEQ ID NO: 1091926 - RNA, 20 nt, Human
gaaauguaucucuugauucu

SEQ ID NO: 1091927 - RNA, 22 nt, Human
ugccagucucacccuggguccu

SEQ ID NO: 1091928 - RNA, 22 nt, Human
cuuaaaguagaauacaagaccu

SEQ ID NO: 1091929 - RNA, 22 nt, Human
cuggcucuucagugcuugguuc

SEQ ID NO: 1091930 - RNA, 22 nt, Human
uucuuugugcauccaauuuucu

SEQ ID NO: 1091931 - RNA, 22 nt, Human
acagaggaagcauauagcacaa

SEQ ID NO: 1091932 - RNA, 19 nt, Human
uuugugaagaaaaugaugc

SEQ ID NO: 1091933 - RNA, 22 nt, Human
ccccacacucuuuacauucaua

SEQ ID NO: 1091934 - RNA, 22 nt, Human
uccaggccgcaggggcagcccc

SEQ ID NO: 1091935 - RNA, 17 nt, Human
cucagaguugcuuuguc

SEQ ID NO: 1091936 - RNA, 19 nt, Human
agcuggcagcuuccacuuc

SEQ ID NO: 1091937 - RNA, 22 nt, Human
caguaaugggcaagacaauaug

SEQ ID NO: 1091938 - RNA, 22 nt, Human
gggguguggacggcugugccag

SEQ ID NO: 1091939 - RNA, 22 nt, Human
aggcuggugcuuccuagggcag

SEQ ID NO: 1091940 - RNA, 22 nt, Human
agccuuuuggaguuauucuggg

SEQ ID NO: 1091941 - RNA, 22 nt, Human
uggagcugggguuugaaucugg

SEQ ID NO: 1091942 - RNA, 22 nt, Human
gcagagcuaucuucuggauuug

SEQ ID NO: 1091943 - RNA, 22 nt, Human
agggucagcuggcugucagggg

SEQ ID NO: 1091944 - RNA, 22 nt, Human
gcagcucuccucugugaggaac

SEQ ID NO: 1091945 - RNA, 22 nt, Human
uagaacagaggguugcccagau

SEQ ID NO: 1091946 - RNA, 22 nt, Human
acacauuuacauguuuacguau

SEQ ID NO: 1091947 - RNA, 22 nt, Human
acacuucuauucccugcacaaa

SEQ ID NO: 1091948 - RNA, 20 nt, Human
ucagaggcugccagcugggg

SEQ ID NO: 1091949 - RNA, 22 nt, Human
gcagcuuggauuucuguaguuu

SEQ ID NO: 1091950 - RNA, 22 nt, Human
gaggcagagugcaccccaggag

SEQ ID NO: 1091951 - RNA, 22 nt, Human
agcucugcaggcacagcugagg

SEQ ID NO: 1091952 - RNA, 22 nt, Human
ggaagagaaaugagucaagacu

SEQ ID NO: 1091953 - RNA, 22 nt, Human
ggaacagacugacuucuugaau

SEQ ID NO: 1091954 - RNA, 22 nt, Human
ucuucagucaauccagauguuu

SEQ ID NO: 1091955 - RNA, 22 nt, Human
gacauaaaccuugagauauuaa

SEQ ID NO: 1091956 - RNA, 22 nt, Human
aagaaagcugaauauucugugu

SEQ ID NO: 1091957 - RNA, 22 nt, Human
cugcugccggcgagccucccuu

SEQ ID NO: 1091958 - RNA, 22 nt, Human
uucauuuaaucagaaucucuaa

SEQ ID NO: 1091959 - RNA, 22 nt, Human
aaaucacuaaguuauagugugg

SEQ ID NO: 1091960 - RNA, 22 nt, Human
gagggagggacuagcauucucu

SEQ ID NO: 1091961 - RNA, 22 nt, Human
agaauuuuugauuaucuacucg

SEQ ID NO: 1091962 - RNA, 22 nt, Human
cugggaggugcagcaaaaauca

SEQ ID NO: 1091963 - RNA, 22 nt, Human
uggagcugggauuugaacugca

SEQ ID NO: 1091964 - RNA, 22 nt, Human
aagcuggcaugucaccugagaa

SEQ ID NO: 1091965 - RNA, 22 nt, Human
ucugaaauaagggagaagggaa

SEQ ID NO: 1091966 - RNA, 22 nt, Human
uggucucugacucugaagaccc

SEQ ID NO: 1091967 - RNA, 22 nt, Human
aauguacagcugcugcugaagg

SEQ ID NO: 1091968 - RNA, 22 nt, Human
ugagccagaggaggcugugugg

SEQ ID NO: 1091969 - RNA, 22 nt, Human
gcagggcuguucaggagggugg

SEQ ID NO: 1091970 - RNA, 18 nt, Human
uuugcuuuccuucuucag

SEQ ID NO: 1091971 - RNA, 21 nt, Human
aaguaaaucagagaaauaacc

SEQ ID NO: 1091972 - RNA, 20 nt, Human
cagggccacgcuccaaggca

SEQ ID NO: 1091973 - RNA, 22 nt, Human
ucuuagaaguuuauggcacgga

SEQ ID NO: 1091974 - RNA, 22 nt, Human
ugcaaggugcuuuuugguguca

SEQ ID NO: 1091975 - RNA, 22 nt, Human
ggcccugcaugagauuaagguu

SEQ ID NO: 1091976 - RNA, 22 nt, Human
gagaggcauggaacagauucuu

SEQ ID NO: 1091977 - RNA, 20 nt, Human
aggcacuguugucuguaucc

SEQ ID NO: 1091978 - RNA, 22 nt, Human
ugccugaagaaaacuugcagca

SEQ ID NO: 1091979 - RNA, 22 nt, Human
agucucuuuaaucacagugucu

SEQ ID NO: 1091980 - RNA, 22 nt, Human
auuccaaacucuuucccugucg

SEQ ID NO: 1091981 - RNA, 22 nt, Human
cugagaguucguuccacccucc

SEQ ID NO: 1091982 - RNA, 22 nt, Human
agaggcggagcuugcagugagc

SEQ ID NO: 1091983 - RNA, 21 nt, Human
agagaagggacucuuccaguc

SEQ ID NO: 1091984 - RNA, 22 nt, Human
gugugcaggccacaggccaggg

SEQ ID NO: 1091985 - RNA, 22 nt, Human
aucaaaguaauuaacacugaga

SEQ ID NO: 1091986 - RNA, 22 nt, Human
gcacagcagccgaaaugcccuu

SEQ ID NO: 1091987 - RNA, 22 nt, Human
ugaaaagugaucauggauuagg

SEQ ID NO: 1091988 - RNA, 23 nt, Human
aaaccuuuuguagaacaauugcu

SEQ ID NO: 1091989 - RNA, 22 nt, Human
agucucuuuguggacucugccu

SEQ ID NO: 1091990 - RNA, 22 nt, Human
augcaccugaacuccaucagcu

SEQ ID NO: 1091991 - RNA, 22 nt, Human
agugccuggaccccaugacaua

SEQ ID NO: 1091992 - RNA, 22 nt, Human
ugcugcuguuuccuacaucuca

SEQ ID NO: 1091993 - RNA, 22 nt, Human
aaaugcucaccacagggaugug

SEQ ID NO: 1091994 - RNA, 23 nt, Human
ucuguuuugcaacaugugacaag

SEQ ID NO: 1091995 - RNA, 22 nt, Human
cccuucccuucugggagaucca

SEQ ID NO: 1091996 - RNA, 17 nt, Human
cccuggcucuaggugga

SEQ ID NO: 1091997 - RNA, 21 nt, Human
gccaccccuggcacaggugcu

SEQ ID NO: 1091998 - RNA, 22 nt, Human
ccugcagaagaguccagcucau

SEQ ID NO: 1091999 - RNA, 22 nt, Human
acccuggguucccgcagcacca

SEQ ID NO: 1092000 - RNA, 22 nt, Human
gggaggugauggcaagcagcgg

SEQ ID NO: 1092001 - RNA, 22 nt, Human
ccugugagucaaccccuccuug

SEQ ID NO: 1092002 - RNA, 18 nt, Human
ccuggcacacuggcucau

SEQ ID NO: 1092003 - RNA, 22 nt, Human
aggcaguggcugagaccagggg

SEQ ID NO: 1092004 - RNA, 22 nt, Human
acagcucuguguauugucaucu

SEQ ID NO: 1092005 - RNA, 22 nt, Human
cagccagcuggcacugugagua

SEQ ID NO: 1092006 - RNA, 22 nt, Human
uuuccuuugcccaauacauguc

SEQ ID NO: 1092007 - RNA, 21 nt, Human
uccagcucuuauguucaugaa

SEQ ID NO: 1092008 - RNA, 22 nt, Human
cucagucaugacgcucaggacc

SEQ ID NO: 1092009 - RNA, 22 nt, Human
augcuuaaccuugguguacaau

SEQ ID NO: 1092010 - RNA, 22 nt, Human
ucccagcccagacuucuccagu

SEQ ID NO: 1092011 - RNA, 21 nt, Human
uagcagagaguuaacuucucc

SEQ ID NO: 1092012 - RNA, 22 nt, Human
cagggcuggauuucauuucuag

SEQ ID NO: 1092013 - RNA, 22 nt, Human
ugaacagauguggagguaccuu

SEQ ID NO: 1092014 - RNA, 22 nt, Human
acauuuuaauaugcuuagugug

SEQ ID NO: 1092015 - RNA, 22 nt, Human
uaacaugcuaggaagagugauu

SEQ ID NO: 1092016 - RNA, 20 nt, Human
gaacauggcagguggagggg

SEQ ID NO: 1092017 - RNA, 22 nt, Human
cuuuccuagaaauauauacuua

SEQ ID NO: 1092018 - RNA, 22 nt, Human
agcagcugccagagagaguucc

SEQ ID NO: 1092019 - RNA, 22 nt, Human
agguccagaacgugccuacucu

SEQ ID NO: 1092020 - RNA, 22 nt, Human
gcacuguucucagagcauuaga

SEQ ID NO: 1092021 - RNA, 22 nt, Human
cccagcaucuccaggcauggcc

SEQ ID NO: 1092022 - RNA, 22 nt, Human
agccaugcaccuuacucuugcu

SEQ ID NO: 1092023 - RNA, 22 nt, Human
cagcacagugcagaugcugacu

SEQ ID NO: 1092024 - RNA, 22 nt, Human
gauuucuuugaauuagagaggu

SEQ ID NO: 1092025 - RNA, 22 nt, Human
uaggaacaguuucaggauguuu

SEQ ID NO: 1092026 - RNA, 22 nt, Human
uugaacagcuguuacauuguua

SEQ ID NO: 1092027 - RNA, 22 nt, Human
auuucuauaggaggacaguauu

SEQ ID NO: 1092028 - RNA, 22 nt, Human
auagucuuagucuauaguuuug

SEQ ID NO: 1092029 - RNA, 22 nt, Human
ugucauguguucuuaaauacau

SEQ ID NO: 1092030 - RNA, 22 nt, Human
gagcuggcuccgccaugcugcu

SEQ ID NO: 1092031 - RNA, 22 nt, Human
aggggagaguuaaugugaaugu

SEQ ID NO: 1092032 - RNA, 22 nt, Human
ccagucagccaagcugcagcgg

SEQ ID NO: 1092033 - RNA, 22 nt, Human
augcaguguuuggaagcuuaag

SEQ ID NO: 1092034 - RNA, 22 nt, Human
cugagccagcuggcaugugcua

SEQ ID NO: 1092035 - RNA, 21 nt, Human
uucauuuguuauagacaaagu

SEQ ID NO: 1092036 - RNA, 22 nt, Human
acagugcuaaacacuucuugaa

SEQ ID NO: 1092037 - RNA, 22 nt, Human
uaccauuugagagagaacauaa

SEQ ID NO: 1092038 - RNA, 22 nt, Human
aggacuuuaucuucuagaccuc

SEQ ID NO: 1092039 - RNA, 22 nt, Human
guuacauuacuugugcaguugu

SEQ ID NO: 1092040 - RNA, 22 nt, Human
caggaagauuagaccaagagcu

SEQ ID NO: 1092041 - RNA, 22 nt, Human
guaaaauucuagcaucugaaag

SEQ ID NO: 1092042 - RNA, 22 nt, Human
agaucucaccucuguguauuau

SEQ ID NO: 1092043 - RNA, 22 nt, Human
cucuucaguuguugcauauucu

SEQ ID NO: 1092044 - RNA, 22 nt, Human
ugccaaauugcccuauaaauga

SEQ ID NO: 1092045 - RNA, 22 nt, Human
agcagggcucacauuaguggau

SEQ ID NO: 1092046 - RNA, 22 nt, Human
auuagcuugguaugccauaaag

SEQ ID NO: 1092047 - RNA, 22 nt, Human
ugggcagagaucuggaucaaac

SEQ ID NO: 1092048 - RNA, 22 nt, Human
aauauucauuugcagaagaagu

SEQ ID NO: 1092049 - RNA, 22 nt, Human
aucaacaugacaggagaagaga

SEQ ID NO: 1092050 - RNA, 22 nt, Human
aucuuuagauuagaaacucuaa

SEQ ID NO: 1092051 - RNA, 21 nt, Human
guuauuuuaagugagcuuugc

SEQ ID NO: 1092052 - RNA, 18 nt, Human
acagacaaaauggaaaug

SEQ ID NO: 1092053 - RNA, 22 nt, Human
gagauggggaauaggagcaagc

SEQ ID NO: 1092054 - RNA, 23 nt, Human
uggcucagggucucuuaugaagu

SEQ ID NO: 1092055 - RNA, 22 nt, Human
gauguagagggaagauuuuaaa

SEQ ID NO: 1092056 - RNA, 22 nt, Human
gaagacauguuuuuaauaugua

SEQ ID NO: 1092057 - RNA, 22 nt, Human
acagcaaaggacgaacacucug

SEQ ID NO: 1092058 - RNA, 22 nt, Human
gaaauucugugucccagagugc

SEQ ID NO: 1092059 - RNA, 23 nt, Human
auuaccagccugacaccaacaaa

SEQ ID NO: 1092060 - RNA, 22 nt, Human
aagcaaaacgugcucuaggagg

SEQ ID NO: 1092061 - RNA, 22 nt, Human
uauaacaccauguucuacagau

SEQ ID NO: 1092062 - RNA, 22 nt, Human
augagacaggacuguaugcagg

SEQ ID NO: 1092063 - RNA, 22 nt, Human
ucagauggucauucacuagggu

SEQ ID NO: 1092064 - RNA, 18 nt, Human
aaguccuuccuuugcuuu

SEQ ID NO: 1092065 - RNA, 22 nt, Human
uagaccaggggagucaacaggu

SEQ ID NO: 1092066 - RNA, 22 nt, Human
ucagggaaugugauacaggaag

SEQ ID NO: 1092067 - RNA, 22 nt, Human
cucuuucuggaaggcagagugg

SEQ ID NO: 1092068 - RNA, 22 nt, Human
ccaggcucugugugggcuagag

SEQ ID NO: 1092069 - RNA, 22 nt, Human
agcugcucuugggugacuucaa

SEQ ID NO: 1092070 - RNA, 19 nt, Human
ugggaguggggaagguccu

SEQ ID NO: 1092071 - RNA, 22 nt, Human
uucucuuagcuguaaagucaau

SEQ ID NO: 1092072 - RNA, 22 nt, Human
gugggagcuuuggcaucaggcu

SEQ ID NO: 1092073 - RNA, 22 nt, Human
cugugggagaaguugcuggagu

SEQ ID NO: 1092074 - RNA, 22 nt, Human
uuaagcauaauuaaagugaaau

SEQ ID NO: 1092075 - RNA, 22 nt, Human
ccuggggaaucuugcaggggaa

SEQ ID NO: 1092076 - RNA, 23 nt, Human
cacuccuguuucuaagccagcau

SEQ ID NO: 1092077 - RNA, 22 nt, Human
uuuaauguagcgugaaaugauu

SEQ ID NO: 1092078 - RNA, 22 nt, Human
uucacauugaaggugcuuucuu

SEQ ID NO: 1092079 - RNA, 22 nt, Human
gagucacaaaagaugcccaggg

SEQ ID NO: 1092080 - RNA, 22 nt, Human
guaggaagcucugaggcuaguu

SEQ ID NO: 1092081 - RNA, 22 nt, Human
ggaggagggguuuacauuggaa

SEQ ID NO: 1092082 - RNA, 22 nt, Human
ggcugagccacugcgccuggcu

SEQ ID NO: 1092083 - RNA, 22 nt, Human
ggagaaaggauaggaaugugcu

SEQ ID NO: 1092084 - RNA, 22 nt, Human
cauucacagagggggaagcauc

SEQ ID NO: 1092085 - RNA, 22 nt, Human
ugggaaauguguuucuggacca

SEQ ID NO: 1092086 - RNA, 20 nt, Human
guucacaggcuuccuuucag

SEQ ID NO: 1092087 - RNA, 22 nt, Human
cugucaguaggcucccaucauu

SEQ ID NO: 1092088 - RNA, 19 nt, Human
acaauaacucauugauugc

SEQ ID NO: 1092089 - RNA, 22 nt, Human
aaugcuuuaauugcauguagug

SEQ ID NO: 1092090 - RNA, 22 nt, Human
cuucccagaccuuagagugcag

SEQ ID NO: 1092091 - RNA, 23 nt, Human
gccugugccuaugcccagcucug

SEQ ID NO: 1092092 - RNA, 18 nt, Human
ggaccacaucaacuugaa

SEQ ID NO: 1092093 - RNA, 22 nt, Human
gcucccacaaccuucuugcucc

SEQ ID NO: 1092094 - RNA, 22 nt, Human
ggccucucauguccugggcuuc

SEQ ID NO: 1092095 - RNA, 22 nt, Human
aagcagcacaguaauauuggug

SEQ ID NO: 1092096 - RNA, 22 nt, Human
gccagccugugcuuggccaggc

SEQ ID NO: 1092097 - RNA, 22 nt, Human
uaguauucagcuucucaggcaa

SEQ ID NO: 1092098 - RNA, 22 nt, Human
gaggagagaagcuaacggugcu

SEQ ID NO: 1092099 - RNA, 22 nt, Human
guuucauaugcaguuaacagca

SEQ ID NO: 1092100 - RNA, 22 nt, Human
caacagaagguguacuacugaa

SEQ ID NO: 1092101 - RNA, 22 nt, Human
ugaaauuuaggugcagauaaau

SEQ ID NO: 1092102 - RNA, 22 nt, Human
agccaggcgggucuuugcuccu

SEQ ID NO: 1092103 - RNA, 22 nt, Human
auggaaauguaacuucugauuc

SEQ ID NO: 1092104 - RNA, 21 nt, Human
agcugcaggccucccagggau

SEQ ID NO: 1092105 - RNA, 22 nt, Human
ugggggugugccagggaccucc

SEQ ID NO: 1092106 - RNA, 22 nt, Human
ggacauuuagaacagaguauuu

SEQ ID NO: 1092107 - RNA, 23 nt, Human
aaacugcuuccaauuccugccau

SEQ ID NO: 1092108 - RNA, 22 nt, Human
caguccagcucaucaguggcac

SEQ ID NO: 1092109 - RNA, 22 nt, Human
caucuuuauuuauauagacagg

SEQ ID NO: 1092110 - RNA, 22 nt, Human
gaggcucugugaugugccaggc

SEQ ID NO: 1092111 - RNA, 22 nt, Human
gggccugcuggugcuuccauug

SEQ ID NO: 1092112 - RNA, 23 nt, Human
agacagaggcugaggcuggccgc

SEQ ID NO: 1092113 - RNA, 22 nt, Human
cccaggaaugaggggcggaggc

SEQ ID NO: 1092114 - RNA, 22 nt, Human
gcuggcagcauuagacccuggg

SEQ ID NO: 1092115 - RNA, 22 nt, Human
cuucacaguaaauccagaagaa

SEQ ID NO: 1092116 - RNA, 22 nt, Human
ccugcugguguccaggcuuugg

SEQ ID NO: 1092117 - RNA, 22 nt, Human
agcacugugauuuauaacauuu

SEQ ID NO: 1092118 - RNA, 22 nt, Human
cagcaaaauuugaggauugccu

SEQ ID NO: 1092119 - RNA, 22 nt, Human
gcagaugccagaucaugcaggg

SEQ ID NO: 1092120 - RNA, 22 nt, Human
cugagaaaauuucaggaagugu

SEQ ID NO: 1092121 - RNA, 22 nt, Human
uaguaucuuucuauauuuccca

SEQ ID NO: 1092122 - RNA, 22 nt, Human
uucaagaagcccaaagacuagc

SEQ ID NO: 1092123 - RNA, 22 nt, Human
caaagaugccaaaaggaagaca

SEQ ID NO: 1092124 - RNA, 22 nt, Human
ugaaggaaagagggaacauccc

SEQ ID NO: 1092125 - RNA, 20 nt, Human
agaauucuuacccuuugaug

SEQ ID NO: 1092126 - RNA, 22 nt, Human
gcaggggcuacucugagcuucc

SEQ ID NO: 1092127 - RNA, 22 nt, Human
ucagaggaauuugcuuuucaug

SEQ ID NO: 1092128 - RNA, 22 nt, Human
ucuucacaugaccuucaugucu

SEQ ID NO: 1092129 - RNA, 22 nt, Human
uuuggcucgauggacuuugaau

SEQ ID NO: 1092130 - RNA, 20 nt, Human
uguaagaaguaggaggguua

SEQ ID NO: 1092131 - RNA, 22 nt, Human
auaaugaaauaugaggaagguc

SEQ ID NO: 1092132 - RNA, 22 nt, Human
aggugggggcuguguccuugac

SEQ ID NO: 1092133 - RNA, 22 nt, Human
gcaggggcugcugggaacucgg

SEQ ID NO: 1092134 - RNA, 22 nt, Human
aacaugcucuguuucuuggaug

SEQ ID NO: 1092135 - RNA, 22 nt, Human
cuguuaaucugcuugcaugaug

SEQ ID NO: 1092136 - RNA, 22 nt, Human
ccuggcuggcaagaucgugaag

SEQ ID NO: 1092137 - RNA, 22 nt, Human
cucugcagauucaucccuucac

SEQ ID NO: 1092138 - RNA, 22 nt, Human
ucucugugguuugagagccggg

SEQ ID NO: 1092139 - RNA, 16 nt, Human
ccaccugcagcucuca

SEQ ID NO: 1092140 - RNA, 22 nt, Human
ggugcccuguaaaagccaugca

SEQ ID NO: 1092141 - RNA, 22 nt, Human
uauguacaaucagcaguucaua

SEQ ID NO: 1092142 - RNA, 22 nt, Human
cagagcugguguuacaagucca

SEQ ID NO: 1092143 - RNA, 19 nt, Human
ucccuucuauaguaauaaa

SEQ ID NO: 1092144 - RNA, 22 nt, Human
acacuuuacagcuuccuuugca

SEQ ID NO: 1092145 - RNA, 21 nt, Human
aaagagacaaauggcauauac

SEQ ID NO: 1092146 - RNA, 22 nt, Human
acucuucaagggccuagaggug

SEQ ID NO: 1092147 - RNA, 22 nt, Human
ucaauuaugccauugcaauauu

SEQ ID NO: 1092148 - RNA, 22 nt, Human
aagggccuccuggggagccugg

SEQ ID NO: 1092149 - RNA, 22 nt, Human
guucaaaggccuguggaaaggg

SEQ ID NO: 1092150 - RNA, 22 nt, Human
cugucuguucagauucauuacu

SEQ ID NO: 1092151 - RNA, 22 nt, Human
uuucuucagccacuccaaacug

SEQ ID NO: 1092152 - RNA, 17 nt, Human
gguguauggggagggaa

SEQ ID NO: 1092153 - RNA, 22 nt, Human
caggccugauacacugaacucu

SEQ ID NO: 1092154 - RNA, 20 nt, Human
caauuucaucauuuccugug

SEQ ID NO: 1092155 - RNA, 22 nt, Human
uucaagaucgaguuuaaaguga

SEQ ID NO: 1092156 - RNA, 22 nt, Human
ucauacaucuuguauaucuauc

SEQ ID NO: 1092157 - RNA, 22 nt, Human
cucuuaguuuaucuuugacaaa

SEQ ID NO: 1092158 - RNA, 22 nt, Human
augccaaauucucagccucuuu

SEQ ID NO: 1092159 - RNA, 22 nt, Human
cugccagcucgccacaaugaca

SEQ ID NO: 1092160 - RNA, 22 nt, Human
auguuucaagagaaaaagagac

SEQ ID NO: 1092161 - RNA, 22 nt, Human
uacaucaagauaaaaacuguca

SEQ ID NO: 1092162 - RNA, 20 nt, Human
ucagagucaucaaagauggu

SEQ ID NO: 1092163 - RNA, 22 nt, Human
ggagggugcagacccuuugcaa

SEQ ID NO: 1092164 - RNA, 22 nt, Human
gcugugggacagguccagccag

SEQ ID NO: 1092165 - RNA, 22 nt, Human
uuaacacuaucugucauaauua

SEQ ID NO: 1092166 - RNA, 22 nt, Human
acagcugauuggaucaaggaca

SEQ ID NO: 1092167 - RNA, 22 nt, Human
ccagcacugcucucagacugag

SEQ ID NO: 1092168 - RNA, 22 nt, Human
caauuucagugcuguggagagg

SEQ ID NO: 1092169 - RNA, 22 nt, Human
gggcuggucuggcuuagucagg

SEQ ID NO: 1092170 - RNA, 23 nt, Human
aaccagauaaauggcuccagggc

SEQ ID NO: 1092171 - RNA, 22 nt, Human
ccuggcucuguccucgcgcaaa

SEQ ID NO: 1092172 - RNA, 22 nt, Human
aaguucuuggaggaugaagagu

SEQ ID NO: 1092173 - RNA, 17 nt, Human
ucucuuucccuuucugc

SEQ ID NO: 1092174 - RNA, 22 nt, Human
agauuauuuaagacaggaacca

SEQ ID NO: 1092175 - RNA, 22 nt, Human
gcaccugguuuauauaaucaua

SEQ ID NO: 1092176 - RNA, 22 nt, Human
aggcuguguggaugagucuuac

SEQ ID NO: 1092177 - RNA, 22 nt, Human
ucagcaggcgguuccuuguggg

SEQ ID NO: 1092178 - RNA, 22 nt, Human
cugccugaguacaagucccaga

SEQ ID NO: 1092179 - RNA, 22 nt, Human
gucucccaauccgggacagccu

SEQ ID NO: 1092180 - RNA, 22 nt, Human
ccucacuuuccuuucuccuggg

SEQ ID NO: 1092181 - RNA, 22 nt, Human
acaacaaagacacuugaaauga

SEQ ID NO: 1092182 - RNA, 22 nt, Human
cugggccaucuccuuugugugg

SEQ ID NO: 1092183 - RNA, 22 nt, Human
cagccugcucucagauguugag

SEQ ID NO: 1092184 - RNA, 21 nt, Human
ggccuuggcgggggccgaauu

SEQ ID NO: 1092185 - RNA, 22 nt, Human
auacagauguuaaagcaauuuc

SEQ ID NO: 1092186 - RNA, 22 nt, Human
aauguuauuucugcauaguagu

SEQ ID NO: 1092187 - RNA, 22 nt, Human
aguggcugacaacuggguuaac

SEQ ID NO: 1092188 - RNA, 22 nt, Human
caggaaccagaaccuucccccg

SEQ ID NO: 1092189 - RNA, 22 nt, Human
gcugcugugugggagacaggcg

SEQ ID NO: 1092190 - RNA, 22 nt, Human
uaggcugggaagaaagauucuc

SEQ ID NO: 1092191 - RNA, 22 nt, Human
ccuggggagagaaagcccagcc

SEQ ID NO: 1092192 - RNA, 22 nt, Human
aggaggccgggauucuggagau

SEQ ID NO: 1092193 - RNA, 22 nt, Human
ucgggcuccugcacuuggagac

SEQ ID NO: 1092194 - RNA, 22 nt, Human
gcucagggcgcgagggacgugg

SEQ ID NO: 1092195 - RNA, 22 nt, Human
acugcagccuugaacucugggc

SEQ ID NO: 1092196 - RNA, 22 nt, Human
uuccuuaguguuagauucugug

SEQ ID NO: 1092197 - RNA, 22 nt, Human
uccuuggcagcagggagcauga

SEQ ID NO: 1092198 - RNA, 18 nt, Human
uugaauucuucuacaugu

SEQ ID NO: 1092199 - RNA, 22 nt, Human
cccuggagucagguuggccugg

SEQ ID NO: 1092200 - RNA, 22 nt, Human
uuuuggucagguuggucucgaa

SEQ ID NO: 1092201 - RNA, 22 nt, Human
ggccagaaguuggaaaagagcc

SEQ ID NO: 1092202 - RNA, 22 nt, Human
cuguucugaacugccugcaugc

SEQ ID NO: 1092203 - RNA, 22 nt, Human
uccuuucccuuuccauccuggc

SEQ ID NO: 1092204 - RNA, 22 nt, Human
uucuucucggcugucagauagu

SEQ ID NO: 1092205 - RNA, 22 nt, Human
uucaagaucuuccaaaggauac

SEQ ID NO: 1092206 - RNA, 20 nt, Human
aaccaggauagaccagggaa

SEQ ID NO: 1092207 - RNA, 21 nt, Human
agcaauuucauuugguuuaac

SEQ ID NO: 1092208 - RNA, 22 nt, Human
aucaagaacuuauuuuggaaau

SEQ ID NO: 1092209 - RNA, 22 nt, Human
uugcuauacucauuaguuauuu

SEQ ID NO: 1092210 - RNA, 21 nt, Human
guuuucuuugauagagggaag

SEQ ID NO: 1092211 - RNA, 22 nt, Human
ugacagagcuggagaauaauuu

SEQ ID NO: 1092212 - RNA, 22 nt, Human
auuuccuuugcaaagacugugc

SEQ ID NO: 1092213 - RNA, 22 nt, Human
caccaucagcagcaggugucaa

SEQ ID NO: 1092214 - RNA, 22 nt, Human
ggucccagcugcucaagaggcu

SEQ ID NO: 1092215 - RNA, 22 nt, Human
acguggagagaauagggcacca

SEQ ID NO: 1092216 - RNA, 22 nt, Human
aagaacuagucuuacagccuca

SEQ ID NO: 1092217 - RNA, 20 nt, Human
acagaaagagagaaugucag

SEQ ID NO: 1092218 - RNA, 22 nt, Human
ugcagggcuaagucagagccug

SEQ ID NO: 1092219 - RNA, 22 nt, Human
agguggagacccagagaaggcg

SEQ ID NO: 1092220 - RNA, 22 nt, Human
acuguugaagugccagcuugau

SEQ ID NO: 1092221 - RNA, 19 nt, Human
acugccugaggcucacagg

SEQ ID NO: 1092222 - RNA, 22 nt, Human
cugugccauccgcuugaccugg

SEQ ID NO: 1092223 - RNA, 17 nt, Human
ggcagcugccacuuuuu

SEQ ID NO: 1092224 - RNA, 22 nt, Human
aacuuucuccagugccaacuau

SEQ ID NO: 1092225 - RNA, 22 nt, Human
cauggccucucuccuggaaugg

SEQ ID NO: 1092226 - RNA, 22 nt, Human
gggaagggacuuguuuaagguc

SEQ ID NO: 1092227 - RNA, 22 nt, Human
aguuuucugauguguagugaga

SEQ ID NO: 1092228 - RNA, 22 nt, Human
agaugcugccucuccucacaag

SEQ ID NO: 1092229 - RNA, 22 nt, Human
cugggccugguguggcaccugc

SEQ ID NO: 1092230 - RNA, 22 nt, Human
gccuuggccuuccuaggccuga

SEQ ID NO: 1092231 - RNA, 22 nt, Human
uaucuguuguccaugcagaaag

SEQ ID NO: 1092232 - RNA, 22 nt, Human
uagguaagauguuaacagcuga

SEQ ID NO: 1092233 - RNA, 22 nt, Human
gcuggccugcgagggcaggcug

SEQ ID NO: 1092234 - RNA, 22 nt, Human
gcaaagcacacccucagaguuu

SEQ ID NO: 1092235 - RNA, 22 nt, Human
ccuggccucuccgaguaaccug

SEQ ID NO: 1092236 - RNA, 22 nt, Human
uuauuauaaugagggauaaaaa

SEQ ID NO: 1092237 - RNA, 22 nt, Human
ucugaaauuuuaguuauagaaa

SEQ ID NO: 1092238 - RNA, 22 nt, Human
ggugcccaccugucuuccugga

SEQ ID NO: 1092239 - RNA, 22 nt, Human
uuacauaaaaguucacguaggc

SEQ ID NO: 1092240 - RNA, 22 nt, Human
agggagcuuccgaacuacagcu

SEQ ID NO: 1092241 - RNA, 22 nt, Human
acuguaaauuacauaagaacag

SEQ ID NO: 1092242 - RNA, 22 nt, Human
uuucacagcugucuuccgucuc

SEQ ID NO: 1092243 - RNA, 22 nt, Human
cagggcugaagaaauucaaaag

SEQ ID NO: 1092244 - RNA, 22 nt, Human
agcugggaggugggcagugaga

SEQ ID NO: 1092245 - RNA, 22 nt, Human
ugagggaggcccuuugagcaga

SEQ ID NO: 1092246 - RNA, 20 nt, Human
gucucagaauggauuugcau

SEQ ID NO: 1092247 - RNA, 22 nt, Human
auacaagugagaaaacugaaga

SEQ ID NO: 1092248 - RNA, 22 nt, Human
gcucaaagaauauucagaauga

SEQ ID NO: 1092249 - RNA, 22 nt, Human
uuuugaaagccagguuuguaug

SEQ ID NO: 1092250 - RNA, 19 nt, Human
caggccagugucagggggc

SEQ ID NO: 1092251 - RNA, 22 nt, Human
aacuggaaagaucaguaggaag

SEQ ID NO: 1092252 - RNA, 17 nt, Human
gcuucuggagcuucugu

SEQ ID NO: 1092253 - RNA, 22 nt, Human
aaguuuaucccucucacaguua

SEQ ID NO: 1092254 - RNA, 22 nt, Human
gcugcucucagagcucaugcug

SEQ ID NO: 1092255 - RNA, 22 nt, Human
agcagccagugggagugauaca

SEQ ID NO: 1092256 - RNA, 22 nt, Human
cuguccuuacugcuucuggcuu

SEQ ID NO: 1092257 - RNA, 22 nt, Human
aacuccaggcagggaggccacu

SEQ ID NO: 1092258 - RNA, 22 nt, Human
ucuagaaaaacaaaguaucuga

SEQ ID NO: 1092259 - RNA, 22 nt, Human
cggcagcuccgcgccguaggac

SEQ ID NO: 1092260 - RNA, 22 nt, Human
cugagagguaagcagcgcagug

SEQ ID NO: 1092261 - RNA, 22 nt, Human
cuggggacgucgggcaguguuc

SEQ ID NO: 1092262 - RNA, 22 nt, Human
gcuagaaaaugaaagauaauuu

SEQ ID NO: 1092263 - RNA, 22 nt, Human
agagccaggcaggcaauguuga

SEQ ID NO: 1092264 - RNA, 22 nt, Human
uaauacagggcacuuugaguga

SEQ ID NO: 1092265 - RNA, 22 nt, Human
aggaacacauggacauuucuga

SEQ ID NO: 1092266 - RNA, 22 nt, Human
ggcuagggagacagagggcaug

SEQ ID NO: 1092267 - RNA, 22 nt, Human
ugcugucugcaacaguacuaca

SEQ ID NO: 1092268 - RNA, 22 nt, Human
uaucuguuguaguacagaugau

SEQ ID NO: 1092269 - RNA, 22 nt, Human
gcaauuauaucaccagagaucu

SEQ ID NO: 1092270 - RNA, 22 nt, Human
augucuuuuaugauuacgggau

SEQ ID NO: 1092271 - RNA, 22 nt, Human
gcccagggugcuuagaacccau

SEQ ID NO: 1092272 - RNA, 18 nt, Human
uccagcuugcacuuaaau

SEQ ID NO: 1092273 - RNA, 23 nt, Human
aguacauuugacccaaauaagcu

SEQ ID NO: 1092274 - RNA, 22 nt, Human
gggcugcugccaccagguggau

SEQ ID NO: 1092275 - RNA, 20 nt, Human
cagcaguggaugagaguuuu

SEQ ID NO: 1092276 - RNA, 22 nt, Human
cucuggaguucuucaagcuacu

SEQ ID NO: 1092277 - RNA, 22 nt, Human
ugcagaggaccauuguccugga

SEQ ID NO: 1092278 - RNA, 22 nt, Human
gugggcuucuguuagggaggcu

SEQ ID NO: 1092279 - RNA, 22 nt, Human
cacagggcaggccccaggccuc

SEQ ID NO: 1092280 - RNA, 22 nt, Human
cacagaggacuguagcggggag

SEQ ID NO: 1092281 - RNA, 22 nt, Human
uaauauauuucugcuaagcuca

SEQ ID NO: 1092282 - RNA, 22 nt, Human
aaagacugguguguuacauaua

SEQ ID NO: 1092283 - RNA, 23 nt, Human
uggaagcaaucacuguagugaau

SEQ ID NO: 1092284 - RNA, 22 nt, Human
auguaagguucagaguauguga

SEQ ID NO: 1092285 - RNA, 22 nt, Human
acuucaguuucccucaacaaga

SEQ ID NO: 1092286 - RNA, 22 nt, Human
uuccugauagaacacuuuccaa

SEQ ID NO: 1092287 - RNA, 18 nt, Human
ucauuuguuuugcaugaa

SEQ ID NO: 1092288 - RNA, 22 nt, Human
acacugugagcugaagggcugc

SEQ ID NO: 1092289 - RNA, 23 nt, Human
cuuugccacccagagccugacag

SEQ ID NO: 1092290 - RNA, 22 nt, Human
ucucccuagggccgcuggcuaa

SEQ ID NO: 1092291 - RNA, 22 nt, Human
gagagaggccuccauguacuga

SEQ ID NO: 1092292 - RNA, 22 nt, Human
gcccagcacagcuggaagaguc

SEQ ID NO: 1092293 - RNA, 22 nt, Human
acaaauguuacauaaguuugga

SEQ ID NO: 1092294 - RNA, 18 nt, Human
ccgggcuuuggugacaca

SEQ ID NO: 1092295 - RNA, 22 nt, Human
ggcuggcacugaggagagcucu

SEQ ID NO: 1092296 - RNA, 22 nt, Human
aaaaucugcacaggucaguuuu

SEQ ID NO: 1092297 - RNA, 22 nt, Human
cagguuucauuggcagcuucau

SEQ ID NO: 1092298 - RNA, 22 nt, Human
uuugaauagcauaggauuacau

SEQ ID NO: 1092299 - RNA, 22 nt, Human
auuucaguguugguuagcaagc

SEQ ID NO: 1092300 - RNA, 22 nt, Human
aaaguuacuaucacaaugaaau

SEQ ID NO: 1092301 - RNA, 22 nt, Human
ucaguguuugguuucagaauug

SEQ ID NO: 1092302 - RNA, 22 nt, Human
cuguacagaguucugaguguac

SEQ ID NO: 1092303 - RNA, 22 nt, Human
uucuuguacuggagauacauga

SEQ ID NO: 1092304 - RNA, 22 nt, Human
cagaaagaccugggcucaagag

SEQ ID NO: 1092305 - RNA, 22 nt, Human
ucuggcuccguguccgcuccca

SEQ ID NO: 1092306 - RNA, 22 nt, Human
acaggaagugcuggcacuuaca

SEQ ID NO: 1092307 - RNA, 22 nt, Human
ucucccaggucauacacagaga

SEQ ID NO: 1092308 - RNA, 22 nt, Human
agacucuuggagaagagcuaua

SEQ ID NO: 1092309 - RNA, 22 nt, Human
cuuuuugucucuguccugauga

SEQ ID NO: 1092310 - RNA, 22 nt, Human
agucagaggaaugggccaggcu

SEQ ID NO: 1092311 - RNA, 22 nt, Human
cuagagaggcagauguccugug

SEQ ID NO: 1092312 - RNA, 21 nt, Human
agcaggaggcagucacagcuc

SEQ ID NO: 1092313 - RNA, 22 nt, Human
uagcaaaaacugcaguuacuuu

SEQ ID NO: 1092314 - RNA, 21 nt, Human
ggccucugccuugccccacuc

SEQ ID NO: 1092315 - RNA, 22 nt, Human
agggccugggucuguacuccuc

SEQ ID NO: 1092316 - RNA, 22 nt, Human
agguaaaauagauaguauuucu

SEQ ID NO: 1092317 - RNA, 22 nt, Human
uuugggcucacuaugcugaaga

SEQ ID NO: 1092318 - RNA, 22 nt, Human
gcagaacauuucacaguaucuu

SEQ ID NO: 1092319 - RNA, 22 nt, Human
aagaaugauuacaaagcaacga

SEQ ID NO: 1092320 - RNA, 22 nt, Human
uuucuacauguuuucuauugaa

SEQ ID NO: 1092321 - RNA, 22 nt, Human
guuuauuauacaacaaaagcua

SEQ ID NO: 1092322 - RNA, 22 nt, Human
aauguaaaauaucuuguacuug

SEQ ID NO: 1092323 - RNA, 22 nt, Human
aaaugcaaggauuuuguuaggc

SEQ ID NO: 1092324 - RNA, 19 nt, Human
cauuuagaaguacauauua

SEQ ID NO: 1092325 - RNA, 22 nt, Human
ugcucagacaagcugaacagua

SEQ ID NO: 1092326 - RNA, 22 nt, Human
ccaauuguccuaauuaauuaga

SEQ ID NO: 1092327 - RNA, 22 nt, Human
uuuggaaaaagccugaacauag

SEQ ID NO: 1092328 - RNA, 22 nt, Human
ccugggcucuauccugacccag

SEQ ID NO: 1092329 - RNA, 18 nt, Human
cccagcuggugggucagu

SEQ ID NO: 1092330 - RNA, 22 nt, Human
ugccucuguugagccuuggcug

SEQ ID NO: 1092331 - RNA, 22 nt, Human
ccugcuggacagggguguucau

SEQ ID NO: 1092332 - RNA, 17 nt, Human
cuggucccaccaagccc

SEQ ID NO: 1092333 - RNA, 22 nt, Human
ccaggcucugacauagauggga

SEQ ID NO: 1092334 - RNA, 22 nt, Human
uucuuuguuguacuuuccuaca

SEQ ID NO: 1092335 - RNA, 21 nt, Human
acauggacugugaauggggac

SEQ ID NO: 1092336 - RNA, 22 nt, Human
ucccagauuguugauggcuuaa

SEQ ID NO: 1092337 - RNA, 22 nt, Human
acccgggaggcaggagucauag

SEQ ID NO: 1092338 - RNA, 22 nt, Human
ugcugccuaacagaacucuuuc

SEQ ID NO: 1092339 - RNA, 17 nt, Human
uugggagagaaagguau

SEQ ID NO: 1092340 - RNA, 20 nt, Human
gucaucgccggcagcaaaga

SEQ ID NO: 1092341 - RNA, 22 nt, Human
auaugaagaauuccaauuugga

SEQ ID NO: 1092342 - RNA, 22 nt, Human
aggaggaggcuggaguacaccc

SEQ ID NO: 1092343 - RNA, 22 nt, Human
ugagcuggucacuccuucugaa

SEQ ID NO: 1092344 - RNA, 22 nt, Human
cugccuagaaaaccaggcuccu

SEQ ID NO: 1092345 - RNA, 22 nt, Human
uugauuaaaaugagacaucauu

SEQ ID NO: 1092346 - RNA, 22 nt, Human
acaucuuuuuggaaacggcuga

SEQ ID NO: 1092347 - RNA, 22 nt, Human
gucuuuuuauuauagaguggag

SEQ ID NO: 1092348 - RNA, 22 nt, Human
cuguggggaagauagaaccgac

SEQ ID NO: 1092349 - RNA, 22 nt, Human
gcugccuuuuaaagccucgcuu

SEQ ID NO: 1092350 - RNA, 22 nt, Human
cucagaauuaauaaccacaagg

SEQ ID NO: 1092351 - RNA, 22 nt, Human
aaggagaguacaggaguuggua

SEQ ID NO: 1092352 - RNA, 22 nt, Human
ugaccugcagucaagaggggaa

SEQ ID NO: 1092353 - RNA, 22 nt, Human
agucccagugagaugagccacg

SEQ ID NO: 1092354 - RNA, 22 nt, Human
caugauuauguguuagaguuug

SEQ ID NO: 1092355 - RNA, 22 nt, Human
gggcugacaaucucuuuacuua

SEQ ID NO: 1092356 - RNA, 22 nt, Human
ggagccagagcacuggggagcc

SEQ ID NO: 1092357 - RNA, 22 nt, Human
aguuacaaccaugacacaagca

SEQ ID NO: 1092358 - RNA, 22 nt, Human
aaacuacugaugccugggcccu

SEQ ID NO: 1092359 - RNA, 22 nt, Human
cacauuuaagugcuuguucaga

SEQ ID NO: 1092360 - RNA, 22 nt, Human
gggcaugagaggcaggcaagug

SEQ ID NO: 1092361 - RNA, 22 nt, Human
uuccuguaguugugcaauguac

SEQ ID NO: 1092362 - RNA, 22 nt, Human
uggcugagaaugggaugaugcc

SEQ ID NO: 1092363 - RNA, 22 nt, Human
uaagucaucacauugcagagau

SEQ ID NO: 1092364 - RNA, 22 nt, Human
ccagguaaauuaccuacugaau

SEQ ID NO: 1092365 - RNA, 22 nt, Human
uggcagagaacacggcugaucu

SEQ ID NO: 1092366 - RNA, 22 nt, Human
caugcagugacucagacacagg

SEQ ID NO: 1092367 - RNA, 22 nt, Human
cccugagcccauaguugacauu

SEQ ID NO: 1092368 - RNA, 21 nt, Human
cucuugucuuugcucaguagc

SEQ ID NO: 1092369 - RNA, 22 nt, Human
gggucccaggaaggagcagugu

SEQ ID NO: 1092370 - RNA, 22 nt, Human
uucaagucugcccagagucagc

SEQ ID NO: 1092371 - RNA, 22 nt, Human
uucuguauguacauauguguau

SEQ ID NO: 1092372 - RNA, 22 nt, Human
acacaguggugagucuggaccu

SEQ ID NO: 1092373 - RNA, 22 nt, Human
cuguugugaaauguccaucaac

SEQ ID NO: 1092374 - RNA, 22 nt, Human
ggaaagccaggugcucuggugu

SEQ ID NO: 1092375 - RNA, 23 nt, Human
aucugaaaaggcauuuucuuccc

SEQ ID NO: 1092376 - RNA, 22 nt, Human
uccuuaaauccuucagagauua

SEQ ID NO: 1092377 - RNA, 22 nt, Human
gauuucuugauaauucaaaucc

SEQ ID NO: 1092378 - RNA, 22 nt, Human
gagcugccagacaugggaauga

SEQ ID NO: 1092379 - RNA, 22 nt, Human
gcccuggaaucucuccauggga

SEQ ID NO: 1092380 - RNA, 18 nt, Human
auggucucauacugggag

SEQ ID NO: 1092381 - RNA, 22 nt, Human
ugccaucacugaacuucugaaa

SEQ ID NO: 1092382 - RNA, 22 nt, Human
aggauggggucugcagccuggu

SEQ ID NO: 1092383 - RNA, 22 nt, Human
agggagccuuccuggcuguggu

SEQ ID NO: 1092384 - RNA, 22 nt, Human
uuaaaaugaauauugauuagca

SEQ ID NO: 1092385 - RNA, 22 nt, Human
ucccagaguucaaugggaaggu

SEQ ID NO: 1092386 - RNA, 17 nt, Human
uucaaagcuuaucaagg

SEQ ID NO: 1092387 - RNA, 22 nt, Human
cagcagcccacgcgugcugucc

SEQ ID NO: 1092388 - RNA, 22 nt, Human
uuuacuaaguacuuguaucccu

SEQ ID NO: 1092389 - RNA, 20 nt, Human
ucccucagcacuucuaccuc

SEQ ID NO: 1092390 - RNA, 19 nt, Human
uuuauucaccuuuaccuug

SEQ ID NO: 1092391 - RNA, 22 nt, Human
aggaggugacagccugcaucug

SEQ ID NO: 1092392 - RNA, 22 nt, Human
cugcugugcuuguggccacccg

SEQ ID NO: 1092393 - RNA, 22 nt, Human
ucccccucauuaccucauucaa

SEQ ID NO: 1092394 - RNA, 22 nt, Human
uuauucagcauuuagaggaagg

SEQ ID NO: 1092395 - RNA, 22 nt, Human
cagcagagcugugugggaaggg

SEQ ID NO: 1092396 - RNA, 22 nt, Human
ccaaaguccacaguuuacauua

SEQ ID NO: 1092397 - RNA, 22 nt, Human
gacacauaugcguauaguuuag

SEQ ID NO: 1092398 - RNA, 22 nt, Human
ucaggaucaggggccuuuccuu

SEQ ID NO: 1092399 - RNA, 22 nt, Human
ucccccacucuaaaggagccuu

SEQ ID NO: 1092400 - RNA, 22 nt, Human
auacuuuuaauuccuucugagu

SEQ ID NO: 1092401 - RNA, 22 nt, Human
gcugagagugagcacuggauau

SEQ ID NO: 1092402 - RNA, 22 nt, Human
ggccugagcucuggggaggcaa

SEQ ID NO: 1092403 - RNA, 22 nt, Human
ugaaaugucaguguuuuauaag

SEQ ID NO: 1092404 - RNA, 22 nt, Human
uucuaguguccuuggacuugcu

SEQ ID NO: 1092405 - RNA, 22 nt, Human
ccugggaggcuguuuccagccu

SEQ ID NO: 1092406 - RNA, 22 nt, Human
uaaagccacgcuggaaaucagg

SEQ ID NO: 1092407 - RNA, 22 nt, Human
aggaagcucggagagggcaaau

SEQ ID NO: 1092408 - RNA, 22 nt, Human
ugaaaugauuauaugguguuug

SEQ ID NO: 1092409 - RNA, 22 nt, Human
cagcucccagaacugaccaugu

SEQ ID NO: 1092410 - RNA, 22 nt, Human
agaccccauaccucagcaggua

SEQ ID NO: 1092411 - RNA, 22 nt, Human
ggagacacagagcaacaaaaua

SEQ ID NO: 1092412 - RNA, 22 nt, Human
acucuugucucaacuuuuguau

SEQ ID NO: 1092413 - RNA, 22 nt, Human
agauaacauguugcagauucug

SEQ ID NO: 1092414 - RNA, 22 nt, Human
uucaguuuguuugacuguuaga

SEQ ID NO: 1092415 - RNA, 18 nt, Human
agaaggagcuaugggcag

SEQ ID NO: 1092416 - RNA, 22 nt, Human
gugggcuccccuggcaugucca

SEQ ID NO: 1092417 - RNA, 22 nt, Human
caggcagccugagggaucuggg

SEQ ID NO: 1092418 - RNA, 22 nt, Human
cuugucagccaauuguggauuu

SEQ ID NO: 1092419 - RNA, 22 nt, Human
uuuuucuaauggcuuaggaugu

SEQ ID NO: 1092420 - RNA, 22 nt, Human
agcagggcacuggaaggcacug

SEQ ID NO: 1092421 - RNA, 22 nt, Human
ggaggugaggccguagggugug

SEQ ID NO: 1092422 - RNA, 22 nt, Human
cagcaugguggagcugcucuuu

SEQ ID NO: 1092423 - RNA, 22 nt, Human
gcagcagcucucaaaguggucu

SEQ ID NO: 1092424 - RNA, 19 nt, Human
guggccugcgcugggugcg

SEQ ID NO: 1092425 - RNA, 23 nt, Human
acgcccucgcauccugagagccc

SEQ ID NO: 1092426 - RNA, 16 nt, Human
uguaugaacgucucca

SEQ ID NO: 1092427 - RNA, 22 nt, Human
aagcagccucauuugugguaag

SEQ ID NO: 1092428 - RNA, 19 nt, Human
gaguuauugccagggcaug

SEQ ID NO: 1092429 - RNA, 22 nt, Human
ucaguaaaauuacagaucuaca

SEQ ID NO: 1092430 - RNA, 22 nt, Human
acacaucuaucucuacacaagg

SEQ ID NO: 1092431 - RNA, 22 nt, Human
cuccucccaauugccaagugcu

SEQ ID NO: 1092432 - RNA, 15 nt, Human
ugauuuccuacuaac

SEQ ID NO: 1092433 - RNA, 22 nt, Human
aauguuugugcauaaauauguu

SEQ ID NO: 1092434 - RNA, 22 nt, Human
cugaggaguuuggguuguucaa

SEQ ID NO: 1092435 - RNA, 22 nt, Human
aucuacaaccccucaaacugug

SEQ ID NO: 1092436 - RNA, 22 nt, Human
aggaagaguguuaccuaugggu

SEQ ID NO: 1092437 - RNA, 22 nt, Human
caaaagcaguucuaucugaguu

SEQ ID NO: 1092438 - RNA, 22 nt, Human
cuggcuuccaugcuguaguggc

SEQ ID NO: 1092439 - RNA, 17 nt, Human
ccuuucucuuucaucuc

SEQ ID NO: 1092440 - RNA, 22 nt, Human
ucagaaaagacucaggggcuga

SEQ ID NO: 1092441 - RNA, 22 nt, Human
ucucauugguauauacaugugu

SEQ ID NO: 1092442 - RNA, 22 nt, Human
augugaaagagguguucagugg

SEQ ID NO: 1092443 - RNA, 18 nt, Human
gugugcaguugcaggggu

SEQ ID NO: 1092444 - RNA, 22 nt, Human
cagccucugacaccacagucgu

SEQ ID NO: 1092445 - RNA, 22 nt, Human
acuuucuauucccacagagaua

SEQ ID NO: 1092446 - RNA, 23 nt, Human
ggggaaagaccaugcuugaggac

SEQ ID NO: 1092447 - RNA, 18 nt, Human
accaggaagcuucuuguc

SEQ ID NO: 1092448 - RNA, 22 nt, Human
gccuuuugaaauagaaaucuga

SEQ ID NO: 1092449 - RNA, 22 nt, Human
ggggauggaauguaguagugau

SEQ ID NO: 1092450 - RNA, 22 nt, Human
uuuaauaucucacacuuccaug

SEQ ID NO: 1092451 - RNA, 20 nt, Human
cagaaauuuguaaaagggau

SEQ ID NO: 1092452 - RNA, 21 nt, Human
ugacauaauccauaguacaaa

SEQ ID NO: 1092453 - RNA, 22 nt, Human
gcaaagcagucuucugugccua

SEQ ID NO: 1092454 - RNA, 22 nt, Human
uccuuagagacaagaccaguuu

SEQ ID NO: 1092455 - RNA, 22 nt, Human
caucacuguccaaaguucaguu

SEQ ID NO: 1092456 - RNA, 22 nt, Human
agggcagcugugagccacugug

SEQ ID NO: 1092457 - RNA, 22 nt, Human
ggcugccauaacugauaccaua

SEQ ID NO: 1092458 - RNA, 22 nt, Human
ugcugccucugcugauauggcc

SEQ ID NO: 1092459 - RNA, 19 nt, Human
ccuggguccacucagacua

SEQ ID NO: 1092460 - RNA, 22 nt, Human
aucacauugccagugauuaccc

SEQ ID NO: 1092461 - RNA, 22 nt, Human
ucucugaggacuugggguugcc

SEQ ID NO: 1092462 - RNA, 22 nt, Human
gucccagggaugcagacaugag

SEQ ID NO: 1092463 - RNA, 22 nt, Human
ucugggcagaagcagugcaaag

SEQ ID NO: 1092464 - RNA, 22 nt, Human
cacaccaaaguauuugguauuu

SEQ ID NO: 1092465 - RNA, 22 nt, Human
aaagagaacuuuuacccaagaa

SEQ ID NO: 1092466 - RNA, 22 nt, Human
gagcagugggaaggaacagggu

SEQ ID NO: 1092467 - RNA, 22 nt, Human
gacuuauucacgcagcuauacu

SEQ ID NO: 1092468 - RNA, 22 nt, Human
ucugggggcgaccagggacugc

SEQ ID NO: 1092469 - RNA, 22 nt, Human
gcccucuggggcacacagagga

SEQ ID NO: 1092470 - RNA, 22 nt, Human
gaaaugucauagucuucaagcc

SEQ ID NO: 1092471 - RNA, 22 nt, Human
aagauucucagagugaaagaau

SEQ ID NO: 1092472 - RNA, 22 nt, Human
ccuguguccuaauccaucaggc

SEQ ID NO: 1092473 - RNA, 19 nt, Human
cacagcucugcucagggaa

SEQ ID NO: 1092474 - RNA, 22 nt, Human
guaucgguuuauuuuugggaua

SEQ ID NO: 1092475 - RNA, 22 nt, Human
cucaggagaugacagaagguau

SEQ ID NO: 1092476 - RNA, 22 nt, Human
aaauuuucagagcacuagagaa

SEQ ID NO: 1092477 - RNA, 22 nt, Human
aacaguuacccuuaagaucuuu

SEQ ID NO: 1092478 - RNA, 22 nt, Human
gcagcucucuggccugcccugg

SEQ ID NO: 1092479 - RNA, 22 nt, Human
agauuuauguggucacacucag

SEQ ID NO: 1092480 - RNA, 22 nt, Human
aggcccagggcugcucucugaa

SEQ ID NO: 1092481 - RNA, 22 nt, Human
uauauuaaccauaggguucuag

SEQ ID NO: 1092482 - RNA, 22 nt, Human
auggcuagcaccgcguugcugg

SEQ ID NO: 1092483 - RNA, 22 nt, Human
ucucagggccccaaaggcuagu

SEQ ID NO: 1092484 - RNA, 22 nt, Human
ccaaaguaaggcaauuccuaaa

SEQ ID NO: 1092485 - RNA, 22 nt, Human
uaagcaggggucaaguguacaa

SEQ ID NO: 1092486 - RNA, 22 nt, Human
ucauugaauuugguucaauaug

SEQ ID NO: 1092487 - RNA, 22 nt, Human
uugccagugccagcccaggcag

SEQ ID NO: 1092488 - RNA, 22 nt, Human
acuuugaaaagacaguagcucu

SEQ ID NO: 1092489 - RNA, 22 nt, Human
uaagacagggagggcucucagc

SEQ ID NO: 1092490 - RNA, 22 nt, Human
ccugguuucaggaacauaaucu

SEQ ID NO: 1092491 - RNA, 22 nt, Human
agccucucuuucugguggcuaa

SEQ ID NO: 1092492 - RNA, 17 nt, Human
auacaaagccauaaacc

SEQ ID NO: 1092493 - RNA, 22 nt, Human
ggaccacagugcauggccugua

SEQ ID NO: 1092494 - RNA, 22 nt, Human
cagucccagcugcucagaaggc

SEQ ID NO: 1092495 - RNA, 22 nt, Human
uaggaacauaugcagugcuuuu

SEQ ID NO: 1092496 - RNA, 22 nt, Human
aagcccucauccccaugggcgu

SEQ ID NO: 1092497 - RNA, 17 nt, Human
ugagacagggcaggccc

SEQ ID NO: 1092498 - RNA, 22 nt, Human
cacacaggaugaagcagcagaa

SEQ ID NO: 1092499 - RNA, 23 nt, Human
ucuggcuccauccuuggggaucc

SEQ ID NO: 1092500 - RNA, 22 nt, Human
ugcaaagaacuaagcagccuua

SEQ ID NO: 1092501 - RNA, 22 nt, Human
gcaggcagagaaggaacauuua

SEQ ID NO: 1092502 - RNA, 22 nt, Human
aauucuaaauguaauuuagaau

SEQ ID NO: 1092503 - RNA, 22 nt, Human
uacauacauuaccucauuuagu

SEQ ID NO: 1092504 - RNA, 22 nt, Human
uggagguggaguuggaaacuga

SEQ ID NO: 1092505 - RNA, 22 nt, Human
agcuccugggagcaggugguac

SEQ ID NO: 1092506 - RNA, 22 nt, Human
acauuucuuuucaucucuauau

SEQ ID NO: 1092507 - RNA, 22 nt, Human
cucuggaauuaaggaagccugu

SEQ ID NO: 1092508 - RNA, 22 nt, Human
gagagggcucuguguggguacu

SEQ ID NO: 1092509 - RNA, 22 nt, Human
caauaagccagguguuuguguu

SEQ ID NO: 1092510 - RNA, 20 nt, Human
augcccuguccucuucuguu

SEQ ID NO: 1092511 - RNA, 22 nt, Human
auggaagggacagaagggcaag

SEQ ID NO: 1092512 - RNA, 22 nt, Human
cuggcugggguccauccucuaa

SEQ ID NO: 1092513 - RNA, 22 nt, Human
ucucuuaauuguaaugguuccu

SEQ ID NO: 1092514 - RNA, 18 nt, Human
uguagagccagguuugcc

SEQ ID NO: 1092515 - RNA, 22 nt, Human
uauggaaagcucuuuuugauug

SEQ ID NO: 1092516 - RNA, 22 nt, Human
cagaggaggcgguauacacugc

SEQ ID NO: 1092517 - RNA, 22 nt, Human
ucuguaaucagaguagcagaua

SEQ ID NO: 1092518 - RNA, 22 nt, Human
gaggcucacgacgggacgaacu

SEQ ID NO: 1092519 - RNA, 22 nt, Human
uggcagcagacaaaaggccauu

SEQ ID NO: 1092520 - RNA, 22 nt, Human
ccuucaaaacacuaguuuuuga

SEQ ID NO: 1092521 - RNA, 22 nt, Human
cagcaguguggaagcugagggg

SEQ ID NO: 1092522 - RNA, 22 nt, Human
gggcugacauauuuggugcucu

SEQ ID NO: 1092523 - RNA, 22 nt, Human
acugagaggugauagugacauu

SEQ ID NO: 1092524 - RNA, 22 nt, Human
uaacagcauaugaaauuacugg

SEQ ID NO: 1092525 - RNA, 22 nt, Human
uuuggaauuggaaagugcugug

SEQ ID NO: 1092526 - RNA, 22 nt, Human
uaguuaauucuuuaagaacaag

SEQ ID NO: 1092527 - RNA, 22 nt, Human
ggcuucuguccucuggaucugu

SEQ ID NO: 1092528 - RNA, 18 nt, Human
ucuuuguuuccuucuugc

SEQ ID NO: 1092529 - RNA, 22 nt, Human
ucuggggagggagccacagguc

SEQ ID NO: 1092530 - RNA, 22 nt, Human
acauuugugggggaacaggaua

SEQ ID NO: 1092531 - RNA, 22 nt, Human
cuuuccuagauggccaucuuuc

SEQ ID NO: 1092532 - RNA, 22 nt, Human
gggcaugguggugcacaccugu

SEQ ID NO: 1092533 - RNA, 22 nt, Human
uguaacauauagcauguucuug

SEQ ID NO: 1092534 - RNA, 22 nt, Human
cuuccuuuccccaaucauaucg

SEQ ID NO: 1092535 - RNA, 22 nt, Human
cucuggaaaaccacuagcagga

SEQ ID NO: 1092536 - RNA, 22 nt, Human
gccccugggagcagagccacca

SEQ ID NO: 1092537 - RNA, 21 nt, Human
acuggcugguggcuaagaauc

SEQ ID NO: 1092538 - RNA, 22 nt, Human
gcagaagcccggucagcgcacg

SEQ ID NO: 1092539 - RNA, 22 nt, Human
ucacagaaggagggaagcuagu

SEQ ID NO: 1092540 - RNA, 22 nt, Human
ccugucuggccuuccacggggg

SEQ ID NO: 1092541 - RNA, 23 nt, Human
gccugcugucacagcgggcccag

SEQ ID NO: 1092542 - RNA, 22 nt, Human
gagucaguaauggauaugucau

SEQ ID NO: 1092543 - RNA, 22 nt, Human
uuucuggaaacggguucaagcu

SEQ ID NO: 1092544 - RNA, 22 nt, Human
aaggcagcaccgccuccugaaa

SEQ ID NO: 1092545 - RNA, 22 nt, Human
acagcacuuauucagcacagug

SEQ ID NO: 1092546 - RNA, 22 nt, Human
uugggcugaaguagagggcaga

SEQ ID NO: 1092547 - RNA, 22 nt, Human
acacauauguaugcaucaugug

SEQ ID NO: 1092548 - RNA, 22 nt, Human
gaaggagagagacaucgucccu

SEQ ID NO: 1092549 - RNA, 22 nt, Human
auggccuggggagcaugggaag

SEQ ID NO: 1092550 - RNA, 23 nt, Human
aucuguugugccucuuauaugua

SEQ ID NO: 1092551 - RNA, 22 nt, Human
cucuguuucucagccuauuucc

SEQ ID NO: 1092552 - RNA, 22 nt, Human
aggaggcucucagguccucccc

SEQ ID NO: 1092553 - RNA, 22 nt, Human
uucugcuuauucaaaugaucuu

SEQ ID NO: 1092554 - RNA, 22 nt, Human
ugaggcagccugcauuaaagag

SEQ ID NO: 1092555 - RNA, 22 nt, Human
acagugauuuuuucgagcagaa

SEQ ID NO: 1092556 - RNA, 22 nt, Human
gagaggccaccugacgagcagu

SEQ ID NO: 1092557 - RNA, 22 nt, Human
agcacugauuuaaacuggauuu

SEQ ID NO: 1092558 - RNA, 23 nt, Human
ucccaugggcucacugcccugca

SEQ ID NO: 1092559 - RNA, 22 nt, Human
gucaccagucccagcuccugaa

SEQ ID NO: 1092560 - RNA, 22 nt, Human
uacaaagugggaaacgaagguu

SEQ ID NO: 1092561 - RNA, 22 nt, Human
uugaaaugagcaaacugucagc

SEQ ID NO: 1092562 - RNA, 22 nt, Human
gugcccaggcccaaggcaccac

SEQ ID NO: 1092563 - RNA, 22 nt, Human
cuucauuuccauccaacuggga

SEQ ID NO: 1092564 - RNA, 22 nt, Human
acugggcugguuaguuuuacua

SEQ ID NO: 1092565 - RNA, 22 nt, Human
cugcuccaggauuucaggccag

SEQ ID NO: 1092566 - RNA, 16 nt, Human
uaaaucugugaucaca

SEQ ID NO: 1092567 - RNA, 22 nt, Human
aauagcucacugauuucucuuu

SEQ ID NO: 1092568 - RNA, 17 nt, Human
uuguguguaguucugau

SEQ ID NO: 1092569 - RNA, 22 nt, Human
uggaaauuuauucaucauucau

SEQ ID NO: 1092570 - RNA, 22 nt, Human
acagauuuuaaaugacacuccc

SEQ ID NO: 1092571 - RNA, 22 nt, Human
augccuggacugacaugcacug

SEQ ID NO: 1092572 - RNA, 22 nt, Human
gcagggugccgacuucagggau

SEQ ID NO: 1092573 - RNA, 22 nt, Human
cuucucagaggccagaagcuau

SEQ ID NO: 1092574 - RNA, 22 nt, Human
ugcauacacaugugcacauacg

SEQ ID NO: 1092575 - RNA, 22 nt, Human
gccaggaaguugggccagucua

SEQ ID NO: 1092576 - RNA, 22 nt, Human
gggugcugacuggggccugaaa

SEQ ID NO: 1092577 - RNA, 22 nt, Human
ucaggcugaggucaucugcauc

SEQ ID NO: 1092578 - RNA, 22 nt, Human
ccuguguggccaggcuggaguc

SEQ ID NO: 1092579 - RNA, 20 nt, Human
uccagggcuagggagcucau

SEQ ID NO: 1092580 - RNA, 22 nt, Human
uuccaagugcugaggacaguag

SEQ ID NO: 1092581 - RNA, 22 nt, Human
aggacagagggaccagagccca

SEQ ID NO: 1092582 - RNA, 22 nt, Human
aguggagcaggcggcgcucacu

SEQ ID NO: 1092583 - RNA, 22 nt, Human
aaucuacaugcaauauuuuuag

SEQ ID NO: 1092584 - RNA, 22 nt, Human
acaggagugaaucuggcacuua

SEQ ID NO: 1092585 - RNA, 22 nt, Human
uggccuggaaccuggcagggac

SEQ ID NO: 1092586 - RNA, 20 nt, Human
ccugucuggagacaaagaga

SEQ ID NO: 1092587 - RNA, 22 nt, Human
auaauuuuuguuugauguccaa

SEQ ID NO: 1092588 - RNA, 22 nt, Human
cugggacacccaaggaaagagc

SEQ ID NO: 1092589 - RNA, 22 nt, Human
uguaaaauaauucuccauguuu

SEQ ID NO: 1092590 - RNA, 22 nt, Human
gugaggggaguaaagccauguu

SEQ ID NO: 1092591 - RNA, 22 nt, Human
uaaacugaagcucaacucaaau

SEQ ID NO: 1092592 - RNA, 22 nt, Human
ggcuacagggccuggccaaggu

SEQ ID NO: 1092593 - RNA, 18 nt, Human
augcccuguugacuucag

SEQ ID NO: 1092594 - RNA, 22 nt, Human
ccuuuucuagaaagggaggcaa

SEQ ID NO: 1092595 - RNA, 22 nt, Human
aacacuguggucuuuucaguaa

SEQ ID NO: 1092596 - RNA, 22 nt, Human
caggccugugacaccgugucug

SEQ ID NO: 1092597 - RNA, 22 nt, Human
agcugccauccuguucagcacc

SEQ ID NO: 1092598 - RNA, 22 nt, Human
caggguggggcuggcuaucaaa

SEQ ID NO: 1092599 - RNA, 20 nt, Human
gcugaccccugcugucaugc

SEQ ID NO: 1092600 - RNA, 23 nt, Human
gggugggccaaauuagguagccu

SEQ ID NO: 1092601 - RNA, 22 nt, Human
cucgggcuugaggcuguuuacc

SEQ ID NO: 1092602 - RNA, 23 nt, Human
uggagcugggcagcugggaaagu

SEQ ID NO: 1092603 - RNA, 22 nt, Human
gagguggcugcuugcugggaaa

SEQ ID NO: 1092604 - RNA, 22 nt, Human
aaagauuuaagaauaauuugug

SEQ ID NO: 1092605 - RNA, 22 nt, Human
cuccucuuuggggauuuacaca

SEQ ID NO: 1092606 - RNA, 22 nt, Human
ucugcgcugccuugauccuugg

SEQ ID NO: 1092607 - RNA, 22 nt, Human
cugaggcugcccagggccaggu

SEQ ID NO: 1092608 - RNA, 22 nt, Human
uuguguaagaugcaauauggua

SEQ ID NO: 1092609 - RNA, 14 nt, Human
gcagguggaucacc

SEQ ID NO: 1092610 - RNA, 22 nt, Human
guguauaaugcuguuuguacau

SEQ ID NO: 1092611 - RNA, 22 nt, Human
acaguguacuaaauaguaagag

SEQ ID NO: 1092612 - RNA, 22 nt, Human
gggcuggaggaccggccucgga

SEQ ID NO: 1092613 - RNA, 22 nt, Human
ugucaguguauacauacaguau

SEQ ID NO: 1092614 - RNA, 22 nt, Human
uuggaggcaaugggaaggaggc

SEQ ID NO: 1092615 - RNA, 22 nt, Human
cuggggcuucaaugcuucggug

SEQ ID NO: 1092616 - RNA, 22 nt, Human
ggcagggaggaggugaaaguga

SEQ ID NO: 1092617 - RNA, 22 nt, Human
uguaagauauucagcuuauuga

SEQ ID NO: 1092618 - RNA, 22 nt, Human
augggcucuaugucuaggagau

SEQ ID NO: 1092619 - RNA, 19 nt, Human
uguuggugcggauguggag

SEQ ID NO: 1092620 - RNA, 22 nt, Human
uucaaagaauuuugagaccuga

SEQ ID NO: 1092621 - RNA, 22 nt, Human
uggagccaagagucaaggggag

SEQ ID NO: 1092622 - RNA, 22 nt, Human
ugucccuggaacuauggcucca

SEQ ID NO: 1092623 - RNA, 22 nt, Human
aauagcaauuacccuucaacuc

SEQ ID NO: 1092624 - RNA, 22 nt, Human
cauaagaaucuuccagggcaug

SEQ ID NO: 1092625 - RNA, 18 nt, Human
gcaaggcucaggccaggc

SEQ ID NO: 1092626 - RNA, 22 nt, Human
cugggagauugaggccauggug

SEQ ID NO: 1092627 - RNA, 22 nt, Human
cacaugggcguaauguccaugg

SEQ ID NO: 1092628 - RNA, 22 nt, Human
cuacauuuguucaaauaagcug

SEQ ID NO: 1092629 - RNA, 22 nt, Human
auuuccuagccucucuugcagu

SEQ ID NO: 1092630 - RNA, 22 nt, Human
gcaaagcauucuguggagucua

SEQ ID NO: 1092631 - RNA, 22 nt, Human
uuggccuuguuaaggaggcccu

SEQ ID NO: 1092632 - RNA, 22 nt, Human
gccaccagcagaaaaggggcca

SEQ ID NO: 1092633 - RNA, 22 nt, Human
guuuacaugcagaaaaucaaug

SEQ ID NO: 1092634 - RNA, 22 nt, Human
uucccaguauuaccuucaggaa

SEQ ID NO: 1092635 - RNA, 22 nt, Human
uuacaauugagucuauuguaug

SEQ ID NO: 1092636 - RNA, 22 nt, Human
auuuguacaaauuuauguuagu

SEQ ID NO: 1092637 - RNA, 22 nt, Human
gugcuuaaggcagucugucaaa

SEQ ID NO: 1092638 - RNA, 22 nt, Human
gucccuaguggaaagacaugau

SEQ ID NO: 1092639 - RNA, 22 nt, Human
ucagacaguuugcagugugccu

SEQ ID NO: 1092640 - RNA, 22 nt, Human
cacauucagguggcauguuaga

SEQ ID NO: 1092641 - RNA, 22 nt, Human
gcaggcaggcuuccuugaacug

SEQ ID NO: 1092642 - RNA, 21 nt, Human
uuuucuggaguaugucuccuc

SEQ ID NO: 1092643 - RNA, 22 nt, Human
agucuaauguuuguaaaaucau

SEQ ID NO: 1092644 - RNA, 22 nt, Human
guuuuauaauugcuucauaaga

SEQ ID NO: 1092645 - RNA, 22 nt, Human
cuucacagucacccugcugugu

SEQ ID NO: 1092646 - RNA, 23 nt, Human
gcccugcuccuggcugggaggga

SEQ ID NO: 1092647 - RNA, 22 nt, Human
cuggccagagguuccucugccc

SEQ ID NO: 1092648 - RNA, 22 nt, Human
gcuguucucuguaacaugcauu

SEQ ID NO: 1092649 - RNA, 22 nt, Human
gcagcccagguguagcucuuug

SEQ ID NO: 1092650 - RNA, 22 nt, Human
ugccaggcuccggaacgacagu

SEQ ID NO: 1092651 - RNA, 22 nt, Human
auuguaaaguacuguguacaau

SEQ ID NO: 1092652 - RNA, 22 nt, Human
gccuggagaagauggaacuagc

SEQ ID NO: 1092653 - RNA, 22 nt, Human
gacauuuagaaguuagauucaa

SEQ ID NO: 1092654 - RNA, 22 nt, Human
aaugaugggaaggagaaaagca

SEQ ID NO: 1092655 - RNA, 22 nt, Human
uggccaaauuugguguaacuug

SEQ ID NO: 1092656 - RNA, 22 nt, Human
uuuaaaauuuagaccucuccac

SEQ ID NO: 1092657 - RNA, 22 nt, Human
ucuaagaaaucagaugaugagg

SEQ ID NO: 1092658 - RNA, 22 nt, Human
agaggcuccuucacucuggcac

SEQ ID NO: 1092659 - RNA, 22 nt, Human
ccagcagcuuuauuggcucucc

SEQ ID NO: 1092660 - RNA, 22 nt, Human
ccaguggccaugcacgagcagc

SEQ ID NO: 1092661 - RNA, 22 nt, Human
aagacugucuuuucugagugac

SEQ ID NO: 1092662 - RNA, 22 nt, Human
ccagcccuguaaggaugaggca

SEQ ID NO: 1092663 - RNA, 22 nt, Human
acagcugggugcugcucagagc

SEQ ID NO: 1092664 - RNA, 23 nt, Human
uugcuucugugcaauucaguacu

SEQ ID NO: 1092665 - RNA, 21 nt, Human
cucacaggaugcaguguuacu

SEQ ID NO: 1092666 - RNA, 22 nt, Human
uguuugcacauucguuucaaua

SEQ ID NO: 1092667 - RNA, 23 nt, Human
aggggcagcaaguuuugguguua

SEQ ID NO: 1092668 - RNA, 22 nt, Human
uauuuuugccucucagauaaaa

SEQ ID NO: 1092669 - RNA, 22 nt, Human
uacuauuuugacaugaaauuga

SEQ ID NO: 1092670 - RNA, 22 nt, Human
gaaggccacuuuguguugagaa

SEQ ID NO: 1092671 - RNA, 23 nt, Human
uagcaaaguuguuugggaaauuu

SEQ ID NO: 1092672 - RNA, 22 nt, Human
cccagcucaucaggagccgccc

SEQ ID NO: 1092673 - RNA, 22 nt, Human
ccagguacuugguaugcauuca

SEQ ID NO: 1092674 - RNA, 22 nt, Human
aguauuucuucauaugauuacu

SEQ ID NO: 1092675 - RNA, 22 nt, Human
uaauuucaccguugcuagaaau

SEQ ID NO: 1092676 - RNA, 19 nt, Human
aucauacauguuacacucu

SEQ ID NO: 1092677 - RNA, 22 nt, Human
cugucaacauuggugucuguca

SEQ ID NO: 1092678 - RNA, 22 nt, Human
ugcagugaugcuucuggcucag

SEQ ID NO: 1092679 - RNA, 18 nt, Human
aaggcacaggagaacauu

SEQ ID NO: 1092680 - RNA, 22 nt, Human
acagacacaggcguggagucgc

SEQ ID NO: 1092681 - RNA, 22 nt, Human
gagaaagcuucuuucccacagg

SEQ ID NO: 1092682 - RNA, 22 nt, Human
cagugggcugugauggauucac

SEQ ID NO: 1092683 - RNA, 22 nt, Human
uucuaaacuucaauucuaaauu

SEQ ID NO: 1092684 - RNA, 22 nt, Human
cagcaggcagccauuucacugu

SEQ ID NO: 1092685 - RNA, 20 nt, Human
agugcccuccgacauuguuu

SEQ ID NO: 1092686 - RNA, 22 nt, Human
caccugcccagcaccugggauc

SEQ ID NO: 1092687 - RNA, 22 nt, Human
ugacaagaggcagaaucagcug

SEQ ID NO: 1092688 - RNA, 22 nt, Human
caaguuuggauuaugaaaaagu

SEQ ID NO: 1092689 - RNA, 22 nt, Human
cuucugugcuucacaguugcca

SEQ ID NO: 1092690 - RNA, 22 nt, Human
guggcugcucgggcuccggccc

SEQ ID NO: 1092691 - RNA, 22 nt, Human
auccuuaauuuccugggccuca

SEQ ID NO: 1092692 - RNA, 17 nt, Human
ugaggcucggugaggag

SEQ ID NO: 1092693 - RNA, 22 nt, Human
aucuuagacccuugguagaaaa

SEQ ID NO: 1092694 - RNA, 22 nt, Human
caucuagaaaaaagaccuguug

SEQ ID NO: 1092695 - RNA, 23 nt, Human
aggcccugccugucccucuuuuu

SEQ ID NO: 1092696 - RNA, 22 nt, Human
ucucagggccucccucuguuuc

SEQ ID NO: 1092697 - RNA, 22 nt, Human
aguccauagaggcugcuuucau

SEQ ID NO: 1092698 - RNA, 22 nt, Human
cuccucugucuaccacgagggu

SEQ ID NO: 1092699 - RNA, 22 nt, Human
uggggcuguccuuagucugaga

SEQ ID NO: 1092700 - RNA, 22 nt, Human
uaaacaucugucauguguuuau

SEQ ID NO: 1092701 - RNA, 22 nt, Human
cggcugugucuucacaggagcc

SEQ ID NO: 1092702 - RNA, 22 nt, Human
ugcucugucaagaaaagaugcc

SEQ ID NO: 1092703 - RNA, 22 nt, Human
aggcugaggcagguggaucauu

SEQ ID NO: 1092704 - RNA, 22 nt, Human
uggcacugaagcuggaaagccu

SEQ ID NO: 1092705 - RNA, 22 nt, Human
ccacagaaaguugucuagagua

SEQ ID NO: 1092706 - RNA, 22 nt, Human
uuucacaggauucugauguagu

SEQ ID NO: 1092707 - RNA, 22 nt, Human
acagcugaacaagauaguguca

SEQ ID NO: 1092708 - RNA, 21 nt, Human
ucucugggcccuccugugggg

SEQ ID NO: 1092709 - RNA, 22 nt, Human
uucaaugagcccaagaacguga

SEQ ID NO: 1092710 - RNA, 22 nt, Human
acugugcaucuauugccauuua

SEQ ID NO: 1092711 - RNA, 22 nt, Human
gcccagggcgauggucggggcc

SEQ ID NO: 1092712 - RNA, 23 nt, Human
cagcugaagcagccugggcugga

SEQ ID NO: 1092713 - RNA, 16 nt, Human
uagggcugggaaggag

SEQ ID NO: 1092714 - RNA, 22 nt, Human
ucagaagcugguguccuuugaa

SEQ ID NO: 1092715 - RNA, 22 nt, Human
cuguggcucucugcaggguccc

SEQ ID NO: 1092716 - RNA, 22 nt, Human
aaauaacuuucuguguauaguc

SEQ ID NO: 1092717 - RNA, 22 nt, Human
uuucuggcagcgggacaggggu

SEQ ID NO: 1092718 - RNA, 22 nt, Human
uuuuaucagcagggauaacaag

SEQ ID NO: 1092719 - RNA, 22 nt, Human
cuaauuguaagcuccuugaggg

SEQ ID NO: 1092720 - RNA, 22 nt, Human
cauguuaaaauauacauucuga

SEQ ID NO: 1092721 - RNA, 22 nt, Human
agaaaacacugcccccucucuc

SEQ ID NO: 1092722 - RNA, 22 nt, Human
ggagccuggccuggcucugugu

SEQ ID NO: 1092723 - RNA, 22 nt, Human
agucucagggccacccggggaa

SEQ ID NO: 1092724 - RNA, 22 nt, Human
cagcugcuguuacugcuuauua

SEQ ID NO: 1092725 - RNA, 22 nt, Human
aauaaacaaauccuuccuuccc

SEQ ID NO: 1092726 - RNA, 23 nt, Human
gcugcagcuguggauguucucag

SEQ ID NO: 1092727 - RNA, 22 nt, Human
caugacauuuuaaaaagaacau

SEQ ID NO: 1092728 - RNA, 22 nt, Human
cugggggcaauggucagagugu

SEQ ID NO: 1092729 - RNA, 22 nt, Human
ugauuaacugucuauuaaucau

SEQ ID NO: 1092730 - RNA, 22 nt, Human
uucccacagagauuacauugaa

SEQ ID NO: 1092731 - RNA, 22 nt, Human
uuauuguaggccuauuguagaa

SEQ ID NO: 1092732 - RNA, 20 nt, Human
uccuggccuucucgggcagu

SEQ ID NO: 1092733 - RNA, 22 nt, Human
ugggcugaaaugcuguggacua

SEQ ID NO: 1092734 - RNA, 22 nt, Human
acagcagccuuguugguuucga

SEQ ID NO: 1092735 - RNA, 22 nt, Human
ggcgagggagcagugcgguggg

SEQ ID NO: 1092736 - RNA, 22 nt, Human
ugauuuuuggaucugagcugca

SEQ ID NO: 1092737 - RNA, 22 nt, Human
ggccugagaaccauggggccaa

SEQ ID NO: 1092738 - RNA, 22 nt, Human
uuuucaaagacuggaggcugau

SEQ ID NO: 1092739 - RNA, 22 nt, Human
ugcaccugagaggucucugagg

SEQ ID NO: 1092740 - RNA, 22 nt, Human
gcuugaaaauucauagguauuu

SEQ ID NO: 1092741 - RNA, 22 nt, Human
ucacaguaucacacaaggauua

SEQ ID NO: 1092742 - RNA, 19 nt, Human
gggcagaauggcaucucag

SEQ ID NO: 1092743 - RNA, 22 nt, Human
cacagggcagagaccugggugc

SEQ ID NO: 1092744 - RNA, 22 nt, Human
ggugcagaaggaagggagcugg

SEQ ID NO: 1092745 - RNA, 22 nt, Human
agcugcccugggucuugcugcu

SEQ ID NO: 1092746 - RNA, 22 nt, Human
agcaaggcagucagcuggcugg

SEQ ID NO: 1092747 - RNA, 22 nt, Human
caagggcucuuuugaggaaugu

SEQ ID NO: 1092748 - RNA, 22 nt, Human
uuauuuauuguguaccuacugu

SEQ ID NO: 1092749 - RNA, 22 nt, Human
ugcagggccuugggaugugucc

SEQ ID NO: 1092750 - RNA, 22 nt, Human
ugcugagagccagggcuggcau

SEQ ID NO: 1092751 - RNA, 22 nt, Human
agugcaaaaaaguguugugaca

SEQ ID NO: 1092752 - RNA, 20 nt, Human
aagagaagaagucuuugaaa

SEQ ID NO: 1092753 - RNA, 22 nt, Human
ugggccuuggaucgcuaagcug

SEQ ID NO: 1092754 - RNA, 22 nt, Human
gagggugggcuuuguuccucca

SEQ ID NO: 1092755 - RNA, 22 nt, Human
ccuggcugcugucacugaccau

SEQ ID NO: 1092756 - RNA, 22 nt, Human
caggaagggggauccuuggaag

SEQ ID NO: 1092757 - RNA, 22 nt, Human
uuucaaagucaauaucauuacc

SEQ ID NO: 1092758 - RNA, 22 nt, Human
gguggcaguuacaggggcaaau

SEQ ID NO: 1092759 - RNA, 22 nt, Human
guuauacauauguguuaacaaa

SEQ ID NO: 1092760 - RNA, 22 nt, Human
uccugaagaacgaagucaugua

SEQ ID NO: 1092761 - RNA, 22 nt, Human
gagaauaucuuggcagucucug

SEQ ID NO: 1092762 - RNA, 22 nt, Human
ugcuggcuggccuggccuggac

SEQ ID NO: 1092763 - RNA, 22 nt, Human
acugccugaugugguucuaaau

SEQ ID NO: 1092764 - RNA, 22 nt, Human
cuacuucuaaguacauggugau

SEQ ID NO: 1092765 - RNA, 22 nt, Human
caguauuuuccuuguuaacuua

SEQ ID NO: 1092766 - RNA, 22 nt, Human
gggcagugguuacacagcugag

SEQ ID NO: 1092767 - RNA, 22 nt, Human
ugaggccucauaaugagauuuc

SEQ ID NO: 1092768 - RNA, 22 nt, Human
uguuccaugucuuuguaggacu

SEQ ID NO: 1092769 - RNA, 22 nt, Human
uucugaggcauagaggaugaga

SEQ ID NO: 1092770 - RNA, 22 nt, Human
agucagcagugaaagcacagcc

SEQ ID NO: 1092771 - RNA, 22 nt, Human
gccuccuggaagucacauguuu

SEQ ID NO: 1092772 - RNA, 22 nt, Human
uggcugaaucugcagcaggaag

SEQ ID NO: 1092773 - RNA, 22 nt, Human
acaugcuuuaacuuauuuugau

SEQ ID NO: 1092774 - RNA, 22 nt, Human
cggcugaggaucuccaggccug

SEQ ID NO: 1092775 - RNA, 22 nt, Human
ucauuucuuaacuagagugaac

SEQ ID NO: 1092776 - RNA, 22 nt, Human
ccauggcauuuuaugugucuua

SEQ ID NO: 1092777 - RNA, 22 nt, Human
uaauuauuugaagacauuagag

SEQ ID NO: 1092778 - RNA, 22 nt, Human
uacuuaaaacugauagaaucuc

SEQ ID NO: 1092779 - RNA, 22 nt, Human
uauguaagugagaucauggagu

SEQ ID NO: 1092780 - RNA, 22 nt, Human
cugcuucuccaaaguaggacuu

SEQ ID NO: 1092781 - RNA, 22 nt, Human
aaaugcaugguaaaugauugcc

SEQ ID NO: 1092782 - RNA, 22 nt, Human
cucugucccagacccaccucuc

SEQ ID NO: 1092783 - RNA, 22 nt, Human
cuuugacauccuuguuccucag

SEQ ID NO: 1092784 - RNA, 22 nt, Human
cgcagguguucaguaaauguau

SEQ ID NO: 1092785 - RNA, 22 nt, Human
ugcaggugcugugucaagagag

SEQ ID NO: 1092786 - RNA, 18 nt, Human
ugaauuaguuugugguuu

SEQ ID NO: 1092787 - RNA, 22 nt, Human
agaaaucaugacuaagagcagu

SEQ ID NO: 1092788 - RNA, 22 nt, Human
auacaucaccuauauauucaca

SEQ ID NO: 1092789 - RNA, 20 nt, Human
uugugguuuagauuaucuga

SEQ ID NO: 1092790 - RNA, 22 nt, Human
caaaggcugccacuguggcugu

SEQ ID NO: 1092791 - RNA, 22 nt, Human
gggcuggcucugucuagaaagg

SEQ ID NO: 1092792 - RNA, 22 nt, Human
ccucagcugcuucccuggagcc

SEQ ID NO: 1092793 - RNA, 23 nt, Human
ggcucugugcugggccugcagga

SEQ ID NO: 1092794 - RNA, 22 nt, Human
uccuggaggggacagcaugggc

SEQ ID NO: 1092795 - RNA, 22 nt, Human
uacaaauggguuaaaauauagu

SEQ ID NO: 1092796 - RNA, 22 nt, Human
gaaauaagaguccaugccaggu

SEQ ID NO: 1092797 - RNA, 22 nt, Human
caggucccgccccgggcugacc

SEQ ID NO: 1092798 - RNA, 22 nt, Human
cugagcuuccaguuccuccagg

SEQ ID NO: 1092799 - RNA, 22 nt, Human
ucuuaagcagagaagaaguuga

SEQ ID NO: 1092800 - RNA, 17 nt, Human
aguggcaggcagauggg

SEQ ID NO: 1092801 - RNA, 18 nt, Human
cugcugugucgucugggc

SEQ ID NO: 1092802 - RNA, 22 nt, Human
gauuuucaugauaaacuuguga

SEQ ID NO: 1092803 - RNA, 22 nt, Human
ugggacagggaaucugaucccc

SEQ ID NO: 1092804 - RNA, 22 nt, Human
uccccucuggaggcugcagggg

SEQ ID NO: 1092805 - RNA, 22 nt, Human
aaaagagguuaaccaggugugu

SEQ ID NO: 1092806 - RNA, 22 nt, Human
auuuucaagggagaggccucug

SEQ ID NO: 1092807 - RNA, 22 nt, Human
cucagaguccccaguggguuug

SEQ ID NO: 1092808 - RNA, 22 nt, Human
caggaacaauguaagucucauu

SEQ ID NO: 1092809 - RNA, 22 nt, Human
agcucuggaccugacaucuggu

SEQ ID NO: 1092810 - RNA, 22 nt, Human
gugcagagaaaugagaagucga

SEQ ID NO: 1092811 - RNA, 22 nt, Human
ugugucagaaggcaauggggau

SEQ ID NO: 1092812 - RNA, 23 nt, Human
uauuuggaaagagggaagaagac

SEQ ID NO: 1092813 - RNA, 22 nt, Human
gaacaauagugguaacaaagcc

SEQ ID NO: 1092814 - RNA, 22 nt, Human
cuugaauugggggaagaucacu

SEQ ID NO: 1092815 - RNA, 22 nt, Human
uaacauccuacacuguugucuu

SEQ ID NO: 1092816 - RNA, 22 nt, Human
auguuucaggcgaacuaacaug

SEQ ID NO: 1092817 - RNA, 22 nt, Human
agcuguguccugaagacacugc

SEQ ID NO: 1092818 - RNA, 22 nt, Human
agcagacaacccagaugaccca

SEQ ID NO: 1092819 - RNA, 22 nt, Human
uuggccuucccuaccugggcca

SEQ ID NO: 1092820 - RNA, 22 nt, Human
uuuacacugcuugaacaaucuc

SEQ ID NO: 1092821 - RNA, 18 nt, Human
aggcccuggccucgaaca

SEQ ID NO: 1092822 - RNA, 22 nt, Human
uuugccaggcuugcaugaauuu

SEQ ID NO: 1092823 - RNA, 22 nt, Human
agagugcaaccgaaacaagcag

SEQ ID NO: 1092824 - RNA, 22 nt, Human
cuugggcucugugggccuuagu

SEQ ID NO: 1092825 - RNA, 23 nt, Human
cugucuccugggcuagguggaau

SEQ ID NO: 1092826 - RNA, 22 nt, Human
accuggagucauuugaggagua

SEQ ID NO: 1092827 - RNA, 22 nt, Human
ucuuuuauccuacauuuagcuc

SEQ ID NO: 1092828 - RNA, 22 nt, Human
ucaccagggagcuuguccucug

SEQ ID NO: 1092829 - RNA, 22 nt, Human
aucuucagcgagguuuccuuuc

SEQ ID NO: 1092830 - RNA, 20 nt, Human
cagauucuccacuaacauau

SEQ ID NO: 1092831 - RNA, 22 nt, Human
cugugcaaaggccuuauguuuu

SEQ ID NO: 1092832 - RNA, 22 nt, Human
gccucaggacuggcauacucau

SEQ ID NO: 1092833 - RNA, 22 nt, Human
ccagagcccgggaccuggacuu

SEQ ID NO: 1092834 - RNA, 21 nt, Human
uccaggccucaggaagggaug

SEQ ID NO: 1092835 - RNA, 22 nt, Human
ucccagacaaucauuggccacc

SEQ ID NO: 1092836 - RNA, 22 nt, Human
ucuuugaaagcuguucuagagu

SEQ ID NO: 1092837 - RNA, 22 nt, Human
uagcuucccuagcuaaagaggu

SEQ ID NO: 1092838 - RNA, 22 nt, Human
agcacagauuugucaacauaga

SEQ ID NO: 1092839 - RNA, 22 nt, Human
gcuuccaguaaguugcugccau

SEQ ID NO: 1092840 - RNA, 22 nt, Human
caaugaaagcaacugccuauaa

SEQ ID NO: 1092841 - RNA, 22 nt, Human
uuugaaagcuacuuucggguca

SEQ ID NO: 1092842 - RNA, 22 nt, Human
uuuucuaaaagaagucacugau

SEQ ID NO: 1092843 - RNA, 22 nt, Human
auugcaaaugagucuuaauaua

SEQ ID NO: 1092844 - RNA, 22 nt, Human
cuucuaagcugagaaugccuuu

SEQ ID NO: 1092845 - RNA, 22 nt, Human
gcucugagccgggggccugucc

SEQ ID NO: 1092846 - RNA, 22 nt, Human
ugaacacauuuucuucaguaga

SEQ ID NO: 1092847 - RNA, 22 nt, Human
ggcaggugcucaaaaauauuug

SEQ ID NO: 1092848 - RNA, 22 nt, Human
uuuuaacuuaaaauacauagau

SEQ ID NO: 1092849 - RNA, 22 nt, Human
agugaaauccuggucaacaggu

SEQ ID NO: 1092850 - RNA, 22 nt, Human
cagguggggcagcugugggagc

SEQ ID NO: 1092851 - RNA, 22 nt, Human
cuggcucauccagguguugcuc

SEQ ID NO: 1092852 - RNA, 22 nt, Human
uacauuguguuaaaacagaaga

SEQ ID NO: 1092853 - RNA, 22 nt, Human
gcaguggcagcugaggggguau

SEQ ID NO: 1092854 - RNA, 22 nt, Human
ucaguaaaugagcaaaaauuuc

SEQ ID NO: 1092855 - RNA, 22 nt, Human
agaugguguuuccccaggugga

SEQ ID NO: 1092856 - RNA, 22 nt, Human
uccaggaacgagaggcugggca

SEQ ID NO: 1092857 - RNA, 22 nt, Human
gggccugggaacuugcauuuag

SEQ ID NO: 1092858 - RNA, 22 nt, Human
aggugggcccagugggcuccag

SEQ ID NO: 1092859 - RNA, 22 nt, Human
gcaggagcugcucuccugacga

SEQ ID NO: 1092860 - RNA, 22 nt, Human
gggagaaggagcuaguucuuga

SEQ ID NO: 1092861 - RNA, 22 nt, Human
acagguggaaacaugguguugg

SEQ ID NO: 1092862 - RNA, 22 nt, Human
uuucuguuaggcaucauuuuaa

SEQ ID NO: 1092863 - RNA, 22 nt, Human
aaauagcacagcagcugaggcu

SEQ ID NO: 1092864 - RNA, 22 nt, Human
ucagaggauuggacuuuuaugu

SEQ ID NO: 1092865 - RNA, 22 nt, Human
cugucuggauauaccuuggcca

SEQ ID NO: 1092866 - RNA, 22 nt, Human
gcagugaguuaugaucaugcca

SEQ ID NO: 1092867 - RNA, 22 nt, Human
gcugcucugugacagccuccgg

SEQ ID NO: 1092868 - RNA, 22 nt, Human
acaguucccgucuugcacagcu

SEQ ID NO: 1092869 - RNA, 22 nt, Human
auacaagugauauaauuguuuc

SEQ ID NO: 1092870 - RNA, 22 nt, Human
uuucuauugaucuaauaaacau

SEQ ID NO: 1092871 - RNA, 22 nt, Human
uucuccaaguagaagcuaaguu

SEQ ID NO: 1092872 - RNA, 22 nt, Human
agcagggcccacuaggggagau

SEQ ID NO: 1092873 - RNA, 22 nt, Human
auuuacauuccauggugguuac

SEQ ID NO: 1092874 - RNA, 22 nt, Human
cucucccccacagcagccuucu

SEQ ID NO: 1092875 - RNA, 22 nt, Human
uccuggcccuguggccugcagu

SEQ ID NO: 1092876 - RNA, 22 nt, Human
ccaggaacuaagaauccuuuag

SEQ ID NO: 1092877 - RNA, 22 nt, Human
gaauaacagcaaguuugcaggc

SEQ ID NO: 1092878 - RNA, 22 nt, Human
gaggccuggagccgccuaggcg

SEQ ID NO: 1092879 - RNA, 22 nt, Human
uggcugaggcuuuucuuaaaga

SEQ ID NO: 1092880 - RNA, 22 nt, Human
uuccucagagagacagaaacua

SEQ ID NO: 1092881 - RNA, 22 nt, Human
ucaguuccucugcccaaggcag

SEQ ID NO: 1092882 - RNA, 19 nt, Human
cugguccugacugaggggu

SEQ ID NO: 1092883 - RNA, 22 nt, Human
gcucuugucaaaaauuaguuga

SEQ ID NO: 1092884 - RNA, 22 nt, Human
uggcccucagucuugcuccugc

SEQ ID NO: 1092885 - RNA, 22 nt, Human
uuuucauuuacauuagggaaga

SEQ ID NO: 1092886 - RNA, 22 nt, Human
ggcacagagcuuugucccaguu

SEQ ID NO: 1092887 - RNA, 22 nt, Human
gauuuacagaucuaagggucac

SEQ ID NO: 1092888 - RNA, 22 nt, Human
gccaggaaaaacguggugggag

SEQ ID NO: 1092889 - RNA, 22 nt, Human
gcucagagcuugaaguuccacu

SEQ ID NO: 1092890 - RNA, 22 nt, Human
gggcccuggggccugauuugca

SEQ ID NO: 1092891 - RNA, 22 nt, Human
cauuuccugucuggaggucaaa

SEQ ID NO: 1092892 - RNA, 22 nt, Human
aauuccaacagacaaaguuaga

SEQ ID NO: 1092893 - RNA, 22 nt, Human
ucagaacuuaaagccgauuggg

SEQ ID NO: 1092894 - RNA, 22 nt, Human
agggcagcagcggcccaggccu

SEQ ID NO: 1092895 - RNA, 22 nt, Human
gcucucuguuauuaagaucuuu

SEQ ID NO: 1092896 - RNA, 22 nt, Human
ucagcagucacauguuguccca

SEQ ID NO: 1092897 - RNA, 22 nt, Human
cugcccuguuuggacagcccgg

SEQ ID NO: 1092898 - RNA, 22 nt, Human
ucaaguguaguggugucagguc

SEQ ID NO: 1092899 - RNA, 18 nt, Human
gggcuguguucaugccca

SEQ ID NO: 1092900 - RNA, 22 nt, Human
aaguguuuaaauuauuugcagg

SEQ ID NO: 1092901 - RNA, 22 nt, Human
gcuccuggguguggcugccccu

SEQ ID NO: 1092902 - RNA, 22 nt, Human
acugcagccuuugggcucauaa

SEQ ID NO: 1092903 - RNA, 22 nt, Human
gggcagcaguugcccuaaucaa

SEQ ID NO: 1092904 - RNA, 22 nt, Human
aagaugauaggacuugcuuaag

SEQ ID NO: 1092905 - RNA, 22 nt, Human
uuccuggugguggugacagcac

SEQ ID NO: 1092906 - RNA, 22 nt, Human
uucagaaugugaccuuauuugg

SEQ ID NO: 1092907 - RNA, 22 nt, Human
aggaagccaugguggacgucua

SEQ ID NO: 1092908 - RNA, 16 nt, Human
ggcuuuaauuuauccc

SEQ ID NO: 1092909 - RNA, 22 nt, Human
guucacaguuuuauaccugaga

SEQ ID NO: 1092910 - RNA, 22 nt, Human
uuucacaucagagguagauuag

SEQ ID NO: 1092911 - RNA, 22 nt, Human
gcaccaugacagugaggagaac

SEQ ID NO: 1092912 - RNA, 20 nt, Human
guccaggacccagcaggagg

SEQ ID NO: 1092913 - RNA, 22 nt, Human
uacuuauugguucagaaguuua

SEQ ID NO: 1092914 - RNA, 22 nt, Human
cagucaggggugggaucaaggc

SEQ ID NO: 1092915 - RNA, 22 nt, Human
ucauuucaaugauacuacuaag

SEQ ID NO: 1092916 - RNA, 22 nt, Human
ggaggccuagccagcuccaguu

SEQ ID NO: 1092917 - RNA, 22 nt, Human
ucagacagaaagaugaguaugg

SEQ ID NO: 1092918 - RNA, 20 nt, Human
acagauauuugauuuucagu

SEQ ID NO: 1092919 - RNA, 22 nt, Human
agcacacagucuuccuuccucc

SEQ ID NO: 1092920 - RNA, 22 nt, Human
uagaaaucauuuagaaguauug

SEQ ID NO: 1092921 - RNA, 22 nt, Human
gugcugggugcugcagacaggu

SEQ ID NO: 1092922 - RNA, 22 nt, Human
gcagcaugagcuauacaaagua

SEQ ID NO: 1092923 - RNA, 22 nt, Human
gaguuaauucgaauauucuagc

SEQ ID NO: 1092924 - RNA, 22 nt, Human
uuuccuaggagauugaucacau

SEQ ID NO: 1092925 - RNA, 19 nt, Human
uguccuguccugcucugac

SEQ ID NO: 1092926 - RNA, 22 nt, Human
gggcuggcucccagguguugaa

SEQ ID NO: 1092927 - RNA, 22 nt, Human
aacaacuugcguucagagaugu

SEQ ID NO: 1092928 - RNA, 22 nt, Human
ugggccucugccacgcuccccc

SEQ ID NO: 1092929 - RNA, 22 nt, Human
gaacacuugcuguuaauaagug

SEQ ID NO: 1092930 - RNA, 22 nt, Human
ucuucuccagugcuucugcaca

SEQ ID NO: 1092931 - RNA, 22 nt, Human
gcuggcugguccagcaggggcu

SEQ ID NO: 1092932 - RNA, 22 nt, Human
auuccuuuggacuccuccuugc

SEQ ID NO: 1092933 - RNA, 20 nt, Human
ucaauuucagguagcauagu

SEQ ID NO: 1092934 - RNA, 22 nt, Human
gaguuguucaacgugugugaaa

SEQ ID NO: 1092935 - RNA, 22 nt, Human
gugggcuuugcuggauccuucc

SEQ ID NO: 1092936 - RNA, 22 nt, Human
ggcaggugcugggagcaucuca

SEQ ID NO: 1092937 - RNA, 22 nt, Human
aucuacaggcugaggugggagg

SEQ ID NO: 1092938 - RNA, 23 nt, Human
gcuauagguagaaggaaucuuuu

SEQ ID NO: 1092939 - RNA, 22 nt, Human
ccugaggcccuggcugugcuga

SEQ ID NO: 1092940 - RNA, 22 nt, Human
ccagugggugcugggcucugcc

SEQ ID NO: 1092941 - RNA, 22 nt, Human
caccagguggaaaugucacagc

SEQ ID NO: 1092942 - RNA, 22 nt, Human
aagucagcacuccaggaagcca

SEQ ID NO: 1092943 - RNA, 22 nt, Human
gcugccuguccugaggaguccg

SEQ ID NO: 1092944 - RNA, 22 nt, Human
ccauuuguaccauuucuuugua

SEQ ID NO: 1092945 - RNA, 22 nt, Human
cgcugggcgccgaccugcuggc

SEQ ID NO: 1092946 - RNA, 22 nt, Human
cagugguuauacuuacuguuuc

SEQ ID NO: 1092947 - RNA, 18 nt, Human
uccugccugugccccagg

SEQ ID NO: 1092948 - RNA, 22 nt, Human
ugugcuucaucacuucucaguu

SEQ ID NO: 1092949 - RNA, 22 nt, Human
caauguuuacuggggacccaga

SEQ ID NO: 1092950 - RNA, 22 nt, Human
caggaggcagagguugcagcga

SEQ ID NO: 1092951 - RNA, 22 nt, Human
gcuccuggcucucugagggcug

SEQ ID NO: 1092952 - RNA, 23 nt, Human
auauaaacaccagauagauugua

SEQ ID NO: 1092953 - RNA, 20 nt, Human
gcagagugugagagggugaa

SEQ ID NO: 1092954 - RNA, 22 nt, Human
aaauuagauaugugugagacuc

SEQ ID NO: 1092955 - RNA, 22 nt, Human
aaacacuucaaggacuucuguc

SEQ ID NO: 1092956 - RNA, 22 nt, Human
cuggccugugggcugucuccgg

SEQ ID NO: 1092957 - RNA, 22 nt, Human
uugaaggaggcuccuuuuuaaa

SEQ ID NO: 1092958 - RNA, 22 nt, Human
ccuucagaccuagacaggaauc

SEQ ID NO: 1092959 - RNA, 22 nt, Human
acuuuacagaugguuuccugac

SEQ ID NO: 1092960 - RNA, 22 nt, Human
auguaaggcugccuaugacacu

SEQ ID NO: 1092961 - RNA, 22 nt, Human
ccuggaaguuggagguugcagu

SEQ ID NO: 1092962 - RNA, 22 nt, Human
cgcaggcuccggggugcccugg

SEQ ID NO: 1092963 - RNA, 18 nt, Human
uaagucauuuugccagca

SEQ ID NO: 1092964 - RNA, 22 nt, Human
gagcucccuggagguucagaua

SEQ ID NO: 1092965 - RNA, 22 nt, Human
ccugcuguuuucuucacuucag

SEQ ID NO: 1092966 - RNA, 22 nt, Human
agcugagcucaggcugauguaa

SEQ ID NO: 1092967 - RNA, 22 nt, Human
uggagccaaaaagggaaggaga

SEQ ID NO: 1092968 - RNA, 22 nt, Human
aacuauacucuguaaaugugcu

SEQ ID NO: 1092969 - RNA, 22 nt, Human
ugacuuuaaagcucacucuuuu

SEQ ID NO: 1092970 - RNA, 21 nt, Human
ccaggguccagcugccauggu

SEQ ID NO: 1092971 - RNA, 22 nt, Human
gcugcugucacggugcuaaggg

SEQ ID NO: 1092972 - RNA, 22 nt, Human
aaaugcaugugcuauagaugug

SEQ ID NO: 1092973 - RNA, 20 nt, Human
auguuuaauguuguccaccc

SEQ ID NO: 1092974 - RNA, 22 nt, Human
aggccaggaauccuugucccag

SEQ ID NO: 1092975 - RNA, 22 nt, Human
ucaaugauuagaguuuagugug

SEQ ID NO: 1092976 - RNA, 21 nt, Human
ccagaggccucucuuggccac

SEQ ID NO: 1092977 - RNA, 18 nt, Human
augggaggggccaagaga

SEQ ID NO: 1092978 - RNA, 22 nt, Human
acuugauuuuuauaauaaaugg

SEQ ID NO: 1092979 - RNA, 22 nt, Human
ucuaaacauugugauagaccuu

SEQ ID NO: 1092980 - RNA, 22 nt, Human
ugagccuguccugugcauguga

SEQ ID NO: 1092981 - RNA, 18 nt, Human
ucagccuguugucugccu

SEQ ID NO: 1092982 - RNA, 22 nt, Human
aaacaugagcaucucuucaagc

SEQ ID NO: 1092983 - RNA, 22 nt, Human
auuuccuggaaugacuaguggg

SEQ ID NO: 1092984 - RNA, 22 nt, Human
uggcagcaaaaccagaaucaga

SEQ ID NO: 1092985 - RNA, 22 nt, Human
uaugaacugugagugugauggg

SEQ ID NO: 1092986 - RNA, 22 nt, Human
gagaaucucuuugacaagcaga

SEQ ID NO: 1092987 - RNA, 22 nt, Human
aacacauaggcagagcaugaca

SEQ ID NO: 1092988 - RNA, 22 nt, Human
aaguaucuuucuagcaacuaaa

SEQ ID NO: 1092989 - RNA, 22 nt, Human
cucugagagcggucuguggcuu

SEQ ID NO: 1092990 - RNA, 22 nt, Human
acaaggaggucuggggggcccu

SEQ ID NO: 1092991 - RNA, 22 nt, Human
gcagcuggggaggucgugggga

SEQ ID NO: 1092992 - RNA, 16 nt, Human
cagccugcagugguca

SEQ ID NO: 1092993 - RNA, 22 nt, Human
aagugacacauggcacuucuau

SEQ ID NO: 1092994 - RNA, 22 nt, Human
ucaacaguucuguccaauuaau

SEQ ID NO: 1092995 - RNA, 22 nt, Human
acuucuuucacaauguuucuag

SEQ ID NO: 1092996 - RNA, 22 nt, Human
uugcugugaaaccaugggaagu

SEQ ID NO: 1092997 - RNA, 23 nt, Human
ugcucugggaggcccuggagagc

SEQ ID NO: 1092998 - RNA, 18 nt, Human
ugaggcagucagugaugg

SEQ ID NO: 1092999 - RNA, 22 nt, Human
ucugagacugcagugagccgcu

SEQ ID NO: 1093000 - RNA, 22 nt, Human
accuuucauuaaagucuguagu

SEQ ID NO: 1093001 - RNA, 22 nt, Human
ucccuggaacagagagacaacg

SEQ ID NO: 1093002 - RNA, 22 nt, Human
ugggcucugaagggucccggau

SEQ ID NO: 1093003 - RNA, 22 nt, Human
ucauuuaucauuugugcuguag

SEQ ID NO: 1093004 - RNA, 22 nt, Human
ucugaaauauauuuugaguguu

SEQ ID NO: 1093005 - RNA, 21 nt, Human
cauuucaguaaggaagccugu

SEQ ID NO: 1093006 - RNA, 22 nt, Human
cauugcacagcccuguggugau

SEQ ID NO: 1093007 - RNA, 22 nt, Human
cugagcccuugaacccaagucc

SEQ ID NO: 1093008 - RNA, 22 nt, Human
ggaagcacugaggcagagaggg

SEQ ID NO: 1093009 - RNA, 22 nt, Human
gcaccaggcuuagagccccagg

SEQ ID NO: 1093010 - RNA, 22 nt, Human
uaaguggaagguuauaugcuaa

SEQ ID NO: 1093011 - RNA, 22 nt, Human
guuugaaaguggcaaguccuug

SEQ ID NO: 1093012 - RNA, 22 nt, Human
aguuuaauauccuucaacuuuc

SEQ ID NO: 1093013 - RNA, 22 nt, Human
ucccucagucccuggacaggca

SEQ ID NO: 1093014 - RNA, 22 nt, Human
aauguuugucaucacacagaua

SEQ ID NO: 1093015 - RNA, 22 nt, Human
uacauacauauucauacaggug

SEQ ID NO: 1093016 - RNA, 22 nt, Human
gagagcugugguuugaccaggc

SEQ ID NO: 1093017 - RNA, 22 nt, Human
uugugcaauuuaaaaucuuccu

SEQ ID NO: 1093018 - RNA, 22 nt, Human
ccucaggggugcccacagcugc

SEQ ID NO: 1093019 - RNA, 22 nt, Human
uucaaaguugcaugacagcuua

SEQ ID NO: 1093020 - RNA, 21 nt, Human
ucagcagcaucugccuagagu

SEQ ID NO: 1093021 - RNA, 22 nt, Human
gucccuuggcucacaaacagcu

SEQ ID NO: 1093022 - RNA, 22 nt, Human
uucaugaauaccccuucuguaa

SEQ ID NO: 1093023 - RNA, 22 nt, Human
ugguucauugagaagacugaag

SEQ ID NO: 1093024 - RNA, 22 nt, Human
auaguuugaaggcuguucuacu

SEQ ID NO: 1093025 - RNA, 22 nt, Human
uauacaaugaguacauucuggg

SEQ ID NO: 1093026 - RNA, 20 nt, Human
ucagacagucgcaguucugg

SEQ ID NO: 1093027 - RNA, 22 nt, Human
ucuacagacagagcagguggga

SEQ ID NO: 1093028 - RNA, 22 nt, Human
uggaggcauugugacugcugaa

SEQ ID NO: 1093029 - RNA, 22 nt, Human
gcucccugaaaagaacaaaguc

SEQ ID NO: 1093030 - RNA, 22 nt, Human
auaggcaaauuaauaagucaua

SEQ ID NO: 1093031 - RNA, 22 nt, Human
ucuucagugcaccugaugucuu

SEQ ID NO: 1093032 - RNA, 22 nt, Human
uguauaaacuuaagcaggaacc

SEQ ID NO: 1093033 - RNA, 22 nt, Human
ugaaaucaaugucuucugucuc

SEQ ID NO: 1093034 - RNA, 22 nt, Human
gaaagguuucaucuacuuuuca

SEQ ID NO: 1093035 - RNA, 22 nt, Human
ccucucuguguggccucuccau

SEQ ID NO: 1093036 - RNA, 22 nt, Human
ggugaaggucuacugugugcca

SEQ ID NO: 1093037 - RNA, 22 nt, Human
uuugcauuaucucacuuauaua

SEQ ID NO: 1093038 - RNA, 22 nt, Human
gcaggaaccugguaagcuucac

SEQ ID NO: 1093039 - RNA, 22 nt, Human
ugcaaucagguaccauuugauu

SEQ ID NO: 1093040 - RNA, 22 nt, Human
ugcuuuuuaguacugucuuauu

SEQ ID NO: 1093041 - RNA, 18 nt, Human
gaggaacauucaccuccu

SEQ ID NO: 1093042 - RNA, 22 nt, Human
gugcagggagcccagaaggucc

SEQ ID NO: 1093043 - RNA, 22 nt, Human
aucugguucuuuguauuuccuu

SEQ ID NO: 1093044 - RNA, 21 nt, Human
uuggacuuuugcgugauugag

SEQ ID NO: 1093045 - RNA, 22 nt, Human
gcugagugauugauauuuuagu

SEQ ID NO: 1093046 - RNA, 22 nt, Human
gccaggaauuucaagagccacu

SEQ ID NO: 1093047 - RNA, 22 nt, Human
agguggccggugccagccgggc

SEQ ID NO: 1093048 - RNA, 22 nt, Human
ugcccaugcaugacagauggcu

SEQ ID NO: 1093049 - RNA, 20 nt, Human
accuuucaaaugauucagca

SEQ ID NO: 1093050 - RNA, 22 nt, Human
ucagguggccaaaugggagcgc

SEQ ID NO: 1093051 - RNA, 22 nt, Human
cccauucauccucgcuuccuuc

SEQ ID NO: 1093052 - RNA, 23 nt, Human
aggcuuccuaucuuagagcuggg

SEQ ID NO: 1093053 - RNA, 22 nt, Human
auguuuccauuuucuuguauca

SEQ ID NO: 1093054 - RNA, 22 nt, Human
gucagcuacugcagggaacuuu

SEQ ID NO: 1093055 - RNA, 22 nt, Human
agccaauaaauuuacaacuaga

SEQ ID NO: 1093056 - RNA, 22 nt, Human
agaaaagggcaggagggauaca

SEQ ID NO: 1093057 - RNA, 22 nt, Human
ugcacacagcugggccuggcug

SEQ ID NO: 1093058 - RNA, 22 nt, Human
ugauuuccuaggucuggagaag

SEQ ID NO: 1093059 - RNA, 22 nt, Human
gaauagcuuccuuuuuuccaaa

SEQ ID NO: 1093060 - RNA, 22 nt, Human
ggcugcaagcaugcacagauac

SEQ ID NO: 1093061 - RNA, 22 nt, Human
guacacagaugcuugagaaucu

SEQ ID NO: 1093062 - RNA, 22 nt, Human
cucuugcagauaccuugaagga

SEQ ID NO: 1093063 - RNA, 22 nt, Human
uucugaaaugagauauaaggua

SEQ ID NO: 1093064 - RNA, 21 nt, Human
uuucaauguguucuuuguagu

SEQ ID NO: 1093065 - RNA, 22 nt, Human
ucucagucuuugcaaggaugcu

SEQ ID NO: 1093066 - RNA, 22 nt, Human
agcaccuggucuccuggcgcug

SEQ ID NO: 1093067 - RNA, 22 nt, Human
gcaaauauuucuaauuccugaa

SEQ ID NO: 1093068 - RNA, 19 nt, Human
caggagagcaugcacuuug

SEQ ID NO: 1093069 - RNA, 22 nt, Human
uccugccucuugccuucuucac

SEQ ID NO: 1093070 - RNA, 23 nt, Human
cauaugaauuuuagaggcaguuu

SEQ ID NO: 1093071 - RNA, 22 nt, Human
ggugauuuucgaguuucauguu

SEQ ID NO: 1093072 - RNA, 19 nt, Human
uguuuuguuaaagcagucc

SEQ ID NO: 1093073 - RNA, 22 nt, Human
aaagccuugggauuugugauca

SEQ ID NO: 1093074 - RNA, 22 nt, Human
uuacacaugcucacuuauuugu

SEQ ID NO: 1093075 - RNA, 22 nt, Human
ggguacagagagaugagguaac

SEQ ID NO: 1093076 - RNA, 22 nt, Human
cucaggaugucggugacuauug

SEQ ID NO: 1093077 - RNA, 20 nt, Human
uggagcugugguaaggagca

SEQ ID NO: 1093078 - RNA, 21 nt, Human
acagcaagccuuccuuucagg

SEQ ID NO: 1093079 - RNA, 23 nt, Human
uacaagguagcauuaguuucuuc

SEQ ID NO: 1093080 - RNA, 22 nt, Human
ccugccagggccuuggaagaaa

SEQ ID NO: 1093081 - RNA, 22 nt, Human
ggcaggugcgcauguugcauua

SEQ ID NO: 1093082 - RNA, 22 nt, Human
agggccugugcuuccugagaua

SEQ ID NO: 1093083 - RNA, 22 nt, Human
ucagaggaccuuacugagaacc

SEQ ID NO: 1093084 - RNA, 22 nt, Human
ggcucugcccagguggacagca

SEQ ID NO: 1093085 - RNA, 19 nt, Human
gcagccaggugcucuaccu

SEQ ID NO: 1093086 - RNA, 22 nt, Human
guauuuuaagugacuacuaggu

SEQ ID NO: 1093087 - RNA, 22 nt, Human
cuggugagacgguugacaggag

SEQ ID NO: 1093088 - RNA, 22 nt, Human
cagaagaguagcugaacaaguu

SEQ ID NO: 1093089 - RNA, 22 nt, Human
aaacaguuuauaacaugauacu

SEQ ID NO: 1093090 - RNA, 22 nt, Human
uuugugcaauuuauguacuaua

SEQ ID NO: 1093091 - RNA, 23 nt, Human
ugaugggaaggaacgacuaccac

SEQ ID NO: 1093092 - RNA, 22 nt, Human
cugggcugcaguuccugguccu

SEQ ID NO: 1093093 - RNA, 22 nt, Human
aagauucuugacuagaaugauu

SEQ ID NO: 1093094 - RNA, 22 nt, Human
cuuucugaucccugcaacccuc

SEQ ID NO: 1093095 - RNA, 20 nt, Human
uaacagaaguagaagugggu

SEQ ID NO: 1093096 - RNA, 22 nt, Human
acauauuuugaaagcuuucuaa

SEQ ID NO: 1093097 - RNA, 22 nt, Human
ucacaagacagaaaacauuuag

SEQ ID NO: 1093098 - RNA, 22 nt, Human
uguuacagaaauauugcuucuu

SEQ ID NO: 1093099 - RNA, 22 nt, Human
ggcaggugaggcaugugccugg

SEQ ID NO: 1093100 - RNA, 22 nt, Human
auuaaacaauguaaaguucuug

SEQ ID NO: 1093101 - RNA, 22 nt, Human
aggaaaaagaguugcugccuuc

SEQ ID NO: 1093102 - RNA, 22 nt, Human
uuuuuauaggucagggcaaguc

SEQ ID NO: 1093103 - RNA, 22 nt, Human
guguccacggcugagaaugauu

SEQ ID NO: 1093104 - RNA, 22 nt, Human
ggaccaaaauuacagucgcucc

SEQ ID NO: 1093105 - RNA, 22 nt, Human
uggcuggggccacaguuuuccu

SEQ ID NO: 1093106 - RNA, 22 nt, Human
caguauuuauggcuugaguauu

SEQ ID NO: 1093107 - RNA, 22 nt, Human
agggugucagccacggaauggg

SEQ ID NO: 1093108 - RNA, 22 nt, Human
ccugagagugagugccuccuua

SEQ ID NO: 1093109 - RNA, 22 nt, Human
uggcaggaaaguaacagagcac

SEQ ID NO: 1093110 - RNA, 22 nt, Human
ccugcuuaacauugccaugaca

SEQ ID NO: 1093111 - RNA, 22 nt, Human
ucuuuuaaccuaacuagcuugg

SEQ ID NO: 1093112 - RNA, 22 nt, Human
gccaguuccuguggagucagag

SEQ ID NO: 1093113 - RNA, 22 nt, Human
gcagauggugggggaggaguac

SEQ ID NO: 1093114 - RNA, 22 nt, Human
uuucaaaauuuugcagugguaa

SEQ ID NO: 1093115 - RNA, 22 nt, Human
ucacugucugaaagaaauggcc

SEQ ID NO: 1093116 - RNA, 22 nt, Human
augcugaagagagaacuacuca

SEQ ID NO: 1093117 - RNA, 22 nt, Human
uccuaaaugauucagaaauuuc

SEQ ID NO: 1093118 - RNA, 22 nt, Human
auuuuaucugcuuacuuucagg

SEQ ID NO: 1093119 - RNA, 22 nt, Human
acccugagggaugagaguugca

SEQ ID NO: 1093120 - RNA, 22 nt, Human
uuugaaagacagaauauuuuug

SEQ ID NO: 1093121 - RNA, 22 nt, Human
acagggcaugugcaagagacau

SEQ ID NO: 1093122 - RNA, 22 nt, Human
ucccagcgcggggggaggaucc

SEQ ID NO: 1093123 - RNA, 22 nt, Human
augaagucugcacaugcaugug

SEQ ID NO: 1093124 - RNA, 22 nt, Human
gcucugugcaguucagggacac

SEQ ID NO: 1093125 - RNA, 22 nt, Human
agcaggguauguuagagcugua

SEQ ID NO: 1093126 - RNA, 22 nt, Human
cugcuuuguggaaucacacugg

SEQ ID NO: 1093127 - RNA, 22 nt, Human
acuggcagagacccugauggcc

SEQ ID NO: 1093128 - RNA, 22 nt, Human
uuugacauugccaauuugcuca

SEQ ID NO: 1093129 - RNA, 22 nt, Human
ugcccucugcaggccgccaugg

SEQ ID NO: 1093130 - RNA, 22 nt, Human
ccagggcagccaacccagaugc

SEQ ID NO: 1093131 - RNA, 22 nt, Human
aaggaagaugaaaguacugcua

SEQ ID NO: 1093132 - RNA, 23 nt, Human
uggcugagguccagguaguuuca

SEQ ID NO: 1093133 - RNA, 22 nt, Human
gacagcagacaaaccauguuuu

SEQ ID NO: 1093134 - RNA, 22 nt, Human
cuguuuuaucucaagaguucaa

SEQ ID NO: 1093135 - RNA, 18 nt, Human
cugugcagcaaacugagc

SEQ ID NO: 1093136 - RNA, 22 nt, Human
uuaaacagagucugaaauguaa

SEQ ID NO: 1093137 - RNA, 22 nt, Human
cuuauacacgaacacaaggugu

SEQ ID NO: 1093138 - RNA, 22 nt, Human
ucagacagucaucagagcuugu

SEQ ID NO: 1093139 - RNA, 22 nt, Human
uucaguauuugaaaccauaggc

SEQ ID NO: 1093140 - RNA, 22 nt, Human
ccugcagguaaggcuaacugcc

SEQ ID NO: 1093141 - RNA, 22 nt, Human
cuacugaguccuucagcugcca

SEQ ID NO: 1093142 - RNA, 22 nt, Human
uacuuacagagcuuauaaguua

SEQ ID NO: 1093143 - RNA, 22 nt, Human
ugugaggagggucaaacugagu

SEQ ID NO: 1093144 - RNA, 22 nt, Human
caaggucagcgugaaguucugu

SEQ ID NO: 1093145 - RNA, 22 nt, Human
aaaaacacaacugucuuucucu

SEQ ID NO: 1093146 - RNA, 22 nt, Human
ucccucagcaggaauguggcag

SEQ ID NO: 1093147 - RNA, 23 nt, Human
aguuuuucugcaugguucuguau

SEQ ID NO: 1093148 - RNA, 22 nt, Human
cugcugcaggaugggcacucug

SEQ ID NO: 1093149 - RNA, 22 nt, Human
gaugggggccagggccugcuuu

SEQ ID NO: 1093150 - RNA, 22 nt, Human
caucagugaaagugaauguucu

SEQ ID NO: 1093151 - RNA, 22 nt, Human
uccagagcagguggucagaagg

SEQ ID NO: 1093152 - RNA, 22 nt, Human
cuuggagauacaagugguaccu

SEQ ID NO: 1093153 - RNA, 22 nt, Human
cuggcugugcagucuuccagaa

SEQ ID NO: 1093154 - RNA, 22 nt, Human
cugugcuugacagugggaagca

SEQ ID NO: 1093155 - RNA, 17 nt, Human
agagauaaggcggagaa

SEQ ID NO: 1093156 - RNA, 22 nt, Human
cuggccugagaaugcuacccuu

SEQ ID NO: 1093157 - RNA, 22 nt, Human
auguauuugcuuguuauggauu

SEQ ID NO: 1093158 - RNA, 22 nt, Human
gcagcuggagccagccagacac

SEQ ID NO: 1093159 - RNA, 23 nt, Human
uucaucaguugcuguugcagaac

SEQ ID NO: 1093160 - RNA, 22 nt, Human
cccuggccuccaggcaguccug

SEQ ID NO: 1093161 - RNA, 22 nt, Human
aaguccugugugcuuacacuug

SEQ ID NO: 1093162 - RNA, 20 nt, Human
cuguggcucaugcaucugcc

SEQ ID NO: 1093163 - RNA, 22 nt, Human
uacucagagucauugcccuucu

SEQ ID NO: 1093164 - RNA, 22 nt, Human
gccuaacuuggcuuuguucacc

SEQ ID NO: 1093165 - RNA, 22 nt, Human
auuuccuguugcuuuugccacu

SEQ ID NO: 1093166 - RNA, 22 nt, Human
gcagugugaccgagcuugcuuc

SEQ ID NO: 1093167 - RNA, 22 nt, Human
uuucacagguacaaacacuccu

SEQ ID NO: 1093168 - RNA, 22 nt, Human
cacagugcaugaugggcagaag

SEQ ID NO: 1093169 - RNA, 22 nt, Human
uauacagaaccgccugaagucu

SEQ ID NO: 1093170 - RNA, 22 nt, Human
ccagagcccagggucaugcagg

SEQ ID NO: 1093171 - RNA, 22 nt, Human
ugguccagaugccuuggcuuua

SEQ ID NO: 1093172 - RNA, 19 nt, Human
uccuuugaauaucaguuga

SEQ ID NO: 1093173 - RNA, 22 nt, Human
auccaggagggcugacuccuua

SEQ ID NO: 1093174 - RNA, 22 nt, Human
aucuuuccuguuuucagacagc

SEQ ID NO: 1093175 - RNA, 22 nt, Human
ggugagaggccugagagcugga

SEQ ID NO: 1093176 - RNA, 23 nt, Human
aaacaagcccuaaugaagagucc

SEQ ID NO: 1093177 - RNA, 22 nt, Human
ccuuccuggcuguccgccugau

SEQ ID NO: 1093178 - RNA, 22 nt, Human
ccucaggaaccacauugcugcu

SEQ ID NO: 1093179 - RNA, 19 nt, Human
gccucugcuggggacaggc

SEQ ID NO: 1093180 - RNA, 22 nt, Human
acacugcagaugaaagcauaag

SEQ ID NO: 1093181 - RNA, 22 nt, Human
ugggcugcuguuacaggggcug

SEQ ID NO: 1093182 - RNA, 20 nt, Human
ccaccuggccaaggcugugc

SEQ ID NO: 1093183 - RNA, 22 nt, Human
acagcuuuucaauucugcugag

SEQ ID NO: 1093184 - RNA, 22 nt, Human
ugccuggcaaugccagaagcca

SEQ ID NO: 1093185 - RNA, 22 nt, Human
uacuguuuucuauaauggcugu

SEQ ID NO: 1093186 - RNA, 22 nt, Human
ugaaaucuucacuaagucucuu

SEQ ID NO: 1093187 - RNA, 22 nt, Human
uauacacaaggugugcauuugu

SEQ ID NO: 1093188 - RNA, 22 nt, Human
gccaggaaaaaccggcccugcu

SEQ ID NO: 1093189 - RNA, 22 nt, Human
gcauccagagguagccacugug

SEQ ID NO: 1093190 - RNA, 22 nt, Human
acuugaaacccugagaugauaa

SEQ ID NO: 1093191 - RNA, 22 nt, Human
ugauggcuaucccuggaagggc

SEQ ID NO: 1093192 - RNA, 22 nt, Human
uauuuggaauagcuugcuaaug

SEQ ID NO: 1093193 - RNA, 21 nt, Human
ccuccaggugauuccgugcuc

SEQ ID NO: 1093194 - RNA, 22 nt, Human
uccagagccuauauguucaacu

SEQ ID NO: 1093195 - RNA, 22 nt, Human
agcagcagaggucagaaaggua

SEQ ID NO: 1093196 - RNA, 22 nt, Human
caggugggagccacagcguaca

SEQ ID NO: 1093197 - RNA, 22 nt, Human
gccuccuggccuuugcuccuca

SEQ ID NO: 1093198 - RNA, 22 nt, Human
uugcaucuagggcaacccagag

SEQ ID NO: 1093199 - RNA, 22 nt, Human
uggggcagcuccaucuauucca

SEQ ID NO: 1093200 - RNA, 22 nt, Human
cccagagcuccgguccugccca

SEQ ID NO: 1093201 - RNA, 22 nt, Human
acagaauuaucaggaaauguua

SEQ ID NO: 1093202 - RNA, 22 nt, Human
uggucuucuuuguugcuauuau

SEQ ID NO: 1093203 - RNA, 22 nt, Human
uuuuagcacuaagugauaugcu

SEQ ID NO: 1093204 - RNA, 22 nt, Human
aaaauaacuucuacuauuugca

SEQ ID NO: 1093205 - RNA, 21 nt, Human
uauguagacucguuagaaugc

SEQ ID NO: 1093206 - RNA, 22 nt, Human
uaccuugaaaagaaggugcuca

SEQ ID NO: 1093207 - RNA, 22 nt, Human
gaggacaggagacucacuguuu

SEQ ID NO: 1093208 - RNA, 22 nt, Human
ugggauggagccugaguauagu

SEQ ID NO: 1093209 - RNA, 22 nt, Human
uuucacauagaaagugauuuac

SEQ ID NO: 1093210 - RNA, 22 nt, Human
cauugaaaaacguugacugagu

SEQ ID NO: 1093211 - RNA, 22 nt, Human
ugcaauuuuuaucaauucagca

SEQ ID NO: 1093212 - RNA, 23 nt, Human
ccuggggagcuguauccagagug

SEQ ID NO: 1093213 - RNA, 22 nt, Human
ggucagagggugggcugccugu

SEQ ID NO: 1093214 - RNA, 22 nt, Human
aggccagcuguuacuagagcca

SEQ ID NO: 1093215 - RNA, 22 nt, Human
agccucucagagugcugggauu

SEQ ID NO: 1093216 - RNA, 22 nt, Human
uguauuuccugguuuagaucaa

SEQ ID NO: 1093217 - RNA, 22 nt, Human
ggccugaggccaccagcagccc

SEQ ID NO: 1093218 - RNA, 22 nt, Human
guggggcggcagaugcucccug

SEQ ID NO: 1093219 - RNA, 22 nt, Human
ucuuagcauuucauaacaacug

SEQ ID NO: 1093220 - RNA, 22 nt, Human
uuuccuuuuaagcagucggccu

SEQ ID NO: 1093221 - RNA, 22 nt, Human
gugcucuccuggcugcccugac

SEQ ID NO: 1093222 - RNA, 22 nt, Human
uuuuguuguaauauaccuaucc

SEQ ID NO: 1093223 - RNA, 22 nt, Human
ggcucagaaacuaaaggcgcug

SEQ ID NO: 1093224 - RNA, 22 nt, Human
uucauaaacaaauuaaggccug

SEQ ID NO: 1093225 - RNA, 22 nt, Human
guuucucugucuguuacauugg

SEQ ID NO: 1093226 - RNA, 22 nt, Human
uagcaaagaccaaagcuaguug

SEQ ID NO: 1093227 - RNA, 22 nt, Human
uuuacagcuacuguccuauuuc

SEQ ID NO: 1093228 - RNA, 22 nt, Human
aagcauuucagguagagauauu

SEQ ID NO: 1093229 - RNA, 22 nt, Human
ggagccugugggaugagaugug

SEQ ID NO: 1093230 - RNA, 22 nt, Human
acagcagcgugaaguguguuau

SEQ ID NO: 1093231 - RNA, 22 nt, Human
agacuaaaagaaggaagcuacc

SEQ ID NO: 1093232 - RNA, 22 nt, Human
guacuagaugagacagcguggg

SEQ ID NO: 1093233 - RNA, 22 nt, Human
uuugggcucuugcugaccuggg

SEQ ID NO: 1093234 - RNA, 22 nt, Human
aaugauauuuauugaauagaug

SEQ ID NO: 1093235 - RNA, 22 nt, Human
caacuuuugacacgugugcuaa

SEQ ID NO: 1093236 - RNA, 22 nt, Human
cuggagcuaauaauccaucuga

SEQ ID NO: 1093237 - RNA, 22 nt, Human
agcugcuguccuaggcacugua

SEQ ID NO: 1093238 - RNA, 22 nt, Human
gugugcagggaugagugcaggu

SEQ ID NO: 1093239 - RNA, 22 nt, Human
gcagcagaugcuuucauggaca

SEQ ID NO: 1093240 - RNA, 22 nt, Human
uuguuuaaaagaaaucauagaa

SEQ ID NO: 1093241 - RNA, 22 nt, Human
cagaagccugccucagaugcac

SEQ ID NO: 1093242 - RNA, 22 nt, Human
ggccccugcggacugccuagag

SEQ ID NO: 1093243 - RNA, 20 nt, Human
auucuacaagaauaagcaug

SEQ ID NO: 1093244 - RNA, 22 nt, Human
ucucuuauuuugccuuugacaa

SEQ ID NO: 1093245 - RNA, 22 nt, Human
uggaacaccuugcuccagaaag

SEQ ID NO: 1093246 - RNA, 22 nt, Human
ccacugggggcugcaggcacuc

SEQ ID NO: 1093247 - RNA, 22 nt, Human
cccauggagugccugagggcca

SEQ ID NO: 1093248 - RNA, 22 nt, Human
aggagacagaauuuaaauuugg

SEQ ID NO: 1093249 - RNA, 22 nt, Human
auggagggugguaagacagaga

SEQ ID NO: 1093250 - RNA, 22 nt, Human
cccagccucuguuugcuccucu

SEQ ID NO: 1093251 - RNA, 22 nt, Human
gagcagcagguggggcuggcuu

SEQ ID NO: 1093252 - RNA, 22 nt, Human
gcaaauguuuuugaguguuuac

SEQ ID NO: 1093253 - RNA, 22 nt, Human
guucuggaguggugccaggccu

SEQ ID NO: 1093254 - RNA, 21 nt, Human
accaggcuugugggagggagc

SEQ ID NO: 1093255 - RNA, 22 nt, Human
cugggagcggcugucacugguu

SEQ ID NO: 1093256 - RNA, 22 nt, Human
uuaaaugacuuuuauuauucuc

SEQ ID NO: 1093257 - RNA, 21 nt, Human
agcuggugucagagcucuggg

SEQ ID NO: 1093258 - RNA, 22 nt, Human
aauacagucuuacuagaaaauc

SEQ ID NO: 1093259 - RNA, 22 nt, Human
aagcagagccaccagcuuugga

SEQ ID NO: 1093260 - RNA, 22 nt, Human
ugcaaauagccugaugaaagaa

SEQ ID NO: 1093261 - RNA, 22 nt, Human
cagugagggaagaucucagcac

SEQ ID NO: 1093262 - RNA, 22 nt, Human
uucucuuuuagaggcuccauga

SEQ ID NO: 1093263 - RNA, 22 nt, Human
aaaugguaguagcauuccauau

SEQ ID NO: 1093264 - RNA, 22 nt, Human
cacauuucuaggaaauuaaaug

SEQ ID NO: 1093265 - RNA, 22 nt, Human
uaacugaauguauuacaacaga

SEQ ID NO: 1093266 - RNA, 22 nt, Human
uuuaaucuauucccuaaacacc

SEQ ID NO: 1093267 - RNA, 23 nt, Human
uccagggauuaaugaagucaguc

SEQ ID NO: 1093268 - RNA, 22 nt, Human
agcuccugcuugacagaagagg

SEQ ID NO: 1093269 - RNA, 22 nt, Human
agggacacaugugauuauuuau

SEQ ID NO: 1093270 - RNA, 22 nt, Human
acugcuuuagaccuagagcucu

SEQ ID NO: 1093271 - RNA, 22 nt, Human
uuucaucuucccagagaccuug

SEQ ID NO: 1093272 - RNA, 22 nt, Human
cagagagagucaaaucuuugcu

SEQ ID NO: 1093273 - RNA, 22 nt, Human
ggagaugccagaauugcaaauu

SEQ ID NO: 1093274 - RNA, 22 nt, Human
caggcucagaugcccugcgcug

SEQ ID NO: 1093275 - RNA, 22 nt, Human
ggccuugguaaagggaugcaug

SEQ ID NO: 1093276 - RNA, 22 nt, Human
acucuacagaaugaauaccugu

SEQ ID NO: 1093277 - RNA, 22 nt, Human
augcugaauugaugcgagggag

SEQ ID NO: 1093278 - RNA, 22 nt, Human
uacauauagacaguuacucuag

SEQ ID NO: 1093279 - RNA, 20 nt, Human
aauaaaagaagccuucaccc

SEQ ID NO: 1093280 - RNA, 22 nt, Human
ugaagcagcaccauuuuagagc

SEQ ID NO: 1093281 - RNA, 22 nt, Human
cccugggcaagcccuauuuucc

SEQ ID NO: 1093282 - RNA, 22 nt, Human
ugccucagagaccugacaguac

SEQ ID NO: 1093283 - RNA, 22 nt, Human
acauucuaugaagauaauuuua

SEQ ID NO: 1093284 - RNA, 22 nt, Human
uuuuuauaugaaggauagugcg

SEQ ID NO: 1093285 - RNA, 22 nt, Human
cagagccaugguaugggcuugu

SEQ ID NO: 1093286 - RNA, 22 nt, Human
aggcaggucacaugcuuggcga

SEQ ID NO: 1093287 - RNA, 22 nt, Human
cugauguuucuagaugcuugcc

SEQ ID NO: 1093288 - RNA, 22 nt, Human
ucucaccaaagccuugaccaua

SEQ ID NO: 1093289 - RNA, 18 nt, Human
ugugaacacauuuuucug

SEQ ID NO: 1093290 - RNA, 22 nt, Human
aggcuggcaaggcagaugugug

SEQ ID NO: 1093291 - RNA, 22 nt, Human
auuacaaaagaagggagaaggu

SEQ ID NO: 1093292 - RNA, 22 nt, Human
uucuucucagggucccacaugg

SEQ ID NO: 1093293 - RNA, 22 nt, Human
gaaguuaggcuuuccuaugcuu

SEQ ID NO: 1093294 - RNA, 20 nt, Human
caggaggcaaggucaagguc

SEQ ID NO: 1093295 - RNA, 22 nt, Human
guuuucaaggggauuuaacuga

SEQ ID NO: 1093296 - RNA, 22 nt, Human
uuuuauugucucccaguucugg

SEQ ID NO: 1093297 - RNA, 22 nt, Human
gcuuccagagagccccgccugg

SEQ ID NO: 1093298 - RNA, 22 nt, Human
uuugaacaugcugcaugauaau

SEQ ID NO: 1093299 - RNA, 22 nt, Human
agaaacuaaagccaagggcucu

SEQ ID NO: 1093300 - RNA, 22 nt, Human
caggaggcccaaagggcgcaga

SEQ ID NO: 1093301 - RNA, 22 nt, Human
auacacaugcacacaugugugu

SEQ ID NO: 1093302 - RNA, 22 nt, Human
aggcugaaaacgagauggcaau

SEQ ID NO: 1093303 - RNA, 22 nt, Human
ggagauuuauagcacacuucag

SEQ ID NO: 1093304 - RNA, 22 nt, Human
gcauuguccugcuucugagugu

SEQ ID NO: 1093305 - RNA, 22 nt, Human
uuacacagugguuaagucuggg

SEQ ID NO: 1093306 - RNA, 18 nt, Human
guaggucaguaccaagca

SEQ ID NO: 1093307 - RNA, 22 nt, Human
uucaacaugcaaacauguuugu

SEQ ID NO: 1093308 - RNA, 23 nt, Human
uuccugugguauauuuuauaggg

SEQ ID NO: 1093309 - RNA, 21 nt, Human
ucauuuuuauugcuaccuugc

SEQ ID NO: 1093310 - RNA, 22 nt, Human
caguggaauacgagcagauguc

SEQ ID NO: 1093311 - RNA, 23 nt, Human
uucacagauuaaauauuucuucu

SEQ ID NO: 1093312 - RNA, 22 nt, Human
aggcagcaugcucugcuucuac

SEQ ID NO: 1093313 - RNA, 22 nt, Human
agcugcccccagggcugugcuu

SEQ ID NO: 1093314 - RNA, 22 nt, Human
gcugcuguugauuuaguccaau

SEQ ID NO: 1093315 - RNA, 23 nt, Human
uugaauuucucuugcaauauuua

SEQ ID NO: 1093316 - RNA, 22 nt, Human
gcuaagugguuuucuucuccuc

SEQ ID NO: 1093317 - RNA, 22 nt, Human
acacaguucaggaucaaauagc

SEQ ID NO: 1093318 - RNA, 22 nt, Human
gcaaaaaaugcuuguugcuuag

SEQ ID NO: 1093319 - RNA, 22 nt, Human
agauacaucauuuauaccuuca

SEQ ID NO: 1093320 - RNA, 22 nt, Human
agaagccaauccuugucucucu

SEQ ID NO: 1093321 - RNA, 20 nt, Human
ugagugauggaggcggguca

SEQ ID NO: 1093322 - RNA, 22 nt, Human
ucucagagaggggccgggccuu

SEQ ID NO: 1093323 - RNA, 19 nt, Human
ggauaagguuggagugauc

SEQ ID NO: 1093324 - RNA, 22 nt, Human
uaauacugaaagggaaaugucc

SEQ ID NO: 1093325 - RNA, 22 nt, Human
gaggagcuggcagcgucuccgc

SEQ ID NO: 1093326 - RNA, 22 nt, Human
aguaaacaguaucuuuaguguc

SEQ ID NO: 1093327 - RNA, 22 nt, Human
gauuucuuuagguguaauagug

SEQ ID NO: 1093328 - RNA, 23 nt, Human
ugaguucucaucuuggcuucuau

SEQ ID NO: 1093329 - RNA, 22 nt, Human
cccaggaacuccagagcuccuc

SEQ ID NO: 1093330 - RNA, 23 nt, Human
agcuccagcugacgugggcagcc

SEQ ID NO: 1093331 - RNA, 21 nt, Human
gccugcugccuguggccgguc

SEQ ID NO: 1093332 - RNA, 22 nt, Human
agaaagacgugaugaagaagua

SEQ ID NO: 1093333 - RNA, 22 nt, Human
uuugcaaagugcuugcagagua

SEQ ID NO: 1093334 - RNA, 22 nt, Human
cugaggcuuugugugcaugccu

SEQ ID NO: 1093335 - RNA, 18 nt, Human
aacuucaacuacaaugga

SEQ ID NO: 1093336 - RNA, 22 nt, Human
uccaggcuagaagucacaggcc

SEQ ID NO: 1093337 - RNA, 22 nt, Human
uucacauugguucuugauagcu

SEQ ID NO: 1093338 - RNA, 22 nt, Human
caagcuccuuacauccacaggg

SEQ ID NO: 1093339 - RNA, 22 nt, Human
cuggccuggggccucagcugcu

SEQ ID NO: 1093340 - RNA, 22 nt, Human
caagaauauaaauacuuucaaa

SEQ ID NO: 1093341 - RNA, 22 nt, Human
gccuggagaaaggaagguggga

SEQ ID NO: 1093342 - RNA, 22 nt, Human
gucuggggaagucagggcauca

SEQ ID NO: 1093343 - RNA, 22 nt, Human
gaggggcugggguugacuccaa

SEQ ID NO: 1093344 - RNA, 22 nt, Human
uggcauuuuagacaugauggug

SEQ ID NO: 1093345 - RNA, 22 nt, Human
ucugaggaccuacugaagaguu

SEQ ID NO: 1093346 - RNA, 22 nt, Human
agggcugaagggaggugcucau

SEQ ID NO: 1093347 - RNA, 22 nt, Human
aaaugcuugcucuugauuauuu

SEQ ID NO: 1093348 - RNA, 22 nt, Human
ugcccagguuugagugcccaag

SEQ ID NO: 1093349 - RNA, 22 nt, Human
cugccagguuggcgcucgcucu

SEQ ID NO: 1093350 - RNA, 22 nt, Human
ccagggugcucuguggcgucgc

SEQ ID NO: 1093351 - RNA, 22 nt, Human
uucaagugaggcugucuuuaga

SEQ ID NO: 1093352 - RNA, 22 nt, Human
uguuacacagcagaauagcaag

SEQ ID NO: 1093353 - RNA, 22 nt, Human
ccugccuggguucaaaucccag

SEQ ID NO: 1093354 - RNA, 22 nt, Human
agggaauucacuggaacgcccu

SEQ ID NO: 1093355 - RNA, 22 nt, Human
uaucauuuagaguauuucuuca

SEQ ID NO: 1093356 - RNA, 22 nt, Human
uuagugcagcugagccccaugg

SEQ ID NO: 1093357 - RNA, 22 nt, Human
gcugucacaaauauuucucagc

SEQ ID NO: 1093358 - RNA, 22 nt, Human
ggcuggcacaaagcuccaaauc

SEQ ID NO: 1093359 - RNA, 22 nt, Human
cuucucccuggcuucugcacac

SEQ ID NO: 1093360 - RNA, 22 nt, Human
uauuaguugcaaaacauugacu

SEQ ID NO: 1093361 - RNA, 21 nt, Human
ccagcuccaggaccuuggauc

SEQ ID NO: 1093362 - RNA, 22 nt, Human
ugugauuauauuguaguacauu

SEQ ID NO: 1093363 - RNA, 22 nt, Human
agcugggcugaugacucauguu

SEQ ID NO: 1093364 - RNA, 22 nt, Human
aggucacuugguguuauucagc

SEQ ID NO: 1093365 - RNA, 22 nt, Human
agcagcagaagggagacccagg

SEQ ID NO: 1093366 - RNA, 21 nt, Human
cugagggccgcagcugggcuc

SEQ ID NO: 1093367 - RNA, 22 nt, Human
uauuucauucuuuaucaggagc

SEQ ID NO: 1093368 - RNA, 22 nt, Human
agggaaggagguuagaacccac

SEQ ID NO: 1093369 - RNA, 22 nt, Human
uuacaucuaaacugugaacaau

SEQ ID NO: 1093370 - RNA, 22 nt, Human
acagugaucaguuacugucugu

SEQ ID NO: 1093371 - RNA, 22 nt, Human
auucacaguuuccucauauucu

SEQ ID NO: 1093372 - RNA, 22 nt, Human
cuguggcugcagccuugguccu

SEQ ID NO: 1093373 - RNA, 19 nt, Human
agaggcugucaccuguagc

SEQ ID NO: 1093374 - RNA, 22 nt, Human
ugaggggaaggcaugauaaaua

SEQ ID NO: 1093375 - RNA, 22 nt, Human
uggagccugagucagcggaggc

SEQ ID NO: 1093376 - RNA, 22 nt, Human
caugaagcauguuuugucauga

SEQ ID NO: 1093377 - RNA, 19 nt, Human
gcugggcuuggguuuguag

SEQ ID NO: 1093378 - RNA, 22 nt, Human
acauacuuaacauuaaagucau

SEQ ID NO: 1093379 - RNA, 22 nt, Human
aagggagguaaagcuauuuaaa

SEQ ID NO: 1093380 - RNA, 22 nt, Human
uccuugaauccuagcauccuau

SEQ ID NO: 1093381 - RNA, 22 nt, Human
cacucugcagcugaagggcugg

SEQ ID NO: 1093382 - RNA, 22 nt, Human
ccuggggcucaagauggcgccg

SEQ ID NO: 1093383 - RNA, 22 nt, Human
ccagugggaacacuggcauugc

SEQ ID NO: 1093384 - RNA, 22 nt, Human
uggaucuucacaagagagggcg

SEQ ID NO: 1093385 - RNA, 22 nt, Human
ugaucugaaggacaugggaccc

SEQ ID NO: 1093386 - RNA, 22 nt, Human
acucagcugaugaagcacaagu

SEQ ID NO: 1093387 - RNA, 22 nt, Human
uuggcacuuugaaugagcucag

SEQ ID NO: 1093388 - RNA, 22 nt, Human
aagccacaaucugcaucagcau

SEQ ID NO: 1093389 - RNA, 22 nt, Human
aguaaugaggauguuugcaaaa

SEQ ID NO: 1093390 - RNA, 22 nt, Human
uacaaaugaaccaacuuugaug

SEQ ID NO: 1093391 - RNA, 22 nt, Human
aaagucacgcugaugggaaaug

SEQ ID NO: 1093392 - RNA, 22 nt, Human
gggcucaggaguuugaggcugc

SEQ ID NO: 1093393 - RNA, 22 nt, Human
caugggagguuggcuuggcaug

SEQ ID NO: 1093394 - RNA, 17 nt, Human
uucugagccacuuccuu

SEQ ID NO: 1093395 - RNA, 22 nt, Human
aguaugaaaguuaaucaauuua

SEQ ID NO: 1093396 - RNA, 22 nt, Human
gccuaggaguacagaaugguuu

SEQ ID NO: 1093397 - RNA, 22 nt, Human
ggaagggaguaguuggaaugca

SEQ ID NO: 1093398 - RNA, 22 nt, Human
agccaagcacucaacuccugga

SEQ ID NO: 1093399 - RNA, 22 nt, Human
ugggccucccaugucuuaggga

SEQ ID NO: 1093400 - RNA, 22 nt, Human
uaagguuuaacgcccugucucg

SEQ ID NO: 1093401 - RNA, 22 nt, Human
uguuaacacaauucuggagaga

SEQ ID NO: 1093402 - RNA, 22 nt, Human
uuucuaaggaaaguaccuggga

SEQ ID NO: 1093403 - RNA, 20 nt, Human
auauaauaaauuuugguuac

SEQ ID NO: 1093404 - RNA, 22 nt, Human
ugaggcucagaagugccaagug

SEQ ID NO: 1093405 - RNA, 22 nt, Human
ugcccuuggguaacuugcugau

SEQ ID NO: 1093406 - RNA, 22 nt, Human
gcuggcaguguauuguuagcug

SEQ ID NO: 1093407 - RNA, 22 nt, Human
gggagcugguuccugcccucca

SEQ ID NO: 1093408 - RNA, 20 nt, Human
aaggagaaugacacggcugc

SEQ ID NO: 1093409 - RNA, 22 nt, Human
gccuaggaguggggauggcggu

SEQ ID NO: 1093410 - RNA, 22 nt, Human
acagagaaacuaaggaguuugg

SEQ ID NO: 1093411 - RNA, 22 nt, Human
aaauuaucaugggggagaaaca

SEQ ID NO: 1093412 - RNA, 22 nt, Human
caaaguaauuuggagauauaua

SEQ ID NO: 1093413 - RNA, 22 nt, Human
cagaaggcuuuguggaguagac

SEQ ID NO: 1093414 - RNA, 22 nt, Human
augaguucaauuguuucaguca

SEQ ID NO: 1093415 - RNA, 20 nt, Human
ugcagggcugccucccagcu

SEQ ID NO: 1093416 - RNA, 22 nt, Human
uguacaaugccgagacuaacuc

SEQ ID NO: 1093417 - RNA, 22 nt, Human
guccaaauuuuucacauguaga

SEQ ID NO: 1093418 - RNA, 22 nt, Human
cuuacacagucuggcacuucuu

SEQ ID NO: 1093419 - RNA, 22 nt, Human
ggguccugcgugggcccaggac

SEQ ID NO: 1093420 - RNA, 19 nt, Human
acaagggcaggcaagguga

SEQ ID NO: 1093421 - RNA, 22 nt, Human
ucagagucugugcauucugcua

SEQ ID NO: 1093422 - RNA, 22 nt, Human
ucaagugcuugugagguauuug

SEQ ID NO: 1093423 - RNA, 22 nt, Human
guuuauaaauucugcuuuuguu

SEQ ID NO: 1093424 - RNA, 22 nt, Human
ggcuucauggaggaggugaguc

SEQ ID NO: 1093425 - RNA, 22 nt, Human
acaucagugcucuugguucuug

SEQ ID NO: 1093426 - RNA, 22 nt, Human
acuucaugaacauguggccugu

SEQ ID NO: 1093427 - RNA, 22 nt, Human
auccccacgauauagccaaagc

SEQ ID NO: 1093428 - RNA, 22 nt, Human
agauggggcagaauggagccau

SEQ ID NO: 1093429 - RNA, 22 nt, Human
agcauuuauuucuuagaaauug

SEQ ID NO: 1093430 - RNA, 22 nt, Human
aaagucauggaaaaucuuggaa

SEQ ID NO: 1093431 - RNA, 20 nt, Human
agaggccaguuaggagucua

SEQ ID NO: 1093432 - RNA, 23 nt, Human
ccagcuccgugagccucgggcuc

SEQ ID NO: 1093433 - RNA, 22 nt, Human
ccagagaagguggagcuugugu

SEQ ID NO: 1093434 - RNA, 22 nt, Human
gaggaggcuaagugggcucugg

SEQ ID NO: 1093435 - RNA, 22 nt, Human
acaaagaucuugcuuuccuacu

SEQ ID NO: 1093436 - RNA, 22 nt, Human
uucaagaugacccagucacacg

SEQ ID NO: 1093437 - RNA, 22 nt, Human
caagaaucaacauuauuuagug

SEQ ID NO: 1093438 - RNA, 22 nt, Human
ggcugaaacagauuucaagaca

SEQ ID NO: 1093439 - RNA, 22 nt, Human
auaggcuuauauaaaaacaucu

SEQ ID NO: 1093440 - RNA, 22 nt, Human
ccugccagucacuaugucaccu

SEQ ID NO: 1093441 - RNA, 22 nt, Human
cagacacaccaggcccauucug

SEQ ID NO: 1093442 - RNA, 22 nt, Human
uaaggcucauguaauuagagau

SEQ ID NO: 1093443 - RNA, 20 nt, Human
guugaaaguaauaugaugcu

SEQ ID NO: 1093444 - RNA, 22 nt, Human
agugucaaauuaaauaaucugg

SEQ ID NO: 1093445 - RNA, 22 nt, Human
auucaguggauaucuucacuuu

SEQ ID NO: 1093446 - RNA, 22 nt, Human
gcucagagauguucaguagcuu

SEQ ID NO: 1093447 - RNA, 17 nt, Human
uguuuucauucauugcu

SEQ ID NO: 1093448 - RNA, 22 nt, Human
uggggcagaguaggauuuuggc

SEQ ID NO: 1093449 - RNA, 22 nt, Human
cuacauggagaagaaaauucuu

SEQ ID NO: 1093450 - RNA, 22 nt, Human
auucugcauugcucacaaagau

SEQ ID NO: 1093451 - RNA, 22 nt, Human
ugcagaccucccauggcugccu

SEQ ID NO: 1093452 - RNA, 22 nt, Human
gccugagaaggacacagcaggu

SEQ ID NO: 1093453 - RNA, 22 nt, Human
aauuauauuguggugugaaugu

SEQ ID NO: 1093454 - RNA, 22 nt, Human
uuuuaacacucagcacuaucuc

SEQ ID NO: 1093455 - RNA, 22 nt, Human
cucagggaggccucugcugguu

SEQ ID NO: 1093456 - RNA, 22 nt, Human
agaagaaacugucggggauauu

SEQ ID NO: 1093457 - RNA, 22 nt, Human
gaaacaugucugacaauuuacc

SEQ ID NO: 1093458 - RNA, 22 nt, Human
ggcugucugugguggagcguug

SEQ ID NO: 1093459 - RNA, 22 nt, Human
aauagcauguucaugauaaaau

SEQ ID NO: 1093460 - RNA, 22 nt, Human
uggcucagaugcucuuccagug

SEQ ID NO: 1093461 - RNA, 22 nt, Human
cuuuucuuauguggacguaccu

SEQ ID NO: 1093462 - RNA, 22 nt, Human
ucuaacuugugaguauagauga

SEQ ID NO: 1093463 - RNA, 20 nt, Human
uauaaauucagagcuuuggu

SEQ ID NO: 1093464 - RNA, 22 nt, Human
gcauucaucuuccuccaugcag

SEQ ID NO: 1093465 - RNA, 22 nt, Human
uucagcuaaaggaaacucagau

SEQ ID NO: 1093466 - RNA, 22 nt, Human
gucuuugugguaguccucagcc

SEQ ID NO: 1093467 - RNA, 21 nt, Human
ugcagcagaguaagcagggga

SEQ ID NO: 1093468 - RNA, 23 nt, Human
uuucauaugguguggaugaagaa

SEQ ID NO: 1093469 - RNA, 22 nt, Human
gugggcagugguuugcgcgguc

SEQ ID NO: 1093470 - RNA, 22 nt, Human
uaauaguugugacuuuguaaag

SEQ ID NO: 1093471 - RNA, 23 nt, Human
agggccacugggaaggauuacug

SEQ ID NO: 1093472 - RNA, 22 nt, Human
caauuuuauugguccaaauaca

SEQ ID NO: 1093473 - RNA, 22 nt, Human
auuuccuauagauauggugagu

SEQ ID NO: 1093474 - RNA, 17 nt, Human
cacuuuguugcuguggg

SEQ ID NO: 1093475 - RNA, 22 nt, Human
acauacaugggauuaaaaaauu

SEQ ID NO: 1093476 - RNA, 23 nt, Human
uuguaaaacagugugacgguucc

SEQ ID NO: 1093477 - RNA, 22 nt, Human
gcugagggcauguguggcgacu

SEQ ID NO: 1093478 - RNA, 19 nt, Human
gacagugcaguuguaguac

SEQ ID NO: 1093479 - RNA, 22 nt, Human
aagcagaggaccgacggaggga

SEQ ID NO: 1093480 - RNA, 22 nt, Human
agucaggagcugcugcauugua

SEQ ID NO: 1093481 - RNA, 22 nt, Human
uaugcaguguacgauguuuagu

SEQ ID NO: 1093482 - RNA, 22 nt, Human
uuauuagguuuacauaaagguu

SEQ ID NO: 1093483 - RNA, 22 nt, Human
ucauuucagaugcauuuagaau

SEQ ID NO: 1093484 - RNA, 22 nt, Human
uggcucaguagcagugugguca

SEQ ID NO: 1093485 - RNA, 22 nt, Human
acacugugucuagcauuuuaca

SEQ ID NO: 1093486 - RNA, 22 nt, Human
acagcagcauaaacugacuaag

SEQ ID NO: 1093487 - RNA, 22 nt, Human
ccuggcaggcaagaggaaggga

SEQ ID NO: 1093488 - RNA, 22 nt, Human
caggggaagaugccaagggaga

SEQ ID NO: 1093489 - RNA, 22 nt, Human
uggaagcaacaacuauggacca

SEQ ID NO: 1093490 - RNA, 22 nt, Human
aaggcagcuucaccacagcauu

SEQ ID NO: 1093491 - RNA, 22 nt, Human
ggagcugggacccugucaucug

SEQ ID NO: 1093492 - RNA, 22 nt, Human
cagugauggauauggagaaguc

SEQ ID NO: 1093493 - RNA, 22 nt, Human
aguguccccuacagaggcauuc

SEQ ID NO: 1093494 - RNA, 21 nt, Human
gggugggguuccagccuuuuc

SEQ ID NO: 1093495 - RNA, 22 nt, Human
uccuugagccucccagacucag

SEQ ID NO: 1093496 - RNA, 22 nt, Human
aaaugcauguauguaauaugcu

SEQ ID NO: 1093497 - RNA, 22 nt, Human
uccagggauguccuguagcacu

SEQ ID NO: 1093498 - RNA, 22 nt, Human
uucuuuccucccagccuuugga

SEQ ID NO: 1093499 - RNA, 22 nt, Human
cuguccugcaguugggggcagg

SEQ ID NO: 1093500 - RNA, 22 nt, Human
uugaaaggaauacagaggccua

SEQ ID NO: 1093501 - RNA, 17 nt, Human
gaacagcagaggggaca

SEQ ID NO: 1093502 - RNA, 17 nt, Human
cugggccuccccugucc

SEQ ID NO: 1093503 - RNA, 22 nt, Human
aaagugcacucucagugcugcu

SEQ ID NO: 1093504 - RNA, 22 nt, Human
agaugaagauaucugcaggggc

SEQ ID NO: 1093505 - RNA, 22 nt, Human
cagugcaguuucccagaugcug

SEQ ID NO: 1093506 - RNA, 22 nt, Human
aauucuuguuguuaguauauuu

SEQ ID NO: 1093507 - RNA, 23 nt, Human
uucaaagcuuaagcucuuuccac

SEQ ID NO: 1093508 - RNA, 22 nt, Human
cacauugaaaugacccaauaau

SEQ ID NO: 1093509 - RNA, 22 nt, Human
aacacaguuaguaagggaaaua

SEQ ID NO: 1093510 - RNA, 23 nt, Human
ggacagggcccugcccuauggcc

SEQ ID NO: 1093511 - RNA, 22 nt, Human
caacagaaaucaauuuucccau

SEQ ID NO: 1093512 - RNA, 22 nt, Human
agcaggcuuaugguugaaggga

SEQ ID NO: 1093513 - RNA, 22 nt, Human
uugaggcacacacagguugcau

SEQ ID NO: 1093514 - RNA, 22 nt, Human
ucuuccaaugguuucuagauuu

SEQ ID NO: 1093515 - RNA, 17 nt, Human
ucuuuccugccaugcuc

SEQ ID NO: 1093516 - RNA, 22 nt, Human
cugugcccuuucgcugcacugu

SEQ ID NO: 1093517 - RNA, 22 nt, Human
acguuuucagugacugugcuuc

SEQ ID NO: 1093518 - RNA, 19 nt, Human
uggcauuuggaggcaaccu

SEQ ID NO: 1093519 - RNA, 19 nt, Human
ugcucauggggacuucucc

SEQ ID NO: 1093520 - RNA, 22 nt, Human
ggacagagcccugguggccuaa

SEQ ID NO: 1093521 - RNA, 22 nt, Human
uuucaaguaagauacauuucag

SEQ ID NO: 1093522 - RNA, 22 nt, Human
aggaaauugagaaucagaauaa

SEQ ID NO: 1093523 - RNA, 22 nt, Human
cccagguguuuguggcagaggu

SEQ ID NO: 1093524 - RNA, 22 nt, Human
uuuacacuugaggaaacugagg

SEQ ID NO: 1093525 - RNA, 22 nt, Human
acauagcauaaagaaugacucu

SEQ ID NO: 1093526 - RNA, 22 nt, Human
gcucagaggagcaucauaagga

SEQ ID NO: 1093527 - RNA, 19 nt, Human
cugaagucuuuucagcugg

SEQ ID NO: 1093528 - RNA, 22 nt, Human
ugugccuucucaguccugcuca

SEQ ID NO: 1093529 - RNA, 22 nt, Human
ucugucauaaacacacacaagc

SEQ ID NO: 1093530 - RNA, 22 nt, Human
uccuugaauggacauuacacug

SEQ ID NO: 1093531 - RNA, 21 nt, Human
ccagagccugcugagcccccu

SEQ ID NO: 1093532 - RNA, 22 nt, Human
acagccaggacuuggcccucuu

SEQ ID NO: 1093533 - RNA, 22 nt, Human
aucuugaagguucuaccauaca

SEQ ID NO: 1093534 - RNA, 22 nt, Human
auacaucuagagucauaaaaac

SEQ ID NO: 1093535 - RNA, 22 nt, Human
cagcucugugcaggccugggga

SEQ ID NO: 1093536 - RNA, 22 nt, Human
ucacaagagcuggacugucuuu

SEQ ID NO: 1093537 - RNA, 22 nt, Human
ggaguaggccccgggagagagu

SEQ ID NO: 1093538 - RNA, 22 nt, Human
ucaugcuuaaaagacacuugag

SEQ ID NO: 1093539 - RNA, 22 nt, Human
cuggccccaucuggagucugag

SEQ ID NO: 1093540 - RNA, 22 nt, Human
acugugugaaacaucaaugugu

SEQ ID NO: 1093541 - RNA, 22 nt, Human
gaggcugcugagagcccuguuu

SEQ ID NO: 1093542 - RNA, 22 nt, Human
ggacugaggacaugugaggcau

SEQ ID NO: 1093543 - RNA, 20 nt, Human
acccagcucugugcccuggg

SEQ ID NO: 1093544 - RNA, 19 nt, Human
agcauccagucaugggauc

SEQ ID NO: 1093545 - RNA, 22 nt, Human
ugggcaggauaauaucucaugu

SEQ ID NO: 1093546 - RNA, 22 nt, Human
uagaaaauggccaagcaggacu

SEQ ID NO: 1093547 - RNA, 22 nt, Human
ugccaggcccugcgggguccca

SEQ ID NO: 1093548 - RNA, 22 nt, Human
aagagcuggaguuugcagcccu

SEQ ID NO: 1093549 - RNA, 22 nt, Human
auuguuaauaacuauuacauug

SEQ ID NO: 1093550 - RNA, 22 nt, Human
acuauaaaaggauaaaccagaa

SEQ ID NO: 1093551 - RNA, 22 nt, Human
guggggcaguggccugggagca

SEQ ID NO: 1093552 - RNA, 22 nt, Human
aagaagcacuuuccuacauguu

SEQ ID NO: 1093553 - RNA, 22 nt, Human
aaaugguauaaugucauguauu

SEQ ID NO: 1093554 - RNA, 22 nt, Human
agauauuuugugugauguuuca

SEQ ID NO: 1093555 - RNA, 18 nt, Human
ugaggcucagcuccuggu

SEQ ID NO: 1093556 - RNA, 20 nt, Human
auuugcaucugaauaacuua

SEQ ID NO: 1093557 - RNA, 22 nt, Human
ucuuuguaagacauguaagucc

SEQ ID NO: 1093558 - RNA, 22 nt, Human
gaugauuacacuuuuaaaacag

SEQ ID NO: 1093559 - RNA, 22 nt, Human
ccugguggagaggggcggagcg

SEQ ID NO: 1093560 - RNA, 17 nt, Human
agagagagcaugccacc

SEQ ID NO: 1093561 - RNA, 23 nt, Human
aagaacuuugguccugcagaguc

SEQ ID NO: 1093562 - RNA, 20 nt, Human
gggagucuggaugaaagaug

SEQ ID NO: 1093563 - RNA, 21 nt, Human
gaacauuuggguuguuucuac

SEQ ID NO: 1093564 - RNA, 22 nt, Human
ggagacucaccccgcauucuag

SEQ ID NO: 1093565 - RNA, 22 nt, Human
aagucaaaccuugcucacagga

SEQ ID NO: 1093566 - RNA, 23 nt, Human
ucucaagaggaagcagggcucau

SEQ ID NO: 1093567 - RNA, 22 nt, Human
gugcuggccucagagggucaug

SEQ ID NO: 1093568 - RNA, 22 nt, Human
caggagaugacagggaagaacc

SEQ ID NO: 1093569 - RNA, 22 nt, Human
ucaauuauuugauaugaaaggg

SEQ ID NO: 1093570 - RNA, 22 nt, Human
ucugggcugaaaugaaggccuu

SEQ ID NO: 1093571 - RNA, 22 nt, Human
guuugucauuuguacuucuagc

SEQ ID NO: 1093572 - RNA, 22 nt, Human
uagcugccuuugggcuccugcu

SEQ ID NO: 1093573 - RNA, 22 nt, Human
uaucaccagagggauagucucu

SEQ ID NO: 1093574 - RNA, 20 nt, Human
aggcacuggauuucuuauau

SEQ ID NO: 1093575 - RNA, 22 nt, Human
cccuuucugccuucuaaaauaa

SEQ ID NO: 1093576 - RNA, 22 nt, Human
gaacaucaugaagaaaacauau

SEQ ID NO: 1093577 - RNA, 22 nt, Human
uggagcuggcuuguggaaguug

SEQ ID NO: 1093578 - RNA, 18 nt, Human
auuaaggaauucuuuaga

SEQ ID NO: 1093579 - RNA, 22 nt, Human
uuugcuuucuguugaacagagu

SEQ ID NO: 1093580 - RNA, 22 nt, Human
gccagaguugaggcaguuuauu

SEQ ID NO: 1093581 - RNA, 22 nt, Human
gccucugcggagcuguacauca

SEQ ID NO: 1093582 - RNA, 23 nt, Human
aaacuacauuuauaguuuuucuc

SEQ ID NO: 1093583 - RNA, 22 nt, Human
aaucuguauugcucauacuuga

SEQ ID NO: 1093584 - RNA, 22 nt, Human
ugcagaagaaugagcuuggagu

SEQ ID NO: 1093585 - RNA, 22 nt, Human
ugcccuggcucuccacuaguuu

SEQ ID NO: 1093586 - RNA, 22 nt, Human
augauuuucugauaaagaacug

SEQ ID NO: 1093587 - RNA, 22 nt, Human
uuucuaagugugauuuuagauu

SEQ ID NO: 1093588 - RNA, 22 nt, Human
ucuucaugucucugcuugaguc

SEQ ID NO: 1093589 - RNA, 22 nt, Human
ucuuccucucuaauugaucaga

SEQ ID NO: 1093590 - RNA, 22 nt, Human
gugcaauggggcaauaucagcu

SEQ ID NO: 1093591 - RNA, 22 nt, Human
acaauuucaccuuuugguucaa

SEQ ID NO: 1093592 - RNA, 22 nt, Human
cuguaugauuccauuucuauaa

SEQ ID NO: 1093593 - RNA, 22 nt, Human
acuaaagcucacagaguugaac

SEQ ID NO: 1093594 - RNA, 22 nt, Human
ucagacagcuugcagggaggug

SEQ ID NO: 1093595 - RNA, 22 nt, Human
uuguuacagcacuuaaccuuuu

SEQ ID NO: 1093596 - RNA, 22 nt, Human
auuucuguuugcuacuauaagu

SEQ ID NO: 1093597 - RNA, 19 nt, Human
ucagaacucagaaugugua

SEQ ID NO: 1093598 - RNA, 22 nt, Human
cagcccugccauggagccuccu

SEQ ID NO: 1093599 - RNA, 22 nt, Human
ugcagcaggcacaggacggaag

SEQ ID NO: 1093600 - RNA, 22 nt, Human
uaggaaccuacugugguuuuaa

SEQ ID NO: 1093601 - RNA, 22 nt, Human
guuuucagccaggagcacauuu

SEQ ID NO: 1093602 - RNA, 22 nt, Human
aggccuccugcagggaugagug

SEQ ID NO: 1093603 - RNA, 22 nt, Human
uugaaacuaugaagacaaccau

SEQ ID NO: 1093604 - RNA, 22 nt, Human
gagcagcucagaggacuagugu

SEQ ID NO: 1093605 - RNA, 22 nt, Human
uaugauuuguagacauuugauu

SEQ ID NO: 1093606 - RNA, 22 nt, Human
gugggagcauggucccagugcc

SEQ ID NO: 1093607 - RNA, 22 nt, Human
aaauuaagggugagaagaguug

SEQ ID NO: 1093608 - RNA, 22 nt, Human
agugcaaagggcuguugagaag

SEQ ID NO: 1093609 - RNA, 22 nt, Human
ucagaauuggaacgugaagauu

SEQ ID NO: 1093610 - RNA, 22 nt, Human
ucacagcuauucucauguauuu

SEQ ID NO: 1093611 - RNA, 22 nt, Human
agcagcuguacuuucaucuguu

SEQ ID NO: 1093612 - RNA, 22 nt, Human
uuguuuuaaccuaguguuuaug

SEQ ID NO: 1093613 - RNA, 22 nt, Human
aaaaugugaucuacaaaugcaa

SEQ ID NO: 1093614 - RNA, 22 nt, Human
acuggcuggccgcgcucuucgc

SEQ ID NO: 1093615 - RNA, 22 nt, Human
cugcuguggccagccaggucaa

SEQ ID NO: 1093616 - RNA, 22 nt, Human
uauuaacauuuuaugaaaauaa

SEQ ID NO: 1093617 - RNA, 22 nt, Human
cucacaggagaaagucaugguc

SEQ ID NO: 1093618 - RNA, 22 nt, Human
gggcacuguggggcccaugcug

SEQ ID NO: 1093619 - RNA, 22 nt, Human
ucucagaggugcccuggcaucu

SEQ ID NO: 1093620 - RNA, 17 nt, Human
ggcuggaggggacccgg

SEQ ID NO: 1093621 - RNA, 22 nt, Human
cacauaaguggguuccauugca

SEQ ID NO: 1093622 - RNA, 22 nt, Human
cugccugugcaugcagucagaa

SEQ ID NO: 1093623 - RNA, 19 nt, Human
uuaacagucaccaaggaga

SEQ ID NO: 1093624 - RNA, 22 nt, Human
auauguuagggaacaauuugag

SEQ ID NO: 1093625 - RNA, 22 nt, Human
gugucucuuagccugcuaaugc

SEQ ID NO: 1093626 - RNA, 22 nt, Human
ugagggcaaaguggugcugagg

SEQ ID NO: 1093627 - RNA, 22 nt, Human
acacaugaaauaauauuaugca

SEQ ID NO: 1093628 - RNA, 22 nt, Human
aguauauugcucuuaaucauag

SEQ ID NO: 1093629 - RNA, 22 nt, Human
aacuuuacacugcuuuacauga

SEQ ID NO: 1093630 - RNA, 22 nt, Human
ugggcugaacuucaucugauga

SEQ ID NO: 1093631 - RNA, 22 nt, Human
uuccuguauucuaaagggaaag

SEQ ID NO: 1093632 - RNA, 22 nt, Human
uggaaggggagcuggaaagggg

SEQ ID NO: 1093633 - RNA, 22 nt, Human
cuguauuucccacauucucuau

SEQ ID NO: 1093634 - RNA, 22 nt, Human
caaggccugccucuggcagaaa

SEQ ID NO: 1093635 - RNA, 22 nt, Human
acaaagucucuaauaaucuucu

SEQ ID NO: 1093636 - RNA, 22 nt, Human
gcugggcuccaggccaggguga

SEQ ID NO: 1093637 - RNA, 22 nt, Human
uaacacugauuuguucucaggg

SEQ ID NO: 1093638 - RNA, 22 nt, Human
caacacagggguuaugccaugg

SEQ ID NO: 1093639 - RNA, 22 nt, Human
gccugugcauagcagcggacuc

SEQ ID NO: 1093640 - RNA, 22 nt, Human
gccuucccaagacgccugaguu

SEQ ID NO: 1093641 - RNA, 22 nt, Human
agcagcugcagggagggucugc

SEQ ID NO: 1093642 - RNA, 22 nt, Human
uugcauugaucccagcuugggc

SEQ ID NO: 1093643 - RNA, 22 nt, Human
uggacucaaguccaaguucacg

SEQ ID NO: 1093644 - RNA, 22 nt, Human
gaauauuaguaucaguuauacc

SEQ ID NO: 1093645 - RNA, 22 nt, Human
caguguggugugcacagcuuag

SEQ ID NO: 1093646 - RNA, 22 nt, Human
ccaggguguagggauuccagau

SEQ ID NO: 1093647 - RNA, 22 nt, Human
gugucauggaaaauugcaaugg

SEQ ID NO: 1093648 - RNA, 22 nt, Human
uuucaaguucuguuccuaaacu

SEQ ID NO: 1093649 - RNA, 22 nt, Human
augaaaguaggguaaaaucaca

SEQ ID NO: 1093650 - RNA, 22 nt, Human
caguggauuagccagagcugga

SEQ ID NO: 1093651 - RNA, 22 nt, Human
acacaguaugcaucuagaaauu

SEQ ID NO: 1093652 - RNA, 22 nt, Human
uucuuauugggagaccuuuucu

SEQ ID NO: 1093653 - RNA, 22 nt, Human
uagcauuaaagguaagacauua

SEQ ID NO: 1093654 - RNA, 22 nt, Human
gcugcccagcaggccccagggg

SEQ ID NO: 1093655 - RNA, 22 nt, Human
uguguucuggaaagcucacuga

SEQ ID NO: 1093656 - RNA, 22 nt, Human
gaacauaugcauguuuguuuug

SEQ ID NO: 1093657 - RNA, 22 nt, Human
ugcuggagaucauuaauguuca

SEQ ID NO: 1093658 - RNA, 22 nt, Human
uaaaauuugucccugaguguug

SEQ ID NO: 1093659 - RNA, 22 nt, Human
uccaggagaggccugaccaggu

SEQ ID NO: 1093660 - RNA, 22 nt, Human
ucacuggggccuuuggucagga

SEQ ID NO: 1093661 - RNA, 22 nt, Human
cagaugaggggcauauaacaau

SEQ ID NO: 1093662 - RNA, 22 nt, Human
acaugacagugcuuagcaaacu

SEQ ID NO: 1093663 - RNA, 23 nt, Human
uccuuccuuugagaggcuccauc

SEQ ID NO: 1093664 - RNA, 22 nt, Human
uaacaucuuuagcagcucgaac

SEQ ID NO: 1093665 - RNA, 22 nt, Human
ccugcacuaccuggggcugcug

SEQ ID NO: 1093666 - RNA, 22 nt, Human
aucauacagaaccugagcacuu

SEQ ID NO: 1093667 - RNA, 22 nt, Human
ugugcucuaccucagugucauu

SEQ ID NO: 1093668 - RNA, 22 nt, Human
auuugcaauuacucaugucauu

SEQ ID NO: 1093669 - RNA, 22 nt, Human
ucuuuuggaaaugaugugcagg

SEQ ID NO: 1093670 - RNA, 22 nt, Human
agcagcagauucagcaggaaug

SEQ ID NO: 1093671 - RNA, 22 nt, Human
cccucugcaggcuggaccugcc

SEQ ID NO: 1093672 - RNA, 22 nt, Human
aacuuuuucugggauggagggu

SEQ ID NO: 1093673 - RNA, 20 nt, Human
cgugcugugaccuugagcau

SEQ ID NO: 1093674 - RNA, 22 nt, Human
caguaaaugguacguauauuuu

SEQ ID NO: 1093675 - RNA, 22 nt, Human
agucccaguucgguucuuccuc

SEQ ID NO: 1093676 - RNA, 22 nt, Human
uaaagucagggagauugaggcu

SEQ ID NO: 1093677 - RNA, 22 nt, Human
uaaaucacaucgaaaucugggu

SEQ ID NO: 1093678 - RNA, 22 nt, Human
gggcucugugguugugcuuugu

SEQ ID NO: 1093679 - RNA, 22 nt, Human
ggcugccuccucgagacaggau

SEQ ID NO: 1093680 - RNA, 22 nt, Human
auuauuagauucuuaauuguaa

SEQ ID NO: 1093681 - RNA, 22 nt, Human
ucuaauuuuaggcauuuguuca

SEQ ID NO: 1093682 - RNA, 22 nt, Human
cuggcucaggguggucuggguc

SEQ ID NO: 1093683 - RNA, 22 nt, Human
uuauacuuuauacuacaucauu

SEQ ID NO: 1093684 - RNA, 22 nt, Human
ugggcucuggagggccuaggau

SEQ ID NO: 1093685 - RNA, 22 nt, Human
uuucucuagcuauucauuaaau

SEQ ID NO: 1093686 - RNA, 17 nt, Human
agccccucagcgucacc

SEQ ID NO: 1093687 - RNA, 22 nt, Human
ccaaaggccaagcucagguaaa

SEQ ID NO: 1093688 - RNA, 22 nt, Human
aggcugugcaauuaggguaaga

SEQ ID NO: 1093689 - RNA, 22 nt, Human
cgcaggugaaagaggcugggca

SEQ ID NO: 1093690 - RNA, 22 nt, Human
gaguuuaaucauuguucuaucc

SEQ ID NO: 1093691 - RNA, 22 nt, Human
uagaggugagacuucagugaca

SEQ ID NO: 1093692 - RNA, 22 nt, Human
agcaguggaccucagugcuauu

SEQ ID NO: 1093693 - RNA, 22 nt, Human
accucagagggauguuacaggc

SEQ ID NO: 1093694 - RNA, 22 nt, Human
aacaggcaacaguugacucuga

SEQ ID NO: 1093695 - RNA, 22 nt, Human
uuuucacuuaaggaauuucaug

SEQ ID NO: 1093696 - RNA, 22 nt, Human
aaguacaugcuguaaugauugg

SEQ ID NO: 1093697 - RNA, 22 nt, Human
gacccauauaggacccuccaaa

SEQ ID NO: 1093698 - RNA, 22 nt, Human
auguauaugaagcuaguauuuu

SEQ ID NO: 1093699 - RNA, 22 nt, Human
aucuggcuggauucuuagcguu

SEQ ID NO: 1093700 - RNA, 22 nt, Human
uuaugugccacuuuuugaagau

SEQ ID NO: 1093701 - RNA, 22 nt, Human
cuggcucccucgcugaggugcu

SEQ ID NO: 1093702 - RNA, 22 nt, Human
gcuauaggaagaaauuuguuuu

SEQ ID NO: 1093703 - RNA, 22 nt, Human
gggcccugggauucagagcaag

SEQ ID NO: 1093704 - RNA, 22 nt, Human
uuugcauuaguuuagauuucaa

SEQ ID NO: 1093705 - RNA, 23 nt, Human
guucauuuuauugucugauugcu

SEQ ID NO: 1093706 - RNA, 22 nt, Human
ucuggggaugaggaccuagaug

SEQ ID NO: 1093707 - RNA, 22 nt, Human
ucugagccagccaccuccuuca

SEQ ID NO: 1093708 - RNA, 22 nt, Human
uucugagagcugaagaaauguu

SEQ ID NO: 1093709 - RNA, 21 nt, Human
cgggcuggccgggcccucacc

SEQ ID NO: 1093710 - RNA, 22 nt, Human
agagcuguucagcagccagguu

SEQ ID NO: 1093711 - RNA, 22 nt, Human
cacaguggauugggugaugccc

SEQ ID NO: 1093712 - RNA, 22 nt, Human
auguguccacaggugugagaga

SEQ ID NO: 1093713 - RNA, 22 nt, Human
auuaacuguacuuucuaauuuu

SEQ ID NO: 1093714 - RNA, 22 nt, Human
ccugggagguggagguugcagc

SEQ ID NO: 1093715 - RNA, 22 nt, Human
ugggcugcugcggugcucuugg

SEQ ID NO: 1093716 - RNA, 20 nt, Human
gccagcccugacacaggagc

SEQ ID NO: 1093717 - RNA, 22 nt, Human
ggcggguguaaguaggacagcg

SEQ ID NO: 1093718 - RNA, 22 nt, Human
ucuagauuccuccugcauccug

SEQ ID NO: 1093719 - RNA, 22 nt, Human
cucacagguaccagcacccucc

SEQ ID NO: 1093720 - RNA, 22 nt, Human
aaaugucuaucuggcauauucc

SEQ ID NO: 1093721 - RNA, 22 nt, Human
uggcagagucaucacaucugga

SEQ ID NO: 1093722 - RNA, 22 nt, Human
ccugggccuggcgggucggcuc

SEQ ID NO: 1093723 - RNA, 22 nt, Human
aagcaauauacugauaugauua

SEQ ID NO: 1093724 - RNA, 20 nt, Human
ugcuugucaugcacucaggc

SEQ ID NO: 1093725 - RNA, 22 nt, Human
ccucacagcuugggcaaacggc

SEQ ID NO: 1093726 - RNA, 18 nt, Human
cugagggcagccccuggg

SEQ ID NO: 1093727 - RNA, 22 nt, Human
gagcagcucugggugacccagu

SEQ ID NO: 1093728 - RNA, 22 nt, Human
ugauuucccucaucauaacaga

SEQ ID NO: 1093729 - RNA, 22 nt, Human
cuuccugcaggacagccaucug

SEQ ID NO: 1093730 - RNA, 22 nt, Human
ccuggggaccugccucagcccu

SEQ ID NO: 1093731 - RNA, 22 nt, Human
cuguuauuuagaacauggaauc

SEQ ID NO: 1093732 - RNA, 22 nt, Human
cugcaagauguugucauaugcu

SEQ ID NO: 1093733 - RNA, 22 nt, Human
cagagcccuuccucccacgggg

SEQ ID NO: 1093734 - RNA, 22 nt, Human
augacacauaaaacaaggacug

SEQ ID NO: 1093735 - RNA, 22 nt, Human
uuuaaagaaauuccucaucuuu

SEQ ID NO: 1093736 - RNA, 22 nt, Human
ugaaagcucugucaucauuccu

SEQ ID NO: 1093737 - RNA, 22 nt, Human
acugucaccaucagagcgggaa

SEQ ID NO: 1093738 - RNA, 22 nt, Human
cacugggcugauaccaggcuuc

SEQ ID NO: 1093739 - RNA, 22 nt, Human
acaggugagggguucuaggcug

SEQ ID NO: 1093740 - RNA, 22 nt, Human
cagucaccaccagguggcagua

SEQ ID NO: 1093741 - RNA, 22 nt, Human
cccugagaugccucacccuagu

SEQ ID NO: 1093742 - RNA, 19 nt, Human
agguuacaggugucacaga

SEQ ID NO: 1093743 - RNA, 22 nt, Human
caugcacagugauaucugaaga

SEQ ID NO: 1093744 - RNA, 22 nt, Human
ugagaaaaguacauggagaagc

SEQ ID NO: 1093745 - RNA, 22 nt, Human
uaagucaugauucuguguuacu

SEQ ID NO: 1093746 - RNA, 22 nt, Human
uggcccugcagaacuagccugg

SEQ ID NO: 1093747 - RNA, 22 nt, Human
cgcaggcaagagaguacaguua

SEQ ID NO: 1093748 - RNA, 22 nt, Human
uacauuugcuuugauuuucagc

SEQ ID NO: 1093749 - RNA, 22 nt, Human
aaaauuauucauggcuuuugga

SEQ ID NO: 1093750 - RNA, 22 nt, Human
aggcaggagugacccugacagg

SEQ ID NO: 1093751 - RNA, 22 nt, Human
cagcaagauuuuuaaagcaagg

SEQ ID NO: 1093752 - RNA, 22 nt, Human
acagaaagaugauuugaaaugg

SEQ ID NO: 1093753 - RNA, 22 nt, Human
uagcuauuuggaaaauuccaau

SEQ ID NO: 1093754 - RNA, 22 nt, Human
gcccagaaaugaacuugcugug

SEQ ID NO: 1093755 - RNA, 22 nt, Human
caagggcagaggcagggccccg

SEQ ID NO: 1093756 - RNA, 22 nt, Human
cagggccaagcugcagcaucug

SEQ ID NO: 1093757 - RNA, 22 nt, Human
agugcaaaaguaauuggaguuu

SEQ ID NO: 1093758 - RNA, 19 nt, Human
uuaugaauagcuucaucca

SEQ ID NO: 1093759 - RNA, 22 nt, Human
ucuucaaaugcuaguaauauca

SEQ ID NO: 1093760 - RNA, 22 nt, Human
ugccugcugcuaagcucuuugu

SEQ ID NO: 1093761 - RNA, 22 nt, Human
ccagccuccauguagauagcug

SEQ ID NO: 1093762 - RNA, 22 nt, Human
uugcacagaugagggugaugcu

SEQ ID NO: 1093763 - RNA, 22 nt, Human
uuuaauauccaguggauacaaa

SEQ ID NO: 1093764 - RNA, 22 nt, Human
agcauggggcaaugcaugugcu

SEQ ID NO: 1093765 - RNA, 22 nt, Human
ccagguggauaagguuucugga

SEQ ID NO: 1093766 - RNA, 22 nt, Human
aggcacugauucucagaguuac

SEQ ID NO: 1093767 - RNA, 22 nt, Human
aaagacuuucaccuagcaaaga

SEQ ID NO: 1093768 - RNA, 22 nt, Human
cuuuccaacucuagugaaauuu

SEQ ID NO: 1093769 - RNA, 22 nt, Human
uucacauugugcagauuauggu

SEQ ID NO: 1093770 - RNA, 22 nt, Human
gguggggccugcuccagcggcc

SEQ ID NO: 1093771 - RNA, 22 nt, Human
acugugggaaccacugaaucag

SEQ ID NO: 1093772 - RNA, 22 nt, Human
cacacagugggaaaaccugaag

SEQ ID NO: 1093773 - RNA, 22 nt, Human
uagaaacacagagagacccaug

SEQ ID NO: 1093774 - RNA, 22 nt, Human
gccagcaaggaggggaaaaaug

SEQ ID NO: 1093775 - RNA, 22 nt, Human
ggcagcuccuccuagucugccc

SEQ ID NO: 1093776 - RNA, 22 nt, Human
gaaaugguagaguaggaagauu

SEQ ID NO: 1093777 - RNA, 22 nt, Human
gucaccauggauaagaaucacu

SEQ ID NO: 1093778 - RNA, 20 nt, Human
agcagcuguguuuucauccu

SEQ ID NO: 1093779 - RNA, 22 nt, Human
gccaggugcuaucccugcgcug

SEQ ID NO: 1093780 - RNA, 22 nt, Human
agauauauuuaagguaauaagu

SEQ ID NO: 1093781 - RNA, 22 nt, Human
uuuuacaccuguuaacucuaag

SEQ ID NO: 1093782 - RNA, 22 nt, Human
agucucuuuugcgaagaguguu

SEQ ID NO: 1093783 - RNA, 22 nt, Human
agugggcagcccaggaggucuu

SEQ ID NO: 1093784 - RNA, 22 nt, Human
agaggcuggauugagcauagac

SEQ ID NO: 1093785 - RNA, 22 nt, Human
gcacagaacuucucuuaguagg

SEQ ID NO: 1093786 - RNA, 22 nt, Human
agacaaagacagcaucucaggu

SEQ ID NO: 1093787 - RNA, 22 nt, Human
gccuggcugagguggggaggca

SEQ ID NO: 1093788 - RNA, 22 nt, Human
acaaaucuguuuuauagacuuu

SEQ ID NO: 1093789 - RNA, 22 nt, Human
aggggccuggacauggacgcgc

SEQ ID NO: 1093790 - RNA, 22 nt, Human
cuggagaaguacugagacauuu

SEQ ID NO: 1093791 - RNA, 22 nt, Human
ugacaacucuaguuaaugaauu

SEQ ID NO: 1093792 - RNA, 17 nt, Human
gaaaggaggcaacacug

SEQ ID NO: 1093793 - RNA, 22 nt, Human
ugaauggucacugagcaucugu

SEQ ID NO: 1093794 - RNA, 22 nt, Human
uuaaaaucacagucacccagua

SEQ ID NO: 1093795 - RNA, 22 nt, Human
cuugcaggauuuugcugcugua

SEQ ID NO: 1093796 - RNA, 23 nt, Human
uuacagaaaguaugcuuuuguuu

SEQ ID NO: 1093797 - RNA, 22 nt, Human
aacauauuuggcugauauuccc

SEQ ID NO: 1093798 - RNA, 18 nt, Human
uucuuuucaugugaucuc

SEQ ID NO: 1093799 - RNA, 22 nt, Human
gagguggcuccuucagggaaua

SEQ ID NO: 1093800 - RNA, 22 nt, Human
ccugucuggugaggggguugca

SEQ ID NO: 1093801 - RNA, 22 nt, Human
cugcucugugguccaugagaca

SEQ ID NO: 1093802 - RNA, 22 nt, Human
cagguaggcagccggucucugg

SEQ ID NO: 1093803 - RNA, 22 nt, Human
ugcagagauugaacaagaagga

SEQ ID NO: 1093804 - RNA, 22 nt, Human
cugucuguuucugauucaaccu

SEQ ID NO: 1093805 - RNA, 22 nt, Human
ucaccaauaauaacuugagaau

SEQ ID NO: 1093806 - RNA, 21 nt, Human
aggcccagagucuugggggga

SEQ ID NO: 1093807 - RNA, 22 nt, Human
ccagcucuagccccauguggcu

SEQ ID NO: 1093808 - RNA, 22 nt, Human
agucaucaucugcccucacugg

SEQ ID NO: 1093809 - RNA, 22 nt, Human
ugcuucuggaaacaguggcugu

SEQ ID NO: 1093810 - RNA, 22 nt, Human
ccacugugcccagccucauggg

SEQ ID NO: 1093811 - RNA, 22 nt, Human
aagugaguggccuggagaggug

SEQ ID NO: 1093812 - RNA, 21 nt, Human
uugcaccaugauaaauucaga

SEQ ID NO: 1093813 - RNA, 22 nt, Human
guucaaguuucugagcuuuaau

SEQ ID NO: 1093814 - RNA, 22 nt, Human
uuacgaauguuagauugcaucu

SEQ ID NO: 1093815 - RNA, 22 nt, Human
cucuccagaauaugccgccgug

SEQ ID NO: 1093816 - RNA, 22 nt, Human
cucaaggacuuauucaugccug

SEQ ID NO: 1093817 - RNA, 22 nt, Human
uuucacagcuggguggcagagu

SEQ ID NO: 1093818 - RNA, 22 nt, Human
uuaaagcaaccucagcccucuu

SEQ ID NO: 1093819 - RNA, 20 nt, Human
ugucagugccugaggcacag

SEQ ID NO: 1093820 - RNA, 22 nt, Human
agggcccauagaucgucagcuu

SEQ ID NO: 1093821 - RNA, 22 nt, Human
uggcagggccugaaucuuauac

SEQ ID NO: 1093822 - RNA, 21 nt, Human
cacucaggguaugugccaggc

SEQ ID NO: 1093823 - RNA, 22 nt, Human
cagucacauugcccugcauuua

SEQ ID NO: 1093824 - RNA, 22 nt, Human
cagcagcugcaaauggaaacag

SEQ ID NO: 1093825 - RNA, 21 nt, Human
cugcuuuacuucagaggaucu

SEQ ID NO: 1093826 - RNA, 22 nt, Human
ggcuggcaggggaugucagaug

SEQ ID NO: 1093827 - RNA, 19 nt, Human
auacacauacguaaacuga

SEQ ID NO: 1093828 - RNA, 20 nt, Human
cugcacugaacaugucugag

SEQ ID NO: 1093829 - RNA, 22 nt, Human
uuauacagcauugcuagugaug

SEQ ID NO: 1093830 - RNA, 22 nt, Human
ggggauggauuccgggucccug

SEQ ID NO: 1093831 - RNA, 22 nt, Human
aagaauguuaguuucugauaca

SEQ ID NO: 1093832 - RNA, 22 nt, Human
ccugggaaguuguggcugcagu

SEQ ID NO: 1093833 - RNA, 22 nt, Human
uuacuguuugaaaaaugaaugu

SEQ ID NO: 1093834 - RNA, 22 nt, Human
ugaaaugacagucuuaagcucu

SEQ ID NO: 1093835 - RNA, 22 nt, Human
cucugcccagugcccacaggag

SEQ ID NO: 1093836 - RNA, 22 nt, Human
caguaacugaugugaucaaacg

SEQ ID NO: 1093837 - RNA, 22 nt, Human
uuuccaaagguggcaggaacaa

SEQ ID NO: 1093838 - RNA, 22 nt, Human
auggacaggaacucccuuggca

SEQ ID NO: 1093839 - RNA, 22 nt, Human
cagagugaaaacugagcucaaa

SEQ ID NO: 1093840 - RNA, 22 nt, Human
agacacugagcauuuuccuagc

SEQ ID NO: 1093841 - RNA, 22 nt, Human
uaauacuguauacugcaaauuu

SEQ ID NO: 1093842 - RNA, 22 nt, Human
ugccuuuuauggcuagccucag

SEQ ID NO: 1093843 - RNA, 22 nt, Human
auauauucuuaaagaaucugac

SEQ ID NO: 1093844 - RNA, 22 nt, Human
cccaggaagcggagauugcaga

SEQ ID NO: 1093845 - RNA, 22 nt, Human
agauuucacaugcugcucuauu

SEQ ID NO: 1093846 - RNA, 23 nt, Human
ucugggcugagacuuggaagguc

SEQ ID NO: 1093847 - RNA, 18 nt, Human
gcaggugccacugcuguu

SEQ ID NO: 1093848 - RNA, 23 nt, Human
uguccuaugcagcuaaaauuccu

SEQ ID NO: 1093849 - RNA, 22 nt, Human
ucuuuagccaguaucauaauga

SEQ ID NO: 1093850 - RNA, 22 nt, Human
ugcaggcuccaugaggacaggc

SEQ ID NO: 1093851 - RNA, 22 nt, Human
aaaauaugacugugcuccuuaa

SEQ ID NO: 1093852 - RNA, 22 nt, Human
cucagcuggcaauucuggcucc

SEQ ID NO: 1093853 - RNA, 22 nt, Human
cagcucccaguggcagcuccuu

SEQ ID NO: 1093854 - RNA, 21 nt, Human
uuugcauuuuacaugugggga

SEQ ID NO: 1093855 - RNA, 17 nt, Human
ccucccacaccgcccug

SEQ ID NO: 1093856 - RNA, 22 nt, Human
ggcuucucucccccagcuccac

SEQ ID NO: 1093857 - RNA, 22 nt, Human
aucuggcuuuuacugaauugcu

SEQ ID NO: 1093858 - RNA, 22 nt, Human
gaaaggaaauugagggacgcau

SEQ ID NO: 1093859 - RNA, 22 nt, Human
guggugcaggccagcaggggcg

SEQ ID NO: 1093860 - RNA, 22 nt, Human
agggcagagaucugagugggca

SEQ ID NO: 1093861 - RNA, 22 nt, Human
accagggcccgggagagcucuc

SEQ ID NO: 1093862 - RNA, 22 nt, Human
gccaggaaaagaagcuggugcu

SEQ ID NO: 1093863 - RNA, 22 nt, Human
uguguacaggccuugcuagacu

SEQ ID NO: 1093864 - RNA, 22 nt, Human
cauucauuagaauagauaugua

SEQ ID NO: 1093865 - RNA, 22 nt, Human
gacagaagaggaacuuggacag

SEQ ID NO: 1093866 - RNA, 23 nt, Human
gcaggaacucaggguaggcagca

SEQ ID NO: 1093867 - RNA, 22 nt, Human
ugcaggcuauccuuugcugcaa

SEQ ID NO: 1093868 - RNA, 22 nt, Human
cuuccccaaccccgacugugug

SEQ ID NO: 1093869 - RNA, 22 nt, Human
uuguaaacuuguuugaagguau

SEQ ID NO: 1093870 - RNA, 22 nt, Human
gcugaaggcccggaggacaggg

SEQ ID NO: 1093871 - RNA, 22 nt, Human
ucaaagcaauuucaccagugcc

SEQ ID NO: 1093872 - RNA, 22 nt, Human
ggagccagcagggugacacuga

SEQ ID NO: 1093873 - RNA, 22 nt, Human
uuggugggcacaggggagaagu

SEQ ID NO: 1093874 - RNA, 22 nt, Human
ucauaaaaauagacucuaaagu

SEQ ID NO: 1093875 - RNA, 21 nt, Human
cauucacagucuggcucuuga

SEQ ID NO: 1093876 - RNA, 22 nt, Human
cugccucugcgucccacagagu

SEQ ID NO: 1093877 - RNA, 22 nt, Human
uacacaucccagacucccagga

SEQ ID NO: 1093878 - RNA, 22 nt, Human
gcugggcuugguuucccugcuu

SEQ ID NO: 1093879 - RNA, 20 nt, Human
uucuuucaucuacacguugu

SEQ ID NO: 1093880 - RNA, 22 nt, Human
gcuuuucuucagcagccugaug

SEQ ID NO: 1093881 - RNA, 22 nt, Human
agugagcauucguuuggaaccc

SEQ ID NO: 1093882 - RNA, 22 nt, Human
aguaacaagugccaacguuaga

SEQ ID NO: 1093883 - RNA, 22 nt, Human
agggcaguucagccacaggcuc

SEQ ID NO: 1093884 - RNA, 22 nt, Human
cauugaaauauggaaacugaug

SEQ ID NO: 1093885 - RNA, 22 nt, Human
ccauuuguucgcccagcuccaa

SEQ ID NO: 1093886 - RNA, 22 nt, Human
cugguccuugcuacccagcaag

SEQ ID NO: 1093887 - RNA, 20 nt, Human
gucagugucuucaguaguga

SEQ ID NO: 1093888 - RNA, 22 nt, Human
cagaaucucugggaguggauca

SEQ ID NO: 1093889 - RNA, 22 nt, Human
aagcaaagaguuuaguggguga

SEQ ID NO: 1093890 - RNA, 22 nt, Human
ugaggaaguuguuucucuucua

SEQ ID NO: 1093891 - RNA, 22 nt, Human
ugaauacuauuucauaaugugg

SEQ ID NO: 1093892 - RNA, 22 nt, Human
uuucacauucuucugaaucuac

SEQ ID NO: 1093893 - RNA, 23 nt, Human
agaggggagcaucugcuggcuga

SEQ ID NO: 1093894 - RNA, 22 nt, Human
uacuuucuuguuccuuucauaa

SEQ ID NO: 1093895 - RNA, 22 nt, Human
gaggccugguuugcaugagaau

SEQ ID NO: 1093896 - RNA, 22 nt, Human
acugggcauuuugaacguucuu

SEQ ID NO: 1093897 - RNA, 22 nt, Human
cugggccagaccuuguggucuu

SEQ ID NO: 1093898 - RNA, 22 nt, Human
acagcaagccagcuugucacug

SEQ ID NO: 1093899 - RNA, 22 nt, Human
agccuggagcuugaguuaugag

SEQ ID NO: 1093900 - RNA, 22 nt, Human
ccagggcuggugggagaugcug

SEQ ID NO: 1093901 - RNA, 22 nt, Human
ucccuuaaccguaggacagucu

SEQ ID NO: 1093902 - RNA, 22 nt, Human
ggaccugccagaacucaggcua

SEQ ID NO: 1093903 - RNA, 22 nt, Human
gcucuggguagccacugccugg

SEQ ID NO: 1093904 - RNA, 22 nt, Human
augcugugaaaaagaaggcuga

SEQ ID NO: 1093905 - RNA, 22 nt, Human
cugucaaauggaaacuuauccu

SEQ ID NO: 1093906 - RNA, 22 nt, Human
auaauguacaacugcuuuuaau

SEQ ID NO: 1093907 - RNA, 22 nt, Human
uuguuaaggguuaugcagcuuu

SEQ ID NO: 1093908 - RNA, 22 nt, Human
gacagccucaugaggagcaaaa

SEQ ID NO: 1093909 - RNA, 22 nt, Human
uuaguuuccaccacacauguuc

SEQ ID NO: 1093910 - RNA, 22 nt, Human
uccaggcccauggagcagagcu

SEQ ID NO: 1093911 - RNA, 23 nt, Human
uuuaaaaguuguaauguaggcuu

SEQ ID NO: 1093912 - RNA, 22 nt, Human
gcagccagaagacucagaacaa

SEQ ID NO: 1093913 - RNA, 22 nt, Human
guggccuggcuggcaccaccuc

SEQ ID NO: 1093914 - RNA, 22 nt, Human
gccuccugagaagccacaggcu

SEQ ID NO: 1093915 - RNA, 22 nt, Human
gcagaggucuagcaccaagaau

SEQ ID NO: 1093916 - RNA, 22 nt, Human
aaaucuggccccuugccuauuu

SEQ ID NO: 1093917 - RNA, 22 nt, Human
gggcagguggcagggucucugg

SEQ ID NO: 1093918 - RNA, 22 nt, Human
uacaggaaggagcacaucggga

SEQ ID NO: 1093919 - RNA, 22 nt, Human
cagucucuaaaucaaucugaau

SEQ ID NO: 1093920 - RNA, 22 nt, Human
cuccuggaccaccuuguggcca

SEQ ID NO: 1093921 - RNA, 22 nt, Human
gugcaugaagacucagaaaguc

SEQ ID NO: 1093922 - RNA, 20 nt, Human
agcuugccccugucuuugcc

SEQ ID NO: 1093923 - RNA, 22 nt, Human
aucuggcugagcgaggcccaca

SEQ ID NO: 1093924 - RNA, 22 nt, Human
ucacacagugagcggggcucag

SEQ ID NO: 1093925 - RNA, 22 nt, Human
aagagcaggcugucaauggggc

SEQ ID NO: 1093926 - RNA, 22 nt, Human
ucuuccaaaugaauaugguuuu

SEQ ID NO: 1093927 - RNA, 22 nt, Human
cugagccaaaaagcagagcuug

SEQ ID NO: 1093928 - RNA, 22 nt, Human
acaauguucuacauauacauaa

SEQ ID NO: 1093929 - RNA, 22 nt, Human
uggcccugguggcacagccugc

SEQ ID NO: 1093930 - RNA, 22 nt, Human
ggaacccaugauuaugguuagg

SEQ ID NO: 1093931 - RNA, 22 nt, Human
ugggaagcuuuaaauggguguc

SEQ ID NO: 1093932 - RNA, 22 nt, Human
uugcauugugauuacagaggug

SEQ ID NO: 1093933 - RNA, 22 nt, Human
caccaggcugcccaggacaggg

SEQ ID NO: 1093934 - RNA, 22 nt, Human
aauuaggcaaauuaauuucucu

SEQ ID NO: 1093935 - RNA, 22 nt, Human
gcucccaggaagagaagggcca

SEQ ID NO: 1093936 - RNA, 20 nt, Human
aggucuuccaaucagcuccu

SEQ ID NO: 1093937 - RNA, 22 nt, Human
gucucuuagaaucgcauauugu

SEQ ID NO: 1093938 - RNA, 20 nt, Human
uccaguuuuggagacauucu

SEQ ID NO: 1093939 - RNA, 19 nt, Human
uggcuguggggaaaugcuu

SEQ ID NO: 1093940 - RNA, 22 nt, Human
augauauuuuaguaaagugaua

SEQ ID NO: 1093941 - RNA, 22 nt, Human
ccccauccuauucauguuucug

SEQ ID NO: 1093942 - RNA, 22 nt, Human
ccaggaacucagcucugcacuu

SEQ ID NO: 1093943 - RNA, 22 nt, Human
aaucaagaaaaugaggauucuu

SEQ ID NO: 1093944 - RNA, 22 nt, Human
uuuauagucgucucaguaauaa

SEQ ID NO: 1093945 - RNA, 22 nt, Human
uucuguuucuggggucucugac

SEQ ID NO: 1093946 - RNA, 22 nt, Human
ucuauacaugugcacacacauc

SEQ ID NO: 1093947 - RNA, 22 nt, Human
ugcuggcuuuuugugucaaaga

SEQ ID NO: 1093948 - RNA, 22 nt, Human
uuucacaugcagcagggaagug

SEQ ID NO: 1093949 - RNA, 17 nt, Human
aaacagugaguguuaug

SEQ ID NO: 1093950 - RNA, 22 nt, Human
ugaacgcagguccacauggcuc

SEQ ID NO: 1093951 - RNA, 22 nt, Human
auacaucuugucagauucaugu

SEQ ID NO: 1093952 - RNA, 22 nt, Human
cagcacagaguauuuuauugau

SEQ ID NO: 1093953 - RNA, 22 nt, Human
aacaucagaauauccauguugg

SEQ ID NO: 1093954 - RNA, 22 nt, Human
cugaaauuauuguuuaaucaaa

SEQ ID NO: 1093955 - RNA, 22 nt, Human
uugagaguuugggggcaauaug

SEQ ID NO: 1093956 - RNA, 22 nt, Human
aagcugccuagaguugaauguc

SEQ ID NO: 1093957 - RNA, 22 nt, Human
uaugacaagguggaguaugagu

SEQ ID NO: 1093958 - RNA, 22 nt, Human
uggcaagggauuguggagaacu

SEQ ID NO: 1093959 - RNA, 22 nt, Human
augaaacugggauaacuauagc

SEQ ID NO: 1093960 - RNA, 20 nt, Human
cgcccaggagggcccaugug

SEQ ID NO: 1093961 - RNA, 19 nt, Human
uuuaagcaauaguaucuug

SEQ ID NO: 1093962 - RNA, 22 nt, Human
aggcacagcacaccuggccccc

SEQ ID NO: 1093963 - RNA, 22 nt, Human
aggcuaauauggcacaugaaca

SEQ ID NO: 1093964 - RNA, 22 nt, Human
uggccaguugaagacaaugcuc

SEQ ID NO: 1093965 - RNA, 18 nt, Human
uggccuggagacaacucu

SEQ ID NO: 1093966 - RNA, 22 nt, Human
uucuggcuuugaccaaguucaa

SEQ ID NO: 1093967 - RNA, 22 nt, Human
accauugccuagaaaaauuccu

SEQ ID NO: 1093968 - RNA, 22 nt, Human
agugcuuucuugcuccaucagu

SEQ ID NO: 1093969 - RNA, 19 nt, Human
uuuugaaguaugagacagg

SEQ ID NO: 1093970 - RNA, 22 nt, Human
agcaaagucaguggaaccaucc

SEQ ID NO: 1093971 - RNA, 17 nt, Human
cagaaggaagcauggca

SEQ ID NO: 1093972 - RNA, 22 nt, Human
cacucccuucaggagccuagga

SEQ ID NO: 1093973 - RNA, 22 nt, Human
aggcuuccgaguagcugggacu

SEQ ID NO: 1093974 - RNA, 22 nt, Human
cgugucaucugagccuugggcg

SEQ ID NO: 1093975 - RNA, 22 nt, Human
ggcuuccuggagaaggucugag

SEQ ID NO: 1093976 - RNA, 22 nt, Human
ucagaggaaagggaacauaguc

SEQ ID NO: 1093977 - RNA, 22 nt, Human
cuggcuguauuaguuugauccu

SEQ ID NO: 1093978 - RNA, 22 nt, Human
uugcaaagagucauguaaguca

SEQ ID NO: 1093979 - RNA, 22 nt, Human
gugagcagagaucgcgugauug

SEQ ID NO: 1093980 - RNA, 22 nt, Human
gcaggugauucacccugggccu

SEQ ID NO: 1093981 - RNA, 22 nt, Human
agccaauacacugaagaucuaa

SEQ ID NO: 1093982 - RNA, 22 nt, Human
ugugcagcucuagagccaagcc

SEQ ID NO: 1093983 - RNA, 22 nt, Human
ccuuagacuggagcuaugccgu

SEQ ID NO: 1093984 - RNA, 22 nt, Human
auuauaggcuugagccaccgug

SEQ ID NO: 1093985 - RNA, 22 nt, Human
ccucaggguggcaucagaucuu

SEQ ID NO: 1093986 - RNA, 22 nt, Human
acacaggacagggauguguuuu

SEQ ID NO: 1093987 - RNA, 22 nt, Human
ccaggccuggaccaugccaggg

SEQ ID NO: 1093988 - RNA, 22 nt, Human
auugagaaaauaaguauggaua

SEQ ID NO: 1093989 - RNA, 22 nt, Human
ugaaaucaguaugucuuucuca

SEQ ID NO: 1093990 - RNA, 22 nt, Human
gugcaagaggacaguaagggug

SEQ ID NO: 1093991 - RNA, 22 nt, Human
gggcaguuuauucuagaugguu

SEQ ID NO: 1093992 - RNA, 22 nt, Human
guucauucaaucuauuugcuuc

SEQ ID NO: 1093993 - RNA, 22 nt, Human
cgggaaaguuccacagauggau

SEQ ID NO: 1093994 - RNA, 22 nt, Human
agaaaguuuauuccuaucuagc

SEQ ID NO: 1093995 - RNA, 22 nt, Human
cugggccuggcguuccaggcug

SEQ ID NO: 1093996 - RNA, 22 nt, Human
ccaggcagaugggccggcuuca

SEQ ID NO: 1093997 - RNA, 22 nt, Human
aucaaaguggaaguuuacuagg

SEQ ID NO: 1093998 - RNA, 22 nt, Human
gggcucuggaaggugcaccaug

SEQ ID NO: 1093999 - RNA, 22 nt, Human
gcagggcagugugucugugggg

SEQ ID NO: 1094000 - RNA, 22 nt, Human
uuucggccgcgugaaguuuucu

SEQ ID NO: 1094001 - RNA, 22 nt, Human
agugaccauuuucagcuagagg

SEQ ID NO: 1094002 - RNA, 22 nt, Human
acacacaugcaugcuugccauu

SEQ ID NO: 1094003 - RNA, 22 nt, Human
cuugggaggagaacaaagcucc

SEQ ID NO: 1094004 - RNA, 22 nt, Human
gcugggcucaccaggccacuag

SEQ ID NO: 1094005 - RNA, 22 nt, Human
cugcugagguccuugcucagac

SEQ ID NO: 1094006 - RNA, 22 nt, Human
ucaggcaggcucagaggaaaac

SEQ ID NO: 1094007 - RNA, 22 nt, Human
uggugcuguggaggggcagaag

SEQ ID NO: 1094008 - RNA, 22 nt, Human
cccugccuucuuggccuuuaaa

SEQ ID NO: 1094009 - RNA, 22 nt, Human
acagauggaauguguuauggga

SEQ ID NO: 1094010 - RNA, 22 nt, Human
ugcaaauuuaaugaaacuaugu

SEQ ID NO: 1094011 - RNA, 22 nt, Human
acagaagaccaagaaagcuucc

SEQ ID NO: 1094012 - RNA, 22 nt, Human
cacauuuauuugaggcuaauug

SEQ ID NO: 1094013 - RNA, 21 nt, Human
auuuccaaauaaggucacauu

SEQ ID NO: 1094014 - RNA, 22 nt, Human
cugggccuccagcucugccagc

SEQ ID NO: 1094015 - RNA, 22 nt, Human
aggccucucuccuuggcuugua

SEQ ID NO: 1094016 - RNA, 22 nt, Human
aggcugcguuagccucacuccc

SEQ ID NO: 1094017 - RNA, 22 nt, Human
cauugcucaggcccagcaggaa

SEQ ID NO: 1094018 - RNA, 22 nt, Human
caacaguuuauaguguuaucuu

SEQ ID NO: 1094019 - RNA, 22 nt, Human
cagcccagcagucuuagccugc

SEQ ID NO: 1094020 - RNA, 22 nt, Human
gcccucugcuggccucaccucg

SEQ ID NO: 1094021 - RNA, 22 nt, Human
cagcuguuguguaucaggcaga

SEQ ID NO: 1094022 - RNA, 19 nt, Human
cugaggugcaguaagaggc

SEQ ID NO: 1094023 - RNA, 20 nt, Human
uacauauuauaucagcugca

SEQ ID NO: 1094024 - RNA, 22 nt, Human
augguguugagucucucuucac

SEQ ID NO: 1094025 - RNA, 20 nt, Human
cccagggaccugagcuccau

SEQ ID NO: 1094026 - RNA, 22 nt, Human
ugggccugauucuugaauccug

SEQ ID NO: 1094027 - RNA, 22 nt, Human
guaacagagaacucagguguua

SEQ ID NO: 1094028 - RNA, 22 nt, Human
ugcagggcauaggguccaguuu

SEQ ID NO: 1094029 - RNA, 22 nt, Human
uggcccugggcaucuuucguga

SEQ ID NO: 1094030 - RNA, 22 nt, Human
ugaaaucaacuaggagacacca

SEQ ID NO: 1094031 - RNA, 22 nt, Human
agcagcugucccuuaacaucag

SEQ ID NO: 1094032 - RNA, 22 nt, Human
ucugaaaugcaaauuugacuga

SEQ ID NO: 1094033 - RNA, 22 nt, Human
augguuauuucauggaaaaauu

SEQ ID NO: 1094034 - RNA, 22 nt, Human
uggcagaauuuuaaagacagau

SEQ ID NO: 1094035 - RNA, 22 nt, Human
cugcuguguggugaaacucagu

SEQ ID NO: 1094036 - RNA, 22 nt, Human
caccaggaaguauucaaagggu

SEQ ID NO: 1094037 - RNA, 22 nt, Human
agaaaucaggaacaguaaggag

SEQ ID NO: 1094038 - RNA, 22 nt, Human
ugggcaggcaagugaauaccuu

SEQ ID NO: 1094039 - RNA, 22 nt, Human
uagcuagaaaguuucagcugug

SEQ ID NO: 1094040 - RNA, 22 nt, Human
aagcgccaugguuccugcgcag

SEQ ID NO: 1094041 - RNA, 22 nt, Human
ugaggcucaaggucugguggag

SEQ ID NO: 1094042 - RNA, 22 nt, Human
auuugaaaaccugagccucccg

SEQ ID NO: 1094043 - RNA, 22 nt, Human
ugagcagaaguuauaaauaaga

SEQ ID NO: 1094044 - RNA, 22 nt, Human
gucccuggggaaucagcuggag

SEQ ID NO: 1094045 - RNA, 22 nt, Human
ucccucuguguugggcaugccu

SEQ ID NO: 1094046 - RNA, 17 nt, Human
uuuucucucuuggauuc

SEQ ID NO: 1094047 - RNA, 22 nt, Human
ugcccaggauugugaggucagg

SEQ ID NO: 1094048 - RNA, 23 nt, Human
acugucugauauguuuuccauca

SEQ ID NO: 1094049 - RNA, 22 nt, Human
ugauuuccacagucaggggugc

SEQ ID NO: 1094050 - RNA, 22 nt, Human
ccuugcauauauuauaucuuug

SEQ ID NO: 1094051 - RNA, 22 nt, Human
ucugacuuggcgcucuugucuu

SEQ ID NO: 1094052 - RNA, 22 nt, Human
ucaagagauugaauaauaacug

SEQ ID NO: 1094053 - RNA, 22 nt, Human
agucucugccagcuuguccucu

SEQ ID NO: 1094054 - RNA, 22 nt, Human
gcuggggagggcgucaaggcca

SEQ ID NO: 1094055 - RNA, 22 nt, Human
guacacacuauuuaaaguguuu

SEQ ID NO: 1094056 - RNA, 22 nt, Human
ggcuguggacacugagcucaga

SEQ ID NO: 1094057 - RNA, 22 nt, Human
gugacagaguuuuagaucucau

SEQ ID NO: 1094058 - RNA, 22 nt, Human
ugagaaauggcagcauuacugg

SEQ ID NO: 1094059 - RNA, 19 nt, Human
gugcuuuuuaagagcucag

SEQ ID NO: 1094060 - RNA, 22 nt, Human
uaggaaccuugaucuuggauuu

SEQ ID NO: 1094061 - RNA, 22 nt, Human
uuccaagugaaaguagcuuugu

SEQ ID NO: 1094062 - RNA, 22 nt, Human
auucaaauuaaguuaauucagc

SEQ ID NO: 1094063 - RNA, 22 nt, Human
gauagcaacauagaacagaauu

SEQ ID NO: 1094064 - RNA, 22 nt, Human
cagaggaaggcucugggaaugu

SEQ ID NO: 1094065 - RNA, 21 nt, Human
ugauuuccagaaaauuggccc

SEQ ID NO: 1094066 - RNA, 18 nt, Human
cuccagggaacucaguca

SEQ ID NO: 1094067 - RNA, 22 nt, Human
ugcaagagauucaaaccauaaa

SEQ ID NO: 1094068 - RNA, 21 nt, Human
agccuggcccagggggaggcu

SEQ ID NO: 1094069 - RNA, 22 nt, Human
uuucacauuuaggcgugaauug

SEQ ID NO: 1094070 - RNA, 17 nt, Human
ucaugcccaacuauuac

SEQ ID NO: 1094071 - RNA, 22 nt, Human
uccaaauuuaccuuacagauau

SEQ ID NO: 1094072 - RNA, 22 nt, Human
gcugccugauuuacauagugaa

SEQ ID NO: 1094073 - RNA, 22 nt, Human
acauucuagaagucuuugcaau

SEQ ID NO: 1094074 - RNA, 22 nt, Human
gcugucucggggcuuucuccug

SEQ ID NO: 1094075 - RNA, 22 nt, Human
cugcugugcauauuuaucuagg

SEQ ID NO: 1094076 - RNA, 22 nt, Human
gaggcucagagaagucauggua

SEQ ID NO: 1094077 - RNA, 22 nt, Human
cuucacagaauaaacucauuau

SEQ ID NO: 1094078 - RNA, 20 nt, Human
ucccucccuccagcucuggg

SEQ ID NO: 1094079 - RNA, 22 nt, Human
acagauuugaucugagaacaaa

SEQ ID NO: 1094080 - RNA, 22 nt, Human
augcuuugauuugguuucucua

SEQ ID NO: 1094081 - RNA, 18 nt, Human
caugucugcgccacaagg

SEQ ID NO: 1094082 - RNA, 22 nt, Human
cucagggcuggaaagccaggaa

SEQ ID NO: 1094083 - RNA, 22 nt, Human
ugggcagaggcucugaagucca

SEQ ID NO: 1094084 - RNA, 22 nt, Human
aggcugccaaagcuucugucuc

SEQ ID NO: 1094085 - RNA, 22 nt, Human
gcaguguucuaaauugggugug

SEQ ID NO: 1094086 - RNA, 22 nt, Human
aauucugugcaggcagagcuau

SEQ ID NO: 1094087 - RNA, 22 nt, Human
ggcuagaacuuuacacuuugca

SEQ ID NO: 1094088 - RNA, 22 nt, Human
ccagcagagggucuuggccauu

SEQ ID NO: 1094089 - RNA, 22 nt, Human
cccaggaaccuaccagcucgag

SEQ ID NO: 1094090 - RNA, 22 nt, Human
acuuucuuaggcuguauaaaug

SEQ ID NO: 1094091 - RNA, 22 nt, Human
cuacagaaaccuuuuucauaca

SEQ ID NO: 1094092 - RNA, 20 nt, Human
cucucccagcacagcuuccu

SEQ ID NO: 1094093 - RNA, 21 nt, Human
caggaugaugauaauucaugg

SEQ ID NO: 1094094 - RNA, 19 nt, Human
auacacuaauauaaaccac

SEQ ID NO: 1094095 - RNA, 22 nt, Human
acauuuaaccaaacuguuuaau

SEQ ID NO: 1094096 - RNA, 22 nt, Human
gaggaaugucagcacaggccuc

SEQ ID NO: 1094097 - RNA, 22 nt, Human
aaaggccauuacuugcuuuuag

SEQ ID NO: 1094098 - RNA, 22 nt, Human
uauuuggagauaagauuuuuag

SEQ ID NO: 1094099 - RNA, 22 nt, Human
acacauuuaaaaaggaacauau

SEQ ID NO: 1094100 - RNA, 22 nt, Human
uugggccucacucuagaaggca

SEQ ID NO: 1094101 - RNA, 22 nt, Human
ucugaaaacuccaugagcucgu

SEQ ID NO: 1094102 - RNA, 22 nt, Human
ugguggggucaucgucagaugc

SEQ ID NO: 1094103 - RNA, 22 nt, Human
uaauggauuaacgucccugucg

SEQ ID NO: 1094104 - RNA, 22 nt, Human
ggaggccaugaggcucuaggug

SEQ ID NO: 1094105 - RNA, 22 nt, Human
aaagcaaucagauucagauguc

SEQ ID NO: 1094106 - RNA, 22 nt, Human
caagaaacuuuauucugccaua

SEQ ID NO: 1094107 - RNA, 22 nt, Human
aagacagagggaagcaaugaug

SEQ ID NO: 1094108 - RNA, 21 nt, Human
ccaggaaggacugagcucccu

SEQ ID NO: 1094109 - RNA, 22 nt, Human
gccugcaguucugugcuaggca

SEQ ID NO: 1094110 - RNA, 22 nt, Human
auauuacacacgguaucacggg

SEQ ID NO: 1094111 - RNA, 22 nt, Human
ugagcuucuuuauuuggccaga

SEQ ID NO: 1094112 - RNA, 22 nt, Human
ggcugagcggacuggggucccu

SEQ ID NO: 1094113 - RNA, 22 nt, Human
agagugggccucugagucccag

SEQ ID NO: 1094114 - RNA, 22 nt, Human
uuuguaaaagcccaagcuguag

SEQ ID NO: 1094115 - RNA, 22 nt, Human
ggcaggcagaggcugagacagg

SEQ ID NO: 1094116 - RNA, 22 nt, Human
aaaucaaggagggauuauauuu

SEQ ID NO: 1094117 - RNA, 23 nt, Human
ggagugcaauggcgccaucucgg

SEQ ID NO: 1094118 - RNA, 21 nt, Human
uggagcugccacuuguccucc

SEQ ID NO: 1094119 - RNA, 19 nt, Human
agcuggggcgguguguguu

SEQ ID NO: 1094120 - RNA, 22 nt, Human
ucccucagaaauucucucugaa

SEQ ID NO: 1094121 - RNA, 22 nt, Human
ggaggcucccacgcagcucaca

SEQ ID NO: 1094122 - RNA, 22 nt, Human
gcacauaaagggcaugggaggu

SEQ ID NO: 1094123 - RNA, 22 nt, Human
guccccugguggcuggagcugc

SEQ ID NO: 1094124 - RNA, 16 nt, Human
gggagugaaggagggu

SEQ ID NO: 1094125 - RNA, 23 nt, Human
acagcugcaccuggccgccuggc

SEQ ID NO: 1094126 - RNA, 22 nt, Human
gugauucauucgauuaguauuu

SEQ ID NO: 1094127 - RNA, 22 nt, Human
caggaacaggguguccuggcag

SEQ ID NO: 1094128 - RNA, 19 nt, Human
ggaagagaggaaaggugga

SEQ ID NO: 1094129 - RNA, 22 nt, Human
ugcucauuggcgaucugaggga

SEQ ID NO: 1094130 - RNA, 22 nt, Human
ugaacagaugccuucucccaug

SEQ ID NO: 1094131 - RNA, 22 nt, Human
acuucaugcuuuagagagauga

SEQ ID NO: 1094132 - RNA, 22 nt, Human
ucaggcagcuccaggaauggua

SEQ ID NO: 1094133 - RNA, 22 nt, Human
uuaaaacugcaaauccuacuga

SEQ ID NO: 1094134 - RNA, 22 nt, Human
gggcagccucggugccugcugc

SEQ ID NO: 1094135 - RNA, 19 nt, Human
gaauguuucugucucuucu

SEQ ID NO: 1094136 - RNA, 21 nt, Human
ccccucauacacucuccuugc

SEQ ID NO: 1094137 - RNA, 22 nt, Human
aaguguuuacuuaaagucaugg

SEQ ID NO: 1094138 - RNA, 22 nt, Human
uuguguguuuguagaaaaucca

SEQ ID NO: 1094139 - RNA, 22 nt, Human
cagcucugaagaaaggugucua

SEQ ID NO: 1094140 - RNA, 22 nt, Human
uucuaagaaauggaaaacgauu

SEQ ID NO: 1094141 - RNA, 22 nt, Human
cugggccuggacgggcagaucu

SEQ ID NO: 1094142 - RNA, 22 nt, Human
ucaauaaaauuguuuuccuauc

SEQ ID NO: 1094143 - RNA, 22 nt, Human
gcuuccuagaucugugguacuc

SEQ ID NO: 1094144 - RNA, 23 nt, Human
gaguguucauagcaggcucuugc

SEQ ID NO: 1094145 - RNA, 20 nt, Human
gcugccuuguccugcuuggu

SEQ ID NO: 1094146 - RNA, 22 nt, Human
auuagcuuaggcaugaagagaa

SEQ ID NO: 1094147 - RNA, 23 nt, Human
uuuaacauuugaacauguggcca

SEQ ID NO: 1094148 - RNA, 22 nt, Human
cugagcccuugcuuaugcuucc

SEQ ID NO: 1094149 - RNA, 20 nt, Human
gcuguugccaguacagaugg

SEQ ID NO: 1094150 - RNA, 22 nt, Human
gcugggcagccccuacagagag

SEQ ID NO: 1094151 - RNA, 22 nt, Human
cagguaacuuuagugaaagagc

SEQ ID NO: 1094152 - RNA, 22 nt, Human
aauaucaacaguguccuucuaa

SEQ ID NO: 1094153 - RNA, 23 nt, Human
ugcaauaugucagugcaaagugg

SEQ ID NO: 1094154 - RNA, 22 nt, Human
accaucagagcacaguccgugc

SEQ ID NO: 1094155 - RNA, 22 nt, Human
acuuccagcaccucaagcggaa

SEQ ID NO: 1094156 - RNA, 22 nt, Human
ggagaggugaauggcugcucua

SEQ ID NO: 1094157 - RNA, 22 nt, Human
gagacagcagggccagggccug

SEQ ID NO: 1094158 - RNA, 22 nt, Human
aaagucacaauauuggaaggug

SEQ ID NO: 1094159 - RNA, 22 nt, Human
gccaggaaugcauaaaugaccu

SEQ ID NO: 1094160 - RNA, 22 nt, Human
gagagugucgggggccccagga

SEQ ID NO: 1094161 - RNA, 22 nt, Human
agcugucucugguauuauguga

SEQ ID NO: 1094162 - RNA, 22 nt, Human
cucaggauccaucuccugcccu

SEQ ID NO: 1094163 - RNA, 22 nt, Human
ggcagaggugacagugucuuuu

SEQ ID NO: 1094164 - RNA, 22 nt, Human
ucugauuuauauaugcagauac

SEQ ID NO: 1094165 - RNA, 22 nt, Human
ucuuggaaucuccauagaguga

SEQ ID NO: 1094166 - RNA, 22 nt, Human
guggaggaaaagaaguugggug

SEQ ID NO: 1094167 - RNA, 22 nt, Human
acagaacauauugcuucucuca

SEQ ID NO: 1094168 - RNA, 22 nt, Human
cuucacaaaauauuucauuaua

SEQ ID NO: 1094169 - RNA, 22 nt, Human
ccccucauaggucagacacgca

SEQ ID NO: 1094170 - RNA, 22 nt, Human
ugacagaaagaguauuaaagau

SEQ ID NO: 1094171 - RNA, 22 nt, Human
uuuguaaugauaauguuaaauu

SEQ ID NO: 1094172 - RNA, 22 nt, Human
uugcugugucauuuguuuaauc

SEQ ID NO: 1094173 - RNA, 22 nt, Human
aguggugcccaccugagccuga

SEQ ID NO: 1094174 - RNA, 22 nt, Human
ucaagcaggguagcaagcuggu

SEQ ID NO: 1094175 - RNA, 22 nt, Human
gugcuuccaucuagagggucac

SEQ ID NO: 1094176 - RNA, 22 nt, Human
aggaagggcuguuucuccaaga

SEQ ID NO: 1094177 - RNA, 22 nt, Human
uggcauuugggcuggcuuuucu

SEQ ID NO: 1094178 - RNA, 19 nt, Human
uuuaaagugacugguauuu

SEQ ID NO: 1094179 - RNA, 22 nt, Human
agcacagccucugguuucugac

SEQ ID NO: 1094180 - RNA, 22 nt, Human
aacaugaaguuuucuauaguga

SEQ ID NO: 1094181 - RNA, 23 nt, Human
uggcagagacccagaaucuacau

SEQ ID NO: 1094182 - RNA, 22 nt, Human
uccucaguuauaaauaggaaac

SEQ ID NO: 1094183 - RNA, 22 nt, Human
gauucugagcugguguuuuacg

SEQ ID NO: 1094184 - RNA, 22 nt, Human
agcagcucuuaacaaagcaugg

SEQ ID NO: 1094185 - RNA, 22 nt, Human
ccagagcagauguggccuuggu

SEQ ID NO: 1094186 - RNA, 18 nt, Human
agcagguggauuuauugg

SEQ ID NO: 1094187 - RNA, 22 nt, Human
ggcaugggguguauguggcacg

SEQ ID NO: 1094188 - RNA, 22 nt, Human
ugauuuccuggcuuuggaguuc

SEQ ID NO: 1094189 - RNA, 18 nt, Human
aggcacagagcauacaua

SEQ ID NO: 1094190 - RNA, 22 nt, Human
caucugcuguaauuaacaagcc

SEQ ID NO: 1094191 - RNA, 20 nt, Human
uaaauuagccuugaagauua

SEQ ID NO: 1094192 - RNA, 22 nt, Human
ucucuuaaaggucuucagcuga

SEQ ID NO: 1094193 - RNA, 22 nt, Human
gggagcugaacugcugaaguug

SEQ ID NO: 1094194 - RNA, 22 nt, Human
uguaugaauauguauuuucaua

SEQ ID NO: 1094195 - RNA, 21 nt, Human
cugcucuggggaccggcugug

SEQ ID NO: 1094196 - RNA, 22 nt, Human
ugggccacaagccaugggacca

SEQ ID NO: 1094197 - RNA, 22 nt, Human
ccagccugguucagaauuggcu

SEQ ID NO: 1094198 - RNA, 22 nt, Human
gagcugggaagauagcuugagc

SEQ ID NO: 1094199 - RNA, 22 nt, Human
gagaaaaugucagacuuggucg

SEQ ID NO: 1094200 - RNA, 21 nt, Human
ggacaccagucacacuggauu

SEQ ID NO: 1094201 - RNA, 18 nt, Human
cagaugagaugcaaucuc

SEQ ID NO: 1094202 - RNA, 22 nt, Human
ugccaggagagugcaugcaggg

SEQ ID NO: 1094203 - RNA, 22 nt, Human
caaacauuuuaaauaagggaua

SEQ ID NO: 1094204 - RNA, 22 nt, Human
uggcugugggauaugugacuga

SEQ ID NO: 1094205 - RNA, 22 nt, Human
ugcuauuuuagacauacuuugu

SEQ ID NO: 1094206 - RNA, 22 nt, Human
ucugaacacugagugucaucac

SEQ ID NO: 1094207 - RNA, 22 nt, Human
ugaaaguuaggauguaguaauu

SEQ ID NO: 1094208 - RNA, 22 nt, Human
ugcaggugcuacaagaacucac

SEQ ID NO: 1094209 - RNA, 22 nt, Human
gagcuuccacucuagaaggagu

SEQ ID NO: 1094210 - RNA, 22 nt, Human
cagguggagcugacugagggca

SEQ ID NO: 1094211 - RNA, 22 nt, Human
agaugcagaaaaacuaagugau

SEQ ID NO: 1094212 - RNA, 22 nt, Human
caguucuggaggcuccacaucu

SEQ ID NO: 1094213 - RNA, 19 nt, Human
ugggaaaguaacauacaaa

SEQ ID NO: 1094214 - RNA, 22 nt, Human
uugaaauagaugcgucagagau

SEQ ID NO: 1094215 - RNA, 22 nt, Human
auacagaagaacuauagccacu

SEQ ID NO: 1094216 - RNA, 22 nt, Human
uccaaguccauuaugguggucu

SEQ ID NO: 1094217 - RNA, 22 nt, Human
gcuugggauaugcugauguaaa

SEQ ID NO: 1094218 - RNA, 22 nt, Human
cugugacuguguuggaugcaca

SEQ ID NO: 1094219 - RNA, 22 nt, Human
uaaagauugcucaaaacuguga

SEQ ID NO: 1094220 - RNA, 22 nt, Human
gacaaagugcuaaaccacagag

SEQ ID NO: 1094221 - RNA, 22 nt, Human
ugucugucugcaagccagaaag

SEQ ID NO: 1094222 - RNA, 22 nt, Human
ggcagagaugugggucagaauc

SEQ ID NO: 1094223 - RNA, 20 nt, Human
cuccagggaacagacuggag

SEQ ID NO: 1094224 - RNA, 22 nt, Human
ccagaagucaggaaugagucuu

SEQ ID NO: 1094225 - RNA, 22 nt, Human
gacucuuucaaacagaaagcca

SEQ ID NO: 1094226 - RNA, 19 nt, Human
aauaagcuuggguaaaacu

SEQ ID NO: 1094227 - RNA, 19 nt, Human
gcuuccagcacugcaggag

SEQ ID NO: 1094228 - RNA, 22 nt, Human
uuuggcaagcgaguacuuucug

SEQ ID NO: 1094229 - RNA, 22 nt, Human
ucacuguugaccuggaaguggg

SEQ ID NO: 1094230 - RNA, 22 nt, Human
uggcacugccuggcagggcccc

SEQ ID NO: 1094231 - RNA, 22 nt, Human
guaaaucagugucauuuuagaa

SEQ ID NO: 1094232 - RNA, 22 nt, Human
gcugggcccagaucccaggauc

SEQ ID NO: 1094233 - RNA, 22 nt, Human
uagaaucuaguucauucauuug

SEQ ID NO: 1094234 - RNA, 22 nt, Human
ggcggggguccaggagccugca

SEQ ID NO: 1094235 - RNA, 21 nt, Human
uauugcauaacaaauuacccu

SEQ ID NO: 1094236 - RNA, 22 nt, Human
gcaggaguggagaccaugggga

SEQ ID NO: 1094237 - RNA, 22 nt, Human
ggacagaggguugacagaguau

SEQ ID NO: 1094238 - RNA, 22 nt, Human
uucaacaugcaaacuuugggag

SEQ ID NO: 1094239 - RNA, 22 nt, Human
gggcacagaagucuaagacauc

SEQ ID NO: 1094240 - RNA, 22 nt, Human
agcugcugaaugacacugcaag

SEQ ID NO: 1094241 - RNA, 22 nt, Human
aucaaagagcuugacaauccua

SEQ ID NO: 1094242 - RNA, 22 nt, Human
ugcuucugacuaagcugcauga

SEQ ID NO: 1094243 - RNA, 22 nt, Human
uugcacuccagcccgagcaaca

SEQ ID NO: 1094244 - RNA, 22 nt, Human
cacaauguauauguauaucaaa

SEQ ID NO: 1094245 - RNA, 22 nt, Human
aaaaugaacagaacaaugggga

SEQ ID NO: 1094246 - RNA, 22 nt, Human
uuagugucuucuucauccucug

SEQ ID NO: 1094247 - RNA, 22 nt, Human
aggcugagccugggcguggugg

SEQ ID NO: 1094248 - RNA, 22 nt, Human
ucucuuaggagaaauucauaaa

SEQ ID NO: 1094249 - RNA, 22 nt, Human
gucaacauaggccucagugagg

SEQ ID NO: 1094250 - RNA, 22 nt, Human
uuuguuuacucauucauugaug

SEQ ID NO: 1094251 - RNA, 20 nt, Human
cagucccaauccagggccag

SEQ ID NO: 1094252 - RNA, 22 nt, Human
cuggaaagagauggcaggguuu

SEQ ID NO: 1094253 - RNA, 22 nt, Human
uagaggcauuaaugaauaaaca

SEQ ID NO: 1094254 - RNA, 22 nt, Human
uggcauguauuaguuggcaguu

SEQ ID NO: 1094255 - RNA, 22 nt, Human
gaaggccauugcguccugggau

SEQ ID NO: 1094256 - RNA, 22 nt, Human
gaggcaggguguugauuacaga

SEQ ID NO: 1094257 - RNA, 22 nt, Human
ucaaauauuggcuauuucacau

SEQ ID NO: 1094258 - RNA, 22 nt, Human
gcugcuggaugcgcuugauggu

SEQ ID NO: 1094259 - RNA, 22 nt, Human
gccuguuggugacuuucuguug

SEQ ID NO: 1094260 - RNA, 22 nt, Human
agccagugggauuagagccucu

SEQ ID NO: 1094261 - RNA, 22 nt, Human
uguaaagguaggugcaaaauga

SEQ ID NO: 1094262 - RNA, 22 nt, Human
gcugagguggagauugcaguga

SEQ ID NO: 1094263 - RNA, 22 nt, Human
cucagcuacgcuuucaccagcu

SEQ ID NO: 1094264 - RNA, 22 nt, Human
augaaggcaguuaaacgucauc

SEQ ID NO: 1094265 - RNA, 21 nt, Human
cagaggggcuagccuggcugc

SEQ ID NO: 1094266 - RNA, 22 nt, Human
cugaaggauuuaguucuuugcu

SEQ ID NO: 1094267 - RNA, 22 nt, Human
gcuggugccuuguuguuguuac

SEQ ID NO: 1094268 - RNA, 19 nt, Human
caguuuaacuaauuuuauc

SEQ ID NO: 1094269 - RNA, 22 nt, Human
cuguguccuccccaucacuucu

SEQ ID NO: 1094270 - RNA, 22 nt, Human
caguuuuauacacugcagcucc

SEQ ID NO: 1094271 - RNA, 22 nt, Human
cugcucuguuaauuaaacuuug

SEQ ID NO: 1094272 - RNA, 20 nt, Human
gcucugggagggaugugaug

SEQ ID NO: 1094273 - RNA, 22 nt, Human
aacuuuauuguuaggggcuaaa

SEQ ID NO: 1094274 - RNA, 22 nt, Human
uuuuauuggagugauaccaagc

SEQ ID NO: 1094275 - RNA, 22 nt, Human
cugggcugcaggaguggggcaa

SEQ ID NO: 1094276 - RNA, 19 nt, Human
gaagaagcuugagaaguag

SEQ ID NO: 1094277 - RNA, 22 nt, Human
auucuagaguuucaauccaagg

SEQ ID NO: 1094278 - RNA, 22 nt, Human
uugaagcaaggcgaaucuugug

SEQ ID NO: 1094279 - RNA, 22 nt, Human
ccuguggacauucuguguggaa

SEQ ID NO: 1094280 - RNA, 22 nt, Human
uaacaguagccuuauguggucu

SEQ ID NO: 1094281 - RNA, 22 nt, Human
aggaggugcuguuuguccugga

SEQ ID NO: 1094282 - RNA, 22 nt, Human
gggcugagcuguucugaguuua

SEQ ID NO: 1094283 - RNA, 22 nt, Human
ccuuucucuuugcugaucaugu

SEQ ID NO: 1094284 - RNA, 22 nt, Human
gccugagacagugugguccaau

SEQ ID NO: 1094285 - RNA, 22 nt, Human
ggcaggugaucuagagucaaua

SEQ ID NO: 1094286 - RNA, 22 nt, Human
uucaguuucguuaucuaugaga

SEQ ID NO: 1094287 - RNA, 17 nt, Human
uuccccugaccaagccu

SEQ ID NO: 1094288 - RNA, 18 nt, Human
gagaagugcauacauuau

SEQ ID NO: 1094289 - RNA, 22 nt, Human
ccuucauugcaucuuuaagaga

SEQ ID NO: 1094290 - RNA, 22 nt, Human
guuguuuuuguucucuauagcu

SEQ ID NO: 1094291 - RNA, 22 nt, Human
cacagcuagauggauagauaga

SEQ ID NO: 1094292 - RNA, 22 nt, Human
ugagucagucugcccuggcuuc

SEQ ID NO: 1094293 - RNA, 22 nt, Human
gcuugcucaacccccgucucuc

SEQ ID NO: 1094294 - RNA, 22 nt, Human
gaggccugguagccgagcccca

SEQ ID NO: 1094295 - RNA, 22 nt, Human
cagcugcccaagccccagaugu

SEQ ID NO: 1094296 - RNA, 22 nt, Human
uacaguuuguuacauuguuagu

SEQ ID NO: 1094297 - RNA, 22 nt, Human
agagaauacaggguaacaggaa

SEQ ID NO: 1094298 - RNA, 22 nt, Human
aaacuugagcagucagaugaag

SEQ ID NO: 1094299 - RNA, 23 nt, Human
cuucaugagagcccugaggaaaa

SEQ ID NO: 1094300 - RNA, 22 nt, Human
cagugcagucaaggaagaacca

SEQ ID NO: 1094301 - RNA, 22 nt, Human
aaggucauuguugcauguucuc

SEQ ID NO: 1094302 - RNA, 20 nt, Human
aggccacugaaugccaauca

SEQ ID NO: 1094303 - RNA, 22 nt, Human
aggauccugcgcuuugggggag

SEQ ID NO: 1094304 - RNA, 22 nt, Human
ugaacuuucacaagaauaugcu

SEQ ID NO: 1094305 - RNA, 22 nt, Human
guucaagguuuuacagagugua

SEQ ID NO: 1094306 - RNA, 22 nt, Human
uuuaugaaccacucuacaccuu

SEQ ID NO: 1094307 - RNA, 22 nt, Human
ggcagaguugguggagucaguu

SEQ ID NO: 1094308 - RNA, 22 nt, Human
aacuuccaacccagaagccuaa

SEQ ID NO: 1094309 - RNA, 22 nt, Human
gaaauuuacaacuuucucaugg

SEQ ID NO: 1094310 - RNA, 18 nt, Human
uaagucauuugaaaugcc

SEQ ID NO: 1094311 - RNA, 22 nt, Human
cagaggcccagugagagggcug

SEQ ID NO: 1094312 - RNA, 22 nt, Human
uaaaggcuucugcagggacuga

SEQ ID NO: 1094313 - RNA, 22 nt, Human
agcugcccuucucuugcccuug

SEQ ID NO: 1094314 - RNA, 22 nt, Human
caguuaaaggcccaauaucugg

SEQ ID NO: 1094315 - RNA, 22 nt, Human
auucuucacauggauaggaucu

SEQ ID NO: 1094316 - RNA, 22 nt, Human
ccugucauacuaacguaguggg

SEQ ID NO: 1094317 - RNA, 22 nt, Human
gcaaggcuuugugaauuuuaaa

SEQ ID NO: 1094318 - RNA, 22 nt, Human
uuugcaaagugacuauuauaug

SEQ ID NO: 1094319 - RNA, 22 nt, Human
ugugaaggagcaugcagagggg

SEQ ID NO: 1094320 - RNA, 22 nt, Human
ucagcagauggguuguguuggc

SEQ ID NO: 1094321 - RNA, 22 nt, Human
ucaaaucucauugccuaaaacu

SEQ ID NO: 1094322 - RNA, 22 nt, Human
ugugcaguuucuauguugucca

SEQ ID NO: 1094323 - RNA, 22 nt, Human
aucaacauacugcucaggcauu

SEQ ID NO: 1094324 - RNA, 22 nt, Human
agcagagucuucaagggcaggc

SEQ ID NO: 1094325 - RNA, 22 nt, Human
gagcccuggcagucugggaugg

SEQ ID NO: 1094326 - RNA, 22 nt, Human
uuguggaaauacagacuccaag

SEQ ID NO: 1094327 - RNA, 20 nt, Human
gcagggcaagggauaugaaa

SEQ ID NO: 1094328 - RNA, 22 nt, Human
agggcuggcaucucuaaugcug

SEQ ID NO: 1094329 - RNA, 18 nt, Human
gagcagaggaggguuuuu

SEQ ID NO: 1094330 - RNA, 22 nt, Human
agauggguaauugauggcagua

SEQ ID NO: 1094331 - RNA, 22 nt, Human
uuucauaauauccagagauuuu

SEQ ID NO: 1094332 - RNA, 22 nt, Human
aagaauaagaggauuuagaaca

SEQ ID NO: 1094333 - RNA, 22 nt, Human
uauucuuacucucgacugcauu

SEQ ID NO: 1094334 - RNA, 22 nt, Human
ccagcaugagacgaugaugaag

SEQ ID NO: 1094335 - RNA, 22 nt, Human
auccucagaccucagcaaagcc

SEQ ID NO: 1094336 - RNA, 22 nt, Human
agagcuggguggacuuguaguu

SEQ ID NO: 1094337 - RNA, 22 nt, Human
aauaugacauagaauugagaug

SEQ ID NO: 1094338 - RNA, 22 nt, Human
ugcuguguggaugugaagaauc

SEQ ID NO: 1094339 - RNA, 22 nt, Human
uacuuugaagacaauaucugga

SEQ ID NO: 1094340 - RNA, 22 nt, Human
uuguauuaauugaaaugaaugc

SEQ ID NO: 1094341 - RNA, 22 nt, Human
agaagccauugaagcagaccuc

SEQ ID NO: 1094342 - RNA, 21 nt, Human
uauacaugugugcauacgugu

SEQ ID NO: 1094343 - RNA, 22 nt, Human
uuuacacuuauuaugaagcuuu

SEQ ID NO: 1094344 - RNA, 22 nt, Human
ccagcccuugaggucuguccau

SEQ ID NO: 1094345 - RNA, 22 nt, Human
aaaagcagguacucagcuuggg

SEQ ID NO: 1094346 - RNA, 22 nt, Human
ugggugggagcacccugucugg

SEQ ID NO: 1094347 - RNA, 22 nt, Human
uuucaguguaucuuccaaaagc

SEQ ID NO: 1094348 - RNA, 22 nt, Human
aaauuauuaugccccucuauaa

SEQ ID NO: 1094349 - RNA, 22 nt, Human
uggugcccacucuggacccagc

SEQ ID NO: 1094350 - RNA, 22 nt, Human
ugccaggcccagcuccagagcu

SEQ ID NO: 1094351 - RNA, 22 nt, Human
cugaagccacgauagcuuccua

SEQ ID NO: 1094352 - RNA, 22 nt, Human
gcugucacauuuggagcacugg

SEQ ID NO: 1094353 - RNA, 22 nt, Human
aaaagcaauugcaguucuugcc

SEQ ID NO: 1094354 - RNA, 22 nt, Human
gcacugaaaauguuggauucca

SEQ ID NO: 1094355 - RNA, 22 nt, Human
auaauucuccaauuuuuguugu

SEQ ID NO: 1094356 - RNA, 22 nt, Human
ggagggagucagcugauuagaa

SEQ ID NO: 1094357 - RNA, 22 nt, Human
uuuaaggaugaugugauauaua

SEQ ID NO: 1094358 - RNA, 22 nt, Human
ggggcucucaggucuccccaaa

SEQ ID NO: 1094359 - RNA, 22 nt, Human
auaaacuauguaauuugcucua

SEQ ID NO: 1094360 - RNA, 20 nt, Human
gcacagcugaguucaggguc

SEQ ID NO: 1094361 - RNA, 22 nt, Human
uguccuuuuggcugucuauggu

SEQ ID NO: 1094362 - RNA, 22 nt, Human
guucauuuaggaaaggaagagu

SEQ ID NO: 1094363 - RNA, 22 nt, Human
augaagcugguuuuggcuuggg

SEQ ID NO: 1094364 - RNA, 22 nt, Human
ucaguguuggucaagaaucagu

SEQ ID NO: 1094365 - RNA, 22 nt, Human
ccagggccugccacuuagcaag

SEQ ID NO: 1094366 - RNA, 22 nt, Human
guuugcuaauuuaaagcuauuu

SEQ ID NO: 1094367 - RNA, 22 nt, Human
caugugggaagaggccagcugg

SEQ ID NO: 1094368 - RNA, 22 nt, Human
caggggcuguuugccucaggcc

SEQ ID NO: 1094369 - RNA, 22 nt, Human
aacugcuguggccuaguacuua

SEQ ID NO: 1094370 - RNA, 22 nt, Human
gcuggcagaauuucuucuugcu

SEQ ID NO: 1094371 - RNA, 22 nt, Human
ucaggcuggagugcaguggcgc

SEQ ID NO: 1094372 - RNA, 22 nt, Human
uggaacacaucuaaggaagcag

SEQ ID NO: 1094373 - RNA, 22 nt, Human
agcuugucuuucaaaggaguuu

SEQ ID NO: 1094374 - RNA, 22 nt, Human
agauacaucuugaacuucuaga

SEQ ID NO: 1094375 - RNA, 19 nt, Human
uuacuuggcaaagucaguc

SEQ ID NO: 1094376 - RNA, 22 nt, Human
aguggcagacacaaugugggca

SEQ ID NO: 1094377 - RNA, 22 nt, Human
caguuuuugccauuaagaguaa

SEQ ID NO: 1094378 - RNA, 18 nt, Human
cugaaggauccaggugua

SEQ ID NO: 1094379 - RNA, 18 nt, Human
ugacucacccugucagug

SEQ ID NO: 1094380 - RNA, 22 nt, Human
gaaaucaaacccuuuucugaua

SEQ ID NO: 1094381 - RNA, 22 nt, Human
aggcagugagaaauagcaagau

SEQ ID NO: 1094382 - RNA, 22 nt, Human
gggcugagaauucagcuuuccu

SEQ ID NO: 1094383 - RNA, 22 nt, Human
ccucuggggugagugggccacu

SEQ ID NO: 1094384 - RNA, 22 nt, Human
acuaaggaauaugacaaacuca

SEQ ID NO: 1094385 - RNA, 22 nt, Human
ugucaauaacuggagucauuau

SEQ ID NO: 1094386 - RNA, 22 nt, Human
ugacuccaaacagaaaacgaau

SEQ ID NO: 1094387 - RNA, 22 nt, Human
uccaugggaagauuuugagugg

SEQ ID NO: 1094388 - RNA, 22 nt, Human
ccagagaccagaacauggggau

SEQ ID NO: 1094389 - RNA, 22 nt, Human
gugaagguagacugggcuuccu

SEQ ID NO: 1094390 - RNA, 22 nt, Human
ugcuucugcucagcuuccuacu

SEQ ID NO: 1094391 - RNA, 22 nt, Human
ccacagggacuguuaaaacccu

SEQ ID NO: 1094392 - RNA, 22 nt, Human
cacugcuuaguugguaaaugug

SEQ ID NO: 1094393 - RNA, 22 nt, Human
cuucaguguugccagggccuag

SEQ ID NO: 1094394 - RNA, 22 nt, Human
uuguuuuuaugaacauccagga

SEQ ID NO: 1094395 - RNA, 22 nt, Human
auggcuaauacgccacuggaca

SEQ ID NO: 1094396 - RNA, 22 nt, Human
ugaugaauaaacuugagaguca

SEQ ID NO: 1094397 - RNA, 22 nt, Human
uuuauauaacagagacugcuau

SEQ ID NO: 1094398 - RNA, 22 nt, Human
ucaaaauuucagcacuagcccu

SEQ ID NO: 1094399 - RNA, 21 nt, Human
gcugcugccccuagugaggcc

SEQ ID NO: 1094400 - RNA, 22 nt, Human
cacagaacauccuuagcucaug

SEQ ID NO: 1094401 - RNA, 22 nt, Human
ccaggcaccaaaguaugcuuua

SEQ ID NO: 1094402 - RNA, 21 nt, Human
uccaggaaaguuuuaagagug

SEQ ID NO: 1094403 - RNA, 22 nt, Human
ccagucuggcaggagggggaac

SEQ ID NO: 1094404 - RNA, 23 nt, Human
cuggccuccgacacuggccaaga

SEQ ID NO: 1094405 - RNA, 22 nt, Human
agacaucagcuugugugcaggg

SEQ ID NO: 1094406 - RNA, 17 nt, Human
cugcuuugugcaacgcu

SEQ ID NO: 1094407 - RNA, 22 nt, Human
cucucaggcuugggucguggca

SEQ ID NO: 1094408 - RNA, 22 nt, Human
gcucugccucuuugcugcguca

SEQ ID NO: 1094409 - RNA, 22 nt, Human
cagagggagcccuccaggagca

SEQ ID NO: 1094410 - RNA, 22 nt, Human
uugggguguuggauggagcaag

SEQ ID NO: 1094411 - RNA, 22 nt, Human
augacacaauuuuagagcugaa

SEQ ID NO: 1094412 - RNA, 19 nt, Human
ccaguagagacagcugcag

SEQ ID NO: 1094413 - RNA, 22 nt, Human
uucugggggaauacagcuauga

SEQ ID NO: 1094414 - RNA, 23 nt, Human
ccuggcuggauucucugcauuca

SEQ ID NO: 1094415 - RNA, 22 nt, Human
auaaacaguagagaaagguggu

SEQ ID NO: 1094416 - RNA, 22 nt, Human
ucaggcugcuggccagcaggcu

SEQ ID NO: 1094417 - RNA, 22 nt, Human
gucauuuuaugggaacagauuu

SEQ ID NO: 1094418 - RNA, 18 nt, Human
cugaggcuggcaggagcc

SEQ ID NO: 1094419 - RNA, 22 nt, Human
uugccuauguaacuuuauauuu

SEQ ID NO: 1094420 - RNA, 22 nt, Human
accaaagggcagaacaugagca

SEQ ID NO: 1094421 - RNA, 22 nt, Human
ugggauaguggccaggaccccc

SEQ ID NO: 1094422 - RNA, 22 nt, Human
gaggaacccagcugggguugcc

SEQ ID NO: 1094423 - RNA, 21 nt, Human
augaagucuaugcuucugugu

SEQ ID NO: 1094424 - RNA, 22 nt, Human
aacuucagggggcacauucaag

SEQ ID NO: 1094425 - RNA, 22 nt, Human
uggcucucagcucccagcagcc

SEQ ID NO: 1094426 - RNA, 22 nt, Human
ggaaaucagggguguugcuuuc

SEQ ID NO: 1094427 - RNA, 22 nt, Human
guacauuucucuuguucuuauu

SEQ ID NO: 1094428 - RNA, 22 nt, Human
uacaggaagcacucaagaaaug

SEQ ID NO: 1094429 - RNA, 22 nt, Human
ucacacagugagaaagugcgga

SEQ ID NO: 1094430 - RNA, 22 nt, Human
ugaaacaaugugaaguugcuga

SEQ ID NO: 1094431 - RNA, 22 nt, Human
agcuguucccucacugcaguca

SEQ ID NO: 1094432 - RNA, 22 nt, Human
cuggaggcacccuuagagaggc

SEQ ID NO: 1094433 - RNA, 22 nt, Human
cuauuucuaaaccuauaaguga

SEQ ID NO: 1094434 - RNA, 22 nt, Human
ucuucagagugaaagucuguga

SEQ ID NO: 1094435 - RNA, 22 nt, Human
uuuaagauucaguaaggcaaac

SEQ ID NO: 1094436 - RNA, 22 nt, Human
agagcugugcuuugcaccacgu

SEQ ID NO: 1094437 - RNA, 22 nt, Human
gaagagcugacagugucauccu

SEQ ID NO: 1094438 - RNA, 22 nt, Human
cuaguuuuaagcuccuugaggu

SEQ ID NO: 1094439 - RNA, 21 nt, Human
aaauccaaacacuaguccaca

SEQ ID NO: 1094440 - RNA, 22 nt, Human
uuucaaagaguuguaaauuacu

SEQ ID NO: 1094441 - RNA, 22 nt, Human
acccugccugacaacagaggau

SEQ ID NO: 1094442 - RNA, 22 nt, Human
ucaggcugaaggaggccuaucu

SEQ ID NO: 1094443 - RNA, 22 nt, Human
cugaggcauguuacaggacaua

SEQ ID NO: 1094444 - RNA, 22 nt, Human
acuuuucaaaugggaaacucag

SEQ ID NO: 1094445 - RNA, 21 nt, Human
gggagcuggaaacugggugac

SEQ ID NO: 1094446 - RNA, 22 nt, Human
ggcuguccaccuaccaugccgg

SEQ ID NO: 1094447 - RNA, 22 nt, Human
uaauuuauuucaacugccaagg

SEQ ID NO: 1094448 - RNA, 22 nt, Human
ugcucuguaacaaauugacaug

SEQ ID NO: 1094449 - RNA, 22 nt, Human
ggcagagcucuggacugagaac

SEQ ID NO: 1094450 - RNA, 22 nt, Human
ucugcugugggucuauauuuua

SEQ ID NO: 1094451 - RNA, 22 nt, Human
ucuuggagaauggcagagaagc

SEQ ID NO: 1094452 - RNA, 22 nt, Human
gaggaagaagggauuagaacuc

SEQ ID NO: 1094453 - RNA, 22 nt, Human
aagaaaagauguuugguuuuca

SEQ ID NO: 1094454 - RNA, 22 nt, Human
uccucuucagagggaccucggg

SEQ ID NO: 1094455 - RNA, 22 nt, Human
ucuuuccuagaggcugaugagu

SEQ ID NO: 1094456 - RNA, 22 nt, Human
cuuaauuucaaacugcuaguga

SEQ ID NO: 1094457 - RNA, 22 nt, Human
uguuuacagggugauuuuaccu

SEQ ID NO: 1094458 - RNA, 22 nt, Human
aacuauaaugggguuaggaaau

SEQ ID NO: 1094459 - RNA, 22 nt, Human
uccccucugguugacccaggag

SEQ ID NO: 1094460 - RNA, 22 nt, Human
gggccacauugaagggugggua

SEQ ID NO: 1094461 - RNA, 22 nt, Human
cuuuuacauuuguugaagagua

SEQ ID NO: 1094462 - RNA, 22 nt, Human
uccuuuccagccucaccucagc

SEQ ID NO: 1094463 - RNA, 21 nt, Human
ucuuuuaacaccaggaauucc

SEQ ID NO: 1094464 - RNA, 22 nt, Human
ucauuucucccggccaaaaacu

SEQ ID NO: 1094465 - RNA, 22 nt, Human
cuucuuuugaagggcguugugu

SEQ ID NO: 1094466 - RNA, 22 nt, Human
ugcugccaggucuugcugucca

SEQ ID NO: 1094467 - RNA, 22 nt, Human
agggcagaggcggacacggaag

SEQ ID NO: 1094468 - RNA, 22 nt, Human
acuucaguaggugauaugugca

SEQ ID NO: 1094469 - RNA, 22 nt, Human
ucuugaagucacacagaaagug

SEQ ID NO: 1094470 - RNA, 22 nt, Human
aaaucaguuggaacacaagcag

SEQ ID NO: 1094471 - RNA, 18 nt, Human
agauuuugagaaauacaa

SEQ ID NO: 1094472 - RNA, 22 nt, Human
ugcugggcuaggguggagcucu

SEQ ID NO: 1094473 - RNA, 22 nt, Human
acugggaggcaucuggagcuga

SEQ ID NO: 1094474 - RNA, 22 nt, Human
uguuuuugucuccuugucugcu

SEQ ID NO: 1094475 - RNA, 22 nt, Human
auauuuuggcaaaugucuagau

SEQ ID NO: 1094476 - RNA, 22 nt, Human
uagaugcauagagcacagcaca

SEQ ID NO: 1094477 - RNA, 22 nt, Human
uaaagcaggcaucucucuccuc

SEQ ID NO: 1094478 - RNA, 22 nt, Human
uugcugcuuucauuuauacagu

SEQ ID NO: 1094479 - RNA, 22 nt, Human
uuccugcccugccugugccacu

SEQ ID NO: 1094480 - RNA, 22 nt, Human
aaaaguacuauuuuaacaaagu

SEQ ID NO: 1094481 - RNA, 22 nt, Human
uauucaaaguaccuucauugcc

SEQ ID NO: 1094482 - RNA, 22 nt, Human
aaagcagauucugaugcaguag

SEQ ID NO: 1094483 - RNA, 22 nt, Human
augcuggggccucagaccagaa

SEQ ID NO: 1094484 - RNA, 22 nt, Human
auuuccaagaaagcuuuaggau

SEQ ID NO: 1094485 - RNA, 22 nt, Human
ccugggccucacccagcucuug

SEQ ID NO: 1094486 - RNA, 20 nt, Human
gggugagauguaggagaggg

SEQ ID NO: 1094487 - RNA, 22 nt, Human
ugauuuccugugcgcccuuagg

SEQ ID NO: 1094488 - RNA, 22 nt, Human
ccucauggccuugagcugaggg

SEQ ID NO: 1094489 - RNA, 22 nt, Human
agcaggcuaaucuugcugaaca

SEQ ID NO: 1094490 - RNA, 22 nt, Human
cccagcccaucucaaaggucua

SEQ ID NO: 1094491 - RNA, 18 nt, Human
gaugaagcugcuggggau

SEQ ID NO: 1094492 - RNA, 22 nt, Human
ucugggcagcagcagcuaguag

SEQ ID NO: 1094493 - RNA, 19 nt, Human
cuguggcugaccucuggcc

SEQ ID NO: 1094494 - RNA, 22 nt, Human
uuucuuaggcucuaaaaugacu

SEQ ID NO: 1094495 - RNA, 22 nt, Human
agugguucuugaucuguagagu

SEQ ID NO: 1094496 - RNA, 22 nt, Human
aggacagaccuaggacuggagc

SEQ ID NO: 1094497 - RNA, 22 nt, Human
ccuucugcuggucaucccagug

SEQ ID NO: 1094498 - RNA, 22 nt, Human
acagagcuuaauucaggagcuu

SEQ ID NO: 1094499 - RNA, 22 nt, Human
agggaggauaguagucaguuua

SEQ ID NO: 1094500 - RNA, 20 nt, Human
cuccaaauuccugaggauaa

SEQ ID NO: 1094501 - RNA, 22 nt, Human
ugaguaggaaaggaaauguuuu

SEQ ID NO: 1094502 - RNA, 22 nt, Human
gaaggccauuuuuagguagaau

SEQ ID NO: 1094503 - RNA, 22 nt, Human
agggccaccagagcagggcagu

SEQ ID NO: 1094504 - RNA, 22 nt, Human
uagaucugauacaauucaucug

SEQ ID NO: 1094505 - RNA, 22 nt, Human
ugccuuuuagugcucaauaaag

SEQ ID NO: 1094506 - RNA, 22 nt, Human
aagaggaacugggggcugaguc

SEQ ID NO: 1094507 - RNA, 22 nt, Human
agaacacauagagaaguuuuau

SEQ ID NO: 1094508 - RNA, 22 nt, Human
aaaggagaaaacauacaggacu

SEQ ID NO: 1094509 - RNA, 22 nt, Human
aggcugcuuccuuacguggcug

SEQ ID NO: 1094510 - RNA, 22 nt, Human
cucugugcgggccauggucagg

SEQ ID NO: 1094511 - RNA, 22 nt, Human
aaacacuggcaauuucaugcac

SEQ ID NO: 1094512 - RNA, 22 nt, Human
gccuggagcucuccacuugggg

SEQ ID NO: 1094513 - RNA, 22 nt, Human
gacacagaguauuuuaaguacu

SEQ ID NO: 1094514 - RNA, 22 nt, Human
gcugucuggaggcucugaggga

SEQ ID NO: 1094515 - RNA, 22 nt, Human
gggugggaacaggaugccagga

SEQ ID NO: 1094516 - RNA, 22 nt, Human
augcuguguuugagaaccuagg

SEQ ID NO: 1094517 - RNA, 22 nt, Human
cuguuucacguguuuaagccca

SEQ ID NO: 1094518 - RNA, 22 nt, Human
gagugcaucguggccauuuuaa

SEQ ID NO: 1094519 - RNA, 22 nt, Human
uaccaaaaccaagccauuaucu

SEQ ID NO: 1094520 - RNA, 22 nt, Human
uccagcuuugagauuuuaugga

SEQ ID NO: 1094521 - RNA, 22 nt, Human
uuucugcugugcuuucuugcgu

SEQ ID NO: 1094522 - RNA, 23 nt, Human
cauaugaaaguagacacuuucca

SEQ ID NO: 1094523 - RNA, 22 nt, Human
caugaagauccuguauguuuuu

SEQ ID NO: 1094524 - RNA, 22 nt, Human
guuugcauaaaguggaugcagg

SEQ ID NO: 1094525 - RNA, 22 nt, Human
uuggcugaagguuaagugcugg

SEQ ID NO: 1094526 - RNA, 22 nt, Human
ggaggccagggacccagucagc

SEQ ID NO: 1094527 - RNA, 22 nt, Human
uuccaggaauucagcucucagu

SEQ ID NO: 1094528 - RNA, 23 nt, Human
uggggcugauggagacggaccag

SEQ ID NO: 1094529 - RNA, 19 nt, Human
ggagaagcccaggaauccu

SEQ ID NO: 1094530 - RNA, 22 nt, Human
gcaagcaguuguggcuucugag

SEQ ID NO: 1094531 - RNA, 22 nt, Human
cuggcucucugagauauugagu

SEQ ID NO: 1094532 - RNA, 22 nt, Human
ugggaguagaugaggagugggc

SEQ ID NO: 1094533 - RNA, 18 nt, Human
ucaggcucucuggcuaga

SEQ ID NO: 1094534 - RNA, 22 nt, Human
gaucaaagccagugaggaguga

SEQ ID NO: 1094535 - RNA, 22 nt, Human
ggaggcaggaaagacagguuca

SEQ ID NO: 1094536 - RNA, 22 nt, Human
aggaggggcaaugauagucugg

SEQ ID NO: 1094537 - RNA, 22 nt, Human
cacaggcagccuuguagaagaa

SEQ ID NO: 1094538 - RNA, 22 nt, Human
uaaagcaauuugagcaaguucu

SEQ ID NO: 1094539 - RNA, 22 nt, Human
uugcuugcuucuauuuuauaca

SEQ ID NO: 1094540 - RNA, 22 nt, Human
gcaggaugagugaguacauuua

SEQ ID NO: 1094541 - RNA, 21 nt, Human
ugguaucaaacuauacaauau

SEQ ID NO: 1094542 - RNA, 22 nt, Human
agccaggcagggcucucgcucu

SEQ ID NO: 1094543 - RNA, 19 nt, Human
ggacacagaaagcugcauu

SEQ ID NO: 1094544 - RNA, 22 nt, Human
aaaaccuucuagacuuuauauu

SEQ ID NO: 1094545 - RNA, 17 nt, Human
cagggcugucugccuag

SEQ ID NO: 1094546 - RNA, 22 nt, Human
gccuggagggucccucucugga

SEQ ID NO: 1094547 - RNA, 22 nt, Human
caauuauauuuagaaugauaca

SEQ ID NO: 1094548 - RNA, 22 nt, Human
ugcaggugcguuuucaagccuc

SEQ ID NO: 1094549 - RNA, 22 nt, Human
uuaauuuuuauguauagugugu

SEQ ID NO: 1094550 - RNA, 22 nt, Human
ucuucccauuaguaaugaagug

SEQ ID NO: 1094551 - RNA, 22 nt, Human
cugggagaggaaccucgagggu

SEQ ID NO: 1094552 - RNA, 19 nt, Human
ccucacccugcagaggagg

SEQ ID NO: 1094553 - RNA, 22 nt, Human
gaggaaaauggaguguaauuaa

SEQ ID NO: 1094554 - RNA, 22 nt, Human
ccucccacauugaggacaugcu

SEQ ID NO: 1094555 - RNA, 22 nt, Human
uaauaggagccaggucacauag

SEQ ID NO: 1094556 - RNA, 22 nt, Human
uuacaaaguucugaguucaaac

SEQ ID NO: 1094557 - RNA, 22 nt, Human
uugauuugauuguaauggcucu

SEQ ID NO: 1094558 - RNA, 22 nt, Human
gccuugcugauuaccuuccuuu

SEQ ID NO: 1094559 - RNA, 22 nt, Human
gacagcugcucccguuucugcu

SEQ ID NO: 1094560 - RNA, 22 nt, Human
gaaaggccauuucugaggguuu

SEQ ID NO: 1094561 - RNA, 22 nt, Human
uccuuuuuauaguuagagaaac

SEQ ID NO: 1094562 - RNA, 22 nt, Human
cagggcagaacauauagauagu

SEQ ID NO: 1094563 - RNA, 22 nt, Human
ugggacuugccucgagggcugc

SEQ ID NO: 1094564 - RNA, 22 nt, Human
ggacacaagcuccggggcugca

SEQ ID NO: 1094565 - RNA, 22 nt, Human
cacagggcuaaaugaaggguug

SEQ ID NO: 1094566 - RNA, 22 nt, Human
aagcuggagaguuaggugaaua

SEQ ID NO: 1094567 - RNA, 22 nt, Human
ccaggcugagcaugauuggagc

SEQ ID NO: 1094568 - RNA, 22 nt, Human
ugcuggccaauggcagaggcgg

SEQ ID NO: 1094569 - RNA, 22 nt, Human
acuuuguagguuucagugaaac

SEQ ID NO: 1094570 - RNA, 22 nt, Human
gccagcaguauguccuggcagu

SEQ ID NO: 1094571 - RNA, 22 nt, Human
aggaugaauaacugaaauggug

SEQ ID NO: 1094572 - RNA, 22 nt, Human
uaaguuagagcacaauucuuac

SEQ ID NO: 1094573 - RNA, 22 nt, Human
ugugccagaaaauaugcugagg

SEQ ID NO: 1094574 - RNA, 22 nt, Human
uaugaagacaaugauagcauga

SEQ ID NO: 1094575 - RNA, 22 nt, Human
ucagugaucuaaggguauggcc

SEQ ID NO: 1094576 - RNA, 22 nt, Human
agaaaacauuacauaggugugu

SEQ ID NO: 1094577 - RNA, 22 nt, Human
gagccuggauagccuuguucca

SEQ ID NO: 1094578 - RNA, 22 nt, Human
guccuggggauacagaagugaa

SEQ ID NO: 1094579 - RNA, 22 nt, Human
gugcccagugcaggcccgcagg

SEQ ID NO: 1094580 - RNA, 22 nt, Human
uuuucaguaaugucuacauaau

SEQ ID NO: 1094581 - RNA, 22 nt, Human
agaaguuaccacauacuucucu

SEQ ID NO: 1094582 - RNA, 22 nt, Human
acaguguagaauccuguacuua

SEQ ID NO: 1094583 - RNA, 22 nt, Human
aauuugacccaucuuggaauuu

SEQ ID NO: 1094584 - RNA, 22 nt, Human
guacuuccguggacuaauuguu

SEQ ID NO: 1094585 - RNA, 19 nt, Human
agcuuccauauucucuagu

SEQ ID NO: 1094586 - RNA, 22 nt, Human
uagaaacaucagcuaaccaaaa

SEQ ID NO: 1094587 - RNA, 22 nt, Human
gaaaugcauggaucuuggcaga

SEQ ID NO: 1094588 - RNA, 22 nt, Human
agauuuugucucaauacuucug

SEQ ID NO: 1094589 - RNA, 22 nt, Human
aaugacaugcuuuuuaauuaua

SEQ ID NO: 1094590 - RNA, 20 nt, Human
ucccuggaggugguggcauc

SEQ ID NO: 1094591 - RNA, 22 nt, Human
uggaagugcucuucugaccaac

SEQ ID NO: 1094592 - RNA, 22 nt, Human
ugcuggggcucugaccacucca

SEQ ID NO: 1094593 - RNA, 22 nt, Human
gccuuugccugcgacguggcug

SEQ ID NO: 1094594 - RNA, 22 nt, Human
aguggggacuuaugccagcauu

SEQ ID NO: 1094595 - RNA, 19 nt, Human
cugagcagcggcagcacuu

SEQ ID NO: 1094596 - RNA, 22 nt, Human
aaucuuaaagaauauucuacca

SEQ ID NO: 1094597 - RNA, 22 nt, Human
auuuucuauucugcugguuuag

SEQ ID NO: 1094598 - RNA, 22 nt, Human
uauguacaugauuucauuugcu

SEQ ID NO: 1094599 - RNA, 22 nt, Human
uuguuaaauggaugcagaauaa

SEQ ID NO: 1094600 - RNA, 22 nt, Human
uggccaaucacugacaaaaugc

SEQ ID NO: 1094601 - RNA, 22 nt, Human
aggaaaagugugaaguauggag

SEQ ID NO: 1094602 - RNA, 22 nt, Human
uuugcauugccucugacuuaug

SEQ ID NO: 1094603 - RNA, 22 nt, Human
ugccucagcugaggccgcucca

SEQ ID NO: 1094604 - RNA, 22 nt, Human
aguucuagaagacuuuuccauu

SEQ ID NO: 1094605 - RNA, 22 nt, Human
ucuugauucauguucccugcau

SEQ ID NO: 1094606 - RNA, 22 nt, Human
uacacauuagucaagaguuuga

SEQ ID NO: 1094607 - RNA, 22 nt, Human
uucauuugccaucaguguaaug

SEQ ID NO: 1094608 - RNA, 22 nt, Human
acagauaaauuuauaggagugu

SEQ ID NO: 1094609 - RNA, 22 nt, Human
aggaacacuuguggaaacauuc

SEQ ID NO: 1094610 - RNA, 22 nt, Human
acucuucuugcugcucauuaau

SEQ ID NO: 1094611 - RNA, 22 nt, Human
caucuuaaaaugugucauaacu

SEQ ID NO: 1094612 - RNA, 22 nt, Human
aucacuguguauguauaugcag

SEQ ID NO: 1094613 - RNA, 22 nt, Human
cacagagauuagaauuagacua

SEQ ID NO: 1094614 - RNA, 22 nt, Human
caggaaaaucugcccacacaag

SEQ ID NO: 1094615 - RNA, 22 nt, Human
aaagccuugagauccuauaguu

SEQ ID NO: 1094616 - RNA, 22 nt, Human
cagcagcaacaacggaagccuu

SEQ ID NO: 1094617 - RNA, 22 nt, Human
ucagaaaagaccacauuauucu

SEQ ID NO: 1094618 - RNA, 20 nt, Human
uugggccugucagcacuccc

SEQ ID NO: 1094619 - RNA, 22 nt, Human
aacaacagcugcuaaagaguug

SEQ ID NO: 1094620 - RNA, 22 nt, Human
cacuggggugggccugguagag

SEQ ID NO: 1094621 - RNA, 22 nt, Human
aaugaugaguucuaauagaccc

SEQ ID NO: 1094622 - RNA, 22 nt, Human
caguguuuaaucauugugaauu

SEQ ID NO: 1094623 - RNA, 22 nt, Human
uuucaaaguaaggauuuucauc

SEQ ID NO: 1094624 - RNA, 19 nt, Human
ggugaccaccuggucagug

SEQ ID NO: 1094625 - RNA, 22 nt, Human
uaucaauacauguuaucagugu

SEQ ID NO: 1094626 - RNA, 22 nt, Human
uugaagauggaucgccacucuc

SEQ ID NO: 1094627 - RNA, 19 nt, Human
cagagccucagagcuagaa

SEQ ID NO: 1094628 - RNA, 22 nt, Human
gcugauauaaaauuacagagga

SEQ ID NO: 1094629 - RNA, 22 nt, Human
ccagagcugcauccagcagguu

SEQ ID NO: 1094630 - RNA, 22 nt, Human
uugcauaaagauuuuauugcau

SEQ ID NO: 1094631 - RNA, 22 nt, Human
ccaggaggcuucguccguggag

SEQ ID NO: 1094632 - RNA, 22 nt, Human
acacacagaaggaagccccacu

SEQ ID NO: 1094633 - RNA, 22 nt, Human
guuucaaaggugucaggcaguu

SEQ ID NO: 1094634 - RNA, 22 nt, Human
ugcgcaggagcucugccaggag

SEQ ID NO: 1094635 - RNA, 22 nt, Human
cuucagugacauuccuucccuc

SEQ ID NO: 1094636 - RNA, 22 nt, Human
aaacaugaugccuguacuaaga

SEQ ID NO: 1094637 - RNA, 22 nt, Human
ugugggcuuuggagucaggaag

SEQ ID NO: 1094638 - RNA, 22 nt, Human
gcaggaaccacugccccccugu

SEQ ID NO: 1094639 - RNA, 22 nt, Human
augcuuuauacaaaacacuuaa

SEQ ID NO: 1094640 - RNA, 19 nt, Human
uuccaguucuaaucucuuc

SEQ ID NO: 1094641 - RNA, 22 nt, Human
aagaaugagcucaaagaucuua

SEQ ID NO: 1094642 - RNA, 22 nt, Human
cccaggcagggacgugcucugg

SEQ ID NO: 1094643 - RNA, 23 nt, Human
ugcuucucugcuugacaguucug

SEQ ID NO: 1094644 - RNA, 22 nt, Human
aggacacagcucuucaguaaga

SEQ ID NO: 1094645 - RNA, 22 nt, Human
gcugcuggccccacaugcucca

SEQ ID NO: 1094646 - RNA, 19 nt, Human
caaggguugggucugucau

SEQ ID NO: 1094647 - RNA, 22 nt, Human
agggccacaguggggccugaga

SEQ ID NO: 1094648 - RNA, 22 nt, Human
caaacuuugcaaaacuuacagu

SEQ ID NO: 1094649 - RNA, 22 nt, Human
ccagggcagggaccacgugucu

SEQ ID NO: 1094650 - RNA, 20 nt, Human
gccugccucagcuagcugag

SEQ ID NO: 1094651 - RNA, 22 nt, Human
gcuggcaccugcaccaagcagg

SEQ ID NO: 1094652 - RNA, 20 nt, Human
agccaggcucaagcuccccc

SEQ ID NO: 1094653 - RNA, 22 nt, Human
guuucaaagggaagacgcugga

SEQ ID NO: 1094654 - RNA, 22 nt, Human
uuccucuuauuuucccagugau

SEQ ID NO: 1094655 - RNA, 22 nt, Human
caggcuggucccagagcauugc

SEQ ID NO: 1094656 - RNA, 22 nt, Human
uggccucuuaggacauccucua

SEQ ID NO: 1094657 - RNA, 22 nt, Human
ggcaggugagagcucuuugaaa

SEQ ID NO: 1094658 - RNA, 18 nt, Human
agcuggggccucuggucc

SEQ ID NO: 1094659 - RNA, 22 nt, Human
ggggcucugcucugagccgugu

SEQ ID NO: 1094660 - RNA, 22 nt, Human
acccugccaaggauggccccga

SEQ ID NO: 1094661 - RNA, 22 nt, Human
ucaaacaugaaagcuugauuuu

SEQ ID NO: 1094662 - RNA, 22 nt, Human
uccucuggcucuuucccuagga

SEQ ID NO: 1094663 - RNA, 22 nt, Human
cacauuuacauauaaaacuuuc

SEQ ID NO: 1094664 - RNA, 22 nt, Human
uugcucugcaguccagacagua

SEQ ID NO: 1094665 - RNA, 22 nt, Human
auaaggcaucucucaguuagca

SEQ ID NO: 1094666 - RNA, 22 nt, Human
cucuggagcauuucaccuacau

SEQ ID NO: 1094667 - RNA, 22 nt, Human
ugcagggauccuagcugaagag

SEQ ID NO: 1094668 - RNA, 22 nt, Human
gagaaaggcauuccuaugcaaa

SEQ ID NO: 1094669 - RNA, 22 nt, Human
uaaaugaaaggguuuaauuuau

SEQ ID NO: 1094670 - RNA, 22 nt, Human
cacacccucgugcucccucccg

SEQ ID NO: 1094671 - RNA, 22 nt, Human
auuuuaaggcuuauuuaaaggc

SEQ ID NO: 1094672 - RNA, 22 nt, Human
agcucuuugacuaaucuugcuu

SEQ ID NO: 1094673 - RNA, 22 nt, Human
caggcuuuacuuucucucugaa

SEQ ID NO: 1094674 - RNA, 22 nt, Human
uguugagacugagggagucagc

SEQ ID NO: 1094675 - RNA, 22 nt, Human
uaaggcaaguuuuuaguggaca

SEQ ID NO: 1094676 - RNA, 19 nt, Human
ggaugagggucaggcauag

SEQ ID NO: 1094677 - RNA, 22 nt, Human
agaagagccuggggaccauggc

SEQ ID NO: 1094678 - RNA, 22 nt, Human
uggccugcuuucauuugaugcu

SEQ ID NO: 1094679 - RNA, 22 nt, Human
cuuacauaugcaagacaaaggg

SEQ ID NO: 1094680 - RNA, 22 nt, Human
aaacacacagaaaugaaugagg

SEQ ID NO: 1094681 - RNA, 22 nt, Human
ccccaccagcacccucucuauc

SEQ ID NO: 1094682 - RNA, 22 nt, Human
caggcagcuagauuuauaacaa

SEQ ID NO: 1094683 - RNA, 22 nt, Human
ucccagggucaguggugaggcc

SEQ ID NO: 1094684 - RNA, 22 nt, Human
cccaagggagugccuggucaac

SEQ ID NO: 1094685 - RNA, 20 nt, Human
aguuuucagcagaacaccca

SEQ ID NO: 1094686 - RNA, 22 nt, Human
cugcaggguuuuucaaggacaa

SEQ ID NO: 1094687 - RNA, 22 nt, Human
uaaagcagugugguuguguccc

SEQ ID NO: 1094688 - RNA, 22 nt, Human
ucccugccucucagacuuccuu

SEQ ID NO: 1094689 - RNA, 22 nt, Human
cacagaggcaaccuucuggggu

SEQ ID NO: 1094690 - RNA, 22 nt, Human
ugaggaaacuuacaaggcagaa

SEQ ID NO: 1094691 - RNA, 22 nt, Human
aaauuccauuaugauaauuucg

SEQ ID NO: 1094692 - RNA, 22 nt, Human
uugguccugcagaggggucugg

SEQ ID NO: 1094693 - RNA, 22 nt, Human
ugguugccucucagagauuccg

SEQ ID NO: 1094694 - RNA, 22 nt, Human
acuguaaagagguguaucuuua

SEQ ID NO: 1094695 - RNA, 22 nt, Human
gcaggugggggucggugcaucu

SEQ ID NO: 1094696 - RNA, 22 nt, Human
uguccaggucagcagcagggac

SEQ ID NO: 1094697 - RNA, 23 nt, Human
auagaagauuauugcaacagucc

SEQ ID NO: 1094698 - RNA, 22 nt, Human
ccaggcucugccaggcccuuga

SEQ ID NO: 1094699 - RNA, 22 nt, Human
ugggcagcauccuccacaguca

SEQ ID NO: 1094700 - RNA, 22 nt, Human
agagcuggcugugggugacuuu

SEQ ID NO: 1094701 - RNA, 22 nt, Human
ggaagggaaaauucauucggcu

SEQ ID NO: 1094702 - RNA, 22 nt, Human
ucuagggggacagcuggcugug

SEQ ID NO: 1094703 - RNA, 22 nt, Human
acugggaagacuggaauugcuc

SEQ ID NO: 1094704 - RNA, 22 nt, Human
cuggcugugcugcaggcuuugg

SEQ ID NO: 1094705 - RNA, 22 nt, Human
ucauuuaauagcuuuugucuuu

SEQ ID NO: 1094706 - RNA, 22 nt, Human
cucaguuucuucauauuguagg

SEQ ID NO: 1094707 - RNA, 17 nt, Human
aggggagagugggaaga

SEQ ID NO: 1094708 - RNA, 22 nt, Human
ccagcagcagcguccaaggaga

SEQ ID NO: 1094709 - RNA, 22 nt, Human
agagggagcccagucauagcug

SEQ ID NO: 1094710 - RNA, 22 nt, Human
caguacuuuucaaccaguauga

SEQ ID NO: 1094711 - RNA, 23 nt, Human
agaauuucuaacucuagcucugu

SEQ ID NO: 1094712 - RNA, 22 nt, Human
caagaaggcuauaugggccagg

SEQ ID NO: 1094713 - RNA, 22 nt, Human
uuuggaaugguaccuucaguug

SEQ ID NO: 1094714 - RNA, 22 nt, Human
gaaaggagugaauauuugugac

SEQ ID NO: 1094715 - RNA, 22 nt, Human
uggccaugaaggaggcagcaga

SEQ ID NO: 1094716 - RNA, 22 nt, Human
uauuacagcuuugauuaucugg

SEQ ID NO: 1094717 - RNA, 22 nt, Human
gggagcugagggaccucugugg

SEQ ID NO: 1094718 - RNA, 22 nt, Human
auuccaaagcacaucagaacua

SEQ ID NO: 1094719 - RNA, 22 nt, Human
agacauuuauugaacaccuagc

SEQ ID NO: 1094720 - RNA, 22 nt, Human
ucucagggagggcgagucagcg

SEQ ID NO: 1094721 - RNA, 22 nt, Human
aggcagugagugugacuucaca

SEQ ID NO: 1094722 - RNA, 22 nt, Human
ccuacagagcagcaggaccaga

SEQ ID NO: 1094723 - RNA, 22 nt, Human
caguuuuaaauuuugaaugucu

SEQ ID NO: 1094724 - RNA, 22 nt, Human
uuguuucuuugaaguuucuaga

SEQ ID NO: 1094725 - RNA, 22 nt, Human
cuuaauuuaaaauaguucaggc

SEQ ID NO: 1094726 - RNA, 19 nt, Human
auuugaaagcugugcuugc

SEQ ID NO: 1094727 - RNA, 22 nt, Human
cuuaaggcuucagcacagguau

SEQ ID NO: 1094728 - RNA, 22 nt, Human
ucucugagcucaggagcugcag

SEQ ID NO: 1094729 - RNA, 23 nt, Human
ccucccaggcugcgagucccgag

SEQ ID NO: 1094730 - RNA, 22 nt, Human
guguuuaacaucugguuuauac

SEQ ID NO: 1094731 - RNA, 20 nt, Human
cugggaggucuuccaaauca

SEQ ID NO: 1094732 - RNA, 22 nt, Human
uucugcagcccaacaguaguuu

SEQ ID NO: 1094733 - RNA, 22 nt, Human
cugcuguguaucauuuuagaug

SEQ ID NO: 1094734 - RNA, 22 nt, Human
uuuauauagagauuugugcaug

SEQ ID NO: 1094735 - RNA, 22 nt, Human
acagauggccauauuacuauau

SEQ ID NO: 1094736 - RNA, 22 nt, Human
acccaggccugagagacaggag

SEQ ID NO: 1094737 - RNA, 20 nt, Human
uagauguuuccugucauaaa

SEQ ID NO: 1094738 - RNA, 22 nt, Human
gagaggccauggcugugcagug

SEQ ID NO: 1094739 - RNA, 22 nt, Human
agcccucugcaaacaccugaua

SEQ ID NO: 1094740 - RNA, 22 nt, Human
uuuaggaaauacuguccuauga

SEQ ID NO: 1094741 - RNA, 22 nt, Human
aacagcagcaaguaagcagguc

SEQ ID NO: 1094742 - RNA, 22 nt, Human
gaaggccucacucugcagcaua

SEQ ID NO: 1094743 - RNA, 22 nt, Human
ucaaaaauuuucugaggaugag

SEQ ID NO: 1094744 - RNA, 22 nt, Human
auaaggcauauagucacuuuuu

SEQ ID NO: 1094745 - RNA, 22 nt, Human
ccugugugucugucacugcaca

SEQ ID NO: 1094746 - RNA, 22 nt, Human
gcagagaccccgcagugaggcc

SEQ ID NO: 1094747 - RNA, 22 nt, Human
agcuggccuguuagagcugagu

SEQ ID NO: 1094748 - RNA, 22 nt, Human
ugagagugguucagcucagaag

SEQ ID NO: 1094749 - RNA, 22 nt, Human
augcauaugugugcacacgugu

SEQ ID NO: 1094750 - RNA, 22 nt, Human
cacagcuucuccccgcugcggc

SEQ ID NO: 1094751 - RNA, 19 nt, Human
caguggccuggaggucucu

SEQ ID NO: 1094752 - RNA, 22 nt, Human
cccucacuucacgcucugcaga

SEQ ID NO: 1094753 - RNA, 22 nt, Human
cugauuucucaguucuaggaag

SEQ ID NO: 1094754 - RNA, 22 nt, Human
cccaggcuggagugcaauggca

SEQ ID NO: 1094755 - RNA, 22 nt, Human
cucugcugcccaggccugcuag

SEQ ID NO: 1094756 - RNA, 22 nt, Human
auaugaaguuacagguaagaaa

SEQ ID NO: 1094757 - RNA, 22 nt, Human
caggcccauucuaggcuugcua

SEQ ID NO: 1094758 - RNA, 22 nt, Human
gcacauccaaugauuguuuuga

SEQ ID NO: 1094759 - RNA, 22 nt, Human
ccuuucuugcuaagaguuuaug

SEQ ID NO: 1094760 - RNA, 22 nt, Human
gggcccuggggauguggacgcg

SEQ ID NO: 1094761 - RNA, 22 nt, Human
uucaacaauuaaguaucagccu

SEQ ID NO: 1094762 - RNA, 22 nt, Human
gcugccuucaguucugauucau

SEQ ID NO: 1094763 - RNA, 22 nt, Human
agcaggagaacacuguggcucu

SEQ ID NO: 1094764 - RNA, 22 nt, Human
agagauauggaugucagaaacu

SEQ ID NO: 1094765 - RNA, 19 nt, Human
ggcagucucaagcagcaca

SEQ ID NO: 1094766 - RNA, 23 nt, Human
gccucugcucugcguuggggacu

SEQ ID NO: 1094767 - RNA, 22 nt, Human
uuaaaaucuaaagcaguugucu

SEQ ID NO: 1094768 - RNA, 22 nt, Human
cauuugaaaccuggaaucuacc

SEQ ID NO: 1094769 - RNA, 22 nt, Human
aaaccacacuuagcaguuucgu

SEQ ID NO: 1094770 - RNA, 22 nt, Human
uggcaugauaggaggugcagaa

SEQ ID NO: 1094771 - RNA, 22 nt, Human
guauccuccccgcuggccuuca

SEQ ID NO: 1094772 - RNA, 22 nt, Human
aaucaaagaaugggcuaguugg

SEQ ID NO: 1094773 - RNA, 22 nt, Human
uucagaaauaaaauaucccaac

SEQ ID NO: 1094774 - RNA, 22 nt, Human
uacuuuaaagagguguaaugag

SEQ ID NO: 1094775 - RNA, 22 nt, Human
ggcaagggacggccgugagaca

SEQ ID NO: 1094776 - RNA, 22 nt, Human
agacauuuuggaaaguauuacu

SEQ ID NO: 1094777 - RNA, 20 nt, Human
gcagugaucucaucggucug

SEQ ID NO: 1094778 - RNA, 22 nt, Human
agcacaggaccaaggaagcugu

SEQ ID NO: 1094779 - RNA, 19 nt, Human
auucuucagcagugagacc

SEQ ID NO: 1094780 - RNA, 22 nt, Human
ccagggaggguccuguggcuuc

SEQ ID NO: 1094781 - RNA, 22 nt, Human
uugggccucggccaaggacggg

SEQ ID NO: 1094782 - RNA, 22 nt, Human
uucccaagucuccaauguggga

SEQ ID NO: 1094783 - RNA, 22 nt, Human
ggcacugaaccaggacacaagc

SEQ ID NO: 1094784 - RNA, 22 nt, Human
cucuggagguugagcccagcaa

SEQ ID NO: 1094785 - RNA, 22 nt, Human
aacacauagacguuugauauca

SEQ ID NO: 1094786 - RNA, 22 nt, Human
auauuccuguuuuuaacacuuu

SEQ ID NO: 1094787 - RNA, 22 nt, Human
ugcuuugugauaugcugugucu

SEQ ID NO: 1094788 - RNA, 22 nt, Human
auuuuguugaugguggaguagc

SEQ ID NO: 1094789 - RNA, 18 nt, Human
gugccaggaggcgcagcc

SEQ ID NO: 1094790 - RNA, 22 nt, Human
ucaaggaggugcuuggcuucac

SEQ ID NO: 1094791 - RNA, 22 nt, Human
uagaaaugaauguuuaaaaguc

SEQ ID NO: 1094792 - RNA, 22 nt, Human
cauugcacuccagcuugggcaa

SEQ ID NO: 1094793 - RNA, 22 nt, Human
uauucacaugaaaacaaauuuu

SEQ ID NO: 1094794 - RNA, 22 nt, Human
aucuuuaggcaaguuacuuaac

SEQ ID NO: 1094795 - RNA, 22 nt, Human
uuugcauuuuagauuuaggccu

SEQ ID NO: 1094796 - RNA, 22 nt, Human
ggggcuggcucacuaagagacu

SEQ ID NO: 1094797 - RNA, 23 nt, Human
aggcagugucucuuauccugucc

SEQ ID NO: 1094798 - RNA, 22 nt, Human
gccuguccuggaugcucugcaa

SEQ ID NO: 1094799 - RNA, 22 nt, Human
uacacagagacucaaaagggca

SEQ ID NO: 1094800 - RNA, 22 nt, Human
aggcugugggaguugagagucu

SEQ ID NO: 1094801 - RNA, 22 nt, Human
acauagcaagugcucaauaaau

SEQ ID NO: 1094802 - RNA, 22 nt, Human
cugggcucaaauccuggcccug

SEQ ID NO: 1094803 - RNA, 22 nt, Human
ucaggcagaugcagggauggau

SEQ ID NO: 1094804 - RNA, 22 nt, Human
gaauacauuggaaaucagaaua

SEQ ID NO: 1094805 - RNA, 22 nt, Human
gcagccuccgcacugcgagucc

SEQ ID NO: 1094806 - RNA, 22 nt, Human
cucaacagcucugccauacucc

SEQ ID NO: 1094807 - RNA, 23 nt, Human
ucucccaagccuggcaggggcac

SEQ ID NO: 1094808 - RNA, 22 nt, Human
aaugcuuuagaaaaccagcuuu

SEQ ID NO: 1094809 - RNA, 22 nt, Human
aggcagaggaaggguggauuug

SEQ ID NO: 1094810 - RNA, 21 nt, Human
ucagaacaauuccaugccucc

SEQ ID NO: 1094811 - RNA, 22 nt, Human
caauucuuuguagaagcucucc

SEQ ID NO: 1094812 - RNA, 22 nt, Human
ggcugccauaacagaguaccac

SEQ ID NO: 1094813 - RNA, 22 nt, Human
ccugggcuuuggaacaguacuu

SEQ ID NO: 1094814 - RNA, 22 nt, Human
ggaggggaugguuugacccugg

SEQ ID NO: 1094815 - RNA, 22 nt, Human
uaugcagugguaucauuuuaaa

SEQ ID NO: 1094816 - RNA, 22 nt, Human
acucccacuccagaguagaagc

SEQ ID NO: 1094817 - RNA, 22 nt, Human
agcuuccuacaaccaucucaga

SEQ ID NO: 1094818 - RNA, 22 nt, Human
ccagcugucugguuccagagcc

SEQ ID NO: 1094819 - RNA, 22 nt, Human
gcugucuuccuugcuccaaggg

SEQ ID NO: 1094820 - RNA, 22 nt, Human
gcacagccacugagugagaacc

SEQ ID NO: 1094821 - RNA, 22 nt, Human
ucuucauggucugguucuccag

SEQ ID NO: 1094822 - RNA, 22 nt, Human
aguuuccaaauauuguuuuagc

SEQ ID NO: 1094823 - RNA, 22 nt, Human
ccagggccaguaagauuggcau

SEQ ID NO: 1094824 - RNA, 22 nt, Human
acaugcuuugauguauuuugca

SEQ ID NO: 1094825 - RNA, 22 nt, Human
uggcucaggccuacgacgccuu

SEQ ID NO: 1094826 - RNA, 22 nt, Human
uggagggcucuuucaccuggua

SEQ ID NO: 1094827 - RNA, 22 nt, Human
auuucucagugugaucaggccu

SEQ ID NO: 1094828 - RNA, 22 nt, Human
agcugcagcguucauuuuucca

SEQ ID NO: 1094829 - RNA, 22 nt, Human
ucugaucugugccuuaggccug

SEQ ID NO: 1094830 - RNA, 22 nt, Human
uacaggcacugaaaugcuuauu

SEQ ID NO: 1094831 - RNA, 22 nt, Human
cagccaagaaccacagacccag

SEQ ID NO: 1094832 - RNA, 22 nt, Human
ugccuugguucucuacuuggag

SEQ ID NO: 1094833 - RNA, 22 nt, Human
uuauuauguggaugaaagaugu

SEQ ID NO: 1094834 - RNA, 22 nt, Human
uaauaacaauuguaggacauga

SEQ ID NO: 1094835 - RNA, 22 nt, Human
gggcugugcugaguaggaggug

SEQ ID NO: 1094836 - RNA, 22 nt, Human
aaauagaauuaacuagcuacug

SEQ ID NO: 1094837 - RNA, 22 nt, Human
uuucaaguggcgagauaaggaa

SEQ ID NO: 1094838 - RNA, 22 nt, Human
cuggccucauagccaagcugug

SEQ ID NO: 1094839 - RNA, 22 nt, Human
caacugcugacaccaucacucc

SEQ ID NO: 1094840 - RNA, 22 nt, Human
agauacauauagaaaacaucaa

SEQ ID NO: 1094841 - RNA, 22 nt, Human
augggcugacccagucguggca

SEQ ID NO: 1094842 - RNA, 22 nt, Human
ucauaaaaugcuccugauauug

SEQ ID NO: 1094843 - RNA, 22 nt, Human
auauaauacaaccugcuaagug

SEQ ID NO: 1094844 - RNA, 22 nt, Human
auugcugggaauauuuagccca

SEQ ID NO: 1094845 - RNA, 22 nt, Human
aggcacugggaauaugcugagg

SEQ ID NO: 1094846 - RNA, 22 nt, Human
auuuugcugcuaugccuugcaa

SEQ ID NO: 1094847 - RNA, 21 nt, Human
auacagaagguggcaaaguac

SEQ ID NO: 1094848 - RNA, 22 nt, Human
gcugcagcuuuaggauccagug

SEQ ID NO: 1094849 - RNA, 22 nt, Human
uauagguaugucgagaaaugaa

SEQ ID NO: 1094850 - RNA, 22 nt, Human
ugcaagagacagacaugacuca

SEQ ID NO: 1094851 - RNA, 22 nt, Human
gaagcccacguuuggugaugua

SEQ ID NO: 1094852 - RNA, 22 nt, Human
agggaggaguccucaaagucau

SEQ ID NO: 1094853 - RNA, 22 nt, Human
ggcaggcuuucagcaucaaguc

SEQ ID NO: 1094854 - RNA, 22 nt, Human
aaguagauagugcuacggaguu

SEQ ID NO: 1094855 - RNA, 20 nt, Human
ccugggguacacuggcaugu

SEQ ID NO: 1094856 - RNA, 22 nt, Human
aauggaacuuguaauuaugucc

SEQ ID NO: 1094857 - RNA, 22 nt, Human
acuaagugauucuaagcaucuu

SEQ ID NO: 1094858 - RNA, 20 nt, Human
ggcucuggaaucuggugggc

SEQ ID NO: 1094859 - RNA, 22 nt, Human
agaauaaacugcuuuagggcag

SEQ ID NO: 1094860 - RNA, 22 nt, Human
ucacagacauggugagguaaca

SEQ ID NO: 1094861 - RNA, 22 nt, Human
ggcucugguggcaauugacugg

SEQ ID NO: 1094862 - RNA, 22 nt, Human
gcagcuggggccacacuuaggc

SEQ ID NO: 1094863 - RNA, 22 nt, Human
acauuuguuucucuagaguagg

SEQ ID NO: 1094864 - RNA, 22 nt, Human
cuguccauuuucgugccuccuu

SEQ ID NO: 1094865 - RNA, 22 nt, Human
auaaagauuucuuuuucucuac

SEQ ID NO: 1094866 - RNA, 22 nt, Human
aucugggggagcugcucaugga

SEQ ID NO: 1094867 - RNA, 22 nt, Human
ugcuaucucuauauccauuuau

SEQ ID NO: 1094868 - RNA, 22 nt, Human
ugcugagugggauuccugugcu

SEQ ID NO: 1094869 - RNA, 22 nt, Human
agcccugcgcucacguucugca

SEQ ID NO: 1094870 - RNA, 22 nt, Human
aaguuaugaaauuuggacagcu

SEQ ID NO: 1094871 - RNA, 22 nt, Human
agaauucuguucuucgggugug

SEQ ID NO: 1094872 - RNA, 22 nt, Human
aauaaacugcucaauugcauca

SEQ ID NO: 1094873 - RNA, 22 nt, Human
guuaaagaguuuggcuuucuuc

SEQ ID NO: 1094874 - RNA, 22 nt, Human
cuguggaguggggaguacuggu

SEQ ID NO: 1094875 - RNA, 22 nt, Human
cccaggggagguccucagggaa

SEQ ID NO: 1094876 - RNA, 18 nt, Human
cagaggagagacauucag

SEQ ID NO: 1094877 - RNA, 22 nt, Human
aagcacagaccagaucuccagg

SEQ ID NO: 1094878 - RNA, 22 nt, Human
uaaaauagcaugugcagugaaa

SEQ ID NO: 1094879 - RNA, 22 nt, Human
ucuguuuuguaccagauacagc

SEQ ID NO: 1094880 - RNA, 22 nt, Human
gccauggcccauaccaggugca

SEQ ID NO: 1094881 - RNA, 22 nt, Human
cugggcugcgggcgccccucca

SEQ ID NO: 1094882 - RNA, 22 nt, Human
cagcucugccaucaucugccuu

SEQ ID NO: 1094883 - RNA, 23 nt, Human
gcaggaguuccuggacuccagga

SEQ ID NO: 1094884 - RNA, 19 nt, Human
cuggcucuuggguggagga

SEQ ID NO: 1094885 - RNA, 22 nt, Human
caggaacccaaugggccaggcc

SEQ ID NO: 1094886 - RNA, 21 nt, Human
agcuuguguguaucacagugu

SEQ ID NO: 1094887 - RNA, 22 nt, Human
ucaaaguauaucccuucgaaac

SEQ ID NO: 1094888 - RNA, 22 nt, Human
ugcuggaaaguuaaauuuugga

SEQ ID NO: 1094889 - RNA, 22 nt, Human
guggcagucuuuggcaaugaca

SEQ ID NO: 1094890 - RNA, 22 nt, Human
aagucauguggaagaauaaccu

SEQ ID NO: 1094891 - RNA, 22 nt, Human
uuucacaguuagcaugaggacu

SEQ ID NO: 1094892 - RNA, 22 nt, Human
aggguggcaguuacuggagcaa

SEQ ID NO: 1094893 - RNA, 22 nt, Human
acagauggcacuuuuuaggacu

SEQ ID NO: 1094894 - RNA, 22 nt, Human
ugugccuggcauucugggcuuc

SEQ ID NO: 1094895 - RNA, 22 nt, Human
uuucuucucgacaccuuauccc

SEQ ID NO: 1094896 - RNA, 22 nt, Human
aacaggaggccuuccaguccag

SEQ ID NO: 1094897 - RNA, 22 nt, Human
gucuucuguaagaugagguccc

SEQ ID NO: 1094898 - RNA, 22 nt, Human
ugauugaagaggugaggaaguu

SEQ ID NO: 1094899 - RNA, 22 nt, Human
gaaggaaaggucucaugccuuu

SEQ ID NO: 1094900 - RNA, 22 nt, Human
cuuaaauuuucaucuacaagaa

SEQ ID NO: 1094901 - RNA, 22 nt, Human
caguuuuaucaucugugaaaug

SEQ ID NO: 1094902 - RNA, 22 nt, Human
uggcugagugauauuugcaaag

SEQ ID NO: 1094903 - RNA, 23 nt, Human
agguacacauuauagaaauagac

SEQ ID NO: 1094904 - RNA, 22 nt, Human
gauuuuaucuuugugugcagua

SEQ ID NO: 1094905 - RNA, 22 nt, Human
gggcuguggagccgcgagggcu

SEQ ID NO: 1094906 - RNA, 22 nt, Human
cugaaugaggaaaagagugagg

SEQ ID NO: 1094907 - RNA, 22 nt, Human
aagggcuggaauaucucuuaga

SEQ ID NO: 1094908 - RNA, 21 nt, Human
gcugccaccgcgugcuccagg

SEQ ID NO: 1094909 - RNA, 22 nt, Human
ucuaaacagccucuuaccaacu

SEQ ID NO: 1094910 - RNA, 22 nt, Human
auuaaauuaaguggcuaauuua

SEQ ID NO: 1094911 - RNA, 21 nt, Human
aauaaaacaguuggugucaau

SEQ ID NO: 1094912 - RNA, 21 nt, Human
agucccaggggugagugaugu

SEQ ID NO: 1094913 - RNA, 22 nt, Human
cagaguacugggagaacagaag

SEQ ID NO: 1094914 - RNA, 22 nt, Human
ccaggcucaccuggagccccug

SEQ ID NO: 1094915 - RNA, 22 nt, Human
uuugaaacucugaacauguuuc

SEQ ID NO: 1094916 - RNA, 22 nt, Human
uacacacaugcauuugccuuau

SEQ ID NO: 1094917 - RNA, 22 nt, Human
cccuggcaugcaugucccuggc

SEQ ID NO: 1094918 - RNA, 22 nt, Human
uggcagagaacacacaugauuc

SEQ ID NO: 1094919 - RNA, 22 nt, Human
auuuccaugccuuagcuuaagg

SEQ ID NO: 1094920 - RNA, 22 nt, Human
cagccugacuauggcugcaggu

SEQ ID NO: 1094921 - RNA, 22 nt, Human
uccaggaacucuugauggugau

SEQ ID NO: 1094922 - RNA, 22 nt, Human
ucaaauaccagcuuuuccagaa

SEQ ID NO: 1094923 - RNA, 22 nt, Human
uuucuaaaugguggcugcauug

SEQ ID NO: 1094924 - RNA, 22 nt, Human
aggcccaguuauccuacuuguu

SEQ ID NO: 1094925 - RNA, 22 nt, Human
ucagggcacguuucugcaaugc

SEQ ID NO: 1094926 - RNA, 22 nt, Human
ucaggauguccaaaauccagcc

SEQ ID NO: 1094927 - RNA, 22 nt, Human
gggcagagaaauggacaguugg

SEQ ID NO: 1094928 - RNA, 22 nt, Human
guuuuauuuccaugagagaccg

SEQ ID NO: 1094929 - RNA, 22 nt, Human
ucacagaauaaauguacuggcc

SEQ ID NO: 1094930 - RNA, 22 nt, Human
uucuuaacucaaauauauaucc

SEQ ID NO: 1094931 - RNA, 23 nt, Human
cuccaaggcccaacugucuaggc

SEQ ID NO: 1094932 - RNA, 22 nt, Human
caggaaccuaaagagacauuac

SEQ ID NO: 1094933 - RNA, 22 nt, Human
uggcccucugcaagauucugga

SEQ ID NO: 1094934 - RNA, 23 nt, Human
aguacaauaaguauaauucuuuc

SEQ ID NO: 1094935 - RNA, 22 nt, Human
uauccauggccaaucaaauaca

SEQ ID NO: 1094936 - RNA, 22 nt, Human
aguucugggaaaaacauggcca

SEQ ID NO: 1094937 - RNA, 22 nt, Human
uuuaugccuccagaucuugcuu

SEQ ID NO: 1094938 - RNA, 22 nt, Human
cccuuuaauuccaacacaggaa

SEQ ID NO: 1094939 - RNA, 22 nt, Human
uucaauucugcucugaucuuag

SEQ ID NO: 1094940 - RNA, 22 nt, Human
cuggucagggcucuuugggagc

SEQ ID NO: 1094941 - RNA, 22 nt, Human
uggccugaggcucggcaugggu

SEQ ID NO: 1094942 - RNA, 22 nt, Human
ggagccagggaagcugcuuccu

SEQ ID NO: 1094943 - RNA, 23 nt, Human
ucugcuggugacacggucacauu

SEQ ID NO: 1094944 - RNA, 22 nt, Human
ggcuggcaagugucugcucaug

SEQ ID NO: 1094945 - RNA, 22 nt, Human
ccacagcuccucagccucuuuc

SEQ ID NO: 1094946 - RNA, 20 nt, Human
cauauauaccuagaagugga

SEQ ID NO: 1094947 - RNA, 22 nt, Human
ucaagcuggcuguugcuauuuc

SEQ ID NO: 1094948 - RNA, 22 nt, Human
augacaaacccaggauguaaca

SEQ ID NO: 1094949 - RNA, 22 nt, Human
aaagcccauguggaaguacagg

SEQ ID NO: 1094950 - RNA, 22 nt, Human
gugcagguguuuuggcugccag

SEQ ID NO: 1094951 - RNA, 22 nt, Human
ucagaggagaugguuaccaggg

SEQ ID NO: 1094952 - RNA, 22 nt, Human
ucagaauuggacaauagaagca

SEQ ID NO: 1094953 - RNA, 22 nt, Human
ugccuagcauaguauuugucac

SEQ ID NO: 1094954 - RNA, 22 nt, Human
uucuuaaaacuuauggacaggu

SEQ ID NO: 1094955 - RNA, 22 nt, Human
ugcugucuguuuacuggcuaua

SEQ ID NO: 1094956 - RNA, 22 nt, Human
uagcagcaaagcaggaucugcu

SEQ ID NO: 1094957 - RNA, 22 nt, Human
agcuggcauucuccuuguuauu

SEQ ID NO: 1094958 - RNA, 22 nt, Human
uggaggaaguggacaguugugu

SEQ ID NO: 1094959 - RNA, 21 nt, Human
gugcucugggcagcagagggc

SEQ ID NO: 1094960 - RNA, 22 nt, Human
auagaauuugcacuaaaucugc

SEQ ID NO: 1094961 - RNA, 22 nt, Human
aggcugagguaggaggaucgcu

SEQ ID NO: 1094962 - RNA, 22 nt, Human
aucaggaaugaauacuuuugga

SEQ ID NO: 1094963 - RNA, 22 nt, Human
uccaaauucuagggccuugguu

SEQ ID NO: 1094964 - RNA, 22 nt, Human
gcuggcagagcucugggcuggg

SEQ ID NO: 1094965 - RNA, 22 nt, Human
uuacuuuaagggugucuuauua

SEQ ID NO: 1094966 - RNA, 23 nt, Human
uagaacaucggugucuuggagca

SEQ ID NO: 1094967 - RNA, 22 nt, Human
ugcaauuuuaauacauuagagg

SEQ ID NO: 1094968 - RNA, 22 nt, Human
ggccaggcuggucucagacuuc

SEQ ID NO: 1094969 - RNA, 22 nt, Human
aggagcugcauggauaccuggu

SEQ ID NO: 1094970 - RNA, 22 nt, Human
agcaacuauauugaaagccacc

SEQ ID NO: 1094971 - RNA, 22 nt, Human
uuaaaugaugcauaucauuuag

SEQ ID NO: 1094972 - RNA, 22 nt, Human
cugaggaugguguggucuucuc

SEQ ID NO: 1094973 - RNA, 22 nt, Human
uuccagaggggagguggcagcc

SEQ ID NO: 1094974 - RNA, 22 nt, Human
acagagcaugcucaguguguga

SEQ ID NO: 1094975 - RNA, 22 nt, Human
aggcagcccacaggacacagga

SEQ ID NO: 1094976 - RNA, 22 nt, Human
gcuuccaaaucuguucaaaaug

SEQ ID NO: 1094977 - RNA, 22 nt, Human
cuuacauuuaaucaugugucau

SEQ ID NO: 1094978 - RNA, 22 nt, Human
gauuuuaauuauaggagguccu

SEQ ID NO: 1094979 - RNA, 22 nt, Human
cugccugcugacauucuuuaua

SEQ ID NO: 1094980 - RNA, 22 nt, Human
aggcgcagacauacagggucug

SEQ ID NO: 1094981 - RNA, 22 nt, Human
uugcccagagcugccuguuaca

SEQ ID NO: 1094982 - RNA, 22 nt, Human
gugugccaggaacuggcugcug

SEQ ID NO: 1094983 - RNA, 22 nt, Human
acagcacaggaguugaaugggc

SEQ ID NO: 1094984 - RNA, 22 nt, Human
accaaggaagaaucuauuugag

SEQ ID NO: 1094985 - RNA, 22 nt, Human
caguauagaaaguuuuaaauug

SEQ ID NO: 1094986 - RNA, 22 nt, Human
ucaguguuucaguuuggaaaug

SEQ ID NO: 1094987 - RNA, 22 nt, Human
cagcuguggagggaggaaaugc

SEQ ID NO: 1094988 - RNA, 22 nt, Human
cagucccuaguggagcucacag

SEQ ID NO: 1094989 - RNA, 21 nt, Human
acaguuuauuagaguaagugc

SEQ ID NO: 1094990 - RNA, 17 nt, Human
ggagcagauccaccauu

SEQ ID NO: 1094991 - RNA, 22 nt, Human
gcucuggacuggggccugagaa

SEQ ID NO: 1094992 - RNA, 22 nt, Human
uacacaguauaugggaucacag

SEQ ID NO: 1094993 - RNA, 21 nt, Human
aucuuaaaaggucuuaacuuu

SEQ ID NO: 1094994 - RNA, 22 nt, Human
auggcagauggcuggagcaggu

SEQ ID NO: 1094995 - RNA, 22 nt, Human
uguaacauauguaaaagcaccu

SEQ ID NO: 1094996 - RNA, 22 nt, Human
uacaaagucacauugaaaugaa

SEQ ID NO: 1094997 - RNA, 22 nt, Human
ugggaaagucuuuauuucucuu

SEQ ID NO: 1094998 - RNA, 22 nt, Human
aaaaguauuuugagcacuuuau

SEQ ID NO: 1094999 - RNA, 22 nt, Human
gccagggggucagcaggcacuu

SEQ ID NO: 1095000 - RNA, 22 nt, Human
uggugccaucauagcucacugc

SEQ ID NO: 1095001 - RNA, 22 nt, Human
uucugagacaauugagagucua

SEQ ID NO: 1095002 - RNA, 22 nt, Human
cacccaggcuagagugcagugg

SEQ ID NO: 1095003 - RNA, 21 nt, Human
gagugggcugagauggggcug

SEQ ID NO: 1095004 - RNA, 18 nt, Human
agcaggcguugccuggga

SEQ ID NO: 1095005 - RNA, 22 nt, Human
ugccugucuuggaguccuggcc

SEQ ID NO: 1095006 - RNA, 22 nt, Human
ugggagugaggcagagucuauc

SEQ ID NO: 1095007 - RNA, 23 nt, Human
ucuucagugagaccagcaaggcc

SEQ ID NO: 1095008 - RNA, 22 nt, Human
ggcugccagugagugcagaccg

SEQ ID NO: 1095009 - RNA, 18 nt, Human
ugcuuuaugcuuauauaa

SEQ ID NO: 1095010 - RNA, 18 nt, Human
caggagcaggaguugaac

SEQ ID NO: 1095011 - RNA, 20 nt, Human
ucucugcuguccacauuugc

SEQ ID NO: 1095012 - RNA, 22 nt, Human
ccuggagcccaaggcagugaga

SEQ ID NO: 1095013 - RNA, 22 nt, Human
uuugucaaucccuugaaaaccu

SEQ ID NO: 1095014 - RNA, 16 nt, Human
agaggccuugaggaag

SEQ ID NO: 1095015 - RNA, 22 nt, Human
cauguucuaacaaugagaaacc

SEQ ID NO: 1095016 - RNA, 22 nt, Human
aguaggcauagaaagaagcacc

SEQ ID NO: 1095017 - RNA, 20 nt, Human
ucacuguaauugccuacauu

SEQ ID NO: 1095018 - RNA, 17 nt, Human
gccaaaggguuccaauc

SEQ ID NO: 1095019 - RNA, 23 nt, Human
ugggaguguugggaucucugcuc

SEQ ID NO: 1095020 - RNA, 22 nt, Human
uguuuccaaaugguauaaagac

SEQ ID NO: 1095021 - RNA, 22 nt, Human
uccauuuuagagaugaagaaac

SEQ ID NO: 1095022 - RNA, 20 nt, Human
ugcuuugauggaaauacagc

SEQ ID NO: 1095023 - RNA, 19 nt, Human
gaauuauuuuuaugggaug

SEQ ID NO: 1095024 - RNA, 22 nt, Human
caauuucaagauucuguucuuu

SEQ ID NO: 1095025 - RNA, 22 nt, Human
cccuuuaaggaaaggaaggaug

SEQ ID NO: 1095026 - RNA, 22 nt, Human
gcagauggcagcccaggcuggg

SEQ ID NO: 1095027 - RNA, 19 nt, Human
ucuguucacauuguuucgc

SEQ ID NO: 1095028 - RNA, 23 nt, Human
uggcucugagcuuccugguggcc

SEQ ID NO: 1095029 - RNA, 22 nt, Human
ccuguucuguuaauuaaacuuu

SEQ ID NO: 1095030 - RNA, 22 nt, Human
augacagaaggccucccugaca

SEQ ID NO: 1095031 - RNA, 22 nt, Human
ugggagcccaagggagcugccg

SEQ ID NO: 1095032 - RNA, 22 nt, Human
ggugaaggucagagcaggaaaa

SEQ ID NO: 1095033 - RNA, 22 nt, Human
uggcugggcccccaccugccuc

SEQ ID NO: 1095034 - RNA, 18 nt, Human
ucccucagaauuauagaa

SEQ ID NO: 1095035 - RNA, 22 nt, Human
uggugagacaggaucaaccccu

SEQ ID NO: 1095036 - RNA, 22 nt, Human
auucuucacuguuucagaauga

SEQ ID NO: 1095037 - RNA, 22 nt, Human
cggcagcaaaggaagccagguc

SEQ ID NO: 1095038 - RNA, 22 nt, Human
uuggcucaccugucuacccaga

SEQ ID NO: 1095039 - RNA, 22 nt, Human
ucacagcuuucagauuguuccc

SEQ ID NO: 1095040 - RNA, 22 nt, Human
cagagacauguggccugcacgu

SEQ ID NO: 1095041 - RNA, 22 nt, Human
ugcccccuuuucuuguuacacu

SEQ ID NO: 1095042 - RNA, 22 nt, Human
aaagacauuagcuuagauguca

SEQ ID NO: 1095043 - RNA, 22 nt, Human
aaugauuggcacuagauacaca

SEQ ID NO: 1095044 - RNA, 22 nt, Human
ucaacauuggaggcaacauuca

SEQ ID NO: 1095045 - RNA, 22 nt, Human
acaucagacaauuaauuauuaa

SEQ ID NO: 1095046 - RNA, 22 nt, Human
gaugggaggaaccugggucccu

SEQ ID NO: 1095047 - RNA, 20 nt, Human
uauucaacuuuaaaaacuua

SEQ ID NO: 1095048 - RNA, 22 nt, Human
cuuacauugucuuaguuuucaa

SEQ ID NO: 1095049 - RNA, 22 nt, Human
auuuccaacuaccccuccauuu

SEQ ID NO: 1095050 - RNA, 23 nt, Human
agaugaggcuucuccauguuggu

SEQ ID NO: 1095051 - RNA, 22 nt, Human
gugagacucgccuuuguguagc

SEQ ID NO: 1095052 - RNA, 22 nt, Human
aacauuuccggccuuuuguucu

SEQ ID NO: 1095053 - RNA, 22 nt, Human
auacacugguuuaugauauugu

SEQ ID NO: 1095054 - RNA, 22 nt, Human
cgagaguggacagggcgcagcu

SEQ ID NO: 1095055 - RNA, 22 nt, Human
aucaggauggguuuggcuuagg

SEQ ID NO: 1095056 - RNA, 20 nt, Human
aucuggcucagauccugcag

SEQ ID NO: 1095057 - RNA, 22 nt, Human
agaggcugugcagagggagugc

SEQ ID NO: 1095058 - RNA, 22 nt, Human
aggugaguugguaggaaguuug

SEQ ID NO: 1095059 - RNA, 22 nt, Human
cuauacacuuuuugaaaauaga

SEQ ID NO: 1095060 - RNA, 22 nt, Human
cagagcccagggccuacguccc

SEQ ID NO: 1095061 - RNA, 22 nt, Human
caucaaaauuagacauuguuga

SEQ ID NO: 1095062 - RNA, 22 nt, Human
augauucaggauugaaccauuu

SEQ ID NO: 1095063 - RNA, 22 nt, Human
augaaguuccaguauaugcagu

SEQ ID NO: 1095064 - RNA, 22 nt, Human
agggcugccauuucuggcccaa

SEQ ID NO: 1095065 - RNA, 22 nt, Human
ucacacagcuccuuuccuuagu

SEQ ID NO: 1095066 - RNA, 22 nt, Human
aacauuuacaaauccuucugca

SEQ ID NO: 1095067 - RNA, 22 nt, Human
uucacaucucagcacugccucu

SEQ ID NO: 1095068 - RNA, 22 nt, Human
gggaggucagggugccugcugg

SEQ ID NO: 1095069 - RNA, 23 nt, Human
cacaacuaaucagaaucucuagg

SEQ ID NO: 1095070 - RNA, 19 nt, Human
aggaaagguggccuuagca

SEQ ID NO: 1095071 - RNA, 22 nt, Human
ggcccuguccuggcugucuccg

SEQ ID NO: 1095072 - RNA, 20 nt, Human
gaggcugcggacugcuggac

SEQ ID NO: 1095073 - RNA, 22 nt, Human
ucuaggagcuuaaaggaggcca

SEQ ID NO: 1095074 - RNA, 22 nt, Human
gggagagaugcugauugccaau

SEQ ID NO: 1095075 - RNA, 22 nt, Human
uagcuagaaugcuucgugauau

SEQ ID NO: 1095076 - RNA, 22 nt, Human
gcugccugaaugaaccuuguuc

SEQ ID NO: 1095077 - RNA, 20 nt, Human
ugggccugagccugugggcu

SEQ ID NO: 1095078 - RNA, 22 nt, Human
ggcagcaagcagaaguucuaug

SEQ ID NO: 1095079 - RNA, 22 nt, Human
uccuaagauagaagauagugaa

SEQ ID NO: 1095080 - RNA, 22 nt, Human
ggcagguggcacugcugcuccc

SEQ ID NO: 1095081 - RNA, 23 nt, Human
ucugucaccuauggcugcucuuc

SEQ ID NO: 1095082 - RNA, 22 nt, Human
acauucuuccagcuggcuguug

SEQ ID NO: 1095083 - RNA, 22 nt, Human
ucacugcagagaccucuaguca

SEQ ID NO: 1095084 - RNA, 22 nt, Human
ugcagggaaugcuugcagcaug

SEQ ID NO: 1095085 - RNA, 22 nt, Human
gggcugagugggccucuuacuu

SEQ ID NO: 1095086 - RNA, 22 nt, Human
ucuggaguugagagugugcgag

SEQ ID NO: 1095087 - RNA, 22 nt, Human
ccagaggcauguucaaagcaau

SEQ ID NO: 1095088 - RNA, 22 nt, Human
gucagcuagaggaugugacauu

SEQ ID NO: 1095089 - RNA, 22 nt, Human
gaguggagaucgugccacugca

SEQ ID NO: 1095090 - RNA, 22 nt, Human
auguuucaaugcacuuuagccu

SEQ ID NO: 1095091 - RNA, 22 nt, Human
ggagggacccacucuagaggug

SEQ ID NO: 1095092 - RNA, 22 nt, Human
guucuucaggcugugcucuaga

SEQ ID NO: 1095093 - RNA, 22 nt, Human
uaagugcaauguuuuacuuaaa

SEQ ID NO: 1095094 - RNA, 17 nt, Human
ggcagggugcuggguau

SEQ ID NO: 1095095 - RNA, 22 nt, Human
gaaagcuuccauuuuguacauu

SEQ ID NO: 1095096 - RNA, 22 nt, Human
auguguuaguuugugauuauac

SEQ ID NO: 1095097 - RNA, 22 nt, Human
ggcccagaagccagaagccucc

SEQ ID NO: 1095098 - RNA, 22 nt, Human
acagaggccgccucucucacgg

SEQ ID NO: 1095099 - RNA, 22 nt, Human
acaggcugccuaccaaguauca

SEQ ID NO: 1095100 - RNA, 22 nt, Human
cagaggcacaagaaagcaaggc

SEQ ID NO: 1095101 - RNA, 22 nt, Human
uuacagauguuucaggaauacu

SEQ ID NO: 1095102 - RNA, 22 nt, Human
uucauuccuucccuaagcaacu

SEQ ID NO: 1095103 - RNA, 22 nt, Human
uggcacuggaaucguagccuug

SEQ ID NO: 1095104 - RNA, 22 nt, Human
cggggcaggagucccuguagag

SEQ ID NO: 1095105 - RNA, 22 nt, Human
uagacaaaagggggcagauaug

SEQ ID NO: 1095106 - RNA, 20 nt, Human
agggacacaauauuucugug

SEQ ID NO: 1095107 - RNA, 22 nt, Human
caaggccauaagagauacaaaa

SEQ ID NO: 1095108 - RNA, 22 nt, Human
agccccugggaguagcugcugc

SEQ ID NO: 1095109 - RNA, 22 nt, Human
uagacacaucuucauccacaau

SEQ ID NO: 1095110 - RNA, 22 nt, Human
ggcagggagagcaugcugauaa

SEQ ID NO: 1095111 - RNA, 19 nt, Human
acacagggcuagaguuaca

SEQ ID NO: 1095112 - RNA, 22 nt, Human
ggcugggucccagcugggagga

SEQ ID NO: 1095113 - RNA, 22 nt, Human
gccugggagugcacagugaggu

SEQ ID NO: 1095114 - RNA, 22 nt, Human
ggcagugaaugaaacagaggcu

SEQ ID NO: 1095115 - RNA, 19 nt, Human
uggaacacucaaacugggu

SEQ ID NO: 1095116 - RNA, 22 nt, Human
acccagggaccccgcugacgcc

SEQ ID NO: 1095117 - RNA, 22 nt, Human
ggguggcagcuguugccaaggu

SEQ ID NO: 1095118 - RNA, 22 nt, Human
agguggagaagagaugggcagu

SEQ ID NO: 1095119 - RNA, 20 nt, Human
uugaggcaugucuagaagua

SEQ ID NO: 1095120 - RNA, 22 nt, Human
gacaauaagaacagauacugug

SEQ ID NO: 1095121 - RNA, 22 nt, Human
ugguucaggcaggguguugcug

SEQ ID NO: 1095122 - RNA, 22 nt, Human
uuauacuaaaacgcauugaauu

SEQ ID NO: 1095123 - RNA, 21 nt, Human
uggaccuguccuucucgcugu

SEQ ID NO: 1095124 - RNA, 22 nt, Human
uucaacauuacacaggcaauuc

SEQ ID NO: 1095125 - RNA, 22 nt, Human
ccuuuucuugccacugacucgg

SEQ ID NO: 1095126 - RNA, 22 nt, Human
caggggcugagaaggaacgucc

SEQ ID NO: 1095127 - RNA, 22 nt, Human
aguucugguugcccaugacauc

SEQ ID NO: 1095128 - RNA, 22 nt, Human
aacugaaacuuaggaaguaauc

SEQ ID NO: 1095129 - RNA, 22 nt, Human
agaguccacccuggggucaggc

SEQ ID NO: 1095130 - RNA, 22 nt, Human
caguuugucuugauucagaaca

SEQ ID NO: 1095131 - RNA, 22 nt, Human
ucaccacugaacagaccuuugg

SEQ ID NO: 1095132 - RNA, 22 nt, Human
cugggcuggguuuacccucuuc

SEQ ID NO: 1095133 - RNA, 22 nt, Human
ccuguucuguggcucucaaagg

SEQ ID NO: 1095134 - RNA, 22 nt, Human
aagagcugcacauauuuauauc

SEQ ID NO: 1095135 - RNA, 22 nt, Human
aauguuguguuucaguucaaga

SEQ ID NO: 1095136 - RNA, 20 nt, Human
acugagcugcauggagagga

SEQ ID NO: 1095137 - RNA, 22 nt, Human
uaaaguauauuuuuucucaaua

SEQ ID NO: 1095138 - RNA, 22 nt, Human
caggacagaaauaaggaauaua

SEQ ID NO: 1095139 - RNA, 22 nt, Human
cagggcuccccagagagccucu

SEQ ID NO: 1095140 - RNA, 20 nt, Human
gaagccagaggggaaaggag

SEQ ID NO: 1095141 - RNA, 22 nt, Human
aagcacaggggaaauaaguugu

SEQ ID NO: 1095142 - RNA, 22 nt, Human
ggccaggagauggacaccacau

SEQ ID NO: 1095143 - RNA, 22 nt, Human
ugugaaggcagcagcucugucc

SEQ ID NO: 1095144 - RNA, 22 nt, Human
aagucuggaagucucaguuuuc

SEQ ID NO: 1095145 - RNA, 22 nt, Human
cugugucggacgugggcagcag

SEQ ID NO: 1095146 - RNA, 22 nt, Human
uggcaggagccugcggggaggu

SEQ ID NO: 1095147 - RNA, 22 nt, Human
ggacaugaagcaaaaugggagg

SEQ ID NO: 1095148 - RNA, 22 nt, Human
auaauaauacugugcaauggau

SEQ ID NO: 1095149 - RNA, 22 nt, Human
aauauuuauauuucucuucccu

SEQ ID NO: 1095150 - RNA, 22 nt, Human
uuuguggcaggagcggagaccg

SEQ ID NO: 1095151 - RNA, 22 nt, Human
guuacaaaggucauaaaagugu

SEQ ID NO: 1095152 - RNA, 22 nt, Human
cagguggggcgcccucaggcag

SEQ ID NO: 1095153 - RNA, 22 nt, Human
cauucugacccuaugauuuaag

SEQ ID NO: 1095154 - RNA, 22 nt, Human
agccagcuggagaccacuguuu

SEQ ID NO: 1095155 - RNA, 22 nt, Human
aaucaagaggcgauggauggaa

SEQ ID NO: 1095156 - RNA, 22 nt, Human
uuucacaggaauacccggcuuu

SEQ ID NO: 1095157 - RNA, 22 nt, Human
ugcagcauuauucacaguagcc

SEQ ID NO: 1095158 - RNA, 22 nt, Human
cacuggugucugagcaggguga

SEQ ID NO: 1095159 - RNA, 22 nt, Human
cauggcagagaaggggaacugg

SEQ ID NO: 1095160 - RNA, 21 nt, Human
uggccucccacacuuccaugg

SEQ ID NO: 1095161 - RNA, 22 nt, Human
ccacugccgugggccuugggga

SEQ ID NO: 1095162 - RNA, 22 nt, Human
ccagcugguaagugauggagcc

SEQ ID NO: 1095163 - RNA, 22 nt, Human
ggagaugcuuuccaguggggau

SEQ ID NO: 1095164 - RNA, 22 nt, Human
aggagaaguaaggcuagaugau

SEQ ID NO: 1095165 - RNA, 22 nt, Human
acaugccagaacuuguaccaau

SEQ ID NO: 1095166 - RNA, 22 nt, Human
acugaugucuggggcagagucu

SEQ ID NO: 1095167 - RNA, 22 nt, Human
acauuucagaaucacacagcuu

SEQ ID NO: 1095168 - RNA, 22 nt, Human
cugcugcugagagcucagccug

SEQ ID NO: 1095169 - RNA, 19 nt, Human
aaagugauuuuuucuggca

SEQ ID NO: 1095170 - RNA, 22 nt, Human
uggggcucuccacagugucuca

SEQ ID NO: 1095171 - RNA, 22 nt, Human
acccucagaguaggcacugcug

SEQ ID NO: 1095172 - RNA, 22 nt, Human
ucaccaggcuccuguuaagaug

SEQ ID NO: 1095173 - RNA, 22 nt, Human
aagggcugcauuugauguguca

SEQ ID NO: 1095174 - RNA, 22 nt, Human
caggaacauuguagaauugaaa

SEQ ID NO: 1095175 - RNA, 22 nt, Human
cuaauacucauuucuguaacuc

SEQ ID NO: 1095176 - RNA, 22 nt, Human
uuuagacauuugugguuugcaa

SEQ ID NO: 1095177 - RNA, 22 nt, Human
caaaguuuggcucucaugacau

SEQ ID NO: 1095178 - RNA, 22 nt, Human
acagcuguggccacuugcaucc

SEQ ID NO: 1095179 - RNA, 22 nt, Human
ucaaugauaguacaaucagccu

SEQ ID NO: 1095180 - RNA, 23 nt, Human
ugaaacauuuaggguagaauuuc

SEQ ID NO: 1095181 - RNA, 22 nt, Human
caggagcagaggguggucagca

SEQ ID NO: 1095182 - RNA, 22 nt, Human
aagcagccuggacuugggcugg

SEQ ID NO: 1095183 - RNA, 22 nt, Human
acagugauucugcaaaccauau

SEQ ID NO: 1095184 - RNA, 22 nt, Human
agggcugagcccaggcauguag

SEQ ID NO: 1095185 - RNA, 22 nt, Human
gggcagguuauuggaguaggga

SEQ ID NO: 1095186 - RNA, 22 nt, Human
gaagagcuguagccugcucuuu

SEQ ID NO: 1095187 - RNA, 22 nt, Human
gcccagggcugcaaguggacgc

SEQ ID NO: 1095188 - RNA, 18 nt, Human
ggagacuaaacuguugac

SEQ ID NO: 1095189 - RNA, 22 nt, Human
ccucaggggucacugugaggag

SEQ ID NO: 1095190 - RNA, 22 nt, Human
cuauuuguaagagccccacacc

SEQ ID NO: 1095191 - RNA, 22 nt, Human
ggaagccacccagcuuugauag

SEQ ID NO: 1095192 - RNA, 22 nt, Human
gcuggugcauuagcugcaguuc

SEQ ID NO: 1095193 - RNA, 21 nt, Human
ucuugauuauuggccucacac

SEQ ID NO: 1095194 - RNA, 22 nt, Human
ucagaagcaaacaucacucuag

SEQ ID NO: 1095195 - RNA, 22 nt, Human
agggucugacugaauggaaaag

SEQ ID NO: 1095196 - RNA, 22 nt, Human
ggugggcaggcgaggcccaggu

SEQ ID NO: 1095197 - RNA, 22 nt, Human
cagcagugcuucagugugagau

SEQ ID NO: 1095198 - RNA, 22 nt, Human
cugcagugcaagcccagaugga

SEQ ID NO: 1095199 - RNA, 20 nt, Human
acuuucucgguuucucaccu

SEQ ID NO: 1095200 - RNA, 18 nt, Human
uuacuguuaucaaaacag

SEQ ID NO: 1095201 - RNA, 22 nt, Human
cugaggcuggcguuugaggaag

SEQ ID NO: 1095202 - RNA, 22 nt, Human
agaauuagaggccauguacuug

SEQ ID NO: 1095203 - RNA, 22 nt, Human
ggcacagggaggcccuggugug

SEQ ID NO: 1095204 - RNA, 22 nt, Human
uccugucuaaagaccugcaggc

SEQ ID NO: 1095205 - RNA, 22 nt, Human
cuuauuuuaagucaguuugggu

SEQ ID NO: 1095206 - RNA, 22 nt, Human
uggcacugagcagccgcggcag

SEQ ID NO: 1095207 - RNA, 22 nt, Human
uggcugcuuguuuuagugaggc

SEQ ID NO: 1095208 - RNA, 22 nt, Human
uuguaagacuguagaaugcaaa

SEQ ID NO: 1095209 - RNA, 22 nt, Human
gagaaccucuccacaagucugg

SEQ ID NO: 1095210 - RNA, 22 nt, Human
uaaguccacaggcugacagcgg

SEQ ID NO: 1095211 - RNA, 22 nt, Human
auagaauaugacuuuuagaucc

SEQ ID NO: 1095212 - RNA, 22 nt, Human
ucaguucuaagugcuuuacaug

SEQ ID NO: 1095213 - RNA, 22 nt, Human
ccagccagcugcccuuggggcc

SEQ ID NO: 1095214 - RNA, 22 nt, Human
aacacuuuuuauauauuguauc

SEQ ID NO: 1095215 - RNA, 22 nt, Human
uuggaccauugaccugaucuac

SEQ ID NO: 1095216 - RNA, 22 nt, Human
auucuuaauuccaaagacugag

SEQ ID NO: 1095217 - RNA, 22 nt, Human
uuuauggcacacaaauaucaaa

SEQ ID NO: 1095218 - RNA, 22 nt, Human
aaaucgcuugaacccaggaagu

SEQ ID NO: 1095219 - RNA, 22 nt, Human
uguggccucucaggcuugauca

SEQ ID NO: 1095220 - RNA, 22 nt, Human
aaagcaugacucaagaauuacu

SEQ ID NO: 1095221 - RNA, 22 nt, Human
cuuguguggucuggucuugcua

SEQ ID NO: 1095222 - RNA, 22 nt, Human
ggcugagccaugggcacugcag

SEQ ID NO: 1095223 - RNA, 22 nt, Human
ggucucagacuggcaggcagug

SEQ ID NO: 1095224 - RNA, 22 nt, Human
ugugaaauauuggcaauuucau

SEQ ID NO: 1095225 - RNA, 22 nt, Human
caugggaggucugcaaggugcu

SEQ ID NO: 1095226 - RNA, 22 nt, Human
agcccuagagcuggaggucagu

SEQ ID NO: 1095227 - RNA, 22 nt, Human
uuuaggaauauuuucuuucagg

SEQ ID NO: 1095228 - RNA, 22 nt, Human
caggaaauaucuccuggcagag

SEQ ID NO: 1095229 - RNA, 22 nt, Human
acaaauuugaauccugacuucu

SEQ ID NO: 1095230 - RNA, 22 nt, Human
ggcagcaguccauggcccaagg

SEQ ID NO: 1095231 - RNA, 22 nt, Human
cgcugggggaacagcgagggug

SEQ ID NO: 1095232 - RNA, 22 nt, Human
gcugcuggaagcaugcgaugaa

SEQ ID NO: 1095233 - RNA, 22 nt, Human
ugacacaggcagcucccagcac

SEQ ID NO: 1095234 - RNA, 22 nt, Human
guggccucuguuggcuccuagg

SEQ ID NO: 1095235 - RNA, 22 nt, Human
gggcacagagggucuugaagaa

SEQ ID NO: 1095236 - RNA, 22 nt, Human
cugugacuagaccugcaggaga

SEQ ID NO: 1095237 - RNA, 20 nt, Human
ugauuucucuucuauuccuu

SEQ ID NO: 1095238 - RNA, 22 nt, Human
aagauuucugcuccugagagaa

SEQ ID NO: 1095239 - RNA, 22 nt, Human
accaaggagaaggugcaagcuu

SEQ ID NO: 1095240 - RNA, 22 nt, Human
uuaaaaaccaucuuccuuuccu

SEQ ID NO: 1095241 - RNA, 22 nt, Human
uuaugauuugccacagauuggu

SEQ ID NO: 1095242 - RNA, 21 nt, Human
gugcuuuuccuuaauguucuu

SEQ ID NO: 1095243 - RNA, 18 nt, Human
gacuuuaaaacacugcuc

SEQ ID NO: 1095244 - RNA, 22 nt, Human
ucagcucacucugcuuccuggg

SEQ ID NO: 1095245 - RNA, 22 nt, Human
gcugugugcucacguaguggaa

SEQ ID NO: 1095246 - RNA, 22 nt, Human
acagagaucagaggcauaagca

SEQ ID NO: 1095247 - RNA, 22 nt, Human
uuuguaaaaggaggaagcaugg

SEQ ID NO: 1095248 - RNA, 22 nt, Human
acuagaaagaaguuuuuugaga

SEQ ID NO: 1095249 - RNA, 22 nt, Human
ccccuuccaggaagcagaaucg

SEQ ID NO: 1095250 - RNA, 21 nt, Human
agcuuugcuuuguacucauuu

SEQ ID NO: 1095251 - RNA, 22 nt, Human
uaaaggaaucaguuuuagagau

SEQ ID NO: 1095252 - RNA, 22 nt, Human
ucuugaaaguaucuuauuuugu

SEQ ID NO: 1095253 - RNA, 22 nt, Human
ucuuugaugcuucugaaggugu

SEQ ID NO: 1095254 - RNA, 22 nt, Human
cugugcuuaccugcccagguga

SEQ ID NO: 1095255 - RNA, 22 nt, Human
gggacaggcugagacuugagcu

SEQ ID NO: 1095256 - RNA, 22 nt, Human
uuguugcauuucaaguaugaga

SEQ ID NO: 1095257 - RNA, 22 nt, Human
gcaggcagagagggguuuccag

SEQ ID NO: 1095258 - RNA, 22 nt, Human
uuacauauuauccaaaacugcu

SEQ ID NO: 1095259 - RNA, 21 nt, Human
uacauugacuacaaauaaagc

SEQ ID NO: 1095260 - RNA, 22 nt, Human
gggcguggauggucagugcagg

SEQ ID NO: 1095261 - RNA, 22 nt, Human
uuugacaguaauaaagcacaag

SEQ ID NO: 1095262 - RNA, 22 nt, Human
ggcuuugacaugcugaauuaaa

SEQ ID NO: 1095263 - RNA, 22 nt, Human
ugcagcauucuuggccacuacu

SEQ ID NO: 1095264 - RNA, 22 nt, Human
cacgagaaccucucauuugauu

SEQ ID NO: 1095265 - RNA, 22 nt, Human
aggggcugggacagagccaagc

SEQ ID NO: 1095266 - RNA, 22 nt, Human
ggcuggccucaggguccucgcu

SEQ ID NO: 1095267 - RNA, 22 nt, Human
ugggaaagacucaggacaggag

SEQ ID NO: 1095268 - RNA, 22 nt, Human
gcccucagaggacagcugacuu

SEQ ID NO: 1095269 - RNA, 22 nt, Human
caugcuuaugauuugcuaagcc

SEQ ID NO: 1095270 - RNA, 22 nt, Human
agauguuuaaaaagaugacucu

SEQ ID NO: 1095271 - RNA, 18 nt, Human
ucaaagucuggcuccacu

SEQ ID NO: 1095272 - RNA, 22 nt, Human
aguaugaauggaaacuaccuau

SEQ ID NO: 1095273 - RNA, 23 nt, Human
ccagugauugccuggaaggaggu

SEQ ID NO: 1095274 - RNA, 22 nt, Human
uaucuuuaacuugcaguauuua

SEQ ID NO: 1095275 - RNA, 22 nt, Human
cuucacagaugcugagagggcu

SEQ ID NO: 1095276 - RNA, 22 nt, Human
cugccagcucaaagcgcagcua

SEQ ID NO: 1095277 - RNA, 22 nt, Human
caggcacuguguuaggcacugu

SEQ ID NO: 1095278 - RNA, 22 nt, Human
ccaggcucugagccucacucuu

SEQ ID NO: 1095279 - RNA, 22 nt, Human
uggcaagagcaaaauguacagu

SEQ ID NO: 1095280 - RNA, 22 nt, Human
caucaguguucacuauuccuuc

SEQ ID NO: 1095281 - RNA, 22 nt, Human
gcccagagagaugcuguagacc

SEQ ID NO: 1095282 - RNA, 22 nt, Human
caggauggagagugagggguca

SEQ ID NO: 1095283 - RNA, 22 nt, Human
gaggcagcugaagcuucaaaga

SEQ ID NO: 1095284 - RNA, 22 nt, Human
gcugccuugaacuuggccuggg

SEQ ID NO: 1095285 - RNA, 22 nt, Human
aagggaggccagagguuuugca

SEQ ID NO: 1095286 - RNA, 22 nt, Human
gcucugggaacugacugccuuc

SEQ ID NO: 1095287 - RNA, 22 nt, Human
cugcacugagcaucuaaccuua

SEQ ID NO: 1095288 - RNA, 22 nt, Human
aggaagaaccuaagaaagucuc

SEQ ID NO: 1095289 - RNA, 22 nt, Human
gaguuauuuguagggauuauau

SEQ ID NO: 1095290 - RNA, 22 nt, Human
augcccaggcccauaccuagau

SEQ ID NO: 1095291 - RNA, 22 nt, Human
aacugcuugagauauguuuguc

SEQ ID NO: 1095292 - RNA, 22 nt, Human
aggcccugggcaguucuguagc

SEQ ID NO: 1095293 - RNA, 22 nt, Human
aggcaagcauugggaacagggc

SEQ ID NO: 1095294 - RNA, 20 nt, Human
cucugcugcccgccggcugc

SEQ ID NO: 1095295 - RNA, 19 nt, Human
ugggcagguucaguaaugg

SEQ ID NO: 1095296 - RNA, 22 nt, Human
ucuacuuuauaaguauauaagu

SEQ ID NO: 1095297 - RNA, 22 nt, Human
guuuuccuucucagccauugcc

SEQ ID NO: 1095298 - RNA, 22 nt, Human
agccuggagguaaugaggaaac

SEQ ID NO: 1095299 - RNA, 22 nt, Human
cacagggcagaggguccguggc

SEQ ID NO: 1095300 - RNA, 22 nt, Human
agcuaggauaagcagagacugg

SEQ ID NO: 1095301 - RNA, 22 nt, Human
agacccugucaguguuaggaaa

SEQ ID NO: 1095302 - RNA, 22 nt, Human
ugaucagucccaugaucuucca

SEQ ID NO: 1095303 - RNA, 22 nt, Human
uucacauuugaaaggaaagaua

SEQ ID NO: 1095304 - RNA, 22 nt, Human
uuucccaggcuggaaugcagug

SEQ ID NO: 1095305 - RNA, 22 nt, Human
uggcagcacuugaacuugagcc

SEQ ID NO: 1095306 - RNA, 22 nt, Human
ucaccaggcaacuauguacucc

SEQ ID NO: 1095307 - RNA, 22 nt, Human
gucuaaacuuuacagagucaag

SEQ ID NO: 1095308 - RNA, 22 nt, Human
uuuaacauguaauugcugcuuu

SEQ ID NO: 1095309 - RNA, 22 nt, Human
aaaugguaaauuaguaguagcu

SEQ ID NO: 1095310 - RNA, 22 nt, Human
uuacaaagcgcuuuaccucuga

SEQ ID NO: 1095311 - RNA, 19 nt, Human
uacauuuguguacacuugu

SEQ ID NO: 1095312 - RNA, 22 nt, Human
agaaaguuaaacagugauaaga

SEQ ID NO: 1095313 - RNA, 22 nt, Human
gcaguggggaaugcuggggaga

SEQ ID NO: 1095314 - RNA, 22 nt, Human
cucuguccuugcacaguuccua

SEQ ID NO: 1095315 - RNA, 22 nt, Human
uguggcucuccuccugcugccc

SEQ ID NO: 1095316 - RNA, 22 nt, Human
aagaugauagaucugucaaugu

SEQ ID NO: 1095317 - RNA, 22 nt, Human
caauacugaguuuacauucauc

SEQ ID NO: 1095318 - RNA, 22 nt, Human
caacuauagggagagugguuaa

SEQ ID NO: 1095319 - RNA, 22 nt, Human
ccugcuggccacugcuccaccu

SEQ ID NO: 1095320 - RNA, 22 nt, Human
ugcucccaggcucuguggucug

SEQ ID NO: 1095321 - RNA, 22 nt, Human
caaagccaggcuuucuaaugua

SEQ ID NO: 1095322 - RNA, 22 nt, Human
uggccuggugucugcgaggccu

SEQ ID NO: 1095323 - RNA, 22 nt, Human
gaaagaagcuuuagauggcuau

SEQ ID NO: 1095324 - RNA, 17 nt, Human
auucucaguguacagug

SEQ ID NO: 1095325 - RNA, 22 nt, Human
ugcaugaugacuaaggugguga

SEQ ID NO: 1095326 - RNA, 22 nt, Human
ucagagucaacuguugccuguu

SEQ ID NO: 1095327 - RNA, 22 nt, Human
ccuggggaauagagucaagggg

SEQ ID NO: 1095328 - RNA, 22 nt, Human
aucuuuuuaucuguuuggaaca

SEQ ID NO: 1095329 - RNA, 22 nt, Human
aggcucauucuugccucugagc

SEQ ID NO: 1095330 - RNA, 22 nt, Human
cagaacagagucaaaaguaugu

SEQ ID NO: 1095331 - RNA, 18 nt, Human
caguuuuuauaucuggca

SEQ ID NO: 1095332 - RNA, 22 nt, Human
aguggguggcgcagaggaggaa

SEQ ID NO: 1095333 - RNA, 22 nt, Human
uugcaagguuucucucugccua

SEQ ID NO: 1095334 - RNA, 22 nt, Human
ucagcacugauguuucagaaga

SEQ ID NO: 1095335 - RNA, 22 nt, Human
guauuucuaguuucuuccacag

SEQ ID NO: 1095336 - RNA, 22 nt, Human
caguuacagcugcaccagagcc

SEQ ID NO: 1095337 - RNA, 22 nt, Human
uugcugaaaucuaugacauccu

SEQ ID NO: 1095338 - RNA, 22 nt, Human
ccagcucucagcgggagacuca

SEQ ID NO: 1095339 - RNA, 22 nt, Human
aaguguagauuauggagugucu

SEQ ID NO: 1095340 - RNA, 22 nt, Human
cucugggcugccuuuuagcucu

SEQ ID NO: 1095341 - RNA, 22 nt, Human
ucccucagcaggaacuggccug

SEQ ID NO: 1095342 - RNA, 22 nt, Human
gggaagagggagcuggaaugau

SEQ ID NO: 1095343 - RNA, 22 nt, Human
acacuuaaucuuacugaggauc

SEQ ID NO: 1095344 - RNA, 22 nt, Human
gugagggcagcuuggucagugu

SEQ ID NO: 1095345 - RNA, 21 nt, Human
cucuucaguggugagcucuuc

SEQ ID NO: 1095346 - RNA, 20 nt, Human
uugauucaagggcugaugga

SEQ ID NO: 1095347 - RNA, 22 nt, Human
agccuggaggaggaguugagca

SEQ ID NO: 1095348 - RNA, 20 nt, Human
ugaaaggugggaauuguggg

SEQ ID NO: 1095349 - RNA, 22 nt, Human
uccuggaggcaaaugaagacuc

SEQ ID NO: 1095350 - RNA, 22 nt, Human
gcagcuggagcaucuucucauc

SEQ ID NO: 1095351 - RNA, 22 nt, Human
caggcagagcaacugguccaga

SEQ ID NO: 1095352 - RNA, 22 nt, Human
auugagaaaggcuuauguuugc

SEQ ID NO: 1095353 - RNA, 22 nt, Human
auaucagacagaaagcauugac

SEQ ID NO: 1095354 - RNA, 22 nt, Human
gacuucuauuaauaccucuacu

SEQ ID NO: 1095355 - RNA, 22 nt, Human
aagagcugcaucuaagccauga

SEQ ID NO: 1095356 - RNA, 22 nt, Human
gcaccugggguacacagcuaca

SEQ ID NO: 1095357 - RNA, 22 nt, Human
agaaaucaugucuuauuucuau

SEQ ID NO: 1095358 - RNA, 22 nt, Human
ccugucugaggaggugcucuuu

SEQ ID NO: 1095359 - RNA, 22 nt, Human
cccagcucucgcacuuacuagc

SEQ ID NO: 1095360 - RNA, 22 nt, Human
gccuggagcagacgugucccgg

SEQ ID NO: 1095361 - RNA, 22 nt, Human
auuucucagugaaaugacaggc

SEQ ID NO: 1095362 - RNA, 20 nt, Human
aucaggauucuugcuuuguu

SEQ ID NO: 1095363 - RNA, 22 nt, Human
ccacugaaggucaacauagagc

SEQ ID NO: 1095364 - RNA, 22 nt, Human
gcugcugggucccucugugcca

SEQ ID NO: 1095365 - RNA, 22 nt, Human
guuucaaagucagaaaaggagg

SEQ ID NO: 1095366 - RNA, 22 nt, Human
aggccugcagcaggagcaaacc

SEQ ID NO: 1095367 - RNA, 22 nt, Human
cugaggccuaagacaugaauga

SEQ ID NO: 1095368 - RNA, 22 nt, Human
ccagggcacguugggacaguac

SEQ ID NO: 1095369 - RNA, 22 nt, Human
uccuuuccaugcuucuagaggc

SEQ ID NO: 1095370 - RNA, 22 nt, Human
uuaacagagaacauagaaguag

SEQ ID NO: 1095371 - RNA, 22 nt, Human
augucagauuccuaaauaucuu

SEQ ID NO: 1095372 - RNA, 22 nt, Human
aucuucccaggcuggggagagg

SEQ ID NO: 1095373 - RNA, 19 nt, Human
ccaggccaucccaguuccc

SEQ ID NO: 1095374 - RNA, 22 nt, Human
uggccuggcugcccugucugga

SEQ ID NO: 1095375 - RNA, 22 nt, Human
cuguggaagguuuagauaggua

SEQ ID NO: 1095376 - RNA, 22 nt, Human
aaagguuuuguucaucgauuuu

SEQ ID NO: 1095377 - RNA, 17 nt, Human
uagcugccccgaaugcu

SEQ ID NO: 1095378 - RNA, 22 nt, Human
ucaggcucucagaccaacagca

SEQ ID NO: 1095379 - RNA, 22 nt, Human
uguucuuaugaauucaagacac

SEQ ID NO: 1095380 - RNA, 22 nt, Human
ggagagcagggaggcugcucug

SEQ ID NO: 1095381 - RNA, 22 nt, Human
ucagggugaaccaggcaggaau

SEQ ID NO: 1095382 - RNA, 22 nt, Human
uagauggcaccuucuguguguc

SEQ ID NO: 1095383 - RNA, 22 nt, Human
aauucucagguaaaaguuaagu

SEQ ID NO: 1095384 - RNA, 22 nt, Human
agugaacaguuuggaacacaug

SEQ ID NO: 1095385 - RNA, 22 nt, Human
acuuuacauuugaucucucuaa

SEQ ID NO: 1095386 - RNA, 22 nt, Human
ccagggugaccagcuggccuag

SEQ ID NO: 1095387 - RNA, 22 nt, Human
cccaucaggaacccaggagccc

SEQ ID NO: 1095388 - RNA, 21 nt, Human
aagaggucaaauuauaaaugg

SEQ ID NO: 1095389 - RNA, 22 nt, Human
gaagaggaugacaggagccggu

SEQ ID NO: 1095390 - RNA, 22 nt, Human
gggaaacuggggacugaaucug

SEQ ID NO: 1095391 - RNA, 22 nt, Human
gaaauauugggacucagagcuu

SEQ ID NO: 1095392 - RNA, 22 nt, Human
uuucuaaguaaacacagcauac

SEQ ID NO: 1095393 - RNA, 15 nt, Human
gcccucaggcgacac

SEQ ID NO: 1095394 - RNA, 22 nt, Human
gccaccuggacagcugugcccu

SEQ ID NO: 1095395 - RNA, 22 nt, Human
gcugcugugccuggcguccugu

SEQ ID NO: 1095396 - RNA, 22 nt, Human
gcuggccugggcagccugucgg

SEQ ID NO: 1095397 - RNA, 22 nt, Human
aauauuucugcagaaugguuuu

SEQ ID NO: 1095398 - RNA, 22 nt, Human
uguuguagcuugacagcagcca

SEQ ID NO: 1095399 - RNA, 22 nt, Human
gggaccuggucuagcacugagc

SEQ ID NO: 1095400 - RNA, 22 nt, Human
cucaggcuugggaggaggccca

SEQ ID NO: 1095401 - RNA, 22 nt, Human
uuucuuuaucauagcaucuuug

SEQ ID NO: 1095402 - RNA, 22 nt, Human
ccagcccuucccaacuggccag

SEQ ID NO: 1095403 - RNA, 22 nt, Human
acagccagggcauugucgccga

SEQ ID NO: 1095404 - RNA, 22 nt, Human
aggugccagaugcacagcugaa

SEQ ID NO: 1095405 - RNA, 22 nt, Human
cugggcugcggugguagguugu

SEQ ID NO: 1095406 - RNA, 22 nt, Human
gaaguuagauguggucacugac

SEQ ID NO: 1095407 - RNA, 22 nt, Human
auaauacaugguuaaccucuuu

SEQ ID NO: 1095408 - RNA, 22 nt, Human
gggcugcacguauucugcucac

SEQ ID NO: 1095409 - RNA, 22 nt, Human
acaacuuugacccuuguucuua

SEQ ID NO: 1095410 - RNA, 22 nt, Human
gaggggcugggcagucccugga

SEQ ID NO: 1095411 - RNA, 22 nt, Human
ccuuuaaagacugcauaacuuc

SEQ ID NO: 1095412 - RNA, 22 nt, Human
cccugugccagagaggcaggag

SEQ ID NO: 1095413 - RNA, 22 nt, Human
uuacagauguaggaacugaagu

SEQ ID NO: 1095414 - RNA, 22 nt, Human
gaggccagaagucugagaucag

SEQ ID NO: 1095415 - RNA, 22 nt, Human
ccagauagaaaagaaggcagga

SEQ ID NO: 1095416 - RNA, 22 nt, Human
ccuucugcucccuggccagggc

SEQ ID NO: 1095417 - RNA, 22 nt, Human
aucuuucagggccauuuguauu

SEQ ID NO: 1095418 - RNA, 22 nt, Human
auucuaggcuugaaacaugaag

SEQ ID NO: 1095419 - RNA, 22 nt, Human
uccugggguccugacugcuucc

SEQ ID NO: 1095420 - RNA, 22 nt, Human
uggcccuguggaggucagugag

SEQ ID NO: 1095421 - RNA, 18 nt, Human
uguagaaaagauaggaau

SEQ ID NO: 1095422 - RNA, 22 nt, Human
ccugggagugucagacuugcuu

SEQ ID NO: 1095423 - RNA, 22 nt, Human
cacugaagccacuggaagagga

SEQ ID NO: 1095424 - RNA, 22 nt, Human
ugaaaucuuuaguuucuguccc

SEQ ID NO: 1095425 - RNA, 22 nt, Human
agggcugcuuugcuaaauaugg

SEQ ID NO: 1095426 - RNA, 22 nt, Human
gagacugauggggcucccagaa

SEQ ID NO: 1095427 - RNA, 22 nt, Human
acagcagugcacagagaacccu

SEQ ID NO: 1095428 - RNA, 22 nt, Human
ugcagcugguuuagaacuagau

SEQ ID NO: 1095429 - RNA, 22 nt, Human
ugcaggcuggcagauaucucau

SEQ ID NO: 1095430 - RNA, 22 nt, Human
cugcucuggcguacucggcauc

SEQ ID NO: 1095431 - RNA, 22 nt, Human
uguuuuaagagcgcacuuuaua

SEQ ID NO: 1095432 - RNA, 22 nt, Human
gagauuuucagcuugacuggga

SEQ ID NO: 1095433 - RNA, 22 nt, Human
cagggugccuguccucagcaaa

SEQ ID NO: 1095434 - RNA, 22 nt, Human
gaaggaagcugucuggaugugu

SEQ ID NO: 1095435 - RNA, 22 nt, Human
uucuggggacauaacaguaagc

SEQ ID NO: 1095436 - RNA, 22 nt, Human
ucagacuugacuuuguaaguuu

SEQ ID NO: 1095437 - RNA, 19 nt, Human
uagauaaggcauuuaaucu

SEQ ID NO: 1095438 - RNA, 22 nt, Human
aaagaaauagauggcauuuaaa

SEQ ID NO: 1095439 - RNA, 22 nt, Human
aaucuuucccuauuaaaugugg

SEQ ID NO: 1095440 - RNA, 22 nt, Human
aagcaaggcccagagcaucagc

SEQ ID NO: 1095441 - RNA, 21 nt, Human
ggagggcagcccagacuggcu

SEQ ID NO: 1095442 - RNA, 22 nt, Human
uugaagaggacuuugcagcugu

SEQ ID NO: 1095443 - RNA, 22 nt, Human
cuuuacauaaggauaaaccugg

SEQ ID NO: 1095444 - RNA, 22 nt, Human
gcagagucugggcagccuccau

SEQ ID NO: 1095445 - RNA, 22 nt, Human
ggugaggaauuggggacugacc

SEQ ID NO: 1095446 - RNA, 22 nt, Human
uuugcauuacuugacuuuaguu

SEQ ID NO: 1095447 - RNA, 20 nt, Human
ugacucugcaaccgucucuc

SEQ ID NO: 1095448 - RNA, 22 nt, Human
ugggaggagcccucugggaagg

SEQ ID NO: 1095449 - RNA, 22 nt, Human
cagagccaggucuaggagucuc

SEQ ID NO: 1095450 - RNA, 22 nt, Human
agugcaaagcagccuguacacc

SEQ ID NO: 1095451 - RNA, 21 nt, Human
cagcagaagcaucuauggaag

SEQ ID NO: 1095452 - RNA, 22 nt, Human
uuggaauugcuauugauaacaa

SEQ ID NO: 1095453 - RNA, 22 nt, Human
ugaagccaucccucagauggcc

SEQ ID NO: 1095454 - RNA, 22 nt, Human
guaagagcacugucuccugcug

SEQ ID NO: 1095455 - RNA, 22 nt, Human
agauacauuguucuaagcauug

SEQ ID NO: 1095456 - RNA, 23 nt, Human
auuuccuaaaagauaaucauuac

SEQ ID NO: 1095457 - RNA, 22 nt, Human
cauuucaagcauugacuucuau

SEQ ID NO: 1095458 - RNA, 22 nt, Human
cugcagccucaaccuccugagc

SEQ ID NO: 1095459 - RNA, 22 nt, Human
aggcugagacugugcauuagug

SEQ ID NO: 1095460 - RNA, 20 nt, Human
uucagcuaccagguaucuuc

SEQ ID NO: 1095461 - RNA, 22 nt, Human
gcaggaacuugcaaaaugagca

SEQ ID NO: 1095462 - RNA, 22 nt, Human
uggucgaccaguuggaaaguaa

SEQ ID NO: 1095463 - RNA, 22 nt, Human
acuuccagaaaugauuuaauuu

SEQ ID NO: 1095464 - RNA, 22 nt, Human
ugggcucagaagauaguuucca

SEQ ID NO: 1095465 - RNA, 22 nt, Human
acacaguaguguggaaaaacau

SEQ ID NO: 1095466 - RNA, 22 nt, Human
uaaaguuuauuugaacaucucu

SEQ ID NO: 1095467 - RNA, 22 nt, Human
aaggcaggaugcggacccaucu

SEQ ID NO: 1095468 - RNA, 22 nt, Human
cugccugcaucccacagugggg

SEQ ID NO: 1095469 - RNA, 22 nt, Human
guuacaaagcacuucaagugaa

SEQ ID NO: 1095470 - RNA, 22 nt, Human
gccucugcccauccaccaucag

SEQ ID NO: 1095471 - RNA, 18 nt, Human
acauacauucugucugca

SEQ ID NO: 1095472 - RNA, 22 nt, Human
aucaggaucaugcuggguggga

SEQ ID NO: 1095473 - RNA, 18 nt, Human
ugaauagggguuugcaga

SEQ ID NO: 1095474 - RNA, 19 nt, Human
gagcccucuccauggccac

SEQ ID NO: 1095475 - RNA, 22 nt, Human
aaauuccagaaacucaguauau

SEQ ID NO: 1095476 - RNA, 22 nt, Human
aguuuuauaaaggcaccucagu

SEQ ID NO: 1095477 - RNA, 22 nt, Human
ggcuccuggggaggugagcuug

SEQ ID NO: 1095478 - RNA, 22 nt, Human
ugauuacagucugacagauguu

SEQ ID NO: 1095479 - RNA, 22 nt, Human
uagagcuggaauuugcagcaag

SEQ ID NO: 1095480 - RNA, 22 nt, Human
acucuucauucaaguaugcaaa

SEQ ID NO: 1095481 - RNA, 22 nt, Human
gaggccaaucaauagggcaaua

SEQ ID NO: 1095482 - RNA, 21 nt, Human
ucaguuccuaagggaggccgc

SEQ ID NO: 1095483 - RNA, 22 nt, Human
ugggugcuucgucagcucugag

SEQ ID NO: 1095484 - RNA, 22 nt, Human
cacuggcaugugaggcgguggc

SEQ ID NO: 1095485 - RNA, 22 nt, Human
ucacaaaaggccauguggcuuc

SEQ ID NO: 1095486 - RNA, 22 nt, Human
uuuggaaaguugucacuuuaga

SEQ ID NO: 1095487 - RNA, 22 nt, Human
guuucauauaccaagcacuuga

SEQ ID NO: 1095488 - RNA, 22 nt, Human
guugggaaggcaagaaguagaa

SEQ ID NO: 1095489 - RNA, 22 nt, Human
acugccugcauccuuaggguag

SEQ ID NO: 1095490 - RNA, 22 nt, Human
acugggcuuaugcuguggagua

SEQ ID NO: 1095491 - RNA, 21 nt, Human
ucccucagaagcucuugguca

SEQ ID NO: 1095492 - RNA, 22 nt, Human
gaggcauaaaucacaguguuca

SEQ ID NO: 1095493 - RNA, 22 nt, Human
caugaaauuugaaguacagcaa

SEQ ID NO: 1095494 - RNA, 22 nt, Human
ccugggaagagcugacaggagg

SEQ ID NO: 1095495 - RNA, 22 nt, Human
gacagcauggugucuguucagg

SEQ ID NO: 1095496 - RNA, 22 nt, Human
uaaaacugaauacauacugagg

SEQ ID NO: 1095497 - RNA, 22 nt, Human
cugcuggggucagagcacuggg

SEQ ID NO: 1095498 - RNA, 22 nt, Human
uacauuguucaugcaugagaaa

SEQ ID NO: 1095499 - RNA, 22 nt, Human
acaugaaguggucagaucaaac

SEQ ID NO: 1095500 - RNA, 22 nt, Human
uggcagcuggagggcaauggcc

SEQ ID NO: 1095501 - RNA, 22 nt, Human
gcaggaguucaauugcccauga

SEQ ID NO: 1095502 - RNA, 22 nt, Human
acacagaugcauuacacaucua

SEQ ID NO: 1095503 - RNA, 22 nt, Human
cagagucaguauugaauugaaa

SEQ ID NO: 1095504 - RNA, 22 nt, Human
ggggcagcuaccggaaguaggg

SEQ ID NO: 1095505 - RNA, 22 nt, Human
caggucuguuuccaucagugcu

SEQ ID NO: 1095506 - RNA, 22 nt, Human
uaacaaguuucauuuauagaau

SEQ ID NO: 1095507 - RNA, 22 nt, Human
uuuagaaguucacacauuuaaa

SEQ ID NO: 1095508 - RNA, 22 nt, Human
gaacacaguacuuuuccugaug

SEQ ID NO: 1095509 - RNA, 22 nt, Human
ccagaggucuccugcacgggau

SEQ ID NO: 1095510 - RNA, 22 nt, Human
aagcuggcaauuaucaaaacug

SEQ ID NO: 1095511 - RNA, 20 nt, Human
agguuccuuuguggagaauu

SEQ ID NO: 1095512 - RNA, 22 nt, Human
cugcccugcuugaugacagcga

SEQ ID NO: 1095513 - RNA, 22 nt, Human
auuauucaaucauauuaaaagu

SEQ ID NO: 1095514 - RNA, 22 nt, Human
cucuccuugcagauggcugccu

SEQ ID NO: 1095515 - RNA, 22 nt, Human
aauaauauuugaagcuucaaag

SEQ ID NO: 1095516 - RNA, 22 nt, Human
ggugcccuucagacagugggca

SEQ ID NO: 1095517 - RNA, 22 nt, Human
uaugcacagaaguuugcugaau

SEQ ID NO: 1095518 - RNA, 22 nt, Human
gcccucagugaccacugauuca

SEQ ID NO: 1095519 - RNA, 21 nt, Human
gagacagcccagugccagggc

SEQ ID NO: 1095520 - RNA, 22 nt, Human
agguggggcccaccaauuugca

SEQ ID NO: 1095521 - RNA, 22 nt, Human
uccaggcugggcugaagggugc

SEQ ID NO: 1095522 - RNA, 22 nt, Human
ucacauacugaaaguccaguga

SEQ ID NO: 1095523 - RNA, 22 nt, Human
acauuuuacaccaagacuucuu

SEQ ID NO: 1095524 - RNA, 22 nt, Human
acauucuacaguuaaccauuag

SEQ ID NO: 1095525 - RNA, 22 nt, Human
aggggagaaaaaugccuucugu

SEQ ID NO: 1095526 - RNA, 22 nt, Human
aaacaagguacacaguaauggu

SEQ ID NO: 1095527 - RNA, 22 nt, Human
aggacccagaggcagaggacgu

SEQ ID NO: 1095528 - RNA, 22 nt, Human
ucauuuguuuagguagcaccau

SEQ ID NO: 1095529 - RNA, 22 nt, Human
cagcugugcugauugcucagua

SEQ ID NO: 1095530 - RNA, 22 nt, Human
cagccagguucaaguccuuaua

SEQ ID NO: 1095531 - RNA, 23 nt, Human
uccuccuggauacaaagggaaca

SEQ ID NO: 1095532 - RNA, 22 nt, Human
aacccaggagacagguugcagu

SEQ ID NO: 1095533 - RNA, 18 nt, Human
gccugggaggaggaaaug

SEQ ID NO: 1095534 - RNA, 22 nt, Human
agccucugcuuaugcaaaggua

SEQ ID NO: 1095535 - RNA, 22 nt, Human
aacaaaguacuuuucagugcuu

SEQ ID NO: 1095536 - RNA, 22 nt, Human
agaccaagacuauaaugagagg

SEQ ID NO: 1095537 - RNA, 22 nt, Human
agccacagugcaagagagaaaa

SEQ ID NO: 1095538 - RNA, 22 nt, Human
gcugugcuugggaagaaucucu

SEQ ID NO: 1095539 - RNA, 22 nt, Human
agggcucauaauuccugacuuc

SEQ ID NO: 1095540 - RNA, 22 nt, Human
gaagcacacugauuuuauuucu

SEQ ID NO: 1095541 - RNA, 22 nt, Human
ucaaugauagacaagaucuaag

SEQ ID NO: 1095542 - RNA, 22 nt, Human
gccaggacucuuccuagaaggu

SEQ ID NO: 1095543 - RNA, 22 nt, Human
agcuccagcccaucugcucgug

SEQ ID NO: 1095544 - RNA, 22 nt, Human
ucuuccuaguuacauaugcaca

SEQ ID NO: 1095545 - RNA, 22 nt, Human
uucuuucugggguccuucggcu

SEQ ID NO: 1095546 - RNA, 22 nt, Human
aaaugcuauuugggaacaacau

SEQ ID NO: 1095547 - RNA, 22 nt, Human
uuucuaagaaaguaaugguuau

SEQ ID NO: 1095548 - RNA, 22 nt, Human
gggcagcagcaggaggucucug

SEQ ID NO: 1095549 - RNA, 22 nt, Human
gugaaggacuagcauggagggc

SEQ ID NO: 1095550 - RNA, 22 nt, Human
uggccuggaagagaggucgagg

SEQ ID NO: 1095551 - RNA, 22 nt, Human
acauacauggauucauggauuc

SEQ ID NO: 1095552 - RNA, 20 nt, Human
uugcaaauaucuauugauug

SEQ ID NO: 1095553 - RNA, 21 nt, Human
ugcagaggcacaaacaagccc

SEQ ID NO: 1095554 - RNA, 22 nt, Human
uuuccucuuauacaguguuuau

SEQ ID NO: 1095555 - RNA, 22 nt, Human
guaaauaacugguaauuggggu

SEQ ID NO: 1095556 - RNA, 22 nt, Human
uguacacaaugauaaauuauua

SEQ ID NO: 1095557 - RNA, 22 nt, Human
ggccugugggaggacagcuggg

SEQ ID NO: 1095558 - RNA, 20 nt, Human
ggcugugcccuuccguggcc

SEQ ID NO: 1095559 - RNA, 20 nt, Human
cauuucauugugucuucacu

SEQ ID NO: 1095560 - RNA, 22 nt, Human
acaaagugcugacauuacaggc

SEQ ID NO: 1095561 - RNA, 22 nt, Human
agggcagacuaggauggaagug

SEQ ID NO: 1095562 - RNA, 22 nt, Human
uccuggccuugcuccugaugcc

SEQ ID NO: 1095563 - RNA, 22 nt, Human
uacagaauguguaucauuacca

SEQ ID NO: 1095564 - RNA, 23 nt, Human
ccugucugugcuggguggacaca

SEQ ID NO: 1095565 - RNA, 22 nt, Human
gaacacaugauuauaaaugcua

SEQ ID NO: 1095566 - RNA, 22 nt, Human
agcugggcuccaagagggaucu

SEQ ID NO: 1095567 - RNA, 22 nt, Human
ccagccuggguguuagaagaca

SEQ ID NO: 1095568 - RNA, 22 nt, Human
cugcaggauucucccaguugga

SEQ ID NO: 1095569 - RNA, 22 nt, Human
guguaugauuucaaauggcuag

SEQ ID NO: 1095570 - RNA, 22 nt, Human
uggccuuguguuuuagagaaag

SEQ ID NO: 1095571 - RNA, 22 nt, Human
ccagucagucaguugcuggcau

SEQ ID NO: 1095572 - RNA, 22 nt, Human
ccucugggugggaggccgggcg

SEQ ID NO: 1095573 - RNA, 22 nt, Human
uaauacauguauuccagagagu

SEQ ID NO: 1095574 - RNA, 22 nt, Human
gcugucacaucaaggcacuaaa

SEQ ID NO: 1095575 - RNA, 22 nt, Human
cacacaguaggcacucauuaau

SEQ ID NO: 1095576 - RNA, 22 nt, Human
agagccagcauuugggcccugc

SEQ ID NO: 1095577 - RNA, 22 nt, Human
aggucaccauggcaugcuccac

SEQ ID NO: 1095578 - RNA, 22 nt, Human
cagauacauuaaaaugaugauu

SEQ ID NO: 1095579 - RNA, 22 nt, Human
uuuaauacagaacuugucaggg

SEQ ID NO: 1095580 - RNA, 22 nt, Human
gagagcuggccagcuucaguau

SEQ ID NO: 1095581 - RNA, 22 nt, Human
uggagccagcccaggccccucu

SEQ ID NO: 1095582 - RNA, 22 nt, Human
aagaauguggguggauaugaug

SEQ ID NO: 1095583 - RNA, 19 nt, Human
gguggcagaacgugggucc

SEQ ID NO: 1095584 - RNA, 22 nt, Human
acaggcugcccgcuccccaccu

SEQ ID NO: 1095585 - RNA, 22 nt, Human
acuugguugaugucauaagguu

SEQ ID NO: 1095586 - RNA, 22 nt, Human
uacccagcuucaagucaggacu

SEQ ID NO: 1095587 - RNA, 22 nt, Human
guccugagaauacuaggcacaa

SEQ ID NO: 1095588 - RNA, 22 nt, Human
ucuguagcaagugagaggcauu

SEQ ID NO: 1095589 - RNA, 22 nt, Human
uaauacuuuugccuuguauuca

SEQ ID NO: 1095590 - RNA, 22 nt, Human
caaaugcaggucagcagguguc

SEQ ID NO: 1095591 - RNA, 20 nt, Human
agagccuggaaaaagacauc

SEQ ID NO: 1095592 - RNA, 22 nt, Human
uaaaugcaagggaaaggcaaga

SEQ ID NO: 1095593 - RNA, 22 nt, Human
acacaaauuguaggauaauugc

SEQ ID NO: 1095594 - RNA, 22 nt, Human
ugggggugaaagucuggacagu

SEQ ID NO: 1095595 - RNA, 22 nt, Human
ggacagcccauacacaugucug

SEQ ID NO: 1095596 - RNA, 22 nt, Human
caugaauuauuuuucacaagau

SEQ ID NO: 1095597 - RNA, 22 nt, Human
cagcuguuacugaaguaaaaug

SEQ ID NO: 1095598 - RNA, 22 nt, Human
uucaacauuuuugaguuuaggu

SEQ ID NO: 1095599 - RNA, 22 nt, Human
uauuuuaucugccagaguggag

SEQ ID NO: 1095600 - RNA, 22 nt, Human
aaaucugggagcagcucggcca

SEQ ID NO: 1095601 - RNA, 22 nt, Human
aguguaucuagguaucuauagu

SEQ ID NO: 1095602 - RNA, 22 nt, Human
ucuuuugugauucuuuaguuac

SEQ ID NO: 1095603 - RNA, 23 nt, Human
cccagagcacagccuccagaugc

SEQ ID NO: 1095604 - RNA, 22 nt, Human
cagaggcagccgggggagaacg

SEQ ID NO: 1095605 - RNA, 22 nt, Human
aaauaucauuuauaacuuuuaa

SEQ ID NO: 1095606 - RNA, 22 nt, Human
cucuuccucucaugcggucaua

SEQ ID NO: 1095607 - RNA, 22 nt, Human
uagcagcacauggugguuuuau

SEQ ID NO: 1095608 - RNA, 22 nt, Human
uacaaagauaguguuagaguaa

SEQ ID NO: 1095609 - RNA, 20 nt, Human
cacuacuuguuuuugucaau

SEQ ID NO: 1095610 - RNA, 22 nt, Human
ucacacaugcuaagccagagau

SEQ ID NO: 1095611 - RNA, 22 nt, Human
agcuccuccugugccaggccag

SEQ ID NO: 1095612 - RNA, 20 nt, Human
accagguggcugaugacacc

SEQ ID NO: 1095613 - RNA, 22 nt, Human
ugcccauggcaggauuucugaa

SEQ ID NO: 1095614 - RNA, 22 nt, Human
cccagcucugcagaccugcccu

SEQ ID NO: 1095615 - RNA, 22 nt, Human
agcugccaaguuucucaguuua

SEQ ID NO: 1095616 - RNA, 22 nt, Human
acagggccucagcugauucugg

SEQ ID NO: 1095617 - RNA, 22 nt, Human
agcaccuguugcacuucauaau

SEQ ID NO: 1095618 - RNA, 22 nt, Human
uauuucaagaacuucuauccau

SEQ ID NO: 1095619 - RNA, 22 nt, Human
auccuugagccuuaucuuuugu

SEQ ID NO: 1095620 - RNA, 22 nt, Human
auuacagaaauauggucaaaga

SEQ ID NO: 1095621 - RNA, 22 nt, Human
gcuggcagccaagugaagaggg

SEQ ID NO: 1095622 - RNA, 22 nt, Human
auaucuuuguaugguucagcag

SEQ ID NO: 1095623 - RNA, 22 nt, Human
gcugucugucucugugacuuaa

SEQ ID NO: 1095624 - RNA, 22 nt, Human
augaugguuguccuaggugcau

SEQ ID NO: 1095625 - RNA, 22 nt, Human
augcugaggacaaagagaucaa

SEQ ID NO: 1095626 - RNA, 22 nt, Human
gaugccugcauuucaggagagu

SEQ ID NO: 1095627 - RNA, 22 nt, Human
uuccaaagucauguugcugaua

SEQ ID NO: 1095628 - RNA, 23 nt, Human
cugugcugggucccaucuugggc

SEQ ID NO: 1095629 - RNA, 22 nt, Human
uaaggccaauuaacaaccaggg

SEQ ID NO: 1095630 - RNA, 21 nt, Human
agcaccaaaugcaggcucugg

SEQ ID NO: 1095631 - RNA, 22 nt, Human
cauacuuugggauaagagugga

SEQ ID NO: 1095632 - RNA, 22 nt, Human
ccuccugggcuccugucugcac

SEQ ID NO: 1095633 - RNA, 22 nt, Human
ccuccuagaggaaccccagggc

SEQ ID NO: 1095634 - RNA, 22 nt, Human
ggccugcuuuccgagccugcag

SEQ ID NO: 1095635 - RNA, 22 nt, Human
ggaagaagggucauuggcagcc

SEQ ID NO: 1095636 - RNA, 22 nt, Human
gccagagugauguaacauauau

SEQ ID NO: 1095637 - RNA, 22 nt, Human
aucauaaaauugcaccauuucu

SEQ ID NO: 1095638 - RNA, 22 nt, Human
ucuuccuagaaggaagaaaucu

SEQ ID NO: 1095639 - RNA, 22 nt, Human
gccaaaguaccuagcccucugc

SEQ ID NO: 1095640 - RNA, 22 nt, Human
cugcuguguuagcagguuuagu

SEQ ID NO: 1095641 - RNA, 22 nt, Human
gggauggcucaaaggagucagg

SEQ ID NO: 1095642 - RNA, 22 nt, Human
gaaaggucaguuccacuuccau

SEQ ID NO: 1095643 - RNA, 22 nt, Human
acacaugugauucuaagacagc

SEQ ID NO: 1095644 - RNA, 22 nt, Human
gcacaauaauuuuuuuaagagg

SEQ ID NO: 1095645 - RNA, 22 nt, Human
acacauuuucuaacagggauca

SEQ ID NO: 1095646 - RNA, 22 nt, Human
agcagcauaucagagaaaguca

SEQ ID NO: 1095647 - RNA, 22 nt, Human
uaugagauaauagauguguaaa

SEQ ID NO: 1095648 - RNA, 22 nt, Human
cccuucuuuguaauaaagauua

SEQ ID NO: 1095649 - RNA, 22 nt, Human
cuggucaggggauggggcucag

SEQ ID NO: 1095650 - RNA, 22 nt, Human
ugcccugucgcucacucccacc

SEQ ID NO: 1095651 - RNA, 22 nt, Human
gcccaagacuguacaguuaaag

SEQ ID NO: 1095652 - RNA, 22 nt, Human
uuucacaucaugggauggaagc

SEQ ID NO: 1095653 - RNA, 22 nt, Human
cugcugagcaucagggcugccc

SEQ ID NO: 1095654 - RNA, 22 nt, Human
cagagguugagcaaaaaugaua

SEQ ID NO: 1095655 - RNA, 22 nt, Human
aaucuuuaaggacucagucucu

SEQ ID NO: 1095656 - RNA, 22 nt, Human
aaacucaaggauuuagacgaag

SEQ ID NO: 1095657 - RNA, 22 nt, Human
uuugcauuguuucaaaagugaa

SEQ ID NO: 1095658 - RNA, 22 nt, Human
ucucuguaguugggcagcugcu

SEQ ID NO: 1095659 - RNA, 18 nt, Human
acugugugaauuagcucc

SEQ ID NO: 1095660 - RNA, 22 nt, Human
caggcccagcccagcccuucga

SEQ ID NO: 1095661 - RNA, 22 nt, Human
uagaaacauguucuguucuguu

SEQ ID NO: 1095662 - RNA, 22 nt, Human
ucaggccuucagaccuggcccg

SEQ ID NO: 1095663 - RNA, 22 nt, Human
ccacacagauaaguguuuucua

SEQ ID NO: 1095664 - RNA, 22 nt, Human
ugggaggacuugugggcuucau

SEQ ID NO: 1095665 - RNA, 22 nt, Human
cuggcuccacucccugccugac

SEQ ID NO: 1095666 - RNA, 22 nt, Human
ugggcagcagcaaagccagacu

SEQ ID NO: 1095667 - RNA, 22 nt, Human
uggagccaaugaacauuugcug

SEQ ID NO: 1095668 - RNA, 19 nt, Human
gcugugccccugccgcuug

SEQ ID NO: 1095669 - RNA, 22 nt, Human
cugcuggccuagcccauccucu

SEQ ID NO: 1095670 - RNA, 22 nt, Human
uucaguaugacagacgcauugg

SEQ ID NO: 1095671 - RNA, 22 nt, Human
gcugggcuuguggccagcuggg

SEQ ID NO: 1095672 - RNA, 22 nt, Human
cuggggacucauucagagcaua

SEQ ID NO: 1095673 - RNA, 22 nt, Human
uucuaagaggcuaaugaagaau

SEQ ID NO: 1095674 - RNA, 23 nt, Human
acaguuauagcugugaauaacau

SEQ ID NO: 1095675 - RNA, 22 nt, Human
agaacagcaguuaugguucauu

SEQ ID NO: 1095676 - RNA, 22 nt, Human
ugacaauauugagucuuagguu

SEQ ID NO: 1095677 - RNA, 21 nt, Human
cugaggcaugcaggccugggc

SEQ ID NO: 1095678 - RNA, 22 nt, Human
cagacagaggcuguaugagggc

SEQ ID NO: 1095679 - RNA, 21 nt, Human
ucccaagaauaugcauaaguu

SEQ ID NO: 1095680 - RNA, 22 nt, Human
uaagucauaagucaugauguua

SEQ ID NO: 1095681 - RNA, 22 nt, Human
cuccaggagcugugucuuucuu

SEQ ID NO: 1095682 - RNA, 22 nt, Human
cacagauaaggauguuaauuuu

SEQ ID NO: 1095683 - RNA, 22 nt, Human
agggcugagugggagagaguug

SEQ ID NO: 1095684 - RNA, 22 nt, Human
acccacacaucucuaauucagu

SEQ ID NO: 1095685 - RNA, 22 nt, Human
gcucaggaucagccaccucuuu

SEQ ID NO: 1095686 - RNA, 22 nt, Human
gggcccugcguccggaagucug

SEQ ID NO: 1095687 - RNA, 19 nt, Human
ugucccagacuccgugucu

SEQ ID NO: 1095688 - RNA, 22 nt, Human
gcaggaacaguuuaucucuggc

SEQ ID NO: 1095689 - RNA, 22 nt, Human
gagcuagaauuaggccaauuuc

SEQ ID NO: 1095690 - RNA, 22 nt, Human
auaaacaucuguuucucuucug

SEQ ID NO: 1095691 - RNA, 23 nt, Human
cugcccugaucuugaucuauugu

SEQ ID NO: 1095692 - RNA, 22 nt, Human
cugaguggaacauaggaugaua

SEQ ID NO: 1095693 - RNA, 22 nt, Human
ugcauuuccagauuucuggagu

SEQ ID NO: 1095694 - RNA, 22 nt, Human
ccugugcccucagccuggcucu

SEQ ID NO: 1095695 - RNA, 22 nt, Human
aggaccagaggccagagucagc

SEQ ID NO: 1095696 - RNA, 22 nt, Human
cagcuguucagcaacucgcaga

SEQ ID NO: 1095697 - RNA, 22 nt, Human
ucacugcucucuaagcaucgcc

SEQ ID NO: 1095698 - RNA, 22 nt, Human
cucaggauugugccuagggaga

SEQ ID NO: 1095699 - RNA, 22 nt, Human
ggcaggcugggugucauggagu

SEQ ID NO: 1095700 - RNA, 22 nt, Human
uucauuacugcgguagucacac

SEQ ID NO: 1095701 - RNA, 22 nt, Human
uauuuaaaauagugcuccagca

SEQ ID NO: 1095702 - RNA, 22 nt, Human
ggugaguugggguucacagguc

SEQ ID NO: 1095703 - RNA, 22 nt, Human
agcguggguccaaggcucuggu

SEQ ID NO: 1095704 - RNA, 22 nt, Human
agacacaguguugaaggcuagu

SEQ ID NO: 1095705 - RNA, 22 nt, Human
cuccuggaguccuuuccuauuc

SEQ ID NO: 1095706 - RNA, 22 nt, Human
gcucucugaggugcuggcagag

SEQ ID NO: 1095707 - RNA, 22 nt, Human
cuuccuugcugucugcuccagg

SEQ ID NO: 1095708 - RNA, 22 nt, Human
auuauucaaauucccacuauac

SEQ ID NO: 1095709 - RNA, 22 nt, Human
caauuuuuaaacuaugaaguug

SEQ ID NO: 1095710 - RNA, 22 nt, Human
ucaggaucggccuuuuuuuaag

SEQ ID NO: 1095711 - RNA, 22 nt, Human
uuugcaaaguccauugaaguua

SEQ ID NO: 1095712 - RNA, 22 nt, Human
acaucagucuuuugcauacaua

SEQ ID NO: 1095713 - RNA, 22 nt, Human
acugccuggcagagguuugcaa

SEQ ID NO: 1095714 - RNA, 22 nt, Human
gccuuucaguuccaucaaagga

SEQ ID NO: 1095715 - RNA, 22 nt, Human
cugaaacuggaguccuuauauc

SEQ ID NO: 1095716 - RNA, 19 nt, Human
uggccagguacugucugcu

SEQ ID NO: 1095717 - RNA, 22 nt, Human
aaugaacauggacaaguuaaua

SEQ ID NO: 1095718 - RNA, 22 nt, Human
gaucuguuauaaucucuuuuau

SEQ ID NO: 1095719 - RNA, 22 nt, Human
aagaauaacacuuagguuuugc

SEQ ID NO: 1095720 - RNA, 22 nt, Human
gguggagcuggaccaggagagg

SEQ ID NO: 1095721 - RNA, 22 nt, Human
ugggcuucugauguugagugcu

SEQ ID NO: 1095722 - RNA, 22 nt, Human
ugagauuuuccuaaauauaaug

SEQ ID NO: 1095723 - RNA, 22 nt, Human
uacagaaaaacaucuggagccg

SEQ ID NO: 1095724 - RNA, 22 nt, Human
uuuccaauaaggucaccuuccu

SEQ ID NO: 1095725 - RNA, 22 nt, Human
gggaacacagacuugaugauga

SEQ ID NO: 1095726 - RNA, 22 nt, Human
uuuacagagaauguacauaaag

SEQ ID NO: 1095727 - RNA, 22 nt, Human
uuuuaagaugcuaguauuucag

SEQ ID NO: 1095728 - RNA, 22 nt, Human
acaaaaaccguggauucagcau

SEQ ID NO: 1095729 - RNA, 21 nt, Human
ccuggcagaagccugauaugc

SEQ ID NO: 1095730 - RNA, 22 nt, Human
uacagaagcugagacacugaga

SEQ ID NO: 1095731 - RNA, 22 nt, Human
caggaaccuugucuguguuguu

SEQ ID NO: 1095732 - RNA, 22 nt, Human
uggcccugacuuggaggccuga

SEQ ID NO: 1095733 - RNA, 22 nt, Human
ugucaaaaugacuuuacuacag

SEQ ID NO: 1095734 - RNA, 22 nt, Human
aaucacaucacugagaaugagg

SEQ ID NO: 1095735 - RNA, 22 nt, Human
gcaagcugcucuuauguggagg

SEQ ID NO: 1095736 - RNA, 22 nt, Human
aucacaaaggguuuucucugag

SEQ ID NO: 1095737 - RNA, 22 nt, Human
uguagauacacacauauagugg

SEQ ID NO: 1095738 - RNA, 22 nt, Human
ugacuucaaaggcucuacuccu

SEQ ID NO: 1095739 - RNA, 22 nt, Human
gguggguauaguuagggccucu

SEQ ID NO: 1095740 - RNA, 22 nt, Human
cagucuuaggagaaacuacaga

SEQ ID NO: 1095741 - RNA, 22 nt, Human
uuuguuaauucuuauguuagag

SEQ ID NO: 1095742 - RNA, 22 nt, Human
aguaugaagaauacauagauga

SEQ ID NO: 1095743 - RNA, 22 nt, Human
aaauauguuuuccaguugucau

SEQ ID NO: 1095744 - RNA, 22 nt, Human
ucaugcuuauugcauauuugga

SEQ ID NO: 1095745 - RNA, 22 nt, Human
aaagucauacauggugcuuacu

SEQ ID NO: 1095746 - RNA, 22 nt, Human
gagcucagacucgggccugggg

SEQ ID NO: 1095747 - RNA, 22 nt, Human
agagauguucauucagcauguu

SEQ ID NO: 1095748 - RNA, 22 nt, Human
agugguggagagaugaggacac

SEQ ID NO: 1095749 - RNA, 22 nt, Human
gagggcugauaaaugcgcaugg

SEQ ID NO: 1095750 - RNA, 22 nt, Human
cugucacacugauaucaggcuu

SEQ ID NO: 1095751 - RNA, 21 nt, Human
uauacagaggggaacaggaga

SEQ ID NO: 1095752 - RNA, 22 nt, Human
uuucaguuguuuuagcucugug

SEQ ID NO: 1095753 - RNA, 22 nt, Human
auuuccauacacccauuucuga

SEQ ID NO: 1095754 - RNA, 22 nt, Human
agaaaucagaacccugaaguuc

SEQ ID NO: 1095755 - RNA, 16 nt, Human
gcagguggaucaccug

SEQ ID NO: 1095756 - RNA, 22 nt, Human
uguuuauucauggcuaaugaaa

SEQ ID NO: 1095757 - RNA, 20 nt, Human
ugugaggagcauggccgcug

SEQ ID NO: 1095758 - RNA, 22 nt, Human
agcccugccucuccaaugccca

SEQ ID NO: 1095759 - RNA, 22 nt, Human
gugggccucuugaggguggcua

SEQ ID NO: 1095760 - RNA, 22 nt, Human
auauaucugcaguacugaagaa

SEQ ID NO: 1095761 - RNA, 22 nt, Human
aggagcagcccacuccuguccu

SEQ ID NO: 1095762 - RNA, 22 nt, Human
ugcagugaggcaguuggguugg

SEQ ID NO: 1095763 - RNA, 22 nt, Human
ggccugcucuggcuguggucag

SEQ ID NO: 1095764 - RNA, 22 nt, Human
cacagcuaugagcagccuagcu

SEQ ID NO: 1095765 - RNA, 22 nt, Human
uuaagaagugauuuuccucauu

SEQ ID NO: 1095766 - RNA, 21 nt, Human
uccauaagagaccaucuccua

SEQ ID NO: 1095767 - RNA, 22 nt, Human
uguggaaaauuggaacguuccu

SEQ ID NO: 1095768 - RNA, 22 nt, Human
ucugucauugcaauaaaauuuc

SEQ ID NO: 1095769 - RNA, 22 nt, Human
agaaaagugcucuagugagagc

SEQ ID NO: 1095770 - RNA, 22 nt, Human
agauacauggaacgucaaaccu

SEQ ID NO: 1095771 - RNA, 22 nt, Human
agggcccaggacagcaucaggg

SEQ ID NO: 1095772 - RNA, 20 nt, Human
cuuuaguuauuaacagcacu

SEQ ID NO: 1095773 - RNA, 22 nt, Human
cugucucuguugccuguaggug

SEQ ID NO: 1095774 - RNA, 22 nt, Human
accagugcuuccugcuggagcu

SEQ ID NO: 1095775 - RNA, 22 nt, Human
cuguauauggcuuacuuuauau

SEQ ID NO: 1095776 - RNA, 22 nt, Human
uucugggcaguuggaaauuuca

SEQ ID NO: 1095777 - RNA, 22 nt, Human
gcucagugcaucauuccaggcu

SEQ ID NO: 1095778 - RNA, 22 nt, Human
cugccuugguucccagccagca

SEQ ID NO: 1095779 - RNA, 22 nt, Human
uuuauucuagcucagaauaguu

SEQ ID NO: 1095780 - RNA, 22 nt, Human
caagcagaaaucuagaacucca

SEQ ID NO: 1095781 - RNA, 22 nt, Human
uaugaaaauuuagcugaagcau

SEQ ID NO: 1095782 - RNA, 20 nt, Human
ccugcugggaacccucugaa

SEQ ID NO: 1095783 - RNA, 22 nt, Human
gcugacucuuugacaaaaugca

SEQ ID NO: 1095784 - RNA, 22 nt, Human
uuuccaaacccagcgagcuaca

SEQ ID NO: 1095785 - RNA, 22 nt, Human
agccucucugaugugacagcua

SEQ ID NO: 1095786 - RNA, 22 nt, Human
ugaugugugauucauucucaaa

SEQ ID NO: 1095787 - RNA, 22 nt, Human
ucccucuaaacuguaagauucu

SEQ ID NO: 1095788 - RNA, 22 nt, Human
gcagggugugucucauacaguu

SEQ ID NO: 1095789 - RNA, 22 nt, Human
augggcagcugcagcaguggug

SEQ ID NO: 1095790 - RNA, 22 nt, Human
uaggaguaacucucgucaucau

SEQ ID NO: 1095791 - RNA, 22 nt, Human
uccucuggggucagggcacuac

SEQ ID NO: 1095792 - RNA, 20 nt, Human
caggcagaggaugcugacca

SEQ ID NO: 1095793 - RNA, 22 nt, Human
auguuucaccagcaaauuaccu

SEQ ID NO: 1095794 - RNA, 22 nt, Human
ccagggaaacuuuggaguggag

SEQ ID NO: 1095795 - RNA, 17 nt, Human
uaaauacacaaggguau

SEQ ID NO: 1095796 - RNA, 22 nt, Human
acaauuuuucaaagaagcuuau

SEQ ID NO: 1095797 - RNA, 22 nt, Human
ccaggcaucacgggcauguggc

SEQ ID NO: 1095798 - RNA, 22 nt, Human
agccccucuguggcucugccuc

SEQ ID NO: 1095799 - RNA, 22 nt, Human
aaguuacuggcaagggcugcag

SEQ ID NO: 1095800 - RNA, 22 nt, Human
ugggccugacucaccugccucc

SEQ ID NO: 1095801 - RNA, 21 nt, Human
ggcuccugcuuugugaggggc

SEQ ID NO: 1095802 - RNA, 22 nt, Human
cagugagguggauggauggccu

SEQ ID NO: 1095803 - RNA, 18 nt, Human
uccaggccugaagugucc

SEQ ID NO: 1095804 - RNA, 22 nt, Human
agggcuggcuaggugcguuccc

SEQ ID NO: 1095805 - RNA, 22 nt, Human
aggaggcuguggagcacuccau

SEQ ID NO: 1095806 - RNA, 22 nt, Human
gaggcagugucgguggcaggau

SEQ ID NO: 1095807 - RNA, 19 nt, Human
gacucacaccuuccgcugu

SEQ ID NO: 1095808 - RNA, 19 nt, Human
guucuuuucaccucugugc

SEQ ID NO: 1095809 - RNA, 22 nt, Human
cagagcugagaauguugaugcu

SEQ ID NO: 1095810 - RNA, 22 nt, Human
agcagaggacaguucuuaggaa

SEQ ID NO: 1095811 - RNA, 19 nt, Human
gagcagcugcacccauuga

SEQ ID NO: 1095812 - RNA, 22 nt, Human
uucuuugaguuaguacagucca

SEQ ID NO: 1095813 - RNA, 22 nt, Human
agagcagcuggggcagagacca

SEQ ID NO: 1095814 - RNA, 22 nt, Human
ugcuggguuaccuaagccuaaa

SEQ ID NO: 1095815 - RNA, 22 nt, Human
acaauauaguccaugagcaugc

SEQ ID NO: 1095816 - RNA, 22 nt, Human
ugcagaaauaaagauauuauca

SEQ ID NO: 1095817 - RNA, 22 nt, Human
auguaacauaugugaucgcauu

SEQ ID NO: 1095818 - RNA, 22 nt, Human
agugagguggggucacagggac

SEQ ID NO: 1095819 - RNA, 22 nt, Human
ggcugccuugacccuggcuccg

SEQ ID NO: 1095820 - RNA, 22 nt, Human
ugaggcaggaauggggaaaagu

SEQ ID NO: 1095821 - RNA, 22 nt, Human
uggggaagaauaauguauguac

SEQ ID NO: 1095822 - RNA, 22 nt, Human
aggcugccucgugagcucgcug

SEQ ID NO: 1095823 - RNA, 22 nt, Human
aucuuuagacaggaagcaauca

SEQ ID NO: 1095824 - RNA, 22 nt, Human
gcagggcagaccuccagccuau

SEQ ID NO: 1095825 - RNA, 22 nt, Human
guggcaguugcuguggcaauaa

SEQ ID NO: 1095826 - RNA, 22 nt, Human
cacugaaggaaggacuacugca

SEQ ID NO: 1095827 - RNA, 22 nt, Human
auuuuuaugacaaaccauccuc

SEQ ID NO: 1095828 - RNA, 21 nt, Human
ccuucucuugcuucagcuuca

SEQ ID NO: 1095829 - RNA, 22 nt, Human
agggcccuaaggaaggcacaca

SEQ ID NO: 1095830 - RNA, 22 nt, Human
aagcagcauugugguaggggag

SEQ ID NO: 1095831 - RNA, 22 nt, Human
accagcagaguugaggaggaca

SEQ ID NO: 1095832 - RNA, 22 nt, Human
aguguuugagacacauuucacu

SEQ ID NO: 1095833 - RNA, 19 nt, Human
cccaaggcccugggcaggc

SEQ ID NO: 1095834 - RNA, 22 nt, Human
cuuccaaauguaaauaaguuuc

SEQ ID NO: 1095835 - RNA, 22 nt, Human
ccagcuuguuugaagcucguca

SEQ ID NO: 1095836 - RNA, 22 nt, Human
ucuucaugauacccuaagccac

SEQ ID NO: 1095837 - RNA, 22 nt, Human
ugaguaauaaacugucuugcuc

SEQ ID NO: 1095838 - RNA, 22 nt, Human
aucugacaaccuauugacuuga

SEQ ID NO: 1095839 - RNA, 22 nt, Human
gagaagguggaccugaaggagc

SEQ ID NO: 1095840 - RNA, 22 nt, Human
auaauuaucucagacacuuguu

SEQ ID NO: 1095841 - RNA, 20 nt, Human
auacacaugcagacagaugc

SEQ ID NO: 1095842 - RNA, 22 nt, Human
ggcucuggaaaguguccuugau

SEQ ID NO: 1095843 - RNA, 22 nt, Human
accuggacaccugcugucaucu

SEQ ID NO: 1095844 - RNA, 22 nt, Human
ucccuggagauaacuucuggga

SEQ ID NO: 1095845 - RNA, 22 nt, Human
agagaagagcaaugauaaauuu

SEQ ID NO: 1095846 - RNA, 22 nt, Human
gccagaagacuggagucagcug

SEQ ID NO: 1095847 - RNA, 22 nt, Human
augaaaguuugcauuccucagu

SEQ ID NO: 1095848 - RNA, 22 nt, Human
uuuucuaagggaaacguccucc

SEQ ID NO: 1095849 - RNA, 22 nt, Human
acccagcuggaugcauggaggc

SEQ ID NO: 1095850 - RNA, 22 nt, Human
acagguggcauaggcaguuuga

SEQ ID NO: 1095851 - RNA, 22 nt, Human
aguauuuagagacacaagaugg

SEQ ID NO: 1095852 - RNA, 22 nt, Human
ucuccaagaaaagaucucagcu

SEQ ID NO: 1095853 - RNA, 22 nt, Human
caagaaacaccaaugacugcug

SEQ ID NO: 1095854 - RNA, 22 nt, Human
acaguguacuagguacauguuc

SEQ ID NO: 1095855 - RNA, 22 nt, Human
ggaccacagcacuuggcuugag

SEQ ID NO: 1095856 - RNA, 22 nt, Human
uuaacacauauuuaucaauugc

SEQ ID NO: 1095857 - RNA, 22 nt, Human
caguguguggauccucccagga

SEQ ID NO: 1095858 - RNA, 22 nt, Human
uucaacauuugauacaagucag

SEQ ID NO: 1095859 - RNA, 22 nt, Human
aaggcacuguacuaguuaguua

SEQ ID NO: 1095860 - RNA, 22 nt, Human
ucugcagacaggaagcugaggc

SEQ ID NO: 1095861 - RNA, 22 nt, Human
ggcagauggagaagcagcaggu

SEQ ID NO: 1095862 - RNA, 23 nt, Human
aggcccaacucugugagggcugc

SEQ ID NO: 1095863 - RNA, 22 nt, Human
cuggccacaacuagcccaggac

SEQ ID NO: 1095864 - RNA, 22 nt, Human
gcugagguggcugccuuaguaa

SEQ ID NO: 1095865 - RNA, 20 nt, Human
caguccaggcugcagcaucu

SEQ ID NO: 1095866 - RNA, 22 nt, Human
cugagcagcguggggagcuggc

SEQ ID NO: 1095867 - RNA, 22 nt, Human
uggagccagcaggacucagagg

SEQ ID NO: 1095868 - RNA, 23 nt, Human
agcagcaaaaauuuaucuuucug

SEQ ID NO: 1095869 - RNA, 21 nt, Human
ucuugaaaaguuagauucucu

SEQ ID NO: 1095870 - RNA, 22 nt, Human
uggcugagaaguucugguggga

SEQ ID NO: 1095871 - RNA, 22 nt, Human
cagugggaagaaugcagccucc

SEQ ID NO: 1095872 - RNA, 22 nt, Human
ucuuagaaugucaacugauguu

SEQ ID NO: 1095873 - RNA, 22 nt, Human
ugcaugcaacaauucuucuaua

SEQ ID NO: 1095874 - RNA, 22 nt, Human
gcucugggugaacuuggagcaa

SEQ ID NO: 1095875 - RNA, 22 nt, Human
aaucacaucucauucaacagcc

SEQ ID NO: 1095876 - RNA, 21 nt, Human
ugaaacuaccuacaagcuacc

SEQ ID NO: 1095877 - RNA, 21 nt, Human
uuucacaaaaguaugugacaa

SEQ ID NO: 1095878 - RNA, 22 nt, Human
uaaaaucaugacagauugacau

SEQ ID NO: 1095879 - RNA, 22 nt, Human
cagagccugcucacgucucugu

SEQ ID NO: 1095880 - RNA, 22 nt, Human
uguacaauggcuauaauacccu

SEQ ID NO: 1095881 - RNA, 22 nt, Human
aagcugcagacccccugucuca

SEQ ID NO: 1095882 - RNA, 22 nt, Human
agggcccucuggcaggccaggc

SEQ ID NO: 1095883 - RNA, 22 nt, Human
ccauccugcauugcuauucaga

SEQ ID NO: 1095884 - RNA, 22 nt, Human
aaaaccaggcguuuccuauuau

SEQ ID NO: 1095885 - RNA, 22 nt, Human
cucaggaaaggccaugcaaggg

SEQ ID NO: 1095886 - RNA, 22 nt, Human
ggccaggaagggaagaucagca

SEQ ID NO: 1095887 - RNA, 22 nt, Human
aacuucuugguccugagcuguu

SEQ ID NO: 1095888 - RNA, 22 nt, Human
uggcccugacugauguggaggg

SEQ ID NO: 1095889 - RNA, 22 nt, Human
aaacacugcaggguuuacuuga

SEQ ID NO: 1095890 - RNA, 22 nt, Human
uucuauauuggaagugagaaau

SEQ ID NO: 1095891 - RNA, 22 nt, Human
caugggcuuuggaggcuggagg

SEQ ID NO: 1095892 - RNA, 22 nt, Human
cugggcacagcguugggcucuu

SEQ ID NO: 1095893 - RNA, 21 nt, Human
acagccugucaucucaugguc

SEQ ID NO: 1095894 - RNA, 22 nt, Human
ggcucuggagacauguggagag

SEQ ID NO: 1095895 - RNA, 23 nt, Human
agaguggccuacucacacucauu

SEQ ID NO: 1095896 - RNA, 22 nt, Human
agcaccaucagaugcaauaucu

SEQ ID NO: 1095897 - RNA, 22 nt, Human
gccaggcuccccggaucccugg

SEQ ID NO: 1095898 - RNA, 20 nt, Human
agucccuuuggucagguauu

SEQ ID NO: 1095899 - RNA, 22 nt, Human
gcugcugggcacccccugagcu

SEQ ID NO: 1095900 - RNA, 22 nt, Human
acugagagaacgggcugcuccc

SEQ ID NO: 1095901 - RNA, 22 nt, Human
gagcugccugugugccaugaug

SEQ ID NO: 1095902 - RNA, 22 nt, Human
ugggcugcccaagguggccaug

SEQ ID NO: 1095903 - RNA, 22 nt, Human
cagggcugguuugucgaagaaa

SEQ ID NO: 1095904 - RNA, 22 nt, Human
ccaaauauuaacaaaguaauuu

SEQ ID NO: 1095905 - RNA, 22 nt, Human
ccucugugucuugguuucaaga

SEQ ID NO: 1095906 - RNA, 20 nt, Human
aggcugaguucuaugcacuu

SEQ ID NO: 1095907 - RNA, 22 nt, Human
gcaguggaagccucuuuaagca

SEQ ID NO: 1095908 - RNA, 22 nt, Human
caaaauaccacgacuuguuuua

SEQ ID NO: 1095909 - RNA, 22 nt, Human
uagcagaggguagugccggggc

SEQ ID NO: 1095910 - RNA, 20 nt, Human
cacaggccuugugagcagac

SEQ ID NO: 1095911 - RNA, 22 nt, Human
gggcaggucugggucagccuga

SEQ ID NO: 1095912 - RNA, 18 nt, Human
acagugauuguucuaugc

SEQ ID NO: 1095913 - RNA, 22 nt, Human
acuuuacaggcacuucaaguau

SEQ ID NO: 1095914 - RNA, 22 nt, Human
guucacagcugggacaagacug

SEQ ID NO: 1095915 - RNA, 22 nt, Human
acaaagaaggaauuggucuuua

SEQ ID NO: 1095916 - RNA, 22 nt, Human
auauuuguugaguucuuaugau

SEQ ID NO: 1095917 - RNA, 22 nt, Human
caguggggaggccaggauagaa

SEQ ID NO: 1095918 - RNA, 22 nt, Human
aagccagguuccauggaggagc

SEQ ID NO: 1095919 - RNA, 22 nt, Human
augcugugccuggaaagcggcu

SEQ ID NO: 1095920 - RNA, 22 nt, Human
aggaacaucuaucacauaaacg

SEQ ID NO: 1095921 - RNA, 22 nt, Human
cuggcuggccggagcgaggcgg

SEQ ID NO: 1095922 - RNA, 22 nt, Human
cuguggcucauucuugguggca

SEQ ID NO: 1095923 - RNA, 22 nt, Human
ccagggaaaggagguugacuug

SEQ ID NO: 1095924 - RNA, 22 nt, Human
cagcauuggguuaccuuuguuu

SEQ ID NO: 1095925 - RNA, 22 nt, Human
caggcugcggucggcucugguc

SEQ ID NO: 1095926 - RNA, 22 nt, Human
auauugaacccuacagacugua

SEQ ID NO: 1095927 - RNA, 22 nt, Human
gcacagaacagagaaauagcca

SEQ ID NO: 1095928 - RNA, 22 nt, Human
ugugaaggagaugaagggagug

SEQ ID NO: 1095929 - RNA, 18 nt, Human
uuaucucuggcaugugcc

SEQ ID NO: 1095930 - RNA, 22 nt, Human
caggggcuguggcacauggugu

SEQ ID NO: 1095931 - RNA, 22 nt, Human
uccugggaagacugugaggaca

SEQ ID NO: 1095932 - RNA, 17 nt, Human
aggccagaugaggcaag

SEQ ID NO: 1095933 - RNA, 17 nt, Human
aaacugaaaaauucacu

SEQ ID NO: 1095934 - RNA, 22 nt, Human
uacacagacucuucaauucaga

SEQ ID NO: 1095935 - RNA, 21 nt, Human
guauugcagaguuaugugcuc

SEQ ID NO: 1095936 - RNA, 22 nt, Human
uugcauacugaccucuaagcuu

SEQ ID NO: 1095937 - RNA, 22 nt, Human
uggagcugagagccaggcuggc

SEQ ID NO: 1095938 - RNA, 22 nt, Human
aagagggguggucugugaggau

SEQ ID NO: 1095939 - RNA, 22 nt, Human
aaugaacaacuugauuuuugcc

SEQ ID NO: 1095940 - RNA, 22 nt, Human
cccuuuaaguccuggaacaaag

SEQ ID NO: 1095941 - RNA, 22 nt, Human
ggcaggaaguagcagucugagc

SEQ ID NO: 1095942 - RNA, 22 nt, Human
ugguggccaauucacagggcuc

SEQ ID NO: 1095943 - RNA, 22 nt, Human
ugucucugaacagcuuacuaaa

SEQ ID NO: 1095944 - RNA, 22 nt, Human
cagaggccaguggacaagggcc

SEQ ID NO: 1095945 - RNA, 22 nt, Human
aaaggaagaucuauacacccca

SEQ ID NO: 1095946 - RNA, 22 nt, Human
uccuggaguugugcagugcaca

SEQ ID NO: 1095947 - RNA, 22 nt, Human
guggcucuccauugacauggaa

SEQ ID NO: 1095948 - RNA, 22 nt, Human
gcuccccuugguccuccuggga

SEQ ID NO: 1095949 - RNA, 22 nt, Human
gcccagcugucuggcagggaug

SEQ ID NO: 1095950 - RNA, 22 nt, Human
ucagcuuggacagcuugguuga

SEQ ID NO: 1095951 - RNA, 20 nt, Human
uucuucucuaguuaucuuca

SEQ ID NO: 1095952 - RNA, 22 nt, Human
cccugcagaaccacagacaaac

SEQ ID NO: 1095953 - RNA, 22 nt, Human
ggcccaugcauccugugcagcc

SEQ ID NO: 1095954 - RNA, 22 nt, Human
uuucauagccuucuaaugaguu

SEQ ID NO: 1095955 - RNA, 22 nt, Human
ugaguucucacccauucuucuu

SEQ ID NO: 1095956 - RNA, 22 nt, Human
ugaagcaggugaauggaugucg

SEQ ID NO: 1095957 - RNA, 22 nt, Human
ccagagacgucggucagggcgc

SEQ ID NO: 1095958 - RNA, 22 nt, Human
uucagcuauggagucuuaguua

SEQ ID NO: 1095959 - RNA, 22 nt, Human
gggcuucucuuaugcuaacugg

SEQ ID NO: 1095960 - RNA, 22 nt, Human
agugcagcaacaaacugcccuc

SEQ ID NO: 1095961 - RNA, 20 nt, Human
uggagcuguaaucuugucug

SEQ ID NO: 1095962 - RNA, 22 nt, Human
gcucccagacugaccagaggug

SEQ ID NO: 1095963 - RNA, 22 nt, Human
gaacacaguuuagaaaaugcug

SEQ ID NO: 1095964 - RNA, 22 nt, Human
cuggcucacaggugagaugcau

SEQ ID NO: 1095965 - RNA, 22 nt, Human
uaacacuaagaaucuaaauuua

SEQ ID NO: 1095966 - RNA, 22 nt, Human
ugggggaagagcuuguuaaagu

SEQ ID NO: 1095967 - RNA, 22 nt, Human
gcugucugggaugucacugcug

SEQ ID NO: 1095968 - RNA, 22 nt, Human
ugaacacauaaggcuuuccugu

SEQ ID NO: 1095969 - RNA, 23 nt, Human
uggagaugccccacucccugucu

SEQ ID NO: 1095970 - RNA, 22 nt, Human
gagccaggcaccuucuguguug

SEQ ID NO: 1095971 - RNA, 22 nt, Human
ucuuuagagcucagaaauacag

SEQ ID NO: 1095972 - RNA, 22 nt, Human
ggcuucugcucagccugcacgc

SEQ ID NO: 1095973 - RNA, 22 nt, Human
auuguaaaaguauucuaagauu

SEQ ID NO: 1095974 - RNA, 22 nt, Human
agaggccagguccagaguuugu

SEQ ID NO: 1095975 - RNA, 22 nt, Human
cacugugucaguuugguuagac

SEQ ID NO: 1095976 - RNA, 22 nt, Human
uggccugaauuauggcagaucu

SEQ ID NO: 1095977 - RNA, 23 nt, Human
augaaaguucuuaaaaugucaug

SEQ ID NO: 1095978 - RNA, 22 nt, Human
ugguaauuuccgaagugaguaa

SEQ ID NO: 1095979 - RNA, 22 nt, Human
acugagcugcaagucagggagg

SEQ ID NO: 1095980 - RNA, 22 nt, Human
ggagugacucucggggccacua

SEQ ID NO: 1095981 - RNA, 22 nt, Human
uggaaggaacagaguuugaaac

SEQ ID NO: 1095982 - RNA, 22 nt, Human
acuguuuucuguaaagggccag

SEQ ID NO: 1095983 - RNA, 20 nt, Human
ggcugcugguuuggcucugu

SEQ ID NO: 1095984 - RNA, 22 nt, Human
uccucacauggugagccacaca

SEQ ID NO: 1095985 - RNA, 22 nt, Human
aacaggaaaacagcacaauagc

SEQ ID NO: 1095986 - RNA, 22 nt, Human
uaguggauguucagagauuuga

SEQ ID NO: 1095987 - RNA, 22 nt, Human
ucacucagaaauagaaugaacc

SEQ ID NO: 1095988 - RNA, 22 nt, Human
acaaaacaguguuccugccccu

SEQ ID NO: 1095989 - RNA, 22 nt, Human
gaggaguguauuccacaccacu

SEQ ID NO: 1095990 - RNA, 22 nt, Human
auugaaagauaggcuacugugg

SEQ ID NO: 1095991 - RNA, 22 nt, Human
cugcccugggaguaccuguccu

SEQ ID NO: 1095992 - RNA, 22 nt, Human
uuuuuuauagcaaugaacccac

SEQ ID NO: 1095993 - RNA, 22 nt, Human
ucagaggaacacuguuucaugc

SEQ ID NO: 1095994 - RNA, 23 nt, Human
gccagccuugcucuccugcagcc

SEQ ID NO: 1095995 - RNA, 17 nt, Human
uagcagcaguaauugug

SEQ ID NO: 1095996 - RNA, 22 nt, Human
ccaguggaauuaaaaauaagug

SEQ ID NO: 1095997 - RNA, 22 nt, Human
uggcuuccuccagagcaggagg

SEQ ID NO: 1095998 - RNA, 22 nt, Human
uuggaaggcccugccuagcagg

SEQ ID NO: 1095999 - RNA, 22 nt, Human
cagagcagaagcgguccucaca

SEQ ID NO: 1096000 - RNA, 22 nt, Human
aaaauaugaaguugucaguaug

SEQ ID NO: 1096001 - RNA, 21 nt, Human
gcccucaggggaggauggccu

SEQ ID NO: 1096002 - RNA, 22 nt, Human
gcagggccagguacaagaagca

SEQ ID NO: 1096003 - RNA, 22 nt, Human
cuugccuagguguauauuaaau

SEQ ID NO: 1096004 - RNA, 22 nt, Human
uuuuaauacugcuauuguagga

SEQ ID NO: 1096005 - RNA, 22 nt, Human
cagggcuguggaaaacuggugc

SEQ ID NO: 1096006 - RNA, 21 nt, Human
agcuggcaauguuguccucuu

SEQ ID NO: 1096007 - RNA, 22 nt, Human
cugagaguaauuuucuacuuga

SEQ ID NO: 1096008 - RNA, 22 nt, Human
uauuuucauucugugugacugu

SEQ ID NO: 1096009 - RNA, 20 nt, Human
ggcaggugcuguccccuccu

SEQ ID NO: 1096010 - RNA, 22 nt, Human
ggaaagauguaauauuaucuaa

SEQ ID NO: 1096011 - RNA, 22 nt, Human
ggaaccaguaacuggucauugc

SEQ ID NO: 1096012 - RNA, 22 nt, Human
cacagugaccucuuuaaaaggg

SEQ ID NO: 1096013 - RNA, 22 nt, Human
ucacaucauggagaauuauggg

SEQ ID NO: 1096014 - RNA, 22 nt, Human
ccacccuuggguucggaggccg

SEQ ID NO: 1096015 - RNA, 22 nt, Human
ugagagugccuuguaaaccugc

SEQ ID NO: 1096016 - RNA, 22 nt, Human
agacucaagcagauaggaauua

SEQ ID NO: 1096017 - RNA, 22 nt, Human
aaucaguuagaaggaagagaau

SEQ ID NO: 1096018 - RNA, 22 nt, Human
ucugccuggaugauggcagggc

SEQ ID NO: 1096019 - RNA, 22 nt, Human
uuccaagaagucaacagguagu

SEQ ID NO: 1096020 - RNA, 20 nt, Human
acacaaagcaauggaguaca

SEQ ID NO: 1096021 - RNA, 22 nt, Human
cuggccaguuguccuggcuugg

SEQ ID NO: 1096022 - RNA, 22 nt, Human
cagaagcauugacuccuugcuc

SEQ ID NO: 1096023 - RNA, 22 nt, Human
gccuggagugcaguggcgugau

SEQ ID NO: 1096024 - RNA, 22 nt, Human
cccugcugaaucccauggaguc

SEQ ID NO: 1096025 - RNA, 20 nt, Human
agcaccagugggggcagccc

SEQ ID NO: 1096026 - RNA, 22 nt, Human
accacccauucagaaacacuga

SEQ ID NO: 1096027 - RNA, 22 nt, Human
auaaugaaugcagaguuauuuu

SEQ ID NO: 1096028 - RNA, 22 nt, Human
cauuaacaauuguuuaugcugu

SEQ ID NO: 1096029 - RNA, 22 nt, Human
caguucagcuagaagaaacaaa

SEQ ID NO: 1096030 - RNA, 22 nt, Human
aauaugcauuauacagacugau

SEQ ID NO: 1096031 - RNA, 22 nt, Human
agcaaacagaugucuccuuuag

SEQ ID NO: 1096032 - RNA, 22 nt, Human
uauguucaucuggugcaucagu

SEQ ID NO: 1096033 - RNA, 23 nt, Human
cccuggagcuagucugagcagag

SEQ ID NO: 1096034 - RNA, 22 nt, Human
gccuccugacuuacacugagcu

SEQ ID NO: 1096035 - RNA, 22 nt, Human
uucuuuuuaaaguguguaugca

SEQ ID NO: 1096036 - RNA, 22 nt, Human
uuguucuugccaagacaugaag

SEQ ID NO: 1096037 - RNA, 22 nt, Human
acugcaggagacacagcugcug

SEQ ID NO: 1096038 - RNA, 22 nt, Human
ucucugcucugugccucaguuu

SEQ ID NO: 1096039 - RNA, 22 nt, Human
uaaaaucagccgaccauggugg

SEQ ID NO: 1096040 - RNA, 23 nt, Human
agccagggcacugguggagauug

SEQ ID NO: 1096041 - RNA, 22 nt, Human
cugggcagguauacaaaaaaug

SEQ ID NO: 1096042 - RNA, 22 nt, Human
gccaggugcaccugcccuggcc

SEQ ID NO: 1096043 - RNA, 18 nt, Human
uugauaaacaauuucauu

SEQ ID NO: 1096044 - RNA, 22 nt, Human
aauggacaggagagcauaguca

SEQ ID NO: 1096045 - RNA, 22 nt, Human
ucugaaauauugguaauacuuu

SEQ ID NO: 1096046 - RNA, 22 nt, Human
gcucaggauuucauccaugugu

SEQ ID NO: 1096047 - RNA, 22 nt, Human
acagggaaguucugcaacagga

SEQ ID NO: 1096048 - RNA, 19 nt, Human
gccuaugucuucaaaucau

SEQ ID NO: 1096049 - RNA, 22 nt, Human
cagaguuuugugaacaacuugg

SEQ ID NO: 1096050 - RNA, 22 nt, Human
aaggcacugacugugcagggga

SEQ ID NO: 1096051 - RNA, 22 nt, Human
accaagcuagaacauuacaggc

SEQ ID NO: 1096052 - RNA, 22 nt, Human
uuuuuaugccuacgcugaaaag

SEQ ID NO: 1096053 - RNA, 22 nt, Human
ggggaggaagcuggaacacggg

SEQ ID NO: 1096054 - RNA, 22 nt, Human
ugcucuggagggugaagcuuuu

SEQ ID NO: 1096055 - RNA, 22 nt, Human
aggcuucuaggguuggcagcgg

SEQ ID NO: 1096056 - RNA, 22 nt, Human
uggaaauuuugaacaguuucua

SEQ ID NO: 1096057 - RNA, 22 nt, Human
ucaggggcuugaggugcauguc

SEQ ID NO: 1096058 - RNA, 22 nt, Human
auauucuugugauuauaaagua

SEQ ID NO: 1096059 - RNA, 22 nt, Human
gagaagucauuugaccaccuag

SEQ ID NO: 1096060 - RNA, 22 nt, Human
ucaggaacauuuaaccacaggg

SEQ ID NO: 1096061 - RNA, 22 nt, Human
caucacccggaacugugucugc

SEQ ID NO: 1096062 - RNA, 22 nt, Human
acuggcucagaguuccuagaga

SEQ ID NO: 1096063 - RNA, 22 nt, Human
ccugcccagcuucccgagugca

SEQ ID NO: 1096064 - RNA, 22 nt, Human
ugaaagaacuagcaucuucaag

SEQ ID NO: 1096065 - RNA, 22 nt, Human
uuugaaacaggugauucagcua

SEQ ID NO: 1096066 - RNA, 23 nt, Human
uggacaguaggguagacagugcc

SEQ ID NO: 1096067 - RNA, 22 nt, Human
augucccaagauacagcuagag

SEQ ID NO: 1096068 - RNA, 22 nt, Human
cagaacauuccaugugcccugc

SEQ ID NO: 1096069 - RNA, 18 nt, Human
aggacuugccucaguugc

SEQ ID NO: 1096070 - RNA, 22 nt, Human
ggccagagucuauaugcagaca

SEQ ID NO: 1096071 - RNA, 22 nt, Human
cacaguguggcaaauuucaacu

SEQ ID NO: 1096072 - RNA, 22 nt, Human
aagaacaacugcuuuaaaagca

SEQ ID NO: 1096073 - RNA, 22 nt, Human
ggaggcccagagaggugaagug

SEQ ID NO: 1096074 - RNA, 22 nt, Human
cuuuuucugauguuccaugauu

SEQ ID NO: 1096075 - RNA, 22 nt, Human
cuggccacuggagguggcaccc

SEQ ID NO: 1096076 - RNA, 22 nt, Human
uuaacagaggacacaucaaacu

SEQ ID NO: 1096077 - RNA, 22 nt, Human
acaggcagguaauuuacauauu

SEQ ID NO: 1096078 - RNA, 22 nt, Human
ucacagcaacccugaggcgagu

SEQ ID NO: 1096079 - RNA, 22 nt, Human
gcaaaggcuucuuuuauucucc

SEQ ID NO: 1096080 - RNA, 22 nt, Human
uuaccagaugggggacuaugag

SEQ ID NO: 1096081 - RNA, 22 nt, Human
ucagggacuaggugcugccuga

SEQ ID NO: 1096082 - RNA, 22 nt, Human
cccuggagugccggaaucaaga

SEQ ID NO: 1096083 - RNA, 22 nt, Human
uagcacacugcauaugaagauu

SEQ ID NO: 1096084 - RNA, 22 nt, Human
uucucuacuugagauuuuaaug

SEQ ID NO: 1096085 - RNA, 22 nt, Human
acacagauaaugcucauauagg

SEQ ID NO: 1096086 - RNA, 22 nt, Human
augcacaagcaagagauaaugg

SEQ ID NO: 1096087 - RNA, 19 nt, Human
uggcagcauugguaccuug

SEQ ID NO: 1096088 - RNA, 22 nt, Human
ggggcaggagcccuucuucagc

SEQ ID NO: 1096089 - RNA, 22 nt, Human
ccugucugcaugaucccugcca

SEQ ID NO: 1096090 - RNA, 22 nt, Human
accucugcaguagggcugugcc

SEQ ID NO: 1096091 - RNA, 22 nt, Human
agaaacauccugcuuuccauuu

SEQ ID NO: 1096092 - RNA, 22 nt, Human
gagaugagugggggaucucuca

SEQ ID NO: 1096093 - RNA, 22 nt, Human
caggguggaaaagcuaguugga

SEQ ID NO: 1096094 - RNA, 22 nt, Human
uucuggagagaaaccuuacaaa

SEQ ID NO: 1096095 - RNA, 22 nt, Human
cugcuuugacuguuaagaacca

SEQ ID NO: 1096096 - RNA, 22 nt, Human
cagacaggaaguucagaagaaa

SEQ ID NO: 1096097 - RNA, 20 nt, Human
aguuugugugucuaugcgcu

SEQ ID NO: 1096098 - RNA, 22 nt, Human
gaacuuuauuccagaagaaagc

SEQ ID NO: 1096099 - RNA, 22 nt, Human
auucugaaguugcaggagaagc

SEQ ID NO: 1096100 - RNA, 22 nt, Human
gaguauuccucagucauuuugu

SEQ ID NO: 1096101 - RNA, 22 nt, Human
ucagaucauggaucuauuacuu

SEQ ID NO: 1096102 - RNA, 23 nt, Human
ugagaagccauuagagcaggugg

SEQ ID NO: 1096103 - RNA, 22 nt, Human
uuggccuuaaccucucugugcc

SEQ ID NO: 1096104 - RNA, 22 nt, Human
ucuauuaaugauucaauagugu

SEQ ID NO: 1096105 - RNA, 22 nt, Human
agcagagcgccugcucagaggg

SEQ ID NO: 1096106 - RNA, 22 nt, Human
auuuuccaaaauaauuguuacu

SEQ ID NO: 1096107 - RNA, 22 nt, Human
cugggaagccacaggguguggg

SEQ ID NO: 1096108 - RNA, 22 nt, Human
augaggcagauguugcaugagg

SEQ ID NO: 1096109 - RNA, 21 nt, Human
uaucagaagagaaagaaugau

SEQ ID NO: 1096110 - RNA, 22 nt, Human
agguggcaggaggucagagaaa

SEQ ID NO: 1096111 - RNA, 22 nt, Human
agcagggaggcggugugcuggc

SEQ ID NO: 1096112 - RNA, 22 nt, Human
gcugcugucagugguggcaguu

SEQ ID NO: 1096113 - RNA, 21 nt, Human
cuguccaaauuucauaacuuu

SEQ ID NO: 1096114 - RNA, 22 nt, Human
aauaaacaaaucuuuccugugg

SEQ ID NO: 1096115 - RNA, 22 nt, Human
cagcugcuuuaguuuuccaucc

SEQ ID NO: 1096116 - RNA, 22 nt, Human
ccagcagcucccucaggguccg

SEQ ID NO: 1096117 - RNA, 22 nt, Human
acauugaacauggcaggacauu

SEQ ID NO: 1096118 - RNA, 22 nt, Human
guaggcagucucucaggugauc

SEQ ID NO: 1096119 - RNA, 22 nt, Human
acucagaaugacugaugcugug

SEQ ID NO: 1096120 - RNA, 22 nt, Human
auucacaguuacugcugaacca

SEQ ID NO: 1096121 - RNA, 22 nt, Human
ucacaucacuagcugguaauga

SEQ ID NO: 1096122 - RNA, 22 nt, Human
agagccuggaccugagcuacaa

SEQ ID NO: 1096123 - RNA, 22 nt, Human
ccaucccuucucuggccagcag

SEQ ID NO: 1096124 - RNA, 22 nt, Human
acaacaguagccuuuacaaggc

SEQ ID NO: 1096125 - RNA, 22 nt, Human
ugcaugcacgugcuauguauga

SEQ ID NO: 1096126 - RNA, 22 nt, Human
agcagccacagcagaucugagu

SEQ ID NO: 1096127 - RNA, 23 nt, Human
acuuuagauaaauuaugugcaca

SEQ ID NO: 1096128 - RNA, 22 nt, Human
caguggucugugcuucuguaca

SEQ ID NO: 1096129 - RNA, 19 nt, Human
aguuggggcagggaagaga

SEQ ID NO: 1096130 - RNA, 22 nt, Human
aucagacaauuguugaguacug

SEQ ID NO: 1096131 - RNA, 22 nt, Human
aggaagcugggaaacugacauu

SEQ ID NO: 1096132 - RNA, 22 nt, Human
aguguuaaugguguauauuagg

SEQ ID NO: 1096133 - RNA, 22 nt, Human
ucccaggacaggccacauggaa

SEQ ID NO: 1096134 - RNA, 22 nt, Human
ccucccugcgcuccugcggcgg

SEQ ID NO: 1096135 - RNA, 22 nt, Human
cuggccagugccugugggcccc

SEQ ID NO: 1096136 - RNA, 22 nt, Human
ggggggugcugaucaguggagc

SEQ ID NO: 1096137 - RNA, 22 nt, Human
ccaaaucaggggccacaagcau

SEQ ID NO: 1096138 - RNA, 22 nt, Human
agcagcauguugggaugugaaa

SEQ ID NO: 1096139 - RNA, 22 nt, Human
ugaaaauauaguuuuccagacu

SEQ ID NO: 1096140 - RNA, 22 nt, Human
ccucuggguaucuguggaagua

SEQ ID NO: 1096141 - RNA, 22 nt, Human
uuuacaagucagggacuguucu

SEQ ID NO: 1096142 - RNA, 22 nt, Human
ccagagaauuuuagacaaaaau

SEQ ID NO: 1096143 - RNA, 22 nt, Human
aggcuucccaagcagcugcaaa

SEQ ID NO: 1096144 - RNA, 22 nt, Human
cagcucaaguuucccaggucag

SEQ ID NO: 1096145 - RNA, 22 nt, Human
ucacagaagcuugaagauuuuc

SEQ ID NO: 1096146 - RNA, 19 nt, Human
ugucacugucauggcccag

SEQ ID NO: 1096147 - RNA, 22 nt, Human
uacacaauucuggaugcauguc

SEQ ID NO: 1096148 - RNA, 22 nt, Human
auauuuucacugaaccaaagua

SEQ ID NO: 1096149 - RNA, 22 nt, Human
ugggcucagccaugaccuccac

SEQ ID NO: 1096150 - RNA, 22 nt, Human
agcccugcgugccaggggacug

SEQ ID NO: 1096151 - RNA, 22 nt, Human
uaaaguauccaguuauucuucu

SEQ ID NO: 1096152 - RNA, 22 nt, Human
gaacagagaagcuuuacuaaag

SEQ ID NO: 1096153 - RNA, 22 nt, Human
augaggcauuccacucaaacuc

SEQ ID NO: 1096154 - RNA, 22 nt, Human
gccuuugcaccaucagugcaau

SEQ ID NO: 1096155 - RNA, 22 nt, Human
aacauguaaauaucauuguacu

SEQ ID NO: 1096156 - RNA, 22 nt, Human
gagcuagacugggcucugaugu

SEQ ID NO: 1096157 - RNA, 22 nt, Human
gcagaagcugggagaagggauu

SEQ ID NO: 1096158 - RNA, 22 nt, Human
cagggguggcugcagcagaggu

SEQ ID NO: 1096159 - RNA, 22 nt, Human
ccagggcauguaacuaauggug

SEQ ID NO: 1096160 - RNA, 22 nt, Human
auggcagggaccaagcugucau

SEQ ID NO: 1096161 - RNA, 22 nt, Human
ugggaugggaucucgcuguguc

SEQ ID NO: 1096162 - RNA, 22 nt, Human
ucagcuuguuuaugauaagcag

SEQ ID NO: 1096163 - RNA, 22 nt, Human
cuccugagcucugaggaagcuu

SEQ ID NO: 1096164 - RNA, 22 nt, Human
gcagcugguuaaugggagaauu

SEQ ID NO: 1096165 - RNA, 22 nt, Human
agcagggcuucugugccugugc

SEQ ID NO: 1096166 - RNA, 22 nt, Human
ccuccagcugccucagucucuu

SEQ ID NO: 1096167 - RNA, 22 nt, Human
aggaaacuccccuacaucucaa

SEQ ID NO: 1096168 - RNA, 22 nt, Human
ggcagagacuggguuggcagag

SEQ ID NO: 1096169 - RNA, 22 nt, Human
cccugcuuugcacccaggcugg

SEQ ID NO: 1096170 - RNA, 22 nt, Human
ugaaggaaugaguauacuguuu

SEQ ID NO: 1096171 - RNA, 22 nt, Human
ucccagaggcuccagucucuau

SEQ ID NO: 1096172 - RNA, 22 nt, Human
cagggccagccauccugcuggg

SEQ ID NO: 1096173 - RNA, 22 nt, Human
cccaggcugauguucagcgggu

SEQ ID NO: 1096174 - RNA, 22 nt, Human
uuacaaacaagaucuuauucuu

SEQ ID NO: 1096175 - RNA, 22 nt, Human
cagcuggcagcccuggcccugc

SEQ ID NO: 1096176 - RNA, 20 nt, Human
ggcagcucacuacuuucugu

SEQ ID NO: 1096177 - RNA, 22 nt, Human
ugaaaauggccugaagaagcaa

SEQ ID NO: 1096178 - RNA, 22 nt, Human
aggcacuggguaauuaguagcu

SEQ ID NO: 1096179 - RNA, 21 nt, Human
ggagcugcaggagccgaaggc

SEQ ID NO: 1096180 - RNA, 22 nt, Human
gcugauccuuuuaugucuagcu

SEQ ID NO: 1096181 - RNA, 16 nt, Human
gggagggaguuggugg

SEQ ID NO: 1096182 - RNA, 22 nt, Human
ggugccaggcuguagucagggu

SEQ ID NO: 1096183 - RNA, 22 nt, Human
aaaagauuguuagggagaaugu

SEQ ID NO: 1096184 - RNA, 22 nt, Human
aauauuucaaaaggaaacacag

SEQ ID NO: 1096185 - RNA, 22 nt, Human
aaaugcuuagagguguucaaau

SEQ ID NO: 1096186 - RNA, 22 nt, Human
agaauauaguuaccaaauucug

SEQ ID NO: 1096187 - RNA, 22 nt, Human
aucagacagggaguucuguguc

SEQ ID NO: 1096188 - RNA, 22 nt, Human
acagcuuuuuacuaauagauug

SEQ ID NO: 1096189 - RNA, 22 nt, Human
ccguggaguugugcugaguaug

SEQ ID NO: 1096190 - RNA, 22 nt, Human
acuggcagcagcagcccuuggg

SEQ ID NO: 1096191 - RNA, 22 nt, Human
uaaccauauuuuccauuaaguu

SEQ ID NO: 1096192 - RNA, 18 nt, Human
cugggccuuuguauuuuu

SEQ ID NO: 1096193 - RNA, 22 nt, Human
ggcaggcauuagagauucccag

SEQ ID NO: 1096194 - RNA, 22 nt, Human
auauaaaguguuuagaaagcug

SEQ ID NO: 1096195 - RNA, 22 nt, Human
uuccaagagucagcugauccca

SEQ ID NO: 1096196 - RNA, 22 nt, Human
gggugcaggcagcccaggcagg

SEQ ID NO: 1096197 - RNA, 22 nt, Human
acagccagaggagccaggcugg

SEQ ID NO: 1096198 - RNA, 22 nt, Human
aggguagggcccggagacagac

SEQ ID NO: 1096199 - RNA, 22 nt, Human
agcagagaagacacaggcuuca

SEQ ID NO: 1096200 - RNA, 22 nt, Human
aauaacaggguugauuugcaau

SEQ ID NO: 1096201 - RNA, 22 nt, Human
uucaauaucauuguuuagucuc

SEQ ID NO: 1096202 - RNA, 19 nt, Human
cugcucaggucagucuguc

SEQ ID NO: 1096203 - RNA, 22 nt, Human
gucugggcaagggagauggcgc

SEQ ID NO: 1096204 - RNA, 22 nt, Human
agucucagaguaccugagggac

SEQ ID NO: 1096205 - RNA, 22 nt, Human
uauuccaagugccuagaagagu

SEQ ID NO: 1096206 - RNA, 22 nt, Human
cugcugugugaccauggacagg

SEQ ID NO: 1096207 - RNA, 22 nt, Human
cagggcugaacugagcuuguga

SEQ ID NO: 1096208 - RNA, 22 nt, Human
uuggauuacaugaaaugcagaa

SEQ ID NO: 1096209 - RNA, 22 nt, Human
ucauaaaacacaccagguaguu

SEQ ID NO: 1096210 - RNA, 22 nt, Human
ccagggcuggguuugucggugu

SEQ ID NO: 1096211 - RNA, 22 nt, Human
aauguauaaaguguuaauaacu

SEQ ID NO: 1096212 - RNA, 22 nt, Human
ugcugccuucuaggcgugcccu

SEQ ID NO: 1096213 - RNA, 22 nt, Human
cacuaaguaagcuccucuacaa

SEQ ID NO: 1096214 - RNA, 22 nt, Human
cagcuguucggggcuggcaugu

SEQ ID NO: 1096215 - RNA, 22 nt, Human
cagccaccauacagcagaagcu

SEQ ID NO: 1096216 - RNA, 22 nt, Human
gcaggagcuuugcuuacugcug

SEQ ID NO: 1096217 - RNA, 22 nt, Human
uggaguucauccaugacagcuu

SEQ ID NO: 1096218 - RNA, 19 nt, Human
uggaagaggaagggaaaua

SEQ ID NO: 1096219 - RNA, 22 nt, Human
auuguauaacagcauguauuuu

SEQ ID NO: 1096220 - RNA, 22 nt, Human
aguguuguaauaaauaucaucu

SEQ ID NO: 1096221 - RNA, 23 nt, Human
uuuauacaagaaaccgcuggccu

SEQ ID NO: 1096222 - RNA, 22 nt, Human
ucccaagagacagaaugguauc

SEQ ID NO: 1096223 - RNA, 22 nt, Human
ucucccaguccucugugcuuac

SEQ ID NO: 1096224 - RNA, 22 nt, Human
aguuauuuuggaaaaugaguca

SEQ ID NO: 1096225 - RNA, 22 nt, Human
uaggcugggcauucuggccagg

SEQ ID NO: 1096226 - RNA, 22 nt, Human
cugcugugccucuuuucacgug

SEQ ID NO: 1096227 - RNA, 22 nt, Human
ggagagaauucagcuuaagauu

SEQ ID NO: 1096228 - RNA, 22 nt, Human
ucuuuuccuugaugguuaaaua

SEQ ID NO: 1096229 - RNA, 20 nt, Human
uaaagcagccguggagggua

SEQ ID NO: 1096230 - RNA, 22 nt, Human
caugcuguguguuuuagcucca

SEQ ID NO: 1096231 - RNA, 22 nt, Human
uuccaacuuugucauauauuau

SEQ ID NO: 1096232 - RNA, 22 nt, Human
gugccuuccccgguggucuguu

SEQ ID NO: 1096233 - RNA, 21 nt, Human
agcuggcagauauggugucug

SEQ ID NO: 1096234 - RNA, 22 nt, Human
ggcuggcacccuuggggauagg

SEQ ID NO: 1096235 - RNA, 20 nt, Human
ucccucaggucauugggcug

SEQ ID NO: 1096236 - RNA, 18 nt, Human
gggcaagcggcugucacc

SEQ ID NO: 1096237 - RNA, 20 nt, Human
ggcaggcuuuauauggaggg

SEQ ID NO: 1096238 - RNA, 22 nt, Human
uacacagaaauuguguagggau

SEQ ID NO: 1096239 - RNA, 22 nt, Human
gccucugcucggacuuugccuc

SEQ ID NO: 1096240 - RNA, 20 nt, Human
ugcaggugggcccuucuggg

SEQ ID NO: 1096241 - RNA, 22 nt, Human
gaaaugaacugauuaucauugc

SEQ ID NO: 1096242 - RNA, 22 nt, Human
gccacaggcacuuaagggcugg

SEQ ID NO: 1096243 - RNA, 22 nt, Human
uagaaacacagaucugguguca

SEQ ID NO: 1096244 - RNA, 22 nt, Human
ggagccuguggcugcuugaagc

SEQ ID NO: 1096245 - RNA, 22 nt, Human
gcaggugggggagaaguuguga

SEQ ID NO: 1096246 - RNA, 22 nt, Human
gcaggagugacauggaugugga

SEQ ID NO: 1096247 - RNA, 22 nt, Human
gugcaugucggggugcauguca

SEQ ID NO: 1096248 - RNA, 22 nt, Human
ccaguguuggaggauggcuugc

SEQ ID NO: 1096249 - RNA, 22 nt, Human
ccuggaaggcaggcauggauug

SEQ ID NO: 1096250 - RNA, 22 nt, Human
guucugggaagguggaccuguu

SEQ ID NO: 1096251 - RNA, 22 nt, Human
uugaaacucaucuuagugaugu

SEQ ID NO: 1096252 - RNA, 22 nt, Human
acugggccuacccagauuggca

SEQ ID NO: 1096253 - RNA, 22 nt, Human
cgcuaggauuaggauuaauccu

SEQ ID NO: 1096254 - RNA, 22 nt, Human
cagcaucucuuuuugcauuccu

SEQ ID NO: 1096255 - RNA, 22 nt, Human
gaauucuaccagggcaagaggg

SEQ ID NO: 1096256 - RNA, 22 nt, Human
ggaacccagagcucauaaaauu

SEQ ID NO: 1096257 - RNA, 22 nt, Human
agacugaaguaagaaugcagcu

SEQ ID NO: 1096258 - RNA, 22 nt, Human
ucuuuugugauucuucaguuac

SEQ ID NO: 1096259 - RNA, 22 nt, Human
gugucccaaagauuagaaauca

SEQ ID NO: 1096260 - RNA, 22 nt, Human
aaggugaaacuggaagcuggcc

SEQ ID NO: 1096261 - RNA, 22 nt, Human
gcauccaaaccauucaucagcc

SEQ ID NO: 1096262 - RNA, 22 nt, Human
augaggcaggagugcaguggca

SEQ ID NO: 1096263 - RNA, 22 nt, Human
aacaguguuuugcucuuugccc

SEQ ID NO: 1096264 - RNA, 22 nt, Human
aaggaagggaaauagugauguc

SEQ ID NO: 1096265 - RNA, 22 nt, Human
ugucucaguauacgaaacacuu

SEQ ID NO: 1096266 - RNA, 22 nt, Human
cauuucauuccuuugaaagugg

SEQ ID NO: 1096267 - RNA, 22 nt, Human
auauuucuggggguguguuucu

SEQ ID NO: 1096268 - RNA, 22 nt, Human
ugucauuuggugccaggaaaga

SEQ ID NO: 1096269 - RNA, 22 nt, Human
auauacugauagcugcacuucu

SEQ ID NO: 1096270 - RNA, 22 nt, Human
gggcgagggcgaaagcgagagc

SEQ ID NO: 1096271 - RNA, 22 nt, Human
ggcacugaauuucuuggcaucu

SEQ ID NO: 1096272 - RNA, 22 nt, Human
ugcucagauuacagccccacau

SEQ ID NO: 1096273 - RNA, 22 nt, Human
ggcgcuggccacgguggcucug

SEQ ID NO: 1096274 - RNA, 22 nt, Human
ucacaguucaacuaguucagau

SEQ ID NO: 1096275 - RNA, 22 nt, Human
ucucaguguuuaaaaagauuuc

SEQ ID NO: 1096276 - RNA, 20 nt, Human
cugugcuuuggaaccuggaa

SEQ ID NO: 1096277 - RNA, 22 nt, Human
cuuuuucuaaucauaauugucu

SEQ ID NO: 1096278 - RNA, 23 nt, Human
agcacacuuguacaaugcccuag

SEQ ID NO: 1096279 - RNA, 22 nt, Human
gcuaaugugauagagcagaaag

SEQ ID NO: 1096280 - RNA, 22 nt, Human
cugagcugguggaagcaugcag

SEQ ID NO: 1096281 - RNA, 22 nt, Human
aagagcagaaguccuuggaucc

SEQ ID NO: 1096282 - RNA, 22 nt, Human
aggcacaggaaugucauccagu

SEQ ID NO: 1096283 - RNA, 22 nt, Human
acaggcauauuucuagauuaca

SEQ ID NO: 1096284 - RNA, 22 nt, Human
ucaugcaaucucuuguucagga

SEQ ID NO: 1096285 - RNA, 22 nt, Human
agcagggcagcugaugcgcacg

SEQ ID NO: 1096286 - RNA, 22 nt, Human
gaaaguauuuaaguccauauuu

SEQ ID NO: 1096287 - RNA, 22 nt, Human
caggaagauuguggaggugguu

SEQ ID NO: 1096288 - RNA, 20 nt, Human
aggaaaaauggaaacuggag

SEQ ID NO: 1096289 - RNA, 22 nt, Human
ugucucugguauuaggugaaaa

SEQ ID NO: 1096290 - RNA, 22 nt, Human
uggagcagaaauggccucuugu

SEQ ID NO: 1096291 - RNA, 22 nt, Human
cacagcugggaaaauuuguaca

SEQ ID NO: 1096292 - RNA, 19 nt, Human
uuugaaagaguuuuauugg

SEQ ID NO: 1096293 - RNA, 22 nt, Human
ccagacaggggcuguuccugcu

SEQ ID NO: 1096294 - RNA, 21 nt, Human
aaugaaguggcuauuuugagg

SEQ ID NO: 1096295 - RNA, 22 nt, Human
ugggccuguuucccuucagggc

SEQ ID NO: 1096296 - RNA, 22 nt, Human
uucaagucagagcaagccaagu

SEQ ID NO: 1096297 - RNA, 21 nt, Human
ucagaagagcugccucuuggu

SEQ ID NO: 1096298 - RNA, 22 nt, Human
uaugggucuggaaaauggcuug

SEQ ID NO: 1096299 - RNA, 22 nt, Human
ucagacagcuugggauaacuga

SEQ ID NO: 1096300 - RNA, 22 nt, Human
ucaggcuggaaugcaguggggc

SEQ ID NO: 1096301 - RNA, 22 nt, Human
ccuggcagcaggugggcccgug

SEQ ID NO: 1096302 - RNA, 22 nt, Human
ucugcugcugagcacacuccua

SEQ ID NO: 1096303 - RNA, 22 nt, Human
ggucccaguccucucccugcua

SEQ ID NO: 1096304 - RNA, 22 nt, Human
aagccaggggcugcuuaggaga

SEQ ID NO: 1096305 - RNA, 22 nt, Human
aucaggaucacugggagucuug

SEQ ID NO: 1096306 - RNA, 22 nt, Human
gcugucccaugguugcaagaug

SEQ ID NO: 1096307 - RNA, 22 nt, Human
gggccagagcuuggcagcuggg

SEQ ID NO: 1096308 - RNA, 22 nt, Human
aaggcauagucuuuaaguucug

SEQ ID NO: 1096309 - RNA, 23 nt, Human
acaugggagggacauggaggcug

SEQ ID NO: 1096310 - RNA, 22 nt, Human
uaaaggcagccuaggaaguguu

SEQ ID NO: 1096311 - RNA, 19 nt, Human
cuccucagucccagagguc

SEQ ID NO: 1096312 - RNA, 22 nt, Human
gggacuguaaauucauauggcc

SEQ ID NO: 1096313 - RNA, 22 nt, Human
uccaaaaaacguuugaauaguu

SEQ ID NO: 1096314 - RNA, 22 nt, Human
cugugucccccucagccaggug

SEQ ID NO: 1096315 - RNA, 22 nt, Human
aucaaagugauuuguaaacagg

SEQ ID NO: 1096316 - RNA, 22 nt, Human
ucuggcucuccagugcucuuag

SEQ ID NO: 1096317 - RNA, 19 nt, Human
ugaguucugugguucucaa

SEQ ID NO: 1096318 - RNA, 22 nt, Human
acaggaacccagaaacauuucu

SEQ ID NO: 1096319 - RNA, 22 nt, Human
aaacaucaccauuuuaccuaau

SEQ ID NO: 1096320 - RNA, 22 nt, Human
cugaaauucugccucugcacaa

SEQ ID NO: 1096321 - RNA, 22 nt, Human
aggagaguucacacuggucaga

SEQ ID NO: 1096322 - RNA, 22 nt, Human
uguaguaagugcgcaauaaaua

SEQ ID NO: 1096323 - RNA, 22 nt, Human
ccagaugguuugcaugggaggg

SEQ ID NO: 1096324 - RNA, 22 nt, Human
aucuaauuuucacucauuugcu

SEQ ID NO: 1096325 - RNA, 18 nt, Human
agcagguggcgucugcag

SEQ ID NO: 1096326 - RNA, 22 nt, Human
gaaaggucuuccggucuuccag

SEQ ID NO: 1096327 - RNA, 22 nt, Human
ugaggcaguauuuuagugacuu

SEQ ID NO: 1096328 - RNA, 22 nt, Human
aaagccaaaugaaagaugguuc

SEQ ID NO: 1096329 - RNA, 22 nt, Human
uccauuuuguagguaugcuaca

SEQ ID NO: 1096330 - RNA, 22 nt, Human
aaacucuuuugcauauuagagg

SEQ ID NO: 1096331 - RNA, 22 nt, Human
aaucuguucuacucuauucaga

SEQ ID NO: 1096332 - RNA, 22 nt, Human
ucuggcucagggcucugaggga

SEQ ID NO: 1096333 - RNA, 22 nt, Human
cacaggugcuccucggggagcu

SEQ ID NO: 1096334 - RNA, 22 nt, Human
agagcuguuuggacaucugagu

SEQ ID NO: 1096335 - RNA, 22 nt, Human
uucaguauguguaaacuacuuu

SEQ ID NO: 1096336 - RNA, 22 nt, Human
gcugggaggaauuuggggaaua

SEQ ID NO: 1096337 - RNA, 22 nt, Human
ucaggaugaccacgagccucua

SEQ ID NO: 1096338 - RNA, 22 nt, Human
ucacaucacaugacaguaggcc

SEQ ID NO: 1096339 - RNA, 22 nt, Human
gcugaagcugcagcaggaggaa

SEQ ID NO: 1096340 - RNA, 22 nt, Human
uuugugugggggaaacaaggua

SEQ ID NO: 1096341 - RNA, 22 nt, Human
ggaacuuuaggauccuggcuca

SEQ ID NO: 1096342 - RNA, 22 nt, Human
gacaucauagggugggaggaaa

SEQ ID NO: 1096343 - RNA, 22 nt, Human
auguucuuccaaaucuguaaca

SEQ ID NO: 1096344 - RNA, 23 nt, Human
aggcugcagaagaauagggucau

SEQ ID NO: 1096345 - RNA, 22 nt, Human
gcguuggggaccccgaagcugg

SEQ ID NO: 1096346 - RNA, 17 nt, Human
ugaaaucagcacccagg

SEQ ID NO: 1096347 - RNA, 22 nt, Human
ccugagggaaggaugcuaccca

SEQ ID NO: 1096348 - RNA, 22 nt, Human
ugaagaacgugagauccagaaa

SEQ ID NO: 1096349 - RNA, 23 nt, Human
ucaguuuuggcuguucaguguug

SEQ ID NO: 1096350 - RNA, 22 nt, Human
ccaggaggcggaagguacagug

SEQ ID NO: 1096351 - RNA, 22 nt, Human
uuuggcuugcacuggcaccaac

SEQ ID NO: 1096352 - RNA, 22 nt, Human
aggccucuguuccccauguuuu

SEQ ID NO: 1096353 - RNA, 19 nt, Human
uguggccaugguucagcug

SEQ ID NO: 1096354 - RNA, 22 nt, Human
aagaagagaaaugugcugcugg

SEQ ID NO: 1096355 - RNA, 22 nt, Human
ccugagauguguaacagauggu

SEQ ID NO: 1096356 - RNA, 22 nt, Human
gcucuccacugaccacggggca

SEQ ID NO: 1096357 - RNA, 22 nt, Human
uugaucagguugcuguggugua

SEQ ID NO: 1096358 - RNA, 22 nt, Human
uauuugaaaguguacaaaaacu

SEQ ID NO: 1096359 - RNA, 22 nt, Human
gagccagggcugugagcugagc

SEQ ID NO: 1096360 - RNA, 22 nt, Human
aagacaauauugcugugaacgu

SEQ ID NO: 1096361 - RNA, 22 nt, Human
auucuuauuuaaauagagucug

SEQ ID NO: 1096362 - RNA, 22 nt, Human
ucugaaauaggagccauguaga

SEQ ID NO: 1096363 - RNA, 19 nt, Human
ugaaauggcaguugcuaaa

SEQ ID NO: 1096364 - RNA, 22 nt, Human
gaacuacaguaagaauugaugu

SEQ ID NO: 1096365 - RNA, 19 nt, Human
agcagguggguaagaaaau

SEQ ID NO: 1096366 - RNA, 22 nt, Human
acuuccaggaggugucacugaa

SEQ ID NO: 1096367 - RNA, 22 nt, Human
ugccaggcccugugcuggaugc

SEQ ID NO: 1096368 - RNA, 22 nt, Human
ggcgguggcgugaagguggcug

SEQ ID NO: 1096369 - RNA, 21 nt, Human
aggcuguccuuugccagcccu

SEQ ID NO: 1096370 - RNA, 19 nt, Human
uggcugggugccaauggcc

SEQ ID NO: 1096371 - RNA, 22 nt, Human
gagaggaguagacacuuugguu

SEQ ID NO: 1096372 - RNA, 22 nt, Human
cggcuggggcuguccccaugac

SEQ ID NO: 1096373 - RNA, 22 nt, Human
cuuuggcacagucucauuugau

SEQ ID NO: 1096374 - RNA, 22 nt, Human
agacucaagacugcagaagacg

SEQ ID NO: 1096375 - RNA, 22 nt, Human
uuuggaaacacggucaucuucc

SEQ ID NO: 1096376 - RNA, 22 nt, Human
uuuucaagggcagggaaaucau

SEQ ID NO: 1096377 - RNA, 22 nt, Human
accugaaaccaacuuguguacu

SEQ ID NO: 1096378 - RNA, 22 nt, Human
cagaccaucuugaagcaaacug

SEQ ID NO: 1096379 - RNA, 22 nt, Human
gggcaguggcucacgccuguaa

SEQ ID NO: 1096380 - RNA, 22 nt, Human
aaacauuugcaacucgguuugg

SEQ ID NO: 1096381 - RNA, 20 nt, Human
ggaagcagagaacuguuuuc

SEQ ID NO: 1096382 - RNA, 22 nt, Human
aacaucuuguccuuagauuaaa

SEQ ID NO: 1096383 - RNA, 22 nt, Human
gagcuggguauauggcuuuaug

SEQ ID NO: 1096384 - RNA, 22 nt, Human
cagcuguucuugggacagacag

SEQ ID NO: 1096385 - RNA, 22 nt, Human
ccuggagcaggagcugcagagg

SEQ ID NO: 1096386 - RNA, 22 nt, Human
ccugggagugugccaucucugu

SEQ ID NO: 1096387 - RNA, 17 nt, Human
agcugagcuggccaggg

SEQ ID NO: 1096388 - RNA, 23 nt, Human
uuguacagcccagauuccucuuc

SEQ ID NO: 1096389 - RNA, 22 nt, Human
aauguuugaccaaaaaacugca

SEQ ID NO: 1096390 - RNA, 22 nt, Human
uggcaaagcuagacauucccuc

SEQ ID NO: 1096391 - RNA, 21 nt, Human
uucuuuccccagaggacuaaa

SEQ ID NO: 1096392 - RNA, 22 nt, Human
ucugggcugguugugcuugcuu

SEQ ID NO: 1096393 - RNA, 22 nt, Human
gucuuucuuaauucaagugcuu

SEQ ID NO: 1096394 - RNA, 19 nt, Human
uggcucugucgaaggcaca

SEQ ID NO: 1096395 - RNA, 22 nt, Human
agccucugucaagcuuuucaaa

SEQ ID NO: 1096396 - RNA, 22 nt, Human
uacaagaaauuucugcauauau

SEQ ID NO: 1096397 - RNA, 22 nt, Human
caccuaggguuucgccuuucuu

SEQ ID NO: 1096398 - RNA, 22 nt, Human
agggagaaugaccaagguauau

SEQ ID NO: 1096399 - RNA, 23 nt, Human
agcugaggcugugggugucagag

SEQ ID NO: 1096400 - RNA, 22 nt, Human
cccaggugggcaccucgaggaa

SEQ ID NO: 1096401 - RNA, 22 nt, Human
uuacaguuguagaaagugguug

SEQ ID NO: 1096402 - RNA, 23 nt, Human
gcucagagguuuuucucuggaug

SEQ ID NO: 1096403 - RNA, 22 nt, Human
gcuguggaaaugccuaacauga

SEQ ID NO: 1096404 - RNA, 21 nt, Human
cauuucuauugaugagaaaag

SEQ ID NO: 1096405 - RNA, 22 nt, Human
gaggcuggaggucaaagaugaa

SEQ ID NO: 1096406 - RNA, 22 nt, Human
uauucucagcaacacacaugga

SEQ ID NO: 1096407 - RNA, 22 nt, Human
uuauuuauggcacuguuggugg

SEQ ID NO: 1096408 - RNA, 22 nt, Human
cuggggaggcagggcugccccu

SEQ ID NO: 1096409 - RNA, 22 nt, Human
uaggaagaagcagccuugcuua

SEQ ID NO: 1096410 - RNA, 19 nt, Human
uugaaagauuagcuuucua

SEQ ID NO: 1096411 - RNA, 22 nt, Human
caucauuucacuuagaugaagu

SEQ ID NO: 1096412 - RNA, 22 nt, Human
ggaggccaaggcgggcggauca

SEQ ID NO: 1096413 - RNA, 22 nt, Human
ggcagcaggcgacuucccuauu

SEQ ID NO: 1096414 - RNA, 22 nt, Human
cauaggaaaagcauucuucuug

SEQ ID NO: 1096415 - RNA, 23 nt, Human
ugggcaucuccucugugccaggc

SEQ ID NO: 1096416 - RNA, 21 nt, Human
ccugccaggaaacugaguguc

SEQ ID NO: 1096417 - RNA, 22 nt, Human
uucauuugggaugagucagaag

SEQ ID NO: 1096418 - RNA, 22 nt, Human
uacagugucuggauaucaaagg

SEQ ID NO: 1096419 - RNA, 22 nt, Human
cagcucagcuuccugggugugu

SEQ ID NO: 1096420 - RNA, 22 nt, Human
uguggcagaaagcauguggaca

SEQ ID NO: 1096421 - RNA, 22 nt, Human
uuagccauugucagcacauggc

SEQ ID NO: 1096422 - RNA, 22 nt, Human
gagguggccucaagcagucuuc

SEQ ID NO: 1096423 - RNA, 22 nt, Human
guuaaguaaacuaugauuuauc

SEQ ID NO: 1096424 - RNA, 22 nt, Human
cugagcucuaaugucagccuug

SEQ ID NO: 1096425 - RNA, 22 nt, Human
agaaacuauccugaguagcaaa

SEQ ID NO: 1096426 - RNA, 22 nt, Human
uggggggauacuugcuacuggc

SEQ ID NO: 1096427 - RNA, 21 nt, Human
agcugagguaaggcaagagag

SEQ ID NO: 1096428 - RNA, 22 nt, Human
auaugagaauuggaaaauauca

SEQ ID NO: 1096429 - RNA, 22 nt, Human
uuuuauucucagcuccagagag

SEQ ID NO: 1096430 - RNA, 22 nt, Human
cagaaaaccugacucuagaacu

SEQ ID NO: 1096431 - RNA, 22 nt, Human
cuggaguuuuggaaaaaugcuu

SEQ ID NO: 1096432 - RNA, 22 nt, Human
caggacaguuugcuuugcccug

SEQ ID NO: 1096433 - RNA, 22 nt, Human
cugcccagaaucacucacucga

SEQ ID NO: 1096434 - RNA, 22 nt, Human
accagcuguguccuggcugcag

SEQ ID NO: 1096435 - RNA, 22 nt, Human
cgcugauaaacgucacguuccc

SEQ ID NO: 1096436 - RNA, 22 nt, Human
aaugggaaagagacuagaugcu

SEQ ID NO: 1096437 - RNA, 22 nt, Human
aggugcaggagcugugcaggga

SEQ ID NO: 1096438 - RNA, 22 nt, Human
uucuuuccccauggaguucgga

SEQ ID NO: 1096439 - RNA, 22 nt, Human
gagaauauuuuuagcuuuccuc

SEQ ID NO: 1096440 - RNA, 22 nt, Human
gggcugagagcuggaaucugag

SEQ ID NO: 1096441 - RNA, 22 nt, Human
caguagcacuagauaugugugg

SEQ ID NO: 1096442 - RNA, 22 nt, Human
aucagcuaauuagaauuaggau

SEQ ID NO: 1096443 - RNA, 22 nt, Human
auuuccaaaaccacuuauugcc

SEQ ID NO: 1096444 - RNA, 22 nt, Human
gcuuccagaccccagucccuca

SEQ ID NO: 1096445 - RNA, 22 nt, Human
gaagagcuaaaggcacaggcuu

SEQ ID NO: 1096446 - RNA, 22 nt, Human
gaggucaauaauaugugcuuua

SEQ ID NO: 1096447 - RNA, 22 nt, Human
cugugggagcacaugacagaua

SEQ ID NO: 1096448 - RNA, 20 nt, Human
agaaggcuccuuuugccaag

SEQ ID NO: 1096449 - RNA, 22 nt, Human
caagagcuagaaauugguuaga

SEQ ID NO: 1096450 - RNA, 22 nt, Human
aaugucugccagaacugaucau

SEQ ID NO: 1096451 - RNA, 22 nt, Human
uucuucaauaaauucccauaag

SEQ ID NO: 1096452 - RNA, 22 nt, Human
ccauuucauugccuguaaagug

SEQ ID NO: 1096453 - RNA, 20 nt, Human
gcugccuguuucuguaagua

SEQ ID NO: 1096454 - RNA, 22 nt, Human
uccagccuuccuuuucacucuc

SEQ ID NO: 1096455 - RNA, 22 nt, Human
caggcccugggcaggcacagag

SEQ ID NO: 1096456 - RNA, 22 nt, Human
cacacauucaccaugacugaaa

SEQ ID NO: 1096457 - RNA, 22 nt, Human
acauuucuaguuguucaucucc

SEQ ID NO: 1096458 - RNA, 21 nt, Human
gggggaagaggaguugcuagu

SEQ ID NO: 1096459 - RNA, 22 nt, Human
acauuuguaugcguuuuuacug

SEQ ID NO: 1096460 - RNA, 22 nt, Human
uucuuuaucaguuacucauagg

SEQ ID NO: 1096461 - RNA, 22 nt, Human
uauucccauuccacuuaucaag

SEQ ID NO: 1096462 - RNA, 22 nt, Human
gauauuuuuaggugaugcaggc

SEQ ID NO: 1096463 - RNA, 22 nt, Human
agcaggcuacuccuguguucgu

SEQ ID NO: 1096464 - RNA, 22 nt, Human
uuauugcagauggugugagaga

SEQ ID NO: 1096465 - RNA, 23 nt, Human
ugguggggucuuggagacagcac

SEQ ID NO: 1096466 - RNA, 22 nt, Human
uuguaauuaauggcagcaauua

SEQ ID NO: 1096467 - RNA, 22 nt, Human
ucuuuucuguaacucagugucu

SEQ ID NO: 1096468 - RNA, 22 nt, Human
auugacaagacaauggcucuua

SEQ ID NO: 1096469 - RNA, 22 nt, Human
cagaaauggaaguucugguuua

SEQ ID NO: 1096470 - RNA, 22 nt, Human
ugaugaaacugagguuccaaga

SEQ ID NO: 1096471 - RNA, 18 nt, Human
ugcucuggucucacuugg

SEQ ID NO: 1096472 - RNA, 22 nt, Human
uauuguacauuuccaaauugcu

SEQ ID NO: 1096473 - RNA, 22 nt, Human
gcaaggcugugcacuuugcauu

SEQ ID NO: 1096474 - RNA, 22 nt, Human
guaaacacuacaaaucaaggcu

SEQ ID NO: 1096475 - RNA, 22 nt, Human
uaaggcaccauaauauauuuaa

SEQ ID NO: 1096476 - RNA, 22 nt, Human
agccucugcacgggcacgggug

SEQ ID NO: 1096477 - RNA, 22 nt, Human
uauguacauggagagcaauuga

SEQ ID NO: 1096478 - RNA, 22 nt, Human
acugaaggucucagcaaggaug

SEQ ID NO: 1096479 - RNA, 22 nt, Human
agcugguggauuaugcuguaca

SEQ ID NO: 1096480 - RNA, 23 nt, Human
ucacauauguagaaguggaauuc

SEQ ID NO: 1096481 - RNA, 22 nt, Human
ggcuggcacagagggcuggugu

SEQ ID NO: 1096482 - RNA, 22 nt, Human
gaaggcugucagagaggagggc

SEQ ID NO: 1096483 - RNA, 21 nt, Human
gcucagaguauugcacuguuu

SEQ ID NO: 1096484 - RNA, 22 nt, Human
aagggcugaaagaccuugggca

SEQ ID NO: 1096485 - RNA, 22 nt, Human
aggcucaguuugguuuccauug

SEQ ID NO: 1096486 - RNA, 22 nt, Human
aagagacagagccauguuucua

SEQ ID NO: 1096487 - RNA, 22 nt, Human
gcacacaguagggauucaauga

SEQ ID NO: 1096488 - RNA, 22 nt, Human
gcccacagcucguuccucuccu

SEQ ID NO: 1096489 - RNA, 22 nt, Human
ucacacagcuaguaagggccga

SEQ ID NO: 1096490 - RNA, 22 nt, Human
gaggaagccccauugaagccag

SEQ ID NO: 1096491 - RNA, 22 nt, Human
gagagcugggggacuguggaug

SEQ ID NO: 1096492 - RNA, 22 nt, Human
ugcauauuguccuugauauuau

SEQ ID NO: 1096493 - RNA, 20 nt, Human
gugaccagaagacagugggu

SEQ ID NO: 1096494 - RNA, 22 nt, Human
ggucagcagugcagggcagagc

SEQ ID NO: 1096495 - RNA, 22 nt, Human
gcuuccucgcugggcagaggca

SEQ ID NO: 1096496 - RNA, 22 nt, Human
cucccagguuacaucugagccu

SEQ ID NO: 1096497 - RNA, 22 nt, Human
uggggcuucuccuguaggcuca

SEQ ID NO: 1096498 - RNA, 22 nt, Human
agaggccagaaaguaugccacc

SEQ ID NO: 1096499 - RNA, 22 nt, Human
gagguuggagggcuggccugca

SEQ ID NO: 1096500 - RNA, 19 nt, Human
aagaagcaauaagcuguga

SEQ ID NO: 1096501 - RNA, 22 nt, Human
cagucccaguuugagacucugg

SEQ ID NO: 1096502 - RNA, 22 nt, Human
acagauggggcacaaagccaca

SEQ ID NO: 1096503 - RNA, 22 nt, Human
acucacauuucaucaggccaag

SEQ ID NO: 1096504 - RNA, 17 nt, Human
ccauacugacauauuga

SEQ ID NO: 1096505 - RNA, 22 nt, Human
ccccuggguccaggcuucucug

SEQ ID NO: 1096506 - RNA, 20 nt, Human
aagggagaauaaugauugua

SEQ ID NO: 1096507 - RNA, 22 nt, Human
uggcagcuugaaugcagucuuu

SEQ ID NO: 1096508 - RNA, 22 nt, Human
uacaaagaggcagcuccauuuu

SEQ ID NO: 1096509 - RNA, 22 nt, Human
aaucagaacuucucaggguggg

SEQ ID NO: 1096510 - RNA, 22 nt, Human
ugggaggaagugcuaaugggag

SEQ ID NO: 1096511 - RNA, 22 nt, Human
gccccagcucugccacaacuag

SEQ ID NO: 1096512 - RNA, 22 nt, Human
acuccagggcuccaucccuugu

SEQ ID NO: 1096513 - RNA, 22 nt, Human
auuguucaaagugcuuugcaug

SEQ ID NO: 1096514 - RNA, 20 nt, Human
gccugagcuauugccaggau

SEQ ID NO: 1096515 - RNA, 17 nt, Human
acacagggagagggagc

SEQ ID NO: 1096516 - RNA, 18 nt, Human
cugaggcuuagagagguu

SEQ ID NO: 1096517 - RNA, 19 nt, Human
gggcucuggccucaguggg

SEQ ID NO: 1096518 - RNA, 22 nt, Human
ggcugcuugcuguuucuuggau

SEQ ID NO: 1096519 - RNA, 19 nt, Human
aauauuuuagccucuuccu

SEQ ID NO: 1096520 - RNA, 22 nt, Human
gaguaagagcuggcuuuggugu

SEQ ID NO: 1096521 - RNA, 22 nt, Human
gauuucuucucucccaagagga

SEQ ID NO: 1096522 - RNA, 22 nt, Human
aaauaugauacucccuuuuagu

SEQ ID NO: 1096523 - RNA, 22 nt, Human
gagacaaaaguuggagugcaag

SEQ ID NO: 1096524 - RNA, 22 nt, Human
caucagaacaaaucgguuaaga

SEQ ID NO: 1096525 - RNA, 22 nt, Human
uccugggaaguggcuggcugag

SEQ ID NO: 1096526 - RNA, 22 nt, Human
cccaggaagaggggucaggugu

SEQ ID NO: 1096527 - RNA, 22 nt, Human
auuggccugaaacugguucagc

SEQ ID NO: 1096528 - RNA, 22 nt, Human
aaauucugauuuaauaagugua

SEQ ID NO: 1096529 - RNA, 20 nt, Human
ccuggcuuugcaucugugau

SEQ ID NO: 1096530 - RNA, 22 nt, Human
acacaugaaagacauuaaggug

SEQ ID NO: 1096531 - RNA, 22 nt, Human
acauuugagcaucuacuaagug

SEQ ID NO: 1096532 - RNA, 22 nt, Human
aucagugaccugaaauguuuuu

SEQ ID NO: 1096533 - RNA, 22 nt, Human
auauugaucuuggaacugauuu

SEQ ID NO: 1096534 - RNA, 22 nt, Human
gucauaaagacagaaacauucc

SEQ ID NO: 1096535 - RNA, 22 nt, Human
gcauuucugugcauacacauga

SEQ ID NO: 1096536 - RNA, 22 nt, Human
aucuggcucuuccuggaguucc

SEQ ID NO: 1096537 - RNA, 22 nt, Human
gugcccuguucauuucucuccc

SEQ ID NO: 1096538 - RNA, 21 nt, Human
uggaaagauucaaagaccagg

SEQ ID NO: 1096539 - RNA, 22 nt, Human
ccagagaggccaaggucguggu

SEQ ID NO: 1096540 - RNA, 23 nt, Human
uaggaagacagcaaaagaaugga

SEQ ID NO: 1096541 - RNA, 22 nt, Human
ugcagguguaaauuuucaagag

SEQ ID NO: 1096542 - RNA, 22 nt, Human
uguucauugcccccuguguaaa

SEQ ID NO: 1096543 - RNA, 22 nt, Human
ugcccaaguguuuggcugaguc

SEQ ID NO: 1096544 - RNA, 22 nt, Human
uugcuagcugguguaugcauug

SEQ ID NO: 1096545 - RNA, 22 nt, Human
gccuggcaguguaauuccuguc

SEQ ID NO: 1096546 - RNA, 22 nt, Human
uucuucauucccuuacuuccga

SEQ ID NO: 1096547 - RNA, 22 nt, Human
auuuguaauuucuuaucugugu

SEQ ID NO: 1096548 - RNA, 22 nt, Human
aaagcagcagcaccugcauuuc

SEQ ID NO: 1096549 - RNA, 22 nt, Human
gccauuuggcaaaacugacuuc

SEQ ID NO: 1096550 - RNA, 22 nt, Human
uuaaagcaaccaucaauuugga

SEQ ID NO: 1096551 - RNA, 22 nt, Human
aaacucaagucuaugaacaagg

SEQ ID NO: 1096552 - RNA, 22 nt, Human
guuuuucuaggaccaugugauu

SEQ ID NO: 1096553 - RNA, 22 nt, Human
uguggucucguuauguugccca

SEQ ID NO: 1096554 - RNA, 22 nt, Human
caggugcccagcuccugcugug

SEQ ID NO: 1096555 - RNA, 22 nt, Human
cucaaggaaagucuggagaaga

SEQ ID NO: 1096556 - RNA, 22 nt, Human
ggaagagccuggggugucaggc

SEQ ID NO: 1096557 - RNA, 22 nt, Human
ucugggcucugucagcaccucu

SEQ ID NO: 1096558 - RNA, 22 nt, Human
agggcugccccaguccagccgg

SEQ ID NO: 1096559 - RNA, 22 nt, Human
auauuccugacuuaauuuuuga

SEQ ID NO: 1096560 - RNA, 22 nt, Human
gugcauugcgaugcagacgacc

SEQ ID NO: 1096561 - RNA, 22 nt, Human
uccucccacauaggacaauggg

SEQ ID NO: 1096562 - RNA, 22 nt, Human
ucaagaauuuggauaagaaaug

SEQ ID NO: 1096563 - RNA, 22 nt, Human
augcaaaugucaccacuucuaa

SEQ ID NO: 1096564 - RNA, 19 nt, Human
accaggccucagaggcccu

SEQ ID NO: 1096565 - RNA, 19 nt, Human
ccugccugaccccggcuac

SEQ ID NO: 1096566 - RNA, 22 nt, Human
aaggaagaagggaaguuacuua

SEQ ID NO: 1096567 - RNA, 22 nt, Human
guggauggauugaggcaguggg

SEQ ID NO: 1096568 - RNA, 22 nt, Human
agugcuuuccuucuugugacau

SEQ ID NO: 1096569 - RNA, 22 nt, Human
ggaggcugagaaguccaagauc

SEQ ID NO: 1096570 - RNA, 22 nt, Human
ggugggauggaggaucuuagac

SEQ ID NO: 1096571 - RNA, 22 nt, Human
ugaacauauucaccucuaaaua

SEQ ID NO: 1096572 - RNA, 22 nt, Human
auucuggacaaugagaaacugg

SEQ ID NO: 1096573 - RNA, 22 nt, Human
agcaggaacgaguucaugggga

SEQ ID NO: 1096574 - RNA, 22 nt, Human
aguucacauaucuguuuuauuu

SEQ ID NO: 1096575 - RNA, 22 nt, Human
ucuuuguaaaugccuagcauaa

SEQ ID NO: 1096576 - RNA, 22 nt, Human
acagaauagagacugccugcuc

SEQ ID NO: 1096577 - RNA, 22 nt, Human
acagggcagagugaaaugcuau

SEQ ID NO: 1096578 - RNA, 22 nt, Human
ucaaaguaccagagugaacuga

SEQ ID NO: 1096579 - RNA, 22 nt, Human
ucauguuuuaaugccuuuuucu

SEQ ID NO: 1096580 - RNA, 22 nt, Human
agagccugcuguguaagucaca

SEQ ID NO: 1096581 - RNA, 22 nt, Human
uggcagaggcucugugauguug

SEQ ID NO: 1096582 - RNA, 20 nt, Human
ccagguggugccuggagagg

SEQ ID NO: 1096583 - RNA, 22 nt, Human
uugcugugucugauggcugaga

SEQ ID NO: 1096584 - RNA, 22 nt, Human
gcugcggucacugcgggggcug

SEQ ID NO: 1096585 - RNA, 22 nt, Human
aaaugccucccauucuacugac

SEQ ID NO: 1096586 - RNA, 20 nt, Human
guaaaauauggucuuugggu

SEQ ID NO: 1096587 - RNA, 22 nt, Human
cucuuuccaggguaccccaggu

SEQ ID NO: 1096588 - RNA, 22 nt, Human
cccagggacagaugggcagcua

SEQ ID NO: 1096589 - RNA, 22 nt, Human
uagcugccuagacagcuauagc

SEQ ID NO: 1096590 - RNA, 22 nt, Human
cugccagucuaugcugcucggc

SEQ ID NO: 1096591 - RNA, 22 nt, Human
agugugcugcuuaaacaguugu

SEQ ID NO: 1096592 - RNA, 22 nt, Human
ugaaggccacuuccugugagcu

SEQ ID NO: 1096593 - RNA, 22 nt, Human
ucaaacauguuagcagucugug

SEQ ID NO: 1096594 - RNA, 22 nt, Human
acuguuuuccuaaugagcaaga

SEQ ID NO: 1096595 - RNA, 22 nt, Human
ugcaggaguccaaucaggagac

SEQ ID NO: 1096596 - RNA, 22 nt, Human
ucaugauuuccugguuaaggac

SEQ ID NO: 1096597 - RNA, 22 nt, Human
aaguggagccagggaaacugaa

SEQ ID NO: 1096598 - RNA, 22 nt, Human
ucucuucauuugcuauggguca

SEQ ID NO: 1096599 - RNA, 22 nt, Human
gagcugcccugagcuuugcaug

SEQ ID NO: 1096600 - RNA, 22 nt, Human
uacagauauuguacaguuauag

SEQ ID NO: 1096601 - RNA, 22 nt, Human
gucuaaacacaaugcaagaagu

SEQ ID NO: 1096602 - RNA, 22 nt, Human
ucuuugaauucaaacuguucaa

SEQ ID NO: 1096603 - RNA, 22 nt, Human
aaaaguguccagauuaugaaga

SEQ ID NO: 1096604 - RNA, 22 nt, Human
uccagaggcuccaaagggagau

SEQ ID NO: 1096605 - RNA, 22 nt, Human
cacuguccaugcuugcuaaccc

SEQ ID NO: 1096606 - RNA, 22 nt, Human
cugguucaauggggcugagccc

SEQ ID NO: 1096607 - RNA, 22 nt, Human
ugcauaguucuccuuccuccuc

SEQ ID NO: 1096608 - RNA, 22 nt, Human
cccuucuguaaaugcugacugg

SEQ ID NO: 1096609 - RNA, 22 nt, Human
guguggcugugggagauguuca

SEQ ID NO: 1096610 - RNA, 22 nt, Human
ugccagcccaccuuggggccuc

SEQ ID NO: 1096611 - RNA, 22 nt, Human
gaggugugguccucagccccca

SEQ ID NO: 1096612 - RNA, 23 nt, Human
cucccuggaguuucuggaagaug

SEQ ID NO: 1096613 - RNA, 22 nt, Human
uaacacuugggggcauccuuag

SEQ ID NO: 1096614 - RNA, 22 nt, Human
gcccuggccuucaucucagaca

SEQ ID NO: 1096615 - RNA, 22 nt, Human
gcuaagggacccuuucuaaugu

SEQ ID NO: 1096616 - RNA, 22 nt, Human
uagaaacauucaguugcagucc

SEQ ID NO: 1096617 - RNA, 22 nt, Human
ccacaaguuucagcacccagag

SEQ ID NO: 1096618 - RNA, 22 nt, Human
uugaaaacagcguagauucaca

SEQ ID NO: 1096619 - RNA, 20 nt, Human
ucuuuagauuuaucuuaugu

SEQ ID NO: 1096620 - RNA, 22 nt, Human
ggcugcuggggacgugggagag

SEQ ID NO: 1096621 - RNA, 21 nt, Human
aagccucaagcagaagacaga

SEQ ID NO: 1096622 - RNA, 22 nt, Human
cuacuucugugaugaaacuaca

SEQ ID NO: 1096623 - RNA, 22 nt, Human
acguuuucuagagaauaugcag

SEQ ID NO: 1096624 - RNA, 22 nt, Human
acaugcaaaugugcaugcaugu

SEQ ID NO: 1096625 - RNA, 22 nt, Human
ugcaggcugccuucacagagcc

SEQ ID NO: 1096626 - RNA, 22 nt, Human
ugcaggggcuugucugggccug

SEQ ID NO: 1096627 - RNA, 22 nt, Human
guuacauuuauuagaggucucu

SEQ ID NO: 1096628 - RNA, 22 nt, Human
aucaaauauaauaauuuucgcu

SEQ ID NO: 1096629 - RNA, 22 nt, Human
gcucagggaacuuuuugcaggc

SEQ ID NO: 1096630 - RNA, 22 nt, Human
gcucaggagcugacagccucaa

SEQ ID NO: 1096631 - RNA, 22 nt, Human
caacauauaauauuugaguucu

SEQ ID NO: 1096632 - RNA, 22 nt, Human
aggggaagauuauacuuuugaa

SEQ ID NO: 1096633 - RNA, 22 nt, Human
uauagcaucuaggaugauugca

SEQ ID NO: 1096634 - RNA, 22 nt, Human
agaauucucuuccauugaaaca

SEQ ID NO: 1096635 - RNA, 22 nt, Human
gggcacuguguucagagugcag

SEQ ID NO: 1096636 - RNA, 22 nt, Human
gcuucaggguuaugcaagagug

SEQ ID NO: 1096637 - RNA, 22 nt, Human
uugugcagaguugccuuuauuu

SEQ ID NO: 1096638 - RNA, 22 nt, Human
uguccucaaggagcuucagucu

SEQ ID NO: 1096639 - RNA, 22 nt, Human
caggagcucucaucgucagggc

SEQ ID NO: 1096640 - RNA, 22 nt, Human
aucagcaagcaugguuaggugu

SEQ ID NO: 1096641 - RNA, 22 nt, Human
uuccucucgcucuccggggccc

SEQ ID NO: 1096642 - RNA, 22 nt, Human
caggcagaaauuuuguuucauu

SEQ ID NO: 1096643 - RNA, 22 nt, Human
caggcugucugaauggaggccc

SEQ ID NO: 1096644 - RNA, 22 nt, Human
cuggagccacuuuuuauccuuu

SEQ ID NO: 1096645 - RNA, 22 nt, Human
gcccuggauggcaggagccauc

SEQ ID NO: 1096646 - RNA, 22 nt, Human
uguuaacagccagauuugguga

SEQ ID NO: 1096647 - RNA, 22 nt, Human
agcucuggaauaaugaugugau

SEQ ID NO: 1096648 - RNA, 22 nt, Human
uacauguauguguuaauaucug

SEQ ID NO: 1096649 - RNA, 20 nt, Human
cugggcugggcuacaggguc

SEQ ID NO: 1096650 - RNA, 22 nt, Human
ucuuacauauacgucauuuagu

SEQ ID NO: 1096651 - RNA, 22 nt, Human
uacacauccauguuuugacuuu

SEQ ID NO: 1096652 - RNA, 19 nt, Human
acauucccaucagcaaugu

SEQ ID NO: 1096653 - RNA, 22 nt, Human
aguccuuugggaaaaaugacua

SEQ ID NO: 1096654 - RNA, 22 nt, Human
uuccucugaaauggcuuggaaa

SEQ ID NO: 1096655 - RNA, 22 nt, Human
gugacagucaaagacaugacuu

SEQ ID NO: 1096656 - RNA, 22 nt, Human
cugagcccuggcucgccuggag

SEQ ID NO: 1096657 - RNA, 22 nt, Human
guggcaugacagugaaugggca

SEQ ID NO: 1096658 - RNA, 22 nt, Human
acugagccuugaagcuagauag

SEQ ID NO: 1096659 - RNA, 23 nt, Human
gcagauggccccagagugcugcc

SEQ ID NO: 1096660 - RNA, 22 nt, Human
agauuucugucaccuucuaugc

SEQ ID NO: 1096661 - RNA, 22 nt, Human
uauauucaaugauuaguaucag

SEQ ID NO: 1096662 - RNA, 22 nt, Human
ugcaggcucacccuggagcuga

SEQ ID NO: 1096663 - RNA, 22 nt, Human
ugaagcagcuucuuucugucaa

SEQ ID NO: 1096664 - RNA, 22 nt, Human
aaccaggaauugcagggcugca

SEQ ID NO: 1096665 - RNA, 22 nt, Human
ggcagucagugugguucauaaa

SEQ ID NO: 1096666 - RNA, 22 nt, Human
aagcagcaacaaacuggauaaa

SEQ ID NO: 1096667 - RNA, 17 nt, Human
uucacauccgagaacaa

SEQ ID NO: 1096668 - RNA, 22 nt, Human
agucagauuuaaagcuguuuga

SEQ ID NO: 1096669 - RNA, 21 nt, Human
gcaaggcuuuuguguuuccca

SEQ ID NO: 1096670 - RNA, 22 nt, Human
ggcuccagauguccccuggcaa

SEQ ID NO: 1096671 - RNA, 22 nt, Human
acaaagcuagagaagagaauug

SEQ ID NO: 1096672 - RNA, 22 nt, Human
ggaggggagguccagcugaucu

SEQ ID NO: 1096673 - RNA, 22 nt, Human
cuucacugaugggacagcucaa

SEQ ID NO: 1096674 - RNA, 22 nt, Human
ugcugguggagaaaguggaggu

SEQ ID NO: 1096675 - RNA, 22 nt, Human
ggcagggguccugguguugacu

SEQ ID NO: 1096676 - RNA, 22 nt, Human
caggugggagcgaggagcuacu

SEQ ID NO: 1096677 - RNA, 22 nt, Human
auaagaauaauuaaguuagucc

SEQ ID NO: 1096678 - RNA, 22 nt, Human
uccugguggugccagcugcagg

SEQ ID NO: 1096679 - RNA, 22 nt, Human
uauucacauucucaggccuggu

SEQ ID NO: 1096680 - RNA, 20 nt, Human
ugggcagcacugcuggcugg

SEQ ID NO: 1096681 - RNA, 22 nt, Human
cugccuguggacacccuggagg

SEQ ID NO: 1096682 - RNA, 22 nt, Human
agggcagaccacgugcaaggau

SEQ ID NO: 1096683 - RNA, 22 nt, Human
agauguuuguaaacacacugcu

SEQ ID NO: 1096684 - RNA, 22 nt, Human
caggaugagaggcccagggaag

SEQ ID NO: 1096685 - RNA, 22 nt, Human
agagcugagaauguggcuuccu

SEQ ID NO: 1096686 - RNA, 22 nt, Human
aggcucaguucacgucaacuuu

SEQ ID NO: 1096687 - RNA, 22 nt, Human
uucaggauucugugucugacaa

SEQ ID NO: 1096688 - RNA, 22 nt, Human
ugucccagacacaguaugcgcu

SEQ ID NO: 1096689 - RNA, 22 nt, Human
gcaggucucaaucugagcaggc

SEQ ID NO: 1096690 - RNA, 22 nt, Human
gcugucacucaccaggccugca

SEQ ID NO: 1096691 - RNA, 22 nt, Human
uccaagcuugcuuuagccacag

SEQ ID NO: 1096692 - RNA, 22 nt, Human
uaauacuugucauaaaggcauu

SEQ ID NO: 1096693 - RNA, 22 nt, Human
gugccagcaguuauggugauuu

SEQ ID NO: 1096694 - RNA, 22 nt, Human
gugccugcugcagagucgcugu

SEQ ID NO: 1096695 - RNA, 22 nt, Human
uuaggaaguguguccagaagcg

SEQ ID NO: 1096696 - RNA, 22 nt, Human
agaggccaucugcucugugggg

SEQ ID NO: 1096697 - RNA, 22 nt, Human
cuucuuuucauggcuugggaag

SEQ ID NO: 1096698 - RNA, 22 nt, Human
gccagcaacuaggagcugaauu

SEQ ID NO: 1096699 - RNA, 22 nt, Human
cccuggagugugacgaggcauu

SEQ ID NO: 1096700 - RNA, 22 nt, Human
acagaggccccgugggagagcc

SEQ ID NO: 1096701 - RNA, 22 nt, Human
caucacauuuaaggggaaggac

SEQ ID NO: 1096702 - RNA, 22 nt, Human
uggagaauucuauguugagggg

SEQ ID NO: 1096703 - RNA, 22 nt, Human
uguguuugaggcauguugcaga

SEQ ID NO: 1096704 - RNA, 22 nt, Human
cuccagggaugagacagaguag

SEQ ID NO: 1096705 - RNA, 22 nt, Human
cuucucagucaccugugagucu

SEQ ID NO: 1096706 - RNA, 22 nt, Human
ugggcugcagagcccggccuuc

SEQ ID NO: 1096707 - RNA, 22 nt, Human
uggcccagaucucugaccuuga

SEQ ID NO: 1096708 - RNA, 17 nt, Human
agguggcugcugcgccu

SEQ ID NO: 1096709 - RNA, 20 nt, Human
aauuauauaacuccaacauu

SEQ ID NO: 1096710 - RNA, 23 nt, Human
agccucuuuucuccugcccugca

SEQ ID NO: 1096711 - RNA, 22 nt, Human
ucucugagaaguuccuuuguga

SEQ ID NO: 1096712 - RNA, 22 nt, Human
ugaauguugauaugaguacaga

SEQ ID NO: 1096713 - RNA, 22 nt, Human
aauuaaaggucauguuaaaggg

SEQ ID NO: 1096714 - RNA, 22 nt, Human
acaugacuuuucucuuccagag

SEQ ID NO: 1096715 - RNA, 22 nt, Human
uguaauggaagugggauugcau

SEQ ID NO: 1096716 - RNA, 22 nt, Human
agcccugcccugccauguggca

SEQ ID NO: 1096717 - RNA, 19 nt, Human
gucuuacaggcaacaugag

SEQ ID NO: 1096718 - RNA, 21 nt, Human
ggacaugaggcaggagaggcu

SEQ ID NO: 1096719 - RNA, 22 nt, Human
uugagaguagagauggcagggc

SEQ ID NO: 1096720 - RNA, 22 nt, Human
cucugguuucgcaggaaauaga

SEQ ID NO: 1096721 - RNA, 22 nt, Human
augggcucggcgcugcugggau

SEQ ID NO: 1096722 - RNA, 22 nt, Human
aauguuuuacagaucccauuag

SEQ ID NO: 1096723 - RNA, 22 nt, Human
uuaaaaucgcuguugcuucugu

SEQ ID NO: 1096724 - RNA, 22 nt, Human
uaggagaggugaauggcacacu

SEQ ID NO: 1096725 - RNA, 22 nt, Human
cuuuuaagggauaauaagaugu

SEQ ID NO: 1096726 - RNA, 22 nt, Human
ccuggagccccucuggccagcc

SEQ ID NO: 1096727 - RNA, 21 nt, Human
cuacacagcuuucuauaggaa

SEQ ID NO: 1096728 - RNA, 22 nt, Human
cccaguuucaacuuuccagugg

SEQ ID NO: 1096729 - RNA, 22 nt, Human
gaagcaagugcaaggaagaggc

SEQ ID NO: 1096730 - RNA, 22 nt, Human
acaaaguuugugguauuccaag

SEQ ID NO: 1096731 - RNA, 22 nt, Human
uggguaggaccagaaaugcacu

SEQ ID NO: 1096732 - RNA, 22 nt, Human
ucacagaagcccucgcaaacua

SEQ ID NO: 1096733 - RNA, 22 nt, Human
gcuccugcccucuugcaauucc

SEQ ID NO: 1096734 - RNA, 22 nt, Human
uuugaagucagacacugcuuug

SEQ ID NO: 1096735 - RNA, 22 nt, Human
ucacagcuuugagcagagacca

SEQ ID NO: 1096736 - RNA, 22 nt, Human
gaacaacuccaagggacaucau

SEQ ID NO: 1096737 - RNA, 22 nt, Human
ucuuauaccccuaaacugcagc

SEQ ID NO: 1096738 - RNA, 22 nt, Human
uuucaaugacacaaaagagaaa

SEQ ID NO: 1096739 - RNA, 22 nt, Human
ugcuuucuguuuuucauauaau

SEQ ID NO: 1096740 - RNA, 22 nt, Human
acaaaguaggucaucaaagcuc

SEQ ID NO: 1096741 - RNA, 22 nt, Human
uggcuggcaaggcuggagucag

SEQ ID NO: 1096742 - RNA, 22 nt, Human
gcaggcaguuugcuuuucccuc

SEQ ID NO: 1096743 - RNA, 22 nt, Human
uggcaggagacacauggcauag

SEQ ID NO: 1096744 - RNA, 22 nt, Human
ucuugauuaauaccuuagcccu

SEQ ID NO: 1096745 - RNA, 22 nt, Human
ugggccacgugacccuuacccu

SEQ ID NO: 1096746 - RNA, 22 nt, Human
uuucacaaagcauagcacuuua

SEQ ID NO: 1096747 - RNA, 22 nt, Human
cucuuuccucagccacagucua

SEQ ID NO: 1096748 - RNA, 22 nt, Human
uuucacagaaagacaacagaua

SEQ ID NO: 1096749 - RNA, 22 nt, Human
cacauacuuguguguacauaug

SEQ ID NO: 1096750 - RNA, 22 nt, Human
gauuucuuggcccacucucaga

SEQ ID NO: 1096751 - RNA, 22 nt, Human
cagcuguuugggcauggccaga

SEQ ID NO: 1096752 - RNA, 22 nt, Human
gugcaguggcagauccuagcuc

SEQ ID NO: 1096753 - RNA, 22 nt, Human
gaggaaccacucugagaagcca

SEQ ID NO: 1096754 - RNA, 22 nt, Human
agaagccauauuuagggaggag

SEQ ID NO: 1096755 - RNA, 17 nt, Human
aggcagcucagaacauc

SEQ ID NO: 1096756 - RNA, 23 nt, Human
uuuugugugacuuaauaucucuu

SEQ ID NO: 1096757 - RNA, 22 nt, Human
ugcagagguuuccaggcaaguu

SEQ ID NO: 1096758 - RNA, 22 nt, Human
auuccuaaaguaauacacuaga

SEQ ID NO: 1096759 - RNA, 22 nt, Human
aauucacaggaucacaggagag

SEQ ID NO: 1096760 - RNA, 22 nt, Human
cagaaacuuucuuuacugagca

SEQ ID NO: 1096761 - RNA, 22 nt, Human
acucaggaaaugagaggcucuc

SEQ ID NO: 1096762 - RNA, 22 nt, Human
aacaucuuugauaaacuuagug

SEQ ID NO: 1096763 - RNA, 22 nt, Human
ggcuccuggcaucuggugggua

SEQ ID NO: 1096764 - RNA, 22 nt, Human
acagaauugaaaguauaaucug

SEQ ID NO: 1096765 - RNA, 22 nt, Human
acauuugacucuguucauauua

SEQ ID NO: 1096766 - RNA, 22 nt, Human
acagugauuauuaguugguggu

SEQ ID NO: 1096767 - RNA, 19 nt, Human
ugggcucauucaggugguu

SEQ ID NO: 1096768 - RNA, 22 nt, Human
gucugcccggccuuccuccacc

SEQ ID NO: 1096769 - RNA, 22 nt, Human
ccuggcuuccuucaugaccugg

SEQ ID NO: 1096770 - RNA, 22 nt, Human
agagaaaagaguucaggcuuug

SEQ ID NO: 1096771 - RNA, 22 nt, Human
gccagagguaucaaagauagua

SEQ ID NO: 1096772 - RNA, 22 nt, Human
auccaguuccaaagaucauuua

SEQ ID NO: 1096773 - RNA, 22 nt, Human
aagaauuuaaacuaaccauaug

SEQ ID NO: 1096774 - RNA, 22 nt, Human
ugaauacacuaaaaaucacuuu

SEQ ID NO: 1096775 - RNA, 22 nt, Human
aguuuuucuccccuggcuucau

SEQ ID NO: 1096776 - RNA, 22 nt, Human
gccuggaguacuccuugaagug

SEQ ID NO: 1096777 - RNA, 17 nt, Human
cauuuguugaucaguug

SEQ ID NO: 1096778 - RNA, 22 nt, Human
acugucuuccaggucuggaggu

SEQ ID NO: 1096779 - RNA, 22 nt, Human
ggcuccuguccuccuggagcuc

SEQ ID NO: 1096780 - RNA, 22 nt, Human
uguacagauaaagacuguaaau

SEQ ID NO: 1096781 - RNA, 22 nt, Human
caaauacuuacugaaccugugc

SEQ ID NO: 1096782 - RNA, 22 nt, Human
guggcagucaucaaggacagau

SEQ ID NO: 1096783 - RNA, 22 nt, Human
cagauaaauagauagauaaacu

SEQ ID NO: 1096784 - RNA, 22 nt, Human
cagcaauaacucaaagccauuu

SEQ ID NO: 1096785 - RNA, 22 nt, Human
gaagagaaaggcaaggaguuuu

SEQ ID NO: 1096786 - RNA, 22 nt, Human
gcugccaugccacagcacucac

SEQ ID NO: 1096787 - RNA, 22 nt, Human
gaggcccaggucaagcagccac

SEQ ID NO: 1096788 - RNA, 23 nt, Human
auaauaacgucugucuugucucu

SEQ ID NO: 1096789 - RNA, 23 nt, Human
agugagcagcuguagggcaagga

SEQ ID NO: 1096790 - RNA, 22 nt, Human
uuucuucuaagauuucaaacua

SEQ ID NO: 1096791 - RNA, 22 nt, Human
cugcuguggaugcaggaccuca

SEQ ID NO: 1096792 - RNA, 22 nt, Human
agguggcagagcuggcccagcg

SEQ ID NO: 1096793 - RNA, 22 nt, Human
uucaacaugcuuuauuucuaaa

SEQ ID NO: 1096794 - RNA, 22 nt, Human
ccucuccuugcacccgucccgc

SEQ ID NO: 1096795 - RNA, 20 nt, Human
gaggaaccacugggaggaga

SEQ ID NO: 1096796 - RNA, 22 nt, Human
guagcagaaucagugcuacaga

SEQ ID NO: 1096797 - RNA, 22 nt, Human
uaacuguaguuauaaagcuauc

SEQ ID NO: 1096798 - RNA, 22 nt, Human
ucacuaagugccgaguuuaguu

SEQ ID NO: 1096799 - RNA, 22 nt, Human
uucaaauacauucuuugccacu

SEQ ID NO: 1096800 - RNA, 22 nt, Human
aauucugaugaauaaaucaucc

SEQ ID NO: 1096801 - RNA, 22 nt, Human
aguguuccacacaucuggggaa

SEQ ID NO: 1096802 - RNA, 22 nt, Human
aggcuucagaugaccuuagcau

SEQ ID NO: 1096803 - RNA, 22 nt, Human
ugugaagguaaggaggggcaag

SEQ ID NO: 1096804 - RNA, 22 nt, Human
agagccuguuuugugggagaug

SEQ ID NO: 1096805 - RNA, 22 nt, Human
aaggaagaaucaucacguuggg

SEQ ID NO: 1096806 - RNA, 22 nt, Human
acagucaaucagaacagcaugu

SEQ ID NO: 1096807 - RNA, 22 nt, Human
acccuggggguggccagugcca

SEQ ID NO: 1096808 - RNA, 22 nt, Human
gaaaucuacgauuagugaaaau

SEQ ID NO: 1096809 - RNA, 22 nt, Human
uuaucauaaguaauugaaauaa

SEQ ID NO: 1096810 - RNA, 22 nt, Human
agccccaguaagggagggccug

SEQ ID NO: 1096811 - RNA, 22 nt, Human
ccuggcugccgagugugcagcg

SEQ ID NO: 1096812 - RNA, 21 nt, Human
aauuacagauggaauuacaga

SEQ ID NO: 1096813 - RNA, 22 nt, Human
acauuuugagaaaugacaagcu

SEQ ID NO: 1096814 - RNA, 22 nt, Human
aggaguggaauuacuggguucu

SEQ ID NO: 1096815 - RNA, 22 nt, Human
gguggaguaauucgcagagguu

SEQ ID NO: 1096816 - RNA, 22 nt, Human
uucuaauagcugccuauguauu

SEQ ID NO: 1096817 - RNA, 22 nt, Human
ccccucuugugggcucagguca

SEQ ID NO: 1096818 - RNA, 22 nt, Human
gaagacauuuuaugcauacucu

SEQ ID NO: 1096819 - RNA, 22 nt, Human
uccagccacucagcagggauug

SEQ ID NO: 1096820 - RNA, 22 nt, Human
gugcccaggggccagcugccgg

SEQ ID NO: 1096821 - RNA, 22 nt, Human
ccugggcuuugagggcaggaug

SEQ ID NO: 1096822 - RNA, 22 nt, Human
ugaaauaucauuuucaucuccc

SEQ ID NO: 1096823 - RNA, 22 nt, Human
gcaggcucaaaagcugguagga

SEQ ID NO: 1096824 - RNA, 22 nt, Human
agaagccagaauauucauggau

SEQ ID NO: 1096825 - RNA, 22 nt, Human
gccuucugcgcucgugucuccg

SEQ ID NO: 1096826 - RNA, 22 nt, Human
cugaaggauguguggugggagu

SEQ ID NO: 1096827 - RNA, 22 nt, Human
gucaggaugacaagugcuuuca

SEQ ID NO: 1096828 - RNA, 22 nt, Human
acagcuaggucuucagcacuuu

SEQ ID NO: 1096829 - RNA, 22 nt, Human
caauguuuguuagagcucuaga

SEQ ID NO: 1096830 - RNA, 22 nt, Human
uacagaaaucacaucgcuuuga

SEQ ID NO: 1096831 - RNA, 22 nt, Human
accagggcaaauguuuguacuc

SEQ ID NO: 1096832 - RNA, 22 nt, Human
ucucccacagucucccauggcu

SEQ ID NO: 1096833 - RNA, 22 nt, Human
uuucaaaguggagaauuagaca

SEQ ID NO: 1096834 - RNA, 22 nt, Human
uccugagcaccuaugccauggc

SEQ ID NO: 1096835 - RNA, 22 nt, Human
acuuuucuuaucagaaaggcca

SEQ ID NO: 1096836 - RNA, 22 nt, Human
uuccaagacaccuuuagucacu

SEQ ID NO: 1096837 - RNA, 22 nt, Human
ggcaggcugcuugggucauguc

SEQ ID NO: 1096838 - RNA, 22 nt, Human
aaggugguaauagugcaggauu

SEQ ID NO: 1096839 - RNA, 22 nt, Human
cacagagacagaucuauuuugc

SEQ ID NO: 1096840 - RNA, 22 nt, Human
auccuugaacuuagacacuagg

SEQ ID NO: 1096841 - RNA, 22 nt, Human
auauauuuugaauagccucugu

SEQ ID NO: 1096842 - RNA, 22 nt, Human
gcucagaggaugcuccuuuaug

SEQ ID NO: 1096843 - RNA, 22 nt, Human
ugcugagcgcauccggcggccg

SEQ ID NO: 1096844 - RNA, 22 nt, Human
ucuucaguuguaaaaguguugg

SEQ ID NO: 1096845 - RNA, 22 nt, Human
caucugaugggaauauaagagc

SEQ ID NO: 1096846 - RNA, 22 nt, Human
gccugcuggauguggccaggcc

SEQ ID NO: 1096847 - RNA, 22 nt, Human
gcuguguuuuauguuagguuaa

SEQ ID NO: 1096848 - RNA, 22 nt, Human
ucagcuggauguggaagugcua

SEQ ID NO: 1096849 - RNA, 22 nt, Human
gacaaaacacauuaguuuaaaa

SEQ ID NO: 1096850 - RNA, 22 nt, Human
agucaguguucuccggagaggc

SEQ ID NO: 1096851 - RNA, 22 nt, Human
aaucagucauuagcucugaccu

SEQ ID NO: 1096852 - RNA, 22 nt, Human
auucuggccuuggcucugucac

SEQ ID NO: 1096853 - RNA, 22 nt, Human
uuacaguagauacaaugaguaa

SEQ ID NO: 1096854 - RNA, 22 nt, Human
gcagggcacacaagaaugauaa

SEQ ID NO: 1096855 - RNA, 22 nt, Human
ggaagagaaugauggcuauggg

SEQ ID NO: 1096856 - RNA, 22 nt, Human
cacaucauguuaauucauuaca

SEQ ID NO: 1096857 - RNA, 22 nt, Human
gugcccuucagcuuugcugaaa

SEQ ID NO: 1096858 - RNA, 22 nt, Human
guuuacauguacucauuauacu

SEQ ID NO: 1096859 - RNA, 22 nt, Human
gagcuuaaauggcuaaauauaa

SEQ ID NO: 1096860 - RNA, 19 nt, Human
ucuaaacucuauacuggua

SEQ ID NO: 1096861 - RNA, 22 nt, Human
ucccaggguccucuucuggaau

SEQ ID NO: 1096862 - RNA, 22 nt, Human
augaaguucuagugagaaaugc

SEQ ID NO: 1096863 - RNA, 22 nt, Human
gaaagguugggugaauggugga

SEQ ID NO: 1096864 - RNA, 22 nt, Human
gcugccaguguggcaugaugca

SEQ ID NO: 1096865 - RNA, 22 nt, Human
ucuuugauggagagauagauau

SEQ ID NO: 1096866 - RNA, 22 nt, Human
ccacagcugaccgcaggugagc

SEQ ID NO: 1096867 - RNA, 18 nt, Human
aagaaguuggccaaagag

SEQ ID NO: 1096868 - RNA, 22 nt, Human
uccuggauucugcccugaaggc

SEQ ID NO: 1096869 - RNA, 22 nt, Human
agucccagagaggucggggcca

SEQ ID NO: 1096870 - RNA, 22 nt, Human
agggcagaaaucgauuacaccu

SEQ ID NO: 1096871 - RNA, 22 nt, Human
ccagcuccugggucuuagucag

SEQ ID NO: 1096872 - RNA, 22 nt, Human
uucacacagcaacuguaugaau

SEQ ID NO: 1096873 - RNA, 22 nt, Human
cugggccuugagaaucauguuu

SEQ ID NO: 1096874 - RNA, 22 nt, Human
caggcccuggcagggcugaguc

SEQ ID NO: 1096875 - RNA, 22 nt, Human
cagcaguggaacuacccaggga

SEQ ID NO: 1096876 - RNA, 22 nt, Human
ccagguggcuucugcccgaugu

SEQ ID NO: 1096877 - RNA, 22 nt, Human
gaaacuuucaugaauauaagau

SEQ ID NO: 1096878 - RNA, 22 nt, Human
cacaggaggaggugcccgggcc

SEQ ID NO: 1096879 - RNA, 22 nt, Human
uagauuuuaggagauuuuacug

SEQ ID NO: 1096880 - RNA, 22 nt, Human
cugcccugagucaugccagaug

SEQ ID NO: 1096881 - RNA, 22 nt, Human
gauauuuugagaaauccuauga

SEQ ID NO: 1096882 - RNA, 22 nt, Human
cuggccuggggggacacauccc

SEQ ID NO: 1096883 - RNA, 22 nt, Human
ggagcauguggggugagcaggg

SEQ ID NO: 1096884 - RNA, 22 nt, Human
cuucugagaggggcuaggagca

SEQ ID NO: 1096885 - RNA, 22 nt, Human
agcugcucccuauccuuuccuu

SEQ ID NO: 1096886 - RNA, 19 nt, Human
agugaaauggaguauucaa

SEQ ID NO: 1096887 - RNA, 22 nt, Human
cugcccugacugaccuuuugaa

SEQ ID NO: 1096888 - RNA, 22 nt, Human
agccuggaccaggggccucaga

SEQ ID NO: 1096889 - RNA, 22 nt, Human
aagauguaucaguuaagucuuc

SEQ ID NO: 1096890 - RNA, 22 nt, Human
aagacacacacauaugcugagu

SEQ ID NO: 1096891 - RNA, 19 nt, Human
gcacacauacacccuuugg

SEQ ID NO: 1096892 - RNA, 20 nt, Human
ucccugccuuuuacugcugg

SEQ ID NO: 1096893 - RNA, 22 nt, Human
ugauggugaugguugcacaaug

SEQ ID NO: 1096894 - RNA, 22 nt, Human
uccaggcccacucagcugaaau

SEQ ID NO: 1096895 - RNA, 22 nt, Human
acaacacauguguauaugugug

SEQ ID NO: 1096896 - RNA, 18 nt, Human
cuggagucacagugggga

SEQ ID NO: 1096897 - RNA, 22 nt, Human
aacaucuuaucugcaugauccc

SEQ ID NO: 1096898 - RNA, 22 nt, Human
ugaguucuaguggcugcagauu

SEQ ID NO: 1096899 - RNA, 22 nt, Human
cuggggaccgagcaagcucugg

SEQ ID NO: 1096900 - RNA, 22 nt, Human
gcaagcugugccuucucaggau

SEQ ID NO: 1096901 - RNA, 22 nt, Human
gucuuauuuaaggacaagaaga

SEQ ID NO: 1096902 - RNA, 22 nt, Human
uaggaacaaguuuccuugcugu

SEQ ID NO: 1096903 - RNA, 22 nt, Human
cugugcccagcucccugacugc

SEQ ID NO: 1096904 - RNA, 22 nt, Human
gguggaaggccuggaaggaggc

SEQ ID NO: 1096905 - RNA, 23 nt, Human
aacaccaaggcucagagagauaa

SEQ ID NO: 1096906 - RNA, 22 nt, Human
caaaagucuguccuuuaacuuc

SEQ ID NO: 1096907 - RNA, 22 nt, Human
cucugugagggucuguacagaa

SEQ ID NO: 1096908 - RNA, 22 nt, Human
ucugaaauguucucuuguuuug

SEQ ID NO: 1096909 - RNA, 22 nt, Human
gagccuggagcuggaacgaagc

SEQ ID NO: 1096910 - RNA, 23 nt, Human
agcauggaauaggaaagaggcag

SEQ ID NO: 1096911 - RNA, 22 nt, Human
ucauuucaguggcacagaagau

SEQ ID NO: 1096912 - RNA, 19 nt, Human
ucaguuuuagucaucaguu

SEQ ID NO: 1096913 - RNA, 22 nt, Human
aauuaauggaaaguaaggaagg

SEQ ID NO: 1096914 - RNA, 22 nt, Human
uuguguguguaacuuuaugaga

SEQ ID NO: 1096915 - RNA, 22 nt, Human
auugaagaguugauuauuaucu

SEQ ID NO: 1096916 - RNA, 22 nt, Human
gggcuggaggccugccugguua

SEQ ID NO: 1096917 - RNA, 22 nt, Human
aaagcaaugggucuaagguaaa

SEQ ID NO: 1096918 - RNA, 22 nt, Human
ucaacauucauauauagccaca

SEQ ID NO: 1096919 - RNA, 22 nt, Human
gagaucgguaaagagcaugcac

SEQ ID NO: 1096920 - RNA, 22 nt, Human
auuuucuauguuguaauuguua

SEQ ID NO: 1096921 - RNA, 22 nt, Human
ggagccagaaaugcugugguug

SEQ ID NO: 1096922 - RNA, 22 nt, Human
caguaaaugaugauagugccuu

SEQ ID NO: 1096923 - RNA, 22 nt, Human
gacacaugaccauaaaugcuaa

SEQ ID NO: 1096924 - RNA, 22 nt, Human
ucugggcuggugcucaugaauu

SEQ ID NO: 1096925 - RNA, 22 nt, Human
guuuucuuugaaugcuucuaga

SEQ ID NO: 1096926 - RNA, 22 nt, Human
ugucccaggcugaaguacagug

SEQ ID NO: 1096927 - RNA, 22 nt, Human
cccagccucagcuuuacuucca

SEQ ID NO: 1096928 - RNA, 22 nt, Human
cuccagggggcauccacacagc

SEQ ID NO: 1096929 - RNA, 22 nt, Human
acauuuaaauaugccuuauauu

SEQ ID NO: 1096930 - RNA, 22 nt, Human
aguagauagauucuaagcacua

SEQ ID NO: 1096931 - RNA, 18 nt, Human
gagcucugccucccaguc

SEQ ID NO: 1096932 - RNA, 22 nt, Human
caggcagcauuuacucugauga

SEQ ID NO: 1096933 - RNA, 20 nt, Human
ugugggcccuuggcuggcaa

SEQ ID NO: 1096934 - RNA, 22 nt, Human
gucccauaaguagugcaacuug

SEQ ID NO: 1096935 - RNA, 22 nt, Human
ugccuugcgggcguuucuguug

SEQ ID NO: 1096936 - RNA, 22 nt, Human
uccaggagagguguggggacug

SEQ ID NO: 1096937 - RNA, 22 nt, Human
uuuauguaaguggaaugaugcc

SEQ ID NO: 1096938 - RNA, 22 nt, Human
uaccacaggccaaauuugaggu

SEQ ID NO: 1096939 - RNA, 22 nt, Human
agucucagcuacuugggaggcu

SEQ ID NO: 1096940 - RNA, 22 nt, Human
ggucccaggauugguugcgcag

SEQ ID NO: 1096941 - RNA, 23 nt, Human
uggcucuguggaucccucaggag

SEQ ID NO: 1096942 - RNA, 22 nt, Human
ccaaaguccauaguuuacauaa

SEQ ID NO: 1096943 - RNA, 20 nt, Human
agggucagagagcgugagug

SEQ ID NO: 1096944 - RNA, 22 nt, Human
gagucugaugucccccaggcca

SEQ ID NO: 1096945 - RNA, 22 nt, Human
uggcucagccauucguguugcc

SEQ ID NO: 1096946 - RNA, 22 nt, Human
cagcagagggagccauugaaau

SEQ ID NO: 1096947 - RNA, 22 nt, Human
gcagaggacacaggagggcaag

SEQ ID NO: 1096948 - RNA, 22 nt, Human
ccagccaggcauugcaaacuga

SEQ ID NO: 1096949 - RNA, 22 nt, Human
uggggccuuggccucauuagau

SEQ ID NO: 1096950 - RNA, 20 nt, Human
auuccucagccccagccuca

SEQ ID NO: 1096951 - RNA, 22 nt, Human
guuuggggucugcagagcggcg

SEQ ID NO: 1096952 - RNA, 22 nt, Human
agggagcugcucugcuuccgug

SEQ ID NO: 1096953 - RNA, 22 nt, Human
gagcucccaggccccagcaagg

SEQ ID NO: 1096954 - RNA, 22 nt, Human
uuugcuuuguuuaaaaguggua

SEQ ID NO: 1096955 - RNA, 22 nt, Human
cugcagggcagggccuccuggc

SEQ ID NO: 1096956 - RNA, 22 nt, Human
uuggcaggaggcuucaguuccu

SEQ ID NO: 1096957 - RNA, 21 nt, Human
uccugccuuaguccagagcag

SEQ ID NO: 1096958 - RNA, 22 nt, Human
gauaaaauauguggccuuuagu

SEQ ID NO: 1096959 - RNA, 22 nt, Human
gagagcuguaauagucaugucu

SEQ ID NO: 1096960 - RNA, 22 nt, Human
caauacaauuaccaguuaauca

SEQ ID NO: 1096961 - RNA, 22 nt, Human
ucagcugaguucuagagcacuc

SEQ ID NO: 1096962 - RNA, 22 nt, Human
caagauggaguccgggaaugug

SEQ ID NO: 1096963 - RNA, 22 nt, Human
ggaggggccggcugccugccac

SEQ ID NO: 1096964 - RNA, 22 nt, Human
ugugccuggucccugagucgag

SEQ ID NO: 1096965 - RNA, 22 nt, Human
ugccacuggcucaauggugcag

SEQ ID NO: 1096966 - RNA, 22 nt, Human
aaauucuaugucaauguuuauu

SEQ ID NO: 1096967 - RNA, 22 nt, Human
uaaauuguuuucuagaaguugu

SEQ ID NO: 1096968 - RNA, 18 nt, Human
ucucuuuuccccucauug

SEQ ID NO: 1096969 - RNA, 22 nt, Human
gcaggagcccuggcauguucuu

SEQ ID NO: 1096970 - RNA, 22 nt, Human
auagaccuucuacacaggacaa

SEQ ID NO: 1096971 - RNA, 22 nt, Human
uugcuuuacuuugccauucguu

SEQ ID NO: 1096972 - RNA, 22 nt, Human
uuccucagacccucauugugag

SEQ ID NO: 1096973 - RNA, 22 nt, Human
aaguuauugcagcaauccaagu

SEQ ID NO: 1096974 - RNA, 22 nt, Human
agagaugaaaaguggagacugg

SEQ ID NO: 1096975 - RNA, 22 nt, Human
gccucugggcucugccccuggc

SEQ ID NO: 1096976 - RNA, 19 nt, Human
aaucagaaauaucgaggcc

SEQ ID NO: 1096977 - RNA, 22 nt, Human
uggcccugaaucaaggccagca

SEQ ID NO: 1096978 - RNA, 22 nt, Human
uggguggcacuucuggggucca

SEQ ID NO: 1096979 - RNA, 17 nt, Human
cugaagauaauggcaac

SEQ ID NO: 1096980 - RNA, 22 nt, Human
cugaagcaaaugaaacagcucu

SEQ ID NO: 1096981 - RNA, 23 nt, Human
acugaaaggauccuagcagagac

SEQ ID NO: 1096982 - RNA, 22 nt, Human
ucagcagaggggaaggcaucug

SEQ ID NO: 1096983 - RNA, 22 nt, Human
ucaguauuccuggaaauacaag

SEQ ID NO: 1096984 - RNA, 22 nt, Human
ucuucacacacaguccucuuuc

SEQ ID NO: 1096985 - RNA, 22 nt, Human
aacaucagcacacaauagcaag

SEQ ID NO: 1096986 - RNA, 22 nt, Human
cagcuuggaggaggaucuaaga

SEQ ID NO: 1096987 - RNA, 22 nt, Human
ugcugcuguugacggcugucca

SEQ ID NO: 1096988 - RNA, 22 nt, Human
gauauacauagguuucuaugca

SEQ ID NO: 1096989 - RNA, 22 nt, Human
gcagacuguaucaaugucagua

SEQ ID NO: 1096990 - RNA, 22 nt, Human
uaacacugguauuucauuuagu

SEQ ID NO: 1096991 - RNA, 22 nt, Human
ggugcugguucaggguggcugu

SEQ ID NO: 1096992 - RNA, 22 nt, Human
cacagagacagaagcacuuaug

SEQ ID NO: 1096993 - RNA, 22 nt, Human
uggcccugugugcaggcugcac

SEQ ID NO: 1096994 - RNA, 19 nt, Human
uacagugaaccaggaggag

SEQ ID NO: 1096995 - RNA, 22 nt, Human
caaggccaugagcagcgagugu

SEQ ID NO: 1096996 - RNA, 22 nt, Human
ucuugggauugcccugcaguuc

SEQ ID NO: 1096997 - RNA, 22 nt, Human
ucuggcugcugcgugagugcuu

SEQ ID NO: 1096998 - RNA, 22 nt, Human
ugugggcucuaauggcagcaga

SEQ ID NO: 1096999 - RNA, 22 nt, Human
gggcuggcuaagacuuuucugu

SEQ ID NO: 1097000 - RNA, 22 nt, Human
ggcaggugcuugucgaaggccu

SEQ ID NO: 1097001 - RNA, 22 nt, Human
agccuguccagaggacagggcu

SEQ ID NO: 1097002 - RNA, 22 nt, Human
uccucuucaaaaggauuuccuu

SEQ ID NO: 1097003 - RNA, 22 nt, Human
uggccuggugcucaggcaguag

SEQ ID NO: 1097004 - RNA, 22 nt, Human
cuggagugaagucuggcagcuu

SEQ ID NO: 1097005 - RNA, 22 nt, Human
uggagcaggugccaggugugug

SEQ ID NO: 1097006 - RNA, 22 nt, Human
agaugcaugcuuaauuagcaca

SEQ ID NO: 1097007 - RNA, 22 nt, Human
agccauuagucauuuuagaaua

SEQ ID NO: 1097008 - RNA, 22 nt, Human
agaggcacaaacuggaaaggac

SEQ ID NO: 1097009 - RNA, 21 nt, Human
cacuauuuauauaugccagcu

SEQ ID NO: 1097010 - RNA, 22 nt, Human
cucugcagaggcccaaggcuga

SEQ ID NO: 1097011 - RNA, 22 nt, Human
acugaacaccauuuauaacauu

SEQ ID NO: 1097012 - RNA, 22 nt, Human
ugagccagucugucugggugaa

SEQ ID NO: 1097013 - RNA, 22 nt, Human
ugaggaaguugaucucaucagu

SEQ ID NO: 1097014 - RNA, 22 nt, Human
gcuggaguuggcaaggcaugua

SEQ ID NO: 1097015 - RNA, 22 nt, Human
uguguugugacauucuuggaug

SEQ ID NO: 1097016 - RNA, 22 nt, Human
aaagaaaccuaucagccacaug

SEQ ID NO: 1097017 - RNA, 22 nt, Human
ggcagagacaccgaaugacucu

SEQ ID NO: 1097018 - RNA, 22 nt, Human
ugaggcucagagaagugcuguu

SEQ ID NO: 1097019 - RNA, 22 nt, Human
uuuuaaugggcgacuauuaugg

SEQ ID NO: 1097020 - RNA, 22 nt, Human
uuggcuucucuuaacccuaaag

SEQ ID NO: 1097021 - RNA, 22 nt, Human
aaugugugaacacuaaugcaac

SEQ ID NO: 1097022 - RNA, 22 nt, Human
aaaugcagauugucauucagga

SEQ ID NO: 1097023 - RNA, 22 nt, Human
aaaguuacacgacuauuuaugu

SEQ ID NO: 1097024 - RNA, 22 nt, Human
gacccuggaguuaguccugugu

SEQ ID NO: 1097025 - RNA, 22 nt, Human
auaugugucgugcuacugccca

SEQ ID NO: 1097026 - RNA, 22 nt, Human
aggccucaggaagguaaagaag

SEQ ID NO: 1097027 - RNA, 22 nt, Human
aaggacagaaacagauugcugg

SEQ ID NO: 1097028 - RNA, 22 nt, Human
aaugaaauguagcuuauccaua

SEQ ID NO: 1097029 - RNA, 22 nt, Human
gggaaguuuguuuggacuggga

SEQ ID NO: 1097030 - RNA, 22 nt, Human
aagguggugcuucugcuccucu

SEQ ID NO: 1097031 - RNA, 22 nt, Human
ggguggcuccuaugggcauagc

SEQ ID NO: 1097032 - RNA, 22 nt, Human
uccugggcagcgggacgcucag

SEQ ID NO: 1097033 - RNA, 22 nt, Human
gggagaagaaugugucaauugu

SEQ ID NO: 1097034 - RNA, 22 nt, Human
uccucaguauuguggagcagau

SEQ ID NO: 1097035 - RNA, 22 nt, Human
cuguggaccugcucuuagagac

SEQ ID NO: 1097036 - RNA, 22 nt, Human
uuggccuucucauuugcuuauu

SEQ ID NO: 1097037 - RNA, 22 nt, Human
acuguugucaggcugcuuugga

SEQ ID NO: 1097038 - RNA, 20 nt, Human
gguuacauugucuacaugug

SEQ ID NO: 1097039 - RNA, 22 nt, Human
augugaaacugaagcauccaua

SEQ ID NO: 1097040 - RNA, 22 nt, Human
acauuucuggaguuucucaaca

SEQ ID NO: 1097041 - RNA, 22 nt, Human
ccacacugaaccucagugucuu

SEQ ID NO: 1097042 - RNA, 22 nt, Human
ucaguuuucucauuuaugagau

SEQ ID NO: 1097043 - RNA, 22 nt, Human
agaggggaguccuaaucugauu

SEQ ID NO: 1097044 - RNA, 22 nt, Human
ccuuucucuaucgacccaucgc

SEQ ID NO: 1097045 - RNA, 22 nt, Human
ggugcuggacacguggcacucc

SEQ ID NO: 1097046 - RNA, 22 nt, Human
gcugucuccauagcuguguguc

SEQ ID NO: 1097047 - RNA, 20 nt, Human
augccucuaauuuugcaaac

SEQ ID NO: 1097048 - RNA, 22 nt, Human
ugcuucugggcaaaugugugug

SEQ ID NO: 1097049 - RNA, 22 nt, Human
cucagacuagccuguaccgaca

SEQ ID NO: 1097050 - RNA, 22 nt, Human
aggcagcaaagaaaugaugcug

SEQ ID NO: 1097051 - RNA, 22 nt, Human
ccuggccagcuaauugcccauc

SEQ ID NO: 1097052 - RNA, 22 nt, Human
agucucagccacacagaccuau

SEQ ID NO: 1097053 - RNA, 22 nt, Human
cucaggccagguuucucccaca

SEQ ID NO: 1097054 - RNA, 22 nt, Human
uugacagcaaagauugugccua

SEQ ID NO: 1097055 - RNA, 22 nt, Human
ucuugauuuauucuacccagaa

SEQ ID NO: 1097056 - RNA, 20 nt, Human
acuccagguggcaugaggac

SEQ ID NO: 1097057 - RNA, 22 nt, Human
gagcaugguuccauagguuggu

SEQ ID NO: 1097058 - RNA, 22 nt, Human
gcuuccuucuaccacaucaugc

SEQ ID NO: 1097059 - RNA, 22 nt, Human
aggaccaguaugagagcaucug

SEQ ID NO: 1097060 - RNA, 22 nt, Human
agucccagugagaugaaccagg

SEQ ID NO: 1097061 - RNA, 20 nt, Human
accucugcaucaauccuuug

SEQ ID NO: 1097062 - RNA, 21 nt, Human
uuacuuuugcagcaaccuaau

SEQ ID NO: 1097063 - RNA, 22 nt, Human
agguccagcuguugcagccucc

SEQ ID NO: 1097064 - RNA, 22 nt, Human
aagcagagagcagaauuaaguu

SEQ ID NO: 1097065 - RNA, 22 nt, Human
ugcccugcuaaccuugguucca

SEQ ID NO: 1097066 - RNA, 22 nt, Human
aguuagcaaauaccacaaucug

SEQ ID NO: 1097067 - RNA, 16 nt, Human
gagcagagcgguucca

SEQ ID NO: 1097068 - RNA, 22 nt, Human
uccauguggccagacacuggca

SEQ ID NO: 1097069 - RNA, 22 nt, Human
ggagaggaaaugccagcacuuc

SEQ ID NO: 1097070 - RNA, 20 nt, Human
ugaagaggaagaggacggcc

SEQ ID NO: 1097071 - RNA, 22 nt, Human
cugagagucagcuucuccuccu

SEQ ID NO: 1097072 - RNA, 22 nt, Human
ugcccacaggaagacaccagcg

SEQ ID NO: 1097073 - RNA, 22 nt, Human
uuuccaaaaguuuguucugugc

SEQ ID NO: 1097074 - RNA, 22 nt, Human
caggcagcugacugucagauau

SEQ ID NO: 1097075 - RNA, 22 nt, Human
ccuggccugugaaucugagagc

SEQ ID NO: 1097076 - RNA, 19 nt, Human
agcagagcagggccguggg

SEQ ID NO: 1097077 - RNA, 22 nt, Human
ugccaggcugcccuccagucug

SEQ ID NO: 1097078 - RNA, 22 nt, Human
uugcacaguuugaagaugacuc

SEQ ID NO: 1097079 - RNA, 23 nt, Human
augcccuguagaggcugcugacc

SEQ ID NO: 1097080 - RNA, 23 nt, Human
ugcagccacucaggagcucagug

SEQ ID NO: 1097081 - RNA, 21 nt, Human
ucaggaagagccaguucaugc

SEQ ID NO: 1097082 - RNA, 20 nt, Human
aaaugccagugauucugcuu

SEQ ID NO: 1097083 - RNA, 22 nt, Human
uccccugcagaugagggcagug

SEQ ID NO: 1097084 - RNA, 22 nt, Human
aggccugaaggaagaugagcug

SEQ ID NO: 1097085 - RNA, 22 nt, Human
cagaaguaagauuacugugaga

SEQ ID NO: 1097086 - RNA, 22 nt, Human
uuuguaacucucccuuuguaua

SEQ ID NO: 1097087 - RNA, 22 nt, Human
uggcccuguguccugcugccag

SEQ ID NO: 1097088 - RNA, 22 nt, Human
cagggguauucaagguaguuua

SEQ ID NO: 1097089 - RNA, 22 nt, Human
acuuuguaggaaaaagucacaa

SEQ ID NO: 1097090 - RNA, 22 nt, Human
ccuuuacaaaguucuucauggg

SEQ ID NO: 1097091 - RNA, 22 nt, Human
aaggacuccaauucuuucaucu

SEQ ID NO: 1097092 - RNA, 22 nt, Human
auucugucuuuuuaaaauaaua

SEQ ID NO: 1097093 - RNA, 21 nt, Human
ugcccacagcaaaugcagagg

SEQ ID NO: 1097094 - RNA, 22 nt, Human
ugcuccagcuggagaugggggc

SEQ ID NO: 1097095 - RNA, 22 nt, Human
uucacauuguuuuaaugugaau

SEQ ID NO: 1097096 - RNA, 22 nt, Human
ggauggagguucucagaugcuc

SEQ ID NO: 1097097 - RNA, 22 nt, Human
acuuuuaaaugaguuucaguug

SEQ ID NO: 1097098 - RNA, 22 nt, Human
uucaagaucuggguuuucagcu

SEQ ID NO: 1097099 - RNA, 22 nt, Human
guccaaguacauguguguacau

SEQ ID NO: 1097100 - RNA, 22 nt, Human
gcuggcagagacaagaagacua

SEQ ID NO: 1097101 - RNA, 20 nt, Human
caggccagagguuugauggc

SEQ ID NO: 1097102 - RNA, 22 nt, Human
aaacuuuuccugcucuuguccu

SEQ ID NO: 1097103 - RNA, 22 nt, Human
uuauuaaugaguacaaguuauu

SEQ ID NO: 1097104 - RNA, 22 nt, Human
acagcaguuuagaggacagcca

SEQ ID NO: 1097105 - RNA, 22 nt, Human
uguacacugcaggaugcauugc

SEQ ID NO: 1097106 - RNA, 22 nt, Human
caaagccauagaguagauaaga

SEQ ID NO: 1097107 - RNA, 22 nt, Human
cuuuucacaggaggauaagccc

SEQ ID NO: 1097108 - RNA, 22 nt, Human
aagacaauaauuuuugggcagg

SEQ ID NO: 1097109 - RNA, 22 nt, Human
caucagaagauggcucuggaaa

SEQ ID NO: 1097110 - RNA, 22 nt, Human
gaagcccagggcguggccgggc

SEQ ID NO: 1097111 - RNA, 22 nt, Human
acagaauagguacagucaguca

SEQ ID NO: 1097112 - RNA, 22 nt, Human
cucugagggcugucaggaaagg

SEQ ID NO: 1097113 - RNA, 22 nt, Human
aggcucaggugccucauucaca

SEQ ID NO: 1097114 - RNA, 22 nt, Human
ugggcagacuaaggucaaagcu

SEQ ID NO: 1097115 - RNA, 19 nt, Human
gccaggaaagaaucaggcg

SEQ ID NO: 1097116 - RNA, 22 nt, Human
cuggcagccaagugggauacuc

SEQ ID NO: 1097117 - RNA, 22 nt, Human
auguaauuugcccucaaguuaa

SEQ ID NO: 1097118 - RNA, 22 nt, Human
augaauggugaagucugauaag

SEQ ID NO: 1097119 - RNA, 22 nt, Human
uuagggcuuuucugaauaggcc

SEQ ID NO: 1097120 - RNA, 23 nt, Human
cugcuguguuggucucgauggga

SEQ ID NO: 1097121 - RNA, 22 nt, Human
ucagaguccucacccugaggau

SEQ ID NO: 1097122 - RNA, 22 nt, Human
aguuuuaagaugcgcuucuguu

SEQ ID NO: 1097123 - RNA, 22 nt, Human
ggucccagcuggucacugucag

SEQ ID NO: 1097124 - RNA, 22 nt, Human
ucagauggauucauuacaugac

SEQ ID NO: 1097125 - RNA, 22 nt, Human
uagaugaauuagcaauuaucuu

SEQ ID NO: 1097126 - RNA, 22 nt, Human
gcagauggaaagugcuugaggg

SEQ ID NO: 1097127 - RNA, 22 nt, Human
guuucuaagcacaugugagugu

SEQ ID NO: 1097128 - RNA, 22 nt, Human
ucccuggcuguguucaggugcg

SEQ ID NO: 1097129 - RNA, 21 nt, Human
uguggcugccucuggcccugg

SEQ ID NO: 1097130 - RNA, 22 nt, Human
uuuucuaaaauauccaggacag

SEQ ID NO: 1097131 - RNA, 22 nt, Human
gggcagaggcucuggcccaucc

SEQ ID NO: 1097132 - RNA, 22 nt, Human
caggaggccaacugugggacuu

SEQ ID NO: 1097133 - RNA, 22 nt, Human
auuucuaaagagggugguuugg

SEQ ID NO: 1097134 - RNA, 22 nt, Human
uguuugugguuauaauaaguau

SEQ ID NO: 1097135 - RNA, 22 nt, Human
uuucuacuucuccugaaugucu

SEQ ID NO: 1097136 - RNA, 22 nt, Human
uguaaauaaugcauguaaauca

SEQ ID NO: 1097137 - RNA, 22 nt, Human
gcagggaggaagagaugcuucc

SEQ ID NO: 1097138 - RNA, 22 nt, Human
uuaauacaacuguugucacugg

SEQ ID NO: 1097139 - RNA, 23 nt, Human
uggccagguagaggagguaguga

SEQ ID NO: 1097140 - RNA, 22 nt, Human
agcuguggaguaggggguugga

SEQ ID NO: 1097141 - RNA, 22 nt, Human
ugcaagagcccagggccaggaa

SEQ ID NO: 1097142 - RNA, 22 nt, Human
cugggagguggagguugcauug

SEQ ID NO: 1097143 - RNA, 22 nt, Human
cugacacacugagcauuugaua

SEQ ID NO: 1097144 - RNA, 22 nt, Human
ugaaauuauucuuaccaaggug

SEQ ID NO: 1097145 - RNA, 22 nt, Human
uggccagugauuaaugacgcuu

SEQ ID NO: 1097146 - RNA, 22 nt, Human
caggggcuagcacuuaauguuu

SEQ ID NO: 1097147 - RNA, 22 nt, Human
cagcaucucacuucccagaagg

SEQ ID NO: 1097148 - RNA, 22 nt, Human
gcaggugguggggcuaugaucu

SEQ ID NO: 1097149 - RNA, 23 nt, Human
aagagcagggaauauuuauuugc

SEQ ID NO: 1097150 - RNA, 22 nt, Human
ccacagggcacaagggagguug

SEQ ID NO: 1097151 - RNA, 22 nt, Human
cugggcugcaucaaagaggcau

SEQ ID NO: 1097152 - RNA, 22 nt, Human
uccaagcuguauguuccuagag

SEQ ID NO: 1097153 - RNA, 22 nt, Human
aggcccugcccagugccacaag

SEQ ID NO: 1097154 - RNA, 21 nt, Human
acaugagacacacauauaugu

SEQ ID NO: 1097155 - RNA, 22 nt, Human
gcugugagaaacagggaguguc

SEQ ID NO: 1097156 - RNA, 22 nt, Human
uggaggcagucaaaugacugac

SEQ ID NO: 1097157 - RNA, 22 nt, Human
cugacccauauaagaguggagg

SEQ ID NO: 1097158 - RNA, 19 nt, Human
agcaaauauaauaguguuc

SEQ ID NO: 1097159 - RNA, 22 nt, Human
cccaguccuaaagcagacgcca

SEQ ID NO: 1097160 - RNA, 22 nt, Human
gccucagggggagaggccagcu

SEQ ID NO: 1097161 - RNA, 22 nt, Human
uaaaggcucacuggcuuggggu

SEQ ID NO: 1097162 - RNA, 20 nt, Human
ucacaucuggcagcugauga

SEQ ID NO: 1097163 - RNA, 22 nt, Human
cauauuaaggucuguaaggggu

SEQ ID NO: 1097164 - RNA, 19 nt, Human
ggcugccuuuccuuaccag

SEQ ID NO: 1097165 - RNA, 22 nt, Human
auaagaaacauuauucuuucca

SEQ ID NO: 1097166 - RNA, 22 nt, Human
gcucugcugcuuacuagauggu

SEQ ID NO: 1097167 - RNA, 22 nt, Human
aucuuugaagaggacuugaagu

SEQ ID NO: 1097168 - RNA, 22 nt, Human
aaaugcaggauuaacagcuuug

SEQ ID NO: 1097169 - RNA, 22 nt, Human
ugucagcagcugguuugcuguu

SEQ ID NO: 1097170 - RNA, 22 nt, Human
aggcugagccacggggcuggcu

SEQ ID NO: 1097171 - RNA, 22 nt, Human
uuucacagcauauagguguacu

SEQ ID NO: 1097172 - RNA, 22 nt, Human
ugucaccagcugcuccucagga

SEQ ID NO: 1097173 - RNA, 22 nt, Human
auugacaauuagcccuuaggug

SEQ ID NO: 1097174 - RNA, 22 nt, Human
cagaauuuuucgaauguacugu

SEQ ID NO: 1097175 - RNA, 22 nt, Human
aaauuauuuucagaauggagaa

SEQ ID NO: 1097176 - RNA, 22 nt, Human
auuguggugucaguuauaggca

SEQ ID NO: 1097177 - RNA, 22 nt, Human
aaacagcagcuguuuaauuugc

SEQ ID NO: 1097178 - RNA, 22 nt, Human
uguagcagucugggggaauuac

SEQ ID NO: 1097179 - RNA, 22 nt, Human
uguaauaccacuguuggacauu

SEQ ID NO: 1097180 - RNA, 22 nt, Human
gcauuccugagaaugcagagug

SEQ ID NO: 1097181 - RNA, 18 nt, Human
aggcagacacuagagguc

SEQ ID NO: 1097182 - RNA, 22 nt, Human
uuucuaaggccagagacugcug

SEQ ID NO: 1097183 - RNA, 22 nt, Human
agcagcaguacauauaagacua

SEQ ID NO: 1097184 - RNA, 22 nt, Human
agggcagcuagcuguagaaaga

SEQ ID NO: 1097185 - RNA, 21 nt, Human
aaaggccauaaucacggagca

SEQ ID NO: 1097186 - RNA, 22 nt, Human
acugggccgcgcugcagagggc

SEQ ID NO: 1097187 - RNA, 18 nt, Human
gggcccuggcguccgccc

SEQ ID NO: 1097188 - RNA, 22 nt, Human
acaggaaaugaaaugguaucua

SEQ ID NO: 1097189 - RNA, 22 nt, Human
uuccaauugugagauuuuuuaa

SEQ ID NO: 1097190 - RNA, 23 nt, Human
aaacuacaacgccaggcacugag

SEQ ID NO: 1097191 - RNA, 22 nt, Human
cauacagagaaggauaauaaag

SEQ ID NO: 1097192 - RNA, 22 nt, Human
aaacacuucuuaggucuuaagu

SEQ ID NO: 1097193 - RNA, 22 nt, Human
ggaugcugacuuuggagcaugg

SEQ ID NO: 1097194 - RNA, 22 nt, Human
ccucugccugcacaucauccug

SEQ ID NO: 1097195 - RNA, 22 nt, Human
cauuugaugacucaacucauaa

SEQ ID NO: 1097196 - RNA, 22 nt, Human
uccaguuugcacuguauaauag

SEQ ID NO: 1097197 - RNA, 22 nt, Human
uagaugcuugucaguuucuguc

SEQ ID NO: 1097198 - RNA, 22 nt, Human
ugcagggcacacgcacgggugu

SEQ ID NO: 1097199 - RNA, 19 nt, Human
cugcugggugcugagggag

SEQ ID NO: 1097200 - RNA, 22 nt, Human
uuucauucauguguuaaaggug

SEQ ID NO: 1097201 - RNA, 22 nt, Human
cucccuggcacagcgagagguu

SEQ ID NO: 1097202 - RNA, 22 nt, Human
cccaggaccgcgcggcugagcg

SEQ ID NO: 1097203 - RNA, 20 nt, Human
uggagccaaggugugucugg

SEQ ID NO: 1097204 - RNA, 19 nt, Human
gcauuucauuuaaccauca

SEQ ID NO: 1097205 - RNA, 19 nt, Human
augauacaggugaaaauug

SEQ ID NO: 1097206 - RNA, 19 nt, Human
cugagagaugcuucacaca

SEQ ID NO: 1097207 - RNA, 22 nt, Human
ggaggggaggauuaaugacaaa

SEQ ID NO: 1097208 - RNA, 22 nt, Human
cccugcagaucuaggguccuuc

SEQ ID NO: 1097209 - RNA, 22 nt, Human
auauuuguaaaauucugugucu

SEQ ID NO: 1097210 - RNA, 22 nt, Human
ucccucagagaccguggugcag

SEQ ID NO: 1097211 - RNA, 22 nt, Human
aaauauacuagaugaugaccca

SEQ ID NO: 1097212 - RNA, 22 nt, Human
ugacaucauuggccauugggga

SEQ ID NO: 1097213 - RNA, 22 nt, Human
accccagcccugcuucugggag

SEQ ID NO: 1097214 - RNA, 22 nt, Human
ucauuuuucacacagggucacc

SEQ ID NO: 1097215 - RNA, 22 nt, Human
uaauuuaauccaaguguuacau

SEQ ID NO: 1097216 - RNA, 22 nt, Human
aaugauguuuuuaaagaacaua

SEQ ID NO: 1097217 - RNA, 22 nt, Human
ucagucucuggggcuucuguuu

SEQ ID NO: 1097218 - RNA, 22 nt, Human
uggaggagaccauuccacucag

SEQ ID NO: 1097219 - RNA, 22 nt, Human
agcagcaggcuuaaggaaaagu

SEQ ID NO: 1097220 - RNA, 22 nt, Human
aaaguccuagcgauccacagaa

SEQ ID NO: 1097221 - RNA, 22 nt, Human
ugcaguggaaucuggagagcag

SEQ ID NO: 1097222 - RNA, 22 nt, Human
gaaaaaugcuccaaaucugugg

SEQ ID NO: 1097223 - RNA, 22 nt, Human
ucucagaguuuagagcugagcc

SEQ ID NO: 1097224 - RNA, 22 nt, Human
ccugggcuuccacgagcagagg

SEQ ID NO: 1097225 - RNA, 22 nt, Human
uggcagagccuugccaaacucc

SEQ ID NO: 1097226 - RNA, 22 nt, Human
aucugccuggcuccaggugagc

SEQ ID NO: 1097227 - RNA, 22 nt, Human
ugaagcagaggggucuugagcu

SEQ ID NO: 1097228 - RNA, 22 nt, Human
ugcuuuuaggagauuaaaauua

SEQ ID NO: 1097229 - RNA, 22 nt, Human
aagaagguguggaaagaugcuc

SEQ ID NO: 1097230 - RNA, 22 nt, Human
aauguauuccucaugcaagagu

SEQ ID NO: 1097231 - RNA, 22 nt, Human
guugaaugaaucauucuaugua

SEQ ID NO: 1097232 - RNA, 20 nt, Human
ugcuguaagauuagagagcu

SEQ ID NO: 1097233 - RNA, 22 nt, Human
agggcugcugcuccgggcccag

SEQ ID NO: 1097234 - RNA, 22 nt, Human
ugggccucuguuuccucaucug

SEQ ID NO: 1097235 - RNA, 22 nt, Human
uccuuccuggggucucugcugc

SEQ ID NO: 1097236 - RNA, 22 nt, Human
ccaaggagcugcaggcacuugu

SEQ ID NO: 1097237 - RNA, 22 nt, Human
caugaauauacauccugauggc

SEQ ID NO: 1097238 - RNA, 22 nt, Human
accuccugaugagaguaaagga

SEQ ID NO: 1097239 - RNA, 22 nt, Human
gaguccaguuguucacagaggc

SEQ ID NO: 1097240 - RNA, 22 nt, Human
ccugauuagggucuuucaaaug

SEQ ID NO: 1097241 - RNA, 22 nt, Human
gucuuuggaaagacaaaguuca

SEQ ID NO: 1097242 - RNA, 22 nt, Human
ugccugcauuuuguggcuggcu

SEQ ID NO: 1097243 - RNA, 22 nt, Human
auucacacauacucauguguga

SEQ ID NO: 1097244 - RNA, 20 nt, Human
uaucaaucagaaagaagacu

SEQ ID NO: 1097245 - RNA, 23 nt, Human
gcaggugguucgaacagaaguuu

SEQ ID NO: 1097246 - RNA, 22 nt, Human
agcacagagaagauuucaauua

SEQ ID NO: 1097247 - RNA, 20 nt, Human
uucuugaauacccaacccca

SEQ ID NO: 1097248 - RNA, 22 nt, Human
ucaaaguuuuugagaauuacau

SEQ ID NO: 1097249 - RNA, 22 nt, Human
uggcaggauuugcccggaagga

SEQ ID NO: 1097250 - RNA, 22 nt, Human
uucacagugguaaggguuguga

SEQ ID NO: 1097251 - RNA, 22 nt, Human
uccucaggucaaagcaggagaa

SEQ ID NO: 1097252 - RNA, 22 nt, Human
gauuuguagcuuuucagucugu

SEQ ID NO: 1097253 - RNA, 22 nt, Human
cggggcugcgcucuuccugccg

SEQ ID NO: 1097254 - RNA, 22 nt, Human
gaauucugguccuguccaaggu

SEQ ID NO: 1097255 - RNA, 22 nt, Human
gcaggugguuaaggucccaugu

SEQ ID NO: 1097256 - RNA, 22 nt, Human
gggcucagcugggcgugcuggu

SEQ ID NO: 1097257 - RNA, 22 nt, Human
guaugaaguuggacuguauaaa

SEQ ID NO: 1097258 - RNA, 22 nt, Human
auuuccucaugaucauaaugca

SEQ ID NO: 1097259 - RNA, 22 nt, Human
uugcacagaugcacaugguugc

SEQ ID NO: 1097260 - RNA, 22 nt, Human
auggcaggcccagguguucauu

SEQ ID NO: 1097261 - RNA, 22 nt, Human
cuggaaagaccugcuugcuuuu

SEQ ID NO: 1097262 - RNA, 22 nt, Human
cuggcucaauuuguacugcugu

SEQ ID NO: 1097263 - RNA, 21 nt, Human
caagccagaccaauagcagcc

SEQ ID NO: 1097264 - RNA, 22 nt, Human
ucaucacaauuuuaugacccuc

SEQ ID NO: 1097265 - RNA, 22 nt, Human
caggcagcucgaugccuuguug

SEQ ID NO: 1097266 - RNA, 22 nt, Human
aggcagcaugggccccagcucc

SEQ ID NO: 1097267 - RNA, 22 nt, Human
ucugggugaugaaaugcacugu

SEQ ID NO: 1097268 - RNA, 22 nt, Human
gcuggccugggcucaagaccag

SEQ ID NO: 1097269 - RNA, 22 nt, Human
gccuccccaaagugcugacagc

SEQ ID NO: 1097270 - RNA, 22 nt, Human
caagucauuguuuagucauguu

SEQ ID NO: 1097271 - RNA, 22 nt, Human
acagcagcagaccagcauaugu

SEQ ID NO: 1097272 - RNA, 22 nt, Human
auguuugucccugacauccucu

SEQ ID NO: 1097273 - RNA, 22 nt, Human
agaccaagaaaggaugaggauc

SEQ ID NO: 1097274 - RNA, 22 nt, Human
aaggaagaagacucuuuacucc

SEQ ID NO: 1097275 - RNA, 22 nt, Human
gagaggaguaggcugauggugc

SEQ ID NO: 1097276 - RNA, 22 nt, Human
cacuguguaagaagaugggcuu

SEQ ID NO: 1097277 - RNA, 22 nt, Human
ucucagagaaaugugucaccau

SEQ ID NO: 1097278 - RNA, 22 nt, Human
ugcagcaggagccaggccuggu

SEQ ID NO: 1097279 - RNA, 22 nt, Human
gucccauuucaagaaauucaug

SEQ ID NO: 1097280 - RNA, 20 nt, Human
agaaaaaguguggaaauuuc

SEQ ID NO: 1097281 - RNA, 22 nt, Human
ugacauuuaagccucugauuuc

SEQ ID NO: 1097282 - RNA, 22 nt, Human
cagcaucccucaggggccucug

SEQ ID NO: 1097283 - RNA, 22 nt, Human
cugccaaggcuggggaggacaa

SEQ ID NO: 1097284 - RNA, 22 nt, Human
cagcccucaucucagcuucuuu

SEQ ID NO: 1097285 - RNA, 22 nt, Human
ucagagugaggcgucaacauga

SEQ ID NO: 1097286 - RNA, 22 nt, Human
ugauauuuuaugagcuuucaua

SEQ ID NO: 1097287 - RNA, 22 nt, Human
gcaacagcccagguucugugug

SEQ ID NO: 1097288 - RNA, 22 nt, Human
ucuuccagcaaugugaaaucac

SEQ ID NO: 1097289 - RNA, 22 nt, Human
ggagagaauuccauggacaugu

SEQ ID NO: 1097290 - RNA, 20 nt, Human
agccaggccucaaguuaagu

SEQ ID NO: 1097291 - RNA, 22 nt, Human
uacauuacaggaaagauaaaga

SEQ ID NO: 1097292 - RNA, 22 nt, Human
agggccucuggaacacugaggg

SEQ ID NO: 1097293 - RNA, 18 nt, Human
cugcuugggagacgucag

SEQ ID NO: 1097294 - RNA, 22 nt, Human
gggacuggaguagaggccggug

SEQ ID NO: 1097295 - RNA, 22 nt, Human
uaagacuugauccaaagaacua

SEQ ID NO: 1097296 - RNA, 22 nt, Human
acugggccggugcagaguaguu

SEQ ID NO: 1097297 - RNA, 22 nt, Human
aagcacaggaucuugaggagcg

SEQ ID NO: 1097298 - RNA, 22 nt, Human
ugugcaaucauauuuuaaaaug

SEQ ID NO: 1097299 - RNA, 22 nt, Human
ugugaagagaguaauaaaguca

SEQ ID NO: 1097300 - RNA, 23 nt, Human
uccugagaugagacagugcugcc

SEQ ID NO: 1097301 - RNA, 18 nt, Human
cugcuuugccuucauucc

SEQ ID NO: 1097302 - RNA, 22 nt, Human
ggcucagguuuaaagugcuuua

SEQ ID NO: 1097303 - RNA, 22 nt, Human
agccaggcagacucucuuucuu

SEQ ID NO: 1097304 - RNA, 22 nt, Human
gcagggcaaauguggaaaggag

SEQ ID NO: 1097305 - RNA, 22 nt, Human
gcccugcccuguugaaacuaga

SEQ ID NO: 1097306 - RNA, 22 nt, Human
agauuaugcuggcugcuacaag

SEQ ID NO: 1097307 - RNA, 22 nt, Human
gagccugaugaaacaggcagac

SEQ ID NO: 1097308 - RNA, 22 nt, Human
aaguuauuuccucgugacugaa

SEQ ID NO: 1097309 - RNA, 22 nt, Human
agggcucagccuccuccucagc

SEQ ID NO: 1097310 - RNA, 22 nt, Human
cauaaacucucuguaccaauau

SEQ ID NO: 1097311 - RNA, 22 nt, Human
agcaaggucucccugcaccugg

SEQ ID NO: 1097312 - RNA, 22 nt, Human
ugggcagguuguuauuugacau

SEQ ID NO: 1097313 - RNA, 22 nt, Human
agcuggcagcucucagggguac

SEQ ID NO: 1097314 - RNA, 22 nt, Human
cuucuuuuacaggucuuggguu

SEQ ID NO: 1097315 - RNA, 22 nt, Human
acagaaaugauguuuggcaaua

SEQ ID NO: 1097316 - RNA, 22 nt, Human
gccgugcgugcgcaggugcugu

SEQ ID NO: 1097317 - RNA, 22 nt, Human
ugccuuuuccagcuuccagagg

SEQ ID NO: 1097318 - RNA, 22 nt, Human
gcagagccugggggucugcgga

SEQ ID NO: 1097319 - RNA, 22 nt, Human
ugcagggccuuguugaugugcu

SEQ ID NO: 1097320 - RNA, 22 nt, Human
ugcagagaaaacuccuggguac

SEQ ID NO: 1097321 - RNA, 22 nt, Human
uucacagauguauuggaacucc

SEQ ID NO: 1097322 - RNA, 22 nt, Human
gcucccuccaugaggcagaccg

SEQ ID NO: 1097323 - RNA, 17 nt, Human
accagccucuccugggg

SEQ ID NO: 1097324 - RNA, 22 nt, Human
gaaggagacccugaagaugcug

SEQ ID NO: 1097325 - RNA, 22 nt, Human
ugguggggcuuuccuucugcuu

SEQ ID NO: 1097326 - RNA, 22 nt, Human
auacagaucccacagcauguga

SEQ ID NO: 1097327 - RNA, 22 nt, Human
gccagcagccacagaagucacu

SEQ ID NO: 1097328 - RNA, 22 nt, Human
agaugugggagaugcuucugca

SEQ ID NO: 1097329 - RNA, 22 nt, Human
cccaguuguugccggcucugga

SEQ ID NO: 1097330 - RNA, 18 nt, Human
ccagguggugacagagau

SEQ ID NO: 1097331 - RNA, 22 nt, Human
ugaaggagcucaaugaugaugc

SEQ ID NO: 1097332 - RNA, 22 nt, Human
uucaaagagaaauuguauuuuc

SEQ ID NO: 1097333 - RNA, 22 nt, Human
caggaagcugagcugcacugca

SEQ ID NO: 1097334 - RNA, 22 nt, Human
uuaacauacaucaugaacaaug

SEQ ID NO: 1097335 - RNA, 22 nt, Human
ugcagccccugaaaauggcagc

SEQ ID NO: 1097336 - RNA, 22 nt, Human
ccagggaagucacauugucuag

SEQ ID NO: 1097337 - RNA, 17 nt, Human
gggaaguggagaaagcu

SEQ ID NO: 1097338 - RNA, 22 nt, Human
ugagagcacacagaaauauuuu

SEQ ID NO: 1097339 - RNA, 22 nt, Human
guggcagguuauaagcaucuca

SEQ ID NO: 1097340 - RNA, 22 nt, Human
ugggcucagggaagcuuggccu

SEQ ID NO: 1097341 - RNA, 22 nt, Human
agagacagaggcaauauagcuu

SEQ ID NO: 1097342 - RNA, 22 nt, Human
gugcccugaugcaauugucuca

SEQ ID NO: 1097343 - RNA, 22 nt, Human
agaaauuaugcaguaguuuuau

SEQ ID NO: 1097344 - RNA, 20 nt, Human
gaaauucucguauuaguuua

SEQ ID NO: 1097345 - RNA, 22 nt, Human
ugcugaugaguccuucuaucgc

SEQ ID NO: 1097346 - RNA, 22 nt, Human
agccaggaauuggacaacacau

SEQ ID NO: 1097347 - RNA, 22 nt, Human
ugacagggcuagaggcaaugca

SEQ ID NO: 1097348 - RNA, 22 nt, Human
ccugcugugaagccaggccugu

SEQ ID NO: 1097349 - RNA, 22 nt, Human
ggcagugacuguucagacgucc

SEQ ID NO: 1097350 - RNA, 22 nt, Human
uggcccugcccucuucaucuuu

SEQ ID NO: 1097351 - RNA, 22 nt, Human
acuguuuucuaaagaacagaug

SEQ ID NO: 1097352 - RNA, 22 nt, Human
cucaacauaugacuuugguggg

SEQ ID NO: 1097353 - RNA, 22 nt, Human
cagaaauguuuguuaauauugu

SEQ ID NO: 1097354 - RNA, 22 nt, Human
ucccaagagcucugggauaagg

SEQ ID NO: 1097355 - RNA, 22 nt, Human
ugcaggugcuccgggggugccc

SEQ ID NO: 1097356 - RNA, 22 nt, Human
gccaggaaagggaauucccuga

SEQ ID NO: 1097357 - RNA, 19 nt, Human
uacuuuuucaggacagagu

SEQ ID NO: 1097358 - RNA, 23 nt, Human
uguaacagagcacugauugacaa

SEQ ID NO: 1097359 - RNA, 22 nt, Human
uaguuacagcaggcaggauaua

SEQ ID NO: 1097360 - RNA, 22 nt, Human
aaaugcagugguucuacuucuc

SEQ ID NO: 1097361 - RNA, 22 nt, Human
uaggggaacuggcacagggcag

SEQ ID NO: 1097362 - RNA, 22 nt, Human
gcagugcugaucccauggcaga

SEQ ID NO: 1097363 - RNA, 22 nt, Human
gucugcugcagagcauggcuuu

SEQ ID NO: 1097364 - RNA, 22 nt, Human
aauauuucguugcguggcuaga

SEQ ID NO: 1097365 - RNA, 21 nt, Human
ucacuuauaauguauuugcug

SEQ ID NO: 1097366 - RNA, 22 nt, Human
acagaauuuaaagcucuagacu

SEQ ID NO: 1097367 - RNA, 22 nt, Human
aauuuauuauauccuaggggaa

SEQ ID NO: 1097368 - RNA, 22 nt, Human
uuauauaaagauaacuuuucuu

SEQ ID NO: 1097369 - RNA, 22 nt, Human
gcaggauggugcccuuucugcc

SEQ ID NO: 1097370 - RNA, 22 nt, Human
aaaugcaaguucauauuuuguu

SEQ ID NO: 1097371 - RNA, 22 nt, Human
gagaagggggcucgaguguccu

SEQ ID NO: 1097372 - RNA, 22 nt, Human
aggcagguguuaccucugguuu

SEQ ID NO: 1097373 - RNA, 21 nt, Human
ggugucaguuuuggucauuag

SEQ ID NO: 1097374 - RNA, 23 nt, Human
ccucucucccuguuuggcaaaua

SEQ ID NO: 1097375 - RNA, 22 nt, Human
ugcauguguuucccagcaagcu

SEQ ID NO: 1097376 - RNA, 22 nt, Human
cuggagcauuuucugcuucugc

SEQ ID NO: 1097377 - RNA, 23 nt, Human
uggcucugugucacauacaggau

SEQ ID NO: 1097378 - RNA, 22 nt, Human
ugaaaaggaguccuuguuuuca

SEQ ID NO: 1097379 - RNA, 22 nt, Human
aagcagaaagaacaacugagug

SEQ ID NO: 1097380 - RNA, 22 nt, Human
acauacaucaaguaucacaaga

SEQ ID NO: 1097381 - RNA, 22 nt, Human
gucccaggucccagcacaucug

SEQ ID NO: 1097382 - RNA, 22 nt, Human
uccauaagcagguucuuccuga

SEQ ID NO: 1097383 - RNA, 22 nt, Human
ccaggcugcucacaagcugccc

SEQ ID NO: 1097384 - RNA, 22 nt, Human
gaggggcucuuuaauaguaaca

SEQ ID NO: 1097385 - RNA, 22 nt, Human
gcugaucucccuuuucucacag

SEQ ID NO: 1097386 - RNA, 21 nt, Human
acagaguaguugaaacagaga

SEQ ID NO: 1097387 - RNA, 22 nt, Human
cucaucaccacauauaacaaag

SEQ ID NO: 1097388 - RNA, 22 nt, Human
guuucacagcaaaguucccugu

SEQ ID NO: 1097389 - RNA, 22 nt, Human
aaauuagaaauacuuucaaagc

SEQ ID NO: 1097390 - RNA, 22 nt, Human
agggcaguucaacuucauagug

SEQ ID NO: 1097391 - RNA, 19 nt, Human
ucaaaggcaaggaggaacu

SEQ ID NO: 1097392 - RNA, 22 nt, Human
uauuauuuuagcacugaggauu

SEQ ID NO: 1097393 - RNA, 22 nt, Human
ugcaauuuggcuuccauuuucu

SEQ ID NO: 1097394 - RNA, 23 nt, Human
ugauuacaagggccaaagaaagg

SEQ ID NO: 1097395 - RNA, 22 nt, Human
ugaaaaacacuaauuggaaagc

SEQ ID NO: 1097396 - RNA, 22 nt, Human
caggguuucaccauguuagcag

SEQ ID NO: 1097397 - RNA, 22 nt, Human
auacuaagcucauuacauuuug

SEQ ID NO: 1097398 - RNA, 22 nt, Human
cccagggauuauaaaggugaaa

SEQ ID NO: 1097399 - RNA, 22 nt, Human
acacagccaggguaguaaggcu

SEQ ID NO: 1097400 - RNA, 22 nt, Human
agagauauauauuuguuuacca

SEQ ID NO: 1097401 - RNA, 20 nt, Human
gggagcuggaauugucuuag

SEQ ID NO: 1097402 - RNA, 22 nt, Human
ugcaggaauuuuuugcagaaag

SEQ ID NO: 1097403 - RNA, 22 nt, Human
auucuuccucaucaaucuguag

SEQ ID NO: 1097404 - RNA, 22 nt, Human
ggagaaggaagaaagcuacuau

SEQ ID NO: 1097405 - RNA, 22 nt, Human
gagucacauuaauuuaauuuua

SEQ ID NO: 1097406 - RNA, 22 nt, Human
agcagcucuggcacuguagcau

SEQ ID NO: 1097407 - RNA, 22 nt, Human
ggagccuuccagacugcccaca

SEQ ID NO: 1097408 - RNA, 22 nt, Human
gaaaacacuuugaucugaaagu

SEQ ID NO: 1097409 - RNA, 22 nt, Human
ugcaggugucucugucuagcgu

SEQ ID NO: 1097410 - RNA, 21 nt, Human
agggaaauccagucacuuuuc

SEQ ID NO: 1097411 - RNA, 22 nt, Human
gccagacacuccccugggcagg

SEQ ID NO: 1097412 - RNA, 22 nt, Human
aaagcagcaaguauuuguuacu

SEQ ID NO: 1097413 - RNA, 22 nt, Human
uggcucugaucagauguccagu

SEQ ID NO: 1097414 - RNA, 22 nt, Human
gccuggcaccacagccuuucag

SEQ ID NO: 1097415 - RNA, 22 nt, Human
cagaacacaggcuaaacugaga

SEQ ID NO: 1097416 - RNA, 22 nt, Human
ggcucaggggccaggccugucc

SEQ ID NO: 1097417 - RNA, 22 nt, Human
cccaggaaaguggaggcggcug

SEQ ID NO: 1097418 - RNA, 23 nt, Human
uggagcugacagucagagggagg

SEQ ID NO: 1097419 - RNA, 22 nt, Human
aaguuaauuaaccucuccauca

SEQ ID NO: 1097420 - RNA, 21 nt, Human
ucccugcuuucuggcccaguc

SEQ ID NO: 1097421 - RNA, 22 nt, Human
ggucucuguugccuccaucaag

SEQ ID NO: 1097422 - RNA, 22 nt, Human
uucagcuauaacauugagacuu

SEQ ID NO: 1097423 - RNA, 22 nt, Human
uuggauccaucucaggcauagg

SEQ ID NO: 1097424 - RNA, 19 nt, Human
ucaggaaguugaugaggug

SEQ ID NO: 1097425 - RNA, 22 nt, Human
ucaaagcaucagucaauuuagg

SEQ ID NO: 1097426 - RNA, 16 nt, Human
gcuaggcaacaggcug

SEQ ID NO: 1097427 - RNA, 22 nt, Human
ucagaguggugguuuugccuuc

SEQ ID NO: 1097428 - RNA, 22 nt, Human
cuccagugggggugagccuaga

SEQ ID NO: 1097429 - RNA, 22 nt, Human
gucuuucugccaugugaagaga

SEQ ID NO: 1097430 - RNA, 22 nt, Human
uggugagaaguuuugagauucu

SEQ ID NO: 1097431 - RNA, 22 nt, Human
cuuccagagauagggccucaag

SEQ ID NO: 1097432 - RNA, 22 nt, Human
acaggcaaggccagugagaaau

SEQ ID NO: 1097433 - RNA, 22 nt, Human
gaggagcccagcaccaucacuu

SEQ ID NO: 1097434 - RNA, 22 nt, Human
gaggcugaggguuagagaguca

SEQ ID NO: 1097435 - RNA, 22 nt, Human
uauuuccacaccuuuugaaucu

SEQ ID NO: 1097436 - RNA, 22 nt, Human
gagagcugcagccgagaggggg

SEQ ID NO: 1097437 - RNA, 22 nt, Human
ugggccuggcccuguggaggag

SEQ ID NO: 1097438 - RNA, 22 nt, Human
aacauugccaugguuaauuuua

SEQ ID NO: 1097439 - RNA, 22 nt, Human
caucagcaggcaacacucuugg

SEQ ID NO: 1097440 - RNA, 19 nt, Human
ccuggaggugaagguucuc

SEQ ID NO: 1097441 - RNA, 22 nt, Human
gagccuggauugaagugggugg

SEQ ID NO: 1097442 - RNA, 22 nt, Human
ucaagagagugcugcuuggggu

SEQ ID NO: 1097443 - RNA, 22 nt, Human
gggagggauuaguucugccugg

SEQ ID NO: 1097444 - RNA, 22 nt, Human
uuucucuuucaaucugcaguac

SEQ ID NO: 1097445 - RNA, 19 nt, Human
cauaaauguacaagauaca

SEQ ID NO: 1097446 - RNA, 22 nt, Human
gaggcagcugaaggagugacag

SEQ ID NO: 1097447 - RNA, 22 nt, Human
uuaacauuucuuuuccacucau

SEQ ID NO: 1097448 - RNA, 22 nt, Human
cugauucuuucuucuugccagg

SEQ ID NO: 1097449 - RNA, 22 nt, Human
gccagaaagaggaggaccuggg

SEQ ID NO: 1097450 - RNA, 22 nt, Human
gucagcugucuccccagagugg

SEQ ID NO: 1097451 - RNA, 22 nt, Human
agcuccuguggcugaaagagga

SEQ ID NO: 1097452 - RNA, 22 nt, Human
uggaagcaucacuucuugccug

SEQ ID NO: 1097453 - RNA, 22 nt, Human
gcugcccauuccacuggauggu

SEQ ID NO: 1097454 - RNA, 22 nt, Human
ugggcucagucugcuugguccu

SEQ ID NO: 1097455 - RNA, 22 nt, Human
ugccuguguauuuccggccugc

SEQ ID NO: 1097456 - RNA, 22 nt, Human
gcagccacuuugcaaccaagag

SEQ ID NO: 1097457 - RNA, 22 nt, Human
aguuuuaucuguaagcuguuca

SEQ ID NO: 1097458 - RNA, 22 nt, Human
gaguggggcgaagucggcgagu

SEQ ID NO: 1097459 - RNA, 22 nt, Human
agugucuuugucaaauuacagg

SEQ ID NO: 1097460 - RNA, 22 nt, Human
uauuccaauugguuguaaagaa

SEQ ID NO: 1097461 - RNA, 22 nt, Human
gcaggugguggcgcgcgcccug

SEQ ID NO: 1097462 - RNA, 22 nt, Human
ggcugucucugugacugccacc

SEQ ID NO: 1097463 - RNA, 22 nt, Human
cagggcagggagcuuagaauga

SEQ ID NO: 1097464 - RNA, 19 nt, Human
ggugugaagugaggaguua

SEQ ID NO: 1097465 - RNA, 22 nt, Human
uuaaauuccagccucauaauag

SEQ ID NO: 1097466 - RNA, 22 nt, Human
gagaacacuuauggauuauucu

SEQ ID NO: 1097467 - RNA, 22 nt, Human
cagaggcucuuccucacugccc

SEQ ID NO: 1097468 - RNA, 21 nt, Human
cuuaacauuuuaaaugaaagg

SEQ ID NO: 1097469 - RNA, 22 nt, Human
ugaggcaggacugagcgggaug

SEQ ID NO: 1097470 - RNA, 22 nt, Human
augaagauuuauaauugccuuu

SEQ ID NO: 1097471 - RNA, 22 nt, Human
gaggaguggaguugcuggguug

SEQ ID NO: 1097472 - RNA, 23 nt, Human
cacugcagcguggucuggcagga

SEQ ID NO: 1097473 - RNA, 22 nt, Human
cuucaguuuaucccaucaucca

SEQ ID NO: 1097474 - RNA, 22 nt, Human
cuccagggagcuuggaaagacc

SEQ ID NO: 1097475 - RNA, 22 nt, Human
aguuucacacaacauuugcaug

SEQ ID NO: 1097476 - RNA, 22 nt, Human
ggcagccauacucagaccuggg

SEQ ID NO: 1097477 - RNA, 22 nt, Human
ccagccagucccgcaugaccgc

SEQ ID NO: 1097478 - RNA, 22 nt, Human
gccugaccucuucugcccuggg

SEQ ID NO: 1097479 - RNA, 22 nt, Human
ccuggccucagacagagggugg

SEQ ID NO: 1097480 - RNA, 22 nt, Human
cccaggaaggagcuguguauuu

SEQ ID NO: 1097481 - RNA, 22 nt, Human
uuugcuauuuuucugugcagcu

SEQ ID NO: 1097482 - RNA, 22 nt, Human
aacuuuaaggcuauaaauuaug

SEQ ID NO: 1097483 - RNA, 22 nt, Human
uucuguuuugcacagacuugaa

SEQ ID NO: 1097484 - RNA, 21 nt, Human
uggcccuggccacggcugcca

SEQ ID NO: 1097485 - RNA, 22 nt, Human
gcugagugaggcugucaaaaug

SEQ ID NO: 1097486 - RNA, 22 nt, Human
cugcugauguaagccaugcucu

SEQ ID NO: 1097487 - RNA, 22 nt, Human
ccaggcugggcggggaaccugg

SEQ ID NO: 1097488 - RNA, 22 nt, Human
uccuucaggguugaggccgacu

SEQ ID NO: 1097489 - RNA, 22 nt, Human
cucugggcacuguauggguucu

SEQ ID NO: 1097490 - RNA, 22 nt, Human
ggagcugcuccuucagccaagu

SEQ ID NO: 1097491 - RNA, 22 nt, Human
acaggcugagcguccaucuuca

SEQ ID NO: 1097492 - RNA, 20 nt, Human
cccugagacaaaggaggggc

SEQ ID NO: 1097493 - RNA, 22 nt, Human
uaucuucauagauuuuuacacc

SEQ ID NO: 1097494 - RNA, 22 nt, Human
cugguacaaaaugcugauauca

SEQ ID NO: 1097495 - RNA, 22 nt, Human
agggcugguauguccaugaaag

SEQ ID NO: 1097496 - RNA, 22 nt, Human
cacaccuguaauaccagcuacu

SEQ ID NO: 1097497 - RNA, 22 nt, Human
aaagacuaagaagaguauuauu

SEQ ID NO: 1097498 - RNA, 22 nt, Human
agaaauguaauugcaacugucu

SEQ ID NO: 1097499 - RNA, 22 nt, Human
ggaguuggugagcaccaggcuu

SEQ ID NO: 1097500 - RNA, 23 nt, Human
uggcucugagagguucagaugcu

SEQ ID NO: 1097501 - RNA, 22 nt, Human
ccagcuccagguagaugggcag

SEQ ID NO: 1097502 - RNA, 22 nt, Human
uagaaacccauguuuauucagu

SEQ ID NO: 1097503 - RNA, 22 nt, Human
uuauuuguggcauccauguugg

SEQ ID NO: 1097504 - RNA, 22 nt, Human
aaaauucuaacaugcagccaag

SEQ ID NO: 1097505 - RNA, 22 nt, Human
cacauuuaaagguugaagcuga

SEQ ID NO: 1097506 - RNA, 22 nt, Human
auuuauguaucuguguagauca

SEQ ID NO: 1097507 - RNA, 22 nt, Human
ggccuugggauguggcugcagc

SEQ ID NO: 1097508 - RNA, 22 nt, Human
uucaagauaauaggaaugaaaa

SEQ ID NO: 1097509 - RNA, 22 nt, Human
gcaaaauuuacacuccuucuuc

SEQ ID NO: 1097510 - RNA, 22 nt, Human
uaagagcauaggcuugaaaaua

SEQ ID NO: 1097511 - RNA, 22 nt, Human
uuugacaggacuaacauauggc

SEQ ID NO: 1097512 - RNA, 22 nt, Human
aaucuggcucagaagaagauga

SEQ ID NO: 1097513 - RNA, 22 nt, Human
caggaagaccagggcuguggcu

SEQ ID NO: 1097514 - RNA, 22 nt, Human
aaauacugugaauaaagguuuu

SEQ ID NO: 1097515 - RNA, 22 nt, Human
gaggucaaggucaagagacaga

SEQ ID NO: 1097516 - RNA, 22 nt, Human
gucaauauauucugucucuuug

SEQ ID NO: 1097517 - RNA, 22 nt, Human
agucugucuacuuaaagucugu

SEQ ID NO: 1097518 - RNA, 22 nt, Human
agugcagaguacauuuguggca

SEQ ID NO: 1097519 - RNA, 22 nt, Human
uaaaucaguuucucuuauuggu

SEQ ID NO: 1097520 - RNA, 22 nt, Human
ucagcuggagaugagaaccgaa

SEQ ID NO: 1097521 - RNA, 22 nt, Human
accaaggagccacauacaaccu

SEQ ID NO: 1097522 - RNA, 18 nt, Human
ucugagggugcgggagcu

SEQ ID NO: 1097523 - RNA, 22 nt, Human
gcccucaguggauucuuauugu

SEQ ID NO: 1097524 - RNA, 22 nt, Human
aggugucugggcuuuggaguca

SEQ ID NO: 1097525 - RNA, 22 nt, Human
gagcacagcuggagguagcauu

SEQ ID NO: 1097526 - RNA, 22 nt, Human
guuucuuuuaaaauauguagac

SEQ ID NO: 1097527 - RNA, 22 nt, Human
cucaggaaaauauugaagaagu

SEQ ID NO: 1097528 - RNA, 22 nt, Human
uuccagcucuugaaggugggau

SEQ ID NO: 1097529 - RNA, 22 nt, Human
ucacuuuugaucccuaugcagu

SEQ ID NO: 1097530 - RNA, 22 nt, Human
uuuguuuagagaauugaagcag

SEQ ID NO: 1097531 - RNA, 22 nt, Human
gaggggauuggaaggaacaccc

SEQ ID NO: 1097532 - RNA, 22 nt, Human
cacugaagccugggaguaagac

SEQ ID NO: 1097533 - RNA, 22 nt, Human
cuuaacagagagaaguguugcu

SEQ ID NO: 1097534 - RNA, 22 nt, Human
cggcuggguagaggugccgggu

SEQ ID NO: 1097535 - RNA, 22 nt, Human
ugcugagaggaaggugcacugg

SEQ ID NO: 1097536 - RNA, 22 nt, Human
ucugccugcggcugcagguggc

SEQ ID NO: 1097537 - RNA, 20 nt, Human
agucacaugcauacacaagu

SEQ ID NO: 1097538 - RNA, 22 nt, Human
uacaaaaaauugauacugacga

SEQ ID NO: 1097539 - RNA, 22 nt, Human
cccagcagaaucugaugagggc

SEQ ID NO: 1097540 - RNA, 22 nt, Human
gucagcugggcaucugcagaug

SEQ ID NO: 1097541 - RNA, 22 nt, Human
uuucaugcucauggaacacagc

SEQ ID NO: 1097542 - RNA, 22 nt, Human
uuacagauacuuuguaggcaag

SEQ ID NO: 1097543 - RNA, 22 nt, Human
ugugcagaguaaggcagcuguu

SEQ ID NO: 1097544 - RNA, 22 nt, Human
aacagcagcugccugaauuugc

SEQ ID NO: 1097545 - RNA, 18 nt, Human
uguacaguuaugagcauu

SEQ ID NO: 1097546 - RNA, 22 nt, Human
auagcuguuagauuggggucga

SEQ ID NO: 1097547 - RNA, 22 nt, Human
aaagucauuggaauauuaauga

SEQ ID NO: 1097548 - RNA, 22 nt, Human
aaaggccaccaacaugaagcau

SEQ ID NO: 1097549 - RNA, 22 nt, Human
uuaauuuauguccaaaccagau

SEQ ID NO: 1097550 - RNA, 22 nt, Human
ugaggccugcauugaacuagaa

SEQ ID NO: 1097551 - RNA, 19 nt, Human
cccucaggucugagcaguc

SEQ ID NO: 1097552 - RNA, 22 nt, Human
uugcuaaaucccuauaauauuc

SEQ ID NO: 1097553 - RNA, 22 nt, Human
aaguuugugguuauacuugauu

SEQ ID NO: 1097554 - RNA, 22 nt, Human
auggaaaugauggaacauuaaa

SEQ ID NO: 1097555 - RNA, 22 nt, Human
uguguucauguauguauacaua

SEQ ID NO: 1097556 - RNA, 22 nt, Human
gugcccugguccccagcauaua

SEQ ID NO: 1097557 - RNA, 20 nt, Human
ucucugagcuucucuugggg

SEQ ID NO: 1097558 - RNA, 23 nt, Human
guuuucaacacaauaaauguaac

SEQ ID NO: 1097559 - RNA, 22 nt, Human
uagcagcuuaaguaauuagaau

SEQ ID NO: 1097560 - RNA, 22 nt, Human
cugcagagaauuguggggcuuc

SEQ ID NO: 1097561 - RNA, 22 nt, Human
uagaaguuuaaauucaccaugc

SEQ ID NO: 1097562 - RNA, 22 nt, Human
uggagcugggaguccugggcug

SEQ ID NO: 1097563 - RNA, 22 nt, Human
cuuauucauauauucucgguag

SEQ ID NO: 1097564 - RNA, 22 nt, Human
cugucugucaaguucaucucca

SEQ ID NO: 1097565 - RNA, 22 nt, Human
uucaggauucucucccauuuac

SEQ ID NO: 1097566 - RNA, 22 nt, Human
ucugggcagagggucuuaguca

SEQ ID NO: 1097567 - RNA, 22 nt, Human
gccuuggcugaugugcgaauga

SEQ ID NO: 1097568 - RNA, 22 nt, Human
uagauuucucauucauagauug

SEQ ID NO: 1097569 - RNA, 23 nt, Human
agucacaucuuagcagccagguc

SEQ ID NO: 1097570 - RNA, 17 nt, Human
gcuuccugugcugggga

SEQ ID NO: 1097571 - RNA, 22 nt, Human
cuggcugcuuguagacucgacu

SEQ ID NO: 1097572 - RNA, 22 nt, Human
ccauuaaaauggaauguaguga

SEQ ID NO: 1097573 - RNA, 22 nt, Human
uggcugggugcuauccaguacu

SEQ ID NO: 1097574 - RNA, 22 nt, Human
gacacagaugaucaggugugga

SEQ ID NO: 1097575 - RNA, 22 nt, Human
acaauguuuuuguucaaagagu

SEQ ID NO: 1097576 - RNA, 22 nt, Human
acugagaguugugcauucaugc

SEQ ID NO: 1097577 - RNA, 22 nt, Human
acuuacaagcuagggaagcuug

SEQ ID NO: 1097578 - RNA, 22 nt, Human
gcaggguccauggaggcagccc

SEQ ID NO: 1097579 - RNA, 22 nt, Human
aagauuucuuacuuauugaugc

SEQ ID NO: 1097580 - RNA, 22 nt, Human
ggcacacauggugguuggugaa

SEQ ID NO: 1097581 - RNA, 22 nt, Human
cagaguggcgacccccucagcu

SEQ ID NO: 1097582 - RNA, 22 nt, Human
acacagggcagagagcuggcuc

SEQ ID NO: 1097583 - RNA, 22 nt, Human
aggaagcuccaugaaggcagag

SEQ ID NO: 1097584 - RNA, 22 nt, Human
cacagcaggugcuuaaugauua

SEQ ID NO: 1097585 - RNA, 22 nt, Human
uauuucaggggguacaagaaga

SEQ ID NO: 1097586 - RNA, 22 nt, Human
ccagcucuggcuucuugcuggg

SEQ ID NO: 1097587 - RNA, 22 nt, Human
gccugucuacacuuucucugca

SEQ ID NO: 1097588 - RNA, 20 nt, Human
gcucccagccugcagucccc

SEQ ID NO: 1097589 - RNA, 22 nt, Human
gcugcccuaauaucacauguua

SEQ ID NO: 1097590 - RNA, 22 nt, Human
acaggggcuccgaaggugaggg

SEQ ID NO: 1097591 - RNA, 22 nt, Human
agauacauugaguuuccuccug

SEQ ID NO: 1097592 - RNA, 22 nt, Human
caacacauugaagcuaugauga

SEQ ID NO: 1097593 - RNA, 22 nt, Human
ccagcccuugagauggaaggga

SEQ ID NO: 1097594 - RNA, 22 nt, Human
gcugaaugaauguauuuuaaaa

SEQ ID NO: 1097595 - RNA, 22 nt, Human
guacagaaaguacccauagaag

SEQ ID NO: 1097596 - RNA, 22 nt, Human
uguaaacaguaggacuaaagag

SEQ ID NO: 1097597 - RNA, 22 nt, Human
uucuugcaggucacucacugag

SEQ ID NO: 1097598 - RNA, 22 nt, Human
agcacccucagccuuauccaga

SEQ ID NO: 1097599 - RNA, 20 nt, Human
uuuuagcagaaagaaagcuc

SEQ ID NO: 1097600 - RNA, 22 nt, Human
uugaaacugucagcuuuuacgc

SEQ ID NO: 1097601 - RNA, 22 nt, Human
aacagauaauuucuaaguuacu

SEQ ID NO: 1097602 - RNA, 22 nt, Human
cagggagcaggcucuguccauc

SEQ ID NO: 1097603 - RNA, 22 nt, Human
cagcccuggccccagguggucu

SEQ ID NO: 1097604 - RNA, 23 nt, Human
cagagcuggcucagagcugccug

SEQ ID NO: 1097605 - RNA, 22 nt, Human
cacagccugcugcacucaagaa

SEQ ID NO: 1097606 - RNA, 22 nt, Human
auuacagauuauaaauuugagc

SEQ ID NO: 1097607 - RNA, 22 nt, Human
agcagcuguuagaaacaggaag

SEQ ID NO: 1097608 - RNA, 22 nt, Human
accuucagacaucaacuaucuc

SEQ ID NO: 1097609 - RNA, 22 nt, Human
uuguacuuacauuuuaaagcua

SEQ ID NO: 1097610 - RNA, 22 nt, Human
uggggaccagauuagaccaugg

SEQ ID NO: 1097611 - RNA, 22 nt, Human
ugccaggcauuugacagacacu

SEQ ID NO: 1097612 - RNA, 22 nt, Human
aggcagcuggaggcagagacua

SEQ ID NO: 1097613 - RNA, 22 nt, Human
ggcagugguuagaaacaugagc

SEQ ID NO: 1097614 - RNA, 22 nt, Human
ucucugaguauccugaacugcc

SEQ ID NO: 1097615 - RNA, 22 nt, Human
aucagaaaggugggcaagcaga

SEQ ID NO: 1097616 - RNA, 22 nt, Human
gccaggcauguccucugcagaa

SEQ ID NO: 1097617 - RNA, 18 nt, Human
ucagggaaucuuggccuu

SEQ ID NO: 1097618 - RNA, 22 nt, Human
agcaggcuccaggcuggccauc

SEQ ID NO: 1097619 - RNA, 22 nt, Human
ucaaacauccccaccagggacu

SEQ ID NO: 1097620 - RNA, 23 nt, Human
agaaguggaauggccgugggguc

SEQ ID NO: 1097621 - RNA, 22 nt, Human
ugaagaaccugaugagcugugu

SEQ ID NO: 1097622 - RNA, 22 nt, Human
agggcagcuggaagguggcuuc

SEQ ID NO: 1097623 - RNA, 22 nt, Human
gguuuuaacuacagaauugcaa

SEQ ID NO: 1097624 - RNA, 22 nt, Human
uaagaugaucaccaaaugcugg

SEQ ID NO: 1097625 - RNA, 22 nt, Human
ggucccaguugcccaggucagg

SEQ ID NO: 1097626 - RNA, 23 nt, Human
uggggagaguuacccuggaagcg

SEQ ID NO: 1097627 - RNA, 22 nt, Human
auacaaggucaugaagguuuac

SEQ ID NO: 1097628 - RNA, 22 nt, Human
cugccagcagaggccagcgcug

SEQ ID NO: 1097629 - RNA, 22 nt, Human
aaacaucuggaggccccguuug

SEQ ID NO: 1097630 - RNA, 22 nt, Human
aaaggcaagcauuuauauagga

SEQ ID NO: 1097631 - RNA, 20 nt, Human
ugcaggcuucgcucuaggag

SEQ ID NO: 1097632 - RNA, 21 nt, Human
aggcucagagagaaacucuug

SEQ ID NO: 1097633 - RNA, 23 nt, Human
auggagcugguacuagcuaccuc

SEQ ID NO: 1097634 - RNA, 22 nt, Human
uagggcagauucgguggaguuu

SEQ ID NO: 1097635 - RNA, 21 nt, Human
agcagaggcugccuggugacu

SEQ ID NO: 1097636 - RNA, 22 nt, Human
cuggagaggcugggaacagguu

SEQ ID NO: 1097637 - RNA, 22 nt, Human
ugccugggccuucccaccucug

SEQ ID NO: 1097638 - RNA, 22 nt, Human
ucuuuuauagugaauuuucuug

SEQ ID NO: 1097639 - RNA, 22 nt, Human
uauuuauucauucagcaagcau

SEQ ID NO: 1097640 - RNA, 22 nt, Human
cacaauuagcagcucuuuauuu

SEQ ID NO: 1097641 - RNA, 22 nt, Human
aaaauguaaagcuugaguguag

SEQ ID NO: 1097642 - RNA, 22 nt, Human
gccuggcagccuccaaccuuca

SEQ ID NO: 1097643 - RNA, 20 nt, Human
ugugaaagcaguagaaugac

SEQ ID NO: 1097644 - RNA, 22 nt, Human
uaguaacugguugaacaacugu

SEQ ID NO: 1097645 - RNA, 21 nt, Human
aaauacagaugcaaaucuguu

SEQ ID NO: 1097646 - RNA, 22 nt, Human
gcuucaugccaggagguuuaag

SEQ ID NO: 1097647 - RNA, 19 nt, Human
gccugcagaaaaggcaggg

SEQ ID NO: 1097648 - RNA, 22 nt, Human
gaagacuuuaagccgagauuag

SEQ ID NO: 1097649 - RNA, 22 nt, Human
cugugagaaaggugauggaggu

SEQ ID NO: 1097650 - RNA, 22 nt, Human
auguuugugggauaaacaaaug

SEQ ID NO: 1097651 - RNA, 22 nt, Human
caggucagaggcgcagccccca

SEQ ID NO: 1097652 - RNA, 22 nt, Human
acaggacagggaauucgaaauu

SEQ ID NO: 1097653 - RNA, 22 nt, Human
agaaaccucacagcaauucuga

SEQ ID NO: 1097654 - RNA, 22 nt, Human
ugugccaagaucaaacuuuucu

SEQ ID NO: 1097655 - RNA, 22 nt, Human
augggcuggggaagcucacucc

SEQ ID NO: 1097656 - RNA, 22 nt, Human
acaagguaagaaacauuggcuu

SEQ ID NO: 1097657 - RNA, 22 nt, Human
uggagggcaugcuguccauggg

SEQ ID NO: 1097658 - RNA, 22 nt, Human
cucugcagaauuugagcugcuc

SEQ ID NO: 1097659 - RNA, 22 nt, Human
aagcacagaaaaggagcaugga

SEQ ID NO: 1097660 - RNA, 22 nt, Human
uacuguuuuuuagacucauggu

SEQ ID NO: 1097661 - RNA, 22 nt, Human
aguccuucaagaaaucuggaaa

SEQ ID NO: 1097662 - RNA, 22 nt, Human
cagugcuguuguaagcucauug

SEQ ID NO: 1097663 - RNA, 22 nt, Human
aguagaaaguugcaggaggaau

SEQ ID NO: 1097664 - RNA, 22 nt, Human
caggauggagaguuguugguug

SEQ ID NO: 1097665 - RNA, 22 nt, Human
caggaggcagaggaugcccagu

SEQ ID NO: 1097666 - RNA, 22 nt, Human
agcaaagcuaucucuauggaga

SEQ ID NO: 1097667 - RNA, 22 nt, Human
acauuuuuuagagucccacauu

SEQ ID NO: 1097668 - RNA, 23 nt, Human
augaaacucaagccagauccaag

SEQ ID NO: 1097669 - RNA, 23 nt, Human
ugacacauuuccuuuccacugca

SEQ ID NO: 1097670 - RNA, 22 nt, Human
caccagcuuugcccacugccca

SEQ ID NO: 1097671 - RNA, 22 nt, Human
auucaagagcccauguuuccug

SEQ ID NO: 1097672 - RNA, 22 nt, Human
uauuuggacaccaaguagaagu

SEQ ID NO: 1097673 - RNA, 22 nt, Human
uucaacuagauuuauacaauuc

SEQ ID NO: 1097674 - RNA, 22 nt, Human
caccagggacaaugcuaggggu

SEQ ID NO: 1097675 - RNA, 22 nt, Human
ccuuggagcggucagcacuggu

SEQ ID NO: 1097676 - RNA, 22 nt, Human
cugcagcuuauuugcuguguga

SEQ ID NO: 1097677 - RNA, 22 nt, Human
ugagguggcuagggaggcacuc

SEQ ID NO: 1097678 - RNA, 22 nt, Human
cauuuuauccucugggaagcua

SEQ ID NO: 1097679 - RNA, 22 nt, Human
cucucagacacccauuuggaaa

SEQ ID NO: 1097680 - RNA, 21 nt, Human
gaaagcacagaaaggacucuu

SEQ ID NO: 1097681 - RNA, 23 nt, Human
aguguuccaguugguugagagug

SEQ ID NO: 1097682 - RNA, 22 nt, Human
aacauguaucgcuuuuuaauau

SEQ ID NO: 1097683 - RNA, 22 nt, Human
ucauccaguaccauggaaggca

SEQ ID NO: 1097684 - RNA, 22 nt, Human
gcauagcuguuaauuugguuuc

SEQ ID NO: 1097685 - RNA, 22 nt, Human
uuguaugaauguauccuaauuu

SEQ ID NO: 1097686 - RNA, 22 nt, Human
uguuuaauucaccaucauguuc

SEQ ID NO: 1097687 - RNA, 23 nt, Human
agcuggaggcugucuacucccaa

SEQ ID NO: 1097688 - RNA, 22 nt, Human
ugccuuguccuucgucagggcu

SEQ ID NO: 1097689 - RNA, 22 nt, Human
gcucagaggcacgaccucuugg

SEQ ID NO: 1097690 - RNA, 21 nt, Human
ucuggggaagacaucuaggau

SEQ ID NO: 1097691 - RNA, 22 nt, Human
gaaugcacuuccaacaucuauu

SEQ ID NO: 1097692 - RNA, 22 nt, Human
uuggugggagagaugaggguug

SEQ ID NO: 1097693 - RNA, 22 nt, Human
ccuccaggcugaauaucuagaa

SEQ ID NO: 1097694 - RNA, 22 nt, Human
gcauguguggaggagaugugcu

SEQ ID NO: 1097695 - RNA, 20 nt, Human
uccaggaaugguagaggacu

SEQ ID NO: 1097696 - RNA, 22 nt, Human
uuuaacagaugcuaugucuacc

SEQ ID NO: 1097697 - RNA, 22 nt, Human
ccagugcuuccaggaauacggu

SEQ ID NO: 1097698 - RNA, 22 nt, Human
cagauggcagggcagcucugca

SEQ ID NO: 1097699 - RNA, 21 nt, Human
gagccuucccucugcccuuuc

SEQ ID NO: 1097700 - RNA, 22 nt, Human
uuguaacacuuuucuauuaaua

SEQ ID NO: 1097701 - RNA, 20 nt, Human
gcuggcagaugucuugagau

SEQ ID NO: 1097702 - RNA, 22 nt, Human
uguuauauaacuuacaaccugu

SEQ ID NO: 1097703 - RNA, 22 nt, Human
augcugaauaguucacucuucu

SEQ ID NO: 1097704 - RNA, 22 nt, Human
aaagggcugucaaauaagcaac

SEQ ID NO: 1097705 - RNA, 22 nt, Human
gaggcaguguuuacugcccugu

SEQ ID NO: 1097706 - RNA, 22 nt, Human
acuacacagggaugugacuacc

SEQ ID NO: 1097707 - RNA, 22 nt, Human
gaagcagacuuuugcuuauuug

SEQ ID NO: 1097708 - RNA, 22 nt, Human
uaggaacaacugcagguacaag

SEQ ID NO: 1097709 - RNA, 22 nt, Human
aaagcagcggugucuuuacugc

SEQ ID NO: 1097710 - RNA, 22 nt, Human
ggcugggcucgcugauuggcug

SEQ ID NO: 1097711 - RNA, 22 nt, Human
ucagguguuagaagaaauuuca

SEQ ID NO: 1097712 - RNA, 22 nt, Human
auaaggcagaaauagggaaagu

SEQ ID NO: 1097713 - RNA, 22 nt, Human
ugucccaguuuaucugggacug

SEQ ID NO: 1097714 - RNA, 22 nt, Human
ucuucuuuaugucauaugccag

SEQ ID NO: 1097715 - RNA, 19 nt, Human
uccugcuuucuacucugcu

SEQ ID NO: 1097716 - RNA, 22 nt, Human
uaaaucacuccuaauaaucagu

SEQ ID NO: 1097717 - RNA, 22 nt, Human
agcaaggauuauccugggaagg

SEQ ID NO: 1097718 - RNA, 17 nt, Human
cucuggggacaguucua

SEQ ID NO: 1097719 - RNA, 21 nt, Human
gauuuuaaagagacugccaca

SEQ ID NO: 1097720 - RNA, 19 nt, Human
ggcugggucuggcagguuc

SEQ ID NO: 1097721 - RNA, 22 nt, Human
uucuaagaaugcuuugcaaaau

SEQ ID NO: 1097722 - RNA, 22 nt, Human
ccuggggaagucacuucucuuu

SEQ ID NO: 1097723 - RNA, 22 nt, Human
ugcaggagacauaauagggacu

SEQ ID NO: 1097724 - RNA, 22 nt, Human
gcugaagcccacguggcuugua

SEQ ID NO: 1097725 - RNA, 22 nt, Human
ccuuuaaauggauguucaacug

SEQ ID NO: 1097726 - RNA, 22 nt, Human
uaacagaaaggggacagaaaua

SEQ ID NO: 1097727 - RNA, 22 nt, Human
uggccugccugggagcagcagg

SEQ ID NO: 1097728 - RNA, 22 nt, Human
uuugaaagaauuuauguacuuu

SEQ ID NO: 1097729 - RNA, 22 nt, Human
ucuuuguauguauguuucaaag

SEQ ID NO: 1097730 - RNA, 22 nt, Human
cugccuguauugucugcuuggg

SEQ ID NO: 1097731 - RNA, 22 nt, Human
gcaguggcaugaugugggcuca

SEQ ID NO: 1097732 - RNA, 22 nt, Human
ucccaccaggugaccauuucau

SEQ ID NO: 1097733 - RNA, 22 nt, Human
ccagcuggcaggagagucaggg

SEQ ID NO: 1097734 - RNA, 22 nt, Human
ugugaagaauuaaugugaauca

SEQ ID NO: 1097735 - RNA, 22 nt, Human
ucuccuggucaccucagaaguc

SEQ ID NO: 1097736 - RNA, 22 nt, Human
cucagggagguccugugcugaa

SEQ ID NO: 1097737 - RNA, 22 nt, Human
acacuuaagcaugaaguauaaa

SEQ ID NO: 1097738 - RNA, 22 nt, Human
agcaggcuuucaagagucuucu

SEQ ID NO: 1097739 - RNA, 22 nt, Human
cucuggagcgcugcuucccgcg

SEQ ID NO: 1097740 - RNA, 22 nt, Human
uuugaacagggaauguuccaca

SEQ ID NO: 1097741 - RNA, 22 nt, Human
gccuccuggguucaugccauuc

SEQ ID NO: 1097742 - RNA, 22 nt, Human
aaggagagguuguccguguugu

SEQ ID NO: 1097743 - RNA, 22 nt, Human
caccugcugagcugcugggggu

SEQ ID NO: 1097744 - RNA, 22 nt, Human
agccucuggcccuagacugcuu

SEQ ID NO: 1097745 - RNA, 22 nt, Human
uagaaacauauguuugagacau

SEQ ID NO: 1097746 - RNA, 22 nt, Human
aucaguuuaacugucaagagcc

SEQ ID NO: 1097747 - RNA, 22 nt, Human
uaacaucugggcugcguccuga

SEQ ID NO: 1097748 - RNA, 22 nt, Human
gugcagcagggggaagacagug

SEQ ID NO: 1097749 - RNA, 22 nt, Human
gacaaagucaacaguacucuca

SEQ ID NO: 1097750 - RNA, 22 nt, Human
agcaggugaauuccuggaugug

SEQ ID NO: 1097751 - RNA, 22 nt, Human
uuuauaagaagcaaugucugag

SEQ ID NO: 1097752 - RNA, 22 nt, Human
ucuggcucucauacucgccagu

SEQ ID NO: 1097753 - RNA, 22 nt, Human
cucccugggcagauguggcucu

SEQ ID NO: 1097754 - RNA, 22 nt, Human
guuacaaauguaaauucugggg

SEQ ID NO: 1097755 - RNA, 22 nt, Human
uuccagaguugggggagugguu

SEQ ID NO: 1097756 - RNA, 20 nt, Human
uccagcugggaacagcugau

SEQ ID NO: 1097757 - RNA, 22 nt, Human
uuacaaacaacagacauuuauu

SEQ ID NO: 1097758 - RNA, 22 nt, Human
ggcuccaagucucagagugaag

SEQ ID NO: 1097759 - RNA, 22 nt, Human
ugagccaggcucaagugauccu

SEQ ID NO: 1097760 - RNA, 22 nt, Human
aaaagggacuacucucagcucc

SEQ ID NO: 1097761 - RNA, 22 nt, Human
uuugaaagagcugauacaugaa

SEQ ID NO: 1097762 - RNA, 22 nt, Human
aauuaaauugguuuagagagga

SEQ ID NO: 1097763 - RNA, 22 nt, Human
aaugcugaauuuaguauuuaug

SEQ ID NO: 1097764 - RNA, 20 nt, Human
acagaaagcugccuuguccc

SEQ ID NO: 1097765 - RNA, 22 nt, Human
ccugaagaugcuguggccuggu

SEQ ID NO: 1097766 - RNA, 22 nt, Human
cccucagcuccacccucagcag

SEQ ID NO: 1097767 - RNA, 22 nt, Human
uuuguagaacuauacuuacauu

SEQ ID NO: 1097768 - RNA, 23 nt, Human
aggcuggcuucaggagccucucc

SEQ ID NO: 1097769 - RNA, 22 nt, Human
cuccucuuuacccgcauggucu

SEQ ID NO: 1097770 - RNA, 22 nt, Human
cugagagaugauauagcuuaau

SEQ ID NO: 1097771 - RNA, 22 nt, Human
uaaaaugacuuccuccaacauc

SEQ ID NO: 1097772 - RNA, 22 nt, Human
agcccugcugcuucuuguauuu

SEQ ID NO: 1097773 - RNA, 22 nt, Human
augguucauauuaugcaucuga

SEQ ID NO: 1097774 - RNA, 22 nt, Human
gggagucugggcuagacuccuu

SEQ ID NO: 1097775 - RNA, 22 nt, Human
cuucaaguccagcucaugcucu

SEQ ID NO: 1097776 - RNA, 22 nt, Human
aggauuucugugccuggaaaau

SEQ ID NO: 1097777 - RNA, 22 nt, Human
cagcugaguguuggcauguuca

SEQ ID NO: 1097778 - RNA, 22 nt, Human
agaccagggguugaguccuagc

SEQ ID NO: 1097779 - RNA, 22 nt, Human
accuucauauucucugauaccu

SEQ ID NO: 1097780 - RNA, 22 nt, Human
uuuuaaugugcucugcaaugau

SEQ ID NO: 1097781 - RNA, 22 nt, Human
cccagcucucugcucuuagccu

SEQ ID NO: 1097782 - RNA, 22 nt, Human
aaaauauggggugagcccagag

SEQ ID NO: 1097783 - RNA, 22 nt, Human
ggcagucuuucccuugagcucu

SEQ ID NO: 1097784 - RNA, 22 nt, Human
cugccugcuucugagccagagg

SEQ ID NO: 1097785 - RNA, 22 nt, Human
ugcuggaggggccugaccagga

SEQ ID NO: 1097786 - RNA, 21 nt, Human
acugugaagaugcuauaaacu

SEQ ID NO: 1097787 - RNA, 22 nt, Human
gaggccuggcugucagucccca

SEQ ID NO: 1097788 - RNA, 22 nt, Human
uggcccugugacugaguucuag

SEQ ID NO: 1097789 - RNA, 22 nt, Human
ggaggucaaauggagggcuggg

SEQ ID NO: 1097790 - RNA, 22 nt, Human
cucuucaguuggucacuauucu

SEQ ID NO: 1097791 - RNA, 22 nt, Human
aggcacugugcuucuuauaugu

SEQ ID NO: 1097792 - RNA, 22 nt, Human
ggcagaagaaaggcuaagucuc

SEQ ID NO: 1097793 - RNA, 22 nt, Human
augcaagacccagaaaucauua

SEQ ID NO: 1097794 - RNA, 22 nt, Human
aggugcuggaguagaagaaaaa

SEQ ID NO: 1097795 - RNA, 22 nt, Human
ggguccagcuacaucagggugg

SEQ ID NO: 1097796 - RNA, 18 nt, Human
agagaugguguagaguuu

SEQ ID NO: 1097797 - RNA, 22 nt, Human
ggaagugguagagccaugagug

SEQ ID NO: 1097798 - RNA, 22 nt, Human
ccuccuggccugugcagagccc

SEQ ID NO: 1097799 - RNA, 21 nt, Human
aauacagugaagaauuucuuu

SEQ ID NO: 1097800 - RNA, 22 nt, Human
ucuucagugaauggcaagaucu

SEQ ID NO: 1097801 - RNA, 22 nt, Human
uuucccaucuuagcagauuaaa

SEQ ID NO: 1097802 - RNA, 22 nt, Human
ggcugggcugcggcuguaccug

SEQ ID NO: 1097803 - RNA, 22 nt, Human
cugcuguguuucugcuagaaaa

SEQ ID NO: 1097804 - RNA, 22 nt, Human
acuuggaaaauucaaaauggca

SEQ ID NO: 1097805 - RNA, 22 nt, Human
cccagcuaccucugcuaggaga

SEQ ID NO: 1097806 - RNA, 22 nt, Human
ucccuggacaacagacuucacu

SEQ ID NO: 1097807 - RNA, 22 nt, Human
uucuuucccaguagaugugaaa

SEQ ID NO: 1097808 - RNA, 22 nt, Human
agacuuucuugaccuaguuaau

SEQ ID NO: 1097809 - RNA, 22 nt, Human
auagaauaaggcacagauucuu

SEQ ID NO: 1097810 - RNA, 17 nt, Human
gaaagguccuagaaauc

SEQ ID NO: 1097811 - RNA, 22 nt, Human
gaauacaaauaauaccaaggug

SEQ ID NO: 1097812 - RNA, 22 nt, Human
agguggcaugccugagacauaa

SEQ ID NO: 1097813 - RNA, 22 nt, Human
gucagcauaguucacacacagu

SEQ ID NO: 1097814 - RNA, 22 nt, Human
ugggaaaguguugaggugucuu

SEQ ID NO: 1097815 - RNA, 22 nt, Human
ugaugauguuuaucuugguauu

SEQ ID NO: 1097816 - RNA, 22 nt, Human
auuagcuuugguggaaaggagu

SEQ ID NO: 1097817 - RNA, 22 nt, Human
ucuuugcaaauguuauuaucuu

SEQ ID NO: 1097818 - RNA, 22 nt, Human
guacucucuugaaggccuuucu

SEQ ID NO: 1097819 - RNA, 22 nt, Human
ccugagagcauuccacacugaa

SEQ ID NO: 1097820 - RNA, 22 nt, Human
gaguccuguugucccagauggg

SEQ ID NO: 1097821 - RNA, 22 nt, Human
gcuuucaaauccuaauuccaac

SEQ ID NO: 1097822 - RNA, 22 nt, Human
gcagccacuaguuuuccuguuu

SEQ ID NO: 1097823 - RNA, 22 nt, Human
ugcaguuugcccuuugcucacu

SEQ ID NO: 1097824 - RNA, 22 nt, Human
uaagccacuagucuguuaugaa

SEQ ID NO: 1097825 - RNA, 22 nt, Human
ugcucuccggcuuccguggccu

SEQ ID NO: 1097826 - RNA, 22 nt, Human
caugccaguuuugagaugcacc

SEQ ID NO: 1097827 - RNA, 21 nt, Human
gguggccuuggugagagaccu

SEQ ID NO: 1097828 - RNA, 22 nt, Human
gaaggccacaaaaaaugucaua

SEQ ID NO: 1097829 - RNA, 22 nt, Human
gagaggucaucucccaucagca

SEQ ID NO: 1097830 - RNA, 22 nt, Human
ucacagcagaauuuaggaggca

SEQ ID NO: 1097831 - RNA, 19 nt, Human
ggaaggugacaguggugaa

SEQ ID NO: 1097832 - RNA, 22 nt, Human
uaggaacacauccuccucuagc

SEQ ID NO: 1097833 - RNA, 22 nt, Human
uuugacaauucaugacauuuau

SEQ ID NO: 1097834 - RNA, 22 nt, Human
ugaaggccagggauuugcagcc

SEQ ID NO: 1097835 - RNA, 22 nt, Human
uuuauauauggcuggucuggau

SEQ ID NO: 1097836 - RNA, 22 nt, Human
ccacccagccagaugcaggaag

SEQ ID NO: 1097837 - RNA, 22 nt, Human
cccagagcugagucugauauau

SEQ ID NO: 1097838 - RNA, 22 nt, Human
cucuuaaagaauguuccagcug

SEQ ID NO: 1097839 - RNA, 20 nt, Human
gagccugggaagucuaaggu

SEQ ID NO: 1097840 - RNA, 22 nt, Human
uauuuucuguggaggaccagau

SEQ ID NO: 1097841 - RNA, 19 nt, Human
auaaauaaaaagugggaga

SEQ ID NO: 1097842 - RNA, 22 nt, Human
uuauaauucuggcauaggcugu

SEQ ID NO: 1097843 - RNA, 22 nt, Human
gugacucuuaaagcaaaucuug

SEQ ID NO: 1097844 - RNA, 22 nt, Human
cugagcccugccucuugucacu

SEQ ID NO: 1097845 - RNA, 22 nt, Human
uggagcaggacugcugcccuca

SEQ ID NO: 1097846 - RNA, 22 nt, Human
augaagaaaaauccagcugucc

SEQ ID NO: 1097847 - RNA, 22 nt, Human
gcucaggaaggcucaaccagga

SEQ ID NO: 1097848 - RNA, 22 nt, Human
gcugggagucgcgucuguggcc

SEQ ID NO: 1097849 - RNA, 20 nt, Human
uaggcagagcugugcagccu

SEQ ID NO: 1097850 - RNA, 22 nt, Human
ucagaggugcaagaaguucuga

SEQ ID NO: 1097851 - RNA, 22 nt, Human
aagaugcagcaaacuacuuuuu

SEQ ID NO: 1097852 - RNA, 22 nt, Human
cuccagggagcuguggagguuu

SEQ ID NO: 1097853 - RNA, 22 nt, Human
cugagcugggcucucuugaggg

SEQ ID NO: 1097854 - RNA, 22 nt, Human
uaacuucucugagccucauucc

SEQ ID NO: 1097855 - RNA, 22 nt, Human
ggaacauguagagggccuguag

SEQ ID NO: 1097856 - RNA, 22 nt, Human
uuucaaguuguuuauauccaga

SEQ ID NO: 1097857 - RNA, 22 nt, Human
uggaagaauaggauagaagaac

SEQ ID NO: 1097858 - RNA, 22 nt, Human
cuucucuucccagggacacagg

SEQ ID NO: 1097859 - RNA, 17 nt, Human
uggaugugggaucugga

SEQ ID NO: 1097860 - RNA, 22 nt, Human
gagcucagcaaaggucugugug

SEQ ID NO: 1097861 - RNA, 21 nt, Human
ggcaggauggcaguggacccc

SEQ ID NO: 1097862 - RNA, 22 nt, Human
aguaugaagcugaaugauuuua

SEQ ID NO: 1097863 - RNA, 22 nt, Human
gcucccugcacucugcagcccu

SEQ ID NO: 1097864 - RNA, 22 nt, Human
cuucuggaggacacuggcccca

SEQ ID NO: 1097865 - RNA, 22 nt, Human
gcagccagguuugaggaccacu

SEQ ID NO: 1097866 - RNA, 22 nt, Human
gaaugcucuuugguccuagacu

SEQ ID NO: 1097867 - RNA, 22 nt, Human
uuaguguauuuucaaauguaga

SEQ ID NO: 1097868 - RNA, 22 nt, Human
cacagcuggggaagcugaggcc

SEQ ID NO: 1097869 - RNA, 19 nt, Human
gagcacagcggcauuuggu

SEQ ID NO: 1097870 - RNA, 19 nt, Human
ugagaggcuuaaggcagcu

SEQ ID NO: 1097871 - RNA, 22 nt, Human
gcccagugguaaaagcaggccu

SEQ ID NO: 1097872 - RNA, 22 nt, Human
aaaauauguauaacucuucugc

SEQ ID NO: 1097873 - RNA, 22 nt, Human
cucugugggggagaggcagcug

SEQ ID NO: 1097874 - RNA, 22 nt, Human
aaaugcuaaaugcagcaaguag

SEQ ID NO: 1097875 - RNA, 22 nt, Human
gcccucagcuugauguuguucu

SEQ ID NO: 1097876 - RNA, 22 nt, Human
auuuuacauaaggaagguuuaa

SEQ ID NO: 1097877 - RNA, 22 nt, Human
aagagagucagucugagcacca

SEQ ID NO: 1097878 - RNA, 22 nt, Human
aggugacaggacaggagcuggu

SEQ ID NO: 1097879 - RNA, 22 nt, Human
ugaggggaacugaugcccauug

SEQ ID NO: 1097880 - RNA, 22 nt, Human
uauuucugagaaccaacuuacc

SEQ ID NO: 1097881 - RNA, 22 nt, Human
cccacacauuuuucacuuaccg

SEQ ID NO: 1097882 - RNA, 22 nt, Human
gcauacagagaggauguggcau

SEQ ID NO: 1097883 - RNA, 22 nt, Human
acagagcaauaacagggagagg

SEQ ID NO: 1097884 - RNA, 19 nt, Human
guauuucaggacaagacgu

SEQ ID NO: 1097885 - RNA, 22 nt, Human
ccugggaccucgcgggaagcgg

SEQ ID NO: 1097886 - RNA, 23 nt, Human
ccuucagaagaaguaacaggggc

SEQ ID NO: 1097887 - RNA, 22 nt, Human
ugggaggcuuccagaccuugcu

SEQ ID NO: 1097888 - RNA, 22 nt, Human
agcccagaggguagcagaagaa

SEQ ID NO: 1097889 - RNA, 22 nt, Human
gcagggguagugucuuccugag

SEQ ID NO: 1097890 - RNA, 22 nt, Human
ugaaagguguccaauauuucuc

SEQ ID NO: 1097891 - RNA, 22 nt, Human
ugcuugucuucaggaaugcuga

SEQ ID NO: 1097892 - RNA, 22 nt, Human
cugaggcaguuuaauuuuugaa

SEQ ID NO: 1097893 - RNA, 22 nt, Human
guuuacaguacucacuugcauu

SEQ ID NO: 1097894 - RNA, 21 nt, Human
ccuggccaaucugauaggguu

SEQ ID NO: 1097895 - RNA, 22 nt, Human
uggccugcucugacuuuggggg

SEQ ID NO: 1097896 - RNA, 22 nt, Human
aaccauuagucaaucagcaaga

SEQ ID NO: 1097897 - RNA, 22 nt, Human
aacaguuugccugaaauguauu

SEQ ID NO: 1097898 - RNA, 19 nt, Human
gucaccauuuccaaaugcc

SEQ ID NO: 1097899 - RNA, 22 nt, Human
cugcucuguauaugagcaggaa

SEQ ID NO: 1097900 - RNA, 22 nt, Human
cugggcagaguccggaagaugg

SEQ ID NO: 1097901 - RNA, 22 nt, Human
cauaacauguacauauaaaugc

SEQ ID NO: 1097902 - RNA, 22 nt, Human
auaugaagucagacaaacuggg

SEQ ID NO: 1097903 - RNA, 22 nt, Human
agcaguggccuggggcucugug

SEQ ID NO: 1097904 - RNA, 22 nt, Human
gaaggccugugguagugagacg

SEQ ID NO: 1097905 - RNA, 22 nt, Human
agaggcugggcaggacccacag

SEQ ID NO: 1097906 - RNA, 22 nt, Human
agaacuuaggaacaacagcuua

SEQ ID NO: 1097907 - RNA, 22 nt, Human
ucacaucuauacccaauaauuu

SEQ ID NO: 1097908 - RNA, 22 nt, Human
ggcacagcacaguggacccagg

SEQ ID NO: 1097909 - RNA, 22 nt, Human
aguucaaaaagguaaaguuuau

SEQ ID NO: 1097910 - RNA, 22 nt, Human
ugcaggugcagcgauacuguga

SEQ ID NO: 1097911 - RNA, 22 nt, Human
agggccugagcuggcugaccuc

SEQ ID NO: 1097912 - RNA, 22 nt, Human
aaacacaagaggcaggguacag

SEQ ID NO: 1097913 - RNA, 22 nt, Human
aggcagggcucauuucuuaggc

SEQ ID NO: 1097914 - RNA, 22 nt, Human
aucugccugcaguggagguggg

SEQ ID NO: 1097915 - RNA, 22 nt, Human
gaaggcuguuucugguagugau

SEQ ID NO: 1097916 - RNA, 22 nt, Human
uucuucuuuccaauuacauggu

SEQ ID NO: 1097917 - RNA, 22 nt, Human
ugggcacuauggcucugugcac

SEQ ID NO: 1097918 - RNA, 22 nt, Human
aagggcugcuguagaagcagag

SEQ ID NO: 1097919 - RNA, 22 nt, Human
agacaaaugguaauuaugucua

SEQ ID NO: 1097920 - RNA, 22 nt, Human
aaauacuguccaccauggagca

SEQ ID NO: 1097921 - RNA, 22 nt, Human
gcagccuguuguaccagccugu

SEQ ID NO: 1097922 - RNA, 22 nt, Human
ccagaugggaagaagcaugacu

SEQ ID NO: 1097923 - RNA, 22 nt, Human
gcagcugcuggaaguuccugcc

SEQ ID NO: 1097924 - RNA, 21 nt, Human
accuuuaauucaagcaucagg

SEQ ID NO: 1097925 - RNA, 22 nt, Human
aggcagguuucccggcugucaa

SEQ ID NO: 1097926 - RNA, 22 nt, Human
cagcagagaugagauuccuaua

SEQ ID NO: 1097927 - RNA, 22 nt, Human
acuuuguuuggcuauuagaguc

SEQ ID NO: 1097928 - RNA, 22 nt, Human
cccagcacucagcaggcucaua

SEQ ID NO: 1097929 - RNA, 22 nt, Human
gcuaggagccgcugcacuaggu

SEQ ID NO: 1097930 - RNA, 22 nt, Human
acacauaugccauuacagcaaa

SEQ ID NO: 1097931 - RNA, 22 nt, Human
uuuauuguguugaaacugaauu

SEQ ID NO: 1097932 - RNA, 22 nt, Human
cauuucugauuacagaauacua

SEQ ID NO: 1097933 - RNA, 22 nt, Human
cuacauuuggagaguauaggaa

SEQ ID NO: 1097934 - RNA, 22 nt, Human
gagccaccuucaacucaggaau

SEQ ID NO: 1097935 - RNA, 22 nt, Human
ucugccugccgagaacaccuac

SEQ ID NO: 1097936 - RNA, 22 nt, Human
cugggcuggauaauucuuugcu

SEQ ID NO: 1097937 - RNA, 22 nt, Human
uagugcauaacauuuaaagguc

SEQ ID NO: 1097938 - RNA, 19 nt, Human
ucaaaacacaaaugguuga

SEQ ID NO: 1097939 - RNA, 18 nt, Human
agaagccacgaggagucc

SEQ ID NO: 1097940 - RNA, 22 nt, Human
cagacuggccacaucugcacug

SEQ ID NO: 1097941 - RNA, 22 nt, Human
ugcaucuaaguggcuaacaacc

SEQ ID NO: 1097942 - RNA, 22 nt, Human
uggaagagcaggcagacaaugc

SEQ ID NO: 1097943 - RNA, 21 nt, Human
caggaacauucuuuacauuua

SEQ ID NO: 1097944 - RNA, 22 nt, Human
cacagggcaccaguuggccauc

SEQ ID NO: 1097945 - RNA, 22 nt, Human
ugggccucaucuucaaugaguc

SEQ ID NO: 1097946 - RNA, 22 nt, Human
gagugugggggugcugaggaca

SEQ ID NO: 1097947 - RNA, 22 nt, Human
ggaggugguggcagugacaauu

SEQ ID NO: 1097948 - RNA, 22 nt, Human
caggcacuagcagaaugaggcu

SEQ ID NO: 1097949 - RNA, 22 nt, Human
gauuucaauccagcuuucuucu

SEQ ID NO: 1097950 - RNA, 22 nt, Human
uauuuggaagguauaaacacaa

SEQ ID NO: 1097951 - RNA, 22 nt, Human
auagucuuagaucagauaaagu

SEQ ID NO: 1097952 - RNA, 22 nt, Human
auuuccuaacagaggcaacagu

SEQ ID NO: 1097953 - RNA, 22 nt, Human
acccaggagcaggcugggcagu

SEQ ID NO: 1097954 - RNA, 22 nt, Human
ccaggaacaaagccccauccac

SEQ ID NO: 1097955 - RNA, 22 nt, Human
cugggugaguugaugaaggaga

SEQ ID NO: 1097956 - RNA, 22 nt, Human
agcaacagcagguuugcacucc

SEQ ID NO: 1097957 - RNA, 22 nt, Human
auuaggcagacaacguagccgg

SEQ ID NO: 1097958 - RNA, 22 nt, Human
ucuagaacuucucuaaaaugaa

SEQ ID NO: 1097959 - RNA, 22 nt, Human
cagaccagcucuaugaacccaa

SEQ ID NO: 1097960 - RNA, 22 nt, Human
uuucacauuuguuuuaagaagu

SEQ ID NO: 1097961 - RNA, 22 nt, Human
aaaugccucauuuucucucacu

SEQ ID NO: 1097962 - RNA, 22 nt, Human
gcagaggcauuucugacgcugc

SEQ ID NO: 1097963 - RNA, 17 nt, Human
acacaucuuggcuuugc

SEQ ID NO: 1097964 - RNA, 22 nt, Human
uuccaacuuuaaaauucauucu

SEQ ID NO: 1097965 - RNA, 22 nt, Human
aagcacagggacucaggaccgg

SEQ ID NO: 1097966 - RNA, 21 nt, Human
ucccacucuaaauggacugaa

SEQ ID NO: 1097967 - RNA, 22 nt, Human
aggaagccugcaggugacugcu

SEQ ID NO: 1097968 - RNA, 22 nt, Human
ucauugcagaaauaaaggugaa

SEQ ID NO: 1097969 - RNA, 22 nt, Human
cagagccugccucuggcugugg

SEQ ID NO: 1097970 - RNA, 22 nt, Human
ugcccuguuccugccuccagcu

SEQ ID NO: 1097971 - RNA, 22 nt, Human
augggaggcaggcucagaaccg

SEQ ID NO: 1097972 - RNA, 22 nt, Human
uauaagucuggcauauguaugc

SEQ ID NO: 1097973 - RNA, 22 nt, Human
uugcuuuguggugguucuucca

SEQ ID NO: 1097974 - RNA, 23 nt, Human
uuucaacaaugcuuagagaaaac

SEQ ID NO: 1097975 - RNA, 22 nt, Human
auccaaaucaugucagaagaac

SEQ ID NO: 1097976 - RNA, 22 nt, Human
auucuaauuaguucuacauguu

SEQ ID NO: 1097977 - RNA, 22 nt, Human
uucucuuauucuggauaugcag

SEQ ID NO: 1097978 - RNA, 22 nt, Human
caagauauugauuuccagcuga

SEQ ID NO: 1097979 - RNA, 22 nt, Human
uugacaaaguuuaguaauaauc

SEQ ID NO: 1097980 - RNA, 22 nt, Human
agaggccaugcuagaggccugg

SEQ ID NO: 1097981 - RNA, 22 nt, Human
caaggccagggaauuuuucugg

SEQ ID NO: 1097982 - RNA, 20 nt, Human
guggccuguccuguuguggg

SEQ ID NO: 1097983 - RNA, 22 nt, Human
uggguggcggccugguucugag

SEQ ID NO: 1097984 - RNA, 22 nt, Human
agggcagccugagugcuggccc

SEQ ID NO: 1097985 - RNA, 22 nt, Human
uugacaauguccuuugaauuuc

SEQ ID NO: 1097986 - RNA, 22 nt, Human
uauuaauaugugugugcaugua

SEQ ID NO: 1097987 - RNA, 22 nt, Human
uuaagugagcuugaauaaucuu

SEQ ID NO: 1097988 - RNA, 22 nt, Human
aucugaaagcuaggaguucuca

SEQ ID NO: 1097989 - RNA, 22 nt, Human
aauagauucaugguuaagagca

SEQ ID NO: 1097990 - RNA, 22 nt, Human
uguaauuaaacugaagacagaa

SEQ ID NO: 1097991 - RNA, 22 nt, Human
uuuauucagcagcagcaguggu

SEQ ID NO: 1097992 - RNA, 22 nt, Human
aaguacuugauagauuaacugu

SEQ ID NO: 1097993 - RNA, 22 nt, Human
cucacacugugccaaauccuuu

SEQ ID NO: 1097994 - RNA, 22 nt, Human
cuggcaggcucucuggucgguu

SEQ ID NO: 1097995 - RNA, 22 nt, Human
gggccaggaguggagauauggg

SEQ ID NO: 1097996 - RNA, 18 nt, Human
ucucagaggccauccuag

SEQ ID NO: 1097997 - RNA, 22 nt, Human
uaaggcaaaggggaaguuauca

SEQ ID NO: 1097998 - RNA, 22 nt, Human
agaggcacuaagggaagagcag

SEQ ID NO: 1097999 - RNA, 22 nt, Human
uuacagaagaguaacuuggcaa

SEQ ID NO: 1098000 - RNA, 22 nt, Human
agaccgagaaguucuccaggcc

SEQ ID NO: 1098001 - RNA, 22 nt, Human
aagugagugguaaggagcaugg

SEQ ID NO: 1098002 - RNA, 23 nt, Human
gagagcugacugucaagacuguu

SEQ ID NO: 1098003 - RNA, 22 nt, Human
agcauacaguaggugcucaguu

SEQ ID NO: 1098004 - RNA, 22 nt, Human
aaucacauuacagcauaucugu

SEQ ID NO: 1098005 - RNA, 22 nt, Human
ggagacagugacuuagagacug

SEQ ID NO: 1098006 - RNA, 22 nt, Human
agccacagcccacaggacucuu

SEQ ID NO: 1098007 - RNA, 22 nt, Human
cagaaacaggcaacgugugcac

SEQ ID NO: 1098008 - RNA, 22 nt, Human
aagauuuccuucaguagagcua

SEQ ID NO: 1098009 - RNA, 22 nt, Human
agugcauacccuucuaaaaagu

SEQ ID NO: 1098010 - RNA, 22 nt, Human
acagggccaggugagaggugcu

SEQ ID NO: 1098011 - RNA, 22 nt, Human
ggccagaaaguuaagcuguggc

SEQ ID NO: 1098012 - RNA, 22 nt, Human
ucagggaaauuuccauguguuu

SEQ ID NO: 1098013 - RNA, 22 nt, Human
gguggggcccuggcacugguau

SEQ ID NO: 1098014 - RNA, 22 nt, Human
ccugccugauuccaggauggcu

SEQ ID NO: 1098015 - RNA, 22 nt, Human
ucuuccaaggugcagaucuucu

SEQ ID NO: 1098016 - RNA, 22 nt, Human
agcaaagcaucacuccaaucug

SEQ ID NO: 1098017 - RNA, 22 nt, Human
gggagcugagaaacaacauucu

SEQ ID NO: 1098018 - RNA, 22 nt, Human
agggucagugaugagggagccc

SEQ ID NO: 1098019 - RNA, 22 nt, Human
ucaucaaagucaaagaaugacu

SEQ ID NO: 1098020 - RNA, 22 nt, Human
ggaggccaaggaggagcuugcc

SEQ ID NO: 1098021 - RNA, 22 nt, Human
uuucuggaaacuguaaagagga

SEQ ID NO: 1098022 - RNA, 18 nt, Human
ugcuggcaacuacuauug

SEQ ID NO: 1098023 - RNA, 22 nt, Human
caugcuaaccagagacauaaag

SEQ ID NO: 1098024 - RNA, 22 nt, Human
aggaagaauguuuacauaucaa

SEQ ID NO: 1098025 - RNA, 22 nt, Human
gggugaggagcugccagucaug

SEQ ID NO: 1098026 - RNA, 20 nt, Human
uccaggagaacugggagccg

SEQ ID NO: 1098027 - RNA, 22 nt, Human
gagggccagcagccucagcaug

SEQ ID NO: 1098028 - RNA, 17 nt, Human
ccacugacucugacuuc

SEQ ID NO: 1098029 - RNA, 22 nt, Human
caaagccucugauuucacuugu

SEQ ID NO: 1098030 - RNA, 22 nt, Human
uuuaugcaucucuaggaagggc

SEQ ID NO: 1098031 - RNA, 22 nt, Human
gugcugucaauugcuuucagua

SEQ ID NO: 1098032 - RNA, 22 nt, Human
aaagaugucaguuugaaauaac

SEQ ID NO: 1098033 - RNA, 22 nt, Human
cuacccaggcuggagugcagua

SEQ ID NO: 1098034 - RNA, 22 nt, Human
augcaugauccugagcaaccca

SEQ ID NO: 1098035 - RNA, 22 nt, Human
cggucaggugcagcguuggcac

SEQ ID NO: 1098036 - RNA, 22 nt, Human
ugcccguggccuggggcagcuu

SEQ ID NO: 1098037 - RNA, 22 nt, Human
gggcccugcgacucgcggcgga

SEQ ID NO: 1098038 - RNA, 22 nt, Human
cagagccacugucugccaggca

SEQ ID NO: 1098039 - RNA, 22 nt, Human
caggcgggcaggugcggccccu

SEQ ID NO: 1098040 - RNA, 22 nt, Human
guggccuuuucaaguaggguau

SEQ ID NO: 1098041 - RNA, 22 nt, Human
gcggcccgagcaggacgggugg

SEQ ID NO: 1098042 - RNA, 22 nt, Human
cuauacagcagcuuacuaguua

SEQ ID NO: 1098043 - RNA, 22 nt, Human
cagagccaaaccucagggcccg

SEQ ID NO: 1098044 - RNA, 22 nt, Human
accaggcccuccagcugcgugg

SEQ ID NO: 1098045 - RNA, 22 nt, Human
gcaggccugucuugcucgcccu

SEQ ID NO: 1098046 - RNA, 22 nt, Human
agcaaggcagcuuucacugcuu

SEQ ID NO: 1098047 - RNA, 22 nt, Human
caggugggagccacagcguaca

SEQ ID NO: 1098048 - RNA, 22 nt, Human
gggagagcgcgcuagggccgag

SEQ ID NO: 1098049 - RNA, 22 nt, Human
agucaacauuugagaugcaaug

SEQ ID NO: 1098050 - RNA, 22 nt, Human
gccggggcuggggagagacaug

SEQ ID NO: 1098051 - RNA, 19 nt, Human
ggggcccggggucugcgag

SEQ ID NO: 1098052 - RNA, 20 nt, Human
uggcccagcacgacgaggac

SEQ ID NO: 1098053 - RNA, 22 nt, Human
ggugucagugaagguagaguuu

SEQ ID NO: 1098054 - RNA, 22 nt, Human
ccaggcuccccaggaggcccuu

SEQ ID NO: 1098055 - RNA, 22 nt, Human
agggcccuagggaaugagacau

SEQ ID NO: 1098056 - RNA, 22 nt, Human
agccccaguccgcugcgggcgg

SEQ ID NO: 1098057 - RNA, 22 nt, Human
augacagcucuagcacacagua

SEQ ID NO: 1098058 - RNA, 22 nt, Human
agcagcaggugaccucgaugcc

SEQ ID NO: 1098059 - RNA, 19 nt, Human
gggucccacugcccgucug

SEQ ID NO: 1098060 - RNA, 22 nt, Human
gcagcccaggaggcgggagccc

SEQ ID NO: 1098061 - RNA, 22 nt, Human
gccagcagcucuugggcgggca

SEQ ID NO: 1098062 - RNA, 22 nt, Human
gcggggggcaggcaguacguug

SEQ ID NO: 1098063 - RNA, 22 nt, Human
ugguccagacuuugaccucuca

SEQ ID NO: 1098064 - RNA, 22 nt, Human
ggcagaggaagcuggaaguggg

SEQ ID NO: 1098065 - RNA, 22 nt, Human
gguuccaggcauggcaggaugu

SEQ ID NO: 1098066 - RNA, 22 nt, Human
caggaacagcaccaggagcuag

SEQ ID NO: 1098067 - RNA, 22 nt, Human
guggcgcagaggguggcagaga

SEQ ID NO: 1098068 - RNA, 22 nt, Human
gcggcgccugggacccgccagc

SEQ ID NO: 1098069 - RNA, 22 nt, Human
cagcaguguacaaggugucaga

SEQ ID NO: 1098070 - RNA, 22 nt, Human
ugaaggccuccccgagcauuag

SEQ ID NO: 1098071 - RNA, 22 nt, Human
gggcagcaucaggaggggcuuu

SEQ ID NO: 1098072 - RNA, 22 nt, Human
uggccagucuuagcugugccug

SEQ ID NO: 1098073 - RNA, 22 nt, Human
gguggcagaggugcaucagccc

SEQ ID NO: 1098074 - RNA, 22 nt, Human
caggaacacaaugagucucaaa

SEQ ID NO: 1098075 - RNA, 22 nt, Human
ggcagcagaacuggcccuguau

SEQ ID NO: 1098076 - RNA, 22 nt, Human
ccagcagcgauagggugagugc

SEQ ID NO: 1098077 - RNA, 22 nt, Human
ugccagagaggagaaagcauuu

SEQ ID NO: 1098078 - RNA, 22 nt, Human
ggggucccugcaccagcauguc

SEQ ID NO: 1098079 - RNA, 22 nt, Human
caggccugugacaccgugucug

SEQ ID NO: 1098080 - RNA, 23 nt, Human
augcaacauugccaguaugggca

SEQ ID NO: 1098081 - RNA, 20 nt, Human
ugcuggaggcgccggcgcuc

SEQ ID NO: 1098082 - RNA, 22 nt, Human
ggagugggaacaaugacauggu

SEQ ID NO: 1098083 - RNA, 22 nt, Human
ccccacaccugccgggcagcag

SEQ ID NO: 1098084 - RNA, 22 nt, Human
agcggcgccggagggaggugcg

SEQ ID NO: 1098085 - RNA, 17 nt, Human
gcaggcacugcugccug

SEQ ID NO: 1098086 - RNA, 22 nt, Human
uggcggugacggcggcgccugg

SEQ ID NO: 1098087 - RNA, 22 nt, Human
ggguuguagagcuggaagggga

SEQ ID NO: 1098088 - RNA, 22 nt, Human
cccaggucgucagcaguguggu

SEQ ID NO: 1098089 - RNA, 22 nt, Human
cacaggaagcaagccuggggcc

SEQ ID NO: 1098090 - RNA, 22 nt, Human
guguccagagccgggcugaaug

SEQ ID NO: 1098091 - RNA, 22 nt, Human
ugucugccugcgggccggcaca

SEQ ID NO: 1098092 - RNA, 22 nt, Human
ucaggggcuugaggugcauguc

SEQ ID NO: 1098093 - RNA, 22 nt, Human
cgugcggccucggggcccggcu

SEQ ID NO: 1098094 - RNA, 22 nt, Human
agccagggacgcugcaggcuac

SEQ ID NO: 1098095 - RNA, 22 nt, Human
ggugggugagcccugggagcug

SEQ ID NO: 1098096 - RNA, 22 nt, Human
agguccugucuuaucucuguaa

SEQ ID NO: 1098097 - RNA, 23 nt, Human
uggggcugauggagacggaccag

SEQ ID NO: 1098098 - RNA, 22 nt, Human
guggcaggagggcaucacuugg

SEQ ID NO: 1098099 - RNA, 22 nt, Human
gcaccgagaaggaagcaugccu

SEQ ID NO: 1098100 - RNA, 22 nt, Human
gagcaacacauugaaugaggau

SEQ ID NO: 1098101 - RNA, 22 nt, Human
gcccagcugagaagcgcggggc

SEQ ID NO: 1098102 - RNA, 22 nt, Human
cagcgguggcaaggugacugug

SEQ ID NO: 1098103 - RNA, 22 nt, Human
gcagcugcgcugguguggggca

SEQ ID NO: 1098104 - RNA, 22 nt, Human
ggcagcugaagaggaacuuugg

SEQ ID NO: 1098105 - RNA, 23 nt, Human
agacagaggcugaggcuggccgc

SEQ ID NO: 1098106 - RNA, 23 nt, Human
gcacagagcaguuaggggaagau

SEQ ID NO: 1098107 - RNA, 22 nt, Human
aaaccggguccagaucuucagg

SEQ ID NO: 1098108 - RNA, 20 nt, Human
gucagaggacccuagagcga

SEQ ID NO: 1098109 - RNA, 22 nt, Human
ggcagcaggguagccauuucuc

SEQ ID NO: 1098110 - RNA, 15 nt, Human
uggugguguugagac

SEQ ID NO: 1098111 - RNA, 22 nt, Human
gcggggccauguccaacggccu

SEQ ID NO: 1098112 - RNA, 19 nt, Human
ugcagcuguaugagcuuaa

SEQ ID NO: 1098113 - RNA, 17 nt, Human
agcagcuggguugaucu

SEQ ID NO: 1098114 - RNA, 22 nt, Human
uuggccguuucacugggcaguu

SEQ ID NO: 1098115 - RNA, 22 nt, Human
acgcggugcggcaaguucaugg

SEQ ID NO: 1098116 - RNA, 22 nt, Human
uggcuccaggggacacgcagua

SEQ ID NO: 1098117 - RNA, 22 nt, Human
ggcggcacgcaggcugcugucg

SEQ ID NO: 1098118 - RNA, 22 nt, Human
ggcuguggucauuaggagguug

SEQ ID NO: 1098119 - RNA, 16 nt, Human
ggcagcagcuccgugc

SEQ ID NO: 1098120 - RNA, 22 nt, Human
ccagccagcugcccuuggggcc

SEQ ID NO: 1098121 - RNA, 22 nt, Human
gugcugccuccauauccgucag

SEQ ID NO: 1098122 - RNA, 22 nt, Human
gaagcgcggcgucggcgugggu

SEQ ID NO: 1098123 - RNA, 22 nt, Human
aagcgcagacacagagagugga

SEQ ID NO: 1098124 - RNA, 22 nt, Human
auacagguucucuagggaacag

SEQ ID NO: 1098125 - RNA, 22 nt, Human
gcagcccaggcucgcucacugc

SEQ ID NO: 1098126 - RNA, 22 nt, Human
agcaccagcucaaggugcaccu

SEQ ID NO: 1098127 - RNA, 22 nt, Human
ccagcaggaaagugacguuuga

SEQ ID NO: 1098128 - RNA, 20 nt, Human
gggugugggcccggccaggc

SEQ ID NO: 1098129 - RNA, 22 nt, Human
gggggcgccgccgcucaucuca

SEQ ID NO: 1098130 - RNA, 22 nt, Human
ggcggcgcguagccggagacuu

SEQ ID NO: 1098131 - RNA, 22 nt, Human
ggccgcggauuuucccgcuggc

SEQ ID NO: 1098132 - RNA, 22 nt, Human
ggcaguggugggaggcucgcuc

SEQ ID NO: 1098133 - RNA, 22 nt, Human
gcagaggggaagcugaggaauu

SEQ ID NO: 1098134 - RNA, 22 nt, Human
gggggcuggacuuucccacaca

SEQ ID NO: 1098135 - RNA, 22 nt, Human
ucuguggcaaacacagugacca

SEQ ID NO: 1098136 - RNA, 23 nt, Human
ugagagccuggcagccuggguuc

SEQ ID NO: 1098137 - RNA, 22 nt, Human
gggcagcaggcuccacguuccu

SEQ ID NO: 1098138 - RNA, 22 nt, Human
cucaguggggcgacagggugcu

SEQ ID NO: 1098139 - RNA, 22 nt, Human
gggagccccaccucggugcccg

SEQ ID NO: 1098140 - RNA, 22 nt, Human
gggcggggcuuccguccuccac

SEQ ID NO: 1098141 - RNA, 22 nt, Human
gguggcaccuuacccugcgcag

SEQ ID NO: 1098142 - RNA, 18 nt, Human
uggggggcuugucugaag

SEQ ID NO: 1098143 - RNA, 22 nt, Human
cagcugccuguauuguccucau

SEQ ID NO: 1098144 - RNA, 22 nt, Human
cggcagcgguuggagguuguag

SEQ ID NO: 1098145 - RNA, 22 nt, Human
cgcagcugcugcucugaaacag

SEQ ID NO: 1098146 - RNA, 22 nt, Human
gcccagggcugcaaguggacgc

SEQ ID NO: 1098147 - RNA, 22 nt, Human
gccagaggggcucgaaggcgcg

SEQ ID NO: 1098148 - RNA, 22 nt, Human
aggggcagccucacaauccucu

SEQ ID NO: 1098149 - RNA, 22 nt, Human
agacagcacuuuuguauggggg

SEQ ID NO: 1098150 - RNA, 22 nt, Human
gccgugcgugcgcaggugcugu

SEQ ID NO: 1098151 - RNA, 20 nt, Human
gugcccaguuggugacagac

SEQ ID NO: 1098152 - RNA, 22 nt, Human
ggcuggccuguguggccgccac

SEQ ID NO: 1098153 - RNA, 18 nt, Human
gagagcccagcagguggu

SEQ ID NO: 1098154 - RNA, 22 nt, Human
gcggggacagaaggcgguucuc

SEQ ID NO: 1098155 - RNA, 22 nt, Human
cgccccagccaguugagcggcg

SEQ ID NO: 1098156 - RNA, 22 nt, Human
caggacccaucagccaggcacu

SEQ ID NO: 1098157 - RNA, 21 nt, Human
uuggccgugcagaugaacagc

SEQ ID NO: 1098158 - RNA, 22 nt, Human
gcaguggccacauggaggagga

SEQ ID NO: 1098159 - RNA, 22 nt, Human
ugcuggccucggcgcugggccu

SEQ ID NO: 1098160 - RNA, 22 nt, Human
cuauucaguugugggcaacaau

SEQ ID NO: 1098161 - RNA, 22 nt, Human
gcccagcgagcagagguggacg

SEQ ID NO: 1098162 - RNA, 19 nt, Human
aggaaggcggcggcugccc

SEQ ID NO: 1098163 - RNA, 22 nt, Human
aagcccgguugggaacguggug

SEQ ID NO: 1098164 - RNA, 22 nt, Human
gggcucggcaucuguggacucu

SEQ ID NO: 1098165 - RNA, 22 nt, Human
cagggcuccccagagagccucu

SEQ ID NO: 1098166 - RNA, 22 nt, Human
cauggggcccaugugcuccaag

SEQ ID NO: 1098167 - RNA, 22 nt, Human
ugcagcugccuagggcuggcuu

SEQ ID NO: 1098168 - RNA, 22 nt, Human
ccagcaggagacuagcaacaua

SEQ ID NO: 1098169 - RNA, 22 nt, Human
gcccaguggcaucuucacugcu

SEQ ID NO: 1098170 - RNA, 23 nt, Human
agcaacagugggugaguguugcu

SEQ ID NO: 1098171 - RNA, 20 nt, Human
gcucagggccugggucugga

SEQ ID NO: 1098172 - RNA, 20 nt, Human
gagcagugagccagggaaag

SEQ ID NO: 1098173 - RNA, 22 nt, Human
caggcucgguccaguggcaccc

SEQ ID NO: 1098174 - RNA, 22 nt, Human
ccaggcccugcuccucacacca

SEQ ID NO: 1098175 - RNA, 22 nt, Human
cucagugcuuaguguguuuugg

SEQ ID NO: 1098176 - RNA, 22 nt, Human
gcaggggcugagcaccagcggg

SEQ ID NO: 1098177 - RNA, 22 nt, Human
uccaguggugguuugaagggca

SEQ ID NO: 1098178 - RNA, 21 nt, Human
gcugcucgagauccagugcuu

SEQ ID NO: 1098179 - RNA, 22 nt, Human
uccagcugugcuccaggaggug

SEQ ID NO: 1098180 - RNA, 22 nt, Human
aacagguagggacucuaacuug

SEQ ID NO: 1098181 - RNA, 22 nt, Human
ggugugggucagcuuuauuaau

SEQ ID NO: 1098182 - RNA, 19 nt, Human
acacaccagugccugugac

SEQ ID NO: 1098183 - RNA, 22 nt, Human
agcaggccugccaccucggggu

SEQ ID NO: 1098184 - RNA, 22 nt, Human
ggagcugcucagagccaguccc

SEQ ID NO: 1098185 - RNA, 22 nt, Human
acuagugcacauuguuucucaa

SEQ ID NO: 1098186 - RNA, 22 nt, Human
acaggcgcacaugagggccgug

SEQ ID NO: 1098187 - RNA, 22 nt, Human
gcccagccccuggguggacgug

SEQ ID NO: 1098188 - RNA, 22 nt, Human
gggccccaagaaccuccuccug

SEQ ID NO: 1098189 - RNA, 22 nt, Human
gggcagcaaaucugagucuggu

SEQ ID NO: 1098190 - RNA, 22 nt, Human
ucggugcgcgaggcgcgguccc

SEQ ID NO: 1098191 - RNA, 21 nt, Human
gcaaccagaccacagggcagu

SEQ ID NO: 1098192 - RNA, 22 nt, Human
gccacaggucggcuagaggguc

SEQ ID NO: 1098193 - RNA, 22 nt, Human
agagggcgcccaggcccacgcc

SEQ ID NO: 1098194 - RNA, 22 nt, Human
cggcgcaggcagaccgcgggcu

SEQ ID NO: 1098195 - RNA, 22 nt, Human
cagugcccuuccaggacugcag

SEQ ID NO: 1098196 - RNA, 22 nt, Human
cccccagcucugcugggucccg

SEQ ID NO: 1098197 - RNA, 22 nt, Human
guggcccaggcuuggcgcuggc

SEQ ID NO: 1098198 - RNA, 22 nt, Human
gccagugccugcugcucagggc

SEQ ID NO: 1098199 - RNA, 21 nt, Human
aggucccagguuugggcagca

SEQ ID NO: 1098200 - RNA, 22 nt, Human
acagcagguuauuguuauggca

SEQ ID NO: 1098201 - RNA, 22 nt, Human
ugcaggccuggacugauguggu

SEQ ID NO: 1098202 - RNA, 22 nt, Human
gcggcccggguccccagcagca

SEQ ID NO: 1098203 - RNA, 22 nt, Human
uggacccaccccagggccugcu

SEQ ID NO: 1098204 - RNA, 22 nt, Human
gaugcgggcccgcuccacugcc

SEQ ID NO: 1098205 - RNA, 22 nt, Human
aaggggggcaccugcaugcccg

SEQ ID NO: 1098206 - RNA, 22 nt, Human
aaggugccacuucccucagacu

SEQ ID NO: 1098207 - RNA, 22 nt, Human
ggcggugguugagaggacggcg

SEQ ID NO: 1098208 - RNA, 22 nt, Human
cagcugccuaugaccuagccuc

SEQ ID NO: 1098209 - RNA, 22 nt, Human
cagacaggguccuguccgucac

SEQ ID NO: 1098210 - RNA, 21 nt, Human
ccaccaggucuucugcucggg

SEQ ID NO: 1098211 - RNA, 22 nt, Human
ggcgagcaugagucacucuggg

SEQ ID NO: 1098212 - RNA, 22 nt, Human
guggcagcggcccaggccgucu

SEQ ID NO: 1098213 - RNA, 22 nt, Rubella virus
uggggcacccggcacucgugua

SEQ ID NO: 1098214 - RNA, 22 nt, Rubella virus
uggcgagccagagggccgaggc

SEQ ID NO: 1098215 - RNA, 22 nt, Rubella virus
gcgagccagcaguuaugcaccu

SEQ ID NO: 1098216 - RNA, 22 nt, Rubella virus
cgugaugcuguggcacagggcg

SEQ ID NO: 1098217 - RNA, 22 nt, Rubella virus
cauggccacggugguguugugc

SEQ ID NO: 1098218 - RNA, 22 nt, Rubella virus
agauggcaauugccucccccgg

SEQ ID NO: 1098219 - RNA, 22 nt, Rubella virus
ucagccugacccgggccuccga

SEQ ID NO: 1098220 - RNA, 22 nt, Rubella virus
gugccccaagugcgccuacggc

SEQ ID NO: 1098221 - RNA, 22 nt, Rubella virus
cgugaugcuguggcacagggcg

SEQ ID NO: 1098222 - RNA, 23 nt, Rubella virus
cgcgcgucccauggggcucacca

SEQ ID NO: 1098223 - RNA, 22 nt, Rubella virus
gugccgccaugauggccgucgu

SEQ ID NO: 1098224 - RNA, 22 nt, Rubella virus
agauggcaauugccucccccgg

SEQ ID NO: 1098225 - RNA, 22 nt, Rubella virus
acggcagcugauggugguggug

SEQ ID NO: 1098226 - RNA, 22 nt, Rubella virus
gcucgccgccuaccgccgcauc

SEQ ID NO: 1098227 - RNA, 22 nt, Rubella virus
uggcgagccagagggccgaggc

SEQ ID NO: 1098228 - RNA, 22 nt, Rubella virus
gcgcacgccuuuggggaccaug

SEQ ID NO: 1098229 - RNA, 22 nt, Rubella virus
ucgaggucgacuucacugaguu

SEQ ID NO: 1098230 - RNA, 22 nt, Human
acagagagaaacaaucagcagc

SEQ ID NO: 1098231 - RNA, 22 nt, Human
gucaggaucaaauugaaguuau

SEQ ID NO: 1098232 - RNA, 22 nt, Human
uucuucaacaaggacacuguua

SEQ ID NO: 1098233 - RNA, 22 nt, Human
uaacacaugguucugucaggaa

SEQ ID NO: 1098234 - RNA, 22 nt, Human
ggauggcauguugggcucuguu

SEQ ID NO: 1098235 - RNA, 22 nt, Human
uuucacauuuaggcgugaauug

SEQ ID NO: 1098236 - RNA, 22 nt, Human
aaaaacugcaauuacuuuuguc

SEQ ID NO: 1098237 - RNA, 22 nt, Human
uacaucauaauaauacuuagaa

SEQ ID NO: 1098238 - RNA, 20 nt, Human
uugagcuuuuaguacagaca

SEQ ID NO: 1098239 - RNA, 22 nt, Human
uggagucugugaugcucugggu

SEQ ID NO: 1098240 - RNA, 22 nt, Human
acugcuuacccggccugacuuc

SEQ ID NO: 1098241 - RNA, 22 nt, Human
uaaggccaccguuauagaacca

SEQ ID NO: 1098242 - RNA, 20 nt, Human
uaacuuucuaugcuuucagc

SEQ ID NO: 1098243 - RNA, 22 nt, Human
acacaaauuguaggauaauugc

SEQ ID NO: 1098244 - RNA, 22 nt, Human
ugucucugauaaguaguucagu

SEQ ID NO: 1098245 - RNA, 22 nt, Human
uagcuagaaugcuucgugauau

SEQ ID NO: 1098246 - RNA, 22 nt, Human
gaaauauuucucuugagccccu

SEQ ID NO: 1098247 - RNA, 22 nt, Human
cugcuguggccagccaggucaa

SEQ ID NO: 1098248 - RNA, 22 nt, Human
uguggaaaagaauaagggagau

SEQ ID NO: 1098249 - RNA, 22 nt, Human
ggaccuggcaauuugcaucucu

SEQ ID NO: 1098250 - RNA, 22 nt, Human
ugucuucagcaaaugccuuucu

SEQ ID NO: 1098251 - RNA, 22 nt, Human
uuauagaaggagcauucacuua

SEQ ID NO: 1098252 - RNA, 22 nt, Human
acaauacaggcuucuggacuua

SEQ ID NO: 1098253 - RNA, 17 nt, Human
gcuguaguuugauaaga

SEQ ID NO: 1098254 - RNA, 22 nt, Human
aucugcuugaguuugaagucag

SEQ ID NO: 1098255 - RNA, 22 nt, Human
gagggucccugcucagggccag

SEQ ID NO: 1098256 - RNA, 22 nt, Human
uagcuaucuguguccagaucca

SEQ ID NO: 1098257 - RNA, 22 nt, Human
aaauuaguacauugcaaagucc

SEQ ID NO: 1098258 - RNA, 22 nt, Human
uuucuucagccuucacaaccug

SEQ ID NO: 1098259 - RNA, 22 nt, Human
cagucuucuaaccuagcagccu

SEQ ID NO: 1098260 - RNA, 22 nt, Human
gaucauuuugaugcccuuuuag

SEQ ID NO: 1098261 - RNA, 22 nt, Human
ucuguggauuuuaguguucaug

SEQ ID NO: 1098262 - RNA, 20 nt, Human
cugcuguguuauuguagaac

SEQ ID NO: 1098263 - RNA, 22 nt, Human
gugcauuuaggucacaugaugu

SEQ ID NO: 1098264 - RNA, 22 nt, Human
uuccucagaaaauacuguccaa

SEQ ID NO: 1098265 - RNA, 22 nt, Human
gcugugcuugggaagaaucucu

SEQ ID NO: 1098266 - RNA, 22 nt, Human
aguucuucauaaccuuacugug

SEQ ID NO: 1098267 - RNA, 22 nt, Human
cacagacccagaagggaugaag

SEQ ID NO: 1098268 - RNA, 22 nt, Human
auaugagaguaaaugccgaucu

SEQ ID NO: 1098269 - RNA, 22 nt, Human
gaggccuggagccgccuaggcg

SEQ ID NO: 1098270 - RNA, 22 nt, Human
auaucacaguaguuguuuaguu

SEQ ID NO: 1098271 - RNA, 22 nt, Human
uucacagaauggcaaguuaugg

SEQ ID NO: 1098272 - RNA, 22 nt, Human
aucuugcauuugcuaaaaugca

SEQ ID NO: 1098273 - RNA, 21 nt, Human
ucucugugucuuuaagcugga

SEQ ID NO: 1098274 - RNA, 22 nt, Human
auacauauaugguacuuccugg

SEQ ID NO: 1098275 - RNA, 22 nt, Human
gcagagcuucuguccuucagga

SEQ ID NO: 1098276 - RNA, 22 nt, Human
aaaguuugucacuuggcuagaa

SEQ ID NO: 1098277 - RNA, 22 nt, Human
auguucuuccaaaucuguaaca

SEQ ID NO: 1098278 - RNA, 22 nt, Human
uagcacaucuggcgcuuauagg

SEQ ID NO: 1098279 - RNA, 22 nt, Human
ucuuuguaaaugccuagcauaa

SEQ ID NO: 1098280 - RNA, 22 nt, Human
cagugguuauacuuacuguuuc

SEQ ID NO: 1098281 - RNA, 22 nt, Human
auuauauaggacuugcccuucc

SEQ ID NO: 1098282 - RNA, 22 nt, Human
agguaugagauaaaucaaugaa

SEQ ID NO: 1098283 - RNA, 22 nt, Human
aguuauuacucuuuaacauauu

SEQ ID NO: 1098284 - RNA, 22 nt, Human
aucugcuuuugagaauuuacuu

SEQ ID NO: 1098285 - RNA, 22 nt, Human
aggccagaaauuuggaguaugu

SEQ ID NO: 1098286 - RNA, 22 nt, Human
cuuagcaugugguguccuugua

SEQ ID NO: 1098287 - RNA, 22 nt, Human
ucacauuuuauaucucugguuu

SEQ ID NO: 1098288 - RNA, 22 nt, Human
ugaaaggugacauuucuuggau

SEQ ID NO: 1098289 - RNA, 22 nt, Human
uugagaagaauguguugaguuu

SEQ ID NO: 1098290 - RNA, 22 nt, Human
aguaaaaauugaggugcaaaau

SEQ ID NO: 1098291 - RNA, 22 nt, Human
aagcaauauacugauaugauua

SEQ ID NO: 1098292 - RNA, 22 nt, Human
aguauaaagugguuuucagcac

SEQ ID NO: 1098293 - RNA, 23 nt, Human
ucucaggacacacaugucuauca

SEQ ID NO: 1098294 - RNA, 22 nt, Human
ugaaacauugcacuguaugaau

SEQ ID NO: 1098295 - RNA, 22 nt, Human
cucagagaggcaguggaaguca

SEQ ID NO: 1098296 - RNA, 19 nt, Human
auguaugaggucuucugcu

SEQ ID NO: 1098297 - RNA, 22 nt, Human
ucaugaacaucucaaauaacca

SEQ ID NO: 1098298 - RNA, 22 nt, Human
uauaucaccaaaaacaguucug

SEQ ID NO: 1098299 - RNA, 22 nt, Human
uuggaaauggcuguaguuauga

SEQ ID NO: 1098300 - RNA, 22 nt, Human
auucugucuaagcuggcuacgu

SEQ ID NO: 1098301 - RNA, 22 nt, Human
uguaaaaccaaaucaaucuagu

SEQ ID NO: 1098302 - RNA, 22 nt, Human
caggauagaaaggccauggagu

SEQ ID NO: 1098303 - RNA, 22 nt, Human
uugauuaaacaggcauauucaa

SEQ ID NO: 1098304 - RNA, 22 nt, Human
ugcccacauggugccauggcca

SEQ ID NO: 1098305 - RNA, 22 nt, Human
ccucaggauacaggagccacag

SEQ ID NO: 1098306 - RNA, 22 nt, Human
aagcaccucuaugauugcuuuu

SEQ ID NO: 1098307 - RNA, 22 nt, Human
aaucauucuuauuucacagcaa

SEQ ID NO: 1098308 - RNA, 23 nt, Human
uugaaagguagcuggcagcuaga

SEQ ID NO: 1098309 - RNA, 20 nt, Human
cuguggaauuuuaccaugcg

SEQ ID NO: 1098310 - RNA, 22 nt, Human
auguagaagcugacagugcugu

SEQ ID NO: 1098311 - RNA, 22 nt, Human
uuuaaauucugucugccgcuua

SEQ ID NO: 1098312 - RNA, 22 nt, Human
agagugucugguagcugcucug

SEQ ID NO: 1098313 - RNA, 22 nt, Human
acuucacagauauuuauuuggu

SEQ ID NO: 1098314 - RNA, 22 nt, Human
ugucuucaguaaaauacacuau

SEQ ID NO: 1098315 - RNA, 22 nt, Human
uuacacaacaucuguauuauua

SEQ ID NO: 1098316 - RNA, 22 nt, Human
uguauaaaccauggacagcuuu

SEQ ID NO: 1098317 - RNA, 22 nt, Human
auuaaauuagcaaacugugaaa

SEQ ID NO: 1098318 - RNA, 22 nt, Human
guucuucagcauuagaagucau

SEQ ID NO: 1098319 - RNA, 22 nt, Human
accgaaggaaacuggaaccguu

SEQ ID NO: 1098320 - RNA, 22 nt, Human
uuauuucauugauuucuaagac

SEQ ID NO: 1098321 - RNA, 22 nt, Human
gcuuugaagacuuuuccagggu

SEQ ID NO: 1098322 - RNA, 22 nt, Human
ccucacugcuauguguuugcuc

SEQ ID NO: 1098323 - RNA, 22 nt, Human
augcuguguauuuuacucuuuc

SEQ ID NO: 1098324 - RNA, 22 nt, Human
guugaaagagcauggacuugaa

SEQ ID NO: 1098325 - RNA, 22 nt, Human
uuuguaaauagcaguacucaug

SEQ ID NO: 1098326 - RNA, 22 nt, Human
agccuauuccaggaugagcuca

SEQ ID NO: 1098327 - RNA, 22 nt, Human
caagauaagaucauuuacacua

SEQ ID NO: 1098328 - RNA, 22 nt, Human
aaggccagccugagagcuaaca

SEQ ID NO: 1098329 - RNA, 22 nt, Human
cagaaggcuuuguggaguagac

SEQ ID NO: 1098330 - RNA, 22 nt, Human
guuguuuuuguucucuauagcu

SEQ ID NO: 1098331 - RNA, 22 nt, Human
uauaaaguuucgaaagauguau

SEQ ID NO: 1098332 - RNA, 22 nt, Human
aguucucagcuuaguaugcugu

SEQ ID NO: 1098333 - RNA, 22 nt, Human
caaaucuauauguugauauucu

SEQ ID NO: 1098334 - RNA, 22 nt, Human
acuggcagcagcagcccuuggg

SEQ ID NO: 1098335 - RNA, 22 nt, Human
ucagagagugcaaaauauagcu

SEQ ID NO: 1098336 - RNA, 22 nt, Human
auaaauaucacuguugucccuc

SEQ ID NO: 1098337 - RNA, 22 nt, Human
auugaaagauuuugggcucaug

SEQ ID NO: 1098338 - RNA, 20 nt, Human
uugauucaagggcugaugga

SEQ ID NO: 1098339 - RNA, 22 nt, Human
uaggaaauggcucaguuacugc

SEQ ID NO: 1098340 - RNA, 22 nt, Human
uucuuugaguuaguacagucca

SEQ ID NO: 1098341 - RNA, 19 nt, Human
ucugccucuggucaggcuc

SEQ ID NO: 1098342 - RNA, 22 nt, Human
uucuucuuuaucucaguauccu

SEQ ID NO: 1098343 - RNA, 22 nt, Human
ugguaauuaauuugauagguuc

SEQ ID NO: 1098344 - RNA, 22 nt, Human
ggccagcagucacagggucaga

SEQ ID NO: 1098345 - RNA, 22 nt, Human
uuuaaauuauaguuaaugucug

SEQ ID NO: 1098346 - RNA, 22 nt, Human
uuugacaugcaaagcacuuuag

SEQ ID NO: 1098347 - RNA, 22 nt, Human
caggguggggaaauagcgcccu

SEQ ID NO: 1098348 - RNA, 22 nt, Human
uggaguucauccaugacagcuu

SEQ ID NO: 1098349 - RNA, 22 nt, Human
gagaacucagacgcaggucaug

SEQ ID NO: 1098350 - RNA, 17 nt, Human
gucauucucagaaaaug

SEQ ID NO: 1098351 - RNA, 22 nt, Human
uguuuuaagagcgcacuuuaua

SEQ ID NO: 1098352 - RNA, 23 nt, Human
uuuuccuguggagacaugacugg

SEQ ID NO: 1098353 - RNA, 22 nt, Human
caaauguauucucacuucaggg

SEQ ID NO: 1098354 - RNA, 22 nt, Human
ucagggugaaccaggcaggaau

SEQ ID NO: 1098355 - RNA, 22 nt, Human
cucuuucugauucgcugggacc

SEQ ID NO: 1098356 - RNA, 22 nt, Human
uucuuauagaagcaaccauugu

SEQ ID NO: 1098357 - RNA, 22 nt, Human
acaugcauaggagaagucuuua

SEQ ID NO: 1098358 - RNA, 22 nt, Human
uucugagacaauugagagucua

SEQ ID NO: 1098359 - RNA, 22 nt, Human
ucagaaaagguagcugugacaa

SEQ ID NO: 1098360 - RNA, 22 nt, Human
uuuggaaugguaccuucaguug

SEQ ID NO: 1098361 - RNA, 22 nt, Human
cuuuggaauauuuuauugagaa

SEQ ID NO: 1098362 - RNA, 22 nt, Human
uucaugaaacuuaacuguuggg

SEQ ID NO: 1098363 - RNA, 22 nt, Human
ccacagagacaggguccuugcu

SEQ ID NO: 1098364 - RNA, 22 nt, Human
ucagaaagaacacaggcaguag

SEQ ID NO: 1098365 - RNA, 20 nt, Human
ucaggaugugcugagugaag

SEQ ID NO: 1098366 - RNA, 22 nt, Human
uucuuuuccuacacagcgauuu

SEQ ID NO: 1098367 - RNA, 22 nt, Human
aauaacuucauguaacauuuaa

SEQ ID NO: 1098368 - RNA, 22 nt, Human
aaugcauauguaggcaagcagu

SEQ ID NO: 1098369 - RNA, 22 nt, Human
uauggaaagcucuuuuugauug

SEQ ID NO: 1098370 - RNA, 22 nt, Human
uaugagaaucugcaguaugcuu

SEQ ID NO: 1098371 - RNA, 22 nt, Human
auuucauugaaguuaauucuuc

SEQ ID NO: 1098372 - RNA, 19 nt, Human
caggaugaucccaugacac

SEQ ID NO: 1098373 - RNA, 22 nt, Human
uugguuuaggaacuggcuugga

SEQ ID NO: 1098374 - RNA, 22 nt, Human
uuaaaugaggcugauguagauu

SEQ ID NO: 1098375 - RNA, 22 nt, Human
ucucaggaauagaguggcagca

SEQ ID NO: 1098376 - RNA, 22 nt, Human
uguugaagauaaaguucucauu

SEQ ID NO: 1098377 - RNA, 22 nt, Human
uuucuucacaggguauugggug

SEQ ID NO: 1098378 - RNA, 22 nt, Human
ccagaagaccccguccaccucc

SEQ ID NO: 1098379 - RNA, 22 nt, Human
aaaggccacuugaaggauuuuu

SEQ ID NO: 1098380 - RNA, 22 nt, Human
cacaaauggccguguucaaaga

SEQ ID NO: 1098381 - RNA, 20 nt, Human
gaguuccccauuucuccugg

SEQ ID NO: 1098382 - RNA, 22 nt, Human
uaaaugaagaaauggagauugu

SEQ ID NO: 1098383 - RNA, 22 nt, Human
acaacauucuuaaauacacuga

SEQ ID NO: 1098384 - RNA, 22 nt, Human
aauaucuucuaaggauagaacu

SEQ ID NO: 1098385 - RNA, 22 nt, Human
aaagauaauguuuccuuauucu

SEQ ID NO: 1098386 - RNA, 22 nt, Human
cauucucaauaguagaugagua

SEQ ID NO: 1098387 - RNA, 22 nt, Human
caaggccaugagcagcgagugu

SEQ ID NO: 1098388 - RNA, 22 nt, Human
ggcucagacucccaggcccucu

SEQ ID NO: 1098389 - RNA, 22 nt, Human
aagacugucuuuucugagugac

SEQ ID NO: 1098390 - RNA, 22 nt, Human
augcuguggggagugaggguag

SEQ ID NO: 1098391 - RNA, 22 nt, Human
ucugucuucaucagcaugugau

SEQ ID NO: 1098392 - RNA, 19 nt, Human
uaaggccaaaaguaagugu

SEQ ID NO: 1098393 - RNA, 22 nt, Human
ucucuucucuagugagcaacug

SEQ ID NO: 1098394 - RNA, 22 nt, Human
aacaugcucuguuucuuggaug

SEQ ID NO: 1098395 - RNA, 22 nt, Human
aauacuauguugugacacauga

SEQ ID NO: 1098396 - RNA, 22 nt, Human
uugauacaggcucuauuucauc

SEQ ID NO: 1098397 - RNA, 22 nt, Human
uucuuuucuuuaggcauugugu

SEQ ID NO: 1098398 - RNA, 22 nt, Human
uucuuuugggaauuacguaugc

SEQ ID NO: 1098399 - RNA, 21 nt, Human
ugaaugaggaggauggcauuu

SEQ ID NO: 1098400 - RNA, 22 nt, Human
ccaggcugccgaggaaagaaag

SEQ ID NO: 1098401 - RNA, 22 nt, Human
uuccuuaggcuguuugcagugc

SEQ ID NO: 1098402 - RNA, 22 nt, Human
uguuccaauaaggaguugaaau

SEQ ID NO: 1098403 - RNA, 22 nt, Human
auugcuguacacuucuagaucu

SEQ ID NO: 1098404 - RNA, 22 nt, Human
uuugaaaguucuucugacacua

SEQ ID NO: 1098405 - RNA, 23 nt, Human
uucuuucaagaaguucacagugc

SEQ ID NO: 1098406 - RNA, 22 nt, Human
cucaggaugucggugacuauug

SEQ ID NO: 1098407 - RNA, 22 nt, Human
auucuuaauugccaugcuguau

SEQ ID NO: 1098408 - RNA, 22 nt, Human
aaaauaacuucuacuauuugca

SEQ ID NO: 1098409 - RNA, 22 nt, Human
ugaaaugauguacaagaaggca

SEQ ID NO: 1098410 - RNA, 22 nt, Human
auccaugauuaguaggauaaag

SEQ ID NO: 1098411 - RNA, 19 nt, Human
agaaguuagacauugcaau

SEQ ID NO: 1098412 - RNA, 22 nt, Human
cuggcugggagcgagcugcuca

SEQ ID NO: 1098413 - RNA, 22 nt, Human
aaauugcauuuuaaagguagau

SEQ ID NO: 1098414 - RNA, 22 nt, Human
cugcuguguuggcauuggauag

SEQ ID NO: 1098415 - RNA, 22 nt, Human
aucauucugauggucaaugcua

SEQ ID NO: 1098416 - RNA, 22 nt, Human
aaggaaccauuugugugcaugg

SEQ ID NO: 1098417 - RNA, 22 nt, Human
uguagaaccuguuuauuauaga

SEQ ID NO: 1098418 - RNA, 22 nt, Human
ugaaacuuauaagaauaugaau

SEQ ID NO: 1098419 - RNA, 22 nt, Human
auuucauagauuguaaaucccu

SEQ ID NO: 1098420 - RNA, 22 nt, Human
uucucagagcucacuguaguaa

SEQ ID NO: 1098421 - RNA, 23 nt, Human
ugaguucucaucuuggcuucuau

SEQ ID NO: 1098422 - RNA, 22 nt, Human
uauuucagcccuacuacuuggc

SEQ ID NO: 1098423 - RNA, 19 nt, Human
ugcuagaaauucugugacu

SEQ ID NO: 1098424 - RNA, 20 nt, Human
uacagaaugcaauaaaaugg

SEQ ID NO: 1098425 - RNA, 22 nt, Human
aaauauagcaauuaugccuacu

SEQ ID NO: 1098426 - RNA, 22 nt, Human
gauugaaacauaggcagucgag

SEQ ID NO: 1098427 - RNA, 22 nt, Human
uagugcuuaauaaauuucagaa

SEQ ID NO: 1098428 - RNA, 22 nt, Human
uuuggaauguaguuuaaucauc

SEQ ID NO: 1098429 - RNA, 22 nt, Human
aaaggccacacagagcagggag

SEQ ID NO: 1098430 - RNA, 22 nt, Human
uuucucuguucucuaacuguaa

SEQ ID NO: 1098431 - RNA, 22 nt, Human
aaaauauuuuagggccaggaga

SEQ ID NO: 1098432 - RNA, 22 nt, Human
ucucugaguaagugacaguuca

SEQ ID NO: 1098433 - RNA, 19 nt, Human
uuucccagcccuugcugug

SEQ ID NO: 1098434 - RNA, 22 nt, Human
ucuucaauuagauuuaccaauu

SEQ ID NO: 1098435 - RNA, 22 nt, Human
gaaaggccauuucugaggguuu

SEQ ID NO: 1098436 - RNA, 22 nt, Human
uagcauuaucugucuuaucauu

SEQ ID NO: 1098437 - RNA, 22 nt, Human
uucaacuauuaugaauaaaauu

SEQ ID NO: 1098438 - RNA, 22 nt, Human
ugaaaugauaucugauaacaaa

SEQ ID NO: 1098439 - RNA, 22 nt, Human
guacauuucucuuguucuuauu

SEQ ID NO: 1098440 - RNA, 17 nt, Human
gccucugcuugugucau

SEQ ID NO: 1098441 - RNA, 22 nt, Human
uaaggccaaguucauauacaac

SEQ ID NO: 1098442 - RNA, 22 nt, Human
uuugaaguucccccauaucaga

SEQ ID NO: 1098443 - RNA, 22 nt, Human
cugcaucaguggauaugauggu

SEQ ID NO: 1098444 - RNA, 22 nt, Human
aucugucagccugggauuaggg

SEQ ID NO: 1098445 - RNA, 18 nt, Human
cauaauuuucuuucuuua

SEQ ID NO: 1098446 - RNA, 22 nt, Human
uagcauuucacugaucuucacu

SEQ ID NO: 1098447 - RNA, 22 nt, Human
ccuuaaauucuccauuugaaag

SEQ ID NO: 1098448 - RNA, 22 nt, Human
aauuuuaagcauaugacugguu

SEQ ID NO: 1098449 - RNA, 19 nt, Human
cccucuugcacaaagcaaa

SEQ ID NO: 1098450 - RNA, 19 nt, Human
aucugccuuagugcugcug

SEQ ID NO: 1098451 - RNA, 22 nt, Human
uuuacaaccucauauucugaug

SEQ ID NO: 1098452 - RNA, 22 nt, Human
ucucagucagccuugauguccc

SEQ ID NO: 1098453 - RNA, 22 nt, Human
ucaacugcaaguuugcuuaguu

SEQ ID NO: 1098454 - RNA, 22 nt, Human
ucuuugaacuuggcugaucucu

SEQ ID NO: 1098455 - RNA, 22 nt, Human
augcugugaaaaagaaggcuga

SEQ ID NO: 1098456 - RNA, 20 nt, Human
cucuccucacccgugucagg

SEQ ID NO: 1098457 - RNA, 22 nt, Human
aaucuuagguuuggcuucaucu

SEQ ID NO: 1098458 - RNA, 17 nt, Human
agguauaaaaugguagc

SEQ ID NO: 1098459 - RNA, 22 nt, Human
cacaauuuccuugcuucacuuu

SEQ ID NO: 1098460 - RNA, 22 nt, Human
ccaugagcuuccuauauagggu

SEQ ID NO: 1098461 - RNA, 22 nt, Human
ugaguucucacccauucuucuu

SEQ ID NO: 1098462 - RNA, 22 nt, Human
cagucucagaggugggaguggg

SEQ ID NO: 1098463 - RNA, 22 nt, Human
auuuguugcuagcagcacugau

SEQ ID NO: 1098464 - RNA, 22 nt, Human
uaauaguuaugguugguucuca

SEQ ID NO: 1098465 - RNA, 22 nt, Human
guccucugaaguugugcaaugc

SEQ ID NO: 1098466 - RNA, 20 nt, Human
ucuguacacucaucuucugc

SEQ ID NO: 1098467 - RNA, 22 nt, Human
ggaaaugacuuggugcuucguu

SEQ ID NO: 1098468 - RNA, 22 nt, Human
aguggaccagaagacugaagcu

SEQ ID NO: 1098469 - RNA, 17 nt, Human
gagagcugcugcuuccg

SEQ ID NO: 1098470 - RNA, 22 nt, Human
cagugcugggcagaggagagcg

SEQ ID NO: 1098471 - RNA, 22 nt, Human
cuguaugaggaucagacuggac

SEQ ID NO: 1098472 - RNA, 22 nt, Human
uaugacauuggccaaguucugu

SEQ ID NO: 1098473 - RNA, 22 nt, Human
ucugggaaccagugcggcuggg

SEQ ID NO: 1098474 - RNA, 22 nt, Human
ccugcuguucuguuuagugaac

SEQ ID NO: 1098475 - RNA, 22 nt, Human
aguaugaaccuggguucuggau

SEQ ID NO: 1098476 - RNA, 22 nt, Human
uguaugaagguuuaccugcugu

SEQ ID NO: 1098477 - RNA, 22 nt, Human
aagcaauagcaacaacuuuaca

SEQ ID NO: 1098478 - RNA, 21 nt, Human
ucuugaaaauuguagcaguuu

SEQ ID NO: 1098479 - RNA, 22 nt, Human
aaaggccaauaaagacaagcug

SEQ ID NO: 1098480 - RNA, 22 nt, Human
auauuucaugggguuccauacu

SEQ ID NO: 1098481 - RNA, 22 nt, Human
gguuauauaauucagugcuuuc

SEQ ID NO: 1098482 - RNA, 22 nt, Human
uauuuuaaagacugccagccua

SEQ ID NO: 1098483 - RNA, 22 nt, Human
ccugcuguaaugugucuuuauu

SEQ ID NO: 1098484 - RNA, 22 nt, Human
uugaauuauaagugugucuacu

SEQ ID NO: 1098485 - RNA, 22 nt, Human
ccuggacucaggcugugggcac

SEQ ID NO: 1098486 - RNA, 22 nt, Human
gguuugaacagcuuuggagaag

SEQ ID NO: 1098487 - RNA, 22 nt, Human
auuuccauagagcgucucacag

SEQ ID NO: 1098488 - RNA, 22 nt, Human
auucacagaauaguuuuaccag

SEQ ID NO: 1098489 - RNA, 22 nt, Human
uucugucucuguguuuacauua

SEQ ID NO: 1098490 - RNA, 22 nt, Human
uaaugcuuaacagcuggcuuuu

SEQ ID NO: 1098491 - RNA, 22 nt, Human
ccucaggaaccacauugcugcu

SEQ ID NO: 1098492 - RNA, 22 nt, Human
acacaaguucuaaagauugcgc

SEQ ID NO: 1098493 - RNA, 22 nt, Human
uucaggauuauacucucuuccc

SEQ ID NO: 1098494 - RNA, 22 nt, Human
ucaugcuuauugcauauuugga

SEQ ID NO: 1098495 - RNA, 22 nt, Human
ucuuuuggaaaugaugugcagg

SEQ ID NO: 1098496 - RNA, 22 nt, Human
agaccaugggcucugaagagca

SEQ ID NO: 1098497 - RNA, 22 nt, Human
ugcuggaauaauuucauguuaa

SEQ ID NO: 1098498 - RNA, 22 nt, Human
uuaugauuugccacagauuggu

SEQ ID NO: 1098499 - RNA, 22 nt, Human
uugcagcuuagugauguuaucu

SEQ ID NO: 1098500 - RNA, 20 nt, Human
aauuuacucacagaaugaau

SEQ ID NO: 1098501 - RNA, 22 nt, Human
uugaacaguccuaagagacccu

SEQ ID NO: 1098502 - RNA, 22 nt, Human
gucugucaucugagauggagug

SEQ ID NO: 1098503 - RNA, 23 nt, Human
auggaagucacuguuuucuuguc

SEQ ID NO: 1098504 - RNA, 22 nt, Human
ucuccucuauuucuguauguau

SEQ ID NO: 1098505 - RNA, 22 nt, Human
acuauaaaaggauaaaccagaa

SEQ ID NO: 1098506 - RNA, 22 nt, Human
aaucuguuuaguucugcguaug

SEQ ID NO: 1098507 - RNA, 20 nt, Human
ccagaagagaugaucaucca

SEQ ID NO: 1098508 - RNA, 22 nt, Human
auuaaaauuccaagguaugcca

SEQ ID NO: 1098509 - RNA, 23 nt, Human
ugugaaauuugaggucagugcuu

SEQ ID NO: 1098510 - RNA, 22 nt, Human
uaucuguugucuuuuacaugua

SEQ ID NO: 1098511 - RNA, 22 nt, Human
aauguaugggugagaaaguuga

SEQ ID NO: 1098512 - RNA, 22 nt, Human
auucuucacaaauauauagaag

SEQ ID NO: 1098513 - RNA, 22 nt, Human
gaucuucuauguaaugaagugu

SEQ ID NO: 1098514 - RNA, 22 nt, Human
gaggaaccaaaucagcuugcac

SEQ ID NO: 1098515 - RNA, 22 nt, Human
uuuuccuguccaggcaauuauu

SEQ ID NO: 1098516 - RNA, 22 nt, Human
ucugauuagcaguuuagggaaa

SEQ ID NO: 1098517 - RNA, 22 nt, Human
cagucucuugcuucauuaguug

SEQ ID NO: 1098518 - RNA, 22 nt, Human
aucaggauagugguuaccuggg

SEQ ID NO: 1098519 - RNA, 22 nt, Human
uauuuccagcaguaagaagaca

SEQ ID NO: 1098520 - RNA, 22 nt, Human
cuucucagucaccugugagucu

SEQ ID NO: 1098521 - RNA, 22 nt, Human
uugauagguuuuauguauaguu

SEQ ID NO: 1098522 - RNA, 22 nt, Human
caguucuuaauaccaugugguu

SEQ ID NO: 1098523 - RNA, 20 nt, Human
uauuuguauuugggaaaguu

SEQ ID NO: 1098524 - RNA, 22 nt, Human
augcuguggaugccuugcccca

SEQ ID NO: 1098525 - RNA, 22 nt, Human
uuauucuuuucuccagaauccc

SEQ ID NO: 1098526 - RNA, 22 nt, Human
uacaaguaaauuguagauacca

SEQ ID NO: 1098527 - RNA, 22 nt, Human
aucugccugagucuagguuuuc

SEQ ID NO: 1098528 - RNA, 22 nt, Human
uugcugugucugauggcugaga

SEQ ID NO: 1098529 - RNA, 22 nt, Human
ugugauauuugaguauugucaa

SEQ ID NO: 1098530 - RNA, 20 nt, Human
ucucuucuggggagauaaaa

SEQ ID NO: 1098531 - RNA, 22 nt, Human
cugcagagcaaguaacauccuc

SEQ ID NO: 1098532 - RNA, 23 nt, Human
ggagugcaauggcgccaucucgg

SEQ ID NO: 1098533 - RNA, 22 nt, Human
gcucagagcuugaaguuccacu

SEQ ID NO: 1098534 - RNA, 22 nt, Human
cucaacagcucugccauacucc

SEQ ID NO: 1098535 - RNA, 22 nt, Human
cauuuguaggaugcuucuuguu

SEQ ID NO: 1098536 - RNA, 22 nt, Human
acucaggaagaaagcagcuggu

SEQ ID NO: 1098537 - RNA, 22 nt, Human
aaacacagauuucuuuguccca

SEQ ID NO: 1098538 - RNA, 22 nt, Human
acaacauuauacauagaaagcu

SEQ ID NO: 1098539 - RNA, 22 nt, Human
cauucacaaagcugauugaugg

SEQ ID NO: 1098540 - RNA, 22 nt, Human
gcuguguuuuauguuagguuaa

SEQ ID NO: 1098541 - RNA, 22 nt, Human
ucucaggaagauuagggcuaag

SEQ ID NO: 1098542 - RNA, 22 nt, Human
cugcugugcacccaggaaggcu

SEQ ID NO: 1098543 - RNA, 23 nt, Human
aaacuacauuuauaguuuuucuc

SEQ ID NO: 1098544 - RNA, 22 nt, Human
uguaugaagacuucuucugugu

SEQ ID NO: 1098545 - RNA, 22 nt, Human
auuugcuucugugaaaucaagu

SEQ ID NO: 1098546 - RNA, 22 nt, Human
uaacacauuaguucuccuagau

SEQ ID NO: 1098547 - RNA, 22 nt, Human
acuguagcugccacuggaugca

SEQ ID NO: 1098548 - RNA, 22 nt, Human
guguauaaugcuguuuguacau

SEQ ID NO: 1098549 - RNA, 22 nt, Human
cucaggauuuacuaauuucaag

SEQ ID NO: 1098550 - RNA, 22 nt, Human
cauaauuucuguaucagcacca

SEQ ID NO: 1098551 - RNA, 22 nt, Human
ugccuguguugauuacuuuguc

SEQ ID NO: 1098552 - RNA, 22 nt, Human
gaggcugauucggggaacagca

SEQ ID NO: 1098553 - RNA, 22 nt, Human
acauauuuugaaagcuuucuaa

SEQ ID NO: 1098554 - RNA, 22 nt, Human
ucacauuucugauuauaccaaa

SEQ ID NO: 1098555 - RNA, 22 nt, Human
aucuacccacugaacacaauau

SEQ ID NO: 1098556 - RNA, 22 nt, Human
ucucaagaucucaagauggccc

SEQ ID NO: 1098557 - RNA, 22 nt, Human
auuauuauuguugauguuaggg

SEQ ID NO: 1098558 - RNA, 22 nt, Human
uaaggccagcaugaaugcagca

SEQ ID NO: 1098559 - RNA, 22 nt, Human
uuugaauagaggccccucagaa

SEQ ID NO: 1098560 - RNA, 22 nt, Human
ugcugcuguuuccuacaucuca

SEQ ID NO: 1098561 - RNA, 22 nt, Human
gaaggccauugcguccugggau

SEQ ID NO: 1098562 - RNA, 22 nt, Human
ucacagacauggugagguaaca

SEQ ID NO: 1098563 - RNA, 22 nt, Human
auucuucacauggauaggaucu

SEQ ID NO: 1098564 - RNA, 22 nt, Human
uuucaucuucccagagaccuug

SEQ ID NO: 1098565 - RNA, 22 nt, Human
ucuuugcagaauuuaacuuugc

SEQ ID NO: 1098566 - RNA, 22 nt, Human
uucuccucuguuggccuucccu

SEQ ID NO: 1098567 - RNA, 22 nt, Human
cacagcauaaugaaauauacuu

SEQ ID NO: 1098568 - RNA, 19 nt, Human
caagugaagccugggaugg

SEQ ID NO: 1098569 - RNA, 22 nt, Human
ugucaaauuuuuauugcaguau

SEQ ID NO: 1098570 - RNA, 22 nt, Human
ugugaaaagggcuuuguacaaa

SEQ ID NO: 1098571 - RNA, 18 nt, Human
ugcuggguaacuguaugg

SEQ ID NO: 1098572 - RNA, 20 nt, Human
uuucaguugguuaauggcau

SEQ ID NO: 1098573 - RNA, 22 nt, Human
guggaauguccuugaucauaag

SEQ ID NO: 1098574 - RNA, 21 nt, Human
cucaggaucuuauauauuagu

SEQ ID NO: 1098575 - RNA, 22 nt, Human
augcugugccuggaaagcggcu

SEQ ID NO: 1098576 - RNA, 22 nt, Human
aaauacauacacuguacguggc

SEQ ID NO: 1098577 - RNA, 22 nt, Human
uucucacuauguauguagauug

SEQ ID NO: 1098578 - RNA, 22 nt, Human
acuuaaaaagaaucuuuucacg

SEQ ID NO: 1098579 - RNA, 22 nt, Human
cuuacagagaagaaaauguagu

SEQ ID NO: 1098580 - RNA, 22 nt, Human
augcugugauuguagaaauauu

SEQ ID NO: 1098581 - RNA, 22 nt, Human
ugagaaaugggucugcugaaga

SEQ ID NO: 1098582 - RNA, 22 nt, Human
uaauuucuagggacuaaggugc

SEQ ID NO: 1098583 - RNA, 21 nt, Human
uuugaaagugggugauucuuu

SEQ ID NO: 1098584 - RNA, 22 nt, Human
cucacugugaccucagcagaca

SEQ ID NO: 1098585 - RNA, 22 nt, Human
uaugaacuguacuguacuaagc

SEQ ID NO: 1098586 - RNA, 21 nt, Human
ccugcugugaucuuagugagu

SEQ ID NO: 1098587 - RNA, 22 nt, Human
uucuucaauuuuccauauacug

SEQ ID NO: 1098588 - RNA, 22 nt, Human
gaaaggccagcucacagaugag

SEQ ID NO: 1098589 - RNA, 22 nt, Human
uuugaaaggaauuaggaugaca

SEQ ID NO: 1098590 - RNA, 22 nt, Human
aaauauguaagauuagcacuag

SEQ ID NO: 1098591 - RNA, 22 nt, Human
uucugugauugacauguggcuu

SEQ ID NO: 1098592 - RNA, 22 nt, Human
cauuuacuuaaaucuuuacaag

SEQ ID NO: 1098593 - RNA, 22 nt, Human
auguuauggcucaaacauuugg

SEQ ID NO: 1098594 - RNA, 22 nt, Human
cucauaaugugacuguauuuga

SEQ ID NO: 1098595 - RNA, 22 nt, Human
guuaucaugcuucaucaucacu

SEQ ID NO: 1098596 - RNA, 22 nt, Human
aagcaccugcaguugacaaaaa

SEQ ID NO: 1098597 - RNA, 22 nt, Human
uucuuaaaacuuauggacaggu

SEQ ID NO: 1098598 - RNA, 22 nt, Human
uuucacauuagauaugucauuu

SEQ ID NO: 1098599 - RNA, 22 nt, Human
cucaggauuaaggaaucuaaau

SEQ ID NO: 1098600 - RNA, 22 nt, Human
uacagcuaggcaaaaaugacau

SEQ ID NO: 1098601 - RNA, 23 nt, Human
ucuccuccuagauacagucaugg

SEQ ID NO: 1098602 - RNA, 20 nt, Human
ucacuaguaaccaucugcuu

SEQ ID NO: 1098603 - RNA, 22 nt, Human
aagcuggagaguuaggugaaua

SEQ ID NO: 1098604 - RNA, 17 nt, Human
acagagcacaucaagau

SEQ ID NO: 1098605 - RNA, 22 nt, Human
acagaauugaaaguauaaucug

SEQ ID NO: 1098606 - RNA, 21 nt, Human
ucacaucuauguuaagcaaac

SEQ ID NO: 1098607 - RNA, 22 nt, Human
cagcauuuaucuuguagcagga

SEQ ID NO: 1098608 - RNA, 22 nt, Human
caguuucuacgaaggucaaccc

SEQ ID NO: 1098609 - RNA, 22 nt, Human
uaauacagaaguguauuaaaau

SEQ ID NO: 1098610 - RNA, 22 nt, Human
uuucuuaguccuagagugauuu

SEQ ID NO: 1098611 - RNA, 22 nt, Human
auaaucuuucuuuuccagauag

SEQ ID NO: 1098612 - RNA, 22 nt, Human
aaauauagugacacuuauaguc

SEQ ID NO: 1098613 - RNA, 22 nt, Human
aaauuuucagagcacuagagaa

SEQ ID NO: 1098614 - RNA, 22 nt, Human
uauugacaauuugugaaacuau

SEQ ID NO: 1098615 - RNA, 21 nt, Human
uuucuucacuuugccccaugu

SEQ ID NO: 1098616 - RNA, 22 nt, Human
cauaauuuuccaugguuugcua

SEQ ID NO: 1098617 - RNA, 22 nt, Human
uugaaagaagaagcugcgaugu

SEQ ID NO: 1098618 - RNA, 22 nt, Human
ucuuugaauucaaacuguucaa

SEQ ID NO: 1098619 - RNA, 22 nt, Human
ucaggaugaccacgagccucua

SEQ ID NO: 1098620 - RNA, 22 nt, Human
ucacaguuauagucuguagaau

SEQ ID NO: 1098621 - RNA, 22 nt, Human
acaguacauaauccugagucug

SEQ ID NO: 1098622 - RNA, 22 nt, Human
gcagcugaaagggaucucuaca

SEQ ID NO: 1098623 - RNA, 22 nt, Human
gaaccucagugaaacuggaggu

SEQ ID NO: 1098624 - RNA, 22 nt, Human
auucuucaaagagugucaaagu

SEQ ID NO: 1098625 - RNA, 22 nt, Human
uuuccucacuucaugagaguuu

SEQ ID NO: 1098626 - RNA, 22 nt, Human
ccagaccacccuggccaugcac

SEQ ID NO: 1098627 - RNA, 22 nt, Human
cagucucuaaaucaaucugaau

SEQ ID NO: 1098628 - RNA, 22 nt, Human
ucuucacauggaacaugaagcu

SEQ ID NO: 1098629 - RNA, 22 nt, Human
ugagacaguuuuucuauuucca

SEQ ID NO: 1098630 - RNA, 22 nt, Human
uugcagcugcaguaaauguuca

SEQ ID NO: 1098631 - RNA, 22 nt, Human
agcacauucugccuugcuuugc

SEQ ID NO: 1098632 - RNA, 22 nt, Human
uuguaugagcuccaggaacuca

SEQ ID NO: 1098633 - RNA, 22 nt, Human
ucacuguugaccuggaaguggg

SEQ ID NO: 1098634 - RNA, 22 nt, Human
aaugauuuccccuacacagaag

SEQ ID NO: 1098635 - RNA, 22 nt, Human
acauacuuaugcuaaaaauaua

SEQ ID NO: 1098636 - RNA, 22 nt, Human
uuggcaguaaaagaaaaugcuu

SEQ ID NO: 1098637 - RNA, 22 nt, Human
uucuucuccuaaggagaguccu

SEQ ID NO: 1098638 - RNA, 22 nt, Human
uuggaaauacagcaguuacuuu

SEQ ID NO: 1098639 - RNA, 22 nt, Human
uuugaaauaugaggcauuauga

SEQ ID NO: 1098640 - RNA, 20 nt, Human
augauuuugcacuaacuuca

SEQ ID NO: 1098641 - RNA, 22 nt, Human
ucacaaauagcuauauuaagga

SEQ ID NO: 1098642 - RNA, 22 nt, Human
gcaguucuacuuauccauagac

SEQ ID NO: 1098643 - RNA, 21 nt, Human
uucuccccagcgaauccucgg

SEQ ID NO: 1098644 - RNA, 22 nt, Human
aaauuauuacaagcuaguuggc

SEQ ID NO: 1098645 - RNA, 22 nt, Human
auuuagaacuuuguuugccaau

SEQ ID NO: 1098646 - RNA, 22 nt, Human
aacaguaaagacagaauuuauc

SEQ ID NO: 1098647 - RNA, 22 nt, Human
uuacaguuuaguccaagccaga

SEQ ID NO: 1098648 - RNA, 19 nt, Human
gugcuuuuuaagagcucag

SEQ ID NO: 1098649 - RNA, 23 nt, Human
ucaggauauugugugccaaggug

SEQ ID NO: 1098650 - RNA, 22 nt, Human
cuguuaaucugcuugcaugaug

SEQ ID NO: 1098651 - RNA, 22 nt, Human
ccaugagccaggcugaggaagc

SEQ ID NO: 1098652 - RNA, 19 nt, Human
ucuuucauuucuagcucug

SEQ ID NO: 1098653 - RNA, 22 nt, Human
uugcauuuuuagaugcuucugu

SEQ ID NO: 1098654 - RNA, 22 nt, Human
gaggacaggagacucacuguuu

SEQ ID NO: 1098655 - RNA, 22 nt, Human
gucuauauauugcuugaauaau

SEQ ID NO: 1098656 - RNA, 22 nt, Human
cuuaaagaaauugaggagagga

SEQ ID NO: 1098657 - RNA, 22 nt, Human
uaacacauauuucaagaguagu

SEQ ID NO: 1098658 - RNA, 22 nt, Human
cauuuucagcacccaucugaaa

SEQ ID NO: 1098659 - RNA, 22 nt, Human
gaaaggugccccauaggcagga

SEQ ID NO: 1098660 - RNA, 22 nt, Human
auuaaauuaaguggcuaauuua

SEQ ID NO: 1098661 - RNA, 22 nt, Human
cuucuucagcacaauauugaug

SEQ ID NO: 1098662 - RNA, 22 nt, Human
cuugaaagcacuccuuugacug

SEQ ID NO: 1098663 - RNA, 22 nt, Human
ccagugcuaagguagccucugc

SEQ ID NO: 1098664 - RNA, 22 nt, Human
uuucaaacuuuacucuugaauc

SEQ ID NO: 1098665 - RNA, 22 nt, Human
cugcuguguggugaaacucagu

SEQ ID NO: 1098666 - RNA, 22 nt, Human
aagucuguuugagugucacacu

SEQ ID NO: 1098667 - RNA, 22 nt, Human
uuucuuguaagauguuuauuaa

SEQ ID NO: 1098668 - RNA, 22 nt, Human
aggcuggagggcaauggcaaga

SEQ ID NO: 1098669 - RNA, 22 nt, Human
uuaauuaaauucaugagcauug

SEQ ID NO: 1098670 - RNA, 22 nt, Human
gaaggccaagaggcuccaagau

SEQ ID NO: 1098671 - RNA, 22 nt, Human
uucugucauccuuucuagaugu

SEQ ID NO: 1098672 - RNA, 22 nt, Human
cucugcaugccuugcucagaca

SEQ ID NO: 1098673 - RNA, 22 nt, Human
gaaauauugggacucagagcuu

SEQ ID NO: 1098674 - RNA, 22 nt, Human
gccaucacauccaggcuaccuc

SEQ ID NO: 1098675 - RNA, 22 nt, Human
gauauguauugaaugaucauuu

SEQ ID NO: 1098676 - RNA, 22 nt, Human
uuugaaagagcugauacaugaa

SEQ ID NO: 1098677 - RNA, 22 nt, Human
ccacugaggcaggcaguaucua

SEQ ID NO: 1098678 - RNA, 21 nt, Human
uggagacucugguucuuugug

SEQ ID NO: 1098679 - RNA, 22 nt, Human
gagggagugccagagggccagc

SEQ ID NO: 1098680 - RNA, 21 nt, Human
acagucuccccagaucucucc

SEQ ID NO: 1098681 - RNA, 23 nt, Human
acaagauagggauaaaaagauaa

SEQ ID NO: 1098682 - RNA, 19 nt, Human
agggaguuuauauuugcac

SEQ ID NO: 1098683 - RNA, 22 nt, Human
aguaugaagauuauaauuuuuc

SEQ ID NO: 1098684 - RNA, 22 nt, Human
aaaauacuguggaguguugaaa

SEQ ID NO: 1098685 - RNA, 22 nt, Human
aaauuguugaucuacaguaagg

SEQ ID NO: 1098686 - RNA, 22 nt, Human
ucuuagaaugucaacugauguu

SEQ ID NO: 1098687 - RNA, 22 nt, Human
uuggaaagauuauuauuaugaa

SEQ ID NO: 1098688 - RNA, 22 nt, Human
ugaaagauugugauucaauaug

SEQ ID NO: 1098689 - RNA, 22 nt, Human
uauuucuucgggauucaagcua

SEQ ID NO: 1098690 - RNA, 22 nt, Human
ugcuuagacgucaaguacagcc

SEQ ID NO: 1098691 - RNA, 22 nt, Human
ugaguucuaguggcugcagauu

SEQ ID NO: 1098692 - RNA, 22 nt, Human
ucauuucaaguucugacagcua

SEQ ID NO: 1098693 - RNA, 18 nt, Human
ugaauagggguuugcaga

SEQ ID NO: 1098694 - RNA, 22 nt, Human
uaugaacugugagugugauggg

SEQ ID NO: 1098695 - RNA, 22 nt, Human
uaugacauugcuuuuuagaacu

SEQ ID NO: 1098696 - RNA, 22 nt, Human
uaacacaugguuaguacacaau

SEQ ID NO: 1098697 - RNA, 22 nt, Human
augacacuuggugauacuuugu

SEQ ID NO: 1098698 - RNA, 22 nt, Human
cuguaugaacccauauacuuau

SEQ ID NO: 1098699 - RNA, 22 nt, Human
augaaaauguacauguguauaa

SEQ ID NO: 1098700 - RNA, 22 nt, Human
ugucucaguacacuccgauguu

SEQ ID NO: 1098701 - RNA, 19 nt, Human
ucauuguugguuugucggg

SEQ ID NO: 1098702 - RNA, 22 nt, Human
aaaggccacugcaagggaaggu

SEQ ID NO: 1098703 - RNA, 22 nt, Human
ugaaguuauauauguugaaaau

SEQ ID NO: 1098704 - RNA, 22 nt, Human
ccuugcugaccaucaccuuuga

SEQ ID NO: 1098705 - RNA, 22 nt, Human
uuuuucuuaaauguggguuggc

SEQ ID NO: 1098706 - RNA, 22 nt, Human
agugcuguaacaacuuauuugg

SEQ ID NO: 1098707 - RNA, 22 nt, Human
guccaugauucugugacacccu

SEQ ID NO: 1098708 - RNA, 22 nt, Human
gcuguguuggugaagcuguagc

SEQ ID NO: 1098709 - RNA, 22 nt, Human
uucaggaucauuuguuuuaucu

SEQ ID NO: 1098710 - RNA, 22 nt, Human
uccauguguuuuccuguccaca

SEQ ID NO: 1098711 - RNA, 22 nt, Human
uucugucacuuuuuuggaaucu

SEQ ID NO: 1098712 - RNA, 22 nt, Human
gugcugugugauccaugcuggc

SEQ ID NO: 1098713 - RNA, 22 nt, Human
gucaggauuggggucaugaguc

SEQ ID NO: 1098714 - RNA, 22 nt, Human
aauggccagcaacaggagugaa

SEQ ID NO: 1098715 - RNA, 23 nt, Human
ugcaugugaauucauacuuguuu

SEQ ID NO: 1098716 - RNA, 22 nt, Human
ugcuucagaggaaaggcaaaag

SEQ ID NO: 1098717 - RNA, 22 nt, Human
aguccaugguucugacucaucu

SEQ ID NO: 1098718 - RNA, 22 nt, Human
uuucucuugcgauaugcuacac

SEQ ID NO: 1098719 - RNA, 22 nt, Human
ggcacagagcccagcuuccuag

SEQ ID NO: 1098720 - RNA, 22 nt, Human
aaguaugaaucaaagacuaucu

SEQ ID NO: 1098721 - RNA, 22 nt, Human
aaaggugacacucugccagcug

SEQ ID NO: 1098722 - RNA, 18 nt, Human
ucauuuguuuugcaugaa

SEQ ID NO: 1098723 - RNA, 22 nt, Human
cuggcugugcugcaggcuuugg

SEQ ID NO: 1098724 - RNA, 22 nt, Human
uauuucagcaagaagaaugugg

SEQ ID NO: 1098725 - RNA, 22 nt, Human
gcaggggcuaaggacacagaga

SEQ ID NO: 1098726 - RNA, 22 nt, Human
uucaaauacauucuuugccacu

SEQ ID NO: 1098727 - RNA, 22 nt, Human
aguuagaauauaauuauguuaa

SEQ ID NO: 1098728 - RNA, 22 nt, Human
guucuucaguaaaauuaaaugu

SEQ ID NO: 1098729 - RNA, 22 nt, Human
ucauggauggccgggaggugau

SEQ ID NO: 1098730 - RNA, 22 nt, Human
uaauuccaaguugagacaugca

SEQ ID NO: 1098731 - RNA, 22 nt, Human
uguuguuuucucauggagaaua

SEQ ID NO: 1098732 - RNA, 20 nt, Human
uuucacaaugaacaugucuc

SEQ ID NO: 1098733 - RNA, 22 nt, Human
uuucacacugcagcaucagaga

SEQ ID NO: 1098734 - RNA, 22 nt, Human
ucuaaagaagaggguucugcgg

SEQ ID NO: 1098735 - RNA, 22 nt, Human
caaggccaagguuuugugaacu

SEQ ID NO: 1098736 - RNA, 22 nt, Human
ugugaaauauuuauauacucaa

SEQ ID NO: 1098737 - RNA, 22 nt, Human
uaaggccagccagcaaaucugu

SEQ ID NO: 1098738 - RNA, 22 nt, Human
uuugcauaagucauguccagug

SEQ ID NO: 1098739 - RNA, 22 nt, Human
uagaaacaucagcuaaccaaaa

SEQ ID NO: 1098740 - RNA, 22 nt, Human
gcugauguuuaguugauguuac

SEQ ID NO: 1098741 - RNA, 22 nt, Human
uaacacauuuuaagccauuuua

SEQ ID NO: 1098742 - RNA, 22 nt, Human
cugggaaauggcuucgagcuca

SEQ ID NO: 1098743 - RNA, 22 nt, Human
uugcugaauugaauccuuuggu

SEQ ID NO: 1098744 - RNA, 22 nt, Human
uacugcauaacuggcauguggg

SEQ ID NO: 1098745 - RNA, 22 nt, Human
uggaaauggaucugaugagucu

SEQ ID NO: 1098746 - RNA, 22 nt, Human
auuacucugucugccucugacc

SEQ ID NO: 1098747 - RNA, 22 nt, Human
auucuucauuguugauucaugu

SEQ ID NO: 1098748 - RNA, 22 nt, Human
gucuucuuguuuugaaggaaau

SEQ ID NO: 1098749 - RNA, 22 nt, Human
uauaauuuggggaaaguggugu

SEQ ID NO: 1098750 - RNA, 22 nt, Human
auuauuauauagggaaaguccc

SEQ ID NO: 1098751 - RNA, 22 nt, Human
ccugcucagagcgucuugugug

SEQ ID NO: 1098752 - RNA, 22 nt, Human
caucaucaaaacaaauggaguc

SEQ ID NO: 1098753 - RNA, 22 nt, Human
uucauugugaacacauucugcc

SEQ ID NO: 1098754 - RNA, 22 nt, Human
ugucucugggugauucaguccu

SEQ ID NO: 1098755 - RNA, 22 nt, Human
gcucaggacuggaggagcgggg

SEQ ID NO: 1098756 - RNA, 22 nt, Human
acaaaugugucuaauugugccu

SEQ ID NO: 1098757 - RNA, 20 nt, Human
aagcacauuucuacaauaau

SEQ ID NO: 1098758 - RNA, 22 nt, Human
gauuucuugauaauucaaaucc

SEQ ID NO: 1098759 - RNA, 22 nt, Human
cauacaagcguucaauagaugu

SEQ ID NO: 1098760 - RNA, 22 nt, Human
acaaauaugguacucggagaaa

SEQ ID NO: 1098761 - RNA, 22 nt, Human
cauauguauuucucauaauuag

SEQ ID NO: 1098762 - RNA, 22 nt, Human
caggauggucucgaucuccuga

SEQ ID NO: 1098763 - RNA, 21 nt, Human
auaaaguuuuacaggaaugca

SEQ ID NO: 1098764 - RNA, 22 nt, Human
aucuuucagggccauuuguauu

SEQ ID NO: 1098765 - RNA, 22 nt, Human
acaaucauuccguucacaacag

SEQ ID NO: 1098766 - RNA, 22 nt, Human
gguggagcuggaccaggagagg

SEQ ID NO: 1098767 - RNA, 22 nt, Human
agguauaagaagauuauuuaua

SEQ ID NO: 1098768 - RNA, 22 nt, Human
cagagggcacaugguuuccuca

SEQ ID NO: 1098769 - RNA, 22 nt, Human
uuaacauacaucaugaacaaug

SEQ ID NO: 1098770 - RNA, 22 nt, Human
auguagaagugggcauuauaga

SEQ ID NO: 1098771 - RNA, 22 nt, Human
ccacagcugaccgcaggugagc

SEQ ID NO: 1098772 - RNA, 22 nt, Human
acacauauauacauauuugugc

SEQ ID NO: 1098773 - RNA, 22 nt, Human
auggaguucuuuaaauucacag

SEQ ID NO: 1098774 - RNA, 22 nt, Human
caggauggucuucauuuggcuc

SEQ ID NO: 1098775 - RNA, 22 nt, Human
uguaugaaaaggaauagauuga

SEQ ID NO: 1098776 - RNA, 22 nt, Human
gaugccuccaaaugagggcaga

SEQ ID NO: 1098777 - RNA, 22 nt, Human
ucugggaaugaauaagaccugu

SEQ ID NO: 1098778 - RNA, 22 nt, Human
gucuucuguaagaugagguccc

SEQ ID NO: 1098779 - RNA, 22 nt, Human
cuggaguuagaguagacacuga

SEQ ID NO: 1098780 - RNA, 22 nt, Human
cagcauuuggugaucaucuuaa

SEQ ID NO: 1098781 - RNA, 21 nt, Human
aaucauacaaaacaugucagg

SEQ ID NO: 1098782 - RNA, 22 nt, Human
guguugaugacauuuuagaaac

SEQ ID NO: 1098783 - RNA, 22 nt, Human
ugaacacauaaggcuuuccugu

SEQ ID NO: 1098784 - RNA, 19 nt, Human
guugaaaguaggugagggu

SEQ ID NO: 1098785 - RNA, 22 nt, Human
auacuuucugaccaauuaauug

SEQ ID NO: 1098786 - RNA, 22 nt, Human
auguagagcaguguuguccaau

SEQ ID NO: 1098787 - RNA, 22 nt, Human
ugcuuggcuuucugagcuucug

SEQ ID NO: 1098788 - RNA, 22 nt, Human
uucauucuugggaucagagagu

SEQ ID NO: 1098789 - RNA, 22 nt, Human
ucuucccuaaucaccaucuuca

SEQ ID NO: 1098790 - RNA, 22 nt, Human
agcuggcagcucucagggguac

SEQ ID NO: 1098791 - RNA, 22 nt, Human
auacacauauguguguauaugu

SEQ ID NO: 1098792 - RNA, 22 nt, Human
uuaacaugucuugacuucaucu

SEQ ID NO: 1098793 - RNA, 22 nt, Human
gcagaagucagaccaucugaau

SEQ ID NO: 1098794 - RNA, 22 nt, Human
uuuuuuaguuaggucagaaugu

SEQ ID NO: 1098795 - RNA, 22 nt, Human
uugacaauguccuuugaauuuc

SEQ ID NO: 1098796 - RNA, 22 nt, Human
agacaguguguguauauauggu

SEQ ID NO: 1098797 - RNA, 22 nt, Human
auuuaaaugcuuaagaggguuu

SEQ ID NO: 1098798 - RNA, 21 nt, Human
auuucagagcacacaaguaaa

SEQ ID NO: 1098799 - RNA, 22 nt, Human
cauuuguuuagaagucuuuaua

SEQ ID NO: 1098800 - RNA, 22 nt, Human
aaagauuauggcauugaaauac

SEQ ID NO: 1098801 - RNA, 22 nt, Human
uucauucugcaguucucagcuc

SEQ ID NO: 1098802 - RNA, 22 nt, Human
gccucugcccuccugggacugc

SEQ ID NO: 1098803 - RNA, 22 nt, Human
uugcuagcugguguaugcauug

SEQ ID NO: 1098804 - RNA, 23 nt, Human
aucuguucaucugacacagauuc

SEQ ID NO: 1098805 - RNA, 22 nt, Human
augcaucuauucccaagggcag

SEQ ID NO: 1098806 - RNA, 22 nt, Human
cugcugugaguuuggaggucua

SEQ ID NO: 1098807 - RNA, 22 nt, Human
uuuguuuagaaagagauuggug

SEQ ID NO: 1098808 - RNA, 22 nt, Human
uagcucuucaaucacugucucc

SEQ ID NO: 1098809 - RNA, 22 nt, Human
aaauuauuaugccccucuauaa

SEQ ID NO: 1098810 - RNA, 22 nt, Human
auuucucuuagcaagacauuac

SEQ ID NO: 1098811 - RNA, 22 nt, Human
uuuggaauauuaaaaugucuca

SEQ ID NO: 1098812 - RNA, 22 nt, Human
uuucaaacauaucuucauuacu

SEQ ID NO: 1098813 - RNA, 21 nt, Human
gacaaagugaagcaggcagga

SEQ ID NO: 1098814 - RNA, 22 nt, Human
aaaggaagaugccaggacucug

SEQ ID NO: 1098815 - RNA, 22 nt, Human
uauacaaugaguacauucuggg

SEQ ID NO: 1098816 - RNA, 22 nt, Human
augacucuuagcuaaagguaag

SEQ ID NO: 1098817 - RNA, 22 nt, Human
uaagaacuucggacauguuauc

SEQ ID NO: 1098818 - RNA, 22 nt, Human
uugcuuuguuacugcaguuucc

SEQ ID NO: 1098819 - RNA, 22 nt, Human
uuugaaaguccuaggagagucc

SEQ ID NO: 1098820 - RNA, 22 nt, Human
uucaggauggaguaccuuuuau

SEQ ID NO: 1098821 - RNA, 22 nt, Human
aauacuauguagccaaaauaau

SEQ ID NO: 1098822 - RNA, 22 nt, Human
ucaucugucauccacaaagcug

SEQ ID NO: 1098823 - RNA, 22 nt, Human
agaaaugaagcaggaguuauua

SEQ ID NO: 1098824 - RNA, 22 nt, Human
uucuucuuuccuauaauuaauu

SEQ ID NO: 1098825 - RNA, 22 nt, Human
aucaggaugaagcuguagcgaa

SEQ ID NO: 1098826 - RNA, 22 nt, Human
ucugauuagagcauucuugagu

SEQ ID NO: 1098827 - RNA, 22 nt, Human
ugaacuuagugggaauaucucu

SEQ ID NO: 1098828 - RNA, 22 nt, Human
aaaauuauagaucuagugccug

SEQ ID NO: 1098829 - RNA, 22 nt, Human
agggcaguucaacuucauagug

SEQ ID NO: 1098830 - RNA, 22 nt, Human
cugcucuaacugcauuaguuuu

SEQ ID NO: 1098831 - RNA, 22 nt, Human
ucuucauuuuauagcaucugug

SEQ ID NO: 1098832 - RNA, 22 nt, Human
ucuucaaguuccaaagugcagg

SEQ ID NO: 1098833 - RNA, 22 nt, Human
ccuugcauauauuauaucuuug

SEQ ID NO: 1098834 - RNA, 22 nt, Human
aauguaugaagguuccaguuuc

SEQ ID NO: 1098835 - RNA, 22 nt, Human
cacaugaagagagucuaguaau

SEQ ID NO: 1098836 - RNA, 22 nt, Human
auacagauguugaauguuauau

SEQ ID NO: 1098837 - RNA, 22 nt, Human
auucuucauuuacuguuacuug

SEQ ID NO: 1098838 - RNA, 22 nt, Human
cucagugugaaugcucaguaaa

SEQ ID NO: 1098839 - RNA, 22 nt, Human
gaaguacaguuuuaucuagcca

SEQ ID NO: 1098840 - RNA, 22 nt, Human
ucugggaagcugguccuguucu

SEQ ID NO: 1098841 - RNA, 22 nt, Human
ugcuagaauuugcagaagcaua

SEQ ID NO: 1098842 - RNA, 22 nt, Human
uuucugaacaaagccauuauca

SEQ ID NO: 1098843 - RNA, 22 nt, Human
uggcaucucaaacaggcagauu

SEQ ID NO: 1098844 - RNA, 22 nt, Human
ucuuccucuagaucugaggccc

SEQ ID NO: 1098845 - RNA, 22 nt, Human
auguaaacaagguuauugucca

SEQ ID NO: 1098846 - RNA, 22 nt, Human
ucauuuugggguuugucaucuu

SEQ ID NO: 1098847 - RNA, 22 nt, Human
uucaaacaguguagaauauaug

SEQ ID NO: 1098848 - RNA, 22 nt, Human
uucugucacuugcaaucaagag

SEQ ID NO: 1098849 - RNA, 22 nt, Human
aaaggagacuucagaucuccuu

SEQ ID NO: 1098850 - RNA, 22 nt, Human
uuuguuuacucauucauugaug

SEQ ID NO: 1098851 - RNA, 22 nt, Human
augcuguguggucaaguuaauu

SEQ ID NO: 1098852 - RNA, 22 nt, Human
caggaugggauguagugggccc

SEQ ID NO: 1098853 - RNA, 22 nt, Human
ucauuuguaccauuuuuuaaga

SEQ ID NO: 1098854 - RNA, 22 nt, Human
cucccagagagcaggugggccg

SEQ ID NO: 1098855 - RNA, 22 nt, Human
agcugaugccauguggaacagu

SEQ ID NO: 1098856 - RNA, 22 nt, Human
gugcuuuuaaaggcaauuagua

SEQ ID NO: 1098857 - RNA, 22 nt, Human
uaggaaaugcuccauugcauaa

SEQ ID NO: 1098858 - RNA, 22 nt, Human
gcugaaugaauguauuuuaaaa

SEQ ID NO: 1098859 - RNA, 22 nt, Human
auucugauaucuuauucuagcu

SEQ ID NO: 1098860 - RNA, 22 nt, Human
ggucagagggugggcugccugu

SEQ ID NO: 1098861 - RNA, 22 nt, Human
aguccuuugggaaaaaugacua

SEQ ID NO: 1098862 - RNA, 22 nt, Human
ugagccuguccugugcauguga

SEQ ID NO: 1098863 - RNA, 22 nt, Human
uuagacauguuugcuaaaauga

SEQ ID NO: 1098864 - RNA, 22 nt, Human
cugcugugggcaggguagcugg

SEQ ID NO: 1098865 - RNA, 22 nt, Human
gugauuuugagaccuauauagu

SEQ ID NO: 1098866 - RNA, 22 nt, Human
cugucccuucauuauucacuac

SEQ ID NO: 1098867 - RNA, 21 nt, Human
uucaaaaugguguguuugucu

SEQ ID NO: 1098868 - RNA, 22 nt, Human
cuucuucaagagaaugggagac

SEQ ID NO: 1098869 - RNA, 19 nt, Human
uuuuccuucuauauguuuc

SEQ ID NO: 1098870 - RNA, 22 nt, Human
uuuaaaauuuagaccucuccac

SEQ ID NO: 1098871 - RNA, 22 nt, Human
gucuucuuguguugccugucuu

SEQ ID NO: 1098872 - RNA, 22 nt, Human
cucuucuuauggccguggcuga

SEQ ID NO: 1098873 - RNA, 22 nt, Human
uagaauucaagauucaacaggc

SEQ ID NO: 1098874 - RNA, 22 nt, Human
agaguucugcucuucucaguga

SEQ ID NO: 1098875 - RNA, 22 nt, Human
acaugcauacacguacauaccu

SEQ ID NO: 1098876 - RNA, 22 nt, Human
ugcuagaagauagcuagaagau

SEQ ID NO: 1098877 - RNA, 22 nt, Human
uccuuagagauacugucuugaa

SEQ ID NO: 1098878 - RNA, 22 nt, Human
guuauauauaguauuucucuga

SEQ ID NO: 1098879 - RNA, 20 nt, Human
cucaggauugucuagccccu

SEQ ID NO: 1098880 - RNA, 22 nt, Human
guucuucaucuuaaccaucugu

SEQ ID NO: 1098881 - RNA, 22 nt, Human
gaaggccacaagagaaguuaag

SEQ ID NO: 1098882 - RNA, 22 nt, Human
cagcugcuguuacugcuuauua

SEQ ID NO: 1098883 - RNA, 22 nt, Human
gucuucuuuaaccuacuaaagc

SEQ ID NO: 1098884 - RNA, 19 nt, Human
agucuuucccacucgucuu

SEQ ID NO: 1098885 - RNA, 22 nt, Human
agucucugcaugccugcugugc

SEQ ID NO: 1098886 - RNA, 22 nt, Human
ugcauguguuugccacagugag

SEQ ID NO: 1098887 - RNA, 20 nt, Human
ucagugauuuugaagaggaa

SEQ ID NO: 1098888 - RNA, 22 nt, Human
auaguuugugaaacacagcagu

SEQ ID NO: 1098889 - RNA, 22 nt, Human
ugaaggccucugguacaugcca

SEQ ID NO: 1098890 - RNA, 22 nt, Human
aauaucagcacuuuugugguau

SEQ ID NO: 1098891 - RNA, 22 nt, Human
uucuucuuucccccugugguac

SEQ ID NO: 1098892 - RNA, 22 nt, Human
gcuugaaaauucauagguauuu

SEQ ID NO: 1098893 - RNA, 22 nt, Human
uugcaucuaccauaucaaagau

SEQ ID NO: 1098894 - RNA, 22 nt, Human
auucugucuuuuuaaaauaaua

SEQ ID NO: 1098895 - RNA, 22 nt, Human
uuuaaauuuguguuuagagggu

SEQ ID NO: 1098896 - RNA, 22 nt, Human
uuagcaucugcuguaagcuuau

SEQ ID NO: 1098897 - RNA, 22 nt, Human
acagcagcuugcgugucugguc

SEQ ID NO: 1098898 - RNA, 22 nt, Human
augcugugucuagcaggaacac

SEQ ID NO: 1098899 - RNA, 22 nt, Human
aaauauguauggaguucaugaa

SEQ ID NO: 1098900 - RNA, 22 nt, Human
aagauggaguaguguaaugguu

SEQ ID NO: 1098901 - RNA, 22 nt, Human
aggcacagagaaugcccuccau

SEQ ID NO: 1098902 - RNA, 22 nt, Human
uucacacacagcuuccuauugu

SEQ ID NO: 1098903 - RNA, 22 nt, Human
agcagagccugggcuaggggug

SEQ ID NO: 1098904 - RNA, 22 nt, Human
cauaugaaauaugaguugaaca

SEQ ID NO: 1098905 - RNA, 22 nt, Human
uuggaaagcaagcuggacauac

SEQ ID NO: 1098906 - RNA, 22 nt, Human
aauaguauuuauuuggaaaaag

SEQ ID NO: 1098907 - RNA, 22 nt, Human
uugaaagugccaaguccuagug

SEQ ID NO: 1098908 - RNA, 19 nt, Human
aauacaguguuauagaauu

SEQ ID NO: 1098909 - RNA, 22 nt, Human
uugcugaaaacaguggguauug

SEQ ID NO: 1098910 - RNA, 22 nt, Human
gucaggauuuacaaacuucagu

SEQ ID NO: 1098911 - RNA, 22 nt, Human
uaacaauaguguuugcuaguca

SEQ ID NO: 1098912 - RNA, 22 nt, Human
guuaaauucgaugauggauaaa

SEQ ID NO: 1098913 - RNA, 22 nt, Human
cucaaauauaagcuaaaugugg

SEQ ID NO: 1098914 - RNA, 22 nt, Human
ugaaaugaaacagaacauauca

SEQ ID NO: 1098915 - RNA, 22 nt, Human
uggagacucugcaucugugaca

SEQ ID NO: 1098916 - RNA, 22 nt, Human
auuuagacuucccagcacugug

SEQ ID NO: 1098917 - RNA, 22 nt, Human
uuagccauguugaagauuuaga

SEQ ID NO: 1098918 - RNA, 22 nt, Human
aggcacaguggcucacaccugu

SEQ ID NO: 1098919 - RNA, 22 nt, Human
cuauuacauuucuggacauuca

SEQ ID NO: 1098920 - RNA, 19 nt, Human
caggaaugagguaauggcu

SEQ ID NO: 1098921 - RNA, 22 nt, Human
uaaggccaaggggccauagucu

SEQ ID NO: 1098922 - RNA, 22 nt, Human
aaucuguucuacucuauucaga

SEQ ID NO: 1098923 - RNA, 22 nt, Human
ucacaguaaaagcauggaagag

SEQ ID NO: 1098924 - RNA, 22 nt, Human
aucuuucuccauauacaucuuu

SEQ ID NO: 1098925 - RNA, 22 nt, Human
aaguuugcauagauuaagcauu

SEQ ID NO: 1098926 - RNA, 22 nt, Human
cuagaauugcauucuaugaaua

SEQ ID NO: 1098927 - RNA, 22 nt, Human
aggcacagcacaccuggccccc

SEQ ID NO: 1098928 - RNA, 22 nt, Human
acuuggcaaguaucuauaaagu

SEQ ID NO: 1098929 - RNA, 22 nt, Human
uauuuuaaagugaagggucuug

SEQ ID NO: 1098930 - RNA, 22 nt, Human
uguucauaucauuuugaaagcu

SEQ ID NO: 1098931 - RNA, 22 nt, Human
ugugaaggagaugaagggagug

SEQ ID NO: 1098932 - RNA, 22 nt, Human
acucagaagauauaaugacuca

SEQ ID NO: 1098933 - RNA, 22 nt, Human
auucuucagaauaucuggcacu

SEQ ID NO: 1098934 - RNA, 22 nt, Human
guccaugacugugacucacaug

SEQ ID NO: 1098935 - RNA, 22 nt, Human
uguccauggauagagcugcucg

SEQ ID NO: 1098936 - RNA, 22 nt, Human
auguagaacagguuaaugacag

SEQ ID NO: 1098937 - RNA, 22 nt, Human
aaaacuaaauacgcuuugccuc

SEQ ID NO: 1098938 - RNA, 22 nt, Human
gaacccaggcuuuugaggcugu

SEQ ID NO: 1098939 - RNA, 22 nt, Human
uuucuugacugcuuaggaaugc

SEQ ID NO: 1098940 - RNA, 22 nt, Human
ugcuggguuaccuaagccuaaa

SEQ ID NO: 1098941 - RNA, 22 nt, Human
guggaaugaauagauuugcauu

SEQ ID NO: 1098942 - RNA, 23 nt, Human
aucauucuccaaucuggagcagg

SEQ ID NO: 1098943 - RNA, 22 nt, Human
aacuuucuuggaugucucaaca

SEQ ID NO: 1098944 - RNA, 22 nt, Human
uauuugcaacauaaaacucuga

SEQ ID NO: 1098945 - RNA, 22 nt, Human
cuguauuuguccucuauuuauu

SEQ ID NO: 1098946 - RNA, 22 nt, Human
uugcauuucccauugaguaaug

SEQ ID NO: 1098947 - RNA, 22 nt, Human
uucuucaaccaucuacauaaac

SEQ ID NO: 1098948 - RNA, 22 nt, Human
gagcauuugguuauaguaauuu

SEQ ID NO: 1098949 - RNA, 22 nt, Human
ucagagaguuagugucuuagcu

SEQ ID NO: 1098950 - RNA, 22 nt, Human
uggaaagucucuuuugacugua

SEQ ID NO: 1098951 - RNA, 22 nt, Human
caggauggccccggggcugugc

SEQ ID NO: 1098952 - RNA, 22 nt, Human
uacagcauguccuuagcaaggc

SEQ ID NO: 1098953 - RNA, 15 nt, Human
cuccaugauuuugca

SEQ ID NO: 1098954 - RNA, 22 nt, Human
agacucaagcagauaggaauua

SEQ ID NO: 1098955 - RNA, 22 nt, Human
uguuuucagucauauagcaggu

SEQ ID NO: 1098956 - RNA, 17 nt, Human
guccuacccauggucua

SEQ ID NO: 1098957 - RNA, 22 nt, Human
ucaggauaaaauguaauggcaa

SEQ ID NO: 1098958 - RNA, 22 nt, Human
uuuaacagguaaaguaaaugug

SEQ ID NO: 1098959 - RNA, 22 nt, Human
auugcuuaucuaucuuuaaguc

SEQ ID NO: 1098960 - RNA, 22 nt, Human
uuauacuaaaacgcauugaauu

SEQ ID NO: 1098961 - RNA, 20 nt, Human
gcccaagguccagaaggggg

SEQ ID NO: 1098962 - RNA, 22 nt, Human
uggcaguccccugugccuggaa

SEQ ID NO: 1098963 - RNA, 22 nt, Human
ggauggagguucucagaugcuc

SEQ ID NO: 1098964 - RNA, 22 nt, Human
ugacuagaccuauaucuuuuug

SEQ ID NO: 1098965 - RNA, 22 nt, Human
gugguaaucggauucuuaccgg

SEQ ID NO: 1098966 - RNA, 22 nt, Human
gucuuuaugguaugaaaacuga

SEQ ID NO: 1098967 - RNA, 22 nt, Human
aggccagacagcuagaaacagg

SEQ ID NO: 1098968 - RNA, 22 nt, Human
ucacaguaucacacaaggauua

SEQ ID NO: 1098969 - RNA, 22 nt, Human
cuggaaauuggagaugauguuu

SEQ ID NO: 1098970 - RNA, 22 nt, Human
aaggccaacuaggaugagcuag

SEQ ID NO: 1098971 - RNA, 22 nt, Human
uucuuaacucaaauauauaucc

SEQ ID NO: 1098972 - RNA, 22 nt, Human
aguaugaaaguuaaucaauuua

SEQ ID NO: 1098973 - RNA, 22 nt, Human
gcuguucucuguaacaugcauu

SEQ ID NO: 1098974 - RNA, 22 nt, Human
uuucaaauagaaucuuuccaaa

SEQ ID NO: 1098975 - RNA, 22 nt, Human
gucuucaauagagccucaauuu

SEQ ID NO: 1098976 - RNA, 22 nt, Human
aaauguauugcauaggauauuu

SEQ ID NO: 1098977 - RNA, 22 nt, Human
uuucaaagucaauaucauuacc

SEQ ID NO: 1098978 - RNA, 22 nt, Human
uucugucauuuagcauugucau

SEQ ID NO: 1098979 - RNA, 22 nt, Human
acucaggaaauugagauaaugg

SEQ ID NO: 1098980 - RNA, 23 nt, Human
ccacuagcaccuguucaacuucu

SEQ ID NO: 1098981 - RNA, 22 nt, Human
ucuuagcauuucauaacaacug

SEQ ID NO: 1098982 - RNA, 22 nt, Human
agucucuuauucccuauugcug

SEQ ID NO: 1098983 - RNA, 22 nt, Human
agucucuuuaaucacagugucu

SEQ ID NO: 1098984 - RNA, 22 nt, Human
uaacacauaucuacaacaugug

SEQ ID NO: 1098985 - RNA, 22 nt, Human
cagaaauguacugacaugcagu

SEQ ID NO: 1098986 - RNA, 20 nt, Human
aaacauucauguacaaguga

SEQ ID NO: 1098987 - RNA, 22 nt, Human
uucuucuucuggcugcaccugg

SEQ ID NO: 1098988 - RNA, 22 nt, Human
ucagagaguuggaaagaauuaa

SEQ ID NO: 1098989 - RNA, 22 nt, Human
uuugaagucagacacugcuuug

SEQ ID NO: 1098990 - RNA, 22 nt, Human
cuugggaaugcuaacagaugac

SEQ ID NO: 1098991 - RNA, 22 nt, Human
gaaggccacggaauggagcugg

SEQ ID NO: 1098992 - RNA, 22 nt, Human
acaucucaugaaugauaaauca

SEQ ID NO: 1098993 - RNA, 22 nt, Human
uauuauuaaauggcagaauuuu

SEQ ID NO: 1098994 - RNA, 22 nt, Human
cacaaugugguuugucaucuuu

SEQ ID NO: 1098995 - RNA, 22 nt, Human
uuguaaauaguaguaagaugcc

SEQ ID NO: 1098996 - RNA, 22 nt, Human
uagaaauguugguauuaacauu

SEQ ID NO: 1098997 - RNA, 22 nt, Human
agauaugugcgucuuagauuga

SEQ ID NO: 1098998 - RNA, 22 nt, Human
uguaugaaugggaaaaggaaac

SEQ ID NO: 1098999 - RNA, 22 nt, Human
gcaagcugaugugauagugaaa

SEQ ID NO: 1099000 - RNA, 22 nt, Human
gugauaaagacgugucauaauu

SEQ ID NO: 1099001 - RNA, 22 nt, Human
acaauucugaugguuucccagu

SEQ ID NO: 1099002 - RNA, 22 nt, Human
auucacaguuuccucauauucu

SEQ ID NO: 1099003 - RNA, 22 nt, Human
ggagcacuauaauagagauuuu

SEQ ID NO: 1099004 - RNA, 22 nt, Human
aucaggaucugcaucauaagaa

SEQ ID NO: 1099005 - RNA, 22 nt, Human
uucuucaaauagcagggaguca

SEQ ID NO: 1099006 - RNA, 22 nt, Human
auugaaagagaauguagcucuu

SEQ ID NO: 1099007 - RNA, 22 nt, Human
aucauucuaguccuuauggucu

SEQ ID NO: 1099008 - RNA, 22 nt, Human
uaugacuuauuucaucaguucu

SEQ ID NO: 1099009 - RNA, 22 nt, Human
aucaggauccaccuugagccug

SEQ ID NO: 1099010 - RNA, 22 nt, Human
uauuuguugaguuguuaugucu

SEQ ID NO: 1099011 - RNA, 19 nt, Human
ugugaaagcuaguguucuu

SEQ ID NO: 1099012 - RNA, 22 nt, Human
caaaugauacuguuuuuagucu

SEQ ID NO: 1099013 - RNA, 21 nt, Human
acucaggagacuaacuauguc

SEQ ID NO: 1099014 - RNA, 22 nt, Human
cagaugaggcaaccucauugcu

SEQ ID NO: 1099015 - RNA, 22 nt, Human
uuauuuugguaaauguuugccu

SEQ ID NO: 1099016 - RNA, 22 nt, Human
ucgcugugguuucuguacaugg

SEQ ID NO: 1099017 - RNA, 22 nt, Human
gugugaaagcuuguccucugua

SEQ ID NO: 1099018 - RNA, 22 nt, Human
gucugucauacggcuuauguaa

SEQ ID NO: 1099019 - RNA, 22 nt, Human
caagaugggcaccccagcaccu

SEQ ID NO: 1099020 - RNA, 22 nt, Human
uuuguaugugauaagacuauuc

SEQ ID NO: 1099021 - RNA, 22 nt, Human
ucagauggcacacagagccugc

SEQ ID NO: 1099022 - RNA, 22 nt, Human
auuguauaacagcauguauuuu

SEQ ID NO: 1099023 - RNA, 19 nt, Human
uucauucucuuauuguugu

SEQ ID NO: 1099024 - RNA, 22 nt, Human
uucuacaugguugcucagaggg

SEQ ID NO: 1099025 - RNA, 20 nt, Human
uugauaggcagcuugucagg

SEQ ID NO: 1099026 - RNA, 22 nt, Human
uuuguaaaggccugaauuucag

SEQ ID NO: 1099027 - RNA, 22 nt, Human
aggcaguuuaggcagcgauuua

SEQ ID NO: 1099028 - RNA, 22 nt, Human
guuuuauaggcuguugcuauau

SEQ ID NO: 1099029 - RNA, 22 nt, Human
uuauuacacugaaagaauugcg

SEQ ID NO: 1099030 - RNA, 22 nt, Human
caaggccaguccauuuuggaag

SEQ ID NO: 1099031 - RNA, 22 nt, Human
uucuuuuacauuaagauuucag

SEQ ID NO: 1099032 - RNA, 22 nt, Human
gcaucuaaacuugcaucauugu

SEQ ID NO: 1099033 - RNA, 21 nt, Human
acagcauguuuguguguuugc

SEQ ID NO: 1099034 - RNA, 22 nt, Human
cugcaucacagcaggaggcaca

SEQ ID NO: 1099035 - RNA, 22 nt, Human
caaggccaguuucuccuaguca

SEQ ID NO: 1099036 - RNA, 22 nt, Human
uugauacauuuuuaggauaaac

SEQ ID NO: 1099037 - RNA, 22 nt, Human
uguguuauugccacugaagacc

SEQ ID NO: 1099038 - RNA, 22 nt, Human
guaucacuuuugagagugagaa

SEQ ID NO: 1099039 - RNA, 22 nt, Human
cccuugcacauuugucuuuaau

SEQ ID NO: 1099040 - RNA, 22 nt, Human
uacaaaugaguuguaugaacca

SEQ ID NO: 1099041 - RNA, 22 nt, Human
uguaggaauguuuuuaaguugg

SEQ ID NO: 1099042 - RNA, 19 nt, Human
cuucuucuuggcagccaag

SEQ ID NO: 1099043 - RNA, 22 nt, Human
auuuguagugaagugaaaauaa

SEQ ID NO: 1099044 - RNA, 22 nt, Human
uucaggaucacuaaacccucca

SEQ ID NO: 1099045 - RNA, 23 nt, Human
uagaaugucauucaaugauaugg

SEQ ID NO: 1099046 - RNA, 22 nt, Human
uaacuacauuucacugcaauua

SEQ ID NO: 1099047 - RNA, 22 nt, Human
cuagcaucagaugagaagcugu

SEQ ID NO: 1099048 - RNA, 22 nt, Human
aauauaugugguauugaccagc

SEQ ID NO: 1099049 - RNA, 22 nt, Human
aucaggauuauuaaaucuggau

SEQ ID NO: 1099050 - RNA, 22 nt, Human
gugggagcuuuggcaucaggcu

SEQ ID NO: 1099051 - RNA, 22 nt, Human
aaggcaguaggaucuuccacag

SEQ ID NO: 1099052 - RNA, 22 nt, Human
uuugcaaagugacuauuauaug

SEQ ID NO: 1099053 - RNA, 22 nt, Human
ucugcugugggucuauauuuua

SEQ ID NO: 1099054 - RNA, 22 nt, Human
ucuucucucauguaggagggaa

SEQ ID NO: 1099055 - RNA, 22 nt, Human
uagauauguguuuauuaugcug

SEQ ID NO: 1099056 - RNA, 22 nt, Human
uaugaaaugguaguaggaaggg

SEQ ID NO: 1099057 - RNA, 22 nt, Human
uucauucuugucuuuguauagu

SEQ ID NO: 1099058 - RNA, 22 nt, Human
aaaagucugcucucauuucaga

SEQ ID NO: 1099059 - RNA, 22 nt, Human
cauuuguauagugcuuagacca

SEQ ID NO: 1099060 - RNA, 22 nt, Human
ugaaucaguauaaauucucaaa

SEQ ID NO: 1099061 - RNA, 22 nt, Human
ucacaaauauuuuaacaguagg

SEQ ID NO: 1099062 - RNA, 22 nt, Human
ucauauaacuggauauuuucaa

SEQ ID NO: 1099063 - RNA, 22 nt, Human
agggaguuagaaauccaggaua

SEQ ID NO: 1099064 - RNA, 22 nt, Human
uuucaugauuaacuuagugaau

SEQ ID NO: 1099065 - RNA, 22 nt, Human
aaagccagagcaagcugucaca

SEQ ID NO: 1099066 - RNA, 23 nt, Human
cuuugccacccagagccugacag

SEQ ID NO: 1099067 - RNA, 22 nt, Human
cauuuuaaaugauuuaagccaa

SEQ ID NO: 1099068 - RNA, 22 nt, Human
gugaaggacuagcauggagggc

SEQ ID NO: 1099069 - RNA, 20 nt, Human
cugagagucugugcuuaguc

SEQ ID NO: 1099070 - RNA, 22 nt, Human
uuuauucaucaucuguucauau

SEQ ID NO: 1099071 - RNA, 22 nt, Human
ugguauaaaacuuuuuauugaa

SEQ ID NO: 1099072 - RNA, 22 nt, Human
aaaguguggucguucauuuugu

SEQ ID NO: 1099073 - RNA, 22 nt, Human
ccauccugcauugcuauucaga

SEQ ID NO: 1099074 - RNA, 22 nt, Human
aauaucaacaguguccuucuaa

SEQ ID NO: 1099075 - RNA, 22 nt, Human
cauuuccagcuccugcaucaug

SEQ ID NO: 1099076 - RNA, 19 nt, Human
caaggccaccauuucuccg

SEQ ID NO: 1099077 - RNA, 22 nt, Human
gaggaacccagcugggguugcc

SEQ ID NO: 1099078 - RNA, 22 nt, Human
cucaggaugaaagucaugguga

SEQ ID NO: 1099079 - RNA, 22 nt, Human
uugauuucuauucagauguaga

SEQ ID NO: 1099080 - RNA, 22 nt, Human
ggccagaaguuggaaaagagcc

SEQ ID NO: 1099081 - RNA, 22 nt, Human
aaggccagacaggaccacaucu

SEQ ID NO: 1099082 - RNA, 22 nt, Human
guucuucagauuccauuucagu

SEQ ID NO: 1099083 - RNA, 22 nt, Human
augcagcugugggcaagaaaug

SEQ ID NO: 1099084 - RNA, 20 nt, Human
aucuucuuggccagcuugcu

SEQ ID NO: 1099085 - RNA, 22 nt, Human
uuaacacaucccugcucuaccc

SEQ ID NO: 1099086 - RNA, 20 nt, Human
caggaugauuggacacgaug

SEQ ID NO: 1099087 - RNA, 22 nt, Human
uuauccaagcagaagcugcaca

SEQ ID NO: 1099088 - RNA, 18 nt, Human
ucuuuggacaacuacugg

SEQ ID NO: 1099089 - RNA, 22 nt, Human
ucuucacaugaccuucaugucu

SEQ ID NO: 1099090 - RNA, 22 nt, Human
uuucagcugguaaaggaguagc

SEQ ID NO: 1099091 - RNA, 18 nt, Human
agucuucugauccauuuu

SEQ ID NO: 1099092 - RNA, 22 nt, Human
ugaaaugaagggcuuguucugg

SEQ ID NO: 1099093 - RNA, 22 nt, Human
cucaugauguagcgaaugagaa

SEQ ID NO: 1099094 - RNA, 22 nt, Human
ccucaggauccgcaggugcagu

SEQ ID NO: 1099095 - RNA, 21 nt, Human
uuccagagauuguuucaccug

SEQ ID NO: 1099096 - RNA, 22 nt, Human
uuuucaguuccaucucugcucu

SEQ ID NO: 1099097 - RNA, 22 nt, Human
uauguuauuuucauacaacaga

SEQ ID NO: 1099098 - RNA, 22 nt, Human
uuucaaaauuuugcagugguaa

SEQ ID NO: 1099099 - RNA, 20 nt, Human
uuuuccuucugaguauguug

SEQ ID NO: 1099100 - RNA, 23 nt, Human
gaauaguuuuagaaauuggagaa

SEQ ID NO: 1099101 - RNA, 22 nt, Human
aaucuuucccuauuaaaugugg

SEQ ID NO: 1099102 - RNA, 22 nt, Human
gcuccuucaggugguagcuguu

SEQ ID NO: 1099103 - RNA, 22 nt, Human
aaaggcaggcuuucacaucuca

SEQ ID NO: 1099104 - RNA, 22 nt, Human
uuguuuuaucuuucuacagacu

SEQ ID NO: 1099105 - RNA, 22 nt, Human
ugaaagcacaaguucuaacagg

SEQ ID NO: 1099106 - RNA, 22 nt, Human
uuuuacuuaauucuuggucaug

SEQ ID NO: 1099107 - RNA, 22 nt, Human
auguagaaauuaggaugauagu

SEQ ID NO: 1099108 - RNA, 19 nt, Human
uuugaaaggauuguuauuu

SEQ ID NO: 1099109 - RNA, 22 nt, Human
aucaggaucaugcuggguggga

SEQ ID NO: 1099110 - RNA, 23 nt, Human
ugaaggccuggaggacgcguugu

SEQ ID NO: 1099111 - RNA, 22 nt, Human
uugcacuaggaaaaggcagcca

SEQ ID NO: 1099112 - RNA, 22 nt, Human
caguucuuauuuggccaguguc

SEQ ID NO: 1099113 - RNA, 22 nt, Human
uaaagcacauaucuuacaauaa

SEQ ID NO: 1099114 - RNA, 22 nt, Human
cauuuguaucugggcugcugug

SEQ ID NO: 1099115 - RNA, 21 nt, Human
agccuguugguuuacugcuca

SEQ ID NO: 1099116 - RNA, 19 nt, Human
acauuuaaauucagaucuc

SEQ ID NO: 1099117 - RNA, 22 nt, Human
augcugugucaggaauuugaua

SEQ ID NO: 1099118 - RNA, 22 nt, Human
aauguaugagcgugaaagcacu

SEQ ID NO: 1099119 - RNA, 22 nt, Human
auucuucacauaagugcuguac

SEQ ID NO: 1099120 - RNA, 22 nt, Human
ccauggcaauggucagucuauu

SEQ ID NO: 1099121 - RNA, 22 nt, Human
aauaacuuuuaaaagacccugg

SEQ ID NO: 1099122 - RNA, 22 nt, Human
augugaaauagcuggauaugaa

SEQ ID NO: 1099123 - RNA, 22 nt, Human
uuaaaaugaauauugauuagca

SEQ ID NO: 1099124 - RNA, 22 nt, Human
agauuuauguggucacacucag

SEQ ID NO: 1099125 - RNA, 22 nt, Human
gaauagcuuccuuuuuuccaaa

SEQ ID NO: 1099126 - RNA, 17 nt, Human
uucaaagcuuaucaagg

SEQ ID NO: 1099127 - RNA, 22 nt, Human
aaacauuugcaacucgguuugg

SEQ ID NO: 1099128 - RNA, 22 nt, Human
ugauuuccccagucuugcugcu

SEQ ID NO: 1099129 - RNA, 22 nt, Human
cuuucauaaaggaaaugaugag

SEQ ID NO: 1099130 - RNA, 22 nt, Human
uuuucagugggcaaugauguga

SEQ ID NO: 1099131 - RNA, 22 nt, Human
aaacugcugguugcuggccagc

SEQ ID NO: 1099132 - RNA, 22 nt, Human
aaugucugagucucuguauccc

SEQ ID NO: 1099133 - RNA, 22 nt, Human
cccaugagaccugguuuaaggc

SEQ ID NO: 1099134 - RNA, 22 nt, Human
aggccagcaagaaagagagucu

SEQ ID NO: 1099135 - RNA, 22 nt, Human
caggaugagguagaggcagaua

SEQ ID NO: 1099136 - RNA, 22 nt, Human
augcuuuuaugucacaugguca

SEQ ID NO: 1099137 - RNA, 22 nt, Human
uggaaauguauuugggcaugcc

SEQ ID NO: 1099138 - RNA, 22 nt, Human
gaacacaugauuauaaaugcua

SEQ ID NO: 1099139 - RNA, 22 nt, Human
auucuucacuguuucagaauga

SEQ ID NO: 1099140 - RNA, 22 nt, Human
gaggaaccaaucugugauauuc

SEQ ID NO: 1099141 - RNA, 22 nt, Human
auguuucaccaguuuuauaaga

SEQ ID NO: 1099142 - RNA, 22 nt, Human
acuguguggaccacucugaggc

SEQ ID NO: 1099143 - RNA, 22 nt, Human
uucuucaugcuguugcugcuug

SEQ ID NO: 1099144 - RNA, 20 nt, Human
auuuggcaugaaguauugau

SEQ ID NO: 1099145 - RNA, 22 nt, Human
cuguucucuggcgguggcuguu

SEQ ID NO: 1099146 - RNA, 22 nt, Human
acauugcugcauucuccuuccc

SEQ ID NO: 1099147 - RNA, 22 nt, Human
agaccaagugcaggugccacua

SEQ ID NO: 1099148 - RNA, 22 nt, Human
caaggccauaagagauacaaaa

SEQ ID NO: 1099149 - RNA, 22 nt, Human
gcuuuggaugugugccugaggu

SEQ ID NO: 1099150 - RNA, 22 nt, Human
uaaaaugaucucucauguucuu

SEQ ID NO: 1099151 - RNA, 22 nt, Human
auauaauuguucugaaguguuu

SEQ ID NO: 1099152 - RNA, 22 nt, Human
ugaaaucaaugucuucugucuc

SEQ ID NO: 1099153 - RNA, 22 nt, Human
gugcugugucuaucaggaauaa

SEQ ID NO: 1099154 - RNA, 22 nt, Human
auguuauaguuauaaaaugagg

SEQ ID NO: 1099155 - RNA, 22 nt, Human
aggccagaaaugucagggagug

SEQ ID NO: 1099156 - RNA, 22 nt, Human
gugcauuugugcaugcacaugu

SEQ ID NO: 1099157 - RNA, 22 nt, Human
uuacaagauaaccugaugcugu

SEQ ID NO: 1099158 - RNA, 23 nt, Human
uacaugcuauaauuucacccuca

SEQ ID NO: 1099159 - RNA, 22 nt, Human
aaggagaaaugguagaugugca

SEQ ID NO: 1099160 - RNA, 22 nt, Human
ugaaggccagcucuuuaucagc

SEQ ID NO: 1099161 - RNA, 22 nt, Human
agacaaauggaguaugagcaac

SEQ ID NO: 1099162 - RNA, 22 nt, Human
uacaacauuguguugcuucaua

SEQ ID NO: 1099163 - RNA, 22 nt, Human
uccaugagcuagggauucauca

SEQ ID NO: 1099164 - RNA, 22 nt, Human
cucucuguuaugcuuucaugaa

SEQ ID NO: 1099165 - RNA, 22 nt, Human
gcucaggagcucuugguggcgc

SEQ ID NO: 1099166 - RNA, 22 nt, Human
uccugagagcagcugcuuugga

SEQ ID NO: 1099167 - RNA, 22 nt, Human
auucucuuuguauaacaucuug

SEQ ID NO: 1099168 - RNA, 22 nt, Human
uuuucguuuauuugacauguaa

SEQ ID NO: 1099169 - RNA, 22 nt, Human
gcugcugucacggugcuaaggg

SEQ ID NO: 1099170 - RNA, 22 nt, Human
uuuaacagaugugaaauuuuca

SEQ ID NO: 1099171 - RNA, 22 nt, Human
agaauccuguuuuacuucauca

SEQ ID NO: 1099172 - RNA, 22 nt, Human
auagcuguuagauuggggucga

SEQ ID NO: 1099173 - RNA, 19 nt, Human
auacagauguauccaugau

SEQ ID NO: 1099174 - RNA, 22 nt, Human
uuguuugaggucacugauauuu

SEQ ID NO: 1099175 - RNA, 22 nt, Human
acaccauacucauguugguucc

SEQ ID NO: 1099176 - RNA, 22 nt, Human
agcaccugucacaagcagaagg

SEQ ID NO: 1099177 - RNA, 22 nt, Human
aaccauuugcaguuacugagac

SEQ ID NO: 1099178 - RNA, 22 nt, Human
uuuacuuuugguaaggucauuu

SEQ ID NO: 1099179 - RNA, 22 nt, Human
gaaacauaguugagacacugcu

SEQ ID NO: 1099180 - RNA, 22 nt, Human
uagcacauuguugaccagaagg

SEQ ID NO: 1099181 - RNA, 22 nt, Human
cauaauuugauaugcuugaugg

SEQ ID NO: 1099182 - RNA, 22 nt, Human
uuucaguuuccagcuuugucau

SEQ ID NO: 1099183 - RNA, 22 nt, Human
cuuaacagagagaaguguugcu

SEQ ID NO: 1099184 - RNA, 22 nt, Human
aaauauaauuucugccucaaua

SEQ ID NO: 1099185 - RNA, 22 nt, Human
gucacuguuuccuauuauauuu

SEQ ID NO: 1099186 - RNA, 22 nt, Human
aaaggccaagcaugagguggac

SEQ ID NO: 1099187 - RNA, 22 nt, Human
cccucuacagggaagcgcuuuc

SEQ ID NO: 1099188 - RNA, 22 nt, Human
uuugauaagagcugcugaaacu

SEQ ID NO: 1099189 - RNA, 22 nt, Human
ggccagagaauaugccuuacgu

SEQ ID NO: 1099190 - RNA, 22 nt, Human
aagauggagcacgagcagaagc

SEQ ID NO: 1099191 - RNA, 22 nt, Human
ucuucaucucagauuaacagga

SEQ ID NO: 1099192 - RNA, 22 nt, Human
cuucagaauccagaaucagaau

SEQ ID NO: 1099193 - RNA, 22 nt, Human
auuuccagugcacugaauagaa

SEQ ID NO: 1099194 - RNA, 22 nt, Human
gcugcugugccuggcguccugu

SEQ ID NO: 1099195 - RNA, 22 nt, Human
agaccaagacuauaaugagagg

SEQ ID NO: 1099196 - RNA, 22 nt, Human
gaacacauuagucugaguuggc

SEQ ID NO: 1099197 - RNA, 22 nt, Human
uucuucucucauagauuaaggu

SEQ ID NO: 1099198 - RNA, 22 nt, Human
uuucuagggcucuugucuucug

SEQ ID NO: 1099199 - RNA, 22 nt, Human
ucuuuggaucccaacuggcugg

SEQ ID NO: 1099200 - RNA, 22 nt, Human
gauuucuugaccccugucucag

SEQ ID NO: 1099201 - RNA, 22 nt, Human
uaucaauugggccaaaugguac

SEQ ID NO: 1099202 - RNA, 23 nt, Human
cugcccugaucuugaucuauugu

SEQ ID NO: 1099203 - RNA, 22 nt, Human
uugaaaggugaacaugaugcac

SEQ ID NO: 1099204 - RNA, 22 nt, Human
acauuuuuuagagucccacauu

SEQ ID NO: 1099205 - RNA, 22 nt, Human
uuucucugcugccugugucgau

SEQ ID NO: 1099206 - RNA, 22 nt, Human
cugcuguguuucacaccucugg

SEQ ID NO: 1099207 - RNA, 22 nt, Human
ugaaaugacaaagguuuuucuu

SEQ ID NO: 1099208 - RNA, 22 nt, Human
uuugaaugcaggacauacagaa

SEQ ID NO: 1099209 - RNA, 22 nt, Human
uucuagaugauaaaccagcagc

SEQ ID NO: 1099210 - RNA, 22 nt, Human
auccagucaaaauuaguaaggu

SEQ ID NO: 1099211 - RNA, 22 nt, Human
gauuucuucauuuguggugaau

SEQ ID NO: 1099212 - RNA, 22 nt, Human
uugaauaguuuuggauagcaua

SEQ ID NO: 1099213 - RNA, 22 nt, Human
guuuuauaggugaaauauuacu

SEQ ID NO: 1099214 - RNA, 22 nt, Human
aaggcaguacuuuauguccaua

SEQ ID NO: 1099215 - RNA, 22 nt, Human
cugcuuugauuagaagaguaca

SEQ ID NO: 1099216 - RNA, 22 nt, Human
ugcauauuguccuugauauuau

SEQ ID NO: 1099217 - RNA, 22 nt, Human
aacauucuauuuugcuaaaaca

SEQ ID NO: 1099218 - RNA, 22 nt, Human
uucucugagauagacuaagugg

SEQ ID NO: 1099219 - RNA, 22 nt, Human
auucuuauuuaaauagagucug

SEQ ID NO: 1099220 - RNA, 22 nt, Human
ucaugcuuaaaagacacuugag

SEQ ID NO: 1099221 - RNA, 22 nt, Human
ugguaaauauguccauucucuu

SEQ ID NO: 1099222 - RNA, 22 nt, Human
ccaugagcuucaacugacacag

SEQ ID NO: 1099223 - RNA, 22 nt, Human
uuuuuggguccaggcuguaucu

SEQ ID NO: 1099224 - RNA, 22 nt, Human
cucugucacuucuccagcugag

SEQ ID NO: 1099225 - RNA, 22 nt, Human
uguuagaaguuaaucacuaauu

SEQ ID NO: 1099226 - RNA, 22 nt, Human
aaggccagaguacuagaggcug

SEQ ID NO: 1099227 - RNA, 22 nt, Human
cugagcugggaguagagacucu

SEQ ID NO: 1099228 - RNA, 22 nt, Human
cuucucaguugcaagugucaga

SEQ ID NO: 1099229 - RNA, 22 nt, Human
caaugugguggcagaugucagu

SEQ ID NO: 1099230 - RNA, 22 nt, Human
auugaaagcauggauuuggauu

SEQ ID NO: 1099231 - RNA, 21 nt, Human
gauuugcagaaacuagacagg

SEQ ID NO: 1099232 - RNA, 22 nt, Human
gaaauauuguacuggagauguu

SEQ ID NO: 1099233 - RNA, 22 nt, Human
uguucuucuagauugccuuuua

SEQ ID NO: 1099234 - RNA, 20 nt, Human
uuucaagucagcaauucuca

SEQ ID NO: 1099235 - RNA, 22 nt, Human
uacuuuuuagcacagugugugc

SEQ ID NO: 1099236 - RNA, 22 nt, Human
ccucagaugucuuaaggcacug

SEQ ID NO: 1099237 - RNA, 22 nt, Human
cauuuguuaaccaguguggauu

SEQ ID NO: 1099238 - RNA, 22 nt, Human
cuuaaauuggaugaguuaaguu

SEQ ID NO: 1099239 - RNA, 23 nt, Human
acagacaacacugaugagagaaa

SEQ ID NO: 1099240 - RNA, 22 nt, Human
aguuauaaucugcuacugauau

SEQ ID NO: 1099241 - RNA, 22 nt, Human
agugcuuucuugcuccaucagu

SEQ ID NO: 1099242 - RNA, 22 nt, Human
gaccuggaggauccucuucuug

SEQ ID NO: 1099243 - RNA, 22 nt, Human
auacuguuuugugacuuaucuu

SEQ ID NO: 1099244 - RNA, 22 nt, Human
auaaaugauucagcaggaaaua

SEQ ID NO: 1099245 - RNA, 22 nt, Human
agguauaagucucauuucuguu

SEQ ID NO: 1099246 - RNA, 22 nt, Human
aauugcaacagguagacuuuuc

SEQ ID NO: 1099247 - RNA, 22 nt, Human
caguuuuugccauuaagaguaa

SEQ ID NO: 1099248 - RNA, 22 nt, Human
caguugcuggaugugcagcucu

SEQ ID NO: 1099249 - RNA, 22 nt, Human
ucauuucccuccuacaaagagg

SEQ ID NO: 1099250 - RNA, 22 nt, Human
uugaaaguccuucuugaguuac

SEQ ID NO: 1099251 - RNA, 22 nt, Human
ugcauaaagugccauaguauua

SEQ ID NO: 1099252 - RNA, 22 nt, Human
caaggccacguucugcaugcgg

SEQ ID NO: 1099253 - RNA, 17 nt, Human
ugaauucaaucugcacu

SEQ ID NO: 1099254 - RNA, 22 nt, Human
gccacaggcacuuaagggcugg

SEQ ID NO: 1099255 - RNA, 22 nt, Human
cuugauguauaaguugauaugu

SEQ ID NO: 1099256 - RNA, 22 nt, Human
gaacaucagucauaauuuaacg

SEQ ID NO: 1099257 - RNA, 22 nt, Human
auccugucaucauaguacuuga

SEQ ID NO: 1099258 - RNA, 22 nt, Human
auucuucaccugagucagucua

SEQ ID NO: 1099259 - RNA, 22 nt, Human
ugcacagugaccccuggugacu

SEQ ID NO: 1099260 - RNA, 22 nt, Human
aaucuucagugucuaaaaagca

SEQ ID NO: 1099261 - RNA, 20 nt, Human
gcaaaauaggcucuguuggu

SEQ ID NO: 1099262 - RNA, 22 nt, Human
ucugugcauuguaacaacuaaa

SEQ ID NO: 1099263 - RNA, 18 nt, Human
cucugucauaagugucau

SEQ ID NO: 1099264 - RNA, 22 nt, Human
ucuucucuccugcuuggcagaa

SEQ ID NO: 1099265 - RNA, 22 nt, Human
cuucaggauuuaggaagaugaa

SEQ ID NO: 1099266 - RNA, 22 nt, Human
agaggccaggcugcagagggau

SEQ ID NO: 1099267 - RNA, 22 nt, Human
auuuuccucaagccucuggaag

SEQ ID NO: 1099268 - RNA, 22 nt, Human
uuucauugaugggugauagaaa

SEQ ID NO: 1099269 - RNA, 22 nt, Human
ucaucuugcugccauugcuuua

SEQ ID NO: 1099270 - RNA, 22 nt, Human
uuucacaucagagguagauuag

SEQ ID NO: 1099271 - RNA, 22 nt, Human
uucuucaaaacaacacuggccu

SEQ ID NO: 1099272 - RNA, 22 nt, Human
cugcuucuccaaaguaggacuu

SEQ ID NO: 1099273 - RNA, 22 nt, Human
augacaguucuacacuuaaucu

SEQ ID NO: 1099274 - RNA, 22 nt, Human
ugaaagguagcuggccucauag

SEQ ID NO: 1099275 - RNA, 22 nt, Human
auugaaagaguuuucugcugca

SEQ ID NO: 1099276 - RNA, 22 nt, Human
ugcuucuggaaacaguggcugu

SEQ ID NO: 1099277 - RNA, 22 nt, Human
uuuugcuugagugcacaaaaug

SEQ ID NO: 1099278 - RNA, 22 nt, Human
acaagcaugggcuuugacauca

SEQ ID NO: 1099279 - RNA, 22 nt, Human
aguucuuuugugaacauaugcu

SEQ ID NO: 1099280 - RNA, 22 nt, Human
uuuccaagacuccaguucuccc

SEQ ID NO: 1099281 - RNA, 20 nt, Human
uuucacagucccuguuuccu

SEQ ID NO: 1099282 - RNA, 22 nt, Human
uucaggaugaaagugugcaaca

SEQ ID NO: 1099283 - RNA, 23 nt, Human
acagaaaguucugcuggacagag

SEQ ID NO: 1099284 - RNA, 22 nt, Human
gaucuguuucauucacagucug

SEQ ID NO: 1099285 - RNA, 22 nt, Human
uauuuccaagcugaauccaaug

SEQ ID NO: 1099286 - RNA, 22 nt, Human
guccucuggaagaugaguucuu

SEQ ID NO: 1099287 - RNA, 22 nt, Human
cucuccucugaaguggugaccc

SEQ ID NO: 1099288 - RNA, 22 nt, Human
ugucaaagccugaaucacauag

SEQ ID NO: 1099289 - RNA, 22 nt, Human
ugcugaugcuguucuguuagga

SEQ ID NO: 1099290 - RNA, 22 nt, Human
gaacacauguccuccuuggauu

SEQ ID NO: 1099291 - RNA, 22 nt, Human
augcuguguggccaccuccaug

SEQ ID NO: 1099292 - RNA, 22 nt, Human
uagacauuucugguuauugaca

SEQ ID NO: 1099293 - RNA, 23 nt, Human
uuucaaauuacucugcagaugac

SEQ ID NO: 1099294 - RNA, 22 nt, Human
gcuuuggagccuguguucugcc

SEQ ID NO: 1099295 - RNA, 20 nt, Human
ggggcugcaugcagagaaga

SEQ ID NO: 1099296 - RNA, 22 nt, Human
uacucagagucauugcccuucu

SEQ ID NO: 1099297 - RNA, 22 nt, Human
aguguguccagaaaucuguauu

SEQ ID NO: 1099298 - RNA, 22 nt, Human
aaauacuagaauucagaguuga

SEQ ID NO: 1099299 - RNA, 22 nt, Human
guuguuuugcaggauccuuaca

SEQ ID NO: 1099300 - RNA, 22 nt, Human
cacucugaugguuucuguucaa

SEQ ID NO: 1099301 - RNA, 21 nt, Human
ggcagccucuguggaagggga

SEQ ID NO: 1099302 - RNA, 22 nt, Human
caugucuguguacacaugcaca

SEQ ID NO: 1099303 - RNA, 22 nt, Human
caugaaauugcuccuuuggugc

SEQ ID NO: 1099304 - RNA, 22 nt, Human
caaggccacugcucagguuucc

SEQ ID NO: 1099305 - RNA, 20 nt, Human
ucauuguguugccaauuccc

SEQ ID NO: 1099306 - RNA, 22 nt, Human
ugugugaaggagccacuguuca

SEQ ID NO: 1099307 - RNA, 22 nt, Human
acucaggaaaugagaggcucuc

SEQ ID NO: 1099308 - RNA, 22 nt, Human
cuucuucacacuggucugaagc

SEQ ID NO: 1099309 - RNA, 22 nt, Human
aucuguuccccuaugcucucua

SEQ ID NO: 1099310 - RNA, 22 nt, Human
cagucccuaguggagcucacag

SEQ ID NO: 1099311 - RNA, 22 nt, Human
aaaguuugaaugauauauuagu

SEQ ID NO: 1099312 - RNA, 22 nt, Human
caguucuuuguggggaguucuc

SEQ ID NO: 1099313 - RNA, 20 nt, Human
uucacagaggacucagguca

SEQ ID NO: 1099314 - RNA, 22 nt, Human
aaaggccaccaacaugaagcau

SEQ ID NO: 1099315 - RNA, 20 nt, Human
ugcguguguauuuauuuucu

SEQ ID NO: 1099316 - RNA, 22 nt, Human
gaacacaucacauuuuacagug

SEQ ID NO: 1099317 - RNA, 22 nt, Human
ucuucagaggaagucagucuuu

SEQ ID NO: 1099318 - RNA, 22 nt, Human
auucuucaguauguguggauug

SEQ ID NO: 1099319 - RNA, 22 nt, Human
uucuacagacuauaacugugau

SEQ ID NO: 1099320 - RNA, 22 nt, Human
augaaacaguguguauagcaaa

SEQ ID NO: 1099321 - RNA, 22 nt, Human
uugaauaguguuuucaguauac

SEQ ID NO: 1099322 - RNA, 22 nt, Human
ugaaaugagauagauaaucagg

SEQ ID NO: 1099323 - RNA, 23 nt, Human
ccacagagcugccaauuccugug

SEQ ID NO: 1099324 - RNA, 22 nt, Human
agaggagugggaagcagugcaa

SEQ ID NO: 1099325 - RNA, 22 nt, Human
cucagaauuuagggcucugagg

SEQ ID NO: 1099326 - RNA, 22 nt, Human
uuucaguuguccuguuaauagc

SEQ ID NO: 1099327 - RNA, 22 nt, Human
acugugugacuguuauuacugu

SEQ ID NO: 1099328 - RNA, 22 nt, Human
uuuaaauuuagaagaaacacug

SEQ ID NO: 1099329 - RNA, 22 nt, Human
ccaggcugcagucaaggggcau

SEQ ID NO: 1099330 - RNA, 19 nt, Human
acaaaugauguugcacuga

SEQ ID NO: 1099331 - RNA, 22 nt, Human
auacaaagacaaaucucaaucu

SEQ ID NO: 1099332 - RNA, 22 nt, Human
acaauauuguacccagaaguuu

SEQ ID NO: 1099333 - RNA, 22 nt, Human
uaaggccaggcuguggucggca

SEQ ID NO: 1099334 - RNA, 22 nt, Human
aucugcuugaaugagcaacagg

SEQ ID NO: 1099335 - RNA, 22 nt, Human
caacugugaauuuuaugauacc

SEQ ID NO: 1099336 - RNA, 20 nt, Human
cuucuucaguaguuuguucu

SEQ ID NO: 1099337 - RNA, 23 nt, Human
aaggccagaauuucaauggugcc

SEQ ID NO: 1099338 - RNA, 22 nt, Human
uuuugugagcccauaaaugcca

SEQ ID NO: 1099339 - RNA, 22 nt, Human
uccauuuuguagguaugcuaca

SEQ ID NO: 1099340 - RNA, 22 nt, Human
agugcuuuccuucuugugacau

SEQ ID NO: 1099341 - RNA, 22 nt, Human
auugugcaaauauuaucuguag

SEQ ID NO: 1099342 - RNA, 22 nt, Human
agucucugcugguugugccuau

SEQ ID NO: 1099343 - RNA, 22 nt, Human
aucuacauaaaacgaauacaua

SEQ ID NO: 1099344 - RNA, 22 nt, Human
gauuucuuuagguguaauagug

SEQ ID NO: 1099345 - RNA, 22 nt, Human
aauaacuucaguucuuacauua

SEQ ID NO: 1099346 - RNA, 22 nt, Human
acagucauuagauacaaugucu

SEQ ID NO: 1099347 - RNA, 22 nt, Human
ggguacuuaauauuuacggggu

SEQ ID NO: 1099348 - RNA, 22 nt, Human
uuaucauugucgcagucuaauu

SEQ ID NO: 1099349 - RNA, 22 nt, Human
uuauacauguguuuugagauga

SEQ ID NO: 1099350 - RNA, 22 nt, Human
ugaaaugagcauuuauucuuua

SEQ ID NO: 1099351 - RNA, 22 nt, Human
aucugucuugccuugcauauuu

SEQ ID NO: 1099352 - RNA, 22 nt, Human
uucagcaagaccaccauguacc

SEQ ID NO: 1099353 - RNA, 20 nt, Human
aguuauaguaucuagccaug

SEQ ID NO: 1099354 - RNA, 22 nt, Human
ucacugcucuccaauguggagu

SEQ ID NO: 1099355 - RNA, 22 nt, Human
agugcugucaguuuuauagaua

SEQ ID NO: 1099356 - RNA, 22 nt, Human
uguugauuaguguuuagacuua

SEQ ID NO: 1099357 - RNA, 22 nt, Human
caagauggguguugugaugguu

SEQ ID NO: 1099358 - RNA, 22 nt, Human
uuuuagcacuaagugauaugcu

SEQ ID NO: 1099359 - RNA, 22 nt, Human
agaaaugaaaccaaagccuaga

SEQ ID NO: 1099360 - RNA, 22 nt, Human
ccuccuuuccuguuuuccugag

SEQ ID NO: 1099361 - RNA, 22 nt, Human
aaauaguuguuuggaucaauaa

SEQ ID NO: 1099362 - RNA, 22 nt, Human
uugguuuacuaggauucaaauu

SEQ ID NO: 1099363 - RNA, 20 nt, Human
caguccaaucagaggccacc

SEQ ID NO: 1099364 - RNA, 22 nt, Human
ucucaggaagugauauugagac

SEQ ID NO: 1099365 - RNA, 22 nt, Human
acacagccgugaaucugcuucu

SEQ ID NO: 1099366 - RNA, 22 nt, Human
uucaggauccccuugaugggcu

SEQ ID NO: 1099367 - RNA, 22 nt, Human
uucucagaggagucgggagcug

SEQ ID NO: 1099368 - RNA, 22 nt, Human
ucugcucuguggcuucagcuaa

SEQ ID NO: 1099369 - RNA, 22 nt, Human
uugugaguagugccgcaauaaa

SEQ ID NO: 1099370 - RNA, 22 nt, Human
aaggcaguuaauuuggcuagaa

SEQ ID NO: 1099371 - RNA, 22 nt, Human
ugcugaugaguccuucuaucgc

SEQ ID NO: 1099372 - RNA, 19 nt, Human
acauauguggauauacaug

SEQ ID NO: 1099373 - RNA, 20 nt, Human
ucacaucuggcagcugauga

SEQ ID NO: 1099374 - RNA, 22 nt, Human
uuaaauauuuucagcaggguca

SEQ ID NO: 1099375 - RNA, 22 nt, Human
ucuccuccuuuuuucaacauag

SEQ ID NO: 1099376 - RNA, 22 nt, Human
aguggcagagugcacucaggca

SEQ ID NO: 1099377 - RNA, 22 nt, Human
agagacagaggcaauauagcuu

SEQ ID NO: 1099378 - RNA, 22 nt, Human
uugaaaguuuauggagucugca

SEQ ID NO: 1099379 - RNA, 19 nt, Human
acauuuagaauguacuugc

SEQ ID NO: 1099380 - RNA, 22 nt, Human
uugaaagaggcaaaguuugauc

SEQ ID NO: 1099381 - RNA, 22 nt, Human
guaugaaaauuguaaaguucuu

SEQ ID NO: 1099382 - RNA, 22 nt, Human
gauaaugaugacaaugacaacc

SEQ ID NO: 1099383 - RNA, 18 nt, Human
ugucauaauauaucaccu

SEQ ID NO: 1099384 - RNA, 22 nt, Human
gucauauacacugcauguaauc

SEQ ID NO: 1099385 - RNA, 20 nt, Human
acaggggcagcacaauaaug

SEQ ID NO: 1099386 - RNA, 22 nt, Human
augcuuuuccaggagaaauaua

SEQ ID NO: 1099387 - RNA, 22 nt, Human
auguggaggaaaugaguguaca

SEQ ID NO: 1099388 - RNA, 22 nt, Human
cagaguucaaagccugcuggga

SEQ ID NO: 1099389 - RNA, 22 nt, Human
uuugacauuggcuuauucuguu

SEQ ID NO: 1099390 - RNA, 22 nt, Human
uucucagauccaucagaagucc

SEQ ID NO: 1099391 - RNA, 22 nt, Human
cagaguggcgacccccucagcu

SEQ ID NO: 1099392 - RNA, 22 nt, Human
ucugcugugauuugcuaccugu

SEQ ID NO: 1099393 - RNA, 22 nt, Human
uggcuguguuaccacuucaugu

SEQ ID NO: 1099394 - RNA, 22 nt, Human
ccaggauggggagcagauagaa

SEQ ID NO: 1099395 - RNA, 22 nt, Human
acaugauuuuuaaagagauaau

SEQ ID NO: 1099396 - RNA, 22 nt, Human
cauuuguagcuauuuacuguau

SEQ ID NO: 1099397 - RNA, 22 nt, Human
ucugucaaaaguuuucaauaaa

SEQ ID NO: 1099398 - RNA, 22 nt, Human
cuguaaauaugaagaauauaug

SEQ ID NO: 1099399 - RNA, 22 nt, Human
uccaugucuucaugugucuaac

SEQ ID NO: 1099400 - RNA, 22 nt, Human
cugcugugccucuuuucacgug

SEQ ID NO: 1099401 - RNA, 21 nt, Human
gugcuuuuccuuaauguucuu

SEQ ID NO: 1099402 - RNA, 22 nt, Human
ugucaagucucugaaugaaaug

SEQ ID NO: 1099403 - RNA, 22 nt, Human
uaucuaaauggaauauuccaga

SEQ ID NO: 1099404 - RNA, 22 nt, Human
uucaggaugcagagguuguagu

SEQ ID NO: 1099405 - RNA, 22 nt, Human
cucaggauccaucuccugcccu

SEQ ID NO: 1099406 - RNA, 22 nt, Human
auugcuguggaaauauaagaug

SEQ ID NO: 1099407 - RNA, 22 nt, Human
gucaggauuauaauccccaugg

SEQ ID NO: 1099408 - RNA, 23 nt, Human
aaauaugucugagggcaaagaau

SEQ ID NO: 1099409 - RNA, 22 nt, Human
gaaacauauuaauccagugaaa

SEQ ID NO: 1099410 - RNA, 21 nt, Human
uuugaaagcuacaucuauagc

SEQ ID NO: 1099411 - RNA, 22 nt, Human
caacugcugacaccaucacucc

SEQ ID NO: 1099412 - RNA, 22 nt, Human
uguuuuaaucucccauugcucu

SEQ ID NO: 1099413 - RNA, 22 nt, Human
uaaauuaugucacaugacucug

SEQ ID NO: 1099414 - RNA, 22 nt, Human
cucagaagaacaaaggcucuac

SEQ ID NO: 1099415 - RNA, 22 nt, Human
ggagcuguucaggacugcuuca

SEQ ID NO: 1099416 - RNA, 17 nt, Human
ggcagcugugugcaugc

SEQ ID NO: 1099417 - RNA, 23 nt, Human
ucuguacaauugagaagagaaca

SEQ ID NO: 1099418 - RNA, 22 nt, Human
uucugucaugcucauguaauug

SEQ ID NO: 1099419 - RNA, 22 nt, Human
gcuggcuugauaguuucugcuu

SEQ ID NO: 1099420 - RNA, 22 nt, Human
cucacugacgaggaagcugaga

SEQ ID NO: 1099421 - RNA, 22 nt, Human
uacuaucucuucuaacuucaga

SEQ ID NO: 1099422 - RNA, 22 nt, Human
ucucuguaguugggcagcugcu

SEQ ID NO: 1099423 - RNA, 22 nt, Human
cucuucuugaaagaggaauuca

SEQ ID NO: 1099424 - RNA, 23 nt, Human
ucagagagcuguugagagcugcc

SEQ ID NO: 1099425 - RNA, 21 nt, Human
uaugaacaugaccaauagucc

SEQ ID NO: 1099426 - RNA, 21 nt, Human
uugaccaagggugcgugcucc

SEQ ID NO: 1099427 - RNA, 22 nt, Human
uuagaacuuaaacuucagaaag

SEQ ID NO: 1099428 - RNA, 22 nt, Human
cauugcuuccuaugucccuucu

SEQ ID NO: 1099429 - RNA, 22 nt, Human
uuugaaauuaagauauugucca

SEQ ID NO: 1099430 - RNA, 22 nt, Human
gucaggauguuuauucuccagu

SEQ ID NO: 1099431 - RNA, 22 nt, Human
ucuuagaaguucauguuccagc

SEQ ID NO: 1099432 - RNA, 22 nt, Human
aaugagacacgugaagcagaug

SEQ ID NO: 1099433 - RNA, 22 nt, Human
gucuucaacaauaacuaccacu

SEQ ID NO: 1099434 - RNA, 22 nt, Human
uuucauugcagagucugugugc

SEQ ID NO: 1099435 - RNA, 22 nt, Human
ucauuuguugcuguuaccugag

SEQ ID NO: 1099436 - RNA, 23 nt, Human
uugcauagacauccucauagauu

SEQ ID NO: 1099437 - RNA, 22 nt, Human
uugagaagaggcuuuguaggaa

SEQ ID NO: 1099438 - RNA, 22 nt, Human
auuaaauuggaucugcauaguu

SEQ ID NO: 1099439 - RNA, 22 nt, Human
cccaugagauucugaauuuggc

SEQ ID NO: 1099440 - RNA, 22 nt, Human
cuuuuccacugagccucacaaa

SEQ ID NO: 1099441 - RNA, 22 nt, Human
auguuuccgugagcauccuuga

SEQ ID NO: 1099442 - RNA, 22 nt, Human
cuggcuuucucugugguguuca

SEQ ID NO: 1099443 - RNA, 22 nt, Human
gauggcagguaguggucucauc

SEQ ID NO: 1099444 - RNA, 22 nt, Human
ggcucagagaccugcgaucuga

SEQ ID NO: 1099445 - RNA, 22 nt, Human
uccucagaaaccccugugaggu

SEQ ID NO: 1099446 - RNA, 22 nt, Human
aucaggaugacuauaaggcugc

SEQ ID NO: 1099447 - RNA, 22 nt, Human
auugcuguaaauuaucuuauua

SEQ ID NO: 1099448 - RNA, 21 nt, Human
ucauuugugaucugauuucca

SEQ ID NO: 1099449 - RNA, 19 nt, Human
uucuccaggcugcagaggg

SEQ ID NO: 1099450 - RNA, 22 nt, Human
uuauuuucuccucagaaagugg

SEQ ID NO: 1099451 - RNA, 22 nt, Human
cuacagacccaccuuggaagaa

SEQ ID NO: 1099452 - RNA, 22 nt, Human
aaaguguugauaugugacaucc

SEQ ID NO: 1099453 - RNA, 22 nt, Human
cugcuguggugucaagcaucuc

SEQ ID NO: 1099454 - RNA, 22 nt, Human
uuuguuaauucuuauguuagag

SEQ ID NO: 1099455 - RNA, 22 nt, Human
auuccaguuggguucuaauaca

SEQ ID NO: 1099456 - RNA, 22 nt, Human
caaauaguaugagcaaugauuc

SEQ ID NO: 1099457 - RNA, 22 nt, Human
uuggaauucaaguuguagcuua

SEQ ID NO: 1099458 - RNA, 20 nt, Human
ugugaaagcaguagaaugac

SEQ ID NO: 1099459 - RNA, 22 nt, Human
uugcucagcacuggagccagcu

SEQ ID NO: 1099460 - RNA, 22 nt, Human
aauauccacacugugucccugc

SEQ ID NO: 1099461 - RNA, 17 nt, Human
uuuagaauacaauguuu

SEQ ID NO: 1099462 - RNA, 22 nt, Human
augcuguggccagaguucaacu

SEQ ID NO: 1099463 - RNA, 22 nt, Human
uuucauaauauccagagauuuu

SEQ ID NO: 1099464 - RNA, 22 nt, Human
uauucacaggcacgaaauauug

SEQ ID NO: 1099465 - RNA, 22 nt, Human
uacauucagcaaaagaaugguu

SEQ ID NO: 1099466 - RNA, 22 nt, Human
ucacugcugcugccaugaugga

SEQ ID NO: 1099467 - RNA, 22 nt, Human
cugcuguguuccuccugcaucu

SEQ ID NO: 1099468 - RNA, 22 nt, Human
uauauguaagcuauguaagagu

SEQ ID NO: 1099469 - RNA, 22 nt, Human
aauacugucuuucacagauauu

SEQ ID NO: 1099470 - RNA, 22 nt, Human
aaaggaagauugagcuuuucca

SEQ ID NO: 1099471 - RNA, 22 nt, Human
cauuuuaagaugaccugguuuc

SEQ ID NO: 1099472 - RNA, 22 nt, Human
guaguuuucugaaaauuacuuu

SEQ ID NO: 1099473 - RNA, 22 nt, Human
auugaaagguuuugagcagaua

SEQ ID NO: 1099474 - RNA, 22 nt, Human
cugagacuuucaugugcuuuua

SEQ ID NO: 1099475 - RNA, 22 nt, Human
aucuuucuauuucuaaaaacua

SEQ ID NO: 1099476 - RNA, 22 nt, Human
uuuagaaguucacacauuuaaa

SEQ ID NO: 1099477 - RNA, 23 nt, Human
auucuucauuaucuucuagaaaa

SEQ ID NO: 1099478 - RNA, 22 nt, Human
uugaaaguuaucuagauucuga

SEQ ID NO: 1099479 - RNA, 22 nt, Human
gcaucuaauccaguccagcauc

SEQ ID NO: 1099480 - RNA, 22 nt, Human
auucaaguggcugcuauguuaa

SEQ ID NO: 1099481 - RNA, 22 nt, Human
cuuguaauuauaauguacuguu

SEQ ID NO: 1099482 - RNA, 22 nt, Human
gauuuuaauuauaggagguccu

SEQ ID NO: 1099483 - RNA, 22 nt, Human
cagucuuuguucccauuacuga

SEQ ID NO: 1099484 - RNA, 22 nt, Human
ucucccaggcugcccuguggac

SEQ ID NO: 1099485 - RNA, 22 nt, Human
aauucuguuacuaaugugaugu

SEQ ID NO: 1099486 - RNA, 22 nt, Human
uuagccauauagaaaaagagcu

SEQ ID NO: 1099487 - RNA, 22 nt, Human
aacuacauuguccuuucugaag

SEQ ID NO: 1099488 - RNA, 22 nt, Human
aagauuauuuaagacaggaacc

SEQ ID NO: 1099489 - RNA, 22 nt, Human
cucugaaagaguuuaguauuau

SEQ ID NO: 1099490 - RNA, 22 nt, Human
augaggcaaucaugguccaguu

SEQ ID NO: 1099491 - RNA, 22 nt, Human
gucauucuuaacaacucaguag

SEQ ID NO: 1099492 - RNA, 22 nt, Human
ugagauguaagguaugcuuacu

SEQ ID NO: 1099493 - RNA, 22 nt, Human
cuguggaaaauuuguauguaau

SEQ ID NO: 1099494 - RNA, 22 nt, Human
ugcacauuaguguuugagaugc

SEQ ID NO: 1099495 - RNA, 22 nt, Human
auauaauacaaccugcuaagug

SEQ ID NO: 1099496 - RNA, 22 nt, Human
guucuucaucauuaacacucug

SEQ ID NO: 1099497 - RNA, 22 nt, Human
agugauggugagugagaagcuc

SEQ ID NO: 1099498 - RNA, 22 nt, Human
uugcauuuaaguagauguuaca

SEQ ID NO: 1099499 - RNA, 22 nt, Human
guucuucacauuucauugagga

SEQ ID NO: 1099500 - RNA, 22 nt, Human
aucauuuuuaagagacucuucu

SEQ ID NO: 1099501 - RNA, 22 nt, Human
caaggccaaagggccacuguca

SEQ ID NO: 1099502 - RNA, 22 nt, Human
aggggcucaaagugugcaggga

SEQ ID NO: 1099503 - RNA, 23 nt, Human
uuugaaguugacugccuuccaga

SEQ ID NO: 1099504 - RNA, 22 nt, Human
uuagccauuaauguccugugca

SEQ ID NO: 1099505 - RNA, 22 nt, Human
uucuucagucccacuagccaca

SEQ ID NO: 1099506 - RNA, 22 nt, Human
uuagccauggacugaauugacu

SEQ ID NO: 1099507 - RNA, 22 nt, Human
ugaaagcagcaccaauaccauu

SEQ ID NO: 1099508 - RNA, 22 nt, Human
uugcuuugccaccagaagucua

SEQ ID NO: 1099509 - RNA, 22 nt, Human
uucaggauuguguuuuuccuga

SEQ ID NO: 1099510 - RNA, 22 nt, Human
augcuacagcaucucucaucag

SEQ ID NO: 1099511 - RNA, 22 nt, Human
cuguguuugaugagaagccacc

SEQ ID NO: 1099512 - RNA, 22 nt, Human
gaaaggcaguacagcugagccu

SEQ ID NO: 1099513 - RNA, 21 nt, Human
aaaggccauaaucacggagca

SEQ ID NO: 1099514 - RNA, 21 nt, Human
ccauaccuaccucaccugguu

SEQ ID NO: 1099515 - RNA, 22 nt, Human
gaccauuugcuaguaaauugca

SEQ ID NO: 1099516 - RNA, 22 nt, Human
ucagugugaguaccaugcucag

SEQ ID NO: 1099517 - RNA, 22 nt, Human
uuccagcaggcagacaggagau

SEQ ID NO: 1099518 - RNA, 22 nt, Human
ucuuuccauggccacacagucu

SEQ ID NO: 1099519 - RNA, 22 nt, Human
uuguaaaugaccuuuucuaauu

SEQ ID NO: 1099520 - RNA, 22 nt, Human
auaucaguaucuauguauuugu

SEQ ID NO: 1099521 - RNA, 22 nt, Human
caaaugauagagccgauuauca

SEQ ID NO: 1099522 - RNA, 22 nt, Human
uagaagcaguaauagaaauagg

SEQ ID NO: 1099523 - RNA, 22 nt, Human
uuagccauuaaauuacaaggug

SEQ ID NO: 1099524 - RNA, 22 nt, Human
gcaaguuauuuccauuuaaagc

SEQ ID NO: 1099525 - RNA, 22 nt, Human
ucauuucuccgaccugcugucc

SEQ ID NO: 1099526 - RNA, 22 nt, Human
uggaaauauacaaugugucucu

SEQ ID NO: 1099527 - RNA, 22 nt, Human
aaaguucuuucucuuauuuggu

SEQ ID NO: 1099528 - RNA, 22 nt, Human
uuucacaagacagcuacuguug

SEQ ID NO: 1099529 - RNA, 22 nt, Human
uucauacaaugggauauuauga

SEQ ID NO: 1099530 - RNA, 22 nt, Human
gggagcugaauggcaauggaga

SEQ ID NO: 1099531 - RNA, 21 nt, Human
cgcagagcgaacuugcggcgc

SEQ ID NO: 1099532 - RNA, 22 nt, Human
auaucaaacgaaguuauuuuaa

SEQ ID NO: 1099533 - RNA, 22 nt, Human
aggaugaauaacugaaauggug

SEQ ID NO: 1099534 - RNA, 22 nt, Human
uuuugaauaauucagaaacagc

SEQ ID NO: 1099535 - RNA, 22 nt, Human
uugcauuugagaaaguucuccu

SEQ ID NO: 1099536 - RNA, 21 nt, Human
ucuagaauccuguauaagacu

SEQ ID NO: 1099537 - RNA, 23 nt, Human
uguugaaguaacuguuacauaga

SEQ ID NO: 1099538 - RNA, 22 nt, Human
gaaacugugaggaucuuaacuu

SEQ ID NO: 1099539 - RNA, 22 nt, Human
aguuugaauugaaaugcagaug

SEQ ID NO: 1099540 - RNA, 22 nt, Human
cugcugugcaacauugcaccua

SEQ ID NO: 1099541 - RNA, 22 nt, Human
gaggccaaucaauagggcaaua

SEQ ID NO: 1099542 - RNA, 22 nt, Human
cacucaggcugugucaggagga

SEQ ID NO: 1099543 - RNA, 22 nt, Human
acauuuagaguucuuuacucca

SEQ ID NO: 1099544 - RNA, 22 nt, Human
ggagcugugcagugacuacaga

SEQ ID NO: 1099545 - RNA, 22 nt, Human
uagugcuuaacacaaagugauu

SEQ ID NO: 1099546 - RNA, 22 nt, Human
uuugagauggagucuugcucug

SEQ ID NO: 1099547 - RNA, 22 nt, Human
aguaccaugcuuccugacuggu

SEQ ID NO: 1099548 - RNA, 22 nt, Human
cuucucagaggccagaagcuau

SEQ ID NO: 1099549 - RNA, 22 nt, Human
ucauuuguucucauucucuacu

SEQ ID NO: 1099550 - RNA, 19 nt, Human
gacagugcaguuguaguac

SEQ ID NO: 1099551 - RNA, 22 nt, Human
aggcacaggccucagcacccag

SEQ ID NO: 1099552 - RNA, 22 nt, Human
uauguacuaacuuucauucuag

SEQ ID NO: 1099553 - RNA, 22 nt, Human
cuugcacacauguacaugugua

SEQ ID NO: 1099554 - RNA, 22 nt, Human
uugguuuagagagugugguuac

SEQ ID NO: 1099555 - RNA, 22 nt, Human
cucuucuuuaguccagaccauc

SEQ ID NO: 1099556 - RNA, 22 nt, Human
uuugacauggaauaacucauuu

SEQ ID NO: 1099557 - RNA, 22 nt, Human
uucuuucucaacaugaauguuu

SEQ ID NO: 1099558 - RNA, 22 nt, Human
uauguacaugauuucauuugcu

SEQ ID NO: 1099559 - RNA, 20 nt, Human
cugcugugauucccuccucc

SEQ ID NO: 1099560 - RNA, 22 nt, Human
ugcauaguucuccuuccuccuc

SEQ ID NO: 1099561 - RNA, 22 nt, Human
gugguaauuuaauccuacacug

SEQ ID NO: 1099562 - RNA, 22 nt, Human
uuuccaagagcuuauuucugaa

SEQ ID NO: 1099563 - RNA, 22 nt, Human
agauggaguuaguaccagaguc

SEQ ID NO: 1099564 - RNA, 22 nt, Human
uaauuauucuagucacauagca

SEQ ID NO: 1099565 - RNA, 18 nt, Human
ugugaacacauuuuucug

SEQ ID NO: 1099566 - RNA, 22 nt, Human
auguuagaaggaauguuaaaag

SEQ ID NO: 1099567 - RNA, 22 nt, Human
gaaggccauuagagccugugcc

SEQ ID NO: 1099568 - RNA, 22 nt, Human
acaauacuuaccaauguuuuug

SEQ ID NO: 1099569 - RNA, 22 nt, Human
caugauuuugucuuguguuaau

SEQ ID NO: 1099570 - RNA, 22 nt, Human
acauauauuacuaguaaagaca

SEQ ID NO: 1099571 - RNA, 21 nt, Human
uuagaaagcucacuacaguua

SEQ ID NO: 1099572 - RNA, 22 nt, Human
cuuuggcagccucugcuauuga

SEQ ID NO: 1099573 - RNA, 22 nt, Human
uauacacaaggugugcauuugu

SEQ ID NO: 1099574 - RNA, 19 nt, Human
ugccuggacaaaugugggg

SEQ ID NO: 1099575 - RNA, 22 nt, Human
aguggacucuucccagugcuug

SEQ ID NO: 1099576 - RNA, 22 nt, Human
uugugguuaaccgcacauuuuu

SEQ ID NO: 1099577 - RNA, 21 nt, Human
uucucagaucgaguagugaga

SEQ ID NO: 1099578 - RNA, 22 nt, Human
cuacaaugacagaauugaguag

SEQ ID NO: 1099579 - RNA, 22 nt, Human
uuuuagauaguuuaacugcacu

SEQ ID NO: 1099580 - RNA, 22 nt, Human
ugaaagguuauuuaggucugcu

SEQ ID NO: 1099581 - RNA, 16 nt, Human
uguaugaacgucucca

SEQ ID NO: 1099582 - RNA, 22 nt, Human
ugacaguuaagguauacauuca

SEQ ID NO: 1099583 - RNA, 22 nt, Human
gaacacauuucucugacuguag

SEQ ID NO: 1099584 - RNA, 22 nt, Human
uagaaaugaauguuuaaaaguc

SEQ ID NO: 1099585 - RNA, 22 nt, Human
cauugcuguuaauugucucuag

SEQ ID NO: 1099586 - RNA, 22 nt, Human
auuacaauaagguuuauuugua

SEQ ID NO: 1099587 - RNA, 22 nt, Human
aaaaugacauuccagugauauu

SEQ ID NO: 1099588 - RNA, 20 nt, Human
agcauuugaaauaugacuau

SEQ ID NO: 1099589 - RNA, 22 nt, Human
uggaaauacuugccauaaaacu

SEQ ID NO: 1099590 - RNA, 22 nt, Human
augcugugagugugccgcagag

SEQ ID NO: 1099591 - RNA, 22 nt, Human
gcagagcuccccaagacaccaa

SEQ ID NO: 1099592 - RNA, 22 nt, Human
cacaugcaucugucauguuugg

SEQ ID NO: 1099593 - RNA, 22 nt, Human
caauaguucgguccugaaggcc

SEQ ID NO: 1099594 - RNA, 22 nt, Human
guagccauuggcaaugaagccu

SEQ ID NO: 1099595 - RNA, 22 nt, Human
augaggcaucugcagucacuag

SEQ ID NO: 1099596 - RNA, 22 nt, Human
aaaaauaggucaaccguguaug

SEQ ID NO: 1099597 - RNA, 20 nt, Human
uccaugaguuagagacuaua

SEQ ID NO: 1099598 - RNA, 22 nt, Human
uuuguuaaauauuuauugagug

SEQ ID NO: 1099599 - RNA, 22 nt, Human
cuuugaagagauuacugugcuc

SEQ ID NO: 1099600 - RNA, 22 nt, Human
uugaauaggacucagcagugau

SEQ ID NO: 1099601 - RNA, 22 nt, Human
caggauggagaguuguugguug

SEQ ID NO: 1099602 - RNA, 22 nt, Human
gcaagcugcucuuauguggagg

SEQ ID NO: 1099603 - RNA, 22 nt, Human
agauauauuuaagguaauaagu

SEQ ID NO: 1099604 - RNA, 22 nt, Human
cugcucuagagagcauuaguca

SEQ ID NO: 1099605 - RNA, 22 nt, Human
uucaguaaaacacugcaauguc

SEQ ID NO: 1099606 - RNA, 22 nt, Human
uaguuaaaauaauggagauguu

SEQ ID NO: 1099607 - RNA, 22 nt, Human
gcauguguggaggagaugugcu

SEQ ID NO: 1099608 - RNA, 22 nt, Human
aaggcaguuugggccaccaucu

SEQ ID NO: 1099609 - RNA, 22 nt, Human
uauuucuaagagauaucuguac

SEQ ID NO: 1099610 - RNA, 22 nt, Human
cacucaggguacaauggagggc

SEQ ID NO: 1099611 - RNA, 22 nt, Human
gaaucucaaggcuugugaggau

SEQ ID NO: 1099612 - RNA, 22 nt, Human
auacauacauguaugcacauac

SEQ ID NO: 1099613 - RNA, 22 nt, Human
ucuucacaggagccugccugcc

SEQ ID NO: 1099614 - RNA, 22 nt, Human
uuugcagugauucuugcaguga

SEQ ID NO: 1099615 - RNA, 21 nt, Human
gcugcaucaaucuacccaggg

SEQ ID NO: 1099616 - RNA, 22 nt, Human
uugacacaguuuucucauuaag

SEQ ID NO: 1099617 - RNA, 23 nt, Human
uuucuucagaagccuugcgaggc

SEQ ID NO: 1099618 - RNA, 22 nt, Human
gacuucuauuaauaccucuacu

SEQ ID NO: 1099619 - RNA, 22 nt, Human
guuuucaaggggauuuaacuga

SEQ ID NO: 1099620 - RNA, 22 nt, Human
cuuugcaaacgauuaccacaug

SEQ ID NO: 1099621 - RNA, 21 nt, Human
auaagcaugcugauuacauuu

SEQ ID NO: 1099622 - RNA, 22 nt, Human
agaccuggauuccaauccuacc

SEQ ID NO: 1099623 - RNA, 22 nt, Human
cucacuguuuaauagcuggauc

SEQ ID NO: 1099624 - RNA, 18 nt, Human
acaaaugugucacaggaa

SEQ ID NO: 1099625 - RNA, 21 nt, Human
uucucagagucuauuacaguu

SEQ ID NO: 1099626 - RNA, 22 nt, Human
auguuuccagguucuuccuaug

SEQ ID NO: 1099627 - RNA, 22 nt, Human
acugauuacacgaguucugacu

SEQ ID NO: 1099628 - RNA, 22 nt, Human
guuuauaaggcccaauauuucu

SEQ ID NO: 1099629 - RNA, 23 nt, Human
uggagcugacagucagagggagg

SEQ ID NO: 1099630 - RNA, 19 nt, Human
uucacaauuaugaaauuag

SEQ ID NO: 1099631 - RNA, 19 nt, Human
gcuuuggagggagguucua

SEQ ID NO: 1099632 - RNA, 22 nt, Human
uaucuguuugcucacagguguu

SEQ ID NO: 1099633 - RNA, 22 nt, Human
cuuuccaagaaugcagauaccu

SEQ ID NO: 1099634 - RNA, 22 nt, Human
cauuuguaguaucuguuuauau

SEQ ID NO: 1099635 - RNA, 22 nt, Human
cccauucauccucgcuuccuuc

SEQ ID NO: 1099636 - RNA, 22 nt, Human
ucuacuauguuucuuaaauaga

SEQ ID NO: 1099637 - RNA, 22 nt, Human
ucuucagauaaagggagaguau

SEQ ID NO: 1099638 - RNA, 17 nt, Human
ucaggauguagcaguag

SEQ ID NO: 1099639 - RNA, 22 nt, Human
agagggagcccagucauagcug

SEQ ID NO: 1099640 - RNA, 18 nt, Human
gagucuuuguuacugcug

SEQ ID NO: 1099641 - RNA, 22 nt, Human
uggaguucucaggugagggcuu

SEQ ID NO: 1099642 - RNA, 22 nt, Human
uucuucaguuugguaaauguaa

SEQ ID NO: 1099643 - RNA, 22 nt, Human
uuuuccagauuggacuuagucc

SEQ ID NO: 1099644 - RNA, 22 nt, Human
ucuagaauuuugccauauagcu

SEQ ID NO: 1099645 - RNA, 21 nt, Human
ucacuagugccuucugucauu

SEQ ID NO: 1099646 - RNA, 22 nt, Human
ccuugcugcgugcuagcacaga

SEQ ID NO: 1099647 - RNA, 22 nt, Human
cuguggaauugaugcuuagugu

SEQ ID NO: 1099648 - RNA, 22 nt, Human
uacuuucuguccuucuguuaaa

SEQ ID NO: 1099649 - RNA, 22 nt, Human
uuaggaguccagaugucuuggg

SEQ ID NO: 1099650 - RNA, 22 nt, Human
auuuagcaaaaaaugaugaagc

SEQ ID NO: 1099651 - RNA, 22 nt, Human
ccuugcguuuuacagcuucuag

SEQ ID NO: 1099652 - RNA, 22 nt, Human
auacaacuuuacaugcaauucc

SEQ ID NO: 1099653 - RNA, 21 nt, Human
uaaggccaagucuauuucugu

SEQ ID NO: 1099654 - RNA, 22 nt, Human
aucauuacuccuguaaaauugu

SEQ ID NO: 1099655 - RNA, 22 nt, Human
gcugucccgcugacuuccagcu

SEQ ID NO: 1099656 - RNA, 22 nt, Human
gcauucuuuuuaggagguuccu

SEQ ID NO: 1099657 - RNA, 22 nt, Human
cauaauuuuuuuaagucagaac

SEQ ID NO: 1099658 - RNA, 22 nt, Human
cugcugugagcacuccagccug

SEQ ID NO: 1099659 - RNA, 22 nt, Human
cucuucuugccugaugaggcag

SEQ ID NO: 1099660 - RNA, 22 nt, Human
ugcauguguguguauuuauaaa

SEQ ID NO: 1099661 - RNA, 22 nt, Human
uucacagacauugcagacugaa

SEQ ID NO: 1099662 - RNA, 22 nt, Human
ucaucucaaaacccaaggggca

SEQ ID NO: 1099663 - RNA, 22 nt, Human
ucacaauuuggauacagcuaug

SEQ ID NO: 1099664 - RNA, 22 nt, Human
ugaaagguuaaaaguaguauug

SEQ ID NO: 1099665 - RNA, 22 nt, Human
aucaaauauaauaauuuucgcu

SEQ ID NO: 1099666 - RNA, 22 nt, Human
auuacaaucgagagaaacaaau

SEQ ID NO: 1099667 - RNA, 22 nt, Human
cccuuagcucaauuucuugccc

SEQ ID NO: 1099668 - RNA, 19 nt, Human
ucaucucacagggccuggc

SEQ ID NO: 1099669 - RNA, 22 nt, Human
uccaugagaacccuuggagaua

SEQ ID NO: 1099670 - RNA, 22 nt, Human
gaggggcagagguagagaacaa

SEQ ID NO: 1099671 - RNA, 22 nt, Human
agaaguuguagguuugcauauu

SEQ ID NO: 1099672 - RNA, 22 nt, Human
aucugccugcaguggagguggg

SEQ ID NO: 1099673 - RNA, 22 nt, Human
uuacaagcagcuacauaucaca

SEQ ID NO: 1099674 - RNA, 22 nt, Human
ucauauaaguuuaaaacuaucu

SEQ ID NO: 1099675 - RNA, 17 nt, Human
aggccagaugaggcaag

SEQ ID NO: 1099676 - RNA, 22 nt, Human
uagcauuucccaaaugcauuug

SEQ ID NO: 1099677 - RNA, 22 nt, Human
cauucauuuaugaaauaucuau

SEQ ID NO: 1099678 - RNA, 22 nt, Human
uggggcucaccuaggcuggaag

SEQ ID NO: 1099679 - RNA, 22 nt, Human
agaaaacuugucacagcucuca

SEQ ID NO: 1099680 - RNA, 22 nt, Human
cuucuucauaggcaguccuguu

SEQ ID NO: 1099681 - RNA, 22 nt, Human
aggcaguuguugcugagcagcu

SEQ ID NO: 1099682 - RNA, 22 nt, Human
caacagcugaucuuugaugaag

SEQ ID NO: 1099683 - RNA, 22 nt, Human
guccaugauucuguguaguaga

SEQ ID NO: 1099684 - RNA, 22 nt, Human
aacaugcugccuuucuacgagu

SEQ ID NO: 1099685 - RNA, 22 nt, Human
agucuuuccugcuugacuguuc

SEQ ID NO: 1099686 - RNA, 22 nt, Human
uugaaaggguuaaagugguaaa

SEQ ID NO: 1099687 - RNA, 22 nt, Human
auuucaaggcuauuaauauaaa

SEQ ID NO: 1099688 - RNA, 22 nt, Human
acucaggaauggggcugggacu

SEQ ID NO: 1099689 - RNA, 22 nt, Human
ucugggaacacacgucacuuca

SEQ ID NO: 1099690 - RNA, 22 nt, Human
gugguuuugccauuacaaguaa

SEQ ID NO: 1099691 - RNA, 22 nt, Human
cugucauugagccugucagggc

SEQ ID NO: 1099692 - RNA, 22 nt, Human
auugaaagcacaaagaacaagu

SEQ ID NO: 1099693 - RNA, 22 nt, Human
gcugguuuccuuaucuauaaag

SEQ ID NO: 1099694 - RNA, 22 nt, Human
cucaggauugugccuagggaga

SEQ ID NO: 1099695 - RNA, 22 nt, Human
ucuuugaauuucugacugucuu

SEQ ID NO: 1099696 - RNA, 22 nt, Human
ucaaauaaugccauucaucauc

SEQ ID NO: 1099697 - RNA, 22 nt, Human
cuuaagauuugcgauaccuaau

SEQ ID NO: 1099698 - RNA, 22 nt, Human
aaguccaugaucaagauguggc

SEQ ID NO: 1099699 - RNA, 21 nt, Human
uucuucaugaugauuaauggc

SEQ ID NO: 1099700 - RNA, 22 nt, Human
cauaauauacuacauugaugaa

SEQ ID NO: 1099701 - RNA, 22 nt, Human
caguuucuuggaugccaauuuc

SEQ ID NO: 1099702 - RNA, 22 nt, Human
uuuaagauucaguaaggcaaac

SEQ ID NO: 1099703 - RNA, 22 nt, Human
gucugucacucaggggcuggag

SEQ ID NO: 1099704 - RNA, 22 nt, Human
ugcugcugaucauuuauagucu

SEQ ID NO: 1099705 - RNA, 22 nt, Human
caggaaugaggucguaaguguc

SEQ ID NO: 1099706 - RNA, 22 nt, Human
agcaccaugaccuugccauuga

SEQ ID NO: 1099707 - RNA, 22 nt, Human
uugcugugucauuuguuuaauc

SEQ ID NO: 1099708 - RNA, 22 nt, Human
uuugcaaagaaauuauugcugu

SEQ ID NO: 1099709 - RNA, 22 nt, Human
uucauacacgaaaaugcaugca

SEQ ID NO: 1099710 - RNA, 22 nt, Human
acauuuuuauucaucaaagcag

SEQ ID NO: 1099711 - RNA, 22 nt, Human
augugaaaauccaauggcagca

SEQ ID NO: 1099712 - RNA, 22 nt, Human
agaaucucuacucaaguacuug

SEQ ID NO: 1099713 - RNA, 22 nt, Human
aaugaaauguagcuuauccaua

SEQ ID NO: 1099714 - RNA, 20 nt, Human
uucugucagauuauauggga

SEQ ID NO: 1099715 - RNA, 22 nt, Human
uuugacaaaggaaaaaugcaca

SEQ ID NO: 1099716 - RNA, 22 nt, Human
uucagugucaauuuuuaaauau

SEQ ID NO: 1099717 - RNA, 22 nt, Human
uaacaucuuuagcagcucgaac

SEQ ID NO: 1099718 - RNA, 22 nt, Human
uuuggaauuggaaagugcugug

SEQ ID NO: 1099719 - RNA, 21 nt, Human
uucuucaaagaagaaggcaca

SEQ ID NO: 1099720 - RNA, 22 nt, Human
uuugcaguuucauugcugaaau

SEQ ID NO: 1099721 - RNA, 22 nt, Human
ucagucuucccuccagugcaac

SEQ ID NO: 1099722 - RNA, 22 nt, Human
cugcuuccauaaauaaugugcu

SEQ ID NO: 1099723 - RNA, 22 nt, Human
cuuuggcacagucucauuugau

SEQ ID NO: 1099724 - RNA, 22 nt, Human
aaugucugccagaacugaucau

SEQ ID NO: 1099725 - RNA, 22 nt, Human
gcuguggucugugagcuccaaa

SEQ ID NO: 1099726 - RNA, 22 nt, Human
aaaauuauucauggcuuuugga

SEQ ID NO: 1099727 - RNA, 22 nt, Human
ugaaguuguuaagguugccauu

SEQ ID NO: 1099728 - RNA, 22 nt, Human
uuuacacaaaagauagcacacc

SEQ ID NO: 1099729 - RNA, 22 nt, Human
uucaggauaugugauaucugaa

SEQ ID NO: 1099730 - RNA, 22 nt, Human
uucaauucugcucugaucuuag

SEQ ID NO: 1099731 - RNA, 22 nt, Human
aucaggaugcugucaguuacca

SEQ ID NO: 1099732 - RNA, 22 nt, Human
aauaucaguauauuguaucagu

SEQ ID NO: 1099733 - RNA, 22 nt, Human
uaaaacuuaacuauccagauua

SEQ ID NO: 1099734 - RNA, 22 nt, Human
aaaguuuguugcuuacaaagaa

SEQ ID NO: 1099735 - RNA, 21 nt, Human
cuugaaagguagagucuacag

SEQ ID NO: 1099736 - RNA, 22 nt, Human
aucaggaucacagaaacuuuua

SEQ ID NO: 1099737 - RNA, 22 nt, Human
cuuagaaaucgaacucagguua

SEQ ID NO: 1099738 - RNA, 22 nt, Human
uuuuuauaugaaggauagugcg

SEQ ID NO: 1099739 - RNA, 22 nt, Human
agugcuuuauguuguugugcaa

SEQ ID NO: 1099740 - RNA, 22 nt, Human
aaaggccauuacuugcuuuuag

SEQ ID NO: 1099741 - RNA, 17 nt, Human
ccuguguuugcuccuuc

SEQ ID NO: 1099742 - RNA, 22 nt, Human
uuguaauuugcaaauguauugu

SEQ ID NO: 1099743 - RNA, 22 nt, Human
ccuggauucaagucuuucuuuc

SEQ ID NO: 1099744 - RNA, 22 nt, Human
uggugguuaugcgcuuuguggg

SEQ ID NO: 1099745 - RNA, 19 nt, Human
agcuuccauauucucuagu

SEQ ID NO: 1099746 - RNA, 22 nt, Human
uacugcaugguggaguggagcu

SEQ ID NO: 1099747 - RNA, 22 nt, Human
uccucagacuucccuuugugua

SEQ ID NO: 1099748 - RNA, 22 nt, Human
uuauuuaaugugaucugaagag

SEQ ID NO: 1099749 - RNA, 22 nt, Human
uaacacauagauauuuuaacuu

SEQ ID NO: 1099750 - RNA, 22 nt, Human
uggcuucuugggaugggucauu

SEQ ID NO: 1099751 - RNA, 22 nt, Human
aauacaguagguaauaguucau

SEQ ID NO: 1099752 - RNA, 22 nt, Human
uuugaaagaauuuauguacuuu

SEQ ID NO: 1099753 - RNA, 22 nt, Human
ggacuucuaagugccagacacu

SEQ ID NO: 1099754 - RNA, 22 nt, Human
ucugucuccucugaggugccag

SEQ ID NO: 1099755 - RNA, 22 nt, Human
gugacaguggucacuuguaguu

SEQ ID NO: 1099756 - RNA, 22 nt, Human
aaacaugaauagauauuaaaca

SEQ ID NO: 1099757 - RNA, 22 nt, Human
aaguugagaugucauaggagac

SEQ ID NO: 1099758 - RNA, 22 nt, Human
uguacuaaggcuguguagaugu

SEQ ID NO: 1099759 - RNA, 22 nt, Human
uauugaaauucuucauguccuc

SEQ ID NO: 1099760 - RNA, 22 nt, Human
auuguuaugaaaauaagauguu

SEQ ID NO: 1099761 - RNA, 18 nt, Human
uuugcaaaggaaguaugg

SEQ ID NO: 1099762 - RNA, 22 nt, Human
augcugucgaaaccaaacaucu

SEQ ID NO: 1099763 - RNA, 18 nt, Human
acacugcagcagucugcu

SEQ ID NO: 1099764 - RNA, 22 nt, Human
cauuaaaauaucucaugguguu

SEQ ID NO: 1099765 - RNA, 22 nt, Human
aguuugaaaguauugacagaag

SEQ ID NO: 1099766 - RNA, 22 nt, Human
aacagcauaaguauuuauuuca

SEQ ID NO: 1099767 - RNA, 22 nt, Human
guguaugauuucaaauggcuag

SEQ ID NO: 1099768 - RNA, 17 nt, Human
aaucuguuuacagucag

SEQ ID NO: 1099769 - RNA, 22 nt, Human
gaacuguaguuaauacuacaca

SEQ ID NO: 1099770 - RNA, 23 nt, Human
agcacacuuguacaaugcccuag

SEQ ID NO: 1099771 - RNA, 22 nt, Human
uugcugugaaaccaugggaagu

SEQ ID NO: 1099772 - RNA, 22 nt, Human
ccaggcugagcaugauuggagc

SEQ ID NO: 1099773 - RNA, 22 nt, Human
aauguauguguauaucaaauca

SEQ ID NO: 1099774 - RNA, 22 nt, Human
acaugauuuuaguaucauaaua

SEQ ID NO: 1099775 - RNA, 22 nt, Human
agauggagaccuuggaugaacu

SEQ ID NO: 1099776 - RNA, 22 nt, Human
acacauuucuaaauuuuuaccg

SEQ ID NO: 1099777 - RNA, 22 nt, Human
aucaggaugacaacugcugggu

SEQ ID NO: 1099778 - RNA, 22 nt, Human
uucuucuucaagugcugcauuc

SEQ ID NO: 1099779 - RNA, 22 nt, Human
uugaaagucacaauggcauuaa

SEQ ID NO: 1099780 - RNA, 22 nt, Human
uaucuguuggcuccuaguugua

SEQ ID NO: 1099781 - RNA, 22 nt, Human
uuagccauugucagcacauggc

SEQ ID NO: 1099782 - RNA, 22 nt, Human
guguaugaacgaaagaauggau

SEQ ID NO: 1099783 - RNA, 22 nt, Human
auuguucaaagugcuuugcaug

SEQ ID NO: 1099784 - RNA, 23 nt, Human
uuucacaaugagcauuacagaau

SEQ ID NO: 1099785 - RNA, 22 nt, Human
ugcauuuccagauuucuggagu

SEQ ID NO: 1099786 - RNA, 22 nt, Human
ggagugucagaaacaguguccu

SEQ ID NO: 1099787 - RNA, 22 nt, Human
augcugugccuucucugugcca

SEQ ID NO: 1099788 - RNA, 22 nt, Human
gcaaauauucaagacuuuucca

SEQ ID NO: 1099789 - RNA, 22 nt, Human
ucagagaggcaauacuguuuaa

SEQ ID NO: 1099790 - RNA, 22 nt, Human
cuuugaaaggaagccacacagc

SEQ ID NO: 1099791 - RNA, 22 nt, Human
gcuggcaggagccuuucccuuu

SEQ ID NO: 1099792 - RNA, 22 nt, Human
cugcugugcagacagacucucu

SEQ ID NO: 1099793 - RNA, 22 nt, Human
ucugguaaccuuuaucccuccu

SEQ ID NO: 1099794 - RNA, 22 nt, Human
auaugugaaugauaucacuuug

SEQ ID NO: 1099795 - RNA, 22 nt, Human
uucuccaacacaagcaugaugu

SEQ ID NO: 1099796 - RNA, 22 nt, Human
gaaguucuuagucucauuugca

SEQ ID NO: 1099797 - RNA, 22 nt, Human
uuucaugagauuccuccacauc

SEQ ID NO: 1099798 - RNA, 22 nt, Human
cauuguuauagcauuacacacc

SEQ ID NO: 1099799 - RNA, 22 nt, Human
ucagagagccucaggcacugcc

SEQ ID NO: 1099800 - RNA, 22 nt, Human
aaagaauagccuuuguccaaau

SEQ ID NO: 1099801 - RNA, 22 nt, Human
auguuauuaaaguacagauucu

SEQ ID NO: 1099802 - RNA, 22 nt, Human
uguauaaacuuaagcaggaacc

SEQ ID NO: 1099803 - RNA, 22 nt, Human
uccuucuuugacaaguggcaga

SEQ ID NO: 1099804 - RNA, 22 nt, Human
aucucauaacucauuugaagac

SEQ ID NO: 1099805 - RNA, 22 nt, Human
gccucugcaauuacauugugcc

SEQ ID NO: 1099806 - RNA, 22 nt, Human
cgccucagccguggucaucuuc

SEQ ID NO: 1099807 - RNA, 20 nt, Human
uuucaguuaucuugaccuuc

SEQ ID NO: 1099808 - RNA, 22 nt, Human
cuccaugaauuugagcuuugug

SEQ ID NO: 1099809 - RNA, 22 nt, Human
gccugcagaacugugaggcaau

SEQ ID NO: 1099810 - RNA, 22 nt, Human
caucaucaaaagugacagagaa

SEQ ID NO: 1099811 - RNA, 21 nt, Human
cucaggauggcggccuggugg

SEQ ID NO: 1099812 - RNA, 22 nt, Human
uuucaaagaguuguaaauuacu

SEQ ID NO: 1099813 - RNA, 23 nt, Human
aaacugcuuccaauuccugccau

SEQ ID NO: 1099814 - RNA, 22 nt, Human
cacauuuaauccuuuauaagua

SEQ ID NO: 1099815 - RNA, 22 nt, Human
uucauuaguucugaagaugucu

SEQ ID NO: 1099816 - RNA, 22 nt, Human
acauuuaaauaccuauguuucu

SEQ ID NO: 1099817 - RNA, 22 nt, Human
cagcuucugcuaucgaacaucu

SEQ ID NO: 1099818 - RNA, 22 nt, Human
guucuucaggcugugcucuaga

SEQ ID NO: 1099819 - RNA, 22 nt, Human
caucaaauaggaauauuuggca

SEQ ID NO: 1099820 - RNA, 22 nt, Human
gucaggaugacaagugcuuuca

SEQ ID NO: 1099821 - RNA, 22 nt, Human
uucaucaauguguuuaauaaug

SEQ ID NO: 1099822 - RNA, 22 nt, Human
uuacuuuggguccugcuuauaa

SEQ ID NO: 1099823 - RNA, 22 nt, Human
cuucugugcuucacaguugcca

SEQ ID NO: 1099824 - RNA, 20 nt, Human
auacacauauucuugcaacu

SEQ ID NO: 1099825 - RNA, 22 nt, Human
cuuucauucuuagauauuagug

SEQ ID NO: 1099826 - RNA, 22 nt, Human
uagucaaaccucagaauacccc

SEQ ID NO: 1099827 - RNA, 17 nt, Human
cucacggaggaugaauc

SEQ ID NO: 1099828 - RNA, 22 nt, Human
guuuuauaauugcuucauaaga

SEQ ID NO: 1099829 - RNA, 22 nt, Human
gugguaauagagcuccaaacua

SEQ ID NO: 1099830 - RNA, 22 nt, Human
uauugaugcuuggauugggcca

SEQ ID NO: 1099831 - RNA, 22 nt, Human
cugccagucuaugcugcucggc

SEQ ID NO: 1099832 - RNA, 22 nt, Human
uaugaaacauucauacaaauaa

SEQ ID NO: 1099833 - RNA, 22 nt, Human
uuccaagagcuuuaauuguuga

SEQ ID NO: 1099834 - RNA, 22 nt, Human
agaggccggccgagcccauggg

SEQ ID NO: 1099835 - RNA, 20 nt, Human
cugcugugugugccucagcc

SEQ ID NO: 1099836 - RNA, 19 nt, Human
ugaguucugugguucucaa

SEQ ID NO: 1099837 - RNA, 22 nt, Human
ugcuggguagaaguauuagucu

SEQ ID NO: 1099838 - RNA, 22 nt, Human
augcuguggaaguuccugaagc

SEQ ID NO: 1099839 - RNA, 22 nt, Human
gagagguccauuccccugucag

SEQ ID NO: 1099840 - RNA, 22 nt, Human
ggcuuugccuggaauuuccuug

SEQ ID NO: 1099841 - RNA, 22 nt, Human
gaaauauucuugucuuguuuuc

SEQ ID NO: 1099842 - RNA, 22 nt, Human
uucucuuuucaccaguugcuaa

SEQ ID NO: 1099843 - RNA, 22 nt, Human
uggggcuccuccuggcaggagg

SEQ ID NO: 1099844 - RNA, 22 nt, Human
acucaggagggaucagcuauca

SEQ ID NO: 1099845 - RNA, 22 nt, Human
cuucucaaaguugugaaucagg

SEQ ID NO: 1099846 - RNA, 22 nt, Human
ucaaauaccagcaauuucaugu

SEQ ID NO: 1099847 - RNA, 21 nt, Human
ggauggauagggaagagauuu

SEQ ID NO: 1099848 - RNA, 22 nt, Human
acucagaaccauuuacucugag

SEQ ID NO: 1099849 - RNA, 22 nt, Human
aagauaaacucuugauuucuga

SEQ ID NO: 1099850 - RNA, 22 nt, Human
uucacauugugcagauuauggu

SEQ ID NO: 1099851 - RNA, 22 nt, Human
agucucugucguagaucagcgu

SEQ ID NO: 1099852 - RNA, 22 nt, Human
ccuccucugggaagauucagag

SEQ ID NO: 1099853 - RNA, 22 nt, Human
ugaaaugaucaguuugguuacu

SEQ ID NO: 1099854 - RNA, 22 nt, Human
uagauauggccgucuguuuuaa

SEQ ID NO: 1099855 - RNA, 22 nt, Human
ucuacagacagagcagguggga

SEQ ID NO: 1099856 - RNA, 22 nt, Human
ccuucauugcaucuuuaagaga

SEQ ID NO: 1099857 - RNA, 22 nt, Human
aaauaguuacuucugcugucuu

SEQ ID NO: 1099858 - RNA, 22 nt, Human
cauuuguuggucagauuguagu

SEQ ID NO: 1099859 - RNA, 22 nt, Human
cuacuucuaaguacauggugau

SEQ ID NO: 1099860 - RNA, 22 nt, Human
uaucuguuguaguacagaugau

SEQ ID NO: 1099861 - RNA, 22 nt, Human
auuaaauuggacgcugggggaa

SEQ ID NO: 1099862 - RNA, 22 nt, Human
ucaaaguuacuugugguuuucu

SEQ ID NO: 1099863 - RNA, 22 nt, Human
ucucuuucuauaugugagucuu

SEQ ID NO: 1099864 - RNA, 20 nt, Human
cucaggauacugcaaaguug

SEQ ID NO: 1099865 - RNA, 22 nt, Human
aaauaguuuagcucucauuuca

SEQ ID NO: 1099866 - RNA, 22 nt, Human
uuugcagucuggccugcuuugg

SEQ ID NO: 1099867 - RNA, 22 nt, Human
aauacauauggaauuccauguu

SEQ ID NO: 1099868 - RNA, 22 nt, Human
uugauguacagaauuguucaca

SEQ ID NO: 1099869 - RNA, 22 nt, Human
acagugcuggcuacaacccugg

SEQ ID NO: 1099870 - RNA, 22 nt, Human
guuauacauauguguuaacaaa

SEQ ID NO: 1099871 - RNA, 22 nt, Human
cagaguggcacucugcuggaug

SEQ ID NO: 1099872 - RNA, 22 nt, Human
ucuuucaaugagcauucuuucc

SEQ ID NO: 1099873 - RNA, 22 nt, Human
auucuucauacagacaaguccu

SEQ ID NO: 1099874 - RNA, 22 nt, Human
aucuccaggcauuucaagagac

SEQ ID NO: 1099875 - RNA, 22 nt, Human
cugaaaauguuacacaggaaga

SEQ ID NO: 1099876 - RNA, 22 nt, Human
aauccugugugacucuggggag

SEQ ID NO: 1099877 - RNA, 22 nt, Human
uuagccauuuuauacaagugua

SEQ ID NO: 1099878 - RNA, 22 nt, Human
uaucuguuaugggcugaauugc

SEQ ID NO: 1099879 - RNA, 22 nt, Human
uugcaauagccuuauuuccaaa

SEQ ID NO: 1099880 - RNA, 22 nt, Human
cagaaccaggaacugauggaga

SEQ ID NO: 1099881 - RNA, 22 nt, Human
uuuucaguaaugucuacauaau

SEQ ID NO: 1099882 - RNA, 22 nt, Human
uuaacacagggggagacaaagu

SEQ ID NO: 1099883 - RNA, 22 nt, Human
ucuuagcacagcuauauaaguu

SEQ ID NO: 1099884 - RNA, 22 nt, Human
uuaaagggccgauuuccaggcc

SEQ ID NO: 1099885 - RNA, 22 nt, Human
ucucaggaaauaggauuugagu

SEQ ID NO: 1099886 - RNA, 22 nt, Human
uuugacaucuaagaauucuuac

SEQ ID NO: 1099887 - RNA, 22 nt, Human
aucauucuauuguugagcugcc

SEQ ID NO: 1099888 - RNA, 22 nt, Human
aagcuggcaugucaccugagaa

SEQ ID NO: 1099889 - RNA, 22 nt, Human
cagcugcuuuaguuuuccaucc

SEQ ID NO: 1099890 - RNA, 22 nt, Human
ugacauaauaauccaaacauac

SEQ ID NO: 1099891 - RNA, 22 nt, Human
ugaaggccacuuccugugagcu

SEQ ID NO: 1099892 - RNA, 23 nt, Human
uuccagaguccacaucugccacc

SEQ ID NO: 1099893 - RNA, 22 nt, Human
ugaaggccagcagagugaaggc

SEQ ID NO: 1099894 - RNA, 22 nt, Human
auugaaaguccuaucuaaggga

SEQ ID NO: 1099895 - RNA, 22 nt, Human
aauaauuagugggacagagaac

SEQ ID NO: 1099896 - RNA, 22 nt, Human
aagugagugguaaggagcaugg

SEQ ID NO: 1099897 - RNA, 22 nt, Human
uuuucagaggccuaagagguuu

SEQ ID NO: 1099898 - RNA, 22 nt, Human
uccaugaguuugaggaaaagag

SEQ ID NO: 1099899 - RNA, 22 nt, Human
gauuucuuugcaagcuguguuc

SEQ ID NO: 1099900 - RNA, 22 nt, Human
uugaagaggacuuugcagcugu

SEQ ID NO: 1099901 - RNA, 20 nt, Human
ccucaggaugagggugagca

SEQ ID NO: 1099902 - RNA, 22 nt, Human
uuucauaauacuguacaugaaa

SEQ ID NO: 1099903 - RNA, 22 nt, Human
cauaauuugugguaguggggga

SEQ ID NO: 1099904 - RNA, 22 nt, Human
auguaugagagauucuuuuauu

SEQ ID NO: 1099905 - RNA, 18 nt, Human
gugcugugggcaguggcc

SEQ ID NO: 1099906 - RNA, 22 nt, Human
cacagucacauaucuaugugug

SEQ ID NO: 1099907 - RNA, 22 nt, Human
auguuucaaugcacuuuagccu

SEQ ID NO: 1099908 - RNA, 23 nt, Human
aaaguuugaagcaacaguaguug

SEQ ID NO: 1099909 - RNA, 22 nt, Human
guguguuucagaagccaggugu

SEQ ID NO: 1099910 - RNA, 22 nt, Human
auuuccuuugcaaagacugugc

SEQ ID NO: 1099911 - RNA, 22 nt, Human
ugucuuuggaauauuuagcuga

SEQ ID NO: 1099912 - RNA, 22 nt, Human
uauuuccauguuagaacuaagu

SEQ ID NO: 1099913 - RNA, 22 nt, Human
ugaguuuuuucaacauaugaag

SEQ ID NO: 1099914 - RNA, 22 nt, Human
gaaacaauuuuuguugucuaag

SEQ ID NO: 1099915 - RNA, 22 nt, Human
augugaggaagaaagagguaag

SEQ ID NO: 1099916 - RNA, 22 nt, Human
aaguguauauaugacuuauaaa

SEQ ID NO: 1099917 - RNA, 22 nt, Human
uuucauaaccucaagcuacagu

SEQ ID NO: 1099918 - RNA, 22 nt, Human
auaugagaauuggaaaauauca

SEQ ID NO: 1099919 - RNA, 23 nt, Human
uugcacauuggagcuggucuucu

SEQ ID NO: 1099920 - RNA, 22 nt, Human
cagucucucagcuuucagcugu

SEQ ID NO: 1099921 - RNA, 22 nt, Human
uccacauccauugcuugacuuu

SEQ ID NO: 1099922 - RNA, 22 nt, Human
cacaaaugugcagaaaugugag

SEQ ID NO: 1099923 - RNA, 22 nt, Human
ucugggaacugagcuccccuag

SEQ ID NO: 1099924 - RNA, 22 nt, Human
gacagugcauuuccuggcaugg

SEQ ID NO: 1099925 - RNA, 22 nt, Human
uugcuuuguggugguucuucca

SEQ ID NO: 1099926 - RNA, 22 nt, Human
ucugcuguaaagaauuucugcc

SEQ ID NO: 1099927 - RNA, 22 nt, Human
auaacuuucuucacccuugcug

SEQ ID NO: 1099928 - RNA, 22 nt, Human
agaccgagaaguucuccaggcc

SEQ ID NO: 1099929 - RNA, 22 nt, Human
uuaacauuguccuuagcagauu

SEQ ID NO: 1099930 - RNA, 22 nt, Human
uguaugaaguuacugagccucu

SEQ ID NO: 1099931 - RNA, 19 nt, Human
uaucuguuuccugcuuguc

SEQ ID NO: 1099932 - RNA, 22 nt, Human
gaccauuuguugaaaagauuau

SEQ ID NO: 1099933 - RNA, 22 nt, Human
ucucucuugucaccccaucugc

SEQ ID NO: 1099934 - RNA, 22 nt, Human
guugaaagcuuuucauuuaguu

SEQ ID NO: 1099935 - RNA, 22 nt, Human
uucuucuuaauguccugggaac

SEQ ID NO: 1099936 - RNA, 22 nt, Human
uuauuuaaaagugguaagauuc

SEQ ID NO: 1099937 - RNA, 22 nt, Human
ucuacugcacuggugucucauc

SEQ ID NO: 1099938 - RNA, 22 nt, Human
uucacagucacccuucuccaug

SEQ ID NO: 1099939 - RNA, 22 nt, Human
ucucaggagccacagcgggagu

SEQ ID NO: 1099940 - RNA, 22 nt, Human
uaauuauuugaagacauuagag

SEQ ID NO: 1099941 - RNA, 22 nt, Human
caggguggcacaucacagcauu

SEQ ID NO: 1099942 - RNA, 22 nt, Human
cuugcuucauuagugucuuagu

SEQ ID NO: 1099943 - RNA, 21 nt, Human
agcaccuuacagcuauaaugg

SEQ ID NO: 1099944 - RNA, 22 nt, Human
agugcuuuagagaaauggugcu

SEQ ID NO: 1099945 - RNA, 22 nt, Human
uuguaugaggauagcaagaagc

SEQ ID NO: 1099946 - RNA, 22 nt, Human
uuggaugaagucuagcuuuagu

SEQ ID NO: 1099947 - RNA, 22 nt, Human
uucucuuuugugaugugagaug

SEQ ID NO: 1099948 - RNA, 22 nt, Human
acauaugugcuuauauccauga

SEQ ID NO: 1099949 - RNA, 22 nt, Human
agacccagaaagcagcugcauu

SEQ ID NO: 1099950 - RNA, 22 nt, Human
aucugcuuccugggcuccauga

SEQ ID NO: 1099951 - RNA, 23 nt, Human
acugucugauauguuuuccauca

SEQ ID NO: 1099952 - RNA, 22 nt, Human
agcaccuugcucuuggccuucc

SEQ ID NO: 1099953 - RNA, 22 nt, Human
ggcagcuggggcagugcccugu

SEQ ID NO: 1099954 - RNA, 22 nt, Human
guguaugaggggagaauguuuu

SEQ ID NO: 1099955 - RNA, 22 nt, Human
ucacugucugaaagaaauggcc

SEQ ID NO: 1099956 - RNA, 22 nt, Human
uaagcugugggagauuggcaua

SEQ ID NO: 1099957 - RNA, 22 nt, Human
cugcugugcaggugccuaugau

SEQ ID NO: 1099958 - RNA, 22 nt, Human
augcuguguuuuaaauggaaau

SEQ ID NO: 1099959 - RNA, 22 nt, Human
uacauucagaagaauggacacg

SEQ ID NO: 1099960 - RNA, 22 nt, Human
agugcuuugguauagaacuauu

SEQ ID NO: 1099961 - RNA, 22 nt, Human
auuuucaucauggguuuaacau

SEQ ID NO: 1099962 - RNA, 22 nt, Human
uccaugaggcagggaggcuggc

SEQ ID NO: 1099963 - RNA, 22 nt, Human
uucugucaaacucacaggccga

SEQ ID NO: 1099964 - RNA, 22 nt, Human
acaguuaucuuugaaauagaga

SEQ ID NO: 1099965 - RNA, 22 nt, Human
auucuuauuauaguaaaacagu

SEQ ID NO: 1099966 - RNA, 22 nt, Human
guguuuuaagaaagaagcucag

SEQ ID NO: 1099967 - RNA, 22 nt, Human
uacaaaguaauguauaauaucg

SEQ ID NO: 1099968 - RNA, 22 nt, Human
uuuuauagcugaauaguauucc

SEQ ID NO: 1099969 - RNA, 22 nt, Human
uaucuaaaggauuuaauuuagu

SEQ ID NO: 1099970 - RNA, 22 nt, Human
gucagagagggcacgugcacac

SEQ ID NO: 1099971 - RNA, 22 nt, Human
uuaaauuccagccucauaauag

SEQ ID NO: 1099972 - RNA, 22 nt, Human
uauucacaugaaaacaaauuuu

SEQ ID NO: 1099973 - RNA, 22 nt, Human
uugcugaagugaagguauguuu

SEQ ID NO: 1099974 - RNA, 22 nt, Human
gaaucucaguggaagcaggaag

SEQ ID NO: 1099975 - RNA, 22 nt, Human
auuuccaguccuaaugaucugg

SEQ ID NO: 1099976 - RNA, 22 nt, Human
agcaccauugcaaauauggcag

SEQ ID NO: 1099977 - RNA, 22 nt, Human
cuugaaguugcaaaacauuaau

SEQ ID NO: 1099978 - RNA, 22 nt, Human
uccaugagacagauacuguaag

SEQ ID NO: 1099979 - RNA, 23 nt, Human
cugcuguuuucuguaccugaagc

SEQ ID NO: 1099980 - RNA, 22 nt, Human
uucucagagugaccaagucuuu

SEQ ID NO: 1099981 - RNA, 22 nt, Human
uagcacauacauaauagauaga

SEQ ID NO: 1099982 - RNA, 22 nt, Human
uuucacaaaugucuuuaacuug

SEQ ID NO: 1099983 - RNA, 22 nt, Human
ggcagcugcaaaucugcucugu

SEQ ID NO: 1099984 - RNA, 22 nt, Human
aguuuucacacucaccaaaagg

SEQ ID NO: 1099985 - RNA, 20 nt, Human
ugaaggccauuuguuccaga

SEQ ID NO: 1099986 - RNA, 22 nt, Human
gaaggucaccuccccucucugg

SEQ ID NO: 1099987 - RNA, 22 nt, Human
caagauggacauaaggagagaa

SEQ ID NO: 1099988 - RNA, 22 nt, Human
cacaauguauauguauaucaaa

SEQ ID NO: 1099989 - RNA, 22 nt, Human
aaauauaguaaaugcauaguuc

SEQ ID NO: 1099990 - RNA, 22 nt, Human
ucuucauauauaaaguggaaua

SEQ ID NO: 1099991 - RNA, 22 nt, Human
ucuuugaaagcuguucuagagu

SEQ ID NO: 1099992 - RNA, 22 nt, Human
cuucugugauuugguuaggaua

SEQ ID NO: 1099993 - RNA, 22 nt, Human
agucucuuuguggacucugccu

SEQ ID NO: 1099994 - RNA, 22 nt, Human
aaaguuguaauggaagaaaugc

SEQ ID NO: 1099995 - RNA, 22 nt, Human
uguuuuuaaauaaugauagaaa

SEQ ID NO: 1099996 - RNA, 17 nt, Human
uccaugagacaugaaga

SEQ ID NO: 1099997 - RNA, 22 nt, Human
agcagcauuaugauauaucuua

SEQ ID NO: 1099998 - RNA, 19 nt, Human
ugaaauggcaguugcuaaa

SEQ ID NO: 1099999 - RNA, 22 nt, Human
augcuacauuuugguuuauaaa

SEQ ID NO: 1100000 - RNA, 22 nt, Human
caaggccacuccagagacuggu

SEQ ID NO: 1100001 - RNA, 22 nt, Human
ucuuuuggguucuuaugauuua

SEQ ID NO: 1100002 - RNA, 22 nt, Human
ucugcaucauuuuucagagccg

SEQ ID NO: 1100003 - RNA, 22 nt, Human
uuggcagugucugcaaaaugga

SEQ ID NO: 1100004 - RNA, 22 nt, Human
gcucucuuuuuccagugguggu

SEQ ID NO: 1100005 - RNA, 22 nt, Human
auguucuuucagccagugcauc

SEQ ID NO: 1100006 - RNA, 22 nt, Human
acuaagugauucuaagcaucuu

SEQ ID NO: 1100007 - RNA, 22 nt, Human
cuguguuggcuuuucucuugua

SEQ ID NO: 1100008 - RNA, 22 nt, Human
ucacaucucccuggaggacaca

SEQ ID NO: 1100009 - RNA, 22 nt, Human
gcauuuccugugcuuggcauau

SEQ ID NO: 1100010 - RNA, 22 nt, Human
agccuuguuggucugaguuugg

SEQ ID NO: 1100011 - RNA, 22 nt, Human
guguguuuagcauuagcagggg

SEQ ID NO: 1100012 - RNA, 22 nt, Human
auauucuuccaaaacaucauuu

SEQ ID NO: 1100013 - RNA, 22 nt, Human
acuuuacaagcuuauagccuag

SEQ ID NO: 1100014 - RNA, 20 nt, Human
gggagucuggaugaaagaug

SEQ ID NO: 1100015 - RNA, 22 nt, Human
gcucaggacccaggugugaccu

SEQ ID NO: 1100016 - RNA, 21 nt, Human
ucuuccuccacagcgugccac

SEQ ID NO: 1100017 - RNA, 20 nt, Human
agaggccaguuaggagucua

SEQ ID NO: 1100018 - RNA, 22 nt, Human
ucuuagaaguuuauggcacgga

SEQ ID NO: 1100019 - RNA, 20 nt, Human
uucuucucuaguuaucuuca

SEQ ID NO: 1100020 - RNA, 22 nt, Human
agucaauuaucucuaggucauc

SEQ ID NO: 1100021 - RNA, 22 nt, Human
ucugucaauauaugugcugcag

SEQ ID NO: 1100022 - RNA, 21 nt, Human
aaugcauuaacauaaagcuga

SEQ ID NO: 1100023 - RNA, 22 nt, Human
ggcucagaccucccagcuccag

SEQ ID NO: 1100024 - RNA, 23 nt, Human
ucguugaauagcaauagcacaac

SEQ ID NO: 1100025 - RNA, 22 nt, Human
gucuuucuaugaugaacuguug

SEQ ID NO: 1100026 - RNA, 19 nt, Human
auauauguauacaaugugg

SEQ ID NO: 1100027 - RNA, 22 nt, Human
aucacauuguuagcauagacug

SEQ ID NO: 1100028 - RNA, 22 nt, Human
aacaugauggggaagaacaaga

SEQ ID NO: 1100029 - RNA, 22 nt, Human
guaguucugcagugucaccuga

SEQ ID NO: 1100030 - RNA, 19 nt, Human
ugagaggcuuaaggcagcu

SEQ ID NO: 1100031 - RNA, 22 nt, Human
aaaguuguucaguaagaaacuc

SEQ ID NO: 1100032 - RNA, 22 nt, Human
cuguauuucccacauucucuau

SEQ ID NO: 1100033 - RNA, 22 nt, Human
acaauguaggauauguacuugu

SEQ ID NO: 1100034 - RNA, 22 nt, Human
gauggcagcagcagccagggau

SEQ ID NO: 1100035 - RNA, 22 nt, Human
auuuugaugcuaucuaaugaau

SEQ ID NO: 1100036 - RNA, 22 nt, Human
agugugagcccuggaguggugc

SEQ ID NO: 1100037 - RNA, 22 nt, Human
ucacauuuucuacuacuguacg

SEQ ID NO: 1100038 - RNA, 22 nt, Human
uuccuuaguugacugucuuagu

SEQ ID NO: 1100039 - RNA, 20 nt, Human
uguuaaaggacacuugcuuu

SEQ ID NO: 1100040 - RNA, 22 nt, Human
uauagccauuuccaguggcauc

SEQ ID NO: 1100041 - RNA, 22 nt, Human
aagcacauuguacauuugugcu

SEQ ID NO: 1100042 - RNA, 22 nt, Human
ucuuugaauccuuuacaucuga

SEQ ID NO: 1100043 - RNA, 22 nt, Human
guugaaaguagaugcuauuugg

SEQ ID NO: 1100044 - RNA, 22 nt, Human
uuuacauuucccucugucaguu

SEQ ID NO: 1100045 - RNA, 22 nt, Human
aacuagucagugauucucagaa

SEQ ID NO: 1100046 - RNA, 22 nt, Human
aucccaugagaccacguuggcu

SEQ ID NO: 1100047 - RNA, 22 nt, Human
ccucuucuagguuucagccugc

SEQ ID NO: 1100048 - RNA, 22 nt, Human
gauucacucauauuuuacguuu

SEQ ID NO: 1100049 - RNA, 22 nt, Human
uucagcaaacacgaugcuuguu

SEQ ID NO: 1100050 - RNA, 22 nt, Human
acagucuugcuguauggucagg

SEQ ID NO: 1100051 - RNA, 22 nt, Human
aacauacauauuucagugucca

SEQ ID NO: 1100052 - RNA, 22 nt, Human
ucaagugcuugugagguauuug

SEQ ID NO: 1100053 - RNA, 22 nt, Human
uucuugaaucacuuuagagaua

SEQ ID NO: 1100054 - RNA, 22 nt, Human
uuucccagagguaugaauaagu

SEQ ID NO: 1100055 - RNA, 22 nt, Human
acacauauucauauguacuuac

SEQ ID NO: 1100056 - RNA, 22 nt, Human
cuugaaagcuuugcgucuucua

SEQ ID NO: 1100057 - RNA, 22 nt, Human
guccucuguuagaaaugugcuu

SEQ ID NO: 1100058 - RNA, 22 nt, Human
auauacuuggagacuaucauug

SEQ ID NO: 1100059 - RNA, 22 nt, Human
uguaugaauauguuggggaggu

SEQ ID NO: 1100060 - RNA, 22 nt, Human
uggcagucuggguuggcaguua

SEQ ID NO: 1100061 - RNA, 22 nt, Human
ugcuuuggccacuagaauucag

SEQ ID NO: 1100062 - RNA, 22 nt, Human
aaaguuagacagcaucauuucu

SEQ ID NO: 1100063 - RNA, 22 nt, Human
uuugaaguggaaaaggauuuaa

SEQ ID NO: 1100064 - RNA, 23 nt, Human
agaugagccaacaccuccaugcc

SEQ ID NO: 1100065 - RNA, 22 nt, Human
uuugaaaucuaaucaaggaaca

SEQ ID NO: 1100066 - RNA, 21 nt, Human
uacagaaugcgcuucagucug

SEQ ID NO: 1100067 - RNA, 22 nt, Human
ucucugaguauccugaacugcc

SEQ ID NO: 1100068 - RNA, 22 nt, Human
gcucaggaucccaggggugugc

SEQ ID NO: 1100069 - RNA, 22 nt, Human
ucugucaucucuaaaauagaaa

SEQ ID NO: 1100070 - RNA, 22 nt, Human
uuccaugagcucugaguucaca

SEQ ID NO: 1100071 - RNA, 22 nt, Human
aguuauaugugaaaacacguau

SEQ ID NO: 1100072 - RNA, 22 nt, Human
agaaaugacaagacugaucagg

SEQ ID NO: 1100073 - RNA, 22 nt, Human
acucaggaaaugaagacugguu

SEQ ID NO: 1100074 - RNA, 22 nt, Human
agucugucuacuuaaagucugu

SEQ ID NO: 1100075 - RNA, 22 nt, Human
guuaacacaggacucucugccu

SEQ ID NO: 1100076 - RNA, 22 nt, Human
gaucuucucuuuaguagaaaca

SEQ ID NO: 1100077 - RNA, 22 nt, Human
uucuacaauaugaauaaugaag

SEQ ID NO: 1100078 - RNA, 22 nt, Human
uguaugaauauguauuuucaua

SEQ ID NO: 1100079 - RNA, 22 nt, Human
aacauuucagcaaauaagaaca

SEQ ID NO: 1100080 - RNA, 20 nt, Human
cuucuucauuaacccuacug

SEQ ID NO: 1100081 - RNA, 22 nt, Human
cucacugugccuuuucccaaac

SEQ ID NO: 1100082 - RNA, 22 nt, Human
aagaauacguaucaacaauggu

SEQ ID NO: 1100083 - RNA, 22 nt, Human
guaaaauagaauaacguggcua

SEQ ID NO: 1100084 - RNA, 22 nt, Human
acaguggagaaggcaugaggcu

SEQ ID NO: 1100085 - RNA, 22 nt, Human
ugaaugaguuuggcugcuguuc

SEQ ID NO: 1100086 - RNA, 22 nt, Human
uaauaucuacuucauagaguuu

SEQ ID NO: 1100087 - RNA, 22 nt, Human
uguaugaaccuuuaauauagug

SEQ ID NO: 1100088 - RNA, 22 nt, Human
uucucagguagugcugaugcug

SEQ ID NO: 1100089 - RNA, 19 nt, Human
ugaggggcucacagucuca

SEQ ID NO: 1100090 - RNA, 22 nt, Human
ucucucagaggaagaggcagug

SEQ ID NO: 1100091 - RNA, 22 nt, Human
cacucuccagcacaccccauuu

SEQ ID NO: 1100092 - RNA, 22 nt, Human
gagcauuuuugucugcauuuua

SEQ ID NO: 1100093 - RNA, 22 nt, Human
cgucuuccucuuacgaugcgcu

SEQ ID NO: 1100094 - RNA, 22 nt, Human
uacauugcuuucuaauacaucu

SEQ ID NO: 1100095 - RNA, 22 nt, Human
agaauaugaugguuggagaauu

SEQ ID NO: 1100096 - RNA, 21 nt, Human
aauguauguuuaucucacagu

SEQ ID NO: 1100097 - RNA, 22 nt, Human
uuucugaaaucucuuuugagga

SEQ ID NO: 1100098 - RNA, 22 nt, Human
gcuccucugucaaaugagagug

SEQ ID NO: 1100099 - RNA, 22 nt, Human
acugcuuuaucugagaaguccu

SEQ ID NO: 1100100 - RNA, 22 nt, Human
auauuguugacuauaagaguaa

SEQ ID NO: 1100101 - RNA, 22 nt, Human
ccucaggggucacugugaggag

SEQ ID NO: 1100102 - RNA, 22 nt, Human
caacauuucaaggucuuuagga

SEQ ID NO: 1100103 - RNA, 22 nt, Human
gagaggucaucucccaucagca

SEQ ID NO: 1100104 - RNA, 23 nt, Human
uaauucacauauacauugcuuca

SEQ ID NO: 1100105 - RNA, 22 nt, Human
uuugaaagcaggugugggaggg

SEQ ID NO: 1100106 - RNA, 22 nt, Human
uaucuguuaggaucagagcugg

SEQ ID NO: 1100107 - RNA, 22 nt, Human
cuggguaaguuccuaaggcuca

SEQ ID NO: 1100108 - RNA, 23 nt, Human
gugagucuugccuuugcugugga

SEQ ID NO: 1100109 - RNA, 22 nt, Human
aguaugaaucucuuuauucugc

SEQ ID NO: 1100110 - RNA, 22 nt, Human
uacaaagucacauugaaaugaa

SEQ ID NO: 1100111 - RNA, 22 nt, Human
ucuuugcaaauguuauuaucuu

SEQ ID NO: 1100112 - RNA, 22 nt, Human
aucaggauucaccccagagcug

SEQ ID NO: 1100113 - RNA, 18 nt, Human
ucuuccaacacugacacc

SEQ ID NO: 1100114 - RNA, 22 nt, Human
aguguuugagacacauuucacu

SEQ ID NO: 1100115 - RNA, 18 nt, Human
ccagguggugacagagau

SEQ ID NO: 1100116 - RNA, 22 nt, Human
uuucuucauucaccuucacccc

SEQ ID NO: 1100117 - RNA, 22 nt, Human
ccucagggaaugggaggcuggg

SEQ ID NO: 1100118 - RNA, 22 nt, Human
gggcacagaagucuaagacauc

SEQ ID NO: 1100119 - RNA, 22 nt, Human
uuaauuuuaaccuguuuguguc

SEQ ID NO: 1100120 - RNA, 22 nt, Human
uucauucuuauuugugaucugg

SEQ ID NO: 1100121 - RNA, 22 nt, Human
ucauaaaugcagugucauaaau

SEQ ID NO: 1100122 - RNA, 22 nt, Human
uaucaucuuguugucaugcagc

SEQ ID NO: 1100123 - RNA, 22 nt, Human
auccaugaucaauuuauuacua

SEQ ID NO: 1100124 - RNA, 22 nt, Human
uaugaacuagcugauuuaguuu

SEQ ID NO: 1100125 - RNA, 22 nt, Human
ucuggcaggucaaucauucuuu

SEQ ID NO: 1100126 - RNA, 22 nt, Human
guugaaaguggagaaccugguu

SEQ ID NO: 1100127 - RNA, 22 nt, Human
acugccauuggucaaaugagug

SEQ ID NO: 1100128 - RNA, 22 nt, Human
cucaggauucucgacacucaca

SEQ ID NO: 1100129 - RNA, 22 nt, Human
guuuagaacacggaaauacuga

SEQ ID NO: 1100130 - RNA, 22 nt, Human
agaauccucuucaguaaauucu

SEQ ID NO: 1100131 - RNA, 22 nt, Human
ugcuagugcaggguuuucaguu

SEQ ID NO: 1100132 - RNA, 22 nt, Human
caaauagugucacauugugagg

SEQ ID NO: 1100133 - RNA, 22 nt, Human
uucaggauaguggugaguggca

SEQ ID NO: 1100134 - RNA, 20 nt, Human
ucuggcaggugaacgagcug

SEQ ID NO: 1100135 - RNA, 22 nt, Human
uugaagagugccuuccagacau

SEQ ID NO: 1100136 - RNA, 22 nt, Human
ucagugugaggucuuccacccg

SEQ ID NO: 1100137 - RNA, 21 nt, Human
gauuuuaaagagacugccaca

SEQ ID NO: 1100138 - RNA, 22 nt, Human
acauaccauacauggugagaug

SEQ ID NO: 1100139 - RNA, 22 nt, Human
uaacauuagguagacauaagcc

SEQ ID NO: 1100140 - RNA, 22 nt, Human
uccauucauucauugaugaaca

SEQ ID NO: 1100141 - RNA, 22 nt, Human
cccuugcaucccauguguggcc

SEQ ID NO: 1100142 - RNA, 22 nt, Human
uugaaggacauccuauuucuag

SEQ ID NO: 1100143 - RNA, 22 nt, Human
agcuagaauauugaucugaaau

SEQ ID NO: 1100144 - RNA, 22 nt, Human
cccuguacagucucuguggcac

SEQ ID NO: 1100145 - RNA, 22 nt, Human
ugugugucagagucuccauggu

SEQ ID NO: 1100146 - RNA, 22 nt, Human
uguacaaagguacuuugauguu

SEQ ID NO: 1100147 - RNA, 23 nt, Human
gugcugugagccccuuggccucc

SEQ ID NO: 1100148 - RNA, 22 nt, Human
auucuucacaccuguuccuguu

SEQ ID NO: 1100149 - RNA, 22 nt, Human
ucugucaaaugagcaaguaacu

SEQ ID NO: 1100150 - RNA, 22 nt, Human
cacaaaugguuguagacauuaa

SEQ ID NO: 1100151 - RNA, 22 nt, Human
cauuucacaaauggccacauca

SEQ ID NO: 1100152 - RNA, 20 nt, Human
ucucagcauaagaacccuuc

SEQ ID NO: 1100153 - RNA, 18 nt, Human
ugcuuggagcauuuacca

SEQ ID NO: 1100154 - RNA, 23 nt, Human
ugaaacauuuaggguagaauuuc

SEQ ID NO: 1100155 - RNA, 22 nt, Human
uuuuuguagucauuagaagagg

SEQ ID NO: 1100156 - RNA, 22 nt, Human
aauauaaugcuguuuuaugcca

SEQ ID NO: 1100157 - RNA, 22 nt, Human
cacauauuugaugaagcuuugu

SEQ ID NO: 1100158 - RNA, 22 nt, Human
caggauggagggagggcuguua

SEQ ID NO: 1100159 - RNA, 22 nt, Human
uuugacauugccaauuugcuca

SEQ ID NO: 1100160 - RNA, 22 nt, Human
uuaaaauagccagugccccucu

SEQ ID NO: 1100161 - RNA, 22 nt, Human
gcuuggcauugaccauuaucau

SEQ ID NO: 1100162 - RNA, 17 nt, Human
uauauguaugccucucc

SEQ ID NO: 1100163 - RNA, 22 nt, Human
ugaacaguuucaagaaaacuuu

SEQ ID NO: 1100164 - RNA, 22 nt, Human
gugcuuucugcugcauuccucu

SEQ ID NO: 1100165 - RNA, 22 nt, Human
auuuucagagacaucuggacuu

SEQ ID NO: 1100166 - RNA, 22 nt, Human
ugaaagggguugaguuacagcu

SEQ ID NO: 1100167 - RNA, 22 nt, Human
auucugucuuuuuauacaucua

SEQ ID NO: 1100168 - RNA, 22 nt, Human
cagauccacccuuguagugaca

SEQ ID NO: 1100169 - RNA, 22 nt, Human
agucuugcucuugcaucugcuu

SEQ ID NO: 1100170 - RNA, 22 nt, Human
cugcuuuguaaaauagacauaa

SEQ ID NO: 1100171 - RNA, 22 nt, Human
ucugggaaaugcuguuccuugu

SEQ ID NO: 1100172 - RNA, 22 nt, Human
acuucaugcagaagagagcugu

SEQ ID NO: 1100173 - RNA, 22 nt, Human
acacaaugcauauuuuuccaga

SEQ ID NO: 1100174 - RNA, 22 nt, Human
caugaaaucugaguauguuucc

SEQ ID NO: 1100175 - RNA, 22 nt, Human
uaaugucaaggugauagauuug

SEQ ID NO: 1100176 - RNA, 22 nt, Human
gccagagguucaacaacugucu

SEQ ID NO: 1100177 - RNA, 22 nt, Human
agacucaagacugcagaagacg

SEQ ID NO: 1100178 - RNA, 22 nt, Human
uauggaaacuaauucauuuuuc

SEQ ID NO: 1100179 - RNA, 22 nt, Human
uuucuucagagagagcuuuccc

SEQ ID NO: 1100180 - RNA, 22 nt, Human
uacuuacagaaggaagcaauug

SEQ ID NO: 1100181 - RNA, 22 nt, Human
caaggccagagccagcgauaag

SEQ ID NO: 1100182 - RNA, 22 nt, Human
ugaaggcccuaucuccauauac

SEQ ID NO: 1100183 - RNA, 22 nt, Human
agguccagcuguugcagccucc

SEQ ID NO: 1100184 - RNA, 22 nt, Human
auaagcauguuagaauauuuga

SEQ ID NO: 1100185 - RNA, 22 nt, Human
gcagcugaauguccauugcugc

SEQ ID NO: 1100186 - RNA, 22 nt, Human
aacaaaugaccugauuucuucc

SEQ ID NO: 1100187 - RNA, 22 nt, Human
gagagaaaugugcaguuugggc

SEQ ID NO: 1100188 - RNA, 21 nt, Human
aaauacagaaacuuguuuuca

SEQ ID NO: 1100189 - RNA, 23 nt, Human
uuugaaaguaucaacucgccuga

SEQ ID NO: 1100190 - RNA, 22 nt, Human
uuuguuuagaugguaaaucagu

SEQ ID NO: 1100191 - RNA, 22 nt, Human
uuguauuucuccacuuucuguu

SEQ ID NO: 1100192 - RNA, 22 nt, Human
aaauaguucagccacggugacu

SEQ ID NO: 1100193 - RNA, 22 nt, Human
cugaggaagacagcagcugugu

SEQ ID NO: 1100194 - RNA, 18 nt, Human
gaugggagcaagagaaga

SEQ ID NO: 1100195 - RNA, 22 nt, Human
uuugaaaggagcuuuauccaga

SEQ ID NO: 1100196 - RNA, 22 nt, Human
uaaucuguguaccuucaucgga

SEQ ID NO: 1100197 - RNA, 22 nt, Human
aaacacauuagcccuguggaaa

SEQ ID NO: 1100198 - RNA, 22 nt, Human
uugaaagacuucuccugugaaa

SEQ ID NO: 1100199 - RNA, 20 nt, Human
caucaucacaugagccaauu

SEQ ID NO: 1100200 - RNA, 22 nt, Human
uuucuaggucuuccauacugcc

SEQ ID NO: 1100201 - RNA, 22 nt, Human
acaggccacaguggagucucug

SEQ ID NO: 1100202 - RNA, 21 nt, Human
uccuuccuugagguccuuucc

SEQ ID NO: 1100203 - RNA, 22 nt, Human
acuucacagaaauuuuaugagg

SEQ ID NO: 1100204 - RNA, 22 nt, Human
uuugaaguguuauuucuaucac

SEQ ID NO: 1100205 - RNA, 22 nt, Human
uuucugugguggguaguucaga

SEQ ID NO: 1100206 - RNA, 22 nt, Human
uaaacauuuguuauucuuguuu

SEQ ID NO: 1100207 - RNA, 22 nt, Human
uaaguggaagguuauaugcuaa

SEQ ID NO: 1100208 - RNA, 23 nt, Human
auguuauuauuagcagucuugcc

SEQ ID NO: 1100209 - RNA, 22 nt, Human
ucaggaugguguggaggaaaua

SEQ ID NO: 1100210 - RNA, 22 nt, Human
aagauauagauaaaacuaugca

SEQ ID NO: 1100211 - RNA, 22 nt, Human
ggauggcagucugcaugagaaa

SEQ ID NO: 1100212 - RNA, 22 nt, Human
agauauguuuguauauauuugu

SEQ ID NO: 1100213 - RNA, 22 nt, Human
auucuucaucacuaccuuguga

SEQ ID NO: 1100214 - RNA, 22 nt, Human
uuucugaagauacagcuuugcu

SEQ ID NO: 1100215 - RNA, 22 nt, Human
uucugaaagccaauucauugaa

SEQ ID NO: 1100216 - RNA, 22 nt, Human
gagccaaggguugccauggaga

SEQ ID NO: 1100217 - RNA, 22 nt, Human
aaaguuuguuauaugauaagga

SEQ ID NO: 1100218 - RNA, 22 nt, Human
acauuucuaguuguucaucucc

SEQ ID NO: 1100219 - RNA, 22 nt, Human
agugcuuugagcguuugaaaag

SEQ ID NO: 1100220 - RNA, 22 nt, Human
uagcuguguaagcuugguaaga

SEQ ID NO: 1100221 - RNA, 22 nt, Human
uccaugaggaccaaauucguag

SEQ ID NO: 1100222 - RNA, 22 nt, Human
caagauggagaagcagcaaggg

SEQ ID NO: 1100223 - RNA, 20 nt, Human
augugucuguaaacaacucu

SEQ ID NO: 1100224 - RNA, 22 nt, Human
ugucagaugcgauaaacuagug

SEQ ID NO: 1100225 - RNA, 22 nt, Human
cauuuguuaauuacuauuaucu

SEQ ID NO: 1100226 - RNA, 17 nt, Human
ugaaggccaugaccacg

SEQ ID NO: 1100227 - RNA, 22 nt, Human
ugauuuccuaggucuggagaag

SEQ ID NO: 1100228 - RNA, 22 nt, Human
cuuugaauugccguuucaucug

SEQ ID NO: 1100229 - RNA, 22 nt, Human
aaauauacuagaugaugaccca

SEQ ID NO: 1100230 - RNA, 20 nt, Human
uggcaucucucaauuguagg

SEQ ID NO: 1100231 - RNA, 22 nt, Human
uuugaaagucaaccuuccaguu

SEQ ID NO: 1100232 - RNA, 23 nt, Human
auuugagaaaguauuuuuaagac

SEQ ID NO: 1100233 - RNA, 22 nt, Human
ucucaggacuuugggaagcuca

SEQ ID NO: 1100234 - RNA, 22 nt, Human
auuugcuuucagguauaaaagg

SEQ ID NO: 1100235 - RNA, 22 nt, Human
ugaacaaacugcauucuucacu

SEQ ID NO: 1100236 - RNA, 22 nt, Human
uuaacacauauuuaucaauugc

SEQ ID NO: 1100237 - RNA, 22 nt, Human
uaugucaaaguuaagaaauagg

SEQ ID NO: 1100238 - RNA, 22 nt, Human
uuucacauaugguuguugauug

SEQ ID NO: 1100239 - RNA, 22 nt, Human
caaggccaguucaccaagggca

SEQ ID NO: 1100240 - RNA, 22 nt, Human
aaaugauugucaaaguucuguu

SEQ ID NO: 1100241 - RNA, 23 nt, Human
aaugauuucaugaugauagcagc

SEQ ID NO: 1100242 - RNA, 22 nt, Human
auuuuacuuugugaauauugac

SEQ ID NO: 1100243 - RNA, 22 nt, Human
caaggccaagucucugugaaga

SEQ ID NO: 1100244 - RNA, 19 nt, Human
cauuuuaagcauccccagu

SEQ ID NO: 1100245 - RNA, 22 nt, Human
aucaggauuacacggggaugcu

SEQ ID NO: 1100246 - RNA, 19 nt, Human
aaacacagauuucuuacca

SEQ ID NO: 1100247 - RNA, 22 nt, Human
gaggaaccacucugagaagcca

SEQ ID NO: 1100248 - RNA, 23 nt, Human
cugcugugaaacaugguuuuggu

SEQ ID NO: 1100249 - RNA, 22 nt, Human
uucugucaaauuugccauaugg

SEQ ID NO: 1100250 - RNA, 22 nt, Human
cacccugggcugggccuguuaa

SEQ ID NO: 1100251 - RNA, 22 nt, Human
cugacuguaauucuguucuuaa

SEQ ID NO: 1100252 - RNA, 22 nt, Human
aaaguugugaaaccgaacaugu

SEQ ID NO: 1100253 - RNA, 22 nt, Human
acaagguauccacauuaaaugu

SEQ ID NO: 1100254 - RNA, 22 nt, Human
aauguauuccucaugcaagagu

SEQ ID NO: 1100255 - RNA, 20 nt, Human
uuaucugucaaucugucuca

SEQ ID NO: 1100256 - RNA, 22 nt, Human
aacugcuguggccuaguacuua

SEQ ID NO: 1100257 - RNA, 22 nt, Human
gucuucuuuucagucugcuugu

SEQ ID NO: 1100258 - RNA, 22 nt, Human
cacaugaguccugccagguaug

SEQ ID NO: 1100259 - RNA, 22 nt, Human
cugguacaaaaugcugauauca

SEQ ID NO: 1100260 - RNA, 22 nt, Human
uguaggccuauguccagcaauu

SEQ ID NO: 1100261 - RNA, 22 nt, Human
gaauauuuucaguacagauggu

SEQ ID NO: 1100262 - RNA, 22 nt, Human
caaauguauaaauguacuuucu

SEQ ID NO: 1100263 - RNA, 23 nt, Human
guaaaauacgcagugcaguguga

SEQ ID NO: 1100264 - RNA, 22 nt, Human
cugcuucugggaugauggagua

SEQ ID NO: 1100265 - RNA, 22 nt, Human
agucauaugacccuucacaaac

SEQ ID NO: 1100266 - RNA, 21 nt, Human
cucaaagaccaaaaguguaga

SEQ ID NO: 1100267 - RNA, 22 nt, Human
uuagaacugaagaagauuaagg

SEQ ID NO: 1100268 - RNA, 22 nt, Human
acauacauauguuuaaaugcau

SEQ ID NO: 1100269 - RNA, 22 nt, Human
agcugcuacugcucugccagag

SEQ ID NO: 1100270 - RNA, 22 nt, Human
agugcuguuagguuaauauagu

SEQ ID NO: 1100271 - RNA, 22 nt, Human
auacaacuuuaucuguaaugag

SEQ ID NO: 1100272 - RNA, 22 nt, Human
agcuaccuggcuuaucacuguc

SEQ ID NO: 1100273 - RNA, 22 nt, Human
uauuuccaccuauuauuuucug

SEQ ID NO: 1100274 - RNA, 22 nt, Human
cuugcugucuugcauuuagagc

SEQ ID NO: 1100275 - RNA, 22 nt, Human
uagcuuuccuuguugccugugc

SEQ ID NO: 1100276 - RNA, 22 nt, Human
ugaaggccagggauuugcagcc

SEQ ID NO: 1100277 - RNA, 22 nt, Human
acagauauuuggggaaagacgu

SEQ ID NO: 1100278 - RNA, 22 nt, Human
cuuugcaaacugucacacuuuc

SEQ ID NO: 1100279 - RNA, 22 nt, Human
aauuuguuaaaagugagugaca

SEQ ID NO: 1100280 - RNA, 22 nt, Human
acaaauauuuacugaauccacu

SEQ ID NO: 1100281 - RNA, 20 nt, Human
uauuuacaacuuagagccuc

SEQ ID NO: 1100282 - RNA, 22 nt, Human
auugaaagauauacuguucuca

SEQ ID NO: 1100283 - RNA, 20 nt, Human
auaaaauaacugccacaaga

SEQ ID NO: 1100284 - RNA, 22 nt, Human
cucacugucuguacuagcugau

SEQ ID NO: 1100285 - RNA, 22 nt, Human
aucacaaaggcugcuucaugau

SEQ ID NO: 1100286 - RNA, 19 nt, Human
aucugccuguuaucacaua

SEQ ID NO: 1100287 - RNA, 22 nt, Human
aaguaugacauuuaagacaauu

SEQ ID NO: 1100288 - RNA, 22 nt, Human
aaaguuaguuucuuauaugucu

SEQ ID NO: 1100289 - RNA, 22 nt, Human
accauccugaaaccuucaugcu

SEQ ID NO: 1100290 - RNA, 22 nt, Human
cuguaguugaugauuucugaua

SEQ ID NO: 1100291 - RNA, 22 nt, Human
ugucccucugaggcuucccugg

SEQ ID NO: 1100292 - RNA, 22 nt, Human
gaucauuugcaggaaacauuaa

SEQ ID NO: 1100293 - RNA, 22 nt, Human
cuucuucauguauugauagucu

SEQ ID NO: 1100294 - RNA, 22 nt, Human
auuucccagcuuugaucaguuu

SEQ ID NO: 1100295 - RNA, 22 nt, Human
uugaaauggaagugaaaauucu

SEQ ID NO: 1100296 - RNA, 22 nt, Human
uugaaaggaauacagaggccua

SEQ ID NO: 1100297 - RNA, 22 nt, Human
aaaguaguuagucaugugaaaa

SEQ ID NO: 1100298 - RNA, 22 nt, Human
uuuccucauuuaucugcuggga

SEQ ID NO: 1100299 - RNA, 22 nt, Human
uucucugaucuugcuagacuga

SEQ ID NO: 1100300 - RNA, 22 nt, Human
uggucuuuaagguagcugucau

SEQ ID NO: 1100301 - RNA, 22 nt, Human
aauugcaauuuucuuaaggucu

SEQ ID NO: 1100302 - RNA, 22 nt, Human
aaaggccaugguuggaguguuu

SEQ ID NO: 1100303 - RNA, 22 nt, Human
ucucauugguauauacaugugu

SEQ ID NO: 1100304 - RNA, 22 nt, Human
guuuuccugaaacugauggugu

SEQ ID NO: 1100305 - RNA, 22 nt, Human
cugcugugcuuguggccacccg

SEQ ID NO: 1100306 - RNA, 22 nt, Human
auugucuuuccacugagaaguu

SEQ ID NO: 1100307 - RNA, 22 nt, Human
ugaaaugauuauaugguguuug

SEQ ID NO: 1100308 - RNA, 22 nt, Human
cucuucuugcuagacugagugc

SEQ ID NO: 1100309 - RNA, 22 nt, Human
cuugcugucccuugguaugaac

SEQ ID NO: 1100310 - RNA, 22 nt, Human
agcaccuguugcacuucauaau

SEQ ID NO: 1100311 - RNA, 22 nt, Human
acauuucacuguucacagcagg

SEQ ID NO: 1100312 - RNA, 22 nt, Human
cucaagacugaucgcaguggaa

SEQ ID NO: 1100313 - RNA, 22 nt, Human
aaucugucguaguaaaaagcag

SEQ ID NO: 1100314 - RNA, 22 nt, Human
ucacaauauuuaucuuccaauu

SEQ ID NO: 1100315 - RNA, 22 nt, Human
ucuuuauugcuacugguuuguc

SEQ ID NO: 1100316 - RNA, 22 nt, Human
cauggcugcgagaagagugggu

SEQ ID NO: 1100317 - RNA, 22 nt, Human
uucaggauccccaccgcguuua

SEQ ID NO: 1100318 - RNA, 22 nt, Human
aauaugcauuaacuguguacau

SEQ ID NO: 1100319 - RNA, 22 nt, Human
ucaguagcagaaagcaaugagu

SEQ ID NO: 1100320 - RNA, 22 nt, Human
uuauggcauauuccucauugua

SEQ ID NO: 1100321 - RNA, 22 nt, Human
uaauuucaauagcuugcauaau

SEQ ID NO: 1100322 - RNA, 22 nt, Human
uuucauggcuaggacuagagug

SEQ ID NO: 1100323 - RNA, 22 nt, Human
auucaaauuaaguuaauucagc

SEQ ID NO: 1100324 - RNA, 20 nt, Human
gagauggacagaugaagggg

SEQ ID NO: 1100325 - RNA, 22 nt, Human
aagauaauauucauuaacuaga

SEQ ID NO: 1100326 - RNA, 21 nt, Human
gauugaaaccauggcagugag

SEQ ID NO: 1100327 - RNA, 22 nt, Human
uuuccagguauuaauacuguau

SEQ ID NO: 1100328 - RNA, 22 nt, Human
auuaaauuuucacuaggcuccc

SEQ ID NO: 1100329 - RNA, 23 nt, Human
auguaucucauccaaggaagcuc

SEQ ID NO: 1100330 - RNA, 22 nt, Human
uuggaaauugcaagugauuugc

SEQ ID NO: 1100331 - RNA, 22 nt, Human
aaugucauugguaaagauuagg

SEQ ID NO: 1100332 - RNA, 22 nt, Human
gaggccaaguuggagaccaggu

SEQ ID NO: 1100333 - RNA, 22 nt, Human
uucucagauauuuacugagcau

SEQ ID NO: 1100334 - RNA, 22 nt, Human
ucucugguuauuaacuaacucc

SEQ ID NO: 1100335 - RNA, 22 nt, Human
ggaggccagggacccagucagc

SEQ ID NO: 1100336 - RNA, 22 nt, Human
cagcauuuggaggagaggcuuu

SEQ ID NO: 1100337 - RNA, 22 nt, Human
gcuaugcaggagccuaaugaca

SEQ ID NO: 1100338 - RNA, 22 nt, Human
ugccuguguccccuucuuggca

SEQ ID NO: 1100339 - RNA, 22 nt, Human
cugccaucugagccaaaagugc

SEQ ID NO: 1100340 - RNA, 23 nt, Human
acucacaaagcaggaucauguug

SEQ ID NO: 1100341 - RNA, 22 nt, Human
cugcuguggguuaagacacugu

SEQ ID NO: 1100342 - RNA, 22 nt, Human
ucacaugaguauuauuuuccaa

SEQ ID NO: 1100343 - RNA, 22 nt, Human
ugcuuggccuacuuguccuuug

SEQ ID NO: 1100344 - RNA, 22 nt, Human
cauauaaauacaacauguguua

SEQ ID NO: 1100345 - RNA, 22 nt, Human
cucaggauagauuguccucuca

SEQ ID NO: 1100346 - RNA, 22 nt, Human
gaauacaugauacaugaacugc

SEQ ID NO: 1100347 - RNA, 22 nt, Human
aaaauuauggaguaucccaaag

SEQ ID NO: 1100348 - RNA, 22 nt, Human
ggcuuggaaauugcaggacaca

SEQ ID NO: 1100349 - RNA, 22 nt, Human
cuucuucaucuguaaaacuugg

SEQ ID NO: 1100350 - RNA, 22 nt, Human
uguucucacuggaugcuucaca

SEQ ID NO: 1100351 - RNA, 22 nt, Human
uaauaucuggcauucaaacaug

SEQ ID NO: 1100352 - RNA, 22 nt, Human
aaauaguuagcccugcauauau

SEQ ID NO: 1100353 - RNA, 22 nt, Human
guuuuucuuugugugaagacaa

SEQ ID NO: 1100354 - RNA, 22 nt, Human
uuucagaaagcugaacauauga

SEQ ID NO: 1100355 - RNA, 22 nt, Human
auguuugacugaguuuggcaga

SEQ ID NO: 1100356 - RNA, 22 nt, Human
uacugccuggagcauuggugcu

SEQ ID NO: 1100357 - RNA, 22 nt, Human
ugaauaguccuuggaauaacug

SEQ ID NO: 1100358 - RNA, 17 nt, Human
caaggccagcaucuuca

SEQ ID NO: 1100359 - RNA, 22 nt, Human
ucucaggaucuaauacauggua

SEQ ID NO: 1100360 - RNA, 22 nt, Human
acugcccucccaucuauugcaa

SEQ ID NO: 1100361 - RNA, 19 nt, Human
agcauuuggaauucuacac

SEQ ID NO: 1100362 - RNA, 20 nt, Human
uuuacauuuugaaacaguga

SEQ ID NO: 1100363 - RNA, 22 nt, Human
uuucacuagaacguucuuguuu

SEQ ID NO: 1100364 - RNA, 22 nt, Human
uagaaauaaaucugcagcuggg

SEQ ID NO: 1100365 - RNA, 19 nt, Human
ugcauaaauuauauacuuu

SEQ ID NO: 1100366 - RNA, 22 nt, Human
aucacugucgucaucugagauu

SEQ ID NO: 1100367 - RNA, 22 nt, Human
auaaagauuucuuuuucucuac

SEQ ID NO: 1100368 - RNA, 22 nt, Human
aggcacaggaaugucauccagu

SEQ ID NO: 1100369 - RNA, 22 nt, Human
auuucccaugugaaucaauugg

SEQ ID NO: 1100370 - RNA, 22 nt, Human
auguucuuguucaaaugucagu

SEQ ID NO: 1100371 - RNA, 22 nt, Human
agugcuuugugcucucacugca

SEQ ID NO: 1100372 - RNA, 22 nt, Human
caggaugguggcaugaucagaa

SEQ ID NO: 1100373 - RNA, 22 nt, Human
guucuucagucacaucacagaa

SEQ ID NO: 1100374 - RNA, 22 nt, Human
ggauguugauugaauggccauu

SEQ ID NO: 1100375 - RNA, 22 nt, Human
aaguauuucuggccugugaaag

SEQ ID NO: 1100376 - RNA, 22 nt, Human
uguauaaauuuaaauuccugcu

SEQ ID NO: 1100377 - RNA, 22 nt, Human
ugacaaaacugcaauuacuuuu

SEQ ID NO: 1100378 - RNA, 22 nt, Human
uucaggauucucucccauuuac

SEQ ID NO: 1100379 - RNA, 22 nt, Human
ugccugugguuccaguuuuuuc

SEQ ID NO: 1100380 - RNA, 22 nt, Human
agaccaagaaaggaugaggauc

SEQ ID NO: 1100381 - RNA, 22 nt, Human
uguauuuuuagaccuuuagacc

SEQ ID NO: 1100382 - RNA, 22 nt, Human
agucuucucauuucacaugcuu

SEQ ID NO: 1100383 - RNA, 22 nt, Human
uucagaaugugaccuuauuugg

SEQ ID NO: 1100384 - RNA, 22 nt, Human
cuugcugggguaagucugugcu

SEQ ID NO: 1100385 - RNA, 22 nt, Human
gaucauuuacuuguucuggacu

SEQ ID NO: 1100386 - RNA, 22 nt, Human
uucaauucuaaacuaauauucu

SEQ ID NO: 1100387 - RNA, 22 nt, Human
uuucaguuuuugcucgauguau

SEQ ID NO: 1100388 - RNA, 22 nt, Human
guugaaugaaucauucuaugua

SEQ ID NO: 1100389 - RNA, 22 nt, Human
cucauuaaaggaaaucaccugc

SEQ ID NO: 1100390 - RNA, 22 nt, Human
ccucuucuaggacguccuugug

SEQ ID NO: 1100391 - RNA, 22 nt, Human
auuucacucauucauguuacuu

SEQ ID NO: 1100392 - RNA, 22 nt, Human
gugcuaaaggguuaugaacaag

SEQ ID NO: 1100393 - RNA, 22 nt, Human
uacuaaauaguuuaauuccuca

SEQ ID NO: 1100394 - RNA, 22 nt, Human
uugaaguuguaguucagugaag

SEQ ID NO: 1100395 - RNA, 22 nt, Human
augaacugcaguauaaacuugg

SEQ ID NO: 1100396 - RNA, 22 nt, Human
cucugauuuccuuauucuguca

SEQ ID NO: 1100397 - RNA, 22 nt, Human
uuugacaaauccuucagcaaug

SEQ ID NO: 1100398 - RNA, 22 nt, Human
auucauaacggcaaaugucacc

SEQ ID NO: 1100399 - RNA, 22 nt, Human
auuaguaaaacauuguauaugu

SEQ ID NO: 1100400 - RNA, 22 nt, Human
gugcugugcgcuuuuucuguau

SEQ ID NO: 1100401 - RNA, 22 nt, Human
uuuccagagcaugucugcucag

SEQ ID NO: 1100402 - RNA, 22 nt, Human
uauaauguuuuccauggacuga

SEQ ID NO: 1100403 - RNA, 22 nt, Human
acuggcaguagagggagcgcau

SEQ ID NO: 1100404 - RNA, 22 nt, Human
cauuugcagagggugacacucu

SEQ ID NO: 1100405 - RNA, 22 nt, Human
caaaugauaccuauuacuaggc

SEQ ID NO: 1100406 - RNA, 22 nt, Human
uguagaaacuacacaugcaaca

SEQ ID NO: 1100407 - RNA, 22 nt, Human
augugucuuugagacucugcua

SEQ ID NO: 1100408 - RNA, 22 nt, Human
ccuucuucuguguggcccaaga

SEQ ID NO: 1100409 - RNA, 22 nt, Human
uuaaauauuauguugucugcaa

SEQ ID NO: 1100410 - RNA, 22 nt, Human
ugcuuucaaaggcuuucuagau

SEQ ID NO: 1100411 - RNA, 18 nt, Human
cccucuugcacaaagcaa

SEQ ID NO: 1100412 - RNA, 22 nt, Human
ugcuagaauuagguuaaacaaa

SEQ ID NO: 1100413 - RNA, 22 nt, Human
uagcaauagaaacauauaaagu

SEQ ID NO: 1100414 - RNA, 18 nt, Human
ugagaggcagguagagga

SEQ ID NO: 1100415 - RNA, 22 nt, Human
auugaggcagcauaguucaggg

SEQ ID NO: 1100416 - RNA, 22 nt, Human
cugcuguguuagcagguuuagu

SEQ ID NO: 1100417 - RNA, 22 nt, Human
cuguuuaucucuaaccuguuua

SEQ ID NO: 1100418 - RNA, 22 nt, Human
uuucauugucuacauaugacau

SEQ ID NO: 1100419 - RNA, 22 nt, Human
cagugauggauauggagaaguc

SEQ ID NO: 1100420 - RNA, 22 nt, Human
ugugaaaagcaggcuacuuucu

SEQ ID NO: 1100421 - RNA, 22 nt, Human
ucuacugugguccuuguaacca

SEQ ID NO: 1100422 - RNA, 22 nt, Human
auguaugaugcuaggcucucag

SEQ ID NO: 1100423 - RNA, 22 nt, Human
uuugaaagcaccauuugaguag

SEQ ID NO: 1100424 - RNA, 22 nt, Human
uucugucaaaugccaguagaga

SEQ ID NO: 1100425 - RNA, 22 nt, Human
ugccuggaaggcccaugggaag

SEQ ID NO: 1100426 - RNA, 22 nt, Human
guuauaaaaugcacaguuguuu

SEQ ID NO: 1100427 - RNA, 22 nt, Human
uuccaugaaggagacugagaag

SEQ ID NO: 1100428 - RNA, 22 nt, Human
caugugguucaaguacuccaca

SEQ ID NO: 1100429 - RNA, 22 nt, Human
aagacuguacauuuuccagucu

SEQ ID NO: 1100430 - RNA, 19 nt, Human
ugcugcuguccuugcaggg

SEQ ID NO: 1100431 - RNA, 22 nt, Human
ugguuuugcuaaaauagaaaga

SEQ ID NO: 1100432 - RNA, 22 nt, Human
cagucucucugaaguauuaaga

SEQ ID NO: 1100433 - RNA, 22 nt, Human
uuagccaugcccuagaagagga

SEQ ID NO: 1100434 - RNA, 22 nt, Human
cauuuccugucuggaggucaaa

SEQ ID NO: 1100435 - RNA, 22 nt, Human
ggauggcaggacaaggacccag

SEQ ID NO: 1100436 - RNA, 22 nt, Human
ucugaaggugcuagagaaagcu

SEQ ID NO: 1100437 - RNA, 22 nt, Human
cauaauuucccaagagauugaa

SEQ ID NO: 1100438 - RNA, 22 nt, Human
uucuaugccauguucagcuacu

SEQ ID NO: 1100439 - RNA, 20 nt, Human
uggaaguucuguugcauugg

SEQ ID NO: 1100440 - RNA, 22 nt, Human
agcagccuuugaucaucuggga

SEQ ID NO: 1100441 - RNA, 22 nt, Human
uaucuuguaauagguccacuug

SEQ ID NO: 1100442 - RNA, 22 nt, Human
ugcuuuggaucuauuugcugag

SEQ ID NO: 1100443 - RNA, 22 nt, Human
uguguucuggaaagcucacuga

SEQ ID NO: 1100444 - RNA, 22 nt, Human
gcugccagccaacuugcugugc

SEQ ID NO: 1100445 - RNA, 21 nt, Human
uuucugaaggcaacaucuauc

SEQ ID NO: 1100446 - RNA, 22 nt, Human
aacauucugguucuaaaaaccu

SEQ ID NO: 1100447 - RNA, 22 nt, Human
ccagugcuucuuugcuagcugg

SEQ ID NO: 1100448 - RNA, 22 nt, Human
augcugugguagacagcauucc

SEQ ID NO: 1100449 - RNA, 22 nt, Human
gcucaggaccgaggggugggaa

SEQ ID NO: 1100450 - RNA, 22 nt, Human
cuuguccccagcagguugguuu

SEQ ID NO: 1100451 - RNA, 22 nt, Human
ucuuccaagguugcacacuauc

SEQ ID NO: 1100452 - RNA, 22 nt, Human
uuugaauguuuuagguacuuaa

SEQ ID NO: 1100453 - RNA, 22 nt, Human
aagauuauggcagauaacaauu

SEQ ID NO: 1100454 - RNA, 22 nt, Human
aucaggaucugggagccugaaa

SEQ ID NO: 1100455 - RNA, 22 nt, Human
gaauaguucuauggcugcaggg

SEQ ID NO: 1100456 - RNA, 22 nt, Human
acauuuaaccaaacuguuuaau

SEQ ID NO: 1100457 - RNA, 22 nt, Human
aaucuucauuuugacaagauuc

SEQ ID NO: 1100458 - RNA, 22 nt, Human
ucagagaguuacacaaauuguu

SEQ ID NO: 1100459 - RNA, 22 nt, Human
gagugucugaauuagagcacaa

SEQ ID NO: 1100460 - RNA, 22 nt, Human
aguuagaauagucagauuguag

SEQ ID NO: 1100461 - RNA, 22 nt, Human
cagagggcucuuggcugccugc

SEQ ID NO: 1100462 - RNA, 22 nt, Human
uuugcaaauaccaugaaacuug

SEQ ID NO: 1100463 - RNA, 22 nt, Human
auuuucaaaacaucugcugugu

SEQ ID NO: 1100464 - RNA, 22 nt, Human
cuuuguagcugcuucugauuua

SEQ ID NO: 1100465 - RNA, 22 nt, Human
ucugaaaugcaaauuugacuga

SEQ ID NO: 1100466 - RNA, 22 nt, Human
cuugaaagauuuggccucugug

SEQ ID NO: 1100467 - RNA, 22 nt, Human
gaaggccaguuuugagauaggu

SEQ ID NO: 1100468 - RNA, 18 nt, Human
ggucuuuaggucaguguc

SEQ ID NO: 1100469 - RNA, 22 nt, Human
cuggcuguauuaguuugauccu

SEQ ID NO: 1100470 - RNA, 22 nt, Human
agauggagaaugacaauuaagg

SEQ ID NO: 1100471 - RNA, 22 nt, Human
aagugggaauagaaaugaaggu

SEQ ID NO: 1100472 - RNA, 22 nt, Human
cuuaaaaucuggcaguuagcua

SEQ ID NO: 1100473 - RNA, 22 nt, Human
uguuagaauauuguaauauucg

SEQ ID NO: 1100474 - RNA, 22 nt, Human
ccucacugaagaggugacauuu

SEQ ID NO: 1100475 - RNA, 23 nt, Human
auugaugacuugauuacacuuuu

SEQ ID NO: 1100476 - RNA, 22 nt, Human
caaaguuuuaguaaacauauau

SEQ ID NO: 1100477 - RNA, 22 nt, Human
ucucuucuaauuaggguccaug

SEQ ID NO: 1100478 - RNA, 22 nt, Human
auguauuucuauguagugaaga

SEQ ID NO: 1100479 - RNA, 20 nt, Human
guugaaaguaauaugaugcu

SEQ ID NO: 1100480 - RNA, 22 nt, Human
cucaggauuuaaaggggcacuc

SEQ ID NO: 1100481 - RNA, 22 nt, Human
uuccaugaagggcagccucuca

SEQ ID NO: 1100482 - RNA, 22 nt, Human
ccagugcuuccaggaauacggu

SEQ ID NO: 1100483 - RNA, 22 nt, Human
gagucuuugguaaagucugcug

SEQ ID NO: 1100484 - RNA, 22 nt, Human
auuugcaaagucguaucuguga

SEQ ID NO: 1100485 - RNA, 22 nt, Human
gcauguguugguuuaugcaugu

SEQ ID NO: 1100486 - RNA, 22 nt, Human
uugagaagaaauaguuugcaau

SEQ ID NO: 1100487 - RNA, 22 nt, Human
auuuccaggagaaaggauuuua

SEQ ID NO: 1100488 - RNA, 22 nt, Human
gucccaggugggcuccaccucu

SEQ ID NO: 1100489 - RNA, 22 nt, Human
aauguaugacaguucuaguggu

SEQ ID NO: 1100490 - RNA, 22 nt, Human
aguauugugacucaaguauucu

SEQ ID NO: 1100491 - RNA, 22 nt, Human
aguuggagugaacaugagauug

SEQ ID NO: 1100492 - RNA, 18 nt, Human
aauuuccauaugaauugc

SEQ ID NO: 1100493 - RNA, 22 nt, Human
ucucuucuauuugagacuauuu

SEQ ID NO: 1100494 - RNA, 22 nt, Human
uacaguaagaugaaauagcaau

SEQ ID NO: 1100495 - RNA, 22 nt, Human
ucuuugaugugguuaauuauga

SEQ ID NO: 1100496 - RNA, 22 nt, Human
aucucuguaaaccauaaauuga

SEQ ID NO: 1100497 - RNA, 22 nt, Human
gagcaccucaauuugcuauuug

SEQ ID NO: 1100498 - RNA, 22 nt, Human
ugcauggacucaucagacaaga

SEQ ID NO: 1100499 - RNA, 22 nt, Human
ugugaaaagcguguguucuagg

SEQ ID NO: 1100500 - RNA, 20 nt, Human
agauuauuccuaagauuucu

SEQ ID NO: 1100501 - RNA, 22 nt, Human
cuagccugggauuugaacuuau

SEQ ID NO: 1100502 - RNA, 20 nt, Human
ucagaugggagugagccauc

SEQ ID NO: 1100503 - RNA, 22 nt, Human
uacauguauguguacgugcaug

SEQ ID NO: 1100504 - RNA, 22 nt, Human
cugcugugacagcugccguguu

SEQ ID NO: 1100505 - RNA, 22 nt, Human
agggacuuguguccuauguaug

SEQ ID NO: 1100506 - RNA, 22 nt, Human
auuacaguaacagcuacaaugc

SEQ ID NO: 1100507 - RNA, 22 nt, Human
ucauuuauaaggaugcaauuaa

SEQ ID NO: 1100508 - RNA, 18 nt, Human
cucaccauucugcccaau

SEQ ID NO: 1100509 - RNA, 22 nt, Human
uucugucagaagcuagcuccug

SEQ ID NO: 1100510 - RNA, 22 nt, Human
caugcugugcaucuugaugacc

SEQ ID NO: 1100511 - RNA, 17 nt, Human
uuugaaaggaugucagu

SEQ ID NO: 1100512 - RNA, 22 nt, Human
aucuuucaaucaggaaaaaucu

SEQ ID NO: 1100513 - RNA, 23 nt, Human
acacauuuuucccguucugaggu

SEQ ID NO: 1100514 - RNA, 22 nt, Human
agugcuuuaccuagauaauguu

SEQ ID NO: 1100515 - RNA, 22 nt, Human
uagaaacauguucuguucuguu

SEQ ID NO: 1100516 - RNA, 22 nt, Human
aauauaauuuuauuccuagagu

SEQ ID NO: 1100517 - RNA, 22 nt, Human
uguuugaauuuugcuaacgugu

SEQ ID NO: 1100518 - RNA, 22 nt, Human
aaauguuuugcucccauguggu

SEQ ID NO: 1100519 - RNA, 22 nt, Human
ucauuuaauaauuuuugaguag

SEQ ID NO: 1100520 - RNA, 22 nt, Human
uucuucuugucugcccucacau

SEQ ID NO: 1100521 - RNA, 22 nt, Human
ugaaacuucuaauaugaauagu

SEQ ID NO: 1100522 - RNA, 22 nt, Human
gcucacugccauucucuagaug

SEQ ID NO: 1100523 - RNA, 22 nt, Human
cugagccagcuggcaugugcua

SEQ ID NO: 1100524 - RNA, 22 nt, Human
gugucccaggccucuggaauua

SEQ ID NO: 1100525 - RNA, 22 nt, Human
aaacacauuuuaggaaaaucua

SEQ ID NO: 1100526 - RNA, 22 nt, Human
ucauuguuauguuuugcugucu

SEQ ID NO: 1100527 - RNA, 22 nt, Human
acacuaaugagaaaggaauuaa

SEQ ID NO: 1100528 - RNA, 22 nt, Human
uucacagacuuuccauagauug

SEQ ID NO: 1100529 - RNA, 22 nt, Human
agaggccagguccagaguuugu

SEQ ID NO: 1100530 - RNA, 22 nt, Human
agaccauggccauccuaggaaa

SEQ ID NO: 1100531 - RNA, 22 nt, Human
cucccagagaccaagcugagaa

SEQ ID NO: 1100532 - RNA, 22 nt, Human
aaacacaucauucaugucguca

SEQ ID NO: 1100533 - RNA, 22 nt, Human
acauuuagcuguacaaucuaug

SEQ ID NO: 1100534 - RNA, 22 nt, Human
uaacacauauuugcaguaagca

SEQ ID NO: 1100535 - RNA, 22 nt, Human
cauuuacacuucuaaccacaag

SEQ ID NO: 1100536 - RNA, 23 nt, Human
uucuucucaauuaguugauucag

SEQ ID NO: 1100537 - RNA, 22 nt, Human
ccugcugugaccggggagcagg

SEQ ID NO: 1100538 - RNA, 22 nt, Human
aaguauuucguucugaaaaagu

SEQ ID NO: 1100539 - RNA, 22 nt, Human
gcucaggaaauaguuuaguguu

SEQ ID NO: 1100540 - RNA, 22 nt, Human
gcucacugcaaccucugcuucc

SEQ ID NO: 1100541 - RNA, 22 nt, Human
aggguccugggugcaguugcuu

SEQ ID NO: 1100542 - RNA, 22 nt, Human
gggacuucauagcuaggcacuu

SEQ ID NO: 1100543 - RNA, 22 nt, Human
aaucacaugugcucaauuuuaa

SEQ ID NO: 1100544 - RNA, 22 nt, Human
uuuuaucuucauuccuaucuac

SEQ ID NO: 1100545 - RNA, 19 nt, Human
aaaaacuuaguccagaaag

SEQ ID NO: 1100546 - RNA, 23 nt, Human
uuuggacuugugacucuucuccu

SEQ ID NO: 1100547 - RNA, 22 nt, Human
uuugcaguagacaucuuauuuu

SEQ ID NO: 1100548 - RNA, 22 nt, Human
ugaaaugacagucuuaagcucu

SEQ ID NO: 1100549 - RNA, 22 nt, Human
cucagaagccuucagucuuggc

SEQ ID NO: 1100550 - RNA, 22 nt, Human
aagcaacucccuccucauuuuu

SEQ ID NO: 1100551 - RNA, 16 nt, Human
uucugucacguacggc

SEQ ID NO: 1100552 - RNA, 22 nt, Human
aacauauaaacucuuaaguuca

SEQ ID NO: 1100553 - RNA, 22 nt, Human
agcuucuuggcucagcacuugg

SEQ ID NO: 1100554 - RNA, 22 nt, Human
acauaugauauugaggaucuca

SEQ ID NO: 1100555 - RNA, 22 nt, Human
ucacaauacucacucaauggcu

SEQ ID NO: 1100556 - RNA, 22 nt, Human
gaauacauuggaaaucagaaua

SEQ ID NO: 1100557 - RNA, 22 nt, Human
cuguggaaauaaacaaugcuaa

SEQ ID NO: 1100558 - RNA, 22 nt, Human
uuucucaguuacuagcuguggu

SEQ ID NO: 1100559 - RNA, 22 nt, Human
ucauuuguucaucugcucuucu

SEQ ID NO: 1100560 - RNA, 22 nt, Human
gaccauuuuuacagagcauuca

SEQ ID NO: 1100561 - RNA, 22 nt, Human
cugugauuguuaguuccuauac

SEQ ID NO: 1100562 - RNA, 22 nt, Human
aucugccuccaaguccaugugu

SEQ ID NO: 1100563 - RNA, 22 nt, Human
cuuugcaauagaggcacacaug

SEQ ID NO: 1100564 - RNA, 22 nt, Human
guugacagcuggugagcugcua

SEQ ID NO: 1100565 - RNA, 19 nt, Human
augucuggguaacagcugc

SEQ ID NO: 1100566 - RNA, 22 nt, Human
gagagucuagugcaccuaguuu

SEQ ID NO: 1100567 - RNA, 22 nt, Human
uugggcucaggaguuugagacc

SEQ ID NO: 1100568 - RNA, 22 nt, Human
gaccauuucuaggaaucagacu

SEQ ID NO: 1100569 - RNA, 22 nt, Human
ucuucuuccucauuuauacaua

SEQ ID NO: 1100570 - RNA, 22 nt, Human
uaacuuucacaucacacugacu

SEQ ID NO: 1100571 - RNA, 22 nt, Human
caaggccagggaauuuuucugg

SEQ ID NO: 1100572 - RNA, 22 nt, Human
uauuuccaggccccacucuaga

SEQ ID NO: 1100573 - RNA, 22 nt, Human
agaaaugacacacaugagacau

SEQ ID NO: 1100574 - RNA, 22 nt, Human
cucacuguccaacaggcuuuac

SEQ ID NO: 1100575 - RNA, 22 nt, Human
ucagugaucuaaggguauggcc

SEQ ID NO: 1100576 - RNA, 22 nt, Human
ucucucuuuuuaaucauguaau

SEQ ID NO: 1100577 - RNA, 22 nt, Human
caggaugaagggcaaaggcaag

SEQ ID NO: 1100578 - RNA, 22 nt, Human
aauauuguuucaagaucacaga

SEQ ID NO: 1100579 - RNA, 22 nt, Human
uucugucacuuaggaggucaua

SEQ ID NO: 1100580 - RNA, 22 nt, Human
ucuuugcaggccaaauuguuaa

SEQ ID NO: 1100581 - RNA, 22 nt, Human
uucucagaugauucagauaaac

SEQ ID NO: 1100582 - RNA, 22 nt, Human
aaggaguuuggguagucauaca

SEQ ID NO: 1100583 - RNA, 22 nt, Human
cuuuggcaaggguuuuaauugu

SEQ ID NO: 1100584 - RNA, 22 nt, Human
cuagccaugggcauuaaaggua

SEQ ID NO: 1100585 - RNA, 22 nt, Human
gcauaugaucacgugugucggu

SEQ ID NO: 1100586 - RNA, 22 nt, Human
cucaggaaaggccaugcaaggg

SEQ ID NO: 1100587 - RNA, 22 nt, Human
ugcugugagguugagaaggaag

SEQ ID NO: 1100588 - RNA, 22 nt, Human
uguuugaacugaauaacauagu

SEQ ID NO: 1100589 - RNA, 22 nt, Human
ucaggauggcuucugcaucaaa

SEQ ID NO: 1100590 - RNA, 22 nt, Human
uccauuuucaucucauguauaa

SEQ ID NO: 1100591 - RNA, 23 nt, Human
uuagagaugauuaaaaaaucuug

SEQ ID NO: 1100592 - RNA, 22 nt, Human
agugcuuuagcauccaacuguc

SEQ ID NO: 1100593 - RNA, 20 nt, Human
cauuuguuagcuuucuacug

SEQ ID NO: 1100594 - RNA, 22 nt, Human
acagucuugagcaucagccaga

SEQ ID NO: 1100595 - RNA, 22 nt, Human
uugacacagaucaauauucaac

SEQ ID NO: 1100596 - RNA, 22 nt, Human
auucuucagcaggggacacuau

SEQ ID NO: 1100597 - RNA, 22 nt, Human
ucacaaaugaggaaaucgagca

SEQ ID NO: 1100598 - RNA, 22 nt, Human
ucaaucacguguuccauguucu

SEQ ID NO: 1100599 - RNA, 22 nt, Human
uuauucuucuucucuugccagg

SEQ ID NO: 1100600 - RNA, 22 nt, Human
acuuuugguucuguaacuguga

SEQ ID NO: 1100601 - RNA, 20 nt, Human
auccaugagagucuggauuc

SEQ ID NO: 1100602 - RNA, 22 nt, Human
uugugaaauguuucaaaauagu

SEQ ID NO: 1100603 - RNA, 22 nt, Human
uaacacaugucugggaugugaa

SEQ ID NO: 1100604 - RNA, 22 nt, Human
uauuugaaaguguacaaaaacu

SEQ ID NO: 1100605 - RNA, 22 nt, Human
uuagaaagaacuuuagauauca

SEQ ID NO: 1100606 - RNA, 22 nt, Human
uuauuauagauuaugcaagauu

SEQ ID NO: 1100607 - RNA, 22 nt, Human
cuucuucaaccugaaaguuuca

SEQ ID NO: 1100608 - RNA, 22 nt, Human
cucugcauuuuaacagaugauu

SEQ ID NO: 1100609 - RNA, 22 nt, Human
aauuuccaaauuucugucacac

SEQ ID NO: 1100610 - RNA, 22 nt, Human
ccccaggacacauggaccaagu

SEQ ID NO: 1100611 - RNA, 22 nt, Human
uuucacaacugcuuauuugaga

SEQ ID NO: 1100612 - RNA, 22 nt, Human
uuauuuacaacucuucucuucc

SEQ ID NO: 1100613 - RNA, 23 nt, Human
uuucaacuccugccauuauuucu

SEQ ID NO: 1100614 - RNA, 22 nt, Human
aaaguuugcaauuuauguuaau

SEQ ID NO: 1100615 - RNA, 22 nt, Human
uaaauuguuuucuagaaguugu

SEQ ID NO: 1100616 - RNA, 22 nt, Human
aaaguucuggcauuuucugucu

SEQ ID NO: 1100617 - RNA, 22 nt, Human
uguucuuuggcuucacagcucu

SEQ ID NO: 1100618 - RNA, 22 nt, Human
uucaggaugacaccauguccag

SEQ ID NO: 1100619 - RNA, 22 nt, Human
augcuguguccuagugaaagaa

SEQ ID NO: 1100620 - RNA, 22 nt, Human
uucuccagaccuugugacuaug

SEQ ID NO: 1100621 - RNA, 22 nt, Human
ucacagacacagggagaagcau

SEQ ID NO: 1100622 - RNA, 22 nt, Human
uacauauguaaacauguauaaa

SEQ ID NO: 1100623 - RNA, 22 nt, Human
auuuaaauuuucugauggagag

SEQ ID NO: 1100624 - RNA, 22 nt, Human
aaguguagauuauggagugucu

SEQ ID NO: 1100625 - RNA, 22 nt, Human
uucacaauggcaaaccauuaaa

SEQ ID NO: 1100626 - RNA, 22 nt, Human
cugcugugagugguucuugccu

SEQ ID NO: 1100627 - RNA, 22 nt, Human
cuuaagaugaggucaugcuaua

SEQ ID NO: 1100628 - RNA, 22 nt, Human
uagugcuuuaaguuuacagaga

SEQ ID NO: 1100629 - RNA, 22 nt, Human
auagucuuagaucagauaaagu

SEQ ID NO: 1100630 - RNA, 22 nt, Human
aagugaagaaauacaugagaau

SEQ ID NO: 1100631 - RNA, 22 nt, Human
ucuuugcaaaauacaacaaugg

SEQ ID NO: 1100632 - RNA, 22 nt, Human
gaauauuuguaauuacuguuga

SEQ ID NO: 1100633 - RNA, 22 nt, Human
uuugaaaggaaguuaauacuuu

SEQ ID NO: 1100634 - RNA, 22 nt, Human
cuagaaauauuuuacagucaag

SEQ ID NO: 1100635 - RNA, 22 nt, Human
augcagcuucaggauuaugaug

SEQ ID NO: 1100636 - RNA, 22 nt, Human
aguccaaggagagacagcauuu

SEQ ID NO: 1100637 - RNA, 22 nt, Human
uugaaaguagcagcugcauaug

SEQ ID NO: 1100638 - RNA, 22 nt, Human
acucagaaugacugaugcugug

SEQ ID NO: 1100639 - RNA, 22 nt, Human
caggaugagaggcccagggaag

SEQ ID NO: 1100640 - RNA, 22 nt, Human
gugauaaaauucaaauagcucu

SEQ ID NO: 1100641 - RNA, 21 nt, Human
ucacagacuggucagugaggc

SEQ ID NO: 1100642 - RNA, 22 nt, Human
uuuuuaguagagguggguuuca

SEQ ID NO: 1100643 - RNA, 15 nt, Human
uucaggauaugacuc

SEQ ID NO: 1100644 - RNA, 22 nt, Human
cugcuuugcauagcugccagag

SEQ ID NO: 1100645 - RNA, 22 nt, Human
aaaaugaugcuguaauuuggca

SEQ ID NO: 1100646 - RNA, 22 nt, Human
ugaaacaaugugaaguugcuga

SEQ ID NO: 1100647 - RNA, 22 nt, Human
uggagacugugcuaagggaguu

SEQ ID NO: 1100648 - RNA, 22 nt, Human
ucuucucuacaccagcagcccc

SEQ ID NO: 1100649 - RNA, 22 nt, Human
uucccucuccuacucaggaaag

SEQ ID NO: 1100650 - RNA, 22 nt, Human
uuucaaaccuacuuguauguuu

SEQ ID NO: 1100651 - RNA, 22 nt, Human
ggagcuguuggcagcuaucuug

SEQ ID NO: 1100652 - RNA, 22 nt, Human
ucuccucucuuaccugguacaa

SEQ ID NO: 1100653 - RNA, 22 nt, Human
agucacuguucugucaugucaa

SEQ ID NO: 1100654 - RNA, 22 nt, Human
augcugugcuggcuaaccaugg

SEQ ID NO: 1100655 - RNA, 22 nt, Human
cuaucauuuuacaugguuggug

SEQ ID NO: 1100656 - RNA, 22 nt, Human
aauuuuaaucaguggugcugag

SEQ ID NO: 1100657 - RNA, 22 nt, Human
uauuuucuggacagucuugcuu

SEQ ID NO: 1100658 - RNA, 22 nt, Human
gcucaggaaaacagucuaguaa

SEQ ID NO: 1100659 - RNA, 22 nt, Human
ccaggaugacccccacuuuccu

SEQ ID NO: 1100660 - RNA, 22 nt, Human
acuggcagagacccugauggcc

SEQ ID NO: 1100661 - RNA, 22 nt, Human
augaacuuauuucugaacuuuu

SEQ ID NO: 1100662 - RNA, 22 nt, Human
aauuaugagguagauaucacau

SEQ ID NO: 1100663 - RNA, 22 nt, Human
uggaguuccuuugaaaggcucu

SEQ ID NO: 1100664 - RNA, 22 nt, Human
agcuggcaguaugacuggugac

SEQ ID NO: 1100665 - RNA, 21 nt, Human
aaugaaguggcuauuuugagg

SEQ ID NO: 1100666 - RNA, 22 nt, Human
cagaccagcucuaugaacccaa

SEQ ID NO: 1100667 - RNA, 22 nt, Human
uugcugaaguuaaugcuugcaa

SEQ ID NO: 1100668 - RNA, 21 nt, Human
augugaaaccuuccacgcuga

SEQ ID NO: 1100669 - RNA, 18 nt, Human
cauuguacaaugcuuuau

SEQ ID NO: 1100670 - RNA, 22 nt, Human
ucauuucuauugcuacugucug

SEQ ID NO: 1100671 - RNA, 22 nt, Human
ugaugaaaauaugauucugagg

SEQ ID NO: 1100672 - RNA, 23 nt, Human
ucagucuucccugucaguaauag

SEQ ID NO: 1100673 - RNA, 19 nt, Human
uugaaagauuagcuuucua

SEQ ID NO: 1100674 - RNA, 20 nt, Human
aguguacagacacuagaaau

SEQ ID NO: 1100675 - RNA, 22 nt, Human
ucugucccugagagcucaggag

SEQ ID NO: 1100676 - RNA, 22 nt, Human
aaauuucaguuggaaugagcuc

SEQ ID NO: 1100677 - RNA, 22 nt, Human
gagaaaugcaugcaugucauca

SEQ ID NO: 1100678 - RNA, 22 nt, Human
uucaugugaucacagauuguaa

SEQ ID NO: 1100679 - RNA, 21 nt, Human
uaacacauuuugguacuuugg

SEQ ID NO: 1100680 - RNA, 22 nt, Human
ucagucuuugcuuaugacaaua

SEQ ID NO: 1100681 - RNA, 22 nt, Human
cucccaggggaacuaucaagua

SEQ ID NO: 1100682 - RNA, 22 nt, Human
agucaauucuuuucaacucaag

SEQ ID NO: 1100683 - RNA, 22 nt, Human
aucacauugccagugauuaccc

SEQ ID NO: 1100684 - RNA, 22 nt, Human
uuugcagucaaauuugcuaaau

SEQ ID NO: 1100685 - RNA, 18 nt, Human
aaacuggcuuggccugug

SEQ ID NO: 1100686 - RNA, 22 nt, Human
uaaaguuuggcagacaauaaca

SEQ ID NO: 1100687 - RNA, 22 nt, Human
auuuuacuacuccaauuaauga

SEQ ID NO: 1100688 - RNA, 22 nt, Human
uaaguucauaagcuuauucuua

SEQ ID NO: 1100689 - RNA, 22 nt, Human
aggccagaugucgggcuagaag

SEQ ID NO: 1100690 - RNA, 22 nt, Human
ugacccauggucugaucauagg

SEQ ID NO: 1100691 - RNA, 22 nt, Human
aauuauguagccauaugaaaca

SEQ ID NO: 1100692 - RNA, 22 nt, Human
auacaacagaaaaugauuauuc

SEQ ID NO: 1100693 - RNA, 22 nt, Human
aaggaaccuggaguagagggag

SEQ ID NO: 1100694 - RNA, 22 nt, Human
ucuuaaagagcgcaauuugagg

SEQ ID NO: 1100695 - RNA, 22 nt, Human
cucaggaugcaauuccaucaag

SEQ ID NO: 1100696 - RNA, 22 nt, Human
uaaggccaauuaacaaccaggg

SEQ ID NO: 1100697 - RNA, 22 nt, Human
uuucaaagaccauuaacuauca

SEQ ID NO: 1100698 - RNA, 22 nt, Human
acuugcugguggcauuuacagu

SEQ ID NO: 1100699 - RNA, 22 nt, Human
acagaaauugggcaaauggaag

SEQ ID NO: 1100700 - RNA, 22 nt, Human
uuuggaauuggcauucuauucu

SEQ ID NO: 1100701 - RNA, 22 nt, Human
uaguauuuaaucacuuuugucu

SEQ ID NO: 1100702 - RNA, 22 nt, Human
cuuccuucugaagcauagaagc

SEQ ID NO: 1100703 - RNA, 22 nt, Human
uuagagucaagcugcauguucu

SEQ ID NO: 1100704 - RNA, 22 nt, Human
auauucuucuuguucagacuau

SEQ ID NO: 1100705 - RNA, 22 nt, Human
auuugcuuaucuccacaguugu

SEQ ID NO: 1100706 - RNA, 22 nt, Human
uguccucuuccagugcuccuuc

SEQ ID NO: 1100707 - RNA, 20 nt, Human
aucaggauucuugcuuuguu

SEQ ID NO: 1100708 - RNA, 22 nt, Human
gaaaacuauuggccuagaacaa

SEQ ID NO: 1100709 - RNA, 22 nt, Human
caugcuguguguuuuagcucca

SEQ ID NO: 1100710 - RNA, 22 nt, Human
ucagucucaucaacucuauucc

SEQ ID NO: 1100711 - RNA, 22 nt, Human
aaacugcuuuccacaguggcua

SEQ ID NO: 1100712 - RNA, 22 nt, Human
uuucuucucgacaccuuauccc

SEQ ID NO: 1100713 - RNA, 21 nt, Human
gcaaauguucaggaaaaaaga

SEQ ID NO: 1100714 - RNA, 21 nt, Human
ugaaaugagaaugcugagcac

SEQ ID NO: 1100715 - RNA, 20 nt, Human
agaaauauugaguucagagg

SEQ ID NO: 1100716 - RNA, 22 nt, Human
agugcuuucccugaaaccuucc

SEQ ID NO: 1100717 - RNA, 22 nt, Human
ugccuugcgggcguuucuguug

SEQ ID NO: 1100718 - RNA, 22 nt, Human
aucugucaagauagacucugca

SEQ ID NO: 1100719 - RNA, 22 nt, Human
auucuucaccauggauaauuug

SEQ ID NO: 1100720 - RNA, 22 nt, Human
aaauacagaguugcuuaaaagc

SEQ ID NO: 1100721 - RNA, 22 nt, Human
ccacagagcauuagauuucaga

SEQ ID NO: 1100722 - RNA, 22 nt, Human
cucaggauguacuacagaaggc

SEQ ID NO: 1100723 - RNA, 22 nt, Human
gauggcagucaaccaggugagg

SEQ ID NO: 1100724 - RNA, 22 nt, Human
acuggaaaugagaugauaucag

SEQ ID NO: 1100725 - RNA, 22 nt, Human
guucuucaucauuuuagauagg

SEQ ID NO: 1100726 - RNA, 22 nt, Human
cagugguugguagauacuugag

SEQ ID NO: 1100727 - RNA, 22 nt, Human
ugccuggauucgguuguuguca

SEQ ID NO: 1100728 - RNA, 22 nt, Human
augucaaaucaguuuuaucaga

SEQ ID NO: 1100729 - RNA, 22 nt, Human
cagagccacuuggagaugagaa

SEQ ID NO: 1100730 - RNA, 22 nt, Human
caacacauugaagcuaugauga

SEQ ID NO: 1100731 - RNA, 22 nt, Human
ucauuuaauagcuuuugucuuu

SEQ ID NO: 1100732 - RNA, 19 nt, Human
uucauucuuucuacuuacc

SEQ ID NO: 1100733 - RNA, 22 nt, Human
cauuguuaccaucuuuuaccua

SEQ ID NO: 1100734 - RNA, 22 nt, Human
uuuuucuugugcuggaucuaau

SEQ ID NO: 1100735 - RNA, 22 nt, Human
uuggaaaaacacgauagugguu

SEQ ID NO: 1100736 - RNA, 22 nt, Human
ugaugaaauguugaggcaguga

SEQ ID NO: 1100737 - RNA, 22 nt, Human
auguuuuugagauacaaacaga

SEQ ID NO: 1100738 - RNA, 22 nt, Human
aucacuguguauguauaugcag

SEQ ID NO: 1100739 - RNA, 16 nt, Human
cuuccucuucacuggc

SEQ ID NO: 1100740 - RNA, 22 nt, Human
ugcuauaaguagacauucaaca

SEQ ID NO: 1100741 - RNA, 22 nt, Human
caagagagaugcagcucacuca

SEQ ID NO: 1100742 - RNA, 22 nt, Human
cuuuggcaaugucauuuucaau

SEQ ID NO: 1100743 - RNA, 22 nt, Human
cucuccucagaacaggcccucu

SEQ ID NO: 1100744 - RNA, 22 nt, Human
aaggcagucugguuucaaagca

SEQ ID NO: 1100745 - RNA, 22 nt, Human
uuguugguggaauugaugcuag

SEQ ID NO: 1100746 - RNA, 22 nt, Human
aucaggauguuuggcugucaua

SEQ ID NO: 1100747 - RNA, 22 nt, Human
aaaguucuaaaacucuuuguga

SEQ ID NO: 1100748 - RNA, 22 nt, Human
uagcugcugcagcacagggagg

SEQ ID NO: 1100749 - RNA, 22 nt, Human
cauuguuaauugguaucuuaca

SEQ ID NO: 1100750 - RNA, 22 nt, Human
aauugcuaaagauuauguuuuc

SEQ ID NO: 1100751 - RNA, 22 nt, Human
aaagauuugaguucugcuuaua

SEQ ID NO: 1100752 - RNA, 21 nt, Human
uuucuuaggcucuaaaaugac

SEQ ID NO: 1100753 - RNA, 22 nt, Human
augugaggcagcacggagauua

SEQ ID NO: 1100754 - RNA, 22 nt, Human
uaauuucacugauaugaaguca

SEQ ID NO: 1100755 - RNA, 22 nt, Human
uuugaaagacagaauauuuuug

SEQ ID NO: 1100756 - RNA, 22 nt, Human
augugaaagagguguucagugg

SEQ ID NO: 1100757 - RNA, 22 nt, Human
uuagaaagcuuuccauagucaa

SEQ ID NO: 1100758 - RNA, 22 nt, Human
auuugcuugugcuaugaaaguu

SEQ ID NO: 1100759 - RNA, 22 nt, Human
augauguugauaaauuacuuua

SEQ ID NO: 1100760 - RNA, 22 nt, Human
ucaguucuuuauuucacaguga

SEQ ID NO: 1100761 - RNA, 22 nt, Human
aauacuuuccuauauaaggugc

SEQ ID NO: 1100762 - RNA, 22 nt, Human
uuaguuuucccaucuuuauggu

SEQ ID NO: 1100763 - RNA, 22 nt, Human
gaugccucuuuuggcugaauua

SEQ ID NO: 1100764 - RNA, 22 nt, Human
agaauaugaucggaauacagau

SEQ ID NO: 1100765 - RNA, 22 nt, Human
aaauaguucagcuuguaaaccc

SEQ ID NO: 1100766 - RNA, 22 nt, Human
ucaggaugagcucauaacuaug

SEQ ID NO: 1100767 - RNA, 22 nt, Human
aagcaccuggguuauaucuuag

SEQ ID NO: 1100768 - RNA, 22 nt, Human
auucucaauggcuacuuucaua

SEQ ID NO: 1100769 - RNA, 22 nt, Human
cucuucuugucucugguuagaa

SEQ ID NO: 1100770 - RNA, 22 nt, Human
acagucuacuugagcuuguaua

SEQ ID NO: 1100771 - RNA, 22 nt, Human
auucacaaaaugauauagauac

SEQ ID NO: 1100772 - RNA, 22 nt, Human
ucaucugucccaggcuuuuuuc

SEQ ID NO: 1100773 - RNA, 22 nt, Human
uauuucagucacuucuucucug

SEQ ID NO: 1100774 - RNA, 22 nt, Human
auucuucauaccuacugagguu

SEQ ID NO: 1100775 - RNA, 22 nt, Human
cccaugagguggagguugcagu

SEQ ID NO: 1100776 - RNA, 22 nt, Human
uuguaugaucaaaagaaaugua

SEQ ID NO: 1100777 - RNA, 22 nt, Human
ucauacaauucaaucucugauu

SEQ ID NO: 1100778 - RNA, 22 nt, Human
ugcuugaaagggguuucccagu

SEQ ID NO: 1100779 - RNA, 22 nt, Human
gcaucuaaauaaacgugggagu

SEQ ID NO: 1100780 - RNA, 22 nt, Human
ucauuguuucugcuuuucauga

SEQ ID NO: 1100781 - RNA, 22 nt, Human
uucauugugauucuuggcuagc

SEQ ID NO: 1100782 - RNA, 22 nt, Human
cugcuguggaugcaggaccuca

SEQ ID NO: 1100783 - RNA, 22 nt, Human
guguaugagccuccagcugggc

SEQ ID NO: 1100784 - RNA, 22 nt, Human
ugaguaauaaacugucuugcuc

SEQ ID NO: 1100785 - RNA, 22 nt, Human
uaugaccuuaggaagcaagaag

SEQ ID NO: 1100786 - RNA, 22 nt, Human
cacaauuuguuuuaucaguauu

SEQ ID NO: 1100787 - RNA, 20 nt, Human
ccucaguguccuggacuggg

SEQ ID NO: 1100788 - RNA, 22 nt, Human
uuucacaaucaaauggugaaau

SEQ ID NO: 1100789 - RNA, 22 nt, Human
uuucaacaccagagaccaugcg

SEQ ID NO: 1100790 - RNA, 22 nt, Human
ucacugcucagucuguacuaca

SEQ ID NO: 1100791 - RNA, 22 nt, Human
gugugaaaaugugcacaauaug

SEQ ID NO: 1100792 - RNA, 22 nt, Human
uuagaacuuaagaauacugucu

SEQ ID NO: 1100793 - RNA, 22 nt, Human
uucugucagcugcuuugucuca

SEQ ID NO: 1100794 - RNA, 22 nt, Human
gccugcagauauauaggauggu

SEQ ID NO: 1100795 - RNA, 21 nt, Human
ucucugguuggaguugugcca

SEQ ID NO: 1100796 - RNA, 22 nt, Human
aauugucaaacacaaauaagag

SEQ ID NO: 1100797 - RNA, 22 nt, Human
gugacagucaaagacaugacuu

SEQ ID NO: 1100798 - RNA, 22 nt, Human
auguuucagauacagaucaaau

SEQ ID NO: 1100799 - RNA, 22 nt, Human
uaucuguuccaggcacucagcu

SEQ ID NO: 1100800 - RNA, 22 nt, Human
guucuugccagcauccucaggu

SEQ ID NO: 1100801 - RNA, 22 nt, Human
ucuucuccagugcuucugcaca

SEQ ID NO: 1100802 - RNA, 22 nt, Human
uauucacaguugauuuacaguu

SEQ ID NO: 1100803 - RNA, 22 nt, Human
uuugaagucaggcuuucuaccc

SEQ ID NO: 1100804 - RNA, 22 nt, Human
caaauauuccagguacaucccu

SEQ ID NO: 1100805 - RNA, 22 nt, Human
cuguaugaguugggaauagaau

SEQ ID NO: 1100806 - RNA, 21 nt, Human
uuugaaagcccuauguuuuca

SEQ ID NO: 1100807 - RNA, 22 nt, Human
cugaaugaggaaaagagugagg

SEQ ID NO: 1100808 - RNA, 22 nt, Human
uucaggaugcucagaguagucu

SEQ ID NO: 1100809 - RNA, 22 nt, Human
uaaucuguauuccuacuuugca

SEQ ID NO: 1100810 - RNA, 22 nt, Human
auuaucuauguagaaugauuuu

SEQ ID NO: 1100811 - RNA, 19 nt, Human
uuucuuaggccuuuggccu

SEQ ID NO: 1100812 - RNA, 22 nt, Human
gcacaauuauuuaugcaguaug

SEQ ID NO: 1100813 - RNA, 22 nt, Human
guuuucaauuauaagauggcuu

SEQ ID NO: 1100814 - RNA, 22 nt, Human
gcagaggggaagcugaggaauu

SEQ ID NO: 1100815 - RNA, 22 nt, Human
cagaccagaaggaagccgacaa

SEQ ID NO: 1100816 - RNA, 22 nt, Human
ggccagaggugguacauagcuu

SEQ ID NO: 1100817 - RNA, 18 nt, Human
acucaggaaaugaugaca

SEQ ID NO: 1100818 - RNA, 22 nt, Human
gauuucuuuaugaaguacagaa

SEQ ID NO: 1100819 - RNA, 22 nt, Human
aaucauaauuguauacauucau

SEQ ID NO: 1100820 - RNA, 23 nt, Human
uggacgccgacuuuggaggcgcu

SEQ ID NO: 1100821 - RNA, 20 nt, Human
uaguauuugcauaaggauag

SEQ ID NO: 1100822 - RNA, 22 nt, Human
uuuucuuauggugaagcacaaa

SEQ ID NO: 1100823 - RNA, 22 nt, Human
caaauacuggguaaguuaauuu

SEQ ID NO: 1100824 - RNA, 22 nt, Human
gucccauaaguagugcaacuug

SEQ ID NO: 1100825 - RNA, 22 nt, Human
auucugucauuucaagaaaaac

SEQ ID NO: 1100826 - RNA, 22 nt, Human
acuguugucaggcugcuuugga

SEQ ID NO: 1100827 - RNA, 22 nt, Human
aaguaugugauacauguuaauu

SEQ ID NO: 1100828 - RNA, 22 nt, Human
aucuucucauguguaaugaggu

SEQ ID NO: 1100829 - RNA, 22 nt, Human
gauauuuugagaaauccuauga

SEQ ID NO: 1100830 - RNA, 22 nt, Human
ucaauaaaauuguuuuccuauc

SEQ ID NO: 1100831 - RNA, 22 nt, Human
uuuuaucuaccuaugcucauuu

SEQ ID NO: 1100832 - RNA, 22 nt, Human
uguaggaaaaacaaugaucugc

SEQ ID NO: 1100833 - RNA, 22 nt, Human
uuuaaaaucagaugggaguugg

SEQ ID NO: 1100834 - RNA, 22 nt, Human
ucugucucaaguucuugcacuc

SEQ ID NO: 1100835 - RNA, 21 nt, Human
acagauauuucauugaacauu

SEQ ID NO: 1100836 - RNA, 22 nt, Human
uauguaaaaauucaucaggcug

SEQ ID NO: 1100837 - RNA, 22 nt, Human
uuugaaagccuggcuuuucucu

SEQ ID NO: 1100838 - RNA, 22 nt, Human
acaauguguuuuuauacauuug

SEQ ID NO: 1100839 - RNA, 22 nt, Human
aucacauucuuucaaagcaguc

SEQ ID NO: 1100840 - RNA, 22 nt, Human
uuugacauuauccuguuacugg

SEQ ID NO: 1100841 - RNA, 20 nt, Human
augugagggguugaaguggg

SEQ ID NO: 1100842 - RNA, 22 nt, Human
caucacccggaacugugucugc

SEQ ID NO: 1100843 - RNA, 22 nt, Human
caaauaguuuuucauguauuau

SEQ ID NO: 1100844 - RNA, 22 nt, Human
ucagcugcucaaauuuauguca

SEQ ID NO: 1100845 - RNA, 22 nt, Human
gucacuguauccagguuccagc

SEQ ID NO: 1100846 - RNA, 17 nt, Human
acucaggaucugggagu

SEQ ID NO: 1100847 - RNA, 22 nt, Human
uugugaaacauucauggauuug

SEQ ID NO: 1100848 - RNA, 22 nt, Human
accuugaugccuuuccaagaug

SEQ ID NO: 1100849 - RNA, 22 nt, Human
cuugcuggugguguuuucuaug

SEQ ID NO: 1100850 - RNA, 22 nt, Human
uucucugaaggccaugcucacu

SEQ ID NO: 1100851 - RNA, 22 nt, Human
cuucagaaugggacuguguuug

SEQ ID NO: 1100852 - RNA, 22 nt, Human
uugauacaggccuucuagauga

SEQ ID NO: 1100853 - RNA, 22 nt, Human
uuaucacuuaugagcuuuuugc

SEQ ID NO: 1100854 - RNA, 22 nt, Human
augaaacacacacgcgcauacu

SEQ ID NO: 1100855 - RNA, 22 nt, Human
uucucuuugacauuauucaggu

SEQ ID NO: 1100856 - RNA, 22 nt, Human
uccauuuuagagaugaagaaac

SEQ ID NO: 1100857 - RNA, 22 nt, Human
cauucuuauauuuacucauuca

SEQ ID NO: 1100858 - RNA, 23 nt, Human
cagaaaacccagagcucaguccc

SEQ ID NO: 1100859 - RNA, 22 nt, Human
cucaucugauaaaucacucuua

SEQ ID NO: 1100860 - RNA, 22 nt, Human
uuaacaauagaguuucuucagg

SEQ ID NO: 1100861 - RNA, 22 nt, Human
uguuugaaacuuugaucacuaa

SEQ ID NO: 1100862 - RNA, 22 nt, Human
acuaaauacacacauuuguuca

SEQ ID NO: 1100863 - RNA, 20 nt, Human
uuucugugagaaacacuguu

SEQ ID NO: 1100864 - RNA, 22 nt, Human
gcugcuguugauuuaguccaau

SEQ ID NO: 1100865 - RNA, 23 nt, Human
ucuugaaaagccuacagcaguuc

SEQ ID NO: 1100866 - RNA, 22 nt, Human
gaagcacauggcuauagcuauu

SEQ ID NO: 1100867 - RNA, 19 nt, Human
uucuccagccugaccugag

SEQ ID NO: 1100868 - RNA, 22 nt, Human
uuuccauguuggugaaaugagg

SEQ ID NO: 1100869 - RNA, 22 nt, Human
aucaggauucaguaucuccagc

SEQ ID NO: 1100870 - RNA, 22 nt, Human
aguaugaauugcuuugccugua

SEQ ID NO: 1100871 - RNA, 22 nt, Human
aguucucaagacaauuaccugu

SEQ ID NO: 1100872 - RNA, 22 nt, Human
uuugaaagggacaaagucacug

SEQ ID NO: 1100873 - RNA, 22 nt, Human
gucaggaugagggaugaggagu

SEQ ID NO: 1100874 - RNA, 22 nt, Human
acaagauagcuuagaagauuca

SEQ ID NO: 1100875 - RNA, 22 nt, Human
uucauugucucuguuugccuuc

SEQ ID NO: 1100876 - RNA, 22 nt, Human
caagaugugccuaaucagaccu

SEQ ID NO: 1100877 - RNA, 22 nt, Human
uucuucucggcugucagauagu

SEQ ID NO: 1100878 - RNA, 22 nt, Human
uacagcauauacagaaugaaca

SEQ ID NO: 1100879 - RNA, 20 nt, Human
acuugcugggcuuuguuacc

SEQ ID NO: 1100880 - RNA, 22 nt, Human
aucuucucaagcagcauccugu

SEQ ID NO: 1100881 - RNA, 22 nt, Human
cugcuuugggcagcuuuguggc

SEQ ID NO: 1100882 - RNA, 22 nt, Human
aaaaaucuaugacugcuucucc

SEQ ID NO: 1100883 - RNA, 22 nt, Human
cuggcaguguccagcucgugau

SEQ ID NO: 1100884 - RNA, 22 nt, Human
aaggcaguagguguuucaaacu

SEQ ID NO: 1100885 - RNA, 22 nt, Human
gaaauaagaguccaugccaggu

SEQ ID NO: 1100886 - RNA, 22 nt, Human
uugcagcuucgagucuaucugu

SEQ ID NO: 1100887 - RNA, 22 nt, Human
gauuuuauuagcccaaacuuug

SEQ ID NO: 1100888 - RNA, 22 nt, Human
ucaggauguccaaaauccagcc

SEQ ID NO: 1100889 - RNA, 22 nt, Human
uagugcuuuaggccugaguguc

SEQ ID NO: 1100890 - RNA, 22 nt, Human
ucagucucuggggcuucuguuu

SEQ ID NO: 1100891 - RNA, 22 nt, Human
ugauugaacugagcuucaagau

SEQ ID NO: 1100892 - RNA, 22 nt, Human
ugcuguguggaugugaagaauc

SEQ ID NO: 1100893 - RNA, 22 nt, Human
gcugggaagugcaagaucaagg

SEQ ID NO: 1100894 - RNA, 22 nt, Human
aaaggccagguuggcugguauu

SEQ ID NO: 1100895 - RNA, 22 nt, Human
agaaaugaauauguagugguua

SEQ ID NO: 1100896 - RNA, 22 nt, Human
acuggaaaacacuacuacaugc

SEQ ID NO: 1100897 - RNA, 20 nt, Human
uuugucuguuaaguguuucu

SEQ ID NO: 1100898 - RNA, 21 nt, Human
cucuugugucagagccagagg

SEQ ID NO: 1100899 - RNA, 20 nt, Human
augugaaagaucaguugucu

SEQ ID NO: 1100900 - RNA, 22 nt, Human
aaaaguauuuauggcuauguaa

SEQ ID NO: 1100901 - RNA, 22 nt, Human
uuggcagugaugcagcuuguuc

SEQ ID NO: 1100902 - RNA, 22 nt, Human
aaaggccacacugcucuuucuc

SEQ ID NO: 1100903 - RNA, 22 nt, Human
acagauauaaacuauaguagug

SEQ ID NO: 1100904 - RNA, 20 nt, Human
cgugcugugaccuugagcau

SEQ ID NO: 1100905 - RNA, 22 nt, Human
uuccaugacaccgagggaaguc

SEQ ID NO: 1100906 - RNA, 22 nt, Human
uucugucaaagacuuuuucagg

SEQ ID NO: 1100907 - RNA, 22 nt, Human
caucucaugggcaugccaagcu

SEQ ID NO: 1100908 - RNA, 22 nt, Human
gaaauauuacaguggaggggau

SEQ ID NO: 1100909 - RNA, 22 nt, Human
aucauucuagcuguuguguuga

SEQ ID NO: 1100910 - RNA, 22 nt, Human
cucaggauauugggcuggagca

SEQ ID NO: 1100911 - RNA, 22 nt, Human
uuugaaagcuacuuucggguca

SEQ ID NO: 1100912 - RNA, 21 nt, Human
auucugucaucccagcuacuu

SEQ ID NO: 1100913 - RNA, 22 nt, Human
uaugaacuuuugaugugacaug

SEQ ID NO: 1100914 - RNA, 22 nt, Human
cugcugugcauauuuaucuagg

SEQ ID NO: 1100915 - RNA, 22 nt, Human
aguaugaacggaaggccuggga

SEQ ID NO: 1100916 - RNA, 22 nt, Human
ucagccucucugaguccagacc

SEQ ID NO: 1100917 - RNA, 22 nt, Human
ucugaaagaagggcagucuuuu

SEQ ID NO: 1100918 - RNA, 22 nt, Human
gcuccucuucucccacugaaug

SEQ ID NO: 1100919 - RNA, 22 nt, Human
uucuucuugaaacuuuagguug

SEQ ID NO: 1100920 - RNA, 22 nt, Human
uccagccuaggggaacagcugc

SEQ ID NO: 1100921 - RNA, 22 nt, Human
gcuuugaagucugugucuuuug

SEQ ID NO: 1100922 - RNA, 22 nt, Human
aaaacaguuuaggcaucacagu

SEQ ID NO: 1100923 - RNA, 22 nt, Human
auuucauacuaaggcucaaaaa

SEQ ID NO: 1100924 - RNA, 22 nt, Human
uuuucauuguuccucgagcauu

SEQ ID NO: 1100925 - RNA, 22 nt, Human
gugaaacagaagcuccuggaau

SEQ ID NO: 1100926 - RNA, 21 nt, Human
ugcugaugucagagaagcaag

SEQ ID NO: 1100927 - RNA, 22 nt, Human
aaaaacuguaauuacuuuugca

SEQ ID NO: 1100928 - RNA, 22 nt, Human
uuuccuaggagauugaucacau

SEQ ID NO: 1100929 - RNA, 22 nt, Human
auucauuuagguauucacuuac

SEQ ID NO: 1100930 - RNA, 22 nt, Human
ucuucagagugaaagucuguga

SEQ ID NO: 1100931 - RNA, 22 nt, Human
uugaaauaucaaguuauuagug

SEQ ID NO: 1100932 - RNA, 22 nt, Human
cuggcagucugccucuucacug

SEQ ID NO: 1100933 - RNA, 22 nt, Human
aucaggauggguuuggcuuagg

SEQ ID NO: 1100934 - RNA, 22 nt, Human
aguaugaagcugaaugauuuua

SEQ ID NO: 1100935 - RNA, 22 nt, Human
aauaacuuaagaaauuucccca

SEQ ID NO: 1100936 - RNA, 22 nt, Human
auaugugaaguggguuauuuug

SEQ ID NO: 1100937 - RNA, 22 nt, Human
uucuuacagaguuuacagagcc

SEQ ID NO: 1100938 - RNA, 22 nt, Human
cauuuguacagaacagcuuuau

SEQ ID NO: 1100939 - RNA, 22 nt, Human
uuguaugaauguauccuaauuu

SEQ ID NO: 1100940 - RNA, 22 nt, Human
uaacaguguggacuugagaucu

SEQ ID NO: 1100941 - RNA, 22 nt, Human
uucaugugauaaaugugugacu

SEQ ID NO: 1100942 - RNA, 22 nt, Human
uugugcucuguguuauuuaagg

SEQ ID NO: 1100943 - RNA, 22 nt, Human
cugcugugugcuuacuuggguu

SEQ ID NO: 1100944 - RNA, 22 nt, Human
ucucagucuuugcaaggaugcu

SEQ ID NO: 1100945 - RNA, 22 nt, Human
ggugaguugggguucacagguc

SEQ ID NO: 1100946 - RNA, 22 nt, Human
ucaauucaacacaugcacauug

SEQ ID NO: 1100947 - RNA, 21 nt, Human
gaacauuuggguuguuucuac

SEQ ID NO: 1100948 - RNA, 22 nt, Human
ggacagaggguugacagaguau

SEQ ID NO: 1100949 - RNA, 22 nt, Human
ugcuagaaaucugaaacuagca

SEQ ID NO: 1100950 - RNA, 23 nt, Human
auuucuaggggauuuucuggugc

SEQ ID NO: 1100951 - RNA, 22 nt, Human
gguaugaaaugauuccauguua

SEQ ID NO: 1100952 - RNA, 22 nt, Human
uugcugaaaucuaugacauccu

SEQ ID NO: 1100953 - RNA, 22 nt, Human
agaaaauauucauugagaggcu

SEQ ID NO: 1100954 - RNA, 22 nt, Human
cugcugugauugggagaaaccg

SEQ ID NO: 1100955 - RNA, 22 nt, Human
cuauuucaaggcccagauauga

SEQ ID NO: 1100956 - RNA, 22 nt, Human
ggcuuggaaaugguaaugagcu

SEQ ID NO: 1100957 - RNA, 22 nt, Human
ugaugaauaaacuugagaguca

SEQ ID NO: 1100958 - RNA, 19 nt, Human
uggagacugagagugagca

SEQ ID NO: 1100959 - RNA, 22 nt, Human
uuugcaauuugugcugcaaaug

SEQ ID NO: 1100960 - RNA, 22 nt, Human
ucagauggguuuugaaggaugu

SEQ ID NO: 1100961 - RNA, 22 nt, Human
aaggccagcuuguagggcuggu

SEQ ID NO: 1100962 - RNA, 22 nt, Human
auguagaauggugauuggcagg

SEQ ID NO: 1100963 - RNA, 22 nt, Human
ucucuucuaacacuagaaauuc

SEQ ID NO: 1100964 - RNA, 22 nt, Human
ucugggaauuuauuggcacuuu

SEQ ID NO: 1100965 - RNA, 22 nt, Human
caaugaaaauuuaaguugcagc

SEQ ID NO: 1100966 - RNA, 22 nt, Human
gaugagcauuguuucauguguu

SEQ ID NO: 1100967 - RNA, 22 nt, Human
augaggcauuccacucaaacuc

SEQ ID NO: 1100968 - RNA, 22 nt, Human
uagcucuucauuucaucugauu

SEQ ID NO: 1100969 - RNA, 19 nt, Human
uggggcuguguuuugaccc

SEQ ID NO: 1100970 - RNA, 22 nt, Human
agaccauagggaccucagguug

SEQ ID NO: 1100971 - RNA, 22 nt, Human
ccugcugugaagccaggccugu

SEQ ID NO: 1100972 - RNA, 22 nt, Human
aaggcaguaaaaucuaccuugc

SEQ ID NO: 1100973 - RNA, 22 nt, Human
uacaauauguggccuuuuguga

SEQ ID NO: 1100974 - RNA, 22 nt, Human
aucugucaucagcaccacaggu

SEQ ID NO: 1100975 - RNA, 22 nt, Human
cagcauuuaaugcagugcuucc

SEQ ID NO: 1100976 - RNA, 22 nt, Human
ucauuugugugagugauuugac

SEQ ID NO: 1100977 - RNA, 22 nt, Human
uccuuagagacaagaccaguuu

SEQ ID NO: 1100978 - RNA, 22 nt, Human
cuuaacauccugcauuuuucuu

SEQ ID NO: 1100979 - RNA, 23 nt, Human
uccuuccuuugagaggcuccauc

SEQ ID NO: 1100980 - RNA, 22 nt, Human
guuugcauuuauuagucuucug

SEQ ID NO: 1100981 - RNA, 22 nt, Human
aguucacauaucuguuuuauuu

SEQ ID NO: 1100982 - RNA, 22 nt, Human
uguugagacugagggagucagc

SEQ ID NO: 1100983 - RNA, 22 nt, Human
uaaggccauuauggugggcccg

SEQ ID NO: 1100984 - RNA, 22 nt, Human
ucugcucugggccagcuauuaa

SEQ ID NO: 1100985 - RNA, 21 nt, Human
acauucacaggauauuaucau

SEQ ID NO: 1100986 - RNA, 22 nt, Human
aaagacuuggcuuaugauuugc

SEQ ID NO: 1100987 - RNA, 22 nt, Human
ugcuuugggucucucuaguuuc

SEQ ID NO: 1100988 - RNA, 22 nt, Human
uucuucuccgaggagggcuggu

SEQ ID NO: 1100989 - RNA, 22 nt, Human
ucauuauccuaguaucuugaau

SEQ ID NO: 1100990 - RNA, 22 nt, Human
cagcauuuagaauuugaagugu

SEQ ID NO: 1100991 - RNA, 22 nt, Human
guuugcauauuugcacaggaau

SEQ ID NO: 1100992 - RNA, 22 nt, Human
gauuuuauauggcauacugugg

SEQ ID NO: 1100993 - RNA, 22 nt, Human
aaauguuucuacuugugagcau

SEQ ID NO: 1100994 - RNA, 21 nt, Human
augucaaaugcuuuauuuuau

SEQ ID NO: 1100995 - RNA, 22 nt, Human
uucauucuuugaaucugaggua

SEQ ID NO: 1100996 - RNA, 22 nt, Human
uuguuauaaagacuaaauaugu

SEQ ID NO: 1100997 - RNA, 22 nt, Human
ugucuucaucuccaugcacaga

SEQ ID NO: 1100998 - RNA, 22 nt, Human
ucuuuucaucauuuaauaggua

SEQ ID NO: 1100999 - RNA, 18 nt, Human
uuccaugauuccuuucac

SEQ ID NO: 1101000 - RNA, 22 nt, Human
ugugaaauucuugaaaugcaca

SEQ ID NO: 1101001 - RNA, 22 nt, Human
caugcugugugguuagaacugu

SEQ ID NO: 1101002 - RNA, 22 nt, Human
ccagaggaggggggucuuucug

SEQ ID NO: 1101003 - RNA, 22 nt, Human
gucaggauuaaugggaguaugc

SEQ ID NO: 1101004 - RNA, 22 nt, Human
cuucucagaucucagcuuugag

SEQ ID NO: 1101005 - RNA, 22 nt, Human
auugaaagauaggcuacugugg

SEQ ID NO: 1101006 - RNA, 22 nt, Human
aauacaguaauuuugaugaguu

SEQ ID NO: 1101007 - RNA, 22 nt, Human
ugugaaagcaagucuaguucuc

SEQ ID NO: 1101008 - RNA, 22 nt, Human
uugcauuugaucuuggguucuc

SEQ ID NO: 1101009 - RNA, 22 nt, Human
uccugaggcucacuuugaaugu

SEQ ID NO: 1101010 - RNA, 22 nt, Human
aucaggaucagggcuagcagag

SEQ ID NO: 1101011 - RNA, 22 nt, Human
uucuuaacuggaaaaugucaga

SEQ ID NO: 1101012 - RNA, 22 nt, Human
auaacuuagaguaggcaaaagu

SEQ ID NO: 1101013 - RNA, 22 nt, Human
uauacaauggcugaaucaucca

SEQ ID NO: 1101014 - RNA, 21 nt, Human
uacugagaccucacagugugc

SEQ ID NO: 1101015 - RNA, 22 nt, Human
ucaauauauuccauguuuucuc

SEQ ID NO: 1101016 - RNA, 21 nt, Human
aucacauuggcuguuauuauu

SEQ ID NO: 1101017 - RNA, 22 nt, Human
aaauuauucucauguguuucuu

SEQ ID NO: 1101018 - RNA, 22 nt, Human
aaacacagggauauauauucca

SEQ ID NO: 1101019 - RNA, 22 nt, Human
ucucacuggguauaaaugagua

SEQ ID NO: 1101020 - RNA, 22 nt, Human
agcuagaaguacagccauauga

SEQ ID NO: 1101021 - RNA, 22 nt, Human
uuucaaaguugggaauuguaau

SEQ ID NO: 1101022 - RNA, 22 nt, Human
augaaacagugaauuagucaag

SEQ ID NO: 1101023 - RNA, 22 nt, Human
acaaauguggacauggauaaug

SEQ ID NO: 1101024 - RNA, 22 nt, Human
gcuccucuauuccccacauuuu

SEQ ID NO: 1101025 - RNA, 22 nt, Human
ucucgacagccuggcacagugg

SEQ ID NO: 1101026 - RNA, 22 nt, Human
uuccuuaguguuagauucugug

SEQ ID NO: 1101027 - RNA, 22 nt, Human
cugagagugcucuuugauguca

SEQ ID NO: 1101028 - RNA, 22 nt, Human
aagcuggaacaucuugaggaag

SEQ ID NO: 1101029 - RNA, 23 nt, Human
cagcccuuccugcauguuuuugu

SEQ ID NO: 1101030 - RNA, 22 nt, Human
aagacauugucauuuuauaauu

SEQ ID NO: 1101031 - RNA, 22 nt, Human
uuccucagcuggccugauuggg

SEQ ID NO: 1101032 - RNA, 22 nt, Human
guucuucagaggggaaagaacc

SEQ ID NO: 1101033 - RNA, 22 nt, Human
aaguuucauuguucauguaaca

SEQ ID NO: 1101034 - RNA, 22 nt, Human
aacauuuaugauugagguaaau

SEQ ID NO: 1101035 - RNA, 22 nt, Human
guuaugaaauaaauauagauca

SEQ ID NO: 1101036 - RNA, 18 nt, Human
guaggucaguaccaagca

SEQ ID NO: 1101037 - RNA, 23 nt, Human
caguggagacucaugcuuccuua

SEQ ID NO: 1101038 - RNA, 18 nt, Human
cugcuugggagacgucag

SEQ ID NO: 1101039 - RNA, 22 nt, Human
ucuggcaggcaaucggcucugg

SEQ ID NO: 1101040 - RNA, 22 nt, Human
cagcauuuucuuaauguaggug

SEQ ID NO: 1101041 - RNA, 22 nt, Human
uuaaauuagucaagcuucucug

SEQ ID NO: 1101042 - RNA, 22 nt, Human
gcaccugauugauuucacugcu

SEQ ID NO: 1101043 - RNA, 22 nt, Human
ugcuucugggcaaaugugugug

SEQ ID NO: 1101044 - RNA, 22 nt, Human
cauuuguaauacugacuugcag

SEQ ID NO: 1101045 - RNA, 22 nt, Human
ggagccuggucagguuggcucc

SEQ ID NO: 1101046 - RNA, 22 nt, Human
uauuuucuguggaggaccagau

SEQ ID NO: 1101047 - RNA, 22 nt, Human
uguuagaaauuauuaguaauau

SEQ ID NO: 1101048 - RNA, 22 nt, Human
uacacacagaggccaugggauu

SEQ ID NO: 1101049 - RNA, 22 nt, Human
gcaugucaugucauguaggaau

SEQ ID NO: 1101050 - RNA, 22 nt, Human
cucaggauggaagccuacagga

SEQ ID NO: 1101051 - RNA, 22 nt, Human
aacaucuacuaagugccaggca

SEQ ID NO: 1101052 - RNA, 22 nt, Human
uuugaaagggaaauaaacuccu

SEQ ID NO: 1101053 - RNA, 22 nt, Human
uaaauuauguuccauguccuuu

SEQ ID NO: 1101054 - RNA, 22 nt, Human
uuaugacaggaaaaucacagaa

SEQ ID NO: 1101055 - RNA, 22 nt, Human
auaucauuauguuaugagcaca

SEQ ID NO: 1101056 - RNA, 19 nt, Human
ucucugcuucucuuggcau

SEQ ID NO: 1101057 - RNA, 22 nt, Human
ggcagaagauaggacagggaau

SEQ ID NO: 1101058 - RNA, 22 nt, Human
augacaugaccugguagagaca

SEQ ID NO: 1101059 - RNA, 22 nt, Human
ccaaaugugccuguuucaacaa

SEQ ID NO: 1101060 - RNA, 22 nt, Human
ccauccuaucugaccuacuugu

SEQ ID NO: 1101061 - RNA, 22 nt, Human
cuucugcaauaaguuuuggucc

SEQ ID NO: 1101062 - RNA, 23 nt, Human
ucucaagaggaagcagggcucau

SEQ ID NO: 1101063 - RNA, 18 nt, Human
gucacuguguuucugagc

SEQ ID NO: 1101064 - RNA, 20 nt, Human
gucaggauuaguaaacucug

SEQ ID NO: 1101065 - RNA, 22 nt, Human
uucucagagcacugcugacaaa

SEQ ID NO: 1101066 - RNA, 23 nt, Human
ucucuuucaagagcuuaaugugc

SEQ ID NO: 1101067 - RNA, 22 nt, Human
uaauaguugugacuuuguaaag

SEQ ID NO: 1101068 - RNA, 22 nt, Human
gaaacuuacuuacucacauuuc

SEQ ID NO: 1101069 - RNA, 22 nt, Human
uguggaaaauuggaacguuccu

SEQ ID NO: 1101070 - RNA, 19 nt, Human
ggcagcuggacgcuguuca

SEQ ID NO: 1101071 - RNA, 22 nt, Human
uucaacuagauuuauacaauuc

SEQ ID NO: 1101072 - RNA, 22 nt, Human
gaggccaggagugcuguaaguu

SEQ ID NO: 1101073 - RNA, 22 nt, Human
aguaugaagaauacauagauga

SEQ ID NO: 1101074 - RNA, 19 nt, Human
cuuugucagaacaugcuuc

SEQ ID NO: 1101075 - RNA, 21 nt, Human
aucauucuggaaaauucaagc

SEQ ID NO: 1101076 - RNA, 22 nt, Human
uucaacuaauguuuauuuuaug

SEQ ID NO: 1101077 - RNA, 21 nt, Human
uucugggaaaugagcuggggc

SEQ ID NO: 1101078 - RNA, 22 nt, Human
ggcuuggaccagucacaguggu

SEQ ID NO: 1101079 - RNA, 22 nt, Human
auguagaauuccuucuacuuug

SEQ ID NO: 1101080 - RNA, 22 nt, Human
uuucauuuugguuaugccauaa

SEQ ID NO: 1101081 - RNA, 22 nt, Human
cucuuaguaaugccaugaagca

SEQ ID NO: 1101082 - RNA, 22 nt, Human
caggauggucagaugcauuguc

SEQ ID NO: 1101083 - RNA, 22 nt, Human
aauuacuuaagagaaacuuuga

SEQ ID NO: 1101084 - RNA, 22 nt, Human
caaauguaaauucuuuugaagc

SEQ ID NO: 1101085 - RNA, 23 nt, Human
acauacauggagauaaagugaug

SEQ ID NO: 1101086 - RNA, 22 nt, Human
ucugaaauagaagugucuuucu

SEQ ID NO: 1101087 - RNA, 22 nt, Human
augugaaaaauuucuuauuaca

SEQ ID NO: 1101088 - RNA, 22 nt, Human
ucacccuugauaauguucuucu

SEQ ID NO: 1101089 - RNA, 22 nt, Human
aauucuguaacuuuacugaauu

SEQ ID NO: 1101090 - RNA, 20 nt, Human
ugcugucguguuuucugcuu

SEQ ID NO: 1101091 - RNA, 22 nt, Human
uucuccagagggcucugcagga

SEQ ID NO: 1101092 - RNA, 22 nt, Human
uuucccaguucccugcucuaua

SEQ ID NO: 1101093 - RNA, 22 nt, Human
ucaggagggugacaggcccugg

SEQ ID NO: 1101094 - RNA, 22 nt, Human
uucauguguauggaacauuuuu

SEQ ID NO: 1101095 - RNA, 22 nt, Human
cuucagagugcagaagauuggg

SEQ ID NO: 1101096 - RNA, 21 nt, Human
uguaaguuucaucugaauugg

SEQ ID NO: 1101097 - RNA, 22 nt, Human
ucuacccagagcuaugaccuga

SEQ ID NO: 1101098 - RNA, 17 nt, Human
uuucuccuuccaucuca

SEQ ID NO: 1101099 - RNA, 20 nt, Human
auacacauucauagaaaaau

SEQ ID NO: 1101100 - RNA, 22 nt, Human
auuucagauucagaaauguagg

SEQ ID NO: 1101101 - RNA, 22 nt, Human
ucuggcuuucauuuguuuaaag

SEQ ID NO: 1101102 - RNA, 22 nt, Human
uggaaugacagagagucugaau

SEQ ID NO: 1101103 - RNA, 22 nt, Human
gauguguuuccaggauuuguuu

SEQ ID NO: 1101104 - RNA, 22 nt, Human
uaauuucaccguugcuagaaau

SEQ ID NO: 1101105 - RNA, 22 nt, Human
cuuuccaaugcauuuccaaugu

SEQ ID NO: 1101106 - RNA, 22 nt, Human
uguacauacauagauauacaca

SEQ ID NO: 1101107 - RNA, 22 nt, Human
ugugugaaggaauauauacuca

SEQ ID NO: 1101108 - RNA, 22 nt, Human
uucaggauggcggauguugggg

SEQ ID NO: 1101109 - RNA, 22 nt, Human
augaaggcuguguagauggaug

SEQ ID NO: 1101110 - RNA, 22 nt, Human
acucuucuugcugcucauuaau

SEQ ID NO: 1101111 - RNA, 22 nt, Human
cagagccauuauggagacuugc

SEQ ID NO: 1101112 - RNA, 23 nt, Human
uugauuucaaaugcagagaacac

SEQ ID NO: 1101113 - RNA, 21 nt, Human
gcucagaguauugcacuguuu

SEQ ID NO: 1101114 - RNA, 22 nt, Human
cagugucuccagaugcuccaau

SEQ ID NO: 1101115 - RNA, 22 nt, Human
ucauuauuuuggacuggagugu

SEQ ID NO: 1101116 - RNA, 22 nt, Human
cuuaaauuuucaucuacaagaa

SEQ ID NO: 1101117 - RNA, 22 nt, Human
uuccuugaaugagucauggaaa

SEQ ID NO: 1101118 - RNA, 22 nt, Human
aucuuucaguuucauaccaauu

SEQ ID NO: 1101119 - RNA, 20 nt, Human
uuucuugucggcuguugcug

SEQ ID NO: 1101120 - RNA, 22 nt, Human
cagaauggcuuuuauggcucag

SEQ ID NO: 1101121 - RNA, 22 nt, Human
auguagaaaguucauagaugcg

SEQ ID NO: 1101122 - RNA, 22 nt, Human
uuugaauaucacaaacuuucaa

SEQ ID NO: 1101123 - RNA, 22 nt, Human
ccaagaugaucuuuacaguguu

SEQ ID NO: 1101124 - RNA, 22 nt, Human
agaaaugaagagagucaagguu

SEQ ID NO: 1101125 - RNA, 22 nt, Human
aaacagcaggaacaucuugcca

SEQ ID NO: 1101126 - RNA, 22 nt, Human
uuuaacagaugcuaugucuacc

SEQ ID NO: 1101127 - RNA, 22 nt, Human
aaaggugacugcagcagcuauu

SEQ ID NO: 1101128 - RNA, 22 nt, Human
acuuugcagggcuugauaucca

SEQ ID NO: 1101129 - RNA, 22 nt, Human
uuccugagggacuuuugagauu

SEQ ID NO: 1101130 - RNA, 22 nt, Human
uugcuguguaacuccuggccug

SEQ ID NO: 1101131 - RNA, 22 nt, Human
uuucuuauacuauauugucauc

SEQ ID NO: 1101132 - RNA, 22 nt, Human
aggcucagaggugagcaucugc

SEQ ID NO: 1101133 - RNA, 22 nt, Human
uagaaacaaugacaugcuugua

SEQ ID NO: 1101134 - RNA, 22 nt, Human
uucagaauauuuguuuuacaug

SEQ ID NO: 1101135 - RNA, 22 nt, Human
gccauuuucugucuuguuuauu

SEQ ID NO: 1101136 - RNA, 22 nt, Human
cuucuucaguugcauguauugg

SEQ ID NO: 1101137 - RNA, 22 nt, Human
uuuuucagccaugaauuacacu

SEQ ID NO: 1101138 - RNA, 22 nt, Human
ucgagcucuggagccaaggaug

SEQ ID NO: 1101139 - RNA, 22 nt, Human
cagaaggcuggcagauugagau

SEQ ID NO: 1101140 - RNA, 22 nt, Human
cucugucaggcugcagaugcuc

SEQ ID NO: 1101141 - RNA, 22 nt, Human
uuugcagugucagcuucugugu

SEQ ID NO: 1101142 - RNA, 22 nt, Human
ucucuucuaauuuucccgagua

SEQ ID NO: 1101143 - RNA, 22 nt, Human
agcauucauugcuagaauguaa

SEQ ID NO: 1101144 - RNA, 22 nt, Human
gugcauuugacgaauacucacu

SEQ ID NO: 1101145 - RNA, 23 nt, Human
cuucucagaagucugugccagga

SEQ ID NO: 1101146 - RNA, 22 nt, Human
ugucauaacuuagugacaaauc

SEQ ID NO: 1101147 - RNA, 22 nt, Human
ccauuguaaauucuguggaagu

SEQ ID NO: 1101148 - RNA, 22 nt, Human
caagauggaguccgggaaugug

SEQ ID NO: 1101149 - RNA, 22 nt, Human
cugcucuaauaucagauagacu

SEQ ID NO: 1101150 - RNA, 22 nt, Human
uaugacauuauaaaggauuauu

SEQ ID NO: 1101151 - RNA, 22 nt, Human
uauaucauggagauuaacauuc

SEQ ID NO: 1101152 - RNA, 22 nt, Human
guucuucaggccauccucccag

SEQ ID NO: 1101153 - RNA, 18 nt, Human
cugcugugucgucugggc

SEQ ID NO: 1101154 - RNA, 22 nt, Human
auguuagaaucucugaaugugg

SEQ ID NO: 1101155 - RNA, 22 nt, Human
gaaacauacgauuuaggagaaa

SEQ ID NO: 1101156 - RNA, 22 nt, Human
gauguagagggaagauuuuaaa

SEQ ID NO: 1101157 - RNA, 22 nt, Human
ugguaauuuacgcauuucugua

SEQ ID NO: 1101158 - RNA, 22 nt, Human
aauaauuuuagcucagaguugu

SEQ ID NO: 1101159 - RNA, 19 nt, Human
uugaaauuguuugauaugg

SEQ ID NO: 1101160 - RNA, 22 nt, Human
augugaaacugaagcauccaua

SEQ ID NO: 1101161 - RNA, 22 nt, Human
uuucaugaggggcaaaaucuca

SEQ ID NO: 1101162 - RNA, 22 nt, Human
cugacagucucauugauuugcu

SEQ ID NO: 1101163 - RNA, 22 nt, Human
agugcuuugaacgaaaggcuga

SEQ ID NO: 1101164 - RNA, 22 nt, Human
cauaauaucuccgauuacuugc

SEQ ID NO: 1101165 - RNA, 21 nt, Human
gaauaguucuguggcagcagu

SEQ ID NO: 1101166 - RNA, 22 nt, Human
uucaauucaauucuaaauauau

SEQ ID NO: 1101167 - RNA, 17 nt, Human
uuucaucugggaccacc

SEQ ID NO: 1101168 - RNA, 22 nt, Human
cucaggauagcugcgcagccug

SEQ ID NO: 1101169 - RNA, 22 nt, Human
aggacuuagaacauuauguacu

SEQ ID NO: 1101170 - RNA, 22 nt, Human
acuggcaggcugcuggccggcg

SEQ ID NO: 1101171 - RNA, 22 nt, Human
agaggccaugcuagaggccugg

SEQ ID NO: 1101172 - RNA, 22 nt, Human
aauguaugugauuauuccucua

SEQ ID NO: 1101173 - RNA, 22 nt, Human
uccaugagagguaacuuuacaa

SEQ ID NO: 1101174 - RNA, 22 nt, Human
cauuuucaugaguuucuguuca

SEQ ID NO: 1101175 - RNA, 22 nt, Human
acuucuucuucagcugggggau

SEQ ID NO: 1101176 - RNA, 22 nt, Human
uaucauuguguuauuucuucca

SEQ ID NO: 1101177 - RNA, 22 nt, Human
aguuagaaaguaaaucauuuga

SEQ ID NO: 1101178 - RNA, 22 nt, Human
ucauuucucccggccaaaaacu

SEQ ID NO: 1101179 - RNA, 22 nt, Human
cuucuucaauagcaagcgcaua

SEQ ID NO: 1101180 - RNA, 22 nt, Human
uaguuuuacuugcgaugauaau

SEQ ID NO: 1101181 - RNA, 22 nt, Human
gugaaacacccuccaaugcaca

SEQ ID NO: 1101182 - RNA, 22 nt, Human
uuagccaugugggaaaaacagc

SEQ ID NO: 1101183 - RNA, 22 nt, Human
cuauugaauuaacuauuaaagu

SEQ ID NO: 1101184 - RNA, 22 nt, Human
uagaacauaagucauucauuug

SEQ ID NO: 1101185 - RNA, 22 nt, Human
aauguaugugcaucauuuacau

SEQ ID NO: 1101186 - RNA, 19 nt, Human
uggcaucuguaaaauggug

SEQ ID NO: 1101187 - RNA, 22 nt, Human
uucacauuggugauauguuucu

SEQ ID NO: 1101188 - RNA, 19 nt, Human
agcaacaccguuuauuucc

SEQ ID NO: 1101189 - RNA, 22 nt, Human
ugucucugaggugagggucagc

SEQ ID NO: 1101190 - RNA, 22 nt, Human
uaaauuauggcuggcagagcag

SEQ ID NO: 1101191 - RNA, 22 nt, Human
ccucugcucugguccaugugcu

SEQ ID NO: 1101192 - RNA, 22 nt, Human
aauaaucucccuuuuuguaugu

SEQ ID NO: 1101193 - RNA, 16 nt, Human
auuuccagauuaugca

SEQ ID NO: 1101194 - RNA, 22 nt, Human
agucucugccagcuuguccucu

SEQ ID NO: 1101195 - RNA, 21 nt, Human
auacacauacacauaaaugug

SEQ ID NO: 1101196 - RNA, 22 nt, Human
uuacuuugcuuucucauuacag

SEQ ID NO: 1101197 - RNA, 20 nt, Human
ucauuucuugggguuccaag

SEQ ID NO: 1101198 - RNA, 22 nt, Human
cucaggaugcaggucacaggac

SEQ ID NO: 1101199 - RNA, 22 nt, Human
auugaaaggcaaaguaggaagc

SEQ ID NO: 1101200 - RNA, 22 nt, Human
ugcuguggcaguuuauguauag

SEQ ID NO: 1101201 - RNA, 22 nt, Human
cugcugugccuuaaaaugcaag

SEQ ID NO: 1101202 - RNA, 23 nt, Human
uccaugagaugugggcuucuagu

SEQ ID NO: 1101203 - RNA, 22 nt, Human
ugauuuuuagcuauucugaaga

SEQ ID NO: 1101204 - RNA, 22 nt, Human
cugccuccugccgugcagcuuc

SEQ ID NO: 1101205 - RNA, 22 nt, Human
gcugcugugaauuuuuuaaaug

SEQ ID NO: 1101206 - RNA, 21 nt, Human
uucuucaguuuaauauaaaau

SEQ ID NO: 1101207 - RNA, 22 nt, Human
uucucugaguacguuucagugu

SEQ ID NO: 1101208 - RNA, 22 nt, Human
auauauuugagaauauucauga

SEQ ID NO: 1101209 - RNA, 22 nt, Human
auguuugaaauuguaaguauau

SEQ ID NO: 1101210 - RNA, 22 nt, Human
uucacagauguauuggaacucc

SEQ ID NO: 1101211 - RNA, 22 nt, Human
uuuucauuguuacuaugagcua

SEQ ID NO: 1101212 - RNA, 22 nt, Human
uucugucagcgucagaaauucu

SEQ ID NO: 1101213 - RNA, 20 nt, Human
aucugcuugccuguccucgg

SEQ ID NO: 1101214 - RNA, 22 nt, Human
cucuucuuggcccccaugaggg

SEQ ID NO: 1101215 - RNA, 21 nt, Human
auugaaagucaacaaucaguu

SEQ ID NO: 1101216 - RNA, 22 nt, Human
gaaagauauuuauuggcaacag

SEQ ID NO: 1101217 - RNA, 22 nt, Human
ugaccuuauuugaaaauagaga

SEQ ID NO: 1101218 - RNA, 22 nt, Human
cacacucauuagucauuucucu

SEQ ID NO: 1101219 - RNA, 22 nt, Human
uucagcaaauggacuguucagg

SEQ ID NO: 1101220 - RNA, 22 nt, Human
uacuuacacagcuguagaaggu

SEQ ID NO: 1101221 - RNA, 22 nt, Human
ucauacaucuguccuggagcuc

SEQ ID NO: 1101222 - RNA, 19 nt, Human
uuagccauccacagugaaa

SEQ ID NO: 1101223 - RNA, 23 nt, Human
uuuauccaacucuguaaucucuc

SEQ ID NO: 1101224 - RNA, 20 nt, Human
cuucuucagccuaugcuuca

SEQ ID NO: 1101225 - RNA, 22 nt, Human
cugcuguguuucugcuagaaaa

SEQ ID NO: 1101226 - RNA, 22 nt, Human
aguaugaauacagauuuucucu

SEQ ID NO: 1101227 - RNA, 22 nt, Human
uuucaucuuccuuggcauaggu

SEQ ID NO: 1101228 - RNA, 22 nt, Human
uucugggagagaaagggccuug

SEQ ID NO: 1101229 - RNA, 22 nt, Human
gucaggauuugaacucaggucu

SEQ ID NO: 1101230 - RNA, 22 nt, Human
uguucauuuggcccuuuuguau

SEQ ID NO: 1101231 - RNA, 22 nt, Human
uauucaaaguaccuucauugcc

SEQ ID NO: 1101232 - RNA, 22 nt, Human
gaccaaggaagaggggagccag

SEQ ID NO: 1101233 - RNA, 22 nt, Human
uagcauuuauuccagauuugga

SEQ ID NO: 1101234 - RNA, 20 nt, Human
ucugugcaccugcuacaagg

SEQ ID NO: 1101235 - RNA, 22 nt, Human
ccacuguuuuucaguuaacuuu

SEQ ID NO: 1101236 - RNA, 22 nt, Human
gucaaaaaguagucauuucugu

SEQ ID NO: 1101237 - RNA, 22 nt, Human
aauauuuguuaguguuuuaaug

SEQ ID NO: 1101238 - RNA, 22 nt, Human
aauggccagcugggagaguuga

SEQ ID NO: 1101239 - RNA, 22 nt, Human
ucauuuguugaacuuuagugcg

SEQ ID NO: 1101240 - RNA, 22 nt, Human
uaucuguuguccaugcagaaag

SEQ ID NO: 1101241 - RNA, 22 nt, Human
ugaugaaacugagguuccaaga

SEQ ID NO: 1101242 - RNA, 22 nt, Human
uucuucucagggucccacaugg

SEQ ID NO: 1101243 - RNA, 22 nt, Human
gaaacuguauguaguuuuuggg

SEQ ID NO: 1101244 - RNA, 21 nt, Human
cugcuguggcccccgacaugc

SEQ ID NO: 1101245 - RNA, 22 nt, Human
agucccuguacuuuccacugcc

SEQ ID NO: 1101246 - RNA, 22 nt, Human
cacugagcugauagaauuccag

SEQ ID NO: 1101247 - RNA, 22 nt, Human
agucuugcauuuucugaagaug

SEQ ID NO: 1101248 - RNA, 22 nt, Human
gcugccagcuuuccuuggcuga

SEQ ID NO: 1101249 - RNA, 22 nt, Human
augauauuugcaaugugcuugc

SEQ ID NO: 1101250 - RNA, 22 nt, Human
uaagauaaguggguugagaugg

SEQ ID NO: 1101251 - RNA, 22 nt, Human
gugauuuucuccuccuagaagu

SEQ ID NO: 1101252 - RNA, 22 nt, Human
cuaauguaucauggcucucagc

SEQ ID NO: 1101253 - RNA, 22 nt, Human
aaaguauuugugauuuuuacca

SEQ ID NO: 1101254 - RNA, 22 nt, Human
uauuuguauguguguacauaua

SEQ ID NO: 1101255 - RNA, 22 nt, Human
gaucuucuagcagaaguaauuu

SEQ ID NO: 1101256 - RNA, 22 nt, Human
cuuaagauuugagauaccuaau

SEQ ID NO: 1101257 - RNA, 17 nt, Human
aaggccauuuccaccca

SEQ ID NO: 1101258 - RNA, 22 nt, Human
uguguaaagcuuguuccagaaa

SEQ ID NO: 1101259 - RNA, 22 nt, Human
aauuuccagaucagaugacuca

SEQ ID NO: 1101260 - RNA, 22 nt, Human
uuugaaaguguuuacuugggaa

SEQ ID NO: 1101261 - RNA, 22 nt, Human
cucucagacugaagggccugug

SEQ ID NO: 1101262 - RNA, 22 nt, Human
cagugauguuucugcaucagag

SEQ ID NO: 1101263 - RNA, 22 nt, Human
uuucaguuacugcuauaucauu

SEQ ID NO: 1101264 - RNA, 22 nt, Human
augcuguguuugagaaccuagg

SEQ ID NO: 1101265 - RNA, 22 nt, Human
ucucacugcaaauauuauguau

SEQ ID NO: 1101266 - RNA, 22 nt, Human
uucugggacaucuggacaguuu

SEQ ID NO: 1101267 - RNA, 22 nt, Human
uaucuguucaauggaagaugac

SEQ ID NO: 1101268 - RNA, 20 nt, Human
uuucugugcccaggucuguu

SEQ ID NO: 1101269 - RNA, 19 nt, Human
cucucacucgccacauccu

SEQ ID NO: 1101270 - RNA, 22 nt, Human
ugaaacauuugaugaucuuugg

SEQ ID NO: 1101271 - RNA, 22 nt, Human
augcugugucaccuuaggauuu

SEQ ID NO: 1101272 - RNA, 22 nt, Human
uugcauuuccuguacuguuuga

SEQ ID NO: 1101273 - RNA, 22 nt, Human
uuuaaauggcauuuucccagau

SEQ ID NO: 1101274 - RNA, 22 nt, Human
caauacuuccuuguuagaggca

SEQ ID NO: 1101275 - RNA, 22 nt, Human
uaaugucagcauaguuuauuuu

SEQ ID NO: 1101276 - RNA, 22 nt, Human
uuuccuaguucuaagaaaugua

SEQ ID NO: 1101277 - RNA, 22 nt, Human
gguauaaaugaucagaucgcug

SEQ ID NO: 1101278 - RNA, 22 nt, Human
ucauuuguggaagugauugugg

SEQ ID NO: 1101279 - RNA, 22 nt, Human
cugucauuuaagacauucugga

SEQ ID NO: 1101280 - RNA, 22 nt, Human
uuauuucauguaaaauuuaugu

SEQ ID NO: 1101281 - RNA, 22 nt, Human
auaucauucugauguauaucuu

SEQ ID NO: 1101282 - RNA, 22 nt, Human
uuuuucaagacaaccugcaugu

SEQ ID NO: 1101283 - RNA, 22 nt, Human
aagaacuuccuaauauauuuuc

SEQ ID NO: 1101284 - RNA, 23 nt, Human
cuuuuaacuugaucugagaccag

SEQ ID NO: 1101285 - RNA, 22 nt, Human
ucuucuuaugugccauuaucuc

SEQ ID NO: 1101286 - RNA, 22 nt, Human
gcuguguuugacaguagcagac

SEQ ID NO: 1101287 - RNA, 22 nt, Human
auuuugcuggucugaauuacuu

SEQ ID NO: 1101288 - RNA, 20 nt, Human
ugaaggccagcagcauaggg

SEQ ID NO: 1101289 - RNA, 23 nt, Human
aggauguaggauguauggcagag

SEQ ID NO: 1101290 - RNA, 22 nt, Human
aucauuucccuuuagaucacaa

SEQ ID NO: 1101291 - RNA, 22 nt, Human
uuugaagugggcauuagaaccu

SEQ ID NO: 1101292 - RNA, 22 nt, Human
uacaaaguagaaauucaguaaa

SEQ ID NO: 1101293 - RNA, 23 nt, Human
aggcccaacucugugagggcugc

SEQ ID NO: 1101294 - RNA, 22 nt, Human
aaauuauaggugccaccuugga

SEQ ID NO: 1101295 - RNA, 22 nt, Human
ucagugcacagagauuuuuguu

SEQ ID NO: 1101296 - RNA, 21 nt, Human
uaauaauuccacuacagagua

SEQ ID NO: 1101297 - RNA, 22 nt, Human
cauuuguaguuaaaaaugucuc

SEQ ID NO: 1101298 - RNA, 22 nt, Human
ucaccgccuugcccggccgggc

SEQ ID NO: 1101299 - RNA, 22 nt, Human
aaccauuugccauuaucuuaag

SEQ ID NO: 1101300 - RNA, 22 nt, Human
ugaaucauggauaaauagcuua

SEQ ID NO: 1101301 - RNA, 23 nt, Human
uuuuccagaaucgacucuguaga

SEQ ID NO: 1101302 - RNA, 22 nt, Human
aagacugugucuauggcuacuc

SEQ ID NO: 1101303 - RNA, 22 nt, Human
aacauucaaaacccaguucagu

SEQ ID NO: 1101304 - RNA, 22 nt, Human
uuagcauuucaguacacauguu

SEQ ID NO: 1101305 - RNA, 22 nt, Human
cuugcugugugguguucucaga

SEQ ID NO: 1101306 - RNA, 22 nt, Human
ugaaggcccagccacagaaugg

SEQ ID NO: 1101307 - RNA, 22 nt, Human
ucuuagaaauuccccaguggcu

SEQ ID NO: 1101308 - RNA, 22 nt, Human
augcuacagaguuugaauaugu

SEQ ID NO: 1101309 - RNA, 22 nt, Human
augucaaacacaacaccagugg

SEQ ID NO: 1101310 - RNA, 22 nt, Human
ucucagaguuuagagcugagcc

SEQ ID NO: 1101311 - RNA, 22 nt, Human
acacauuucucuuuuuguaagu

SEQ ID NO: 1101312 - RNA, 22 nt, Human
uccauuuuagaagaaaauccac

SEQ ID NO: 1101313 - RNA, 22 nt, Human
uucccucucacuuaaagcuugg

SEQ ID NO: 1101314 - RNA, 22 nt, Human
ccagaggaaaaauaucucccua

SEQ ID NO: 1101315 - RNA, 22 nt, Human
gaaggccauuuuuagguagaau

SEQ ID NO: 1101316 - RNA, 22 nt, Human
cggagccugcuuguugcagcug

SEQ ID NO: 1101317 - RNA, 22 nt, Human
uuugaaaggugucgagaugugu

SEQ ID NO: 1101318 - RNA, 22 nt, Human
ucaauucugguccucaggaacu

SEQ ID NO: 1101319 - RNA, 22 nt, Human
uuucaguuuaugucuugaauua

SEQ ID NO: 1101320 - RNA, 22 nt, Human
acuuucugcaguguuggaaaug

SEQ ID NO: 1101321 - RNA, 22 nt, Human
cauuuguaucauauguaucuua

SEQ ID NO: 1101322 - RNA, 22 nt, Human
uaugaacauguucauugacuua

SEQ ID NO: 1101323 - RNA, 22 nt, Human
uuccaagaguaaauucaaauug

SEQ ID NO: 1101324 - RNA, 22 nt, Human
gaggcugaggguuagagaguca

SEQ ID NO: 1101325 - RNA, 22 nt, Human
uacauaugaacuuuauaacuug

SEQ ID NO: 1101326 - RNA, 22 nt, Human
uuaaauuuuagaaacagacucu

SEQ ID NO: 1101327 - RNA, 22 nt, Human
acagugacguuuauuugagacg

SEQ ID NO: 1101328 - RNA, 22 nt, Human
auacuucuuugauguucacagg

SEQ ID NO: 1101329 - RNA, 22 nt, Human
ucauaaaucauacuccauuugc

SEQ ID NO: 1101330 - RNA, 22 nt, Human
uucugucuguaaacuucucaau

SEQ ID NO: 1101331 - RNA, 22 nt, Human
ucacacagauugguagagcuga

SEQ ID NO: 1101332 - RNA, 22 nt, Human
auuugcuuuuacuauguuaaaa

SEQ ID NO: 1101333 - RNA, 21 nt, Human
auacauucuauuaagcauuua

SEQ ID NO: 1101334 - RNA, 22 nt, Human
auuuggcaacauuaauugaauc

SEQ ID NO: 1101335 - RNA, 22 nt, Human
uccauuuucuugcucuagguaa

SEQ ID NO: 1101336 - RNA, 22 nt, Human
cuucucagcauuuugucagucu

SEQ ID NO: 1101337 - RNA, 23 nt, Human
cugcuguguuggucucgauggga

SEQ ID NO: 1101338 - RNA, 20 nt, Human
cugcugugguccuuuauuuu

SEQ ID NO: 1101339 - RNA, 22 nt, Human
cauaauuucacugucguauggc

SEQ ID NO: 1101340 - RNA, 22 nt, Human
accauguguuuuacacauggua

SEQ ID NO: 1101341 - RNA, 22 nt, Human
uucuucuucauuucugacgaug

SEQ ID NO: 1101342 - RNA, 22 nt, Human
ucaguucugcuagaaaaacagu

SEQ ID NO: 1101343 - RNA, 22 nt, Human
auucuucaucagagaugcacua

SEQ ID NO: 1101344 - RNA, 22 nt, Human
gagagucuaggaaccucauaua

SEQ ID NO: 1101345 - RNA, 22 nt, Human
uucuugcaggucacucacugag

SEQ ID NO: 1101346 - RNA, 22 nt, Human
ucauucuugaucacuaguuagu

SEQ ID NO: 1101347 - RNA, 22 nt, Human
cuguuucaagugaagucagaca

SEQ ID NO: 1101348 - RNA, 22 nt, Human
gucaggaugggcagccaaacua

SEQ ID NO: 1101349 - RNA, 22 nt, Human
uaugaacuguaacccucaccgc

SEQ ID NO: 1101350 - RNA, 22 nt, Human
uuuuccuucuagagcagauuuc

SEQ ID NO: 1101351 - RNA, 18 nt, Human
ccucagggagagagacgc

SEQ ID NO: 1101352 - RNA, 22 nt, Human
acauuguuugagaauacagaug

SEQ ID NO: 1101353 - RNA, 20 nt, Human
accaauguuagcuuaguacu

SEQ ID NO: 1101354 - RNA, 22 nt, Human
ccaggcugggcuacaaguugag

SEQ ID NO: 1101355 - RNA, 22 nt, Human
uugcagcuucuaccacuguuuc

SEQ ID NO: 1101356 - RNA, 22 nt, Human
uuuucucuuguuaauguacuga

SEQ ID NO: 1101357 - RNA, 22 nt, Human
ucaugaacauggaauaucuuuu

SEQ ID NO: 1101358 - RNA, 22 nt, Human
ucucucuucaacccuuaacuag

SEQ ID NO: 1101359 - RNA, 22 nt, Human
uuugaauagcauaggauuacau

SEQ ID NO: 1101360 - RNA, 22 nt, Human
auuucagaugaccaaauggaaa

SEQ ID NO: 1101361 - RNA, 19 nt, Human
cauuuagaaguacauauua

SEQ ID NO: 1101362 - RNA, 23 nt, Human
cuuuuaacuagaguaucagcugc

SEQ ID NO: 1101363 - RNA, 22 nt, Human
acagugcuaaacacuucuugaa

SEQ ID NO: 1101364 - RNA, 22 nt, Human
acagucucuccacacugcaggg

SEQ ID NO: 1101365 - RNA, 22 nt, Human
aauagcucacugauuucucuuu

SEQ ID NO: 1101366 - RNA, 23 nt, Human
uguaugaauaugccacaguuuaa

SEQ ID NO: 1101367 - RNA, 22 nt, Human
gcauguguuauuuuauguauga

SEQ ID NO: 1101368 - RNA, 20 nt, Human
augcuuucuugugugcugcu

SEQ ID NO: 1101369 - RNA, 22 nt, Human
uguaugaaucucauuuguuuaa

SEQ ID NO: 1101370 - RNA, 22 nt, Human
uucagaaguagcuaagcaguca

SEQ ID NO: 1101371 - RNA, 22 nt, Human
ucuucagacuccaaauguuuua

SEQ ID NO: 1101372 - RNA, 22 nt, Human
ugucugugaccucuuaggcaag

SEQ ID NO: 1101373 - RNA, 22 nt, Human
cucuucucugcagccuuugaag

SEQ ID NO: 1101374 - RNA, 23 nt, Human
acuauaaaguuguucugauuuac

SEQ ID NO: 1101375 - RNA, 22 nt, Human
gaaacugugaucguguucuggg

SEQ ID NO: 1101376 - RNA, 22 nt, Human
augaguucaauuguuucaguca

SEQ ID NO: 1101377 - RNA, 22 nt, Human
ugaaaugaaugugauucgauag

SEQ ID NO: 1101378 - RNA, 22 nt, Human
ccacaucucgguccccucuuug

SEQ ID NO: 1101379 - RNA, 22 nt, Human
cauucacaucuuguuccaucac

SEQ ID NO: 1101380 - RNA, 22 nt, Human
uuuggacuuagccugcagaauu

SEQ ID NO: 1101381 - RNA, 22 nt, Human
agucagugaaaacuagaauguu

SEQ ID NO: 1101382 - RNA, 22 nt, Human
uuucuagucucgaucucuuaau

SEQ ID NO: 1101383 - RNA, 22 nt, Human
uagugcuugagucucuccguac

SEQ ID NO: 1101384 - RNA, 22 nt, Human
cugcugugugaccauggacagg

SEQ ID NO: 1101385 - RNA, 22 nt, Human
cucuggcuucuaccuugcaguu

SEQ ID NO: 1101386 - RNA, 22 nt, Human
cuggcugugcagucuuccagaa

SEQ ID NO: 1101387 - RNA, 22 nt, Human
uuugacaucaauacccuagaau

SEQ ID NO: 1101388 - RNA, 22 nt, Human
cuugaaagucagcagaguggau

SEQ ID NO: 1101389 - RNA, 22 nt, Human
ucuaaccuuugaaacugcuuuc

SEQ ID NO: 1101390 - RNA, 22 nt, Human
uuucugcugugcuuucuugcgu

SEQ ID NO: 1101391 - RNA, 22 nt, Human
ucaguuaacaacuauuuauuga

SEQ ID NO: 1101392 - RNA, 17 nt, Human
uagcuguguuucagcua

SEQ ID NO: 1101393 - RNA, 22 nt, Human
ucugggaacucugucauuuccc

SEQ ID NO: 1101394 - RNA, 22 nt, Human
uaacuuucuucauaugugaacc

SEQ ID NO: 1101395 - RNA, 17 nt, Human
uucucugagcuguauug

SEQ ID NO: 1101396 - RNA, 22 nt, Human
cagcuucugucugauuagcaag

SEQ ID NO: 1101397 - RNA, 22 nt, Human
uucugugaaucuuuuuucccac

SEQ ID NO: 1101398 - RNA, 22 nt, Human
augaagcugaaaaaggcauaua

SEQ ID NO: 1101399 - RNA, 22 nt, Human
agucuacaaucuuaaaugaacu

SEQ ID NO: 1101400 - RNA, 22 nt, Human
cuagguauucauguuucguggc

SEQ ID NO: 1101401 - RNA, 22 nt, Human
acacauuuacauguuuacguau

SEQ ID NO: 1101402 - RNA, 22 nt, Human
uccaugagggacacuggaugcu

SEQ ID NO: 1101403 - RNA, 22 nt, Human
ugagaauuuucaguuucacuuu

SEQ ID NO: 1101404 - RNA, 22 nt, Human
uuucaguguaucuuccaaaagc

SEQ ID NO: 1101405 - RNA, 22 nt, Human
ucauucuuuaccaaguugucac

SEQ ID NO: 1101406 - RNA, 22 nt, Human
uaaggccaauuacauauguuca

SEQ ID NO: 1101407 - RNA, 22 nt, Human
uugcaucuagggcaacccagag

SEQ ID NO: 1101408 - RNA, 22 nt, Human
uucucagaauugacugggagca

SEQ ID NO: 1101409 - RNA, 22 nt, Human
uuuuuauaacucuuuugugaca

SEQ ID NO: 1101410 - RNA, 22 nt, Human
gaauauuuuuaaagggacuaau

SEQ ID NO: 1101411 - RNA, 22 nt, Human
acaaaguuugugguauuccaag

SEQ ID NO: 1101412 - RNA, 22 nt, Human
uuucuucaauugcuaacaagga

SEQ ID NO: 1101413 - RNA, 22 nt, Human
cagagccaggucuaggagucuc

SEQ ID NO: 1101414 - RNA, 22 nt, Human
guuuuucuaggaccaugugauu

SEQ ID NO: 1101415 - RNA, 22 nt, Human
cugcugugucagaguccagggg

SEQ ID NO: 1101416 - RNA, 22 nt, Human
uagaauucauguuacuguuagc

SEQ ID NO: 1101417 - RNA, 22 nt, Human
ucuuuguaacugucuauugaga

SEQ ID NO: 1101418 - RNA, 19 nt, Human
uuacuuggcaaagucaguc

SEQ ID NO: 1101419 - RNA, 22 nt, Human
ucaggaugguccuuuaugagaa

SEQ ID NO: 1101420 - RNA, 22 nt, Human
agucugucugucacuucugcag

SEQ ID NO: 1101421 - RNA, 19 nt, Human
uuugcagugguuccuuugu

SEQ ID NO: 1101422 - RNA, 22 nt, Human
uguaugaaagaacaagggcuua

SEQ ID NO: 1101423 - RNA, 22 nt, Human
cagagaaaaaauccugcucuca

SEQ ID NO: 1101424 - RNA, 22 nt, Human
aaguauaagcuauucuucauga

SEQ ID NO: 1101425 - RNA, 22 nt, Human
uuugaaaggguuaugagacuga

SEQ ID NO: 1101426 - RNA, 22 nt, Human
aucaggaucacugggagucuug

SEQ ID NO: 1101427 - RNA, 22 nt, Human
cauucauuagaauagauaugua

SEQ ID NO: 1101428 - RNA, 22 nt, Human
uuuuccagagcugucucuugca

SEQ ID NO: 1101429 - RNA, 22 nt, Human
aauucugugcaggcagagcuau

SEQ ID NO: 1101430 - RNA, 22 nt, Human
gggagucugggcuagacuccuu

SEQ ID NO: 1101431 - RNA, 22 nt, Human
ucugcuguauuagguugaacug

SEQ ID NO: 1101432 - RNA, 22 nt, Human
auguuuccauuuucuuguauca

SEQ ID NO: 1101433 - RNA, 22 nt, Human
auguucuguuuuguaauucaua

SEQ ID NO: 1101434 - RNA, 22 nt, Human
uccagaaacuuuuccagucuca

SEQ ID NO: 1101435 - RNA, 22 nt, Human
ccucaugguacuuacuguagcu

SEQ ID NO: 1101436 - RNA, 22 nt, Human
auacacauguguaugugcaugc

SEQ ID NO: 1101437 - RNA, 23 nt, Human
auguauuuaaauuucagugauga

SEQ ID NO: 1101438 - RNA, 18 nt, Human
acugugugaauuagcucc

SEQ ID NO: 1101439 - RNA, 22 nt, Human
ugcuguguucuccugacucacc

SEQ ID NO: 1101440 - RNA, 22 nt, Human
aaauacauaaagguuguaccag

SEQ ID NO: 1101441 - RNA, 22 nt, Human
cuucagaagccugcagccuuug

SEQ ID NO: 1101442 - RNA, 22 nt, Human
uuccaugaaauguguuaugcuu

SEQ ID NO: 1101443 - RNA, 22 nt, Human
ugcuacaauucacaucuggaua

SEQ ID NO: 1101444 - RNA, 22 nt, Human
uguaugaagccagaaucuguuu

SEQ ID NO: 1101445 - RNA, 22 nt, Human
ugagaacugaggauuugaauuc

SEQ ID NO: 1101446 - RNA, 21 nt, Human
uuucacaaaaguaugugacaa

SEQ ID NO: 1101447 - RNA, 22 nt, Human
uuccaugaaagugaaauggagc

SEQ ID NO: 1101448 - RNA, 22 nt, Human
uacauaguauucacauuguuuu

SEQ ID NO: 1101449 - RNA, 22 nt, Human
ucuggucaguaauaagaagugg

SEQ ID NO: 1101450 - RNA, 22 nt, Human
uguuuuaaagccauugccuuuc

SEQ ID NO: 1101451 - RNA, 22 nt, Human
ccugucacgaugacugcacucu

SEQ ID NO: 1101452 - RNA, 22 nt, Human
agcuggcagucauccuagugag

SEQ ID NO: 1101453 - RNA, 22 nt, Human
ugugccagccucuggcuguguc

SEQ ID NO: 1101454 - RNA, 22 nt, Human
agaagucauuuauguuagauga

SEQ ID NO: 1101455 - RNA, 22 nt, Human
uuugaaagaaaccagugaguga

SEQ ID NO: 1101456 - RNA, 21 nt, Human
augugaaauaucaucagagca

SEQ ID NO: 1101457 - RNA, 17 nt, Human
ugauaguucauuuuaag

SEQ ID NO: 1101458 - RNA, 22 nt, Human
aaucuucuacuugacaguucuc

SEQ ID NO: 1101459 - RNA, 22 nt, Human
cacauauuguaguucaccagga

SEQ ID NO: 1101460 - RNA, 22 nt, Human
uuagacauagaauauugucuag

SEQ ID NO: 1101461 - RNA, 22 nt, Human
guuuucugauuagcaaaucuga

SEQ ID NO: 1101462 - RNA, 22 nt, Human
ugucugugaccucuuuggagcc

SEQ ID NO: 1101463 - RNA, 22 nt, Human
gucaggauuauuuuauuaaaag

SEQ ID NO: 1101464 - RNA, 22 nt, Human
auguuucaccagcaaauuaccu

SEQ ID NO: 1101465 - RNA, 22 nt, Human
ucaggauguuaauauagcauua

SEQ ID NO: 1101466 - RNA, 22 nt, Human
uuauuugcccauguuuagcaga

SEQ ID NO: 1101467 - RNA, 22 nt, Human
cugcuuuggacaacuauucuug

SEQ ID NO: 1101468 - RNA, 22 nt, Human
uucccaugccuggccccuaucc

SEQ ID NO: 1101469 - RNA, 22 nt, Human
aauguauggauucaugucugug

SEQ ID NO: 1101470 - RNA, 22 nt, Human
uaaggccaaacuauuauaguuc

SEQ ID NO: 1101471 - RNA, 22 nt, Human
ugaaaugagagcacagaauaaa

SEQ ID NO: 1101472 - RNA, 22 nt, Human
uuucuaggcacagugucuuccc

SEQ ID NO: 1101473 - RNA, 22 nt, Human
uuuaucuuuaggacuuugcaga

SEQ ID NO: 1101474 - RNA, 22 nt, Human
aaguuucaaauguugauuaugc

SEQ ID NO: 1101475 - RNA, 22 nt, Human
uuugcauaaaggagcauuucuc

SEQ ID NO: 1101476 - RNA, 22 nt, Human
ucauuuuucacacagggucacc

SEQ ID NO: 1101477 - RNA, 22 nt, Human
cucugucagaguguugucccca

SEQ ID NO: 1101478 - RNA, 22 nt, Human
uugcaaaggggaauaaagcaau

SEQ ID NO: 1101479 - RNA, 22 nt, Human
uccauuuuucaugacuccucaa

SEQ ID NO: 1101480 - RNA, 22 nt, Human
ucaggaggccaccaggaccugu

SEQ ID NO: 1101481 - RNA, 22 nt, Human
agucucuuccuucaaggcuggu

SEQ ID NO: 1101482 - RNA, 22 nt, Human
ugcuugugagaguuuuuucaga

SEQ ID NO: 1101483 - RNA, 22 nt, Human
ucaggaauccagacagggcaca

SEQ ID NO: 1101484 - RNA, 22 nt, Human
uauauguaaauaagucuaaugu

SEQ ID NO: 1101485 - RNA, 22 nt, Human
ucagguggcuuggagggggacg

SEQ ID NO: 1101486 - RNA, 22 nt, Human
aucugccuggcuccaggugagc

SEQ ID NO: 1101487 - RNA, 18 nt, Human
uugcuuuguaagcuugca

SEQ ID NO: 1101488 - RNA, 22 nt, Human
aaugcuuuuugcgaaaugugca

SEQ ID NO: 1101489 - RNA, 22 nt, Human
uauuuccaaaagccuauuauga

SEQ ID NO: 1101490 - RNA, 22 nt, Human
uccauuuucuaaguaucacuua

SEQ ID NO: 1101491 - RNA, 22 nt, Human
guugaaagaucauguggcugcc

SEQ ID NO: 1101492 - RNA, 22 nt, Human
cugcauuagucaugcuuugcag

SEQ ID NO: 1101493 - RNA, 22 nt, Human
aaauuagucgguuuaggaauuu

SEQ ID NO: 1101494 - RNA, 22 nt, Human
uuaauacaagcauaugcacaca

SEQ ID NO: 1101495 - RNA, 22 nt, Human
uacuuuuagccuauuugauucu

SEQ ID NO: 1101496 - RNA, 22 nt, Human
uuaagauagaacccaguagucu

SEQ ID NO: 1101497 - RNA, 22 nt, Human
ugcauggaggaagaugaaugca

SEQ ID NO: 1101498 - RNA, 22 nt, Human
ugagccugguugcagugucugg

SEQ ID NO: 1101499 - RNA, 22 nt, Human
uauguacuacacuagaacauuu

SEQ ID NO: 1101500 - RNA, 22 nt, Human
aucuagcaguguuauaauugga

SEQ ID NO: 1101501 - RNA, 22 nt, Human
aagcgccaugguuccugcgcag

SEQ ID NO: 1101502 - RNA, 22 nt, Human
gucaggaugcuauuguuauuaa

SEQ ID NO: 1101503 - RNA, 22 nt, Human
ucuucagauggccaguuguccc

SEQ ID NO: 1101504 - RNA, 22 nt, Human
uuucuucagccacuccaaacug

SEQ ID NO: 1101505 - RNA, 20 nt, Human
guaaaauauggucuuugggu

SEQ ID NO: 1101506 - RNA, 22 nt, Human
gucaggauuuuaaaaucccagu

SEQ ID NO: 1101507 - RNA, 22 nt, Human
ugagaauuuuuugucaugcauu

SEQ ID NO: 1101508 - RNA, 22 nt, Human
cuaauacacccuauugcuuguu

SEQ ID NO: 1101509 - RNA, 22 nt, Human
uacacacaugcauuugccuuau

SEQ ID NO: 1101510 - RNA, 18 nt, Human
caugucugcgccacaagg

SEQ ID NO: 1101511 - RNA, 22 nt, Human
uuucuucauagaccuugucuug

SEQ ID NO: 1101512 - RNA, 22 nt, Human
ucuucagacccuuagcugugau

SEQ ID NO: 1101513 - RNA, 22 nt, Human
ucacauucucagcaucuauaca

SEQ ID NO: 1101514 - RNA, 19 nt, Human
uucaggauugacccuacug

SEQ ID NO: 1101515 - RNA, 22 nt, Human
gcugauguaagacuuuugguuu

SEQ ID NO: 1101516 - RNA, 22 nt, Human
uucauucugggcucuaaggaac

SEQ ID NO: 1101517 - RNA, 22 nt, Human
auuugcuuuaagguauaaaagg

SEQ ID NO: 1101518 - RNA, 22 nt, Human
auaguuugaaggcuguucuacu

SEQ ID NO: 1101519 - RNA, 22 nt, Human
uauuucagggagaauaaauuug

SEQ ID NO: 1101520 - RNA, 22 nt, Human
auccaugaagguacuucucagg

SEQ ID NO: 1101521 - RNA, 22 nt, Human
uaauacuguauacugcaaauuu

SEQ ID NO: 1101522 - RNA, 22 nt, Human
ugcugcugauggcaccuaggca

SEQ ID NO: 1101523 - RNA, 22 nt, Human
cuucagaggggacucaaaguca

SEQ ID NO: 1101524 - RNA, 22 nt, Human
cuugaaagaagggucuuuuaau

SEQ ID NO: 1101525 - RNA, 22 nt, Human
auucauuugcuauuguguaugg

SEQ ID NO: 1101526 - RNA, 22 nt, Human
ugagagggcccagagcacacca

SEQ ID NO: 1101527 - RNA, 22 nt, Human
guuuuaguggguggccacugau

SEQ ID NO: 1101528 - RNA, 22 nt, Human
uucaugugaauauauuugucuu

SEQ ID NO: 1101529 - RNA, 22 nt, Human
uuuuaucugcuucauuaguuga

SEQ ID NO: 1101530 - RNA, 21 nt, Human
caauaaacugcacauugagac

SEQ ID NO: 1101531 - RNA, 22 nt, Human
acucaggaaaaauguagugaua

SEQ ID NO: 1101532 - RNA, 19 nt, Human
ugcaagcuuuuucuuguua

SEQ ID NO: 1101533 - RNA, 22 nt, Human
ugaguuuugucuugcuagaagu

SEQ ID NO: 1101534 - RNA, 22 nt, Human
aaaguauucuugacuguuuuuc

SEQ ID NO: 1101535 - RNA, 22 nt, Human
ggaggcugagaaguccaagauc

SEQ ID NO: 1101536 - RNA, 22 nt, Human
uugaacauuggcaauuucauau

SEQ ID NO: 1101537 - RNA, 22 nt, Human
ucugcugucacucauuugcuuc

SEQ ID NO: 1101538 - RNA, 22 nt, Human
ccucuucugcuucaggagcacu

SEQ ID NO: 1101539 - RNA, 22 nt, Human
aaucuucuuucuuaacaguaca

SEQ ID NO: 1101540 - RNA, 22 nt, Human
aaaauugaagugaucaggaacu

SEQ ID NO: 1101541 - RNA, 22 nt, Human
acuugcauuauauuuaucacaa

SEQ ID NO: 1101542 - RNA, 22 nt, Human
ucccuucacagaugcgauguuu

SEQ ID NO: 1101543 - RNA, 22 nt, Human
ucauuucaaugauacuacuaag

SEQ ID NO: 1101544 - RNA, 22 nt, Human
uguacauagaucuugaaaauua

SEQ ID NO: 1101545 - RNA, 22 nt, Human
uguuuauuacaguucuuggaau

SEQ ID NO: 1101546 - RNA, 21 nt, Human
uucuucuuggacuguuuuggc

SEQ ID NO: 1101547 - RNA, 22 nt, Human
cuugaaagucacaugcagcccu

SEQ ID NO: 1101548 - RNA, 22 nt, Human
ugaaaugagauaauuuaagugc

SEQ ID NO: 1101549 - RNA, 22 nt, Human
uucuucaguguagcaacuguau

SEQ ID NO: 1101550 - RNA, 22 nt, Human
accauuuuggguauuuucagag

SEQ ID NO: 1101551 - RNA, 22 nt, Human
ucuacuguagugaugcugcagu

SEQ ID NO: 1101552 - RNA, 22 nt, Human
uucuucaaugugcccuguuuuc

SEQ ID NO: 1101553 - RNA, 22 nt, Human
caguggagagacuuuuacucuu

SEQ ID NO: 1101554 - RNA, 22 nt, Human
cagauggaacacagaaaggaga

SEQ ID NO: 1101555 - RNA, 22 nt, Human
ggcugaaggaugaaagcugcag

SEQ ID NO: 1101556 - RNA, 22 nt, Human
aagauauucaaagauuuauuag

SEQ ID NO: 1101557 - RNA, 22 nt, Human
uggaagggagugacagucagag

SEQ ID NO: 1101558 - RNA, 22 nt, Human
ccucaggaaaugaauaaauggc

SEQ ID NO: 1101559 - RNA, 22 nt, Human
agucucugggcaugguugugac

SEQ ID NO: 1101560 - RNA, 22 nt, Human
ugccuugcacauaauauacauu

SEQ ID NO: 1101561 - RNA, 22 nt, Human
acauucuuaacaguuaaaaacu

SEQ ID NO: 1101562 - RNA, 22 nt, Human
cuuaaauucuuaaugcccucau

SEQ ID NO: 1101563 - RNA, 22 nt, Human
cugcuguguugccagugucacc

SEQ ID NO: 1101564 - RNA, 22 nt, Human
aucaggauagucuguaaauugu

SEQ ID NO: 1101565 - RNA, 22 nt, Human
uaugaacucuggagucugagug

SEQ ID NO: 1101566 - RNA, 22 nt, Human
uaacacaugaaagcaccuucuu

SEQ ID NO: 1101567 - RNA, 22 nt, Human
uuuagacauggcuugcucacuu

SEQ ID NO: 1101568 - RNA, 22 nt, Human
auggagacgcaagggaccuagg

SEQ ID NO: 1101569 - RNA, 22 nt, Human
aagacaauuugauacuaguugc

SEQ ID NO: 1101570 - RNA, 19 nt, Human
uguguguuuauauauguau

SEQ ID NO: 1101571 - RNA, 20 nt, Human
agcuucuucugucuaauuuu

SEQ ID NO: 1101572 - RNA, 22 nt, Human
uuugcauaggauggacauuuua

SEQ ID NO: 1101573 - RNA, 17 nt, Human
agaacuguaguagcucc

SEQ ID NO: 1101574 - RNA, 22 nt, Human
caaggccauauugccuguaugu

SEQ ID NO: 1101575 - RNA, 22 nt, Human
ugauugaagaggugaggaaguu

SEQ ID NO: 1101576 - RNA, 22 nt, Human
cagaccucaguccucaguagga

SEQ ID NO: 1101577 - RNA, 22 nt, Human
auucaaguucuucugucuuugc

SEQ ID NO: 1101578 - RNA, 22 nt, Human
uagugcuuggcccuaccagaua

SEQ ID NO: 1101579 - RNA, 19 nt, Human
acuggcaguuucugcaugg

SEQ ID NO: 1101580 - RNA, 22 nt, Human
acagauguacacucauauauaa

SEQ ID NO: 1101581 - RNA, 22 nt, Human
cuaaucaucuuucucuuaaagc

SEQ ID NO: 1101582 - RNA, 22 nt, Human
uacuuccuguuuccaugucugu

SEQ ID NO: 1101583 - RNA, 22 nt, Human
ucucaaaucaaacuuugagcuu

SEQ ID NO: 1101584 - RNA, 22 nt, Human
uuauccuggauuauauauguga

SEQ ID NO: 1101585 - RNA, 23 nt, Human
aauguauguuaguaucuuagaga

SEQ ID NO: 1101586 - RNA, 20 nt, Human
cagagccaagagcagcaucu

SEQ ID NO: 1101587 - RNA, 22 nt, Human
aguuugaaauguuggcaauauu

SEQ ID NO: 1101588 - RNA, 22 nt, Human
uuugcacuagcauuuguccaug

SEQ ID NO: 1101589 - RNA, 22 nt, Human
cuucucagcaugguuacuguga

SEQ ID NO: 1101590 - RNA, 22 nt, Human
acuagauaauuauaaaagguag

SEQ ID NO: 1101591 - RNA, 22 nt, Human
ucucuucuagcuucuugugguu

SEQ ID NO: 1101592 - RNA, 22 nt, Human
uaucaauacauguuaucagugu

SEQ ID NO: 1101593 - RNA, 22 nt, Human
gugguuuucuccaacccagaac

SEQ ID NO: 1101594 - RNA, 22 nt, Human
agucuccuuggccucaaugccu

SEQ ID NO: 1101595 - RNA, 22 nt, Human
auguaugauauuuccaguauca

SEQ ID NO: 1101596 - RNA, 22 nt, Human
ucuucuucccaucccucaaaug

SEQ ID NO: 1101597 - RNA, 22 nt, Human
uaauuauuaugacaacaauugc

SEQ ID NO: 1101598 - RNA, 22 nt, Human
uaaaauagcaugugcagugaaa

SEQ ID NO: 1101599 - RNA, 22 nt, Human
caggauggugugagugugagga

SEQ ID NO: 1101600 - RNA, 22 nt, Human
ucucacuuuccagacuuuucaa

SEQ ID NO: 1101601 - RNA, 22 nt, Human
auguaugaagcuuuguuuggga

SEQ ID NO: 1101602 - RNA, 22 nt, Human
uugcucaggcuggugugcagug

SEQ ID NO: 1101603 - RNA, 22 nt, Human
agcaccugccugcauuggcuau

SEQ ID NO: 1101604 - RNA, 22 nt, Human
uuuuaacuuaaaauacauagau

SEQ ID NO: 1101605 - RNA, 20 nt, Human
uucaggauucuagaccacac

SEQ ID NO: 1101606 - RNA, 22 nt, Human
acauguaaaaggaacaugcaug

SEQ ID NO: 1101607 - RNA, 22 nt, Human
aucuuguuauaagagauaaugg

SEQ ID NO: 1101608 - RNA, 22 nt, Human
uauguguuugacacccugcaag

SEQ ID NO: 1101609 - RNA, 22 nt, Human
uaacacauuuuccucauacgga

SEQ ID NO: 1101610 - RNA, 21 nt, Human
cuguggaagggaacuagaggg

SEQ ID NO: 1101611 - RNA, 22 nt, Human
uugcauuugacaaauuauuuaa

SEQ ID NO: 1101612 - RNA, 22 nt, Human
ugcugcuguauccuuaguguca

SEQ ID NO: 1101613 - RNA, 22 nt, Human
cuggaggcacccuuagagaggc

SEQ ID NO: 1101614 - RNA, 22 nt, Human
uagauuuuacuucugucauuac

SEQ ID NO: 1101615 - RNA, 22 nt, Human
agcauccaacaggagggaaggg

SEQ ID NO: 1101616 - RNA, 22 nt, Human
ucugggaacagccuggcugugu

SEQ ID NO: 1101617 - RNA, 20 nt, Human
cuguuaaaagguaugaauuc

SEQ ID NO: 1101618 - RNA, 22 nt, Human
ucacuucacacccacuaucaug

SEQ ID NO: 1101619 - RNA, 22 nt, Human
ugaaggccuaacuuccagugcu

SEQ ID NO: 1101620 - RNA, 22 nt, Human
auucaaguccagcuucucuaca

SEQ ID NO: 1101621 - RNA, 22 nt, Human
uaaaugagggcugacaugauug

SEQ ID NO: 1101622 - RNA, 22 nt, Human
uguccucagauaugucuacucu

SEQ ID NO: 1101623 - RNA, 22 nt, Human
cucaggaucgcuugcccuaggg

SEQ ID NO: 1101624 - RNA, 22 nt, Human
acaaaugucuccucuuuuguua

SEQ ID NO: 1101625 - RNA, 22 nt, Human
aucugucaggagcaaggacuac

SEQ ID NO: 1101626 - RNA, 22 nt, Human
cauuuguauguuccuccuuagg

SEQ ID NO: 1101627 - RNA, 22 nt, Human
uauuaaauuauggauuuaggag

SEQ ID NO: 1101628 - RNA, 23 nt, Human
uugcuuucaucaugagaugcucc

SEQ ID NO: 1101629 - RNA, 22 nt, Human
ucuuugcacugugcaagcagaa

SEQ ID NO: 1101630 - RNA, 22 nt, Human
uaugauuuguagacauuugauu

SEQ ID NO: 1101631 - RNA, 22 nt, Human
cugcuguguggauucaauggcu

SEQ ID NO: 1101632 - RNA, 22 nt, Human
gaucuguuauaaucucuuuuau

SEQ ID NO: 1101633 - RNA, 19 nt, Human
agccuggcuuugcucugcu

SEQ ID NO: 1101634 - RNA, 22 nt, Human
ccuacucugagcgccuccgcau

SEQ ID NO: 1101635 - RNA, 22 nt, Human
cccaucacagacacuggguuau

SEQ ID NO: 1101636 - RNA, 22 nt, Human
uucaggauucuuucagacuggg

SEQ ID NO: 1101637 - RNA, 23 nt, Human
acagaaaucauuuguaagguacc

SEQ ID NO: 1101638 - RNA, 22 nt, Human
auaaaguuuaaaagucaauagu

SEQ ID NO: 1101639 - RNA, 22 nt, Human
aaaguucuggggguguuucugg

SEQ ID NO: 1101640 - RNA, 22 nt, Human
uaugccugauaacugugucucu

SEQ ID NO: 1101641 - RNA, 17 nt, Human
cccaugagcccacuccc

SEQ ID NO: 1101642 - RNA, 22 nt, Human
uucaggaucaaguugccaguag

SEQ ID NO: 1101643 - RNA, 23 nt, Human
aaauuauugcucuucaauugccu

SEQ ID NO: 1101644 - RNA, 20 nt, Human
aggcucagcugagcucuugg

SEQ ID NO: 1101645 - RNA, 22 nt, Human
agucucagaaaagaagcaugga

SEQ ID NO: 1101646 - RNA, 22 nt, Human
auuauucuuaugucaucauggc

SEQ ID NO: 1101647 - RNA, 22 nt, Human
ugaaauuaugcauuguuguacc

SEQ ID NO: 1101648 - RNA, 22 nt, Human
cuugaaagcacuuaguaaauua

SEQ ID NO: 1101649 - RNA, 22 nt, Human
ucuucauuccguagauauuuau

SEQ ID NO: 1101650 - RNA, 21 nt, Human
agucuguuaggaugacucuga

SEQ ID NO: 1101651 - RNA, 22 nt, Human
ugcacauucacuuagguauugu

SEQ ID NO: 1101652 - RNA, 22 nt, Human
uagcacaucuucuuggccugca

SEQ ID NO: 1101653 - RNA, 22 nt, Human
ucucaguguguuuucucucaga

SEQ ID NO: 1101654 - RNA, 22 nt, Human
uuucuugaccacuauguugaua

SEQ ID NO: 1101655 - RNA, 22 nt, Human
uucacagaugccugaugugugg

SEQ ID NO: 1101656 - RNA, 22 nt, Human
guugaaagaugucuugguuccc

SEQ ID NO: 1101657 - RNA, 22 nt, Human
aaguggacuaauacaaggacua

SEQ ID NO: 1101658 - RNA, 22 nt, Human
uuagagucaaaauggcauguua

SEQ ID NO: 1101659 - RNA, 23 nt, Human
uucauuugucuacuucacuuguu

SEQ ID NO: 1101660 - RNA, 17 nt, Human
cauuuguugaucaguug

SEQ ID NO: 1101661 - RNA, 22 nt, Human
cuggcuugcagcucaucauaaa

SEQ ID NO: 1101662 - RNA, 22 nt, Human
uaacacauaagcugagaccaug

SEQ ID NO: 1101663 - RNA, 22 nt, Human
gccaugcuugguaugcugugag

SEQ ID NO: 1101664 - RNA, 22 nt, Human
uaccauuucauucuuuccucau

SEQ ID NO: 1101665 - RNA, 22 nt, Human
gucuccugagccuugacugcaa

SEQ ID NO: 1101666 - RNA, 22 nt, Human
uaauaguuucauaaugugcuuc

SEQ ID NO: 1101667 - RNA, 22 nt, Human
aauguaugcugugguaucuucu

SEQ ID NO: 1101668 - RNA, 22 nt, Human
cuguggaaggccuguccugaaa

SEQ ID NO: 1101669 - RNA, 22 nt, Human
uuuuguuguaauauaccuaucc

SEQ ID NO: 1101670 - RNA, 22 nt, Human
uuucaaacauagaucugaauau

SEQ ID NO: 1101671 - RNA, 21 nt, Human
cacucaggguaugugccaggc

SEQ ID NO: 1101672 - RNA, 22 nt, Human
aggcacaguuucauccccgggc

SEQ ID NO: 1101673 - RNA, 22 nt, Human
ucacacagguuugcaaugauuu

SEQ ID NO: 1101674 - RNA, 22 nt, Human
cagagcucuauguucauggagg

SEQ ID NO: 1101675 - RNA, 22 nt, Human
gucuccugagacugcagucacc

SEQ ID NO: 1101676 - RNA, 22 nt, Human
ccugccugcaccuucucugggg

SEQ ID NO: 1101677 - RNA, 21 nt, Human
uugaaaguaaauucagcagcu

SEQ ID NO: 1101678 - RNA, 22 nt, Human
auacuaaaguauagaacuuagu

SEQ ID NO: 1101679 - RNA, 22 nt, Human
aguacauauaguaauuuagcca

SEQ ID NO: 1101680 - RNA, 22 nt, Human
uuauucuuuaaacauauauguu

SEQ ID NO: 1101681 - RNA, 22 nt, Human
gucaggaucucccaguacauau

SEQ ID NO: 1101682 - RNA, 22 nt, Human
ucugcuguucauucuuuuagcu

SEQ ID NO: 1101683 - RNA, 22 nt, Human
aucaguuauuuuuaagcuauaa

SEQ ID NO: 1101684 - RNA, 22 nt, Human
aguggcagagccaaguagagcc

SEQ ID NO: 1101685 - RNA, 22 nt, Human
ccaggcugugguuuagauagag

SEQ ID NO: 1101686 - RNA, 19 nt, Human
uuugaaagaguuuuauugg

SEQ ID NO: 1101687 - RNA, 22 nt, Human
ucucuguacaguacaugccgug

SEQ ID NO: 1101688 - RNA, 22 nt, Human
aggaaacuccccuacaucucaa

SEQ ID NO: 1101689 - RNA, 22 nt, Human
acaauacuauuuucaguauccu

SEQ ID NO: 1101690 - RNA, 22 nt, Human
gaaggccacaaaaaaugucaua

SEQ ID NO: 1101691 - RNA, 22 nt, Human
cauagagugauguaagguaugu

SEQ ID NO: 1101692 - RNA, 22 nt, Human
ucauuuguacuugugugcuugu

SEQ ID NO: 1101693 - RNA, 22 nt, Human
uuucacagguacaaacacuccu

SEQ ID NO: 1101694 - RNA, 22 nt, Human
ucugggaaguccucugucaugc

SEQ ID NO: 1101695 - RNA, 22 nt, Human
cauucuuacacaauauuuuaau

SEQ ID NO: 1101696 - RNA, 22 nt, Human
uuucaguucaguuuauuauauc

SEQ ID NO: 1101697 - RNA, 22 nt, Human
aaaguuugagugauuugacaca

SEQ ID NO: 1101698 - RNA, 22 nt, Human
aauuuccagaccccauccacag

SEQ ID NO: 1101699 - RNA, 22 nt, Human
ugggagcccaagggagcugccg

SEQ ID NO: 1101700 - RNA, 22 nt, Human
auacuguuucucuucuacauga

SEQ ID NO: 1101701 - RNA, 23 nt, Human
cccauuuucauguuaacuccugg

SEQ ID NO: 1101702 - RNA, 22 nt, Human
agucuacaaagaaaaguuauug

SEQ ID NO: 1101703 - RNA, 22 nt, Human
uauauauucuuaaguaguguag

SEQ ID NO: 1101704 - RNA, 22 nt, Human
ugaaggaaugaguauacuguuu

SEQ ID NO: 1101705 - RNA, 22 nt, Human
gaaggccacuuuguguugagaa

SEQ ID NO: 1101706 - RNA, 22 nt, Human
uauaauuuaucaugucacaguu

SEQ ID NO: 1101707 - RNA, 22 nt, Human
cugcuuugacuguuaagaacca

SEQ ID NO: 1101708 - RNA, 22 nt, Human
cugcuguguaucauuuuagaug

SEQ ID NO: 1101709 - RNA, 22 nt, Human
gcuggcagggacagcugcgugu

SEQ ID NO: 1101710 - RNA, 22 nt, Human
uuucacagcuggguggcagagu

SEQ ID NO: 1101711 - RNA, 22 nt, Human
uugcuucaguagcucuuuaaag

SEQ ID NO: 1101712 - RNA, 21 nt, Human
acagcaagccuucacaugagu

SEQ ID NO: 1101713 - RNA, 22 nt, Human
agugugucugaucacuugugag

SEQ ID NO: 1101714 - RNA, 22 nt, Human
aucugccucuucuucauugcga

SEQ ID NO: 1101715 - RNA, 22 nt, Human
gcugcugucagugguggcaguu

SEQ ID NO: 1101716 - RNA, 22 nt, Human
gcucaggaucagccaccucuuu

SEQ ID NO: 1101717 - RNA, 22 nt, Human
agacaaaugguaauuaugucua

SEQ ID NO: 1101718 - RNA, 22 nt, Human
gauuucuugauaaguaguguga

SEQ ID NO: 1101719 - RNA, 19 nt, Human
cuugcugggugguuucugc

SEQ ID NO: 1101720 - RNA, 22 nt, Human
uggagcugggguuugaaucugg

SEQ ID NO: 1101721 - RNA, 22 nt, Human
uucugucacagugcugguauca

SEQ ID NO: 1101722 - RNA, 22 nt, Human
augaaggcaguuaaacgucauc

SEQ ID NO: 1101723 - RNA, 22 nt, Human
aguggcaggcggagauguagga

SEQ ID NO: 1101724 - RNA, 22 nt, Human
ucuuuccaaggacucuguagca

SEQ ID NO: 1101725 - RNA, 22 nt, Human
uuucaucuaacacuacauaggg

SEQ ID NO: 1101726 - RNA, 22 nt, Human
auauucuugugauuauaaagua

SEQ ID NO: 1101727 - RNA, 22 nt, Human
cccuuagcuccaagggguuugg

SEQ ID NO: 1101728 - RNA, 22 nt, Human
aaugucugcucuacucaggagg

SEQ ID NO: 1101729 - RNA, 17 nt, Human
ucauuuguugugacuag

SEQ ID NO: 1101730 - RNA, 22 nt, Human
ucugggaagcugcgugccuguu

SEQ ID NO: 1101731 - RNA, 20 nt, Human
uuuuccagaaaguaucauug

SEQ ID NO: 1101732 - RNA, 22 nt, Human
uucuucaaacaaaaguggcaug

SEQ ID NO: 1101733 - RNA, 22 nt, Human
uccaugagcuagcuuuccaaag

SEQ ID NO: 1101734 - RNA, 22 nt, Human
aauacugccugugagguaacuc

SEQ ID NO: 1101735 - RNA, 22 nt, Human
gcucucuugguggcuguccugg

SEQ ID NO: 1101736 - RNA, 22 nt, Human
uugaaauacugcauuguucagu

SEQ ID NO: 1101737 - RNA, 22 nt, Human
uccuucuuucccccuagucauu

SEQ ID NO: 1101738 - RNA, 22 nt, Human
guucuucaaagugacaacuaaa

SEQ ID NO: 1101739 - RNA, 22 nt, Human
guucucucugcuuccaagaugg

SEQ ID NO: 1101740 - RNA, 22 nt, Human
aaucacuuuucucuaauguagc

SEQ ID NO: 1101741 - RNA, 22 nt, Human
uuuguagaggguaauugacaga

SEQ ID NO: 1101742 - RNA, 22 nt, Human
uugaauuagacuuugcuacagg

SEQ ID NO: 1101743 - RNA, 22 nt, Human
aaguuucaugauguaauuauug

SEQ ID NO: 1101744 - RNA, 22 nt, Human
caguuucuauggcugggcucug

SEQ ID NO: 1101745 - RNA, 22 nt, Human
uucaggauucugugucugacaa

SEQ ID NO: 1101746 - RNA, 22 nt, Human
cuucagaagaaaagcagugugu

SEQ ID NO: 1101747 - RNA, 22 nt, Human
gagagcuggguucaaguagcug

SEQ ID NO: 1101748 - RNA, 22 nt, Human
cagcuuucaucagugacacuca

SEQ ID NO: 1101749 - RNA, 22 nt, Human
augaaggcuguguggagccccc

SEQ ID NO: 1101750 - RNA, 22 nt, Human
cauuuccacuucugaaaacugg

SEQ ID NO: 1101751 - RNA, 22 nt, Human
gaaauuauugcuagagacugca

SEQ ID NO: 1101752 - RNA, 22 nt, Human
augaggcaguacacacaaagcc

SEQ ID NO: 1101753 - RNA, 22 nt, Human
ucagccagaggcuucuugguuu

SEQ ID NO: 1101754 - RNA, 22 nt, Human
cagcaguguacaaggugucaga

SEQ ID NO: 1101755 - RNA, 22 nt, Human
uaagaaacauuuuuaugacagu

SEQ ID NO: 1101756 - RNA, 22 nt, Human
aguggcaguagaugagcugguu

SEQ ID NO: 1101757 - RNA, 22 nt, Human
guuuugaauacuacuagaacuu

SEQ ID NO: 1101758 - RNA, 22 nt, Human
agauggcagggguaccuggaag

SEQ ID NO: 1101759 - RNA, 22 nt, Human
agcccugaccuguccuguucug

SEQ ID NO: 1101760 - RNA, 22 nt, Human
aaauugcuugagauuagucucc

SEQ ID NO: 1101761 - RNA, 23 nt, Human
agccucuuguggauggucagcga

SEQ ID NO: 1101762 - RNA, 22 nt, Human
caauaauugcuuuccagaguua

SEQ ID NO: 1101763 - RNA, 22 nt, Human
uuccaggccgggcaggaaacac

SEQ ID NO: 1101764 - RNA, 22 nt, Human
uuccauacgacugaggucucgg

SEQ ID NO: 1101765 - RNA, 22 nt, Human
agaaagcacccugcacuuucug

SEQ ID NO: 1101766 - RNA, 22 nt, Human
uucguuuaguccacaaaugcau

SEQ ID NO: 1101767 - RNA, 22 nt, Human
acgugcuggagaagagcucgcc

SEQ ID NO: 1101768 - RNA, 22 nt, Human
auacacauguuauuguggaagc

SEQ ID NO: 1101769 - RNA, 22 nt, Human
aaaagagccacuuaugaccuca

SEQ ID NO: 1101770 - RNA, 22 nt, Human
uccuuggcaugccgucuucucc

SEQ ID NO: 1101771 - RNA, 22 nt, Human
auagucuuagaaucuugagugu

SEQ ID NO: 1101772 - RNA, 22 nt, Human
aucauugaguaaaaugaauaca

SEQ ID NO: 1101773 - RNA, 22 nt, Human
ggaaacauuccaagaguugaaa

SEQ ID NO: 1101774 - RNA, 22 nt, Human
ugccagcaguagcaguaggcca

SEQ ID NO: 1101775 - RNA, 22 nt, Human
uaaguauuggccuauagcuaga

SEQ ID NO: 1101776 - RNA, 22 nt, Human
gagccacaguggauugauucca

SEQ ID NO: 1101777 - RNA, 22 nt, Human
aaagcagaacugagagagcugg

SEQ ID NO: 1101778 - RNA, 22 nt, Human
ugaaauguggagaugguaagua

SEQ ID NO: 1101779 - RNA, 22 nt, Human
aaugugcugguaacugcuuugc

SEQ ID NO: 1101780 - RNA, 22 nt, Human
auuuggucuacauuuuccaaau

SEQ ID NO: 1101781 - RNA, 22 nt, Human
cugaagcugggcacuuccuuuu

SEQ ID NO: 1101782 - RNA, 22 nt, Human
auugagaaaauucgagcaaguu

SEQ ID NO: 1101783 - RNA, 22 nt, Human
ccagcuugcuccucugcaaugg

SEQ ID NO: 1101784 - RNA, 22 nt, Human
agaaaagaggcuuucuaagcau

SEQ ID NO: 1101785 - RNA, 22 nt, Human
aaggaucauguauauguuuaag

SEQ ID NO: 1101786 - RNA, 22 nt, Human
ugcacauggccugagugccuga

SEQ ID NO: 1101787 - RNA, 22 nt, Human
ucacccuucccagcuguccgcc

SEQ ID NO: 1101788 - RNA, 20 nt, Human
cagagcagugcccaggcggc

SEQ ID NO: 1101789 - RNA, 22 nt, Human
auuaguagcacacagagaucag

SEQ ID NO: 1101790 - RNA, 16 nt, Human
ggcagcagcuccgugc

SEQ ID NO: 1101791 - RNA, 22 nt, Human
aacaucuagguucucaucgaua

SEQ ID NO: 1101792 - RNA, 22 nt, Human
uggcaacucaauuucuacaaga

SEQ ID NO: 1101793 - RNA, 22 nt, Human
gcagagcugguacuugagccug

SEQ ID NO: 1101794 - RNA, 22 nt, Human
aagacagugacagucacaauug

SEQ ID NO: 1101795 - RNA, 21 nt, Human
ucuuggggaggagggcugcac

SEQ ID NO: 1101796 - RNA, 22 nt, Human
ugaaaugccuaugaagucagga

SEQ ID NO: 1101797 - RNA, 20 nt, Human
cuuguuaaauaugcagguag

SEQ ID NO: 1101798 - RNA, 21 nt, Human
uaaggaagagcauuuuagguc

SEQ ID NO: 1101799 - RNA, 22 nt, Human
guaauucugugugaaucuauua

SEQ ID NO: 1101800 - RNA, 22 nt, Human
cauggaaggcaaaagacacaga

SEQ ID NO: 1101801 - RNA, 22 nt, Human
gcggggggcaggcaguacguug

SEQ ID NO: 1101802 - RNA, 22 nt, Human
caguauuuaggauuaggagaga

SEQ ID NO: 1101803 - RNA, 22 nt, Human
guguguggaaugcucauuuauu

SEQ ID NO: 1101804 - RNA, 22 nt, Human
uucuuucugggguccuucggcu

SEQ ID NO: 1101805 - RNA, 22 nt, Human
gaaaccuuugccgauggggucc

SEQ ID NO: 1101806 - RNA, 20 nt, Human
ggcagcaaccauaugcuaca

SEQ ID NO: 1101807 - RNA, 22 nt, Human
ucucuuugacccuuuagcucca

SEQ ID NO: 1101808 - RNA, 22 nt, Human
acauuuaaugauccuacuguga

SEQ ID NO: 1101809 - RNA, 19 nt, Human
ggaggcuucuuggggucgg

SEQ ID NO: 1101810 - RNA, 22 nt, Human
gcauuuaaauuugaacuucaga

SEQ ID NO: 1101811 - RNA, 22 nt, Human
acaaguuucauuguuuagaacc

SEQ ID NO: 1101812 - RNA, 22 nt, Human
uuuguucaccuagcaaacuuuu

SEQ ID NO: 1101813 - RNA, 22 nt, Human
augcuugaaaguuauuucauuu

SEQ ID NO: 1101814 - RNA, 22 nt, Human
ccaaaauauuagugcuuaagua

SEQ ID NO: 1101815 - RNA, 22 nt, Human
ugcccucagcagcagcuccugc

SEQ ID NO: 1101816 - RNA, 22 nt, Human
cuuauuagaaagaaaagacaug

SEQ ID NO: 1101817 - RNA, 22 nt, Human
cuucauuaaugucuauaaguuu

SEQ ID NO: 1101818 - RNA, 22 nt, Human
ugguuaaaugcuccgaucuugg

SEQ ID NO: 1101819 - RNA, 22 nt, Human
ucagccaggccaggcauucaca

SEQ ID NO: 1101820 - RNA, 22 nt, Human
ggcugagcuuuucaugaugguu

SEQ ID NO: 1101821 - RNA, 22 nt, Human
caguguuuagcacagugcuugg

SEQ ID NO: 1101822 - RNA, 22 nt, Human
agccacauggaccugaugcuag

SEQ ID NO: 1101823 - RNA, 22 nt, Human
cugagcaugcuacaugcagcac

SEQ ID NO: 1101824 - RNA, 22 nt, Human
uguaauguuagaaacaauugcu

SEQ ID NO: 1101825 - RNA, 19 nt, Human
auagaguagaguaucuguu

SEQ ID NO: 1101826 - RNA, 22 nt, Human
gaaaauaguucaucacaaugau

SEQ ID NO: 1101827 - RNA, 22 nt, Human
ucuaaugcuugacugggggcuu

SEQ ID NO: 1101828 - RNA, 22 nt, Human
ugacauuugagagagauauaca

SEQ ID NO: 1101829 - RNA, 23 nt, Human
ugucuugguuucuucacccuagu

SEQ ID NO: 1101830 - RNA, 22 nt, Human
uuguuuguaaggcucuuagaau

SEQ ID NO: 1101831 - RNA, 22 nt, Human
gguguuguacauucuguggauu

SEQ ID NO: 1101832 - RNA, 22 nt, Human
aagcagcauaugacagcaucca

SEQ ID NO: 1101833 - RNA, 22 nt, Human
caugugguauugugagauccac

SEQ ID NO: 1101834 - RNA, 22 nt, Human
ggcaagaaccucaauuaccuuu

SEQ ID NO: 1101835 - RNA, 22 nt, Human
ggcaauuacguauuagucaugu

SEQ ID NO: 1101836 - RNA, 22 nt, Human
ugaggagcaggguggcuuacuc

SEQ ID NO: 1101837 - RNA, 22 nt, Human
agcaauguuggccuauauaccu

SEQ ID NO: 1101838 - RNA, 22 nt, Human
gcuuucuuuucaagaauguauu

SEQ ID NO: 1101839 - RNA, 22 nt, Human
uuuuuggguccaggcuguaucu

SEQ ID NO: 1101840 - RNA, 18 nt, Human
ccucuggguuuuguuccc

SEQ ID NO: 1101841 - RNA, 22 nt, Human
guguuuugugaggccuucuuuc

SEQ ID NO: 1101842 - RNA, 22 nt, Human
ugaggauggaaugcugugcaag

SEQ ID NO: 1101843 - RNA, 22 nt, Human
augcggagccccaagcuugaag

SEQ ID NO: 1101844 - RNA, 22 nt, Human
ggugaccucaccuggucccacc

SEQ ID NO: 1101845 - RNA, 22 nt, Human
ggcagcagaacuggcccuguau

SEQ ID NO: 1101846 - RNA, 23 nt, Human
cuuuccuuucuuugacacccagc

SEQ ID NO: 1101847 - RNA, 22 nt, Human
aggcuuuugcucuggcuccucu

SEQ ID NO: 1101848 - RNA, 22 nt, Human
aaggcucccucuucucgagugu

SEQ ID NO: 1101849 - RNA, 22 nt, Human
ugugucuuuggcgaugucugga

SEQ ID NO: 1101850 - RNA, 22 nt, Human
gagcagcaggccagguugcagg

SEQ ID NO: 1101851 - RNA, 22 nt, Human
aagcucuuuccacuaaaccacu

SEQ ID NO: 1101852 - RNA, 22 nt, Human
agcaguuuauccucauaaugga

SEQ ID NO: 1101853 - RNA, 18 nt, Human
gcugaaauucuaaacaaa

SEQ ID NO: 1101854 - RNA, 19 nt, Human
cagcaaacacuguaaaugg

SEQ ID NO: 1101855 - RNA, 22 nt, Human
cuugucugcuauaaaaauccag

SEQ ID NO: 1101856 - RNA, 22 nt, Human
agcagcaggagccgugggguga

SEQ ID NO: 1101857 - RNA, 21 nt, Human
ucaggaagagccaguucaugc

SEQ ID NO: 1101858 - RNA, 22 nt, Human
aggcauuuaaagauguaagacu

SEQ ID NO: 1101859 - RNA, 22 nt, Human
uagcagcacuauuuguuguagu

SEQ ID NO: 1101860 - RNA, 22 nt, Human
caauuuuuaaacuaugaaguug

SEQ ID NO: 1101861 - RNA, 22 nt, Human
agcaaauaauugucuuugaggg

SEQ ID NO: 1101862 - RNA, 22 nt, Human
ugugcuauuuuugcauaugugu

SEQ ID NO: 1101863 - RNA, 22 nt, Human
uucacagcuaagagcuaaguaa

SEQ ID NO: 1101864 - RNA, 22 nt, Human
gaaaugucaagauauguuugga

SEQ ID NO: 1101865 - RNA, 22 nt, Human
guuuccuuuuggaauuagagcu

SEQ ID NO: 1101866 - RNA, 22 nt, Human
uagaaguuaaaggaauacagaa

SEQ ID NO: 1101867 - RNA, 22 nt, Human
gaggcugaacagguucucauga

SEQ ID NO: 1101868 - RNA, 22 nt, Human
cuuuggucuccgucaucaauca

SEQ ID NO: 1101869 - RNA, 22 nt, Human
uggccuuggucacaaugcaaac

SEQ ID NO: 1101870 - RNA, 22 nt, Human
cucaggaaaauauugaagaagu

SEQ ID NO: 1101871 - RNA, 22 nt, Human
ucuucaugucucugcuugaguc

SEQ ID NO: 1101872 - RNA, 22 nt, Human
uuauuuaaaagugguaagauuc

SEQ ID NO: 1101873 - RNA, 22 nt, Human
aucauccuagaaggaagcuagg

SEQ ID NO: 1101874 - RNA, 22 nt, Human
gagagaagggggauaugagccu

SEQ ID NO: 1101875 - RNA, 22 nt, Human
aaggcaguuaauuuggcuagaa

SEQ ID NO: 1101876 - RNA, 21 nt, Human
ugucagcaacaauacuuucuc

SEQ ID NO: 1101877 - RNA, 22 nt, Human
cccuugagguagacugaacacc

SEQ ID NO: 1101878 - RNA, 22 nt, Human
gagcaaggaugggucuauagua

SEQ ID NO: 1101879 - RNA, 21 nt, Human
cccuugccugcacuccucggc

SEQ ID NO: 1101880 - RNA, 19 nt, Human
ucuuucauuucuagcucug

SEQ ID NO: 1101881 - RNA, 22 nt, Human
uuguaacaguagcugucagcuc

SEQ ID NO: 1101882 - RNA, 22 nt, Human
caagucugaccucugggugaag

SEQ ID NO: 1101883 - RNA, 22 nt, Human
uguucuggugaggccauggggu

SEQ ID NO: 1101884 - RNA, 20 nt, Human
ccacaguggagacuggagac

SEQ ID NO: 1101885 - RNA, 22 nt, Human
auagcaaaggacaauagucagu

SEQ ID NO: 1101886 - RNA, 22 nt, Human
uaaugccuuaugucaaauguaa

SEQ ID NO: 1101887 - RNA, 22 nt, Human
ugccauagcaaugguaagcuga

SEQ ID NO: 1101888 - RNA, 22 nt, Human
gcagcaaucuucacagugucau

SEQ ID NO: 1101889 - RNA, 22 nt, Human
ugcuuguauucauaucacagcu

SEQ ID NO: 1101890 - RNA, 22 nt, Human
uggccuugcccagcgccuaggu

SEQ ID NO: 1101891 - RNA, 22 nt, Human
acaaucagcacugaguuuaucu

SEQ ID NO: 1101892 - RNA, 22 nt, Human
uaaagcaaugaaaguuuugcag

SEQ ID NO: 1101893 - RNA, 22 nt, Human
agagucaguuaugucaagugcu

SEQ ID NO: 1101894 - RNA, 22 nt, Human
uccucauucuuggugcaucaaa

SEQ ID NO: 1101895 - RNA, 22 nt, Human
uuuugaauaauucagaaacagc

SEQ ID NO: 1101896 - RNA, 22 nt, Human
ugagacaaagcagcugacagaa

SEQ ID NO: 1101897 - RNA, 22 nt, Human
aagcagcacagcaaugacucua

SEQ ID NO: 1101898 - RNA, 22 nt, Human
guggccuccuccguccgccucu

SEQ ID NO: 1101899 - RNA, 22 nt, Human
agcagcaggugaccucgaugcc

SEQ ID NO: 1101900 - RNA, 22 nt, Human
agugaauuagccuauuuguaaa

SEQ ID NO: 1101901 - RNA, 17 nt, Human
agcagcuggguugaucu

SEQ ID NO: 1101902 - RNA, 22 nt, Human
ucuuuuaucuguuguguaacaa

SEQ ID NO: 1101903 - RNA, 22 nt, Human
auuuccuauacaguuguccaua

SEQ ID NO: 1101904 - RNA, 22 nt, Human
uggcugaggcuuuucuuaaaga

SEQ ID NO: 1101905 - RNA, 22 nt, Human
uggcaauguggaaugguccagg

SEQ ID NO: 1101906 - RNA, 22 nt, Human
agccagcauauauauaguugaa

SEQ ID NO: 1101907 - RNA, 22 nt, Human
caaugcagauaccuuccagaga

SEQ ID NO: 1101908 - RNA, 22 nt, Human
acauuguugagccucuuguuca

SEQ ID NO: 1101909 - RNA, 22 nt, Human
agauguuuauaacucaugagug

SEQ ID NO: 1101910 - RNA, 22 nt, Human
uuuguaguuguggaugcugaag

SEQ ID NO: 1101911 - RNA, 22 nt, Human
auugcacaucugcacuacagcc

SEQ ID NO: 1101912 - RNA, 19 nt, Human
ccauucugucucugccaca

SEQ ID NO: 1101913 - RNA, 22 nt, Human
uccuccuuuccccgcuggagcc

SEQ ID NO: 1101914 - RNA, 22 nt, Human
gaauacaaauaauaccaaggug

SEQ ID NO: 1101915 - RNA, 21 nt, Human
cuagaaagaauguugucgucu

SEQ ID NO: 1101916 - RNA, 22 nt, Human
uggcugaggagagggcggaagu

SEQ ID NO: 1101917 - RNA, 22 nt, Human
cugggguccuugccauguguca

SEQ ID NO: 1101918 - RNA, 22 nt, Human
uaacaaaguauuguuuguguau

SEQ ID NO: 1101919 - RNA, 22 nt, Human
ggcuagcuuagagucaugcuag

SEQ ID NO: 1101920 - RNA, 22 nt, Human
cagcagcaggcgcacggccguc

SEQ ID NO: 1101921 - RNA, 22 nt, Human
uuugaaauguaucaguauaggu

SEQ ID NO: 1101922 - RNA, 22 nt, Human
agucaacauuugagaugcaaug

SEQ ID NO: 1101923 - RNA, 22 nt, Human
cagcaguacuucucagagguau

SEQ ID NO: 1101924 - RNA, 22 nt, Human
gaagaaguguaagucuguuuca

SEQ ID NO: 1101925 - RNA, 20 nt, Human
caucaacaccuugucagccu

SEQ ID NO: 1101926 - RNA, 22 nt, Human
uccuuucugucuuuacucugga

SEQ ID NO: 1101927 - RNA, 22 nt, Human
aagaagguugaaugacuacuuu

SEQ ID NO: 1101928 - RNA, 22 nt, Human
auuuacagacguggauuagugc

SEQ ID NO: 1101929 - RNA, 22 nt, Human
uccuggccucugagucaagaac

SEQ ID NO: 1101930 - RNA, 22 nt, Human
agcucuuuuaucaugaggagag

SEQ ID NO: 1101931 - RNA, 22 nt, Human
uaaggacagcagcuacuuuucc

SEQ ID NO: 1101932 - RNA, 22 nt, Human
ccacugcuaacuugcugcagcu

SEQ ID NO: 1101933 - RNA, 22 nt, Human
ccaaacauuucaaauuuagaga

SEQ ID NO: 1101934 - RNA, 22 nt, Human
gucagcaggguccccuugagug

SEQ ID NO: 1101935 - RNA, 23 nt, Human
aacauuuguaaggugauuuuguu

SEQ ID NO: 1101936 - RNA, 23 nt, Human
agcaacagugggugaguguugcu

SEQ ID NO: 1101937 - RNA, 18 nt, Human
uauaaacacacuuagguu

SEQ ID NO: 1101938 - RNA, 22 nt, Human
auugagaaggagauuggcaucu

SEQ ID NO: 1101939 - RNA, 22 nt, Human
guuaacaacacugugagugcug

SEQ ID NO: 1101940 - RNA, 22 nt, Human
ucauugaggaaagguaguggcu

SEQ ID NO: 1101941 - RNA, 22 nt, Human
auggcucugcugggcaaagcaa

SEQ ID NO: 1101942 - RNA, 22 nt, Human
ggaguugacggccgacacccag

SEQ ID NO: 1101943 - RNA, 22 nt, Human
uacaagcuuuuguguauaaaug

SEQ ID NO: 1101944 - RNA, 20 nt, Human
uugaggagauauugaauacu

SEQ ID NO: 1101945 - RNA, 22 nt, Human
gugcugagugcagagugcagag

SEQ ID NO: 1101946 - RNA, 22 nt, Human
uagcauuucacugaucuucacu

SEQ ID NO: 1101947 - RNA, 22 nt, Human
gcaaugagcacccagagggcag

SEQ ID NO: 1101948 - RNA, 22 nt, Human
uuagccaugcccuagaagagga

SEQ ID NO: 1101949 - RNA, 22 nt, Human
uuguccuuaccucaaucuggaa

SEQ ID NO: 1101950 - RNA, 22 nt, Human
aagaauaagaggauuuagaaca

SEQ ID NO: 1101951 - RNA, 22 nt, Human
ggcucucuuaacuggccauccu

SEQ ID NO: 1101952 - RNA, 22 nt, Human
gcagggaaguuguaauguaaug

SEQ ID NO: 1101953 - RNA, 22 nt, Human
cagagcagaaaccugggugauu

SEQ ID NO: 1101954 - RNA, 22 nt, Human
uuugaacuucuaccugucauau

SEQ ID NO: 1101955 - RNA, 22 nt, Human
cucacagcugcuucaggaucca

SEQ ID NO: 1101956 - RNA, 22 nt, Human
aauuagaagcuguuagcaaaau

SEQ ID NO: 1101957 - RNA, 19 nt, Human
ggguccauggugucaagga

SEQ ID NO: 1101958 - RNA, 22 nt, Human
uaaaaguuagcuaggacaaagu

SEQ ID NO: 1101959 - RNA, 22 nt, Human
gguagacugagcuccuugagga

SEQ ID NO: 1101960 - RNA, 22 nt, Human
ugcauguuucuguauguuaaug

SEQ ID NO: 1101961 - RNA, 22 nt, Human
ccugugggagggagcggcugga

SEQ ID NO: 1101962 - RNA, 22 nt, Human
gagaauguuaauguugaaguau

SEQ ID NO: 1101963 - RNA, 22 nt, Human
cuagcagaagcuccuugagggu

SEQ ID NO: 1101964 - RNA, 22 nt, Human
ugagcuucuuuauuuggccaga

SEQ ID NO: 1101965 - RNA, 22 nt, Human
auugugcaccuacugugugcag

SEQ ID NO: 1101966 - RNA, 22 nt, Human
aggcugagccugggcguggugg

SEQ ID NO: 1101967 - RNA, 22 nt, Human
uuccaggacuggguguuugaag

SEQ ID NO: 1101968 - RNA, 22 nt, Human
agugagaguauuaaugugaacu

SEQ ID NO: 1101969 - RNA, 22 nt, Human
uagcugcacaggaaguaagauu

SEQ ID NO: 1101970 - RNA, 22 nt, Human
aaaugcaugugcuauagaugug

SEQ ID NO: 1101971 - RNA, 22 nt, Human
uccuggcccuguggccugcagu

SEQ ID NO: 1101972 - RNA, 22 nt, Human
augcauugaggaugacaugagu

SEQ ID NO: 1101973 - RNA, 22 nt, Human
aagccuucaguccguugcagag

SEQ ID NO: 1101974 - RNA, 22 nt, Human
uggcugaggcacagcugccgcc

SEQ ID NO: 1101975 - RNA, 22 nt, Human
uauuuggugaaucuauggucag

SEQ ID NO: 1101976 - RNA, 22 nt, Human
ucugaaauuuuaguuauagaaa

SEQ ID NO: 1101977 - RNA, 22 nt, Human
auguuguugaacucuuugcaug

SEQ ID NO: 1101978 - RNA, 22 nt, Human
auucuggacaaggcaagcuccu

SEQ ID NO: 1101979 - RNA, 22 nt, Human
gagcagcaucuccggcuuaaag

SEQ ID NO: 1101980 - RNA, 22 nt, Human
caauguuuuuccuuccuuaaua

SEQ ID NO: 1101981 - RNA, 22 nt, Human
aggcuguagaucuagacaugua

SEQ ID NO: 1101982 - RNA, 19 nt, Human
acaguuugggaaaugagca

SEQ ID NO: 1101983 - RNA, 22 nt, Human
aaguuacacauuuucauuguaa

SEQ ID NO: 1101984 - RNA, 22 nt, Human
gauguucgagcagaagaccagg

SEQ ID NO: 1101985 - RNA, 22 nt, Human
uaccaggagcccccuucugguc

SEQ ID NO: 1101986 - RNA, 22 nt, Human
cuguccauggcaaugaugcaga

SEQ ID NO: 1101987 - RNA, 22 nt, Human
ugaaguuguuaagguugccauu

SEQ ID NO: 1101988 - RNA, 22 nt, Human
augaaacaacagacuuggucaa

SEQ ID NO: 1101989 - RNA, 21 nt, Human
gacauugagcgugucgcagug

SEQ ID NO: 1101990 - RNA, 22 nt, Human
cagacucuugagcugauuguau

SEQ ID NO: 1101991 - RNA, 22 nt, Human
cagcagcaacaacggaagccuu

SEQ ID NO: 1101992 - RNA, 22 nt, Human
guggucaucuaacuaaauuuuc

SEQ ID NO: 1101993 - RNA, 21 nt, Human
caaaagagacugauucuugga

SEQ ID NO: 1101994 - RNA, 22 nt, Human
ucuauuaaugauucaauagugu

SEQ ID NO: 1101995 - RNA, 22 nt, Human
ccaccgaaacgucugcggaucc

SEQ ID NO: 1101996 - RNA, 22 nt, Human
cagcacauggauggaguuagga

SEQ ID NO: 1101997 - RNA, 22 nt, Human
gaauguuuaaaaggugcaguuu

SEQ ID NO: 1101998 - RNA, 22 nt, Human
aggauaauaauaaucucguuua

SEQ ID NO: 1101999 - RNA, 22 nt, Human
ccagcuggcccagcugugcucc

SEQ ID NO: 1102000 - RNA, 22 nt, Human
ggcagcaggguagccauuucuc

SEQ ID NO: 1102001 - RNA, 22 nt, Human
aaggcuuguugucacgcucuug

SEQ ID NO: 1102002 - RNA, 22 nt, Human
auuccaaagccugaauaaugga

SEQ ID NO: 1102003 - RNA, 22 nt, Human
cugcugccuuccaaaggccagg

SEQ ID NO: 1102004 - RNA, 19 nt, Human
uggcagcauugguaccuug

SEQ ID NO: 1102005 - RNA, 21 nt, Human
agaaggcaaaagcagacaucu

SEQ ID NO: 1102006 - RNA, 22 nt, Human
uggccuuggcagugagaagagu

SEQ ID NO: 1102007 - RNA, 22 nt, Human
gcagcagugugggcugaaccua

SEQ ID NO: 1102008 - RNA, 22 nt, Human
cagugcaacguugugcauucaa

SEQ ID NO: 1102009 - RNA, 22 nt, Human
guaauagucucaaacuccugga

SEQ ID NO: 1102010 - RNA, 22 nt, Human
aaugagaauguaagugaagaga

SEQ ID NO: 1102011 - RNA, 22 nt, Human
uuuccaaagguggcaggaacaa

SEQ ID NO: 1102012 - RNA, 20 nt, Human
caauaauuuacuucccuauu

SEQ ID NO: 1102013 - RNA, 22 nt, Human
gcuucuggugaggccucaggaa

SEQ ID NO: 1102014 - RNA, 21 nt, Human
acaaauuguuuauauaggaag

SEQ ID NO: 1102015 - RNA, 22 nt, Human
uugcaaauaauagccugaaacu

SEQ ID NO: 1102016 - RNA, 22 nt, Human
cacuguuuuacauguuauuuaa

SEQ ID NO: 1102017 - RNA, 20 nt, Human
gagcagugagccagggaaag

SEQ ID NO: 1102018 - RNA, 22 nt, Human
uaucuguauucugacagucacu

SEQ ID NO: 1102019 - RNA, 22 nt, Human
uaggcuccaguguguggcgagu

SEQ ID NO: 1102020 - RNA, 22 nt, Human
caagaaguugacagccagguga

SEQ ID NO: 1102021 - RNA, 22 nt, Human
gcagagcugucuaagucacuuc

SEQ ID NO: 1102022 - RNA, 22 nt, Human
ucuucaugucaugguauauuga

SEQ ID NO: 1102023 - RNA, 22 nt, Human
gcagugacagacaacuguuuga

SEQ ID NO: 1102024 - RNA, 22 nt, Human
ugucuucuaccuugacagcauu

SEQ ID NO: 1102025 - RNA, 22 nt, Human
augaaaacggaccagagcuauu

SEQ ID NO: 1102026 - RNA, 22 nt, Human
cagcaugaauguguucguaggg

SEQ ID NO: 1102027 - RNA, 22 nt, Human
auguuuguguuucccauucagg

SEQ ID NO: 1102028 - RNA, 22 nt, Human
ccagcagcucccucaggguccg

SEQ ID NO: 1102029 - RNA, 22 nt, Human
ccaggaagaaacagucuuuaua

SEQ ID NO: 1102030 - RNA, 22 nt, Human
aauguuugaacuuugcauauuu

SEQ ID NO: 1102031 - RNA, 22 nt, Human
guuaaaugcagauucugacuca

SEQ ID NO: 1102032 - RNA, 22 nt, Human
agugaaauaugcccauugcugu

SEQ ID NO: 1102033 - RNA, 22 nt, Human
uugcugccagcgcccugcaggg

SEQ ID NO: 1102034 - RNA, 22 nt, Human
cccuugagccuggaggagcucu

SEQ ID NO: 1102035 - RNA, 22 nt, Human
augaugaagcaugguuacacug

SEQ ID NO: 1102036 - RNA, 22 nt, Human
uagaugaacagaaagccacugu

SEQ ID NO: 1102037 - RNA, 22 nt, Human
cauagacauugauagguuauau

SEQ ID NO: 1102038 - RNA, 18 nt, Human
ucagacaaguuagacagg

SEQ ID NO: 1102039 - RNA, 22 nt, Human
uugauguaauacuuugcaacca

SEQ ID NO: 1102040 - RNA, 22 nt, Human
ccauuuguaccauuucuuugua

SEQ ID NO: 1102041 - RNA, 22 nt, Human
aaugucaacacaagagaaaugc

SEQ ID NO: 1102042 - RNA, 22 nt, Human
gagcagcagcugggccagguuc

SEQ ID NO: 1102043 - RNA, 22 nt, Human
cuagcagcauucuucuaguuag

SEQ ID NO: 1102044 - RNA, 22 nt, Human
uucacagcucauacuguucuca

SEQ ID NO: 1102045 - RNA, 22 nt, Human
uggcagcagggccccuggagga

SEQ ID NO: 1102046 - RNA, 22 nt, Human
cucugcguggcugggcccaggg

SEQ ID NO: 1102047 - RNA, 22 nt, Human
aaagcacauuacaagcucaguc

SEQ ID NO: 1102048 - RNA, 22 nt, Human
ugguaaaugucuaacaaucacu

SEQ ID NO: 1102049 - RNA, 20 nt, Human
aaagauacuuuuuguaaugg

SEQ ID NO: 1102050 - RNA, 22 nt, Human
uggaucuugaugcuccaagagu

SEQ ID NO: 1102051 - RNA, 22 nt, Human
cccaggaguaagugacauuguu

SEQ ID NO: 1102052 - RNA, 22 nt, Human
agauaaaguccaaacuguguag

SEQ ID NO: 1102053 - RNA, 22 nt, Human
auguaguauuuggaaauguaaa

SEQ ID NO: 1102054 - RNA, 22 nt, Human
uugggcugcagcaauuauuagu

SEQ ID NO: 1102055 - RNA, 22 nt, Human
uuucauguuggauacuguuuca

SEQ ID NO: 1102056 - RNA, 22 nt, Human
ugcaaauucuuuacucugugau

SEQ ID NO: 1102057 - RNA, 22 nt, Human
ucauuguuucugcuuuucauga

SEQ ID NO: 1102058 - RNA, 22 nt, Human
auccuucaaaaggaauagcagg

SEQ ID NO: 1102059 - RNA, 20 nt, Human
uaugauaauuacaaaauagu

SEQ ID NO: 1102060 - RNA, 22 nt, Human
ccugaaaugaguucugcucacu

SEQ ID NO: 1102061 - RNA, 22 nt, Human
cagagcagcagagcuuccaugg

SEQ ID NO: 1102062 - RNA, 22 nt, Human
ugggcaaaugcuuuuuagucaa

SEQ ID NO: 1102063 - RNA, 22 nt, Human
auggucacuucacccaugagcu

SEQ ID NO: 1102064 - RNA, 17 nt, Human
ugagcaguagaagaugc

SEQ ID NO: 1102065 - RNA, 22 nt, Human
aggcaguuguugcugagcagcu

SEQ ID NO: 1102066 - RNA, 22 nt, Human
augaauaaaacauuuuaaucag

SEQ ID NO: 1102067 - RNA, 22 nt, Human
aaauugaauuugggaaacauug

SEQ ID NO: 1102068 - RNA, 21 nt, Human
auucaaagaagaggaaggccc

SEQ ID NO: 1102069 - RNA, 22 nt, Human
uagcaggacaugugcagagaag

SEQ ID NO: 1102070 - RNA, 18 nt, Human
agcucacagaucuguuuu

SEQ ID NO: 1102071 - RNA, 22 nt, Human
cuucauuuggcaggcuggccuc

SEQ ID NO: 1102072 - RNA, 22 nt, Human
uugagcagaucgggcugugggg

SEQ ID NO: 1102073 - RNA, 22 nt, Human
uggcugaguuacgaacagagca

SEQ ID NO: 1102074 - RNA, 22 nt, Human
cuccccuagcccguugggaggu

SEQ ID NO: 1102075 - RNA, 22 nt, Human
augaaacucuagcuuucagcac

SEQ ID NO: 1102076 - RNA, 22 nt, Human
agugaaaaccuaaucaugcagu

SEQ ID NO: 1102077 - RNA, 22 nt, Human
uagcagaacaauagucaaugau

SEQ ID NO: 1102078 - RNA, 22 nt, Human
gggcugagggguaucucauggg

SEQ ID NO: 1102079 - RNA, 22 nt, Human
uccuggccaaguagauguggcg

SEQ ID NO: 1102080 - RNA, 22 nt, Human
uaagucauagauuaauggccac

SEQ ID NO: 1102081 - RNA, 22 nt, Human
uagcauuuagaacaccuugaga

SEQ ID NO: 1102082 - RNA, 22 nt, Human
gcagcagaaggccaaggggagc

SEQ ID NO: 1102083 - RNA, 22 nt, Human
ugugugaacucucugauguaca

SEQ ID NO: 1102084 - RNA, 22 nt, Human
gaauaauugugaugcuugaagu

SEQ ID NO: 1102085 - RNA, 22 nt, Human
uggcuuccagaacugagcaaca

SEQ ID NO: 1102086 - RNA, 22 nt, Human
auucauucugaccucaagagaa

SEQ ID NO: 1102087 - RNA, 22 nt, Human
ugaauaugugacuuugauuuca

SEQ ID NO: 1102088 - RNA, 22 nt, Human
uaucacauacuucucauccagg

SEQ ID NO: 1102089 - RNA, 22 nt, Human
cagaaagcaguugucaaugggc

SEQ ID NO: 1102090 - RNA, 22 nt, Human
agagaagagucuugucaaauua

SEQ ID NO: 1102091 - RNA, 23 nt, Human
aguacauuugacccaaauaagcu

SEQ ID NO: 1102092 - RNA, 22 nt, Human
auucuugauauagauaguuaau

SEQ ID NO: 1102093 - RNA, 22 nt, Human
ugguuuguauauguuugugaga

SEQ ID NO: 1102094 - RNA, 22 nt, Human
aucaugcagcaacaagcaaggc

SEQ ID NO: 1102095 - RNA, 22 nt, Human
caugcuggucagccaguggaug

SEQ ID NO: 1102096 - RNA, 22 nt, Human
aauacagugaaagugagcaagg

SEQ ID NO: 1102097 - RNA, 22 nt, Human
acagugcugaucuagacugacc

SEQ ID NO: 1102098 - RNA, 18 nt, Human
accugauuggcgcagccc

SEQ ID NO: 1102099 - RNA, 22 nt, Human
ugugaggaccucagcagagucu

SEQ ID NO: 1102100 - RNA, 23 nt, Human
gggcagcuuaagcuuguuuuucu

SEQ ID NO: 1102101 - RNA, 22 nt, Human
uugaggagucaggggcacggaa

SEQ ID NO: 1102102 - RNA, 22 nt, Human
guaugucuuaggguucaguaac

SEQ ID NO: 1102103 - RNA, 22 nt, Human
agugacauuauuuuguguacua

SEQ ID NO: 1102104 - RNA, 22 nt, Human
acagugcuaucaauagcuagaa

SEQ ID NO: 1102105 - RNA, 22 nt, Human
guggccuuuucaaguaggguau

SEQ ID NO: 1102106 - RNA, 22 nt, Human
ucagcacaggucuugcaaaaca

SEQ ID NO: 1102107 - RNA, 22 nt, Human
ugggugaagaggcuaugcuacu

SEQ ID NO: 1102108 - RNA, 22 nt, Human
auugaacauuguucuaggaggc

SEQ ID NO: 1102109 - RNA, 22 nt, Human
acuuuggugcgaagucacuuua

SEQ ID NO: 1102110 - RNA, 22 nt, Human
uuagacaucaagaagccaaugu

SEQ ID NO: 1102111 - RNA, 22 nt, Human
uccugaaggccugaguuccacc

SEQ ID NO: 1102112 - RNA, 22 nt, Human
uagcaucuguacugacauaauc

SEQ ID NO: 1102113 - RNA, 22 nt, Human
guagagcagggagcaggaagcu

SEQ ID NO: 1102114 - RNA, 22 nt, Human
ccacccuuccauucuuccucuu

SEQ ID NO: 1102115 - RNA, 22 nt, Human
gacuggcucuaucaggauaaau

SEQ ID NO: 1102116 - RNA, 22 nt, Human
ugucacagugcacagcuaagaa

SEQ ID NO: 1102117 - RNA, 22 nt, Human
uuagaaaucaccucugaagauc

SEQ ID NO: 1102118 - RNA, 22 nt, Human
uugcugccuuuguacucugaug

SEQ ID NO: 1102119 - RNA, 22 nt, Human
acaguaaucugggaacuuguua

SEQ ID NO: 1102120 - RNA, 22 nt, Human
guugguccuuugagcaagaucc

SEQ ID NO: 1102121 - RNA, 22 nt, Human
uuuugucagugagaacagaguu

SEQ ID NO: 1102122 - RNA, 22 nt, Human
guguggucgaaguucucccgga

SEQ ID NO: 1102123 - RNA, 22 nt, Human
uagcccauggacuggucagcug

SEQ ID NO: 1102124 - RNA, 22 nt, Human
gucaaaacaaaguuaagaauuc

SEQ ID NO: 1102125 - RNA, 22 nt, Human
uguuccucugaacuucuuccaa

SEQ ID NO: 1102126 - RNA, 22 nt, Human
ugugugcacaaagaguacaugg

SEQ ID NO: 1102127 - RNA, 22 nt, Human
uguggguccuccugugugcccg

SEQ ID NO: 1102128 - RNA, 22 nt, Human
ggaagcaaauuccagaaccaca

SEQ ID NO: 1102129 - RNA, 22 nt, Human
aauagcaaaugcucauuugaaa

SEQ ID NO: 1102130 - RNA, 22 nt, Human
uguuaguauuggcaaauuuguu

SEQ ID NO: 1102131 - RNA, 22 nt, Human
gggaaucuuccuuuuuuguaag

SEQ ID NO: 1102132 - RNA, 22 nt, Human
aucagaagaaauggaugugacu

SEQ ID NO: 1102133 - RNA, 22 nt, Human
aaguuugucucauuugaucuuc

SEQ ID NO: 1102134 - RNA, 22 nt, Human
ugaauaaucuuggguauuaaua

SEQ ID NO: 1102135 - RNA, 22 nt, Human
uucuguuuauaauuugcaguug

SEQ ID NO: 1102136 - RNA, 22 nt, Human
aguggcagggacuucauauaaa

SEQ ID NO: 1102137 - RNA, 22 nt, Human
ucauugagcgguucuuaaccca

SEQ ID NO: 1102138 - RNA, 21 nt, Human
uuuguucaggggcaaaguuaa

SEQ ID NO: 1102139 - RNA, 20 nt, Human
uuugauugccccucugacuu

SEQ ID NO: 1102140 - RNA, 23 nt, Human
aaauugucguaagguggagaugu

SEQ ID NO: 1102141 - RNA, 22 nt, Human
cagaaacacuguauuuagggaa

SEQ ID NO: 1102142 - RNA, 18 nt, Human
uagcucuuguugguccau

SEQ ID NO: 1102143 - RNA, 22 nt, Human
aggcugcugccuuggagagugu

SEQ ID NO: 1102144 - RNA, 22 nt, Human
uugcaguuuugacagaccaaau

SEQ ID NO: 1102145 - RNA, 22 nt, Human
uucuuuuaauagagauccugug

SEQ ID NO: 1102146 - RNA, 22 nt, Human
cuuccucuguggccagagugua

SEQ ID NO: 1102147 - RNA, 22 nt, Human
gagauuuccauauuuuguaaca

SEQ ID NO: 1102148 - RNA, 22 nt, Human
cagcuauuguucuguauaauga

SEQ ID NO: 1102149 - RNA, 22 nt, Human
uuuaauuuucugggcccagcag

SEQ ID NO: 1102150 - RNA, 22 nt, Human
gaaggcaagcagcauaaauguc

SEQ ID NO: 1102151 - RNA, 22 nt, Human
uaacauuucggugacaguggga

SEQ ID NO: 1102152 - RNA, 22 nt, Human
uauaagaaacaaggcaaauuuu

SEQ ID NO: 1102153 - RNA, 22 nt, Human
gugcuaugauuggacagaauag

SEQ ID NO: 1102154 - RNA, 22 nt, Human
auaguguguaaagugcagugau

SEQ ID NO: 1102155 - RNA, 22 nt, Human
ccuugcagcauauagagucccu

SEQ ID NO: 1102156 - RNA, 22 nt, Human
caagcagauauuuuagucaaga

SEQ ID NO: 1102157 - RNA, 22 nt, Human
aaagccauaucuauucuauucu

SEQ ID NO: 1102158 - RNA, 22 nt, Human
aucauccauggcugaucauaaa

SEQ ID NO: 1102159 - RNA, 22 nt, Human
agagaagcagggagucaucugu

SEQ ID NO: 1102160 - RNA, 22 nt, Human
ugggugguugcugaggcuccuu

SEQ ID NO: 1102161 - RNA, 22 nt, Human
uggcugagugaacauguccauu

SEQ ID NO: 1102162 - RNA, 22 nt, SARS coronavirus
auugugcagacaccuauuguag

SEQ ID NO: 1102163 - RNA, 20 nt, SARS coronavirus
aauaaauugccagaagcugc

SEQ ID NO: 1102164 - RNA, 22 nt, SARS coronavirus
cacaaggcagaugggcuaugua

SEQ ID NO: 1102165 - RNA, 22 nt, SARS coronavirus
uacuagagcagcaacaaugaga

SEQ ID NO: 1102166 - RNA, 22 nt, SARS coronavirus
uuaacaauuuucuugaacuuac

SEQ ID NO: 1102167 - RNA, 21 nt, SARS coronavirus
uuguccuccacuugcuaggua

SEQ ID NO: 1102168 - RNA, 20 nt, SARS coronavirus
aauaaauugccagaagcugc

SEQ ID NO: 1102169 - RNA, 22 nt, SARS coronavirus
uccaucauuaauaaugcuguuu

SEQ ID NO: 1102170 - RNA, 23 nt, SARS coronavirus
cucacgaauuuugcucacagcau

SEQ ID NO: 1102171 - RNA, 22 nt, SARS coronavirus
cucuuaauggugaagcaaagua

SEQ ID NO: 1102172 - RNA, 22 nt, SARS coronavirus
auugugcagacaccuauuguag

SEQ ID NO: 1102173 - RNA, 20 nt, Human
aaagagcccuuggagcaggc

SEQ ID NO: 1102174 - RNA, 22 nt, Human
gcuugggaagggcccuguguac

SEQ ID NO: 1102175 - RNA, 22 nt, Human
guggcagucgcugacagauaca

SEQ ID NO: 1102176 - RNA, 22 nt, Human
cucugagcagaggccguggcua

SEQ ID NO: 1102177 - RNA, 22 nt, Human
agcacaggaccaaggaagcugu

SEQ ID NO: 1102178 - RNA, 22 nt, Human
ccuggcagcauugguagagauu

SEQ ID NO: 1102179 - RNA, 22 nt, Human
uacacagauaugugaucaauca

SEQ ID NO: 1102180 - RNA, 23 nt, Human
uuggagagggugaguagugucag

SEQ ID NO: 1102181 - RNA, 22 nt, Human
cugagggucaacuugauuguau

SEQ ID NO: 1102182 - RNA, 22 nt, Human
ucuggcagcuauccucuggcca

SEQ ID NO: 1102183 - RNA, 22 nt, Human
cacauaagaaaugaauaugaga

SEQ ID NO: 1102184 - RNA, 22 nt, Human
ucccagccacaguuuccaccug

SEQ ID NO: 1102185 - RNA, 22 nt, Human
uucaguuccauuucaggugggu

SEQ ID NO: 1102186 - RNA, 19 nt, Human
gcuggcagaauuuugaacc

SEQ ID NO: 1102187 - RNA, 21 nt, Human
acauacauaccuuaccaccuu

SEQ ID NO: 1102188 - RNA, 22 nt, Human
ccagcccuugcugaaggguggc

SEQ ID NO: 1102189 - RNA, 22 nt, Human
uggcagggugccaguugcgagu

SEQ ID NO: 1102190 - RNA, 22 nt, Human
uccuggcauccgugggucugug

SEQ ID NO: 1102191 - RNA, 22 nt, Human
auggccugcagugcugccacag

SEQ ID NO: 1102192 - RNA, 22 nt, Human
cacugucccuguuuccuggaaa

SEQ ID NO: 1102193 - RNA, 22 nt, Human
cacccacauuccaucacucugc

SEQ ID NO: 1102194 - RNA, 22 nt, Human
ucuggcaggaccaugaagcgua

SEQ ID NO: 1102195 - RNA, 22 nt, Human
ucuggcagugagcaacuugaca

SEQ ID NO: 1102196 - RNA, 22 nt, Human
gguggcauaagaacacuaaaga

SEQ ID NO: 1102197 - RNA, 22 nt, Human
uggcaguggauaggggagcggu

SEQ ID NO: 1102198 - RNA, 22 nt, Human
ggcacagggggcugaggacuag

SEQ ID NO: 1102199 - RNA, 22 nt, Human
acuccugggugcugaccagcgu

SEQ ID NO: 1102200 - RNA, 22 nt, Human
cccacccugggaagcuaggcag

SEQ ID NO: 1102201 - RNA, 22 nt, Human
uccaggcuccccugcgugcucc

SEQ ID NO: 1102202 - RNA, 22 nt, Human
cucaucaccacauauaacaaag

SEQ ID NO: 1102203 - RNA, 22 nt, Human
acacagaguuugacacauggga

SEQ ID NO: 1102204 - RNA, 22 nt, Human
cacauacauacguauguauaca

SEQ ID NO: 1102205 - RNA, 22 nt, Human
ucuuuuucugcacacguguccc

SEQ ID NO: 1102206 - RNA, 22 nt, Human
uggcgucucucauaaguaugug

SEQ ID NO: 1102207 - RNA, 22 nt, Human
ugguaagaacccaucagagaag

SEQ ID NO: 1102208 - RNA, 22 nt, Human
gcuggcaggauaacuucuaagc

SEQ ID NO: 1102209 - RNA, 22 nt, Human
uguggggaagaguaugacuugg

SEQ ID NO: 1102210 - RNA, 22 nt, Human
ggagccugaaaagucugcauuu

SEQ ID NO: 1102211 - RNA, 22 nt, Human
auaauggccgggggcugaaugc

SEQ ID NO: 1102212 - RNA, 22 nt, Human
cccagcaugcacgcugacacuc

SEQ ID NO: 1102213 - RNA, 23 nt, Human
uccuuccuuugagaggcuccauc

SEQ ID NO: 1102214 - RNA, 22 nt, Human
aggcaguguguagcuggaagag

SEQ ID NO: 1102215 - RNA, 23 nt, Human
uaaauuaccuuuccagugcaggg

SEQ ID NO: 1102216 - RNA, 22 nt, Human
uccugagcacagagacaaggaa

SEQ ID NO: 1102217 - RNA, 22 nt, Human
cuuggcaggguggaggaugcag

SEQ ID NO: 1102218 - RNA, 23 nt, Human
uguaaacaucacccccuggaguu

SEQ ID NO: 1102219 - RNA, 22 nt, Human
gcuggcagagcucugggcuggg

SEQ ID NO: 1102220 - RNA, 20 nt, Human
gauacacagcacagagggcc

SEQ ID NO: 1102221 - RNA, 22 nt, Human
ucuggcagcaagauaacaaugg

SEQ ID NO: 1102222 - RNA, 22 nt, Human
ggagagaauuccauggacaugu

SEQ ID NO: 1102223 - RNA, 22 nt, Human
acccacccuacuagcagugucc

SEQ ID NO: 1102224 - RNA, 22 nt, Human
guccucuguuagaaaugugcuu

SEQ ID NO: 1102225 - RNA, 22 nt, Human
cugcaggacgaccgccucaucu

SEQ ID NO: 1102226 - RNA, 22 nt, Human
gccuggcauauaguaguugugc

SEQ ID NO: 1102227 - RNA, 22 nt, Human
ccccacccucgcuccauuucgg

SEQ ID NO: 1102228 - RNA, 22 nt, Human
gacaaaaguguuuugaacaagg

SEQ ID NO: 1102229 - RNA, 19 nt, Human
uccuggcauuuguaggaaa

SEQ ID NO: 1102230 - RNA, 22 nt, Human
cccacacaaaucauggggagaa

SEQ ID NO: 1102231 - RNA, 22 nt, Human
cccuuccucccaggcuucugug

SEQ ID NO: 1102232 - RNA, 22 nt, Human
cuccucuggguccugguggcca

SEQ ID NO: 1102233 - RNA, 22 nt, Human
cuggccucagagggucauggug

SEQ ID NO: 1102234 - RNA, 22 nt, Human
aauggcagaggcaaagauggua

SEQ ID NO: 1102235 - RNA, 22 nt, Human
ggccucucagggcagagacccu

SEQ ID NO: 1102236 - RNA, 22 nt, Human
uccccaccccagaacuacuagg

SEQ ID NO: 1102237 - RNA, 22 nt, Human
uuggaacaugccgggguccagg

SEQ ID NO: 1102238 - RNA, 22 nt, Human
aacacauauuuauauaugcaca

SEQ ID NO: 1102239 - RNA, 22 nt, Human
cugcaggagcaaagccucugcu

SEQ ID NO: 1102240 - RNA, 22 nt, Human
auguuggagucguaaggcaugg

SEQ ID NO: 1102241 - RNA, 18 nt, Human
uguagagccagguuugcc

SEQ ID NO: 1102242 - RNA, 22 nt, Human
cuccugaggaaaagcuugguca

SEQ ID NO: 1102243 - RNA, 22 nt, Human
cuccuggcacugucuugaccca

SEQ ID NO: 1102244 - RNA, 22 nt, Human
acagguccucaagucagcuggg

SEQ ID NO: 1102245 - RNA, 22 nt, Human
ucccacccccuccaaggaggaa

SEQ ID NO: 1102246 - RNA, 22 nt, Human
gacccauauaggacccuccaaa

SEQ ID NO: 1102247 - RNA, 22 nt, Human
guuaggaacacuggagccuaaa

SEQ ID NO: 1102248 - RNA, 22 nt, Human
gccuggcaggccuguuggggcu

SEQ ID NO: 1102249 - RNA, 22 nt, Human
agggagacacaugaggaaguca

SEQ ID NO: 1102250 - RNA, 22 nt, Human
gacacagagggcaccagauaug

SEQ ID NO: 1102251 - RNA, 22 nt, Human
ucuggcagguucccauguuaug

SEQ ID NO: 1102252 - RNA, 22 nt, Human
ccuccccaugacccggugcugg

SEQ ID NO: 1102253 - RNA, 18 nt, Human
gccugcucugcucucccc

SEQ ID NO: 1102254 - RNA, 22 nt, Human
cacacugucagguaaauaacac

SEQ ID NO: 1102255 - RNA, 22 nt, Human
ccagcccugucaccaacuggag

SEQ ID NO: 1102256 - RNA, 22 nt, Human
acacacacaagcagguugugga

SEQ ID NO: 1102257 - RNA, 22 nt, Human
ccuggcagcgugccgagcugcg

SEQ ID NO: 1102258 - RNA, 22 nt, Human
aaagaucacgucccaggacucg

SEQ ID NO: 1102259 - RNA, 22 nt, Human
gcugcuaagcguuucuguucca

SEQ ID NO: 1102260 - RNA, 22 nt, Human
cggcuggugucgggcacagcaa

SEQ ID NO: 1102261 - RNA, 22 nt, Human
uagacacaucuucauccacaau

SEQ ID NO: 1102262 - RNA, 22 nt, Human
gaggcugcggggaggagccugc

SEQ ID NO: 1102263 - RNA, 22 nt, Human
uggcaguagauccagucucucu

SEQ ID NO: 1102264 - RNA, 22 nt, Human
cuugccucccucagcucacagc

SEQ ID NO: 1102265 - RNA, 22 nt, Human
caucacagaaauaaacauaccu

SEQ ID NO: 1102266 - RNA, 22 nt, Human
auccaggcgaaugcagaaggcc

SEQ ID NO: 1102267 - RNA, 22 nt, Human
ccagugcccagcugcccaggca

SEQ ID NO: 1102268 - RNA, 22 nt, Human
cccacacacauuuaugauagga

SEQ ID NO: 1102269 - RNA, 20 nt, Human
agaggcuuccuugggaggag

SEQ ID NO: 1102270 - RNA, 22 nt, Human
caaauacuacgauucuugcagu

SEQ ID NO: 1102271 - RNA, 22 nt, Human
cacacagaaccgcucgccacuu

SEQ ID NO: 1102272 - RNA, 22 nt, Human
caggaguggugugagggacucc

SEQ ID NO: 1102273 - RNA, 22 nt, Human
cucucuccuuagcugcagacca

SEQ ID NO: 1102274 - RNA, 22 nt, Human
gcuggcagccaagugaagaggg

SEQ ID NO: 1102275 - RNA, 22 nt, Human
ccaggcugggcggggaaccugg

SEQ ID NO: 1102276 - RNA, 22 nt, Human
cuccucuguauugauugggacu

SEQ ID NO: 1102277 - RNA, 22 nt, Human
gcuggcaggagccuuucccuuu

SEQ ID NO: 1102278 - RNA, 22 nt, Human
ugcucuguauucuauggcaguu

SEQ ID NO: 1102279 - RNA, 22 nt, Human
gcuggcagugugaaugacaagc

SEQ ID NO: 1102280 - RNA, 21 nt, Human
ucuggcaguggucuuucaaau

SEQ ID NO: 1102281 - RNA, 22 nt, Human
ucacacaugcuaagccagagau

SEQ ID NO: 1102282 - RNA, 22 nt, Human
ucuccugggaggacaaggaagg

SEQ ID NO: 1102283 - RNA, 22 nt, Human
acacacaugccuuuccuaagua

SEQ ID NO: 1102284 - RNA, 22 nt, Human
uugggaagaauggaggugguua

SEQ ID NO: 1102285 - RNA, 22 nt, Human
ugaguagagaauucagcuaagg

SEQ ID NO: 1102286 - RNA, 22 nt, Human
aaaagagucuuaggcagucaua

SEQ ID NO: 1102287 - RNA, 22 nt, Human
gccuggcaggggccugggagug

SEQ ID NO: 1102288 - RNA, 22 nt, Human
gcugcgccggaucccacguucc

SEQ ID NO: 1102289 - RNA, 22 nt, Human
augacugcucugggcucccaug

SEQ ID NO: 1102290 - RNA, 22 nt, Human
ugccugccucuggcagcccugc

SEQ ID NO: 1102291 - RNA, 22 nt, Human
uccugagcccuguaggacccug

SEQ ID NO: 1102292 - RNA, 22 nt, Human
uuccuggcauagagagggcaca

SEQ ID NO: 1102293 - RNA, 22 nt, Human
guccucuggagguuuuuaggug

SEQ ID NO: 1102294 - RNA, 15 nt, Human
cacacagacagcuug

SEQ ID NO: 1102295 - RNA, 22 nt, Human
acaucccacagaaacauacaua

SEQ ID NO: 1102296 - RNA, 22 nt, Human
acacacuuuaaauuaaaccucu

SEQ ID NO: 1102297 - RNA, 22 nt, Human
cacaacuuuaggaaccacauuc

SEQ ID NO: 1102298 - RNA, 22 nt, Human
ucuggcagcucuccucggcgga

SEQ ID NO: 1102299 - RNA, 22 nt, Human
aucacaauguacguuaaaaugu

SEQ ID NO: 1102300 - RNA, 16 nt, Human
ucacauacuuccuugc

SEQ ID NO: 1102301 - RNA, 19 nt, Human
ccacacagugugcaauuua

SEQ ID NO: 1102302 - RNA, 22 nt, Human
acaggugguaaaauggacuguc

SEQ ID NO: 1102303 - RNA, 22 nt, Human
gaggacucugggcguguauggg

SEQ ID NO: 1102304 - RNA, 22 nt, Human
cccagccuuccacccuggacua

SEQ ID NO: 1102305 - RNA, 22 nt, Human
ugcacaggaggcuguggagaag

SEQ ID NO: 1102306 - RNA, 22 nt, Human
uugggaaguuuaaugacagacu

SEQ ID NO: 1102307 - RNA, 22 nt, Human
ucccagccuuccagucugguuu

SEQ ID NO: 1102308 - RNA, 22 nt, Human
ggccucucugagagcagacguu

SEQ ID NO: 1102309 - RNA, 23 nt, Human
guccucuggagagaaaggcagua

SEQ ID NO: 1102310 - RNA, 22 nt, Human
cacauacuuguguguacauaug

SEQ ID NO: 1102311 - RNA, 22 nt, Human
gccuccuguuaugccaugugcc

SEQ ID NO: 1102312 - RNA, 22 nt, Human
acagguggggcacuuggagccu

SEQ ID NO: 1102313 - RNA, 22 nt, Human
gcuggcagacugggggcagaac

SEQ ID NO: 1102314 - RNA, 22 nt, Human
guccucugggagccuugagccu

SEQ ID NO: 1102315 - RNA, 22 nt, Human
cacaaaaguaggaggcaggcgg

SEQ ID NO: 1102316 - RNA, 22 nt, Human
auggccuggggauuccugagca

SEQ ID NO: 1102317 - RNA, 22 nt, Human
cccagccuacucugccauagca

SEQ ID NO: 1102318 - RNA, 22 nt, Human
gauggccuuguuuucucccuuc

SEQ ID NO: 1102319 - RNA, 22 nt, Human
gaggagcugggacccugucauc

SEQ ID NO: 1102320 - RNA, 22 nt, Human
ucuggcagagugauaggauaag

SEQ ID NO: 1102321 - RNA, 22 nt, Human
cccuuccuugauuuuaacugga

SEQ ID NO: 1102322 - RNA, 22 nt, Human
uuccagcccgcgacuuguucag

SEQ ID NO: 1102323 - RNA, 22 nt, Human
guacacacuauguauuguacac

SEQ ID NO: 1102324 - RNA, 22 nt, Human
cacuguccaugcuugcuaaccc

SEQ ID NO: 1102325 - RNA, 22 nt, Human
gcuggcagguccaagauagagc

SEQ ID NO: 1102326 - RNA, 23 nt, Human
ugagggacaugguggcuucugag

SEQ ID NO: 1102327 - RNA, 22 nt, Human
acagguggccccgagggagugg

SEQ ID NO: 1102328 - RNA, 22 nt, Human
gcacacacaugugaguacaugc

SEQ ID NO: 1102329 - RNA, 22 nt, Human
ggcacagagcuuugucccaguu

SEQ ID NO: 1102330 - RNA, 22 nt, Human
ccuggcaggcuggggacagugc

SEQ ID NO: 1102331 - RNA, 22 nt, Human
ggagcugaaggggugggcucag

SEQ ID NO: 1102332 - RNA, 22 nt, Human
ucuggcaggacaugcugaccau

SEQ ID NO: 1102333 - RNA, 22 nt, Human
ucuggcagagauauccauccca

SEQ ID NO: 1102334 - RNA, 19 nt, Human
gcuggcagauguggccgug

SEQ ID NO: 1102335 - RNA, 22 nt, Human
ucacauacugaaaguccaguga

SEQ ID NO: 1102336 - RNA, 22 nt, Human
uccccacacuuucacuccuggc

SEQ ID NO: 1102337 - RNA, 22 nt, Human
uucccacaguguugaauccucu

SEQ ID NO: 1102338 - RNA, 22 nt, Human
accugccucagugcagcuggau

SEQ ID NO: 1102339 - RNA, 22 nt, Human
ucaggcccuuugcugcugcccc

SEQ ID NO: 1102340 - RNA, 22 nt, Human
aucucccagccacagcauucuu

SEQ ID NO: 1102341 - RNA, 22 nt, Human
ccacauacaaauggggugcugu

SEQ ID NO: 1102342 - RNA, 22 nt, Human
guccucugucccuggggcacgg

SEQ ID NO: 1102343 - RNA, 22 nt, Human
guccuggcugguucuguggggc

SEQ ID NO: 1102344 - RNA, 22 nt, Human
cagugggggggccaugcugcag

SEQ ID NO: 1102345 - RNA, 22 nt, Human
cccgagugucuacucacuccca

SEQ ID NO: 1102346 - RNA, 22 nt, Human
uacacaucccagacucccagga

SEQ ID NO: 1102347 - RNA, 22 nt, Human
cccccaaaguuugcacggauaa

SEQ ID NO: 1102348 - RNA, 22 nt, Human
cuuacacagucuggcacuucuu

SEQ ID NO: 1102349 - RNA, 22 nt, Human
ccugccuucagcccugaagucu

SEQ ID NO: 1102350 - RNA, 22 nt, Human
ucacacacauuugcugucugau

SEQ ID NO: 1102351 - RNA, 22 nt, Human
cccagccugugacagccguccu

SEQ ID NO: 1102352 - RNA, 22 nt, Human
ccuggcagcuaagugcuuugag

SEQ ID NO: 1102353 - RNA, 22 nt, Human
caggacaaagcccuuugagaaa

SEQ ID NO: 1102354 - RNA, 22 nt, Human
gacacagacaguuagagguaau

SEQ ID NO: 1102355 - RNA, 22 nt, Human
ccacagaccuuggcuuccaccu

SEQ ID NO: 1102356 - RNA, 22 nt, Human
uacacagacucuucaauucaga

SEQ ID NO: 1102357 - RNA, 22 nt, Human
ucacacauuucucaaguguagg

SEQ ID NO: 1102358 - RNA, 22 nt, Human
uggcaucuccgacagucuugau

SEQ ID NO: 1102359 - RNA, 22 nt, Human
ccagcccuuagauaaaccuggc

SEQ ID NO: 1102360 - RNA, 22 nt, Human
acuggcaggcugcuggccggcg

SEQ ID NO: 1102361 - RNA, 22 nt, Human
agaggccuccgaaaggugggcu

SEQ ID NO: 1102362 - RNA, 22 nt, Human
acauaaugagcucuuuauaaau

SEQ ID NO: 1102363 - RNA, 22 nt, Human
guccucugaaagaugaaccaug

SEQ ID NO: 1102364 - RNA, 22 nt, Human
ucuggcagaagugcugucagua

SEQ ID NO: 1102365 - RNA, 22 nt, Human
ggcccagccucagacaugcccu

SEQ ID NO: 1102366 - RNA, 22 nt, Human
uacacacagaggccaugggauu

SEQ ID NO: 1102367 - RNA, 22 nt, Human
ugcagagaaaacuccuggguac

SEQ ID NO: 1102368 - RNA, 22 nt, Human
gugugggaaggcuaggaugcug

SEQ ID NO: 1102369 - RNA, 22 nt, Human
gccucaggccgcccugcugcuc

SEQ ID NO: 1102370 - RNA, 22 nt, Human
aagugccaucauagcauggcug

SEQ ID NO: 1102371 - RNA, 22 nt, Human
cugccugcaggacaccucgcua

SEQ ID NO: 1102372 - RNA, 23 nt, Human
ccuggcagcaaacgaggagguua

SEQ ID NO: 1102373 - RNA, 22 nt, Human
ccaccccaaaugaagaccucuc

SEQ ID NO: 1102374 - RNA, 20 nt, Human
ccuggcaggcggguuacuua

SEQ ID NO: 1102375 - RNA, 17 nt, Human
cccaggccgccgggagc

SEQ ID NO: 1102376 - RNA, 22 nt, Human
gcuggcaguguauuguuagcug

SEQ ID NO: 1102377 - RNA, 22 nt, Human
acagaguccuagcugcaaagaa

SEQ ID NO: 1102378 - RNA, 22 nt, Human
ggagcugaggcugaggccucac

SEQ ID NO: 1102379 - RNA, 20 nt, Human
cacaacuguccacaugcucc

SEQ ID NO: 1102380 - RNA, 22 nt, Human
aggcugcuucagcugcagggag

SEQ ID NO: 1102381 - RNA, 22 nt, Human
agaggcuuggaggugcaagguu

SEQ ID NO: 1102382 - RNA, 22 nt, Human
ucccacaccugucuauuccuag

SEQ ID NO: 1102383 - RNA, 21 nt, Human
uucucuccauaugcccagccc

SEQ ID NO: 1102384 - RNA, 22 nt, Human
cugccugcucaccagggcucug

SEQ ID NO: 1102385 - RNA, 22 nt, Human
uacaaaaguaauuacgguuuuu

SEQ ID NO: 1102386 - RNA, 22 nt, Human
cucuccagccuuuagcccacgc

SEQ ID NO: 1102387 - RNA, 22 nt, Human
uggcaguggcucagagugcaga

SEQ ID NO: 1102388 - RNA, 22 nt, Human
gaaaagaguccugugugaggag

SEQ ID NO: 1102389 - RNA, 23 nt, Human
acuccccagucucuucuugccaa

SEQ ID NO: 1102390 - RNA, 20 nt, Human
gagucacagaagaagcugaa

SEQ ID NO: 1102391 - RNA, 22 nt, Human
gccacauagaggaggauauuaa

SEQ ID NO: 1102392 - RNA, 22 nt, Human
aucccacaccccuacaacauau

SEQ ID NO: 1102393 - RNA, 22 nt, Human
acaauucugaugguuucccagu

SEQ ID NO: 1102394 - RNA, 18 nt, Human
acucugcggaggccccag

SEQ ID NO: 1102395 - RNA, 23 nt, Human
uccaggagcaugcuggcuggcga

SEQ ID NO: 1102396 - RNA, 22 nt, Human
aggaggcuguggagcacuccau

SEQ ID NO: 1102397 - RNA, 22 nt, Human
cuggcagucugguggaaggccu

SEQ ID NO: 1102398 - RNA, 22 nt, Human
aaauuacagaucaccaaugcau

SEQ ID NO: 1102399 - RNA, 22 nt, Human
guccucuguagggcugggccac

SEQ ID NO: 1102400 - RNA, 20 nt, Human
cccagccccuaccuguugcc

SEQ ID NO: 1102401 - RNA, 22 nt, Human
uggcagagagacucuccuugau

SEQ ID NO: 1102402 - RNA, 22 nt, Human
gacugccucaguuucccugcag

SEQ ID NO: 1102403 - RNA, 22 nt, Human
ucuggcaggccuugucaaucug

SEQ ID NO: 1102404 - RNA, 22 nt, Human
cucaccccacuaccccuuggug

SEQ ID NO: 1102405 - RNA, 22 nt, Human
auccuggcccagguguggaggg

SEQ ID NO: 1102406 - RNA, 22 nt, Human
ugaccaggauacugcagggaug

SEQ ID NO: 1102407 - RNA, 22 nt, Human
agugccccaugggugccugggg

SEQ ID NO: 1102408 - RNA, 22 nt, Human
ccccacacucuuuacauucaua

SEQ ID NO: 1102409 - RNA, 22 nt, Human
aggccccaaagcagugcaagua

SEQ ID NO: 1102410 - RNA, 22 nt, Human
ccuggcagacugugagggcagg

SEQ ID NO: 1102411 - RNA, 22 nt, Human
acuggcaguagagggagcgcau

SEQ ID NO: 1102412 - RNA, 22 nt, Human
ccuucuucuguguggcccaaga

SEQ ID NO: 1102413 - RNA, 22 nt, Human
uacaaaaggaagagggaucuua

SEQ ID NO: 1102414 - RNA, 22 nt, Human
agccagggucucucgcucuguu

SEQ ID NO: 1102415 - RNA, 22 nt, Human
ucccacacuugaaacaaggcug

SEQ ID NO: 1102416 - RNA, 22 nt, Human
agagucccagggacacuccaga

SEQ ID NO: 1102417 - RNA, 22 nt, Human
cacaauguauauguauaucaaa

SEQ ID NO: 1102418 - RNA, 22 nt, Human
aggcacaggaggugguaagaag

SEQ ID NO: 1102419 - RNA, 22 nt, Human
cacacacuggagcaaggagaug

SEQ ID NO: 1102420 - RNA, 23 nt, Human
acacugucucauggauagacugc

SEQ ID NO: 1102421 - RNA, 22 nt, Human
uugggaagaaacauguccauca

SEQ ID NO: 1102422 - RNA, 22 nt, Human
gcuccaggagagggaagcagau

SEQ ID NO: 1102423 - RNA, 22 nt, Human
guacacacuauuuaaaguguuu

SEQ ID NO: 1102424 - RNA, 22 nt, Human
agacaagaaacugggagucucu

SEQ ID NO: 1102425 - RNA, 18 nt, Human
gacacauccccaggccuc

SEQ ID NO: 1102426 - RNA, 22 nt, Human
uuccaggcuucucuggggcguc

SEQ ID NO: 1102427 - RNA, 22 nt, Human
aggguagggcccggagacagac

SEQ ID NO: 1102428 - RNA, 22 nt, Human
ccuggcagcaggugggcccgug

SEQ ID NO: 1102429 - RNA, 22 nt, Human
acuggcaguuugagaaugcauu

SEQ ID NO: 1102430 - RNA, 22 nt, Human
ucuggcagagucagugcacaca

SEQ ID NO: 1102431 - RNA, 22 nt, Human
gacacauaugcguauaguuuag

SEQ ID NO: 1102432 - RNA, 22 nt, Human
agucuagggugggguccacagg

SEQ ID NO: 1102433 - RNA, 22 nt, Human
agaggccugugugcuccagugg

SEQ ID NO: 1102434 - RNA, 22 nt, Human
aggccacaguacuuugcagacc

SEQ ID NO: 1102435 - RNA, 22 nt, Human
cuguccuccagacgacaguccc

SEQ ID NO: 1102436 - RNA, 21 nt, Human
uccacccucucugcucccagu

SEQ ID NO: 1102437 - RNA, 20 nt, Human
uuccacaucuuugcacaugc

SEQ ID NO: 1102438 - RNA, 22 nt, Human
ccacccuaacaauccuuacugu

SEQ ID NO: 1102439 - RNA, 22 nt, Human
aaagagucaaaggcaugucucu

SEQ ID NO: 1102440 - RNA, 22 nt, Human
auggccugaugcaccuguccca

SEQ ID NO: 1102441 - RNA, 22 nt, Human
gcuggcagggacagcugcgugu

SEQ ID NO: 1102442 - RNA, 22 nt, Human
ugcagagaagaggacaguucua

SEQ ID NO: 1102443 - RNA, 23 nt, Human
aguguugguugggaagccaagca

SEQ ID NO: 1102444 - RNA, 22 nt, Human
uccccaccuaagauacccaucu

SEQ ID NO: 1102445 - RNA, 22 nt, Human
ucccuccccacuucugagcuuu

SEQ ID NO: 1102446 - RNA, 22 nt, Human
uggcaggaaaguaacagagcac

SEQ ID NO: 1102447 - RNA, 22 nt, Human
gguggcagaggugcaucagccc

SEQ ID NO: 1102448 - RNA, 22 nt, Human
uuccuggccccaccccuggaga

SEQ ID NO: 1102449 - RNA, 22 nt, Human
gcuggcagcauuagacccuggg

SEQ ID NO: 1102450 - RNA, 22 nt, Human
ucuggcagcgaagcguguacuu

SEQ ID NO: 1102451 - RNA, 22 nt, Human
ccuggcagacagcacugaagcu

SEQ ID NO: 1102452 - RNA, 22 nt, Human
acacacuguaaggacuaucacu

SEQ ID NO: 1102453 - RNA, 22 nt, Human
gcacacacuguuuuccucacau

SEQ ID NO: 1102454 - RNA, 22 nt, Human
ucccacaugugaauccucaggu

SEQ ID NO: 1102455 - RNA, 22 nt, Human
acuggcagguccaucgcccuuu

SEQ ID NO: 1102456 - RNA, 22 nt, Human
ccacaaaacugugugucaaaga

SEQ ID NO: 1102457 - RNA, 22 nt, Human
ggugccaggcuguagucagggu

SEQ ID NO: 1102458 - RNA, 22 nt, Human
agggcugacaaauggcagugac

SEQ ID NO: 1102459 - RNA, 22 nt, Human
ugagagucuguuccucuugcag

SEQ ID NO: 1102460 - RNA, 22 nt, Human
uguaaacauaccagagccaagu

SEQ ID NO: 1102461 - RNA, 22 nt, Human
acaagagcauugcagguguguu

SEQ ID NO: 1102462 - RNA, 18 nt, Human
acacacacaccuguguau

SEQ ID NO: 1102463 - RNA, 22 nt, Human
ggggcugagucagugggaagag

SEQ ID NO: 1102464 - RNA, 22 nt, Human
cagucccaugagcccagaacau

SEQ ID NO: 1102465 - RNA, 19 nt, Human
gugggacagacauuacaua

SEQ ID NO: 1102466 - RNA, 22 nt, Human
gaggcacauauauacagagccc

SEQ ID NO: 1102467 - RNA, 22 nt, Human
gauggcagguaguggucucauc

SEQ ID NO: 1102468 - RNA, 22 nt, Human
auacaugacucacacauucugc

SEQ ID NO: 1102469 - RNA, 18 nt, Human
aggaaagaaaggcaggug

SEQ ID NO: 1102470 - RNA, 22 nt, Human
cacacaguaggcacucauuaau

SEQ ID NO: 1102471 - RNA, 22 nt, Human
acacacaugguauuguucagaa

SEQ ID NO: 1102472 - RNA, 18 nt, Human
ggccucuggacuggcagc

SEQ ID NO: 1102473 - RNA, 22 nt, Human
uggcagagaacacacaugauuc

SEQ ID NO: 1102474 - RNA, 22 nt, Human
ucccugcccucagugcacccgg

SEQ ID NO: 1102475 - RNA, 22 nt, Human
ccugaccuauuuuucucagcug

SEQ ID NO: 1102476 - RNA, 22 nt, Human
gaugccuggcacccagcaagga

SEQ ID NO: 1102477 - RNA, 22 nt, Human
uccuggcagugcuuguuuugga

SEQ ID NO: 1102478 - RNA, 22 nt, Human
agcagguugugauacacucaga

SEQ ID NO: 1102479 - RNA, 22 nt, Human
cuuggcagagggcugggcucag

SEQ ID NO: 1102480 - RNA, 22 nt, Human
cccagcccccgagugucuggaa

SEQ ID NO: 1102481 - RNA, 22 nt, Human
ggagacucggguucuagccuug

SEQ ID NO: 1102482 - RNA, 22 nt, Human
agacacagucugucuggaggag

SEQ ID NO: 1102483 - RNA, 22 nt, Human
cugagagaucaagccacaggau

SEQ ID NO: 1102484 - RNA, 22 nt, Human
aggacacacagaauacaaaucc

SEQ ID NO: 1102485 - RNA, 20 nt, Human
accccacagaguccauugca

SEQ ID NO: 1102486 - RNA, 22 nt, Human
ccucuccuugcacccgucccgc

SEQ ID NO: 1102487 - RNA, 22 nt, Human
ccuggcagguagcauugaggag

SEQ ID NO: 1102488 - RNA, 22 nt, Human
cccaggccagaacuugguugcu

SEQ ID NO: 1102489 - RNA, 22 nt, Human
agggccccauagucacugcccg

SEQ ID NO: 1102490 - RNA, 22 nt, Human
uauuacagaaucaggcauaacu

SEQ ID NO: 1102491 - RNA, 22 nt, Human
uucuuucaauagcuggcauaug

SEQ ID NO: 1102492 - RNA, 22 nt, Human
ccuggcagguggagguugcagu

SEQ ID NO: 1102493 - RNA, 22 nt, Human
uccugccuguuuaccuguacuu

SEQ ID NO: 1102494 - RNA, 22 nt, Human
gcuccaggcagcauaguggaug

SEQ ID NO: 1102495 - RNA, 22 nt, Human
gcacacaguauaugcucauuaa

SEQ ID NO: 1102496 - RNA, 22 nt, Human
uggcagugggaauggacaaaca

SEQ ID NO: 1102497 - RNA, 22 nt, Human
agagggugcuggagagacauug

SEQ ID NO: 1102498 - RNA, 22 nt, Human
ugccagccagggaagcucaccc

SEQ ID NO: 1102499 - RNA, 22 nt, Human
gaggcacagucccgaggcaagg

SEQ ID NO: 1102500 - RNA, 22 nt, Human
cacacacugacaccuuaucuug

SEQ ID NO: 1102501 - RNA, 22 nt, Human
caggagggcccgagacucuucc

SEQ ID NO: 1102502 - RNA, 22 nt, Human
cugccugccuuggccuccagga

SEQ ID NO: 1102503 - RNA, 22 nt, Human
ucaucacauguguagucauccc

SEQ ID NO: 1102504 - RNA, 22 nt, Human
gccuccuggaagucacauguuu

SEQ ID NO: 1102505 - RNA, 22 nt, Human
gaggcuguuaggagggacucug

SEQ ID NO: 1102506 - RNA, 22 nt, Human
cauucccacguguucuuugcuu

SEQ ID NO: 1102507 - RNA, 22 nt, Human
uccuggcaaagauguugguguu

SEQ ID NO: 1102508 - RNA, 22 nt, Human
cuggcaguuggcauuggcaucu

SEQ ID NO: 1102509 - RNA, 21 nt, Human
ugacugaggcuucuucacaca

SEQ ID NO: 1102510 - RNA, 22 nt, Human
ccaggcuguaagagugauguug

SEQ ID NO: 1102511 - RNA, 22 nt, Human
gcagccucaaacuccccagcuc

SEQ ID NO: 1102512 - RNA, 22 nt, Human
ggccucagagaaggcugugcgg

SEQ ID NO: 1102513 - RNA, 22 nt, Human
gagaaagacguaggcugggagg

SEQ ID NO: 1102514 - RNA, 22 nt, Human
ccucucccgggugccgcugggc

SEQ ID NO: 1102515 - RNA, 22 nt, Human
ucccacacuacacgguuguugg

SEQ ID NO: 1102516 - RNA, 22 nt, Human
uguaaagaaagacgcagaguua

SEQ ID NO: 1102517 - RNA, 22 nt, Human
ucuggcagugauuucugugauc

SEQ ID NO: 1102518 - RNA, 22 nt, Human
aggaagaaccuaagaaagucuc

SEQ ID NO: 1102519 - RNA, 22 nt, Human
auggcagaccuccuggccacaa

SEQ ID NO: 1102520 - RNA, 22 nt, Human
guccacagagggcugggcaggc

SEQ ID NO: 1102521 - RNA, 22 nt, Human
gccuggcacaguagggacccaa

SEQ ID NO: 1102522 - RNA, 22 nt, Human
gcuggcaguuuccucaccgagg

SEQ ID NO: 1102523 - RNA, 22 nt, Human
ccucucagcgauuccucuugga

SEQ ID NO: 1102524 - RNA, 22 nt, Human
cuucccacuaguaucacagagc

SEQ ID NO: 1102525 - RNA, 22 nt, Human
gccuccggagucacagugucuu

SEQ ID NO: 1102526 - RNA, 22 nt, Human
ccuggcagucaggggaguccuu

SEQ ID NO: 1102527 - RNA, 22 nt, Human
ccuugcucaagcuagugacggg

SEQ ID NO: 1102528 - RNA, 22 nt, Human
cagguugguauucaucuccaca

SEQ ID NO: 1102529 - RNA, 22 nt, Human
caugagauaauuuuucuccagu

SEQ ID NO: 1102530 - RNA, 22 nt, Human
auccccacgauauagccaaagc

SEQ ID NO: 1102531 - RNA, 21 nt, Human
aaagagcccgcugagagguuc

SEQ ID NO: 1102532 - RNA, 22 nt, Human
aggcuggauuuauggggacuuc

SEQ ID NO: 1102533 - RNA, 22 nt, Human
cuggccucauagccaagcugug

SEQ ID NO: 1102534 - RNA, 22 nt, Human
ucccaccccggucaagggcuga

SEQ ID NO: 1102535 - RNA, 22 nt, Human
ucaggcccagagucacggaucc

SEQ ID NO: 1102536 - RNA, 22 nt, Human
gcccucucuucugcagccucca

SEQ ID NO: 1102537 - RNA, 22 nt, Human
ugggagaaacugucucucccac

SEQ ID NO: 1102538 - RNA, 22 nt, Human
aagagagagugcgcucacagaa

SEQ ID NO: 1102539 - RNA, 22 nt, Human
cuggcacgcccacguaggcacu

SEQ ID NO: 1102540 - RNA, 22 nt, Human
cccagcccacgguccugggugg

SEQ ID NO: 1102541 - RNA, 22 nt, Human
ucccugccuccuggcagugcca

SEQ ID NO: 1102542 - RNA, 17 nt, Human
agccugccccaugcugc

SEQ ID NO: 1102543 - RNA, 22 nt, Human
cugccugcuuaccaugcaucag

SEQ ID NO: 1102544 - RNA, 22 nt, Human
guccucugcuucaugcccugau

SEQ ID NO: 1102545 - RNA, 22 nt, Human
gcuggcagucccaucagcuggg

SEQ ID NO: 1102546 - RNA, 22 nt, Human
gcuggcagagagcuggugagga

SEQ ID NO: 1102547 - RNA, 22 nt, Human
guccucugggcagcugccccac

SEQ ID NO: 1102548 - RNA, 22 nt, Human
uccccacacagauacagaguag

SEQ ID NO: 1102549 - RNA, 22 nt, Human
cacacacaguuuuguauucugu

SEQ ID NO: 1102550 - RNA, 22 nt, Human
caggauggucucgaucuccuga

SEQ ID NO: 1102551 - RNA, 22 nt, Human
uccaggccauugacugcauccu

SEQ ID NO: 1102552 - RNA, 22 nt, Human
uuccaggccgggcaggaaacac

SEQ ID NO: 1102553 - RNA, 22 nt, Human
gagaaagauuguccuucagggg

SEQ ID NO: 1102554 - RNA, 21 nt, Human
ccuggcagaagccugauaugc

SEQ ID NO: 1102555 - RNA, 22 nt, Human
uggaaagaggaagugcccagca

SEQ ID NO: 1102556 - RNA, 22 nt, Human
uccaggaggaggaaggcugcca

SEQ ID NO: 1102557 - RNA, 22 nt, Human
ggagcugaguucuucagccggg

SEQ ID NO: 1102558 - RNA, 22 nt, Human
uccccacagcagaagaucugag

SEQ ID NO: 1102559 - RNA, 22 nt, Human
agagcacagaagaauaggugcu

SEQ ID NO: 1102560 - RNA, 22 nt, Human
gcuccaggugucccagguaaaa

SEQ ID NO: 1102561 - RNA, 22 nt, Human
guccuggcaccucacuggcuac

SEQ ID NO: 1102562 - RNA, 22 nt, Human
guugggaagcagauggaugagc

SEQ ID NO: 1102563 - RNA, 16 nt, Human
gcacacacaucaauga

SEQ ID NO: 1102564 - RNA, 20 nt, Human
auacacaugcagacagaugc

SEQ ID NO: 1102565 - RNA, 22 nt, Human
acacauuugcauaauaccucau

SEQ ID NO: 1102566 - RNA, 22 nt, Human
aguugggaguuauagacucuau

SEQ ID NO: 1102567 - RNA, 22 nt, Human
uccugagccugacaaucaccau

SEQ ID NO: 1102568 - RNA, 22 nt, Human
cgcugauaaacgucacguuccc

SEQ ID NO: 1102569 - RNA, 22 nt, Human
aaagaaucagaagucucaaaca

SEQ ID NO: 1102570 - RNA, 22 nt, Human
acacucacccucccacugccug

SEQ ID NO: 1102571 - RNA, 22 nt, Human
gcuggcaggagaaacggggugc

SEQ ID NO: 1102572 - RNA, 22 nt, Human
cccagcccaucucaaaggucua

SEQ ID NO: 1102573 - RNA, 22 nt, Human
ucuggcaguaauaggggagaga

SEQ ID NO: 1102574 - RNA, 22 nt, Human
guccucugacucagccuuggga

SEQ ID NO: 1102575 - RNA, 22 nt, Human
cccacacacuggcugcugccaa

SEQ ID NO: 1102576 - RNA, 22 nt, Human
ccuggcagcgccgaagcuggcc

SEQ ID NO: 1102577 - RNA, 22 nt, Human
auggcagauggcuggagcaggu

SEQ ID NO: 1102578 - RNA, 22 nt, Human
agacacauaggaccacacugug

SEQ ID NO: 1102579 - RNA, 22 nt, Human
aggcaggggagcuggaagggua

SEQ ID NO: 1102580 - RNA, 22 nt, Human
cuggccuggggggacacauccc

SEQ ID NO: 1102581 - RNA, 22 nt, Human
cagcacagugaccagacccacu

SEQ ID NO: 1102582 - RNA, 22 nt, Human
ccacaucauggauacaguuaug

SEQ ID NO: 1102583 - RNA, 18 nt, Human
cuccuggcugauggugag

SEQ ID NO: 1102584 - RNA, 22 nt, Human
ccacacuaaacugcucaaacca

SEQ ID NO: 1102585 - RNA, 22 nt, Human
ucacacacauggauaguauuuu

SEQ ID NO: 1102586 - RNA, 22 nt, Human
ccccacccaccuaagagaaacu

SEQ ID NO: 1102587 - RNA, 22 nt, Human
cugccugccacguucagcugua

SEQ ID NO: 1102588 - RNA, 22 nt, Human
acauacacaugaauauauuuuu

SEQ ID NO: 1102589 - RNA, 22 nt, Human
gagccugaugaaacaggcagac

SEQ ID NO: 1102590 - RNA, 22 nt, Human
uauucccagccucuuucuaucu

SEQ ID NO: 1102591 - RNA, 22 nt, Human
uacacagaaccugguguacagu

SEQ ID NO: 1102592 - RNA, 22 nt, Human
uagauacaggcucucugagccu

SEQ ID NO: 1102593 - RNA, 22 nt, Human
ccagcccugccagagagagcug

SEQ ID NO: 1102594 - RNA, 22 nt, Human
ugccugacugcugccaccacua

SEQ ID NO: 1102595 - RNA, 22 nt, Human
acacaucuuagacugaaauaug

SEQ ID NO: 1102596 - RNA, 22 nt, Human
aggaggcuuuugcaggugccac

SEQ ID NO: 1102597 - RNA, 22 nt, Human
aagagcacuaacagagcugaua

SEQ ID NO: 1102598 - RNA, 22 nt, Human
uggcacaguccugggugccugc

SEQ ID NO: 1102599 - RNA, 17 nt, Human
ugcuggcaacauacaaa

SEQ ID NO: 1102600 - RNA, 22 nt, Human
uccuggcacccuuggguuggag

SEQ ID NO: 1102601 - RNA, 22 nt, Human
ucccagccaggcucuaccacuu

SEQ ID NO: 1102602 - RNA, 22 nt, Human
uccucuccaugucucacgccac

SEQ ID NO: 1102603 - RNA, 22 nt, Human
uggaaagagguagaggaucugg

SEQ ID NO: 1102604 - RNA, 22 nt, Human
acacauaagccuaaucaucucc

SEQ ID NO: 1102605 - RNA, 22 nt, Human
gcuggcagagacaagaagacua

SEQ ID NO: 1102606 - RNA, 22 nt, Human
cccuuccugggugucccggagu

SEQ ID NO: 1102607 - RNA, 22 nt, Human
acaucacaguaguuaagccaga

SEQ ID NO: 1102608 - RNA, 22 nt, Human
gguucccggaucuccgaguccc

SEQ ID NO: 1102609 - RNA, 22 nt, Human
guccucugagggggcugcacgc

SEQ ID NO: 1102610 - RNA, 22 nt, Human
acaaauccagugaacuccagug

SEQ ID NO: 1102611 - RNA, 22 nt, Human
ccuggcagcuguuuggcuuggc

SEQ ID NO: 1102612 - RNA, 22 nt, Human
ccuggcagcuccuccccggcgg

SEQ ID NO: 1102613 - RNA, 22 nt, Human
gacucugggcugagccagggcc

SEQ ID NO: 1102614 - RNA, 22 nt, Human
ccucccuucaguagagcccaau

SEQ ID NO: 1102615 - RNA, 22 nt, Human
ucuggcagcaagucuguuucuc

SEQ ID NO: 1102616 - RNA, 22 nt, Human
aggcaguggagcuggaauaggc

SEQ ID NO: 1102617 - RNA, 21 nt, Human
agugccaguagguauggagga

SEQ ID NO: 1102618 - RNA, 22 nt, Human
aagagagaacucccuucgccag

SEQ ID NO: 1102619 - RNA, 22 nt, Human
acuggcagaauugaauaguugu

SEQ ID NO: 1102620 - RNA, 22 nt, Human
acacacagaaggaagccccacu

SEQ ID NO: 1102621 - RNA, 22 nt, Human
gcacacaggcaguuuccagcca

SEQ ID NO: 1102622 - RNA, 22 nt, Human
cuggcaggagcauucacagagg

SEQ ID NO: 1102623 - RNA, 22 nt, Human
ccaucacaguccccaucgugau

SEQ ID NO: 1102624 - RNA, 22 nt, Human
cccacccugggcuacacaucca

SEQ ID NO: 1102625 - RNA, 22 nt, Human
acacauacauggggaagaugag

SEQ ID NO: 1102626 - RNA, 22 nt, Human
cagucacauagguauacacaua

SEQ ID NO: 1102627 - RNA, 22 nt, Human
acaguucccgucuugcacagcu

SEQ ID NO: 1102628 - RNA, 22 nt, Human
cagcccagccuugucucuuuau

SEQ ID NO: 1102629 - RNA, 22 nt, Human
gcccagccuccaagcuccaagg

SEQ ID NO: 1102630 - RNA, 22 nt, Human
gagaggcuggcagugccagguu

SEQ ID NO: 1102631 - RNA, 22 nt, Human
gacuguggggggcggacacaag

SEQ ID NO: 1102632 - RNA, 22 nt, Human
cccugccuugggguccacaccg

SEQ ID NO: 1102633 - RNA, 18 nt, Human
cccacacagcaguagcuc

SEQ ID NO: 1102634 - RNA, 20 nt, Human
aagagucuuuacugagcuaa

SEQ ID NO: 1102635 - RNA, 17 nt, Human
uugggagagaaagguau

SEQ ID NO: 1102636 - RNA, 22 nt, Human
gacacuucaccuuucccagccu

SEQ ID NO: 1102637 - RNA, 17 nt, Human
gccuucucugcccucac

SEQ ID NO: 1102638 - RNA, 22 nt, Human
aaaaagucugcaaaggagguug

SEQ ID NO: 1102639 - RNA, 22 nt, Human
acacagaugcauuacacaucua

SEQ ID NO: 1102640 - RNA, 22 nt, Human
uccuggcagagggcggccucga

SEQ ID NO: 1102641 - RNA, 21 nt, Human
cagcccagcccauugacagug

SEQ ID NO: 1102642 - RNA, 19 nt, Human
acuggcagcuguagucugu

SEQ ID NO: 1102643 - RNA, 22 nt, Human
gacacauagaucuaucucacuc

SEQ ID NO: 1102644 - RNA, 22 nt, Human
uacacaucucugucaguaguga

SEQ ID NO: 1102645 - RNA, 22 nt, Human
aaagaucaauagauaaagcuac

SEQ ID NO: 1102646 - RNA, 22 nt, Human
ucccuccuggccgucaccgcug

SEQ ID NO: 1102647 - RNA, 22 nt, Human
uggccucugugggagcugagca

SEQ ID NO: 1102648 - RNA, 22 nt, Human
ggagcugaaccccaucgugcug

SEQ ID NO: 1102649 - RNA, 22 nt, Human
ucaggcccuucucccaggacuc

SEQ ID NO: 1102650 - RNA, 23 nt, Human
gcccacccucagcguccucacgg

SEQ ID NO: 1102651 - RNA, 22 nt, Human
cccuuccuugugacuggugggg

SEQ ID NO: 1102652 - RNA, 22 nt, Human
cccugccucugaagcugcucag

SEQ ID NO: 1102653 - RNA, 22 nt, Human
acacacuguugcucauccaggc

SEQ ID NO: 1102654 - RNA, 22 nt, Human
cucuccagaauaugccgccgug

SEQ ID NO: 1102655 - RNA, 22 nt, Human
acugccaaugguaguuugaugg

SEQ ID NO: 1102656 - RNA, 22 nt, Human
gaggagcugcagggggagucua

SEQ ID NO: 1102657 - RNA, 22 nt, Human
uaagaacaguagaacaguaggu

SEQ ID NO: 1102658 - RNA, 22 nt, Human
ucuggcaguuugagaaaggcua

SEQ ID NO: 1102659 - RNA, 22 nt, Human
uuccuggccuaagguaggugac

SEQ ID NO: 1102660 - RNA, 22 nt, Human
ugcagagagauccucaggguuu

SEQ ID NO: 1102661 - RNA, 22 nt, Human
auggcagacgaggcagcagggg

SEQ ID NO: 1102662 - RNA, 19 nt, Human
gggagcugaggucuuuggu

SEQ ID NO: 1102663 - RNA, 22 nt, Human
guccucugggcuuugagcaguc

SEQ ID NO: 1102664 - RNA, 22 nt, Human
acacaucucaggggacacucuc

SEQ ID NO: 1102665 - RNA, 22 nt, Human
uccacccugcuuucuuaucucc

SEQ ID NO: 1102666 - RNA, 22 nt, Human
acuggcagagacccugauggcc

SEQ ID NO: 1102667 - RNA, 22 nt, Human
gccuggcaauggccucaggaag

SEQ ID NO: 1102668 - RNA, 22 nt, Human
aaagagucguguuccagguuug

SEQ ID NO: 1102669 - RNA, 22 nt, Human
ccuggcagcccagagcgccgcu

SEQ ID NO: 1102670 - RNA, 22 nt, Human
ugcacaggugagacucaggaag

SEQ ID NO: 1102671 - RNA, 17 nt, Human
uccaggcagcaacugag

SEQ ID NO: 1102672 - RNA, 22 nt, Human
gaaagacuuccuuugagaguac

SEQ ID NO: 1102673 - RNA, 22 nt, Human
gccuggcacucaaucaucugcu

SEQ ID NO: 1102674 - RNA, 22 nt, Human
gcacaggaugauggguugaggg

SEQ ID NO: 1102675 - RNA, 22 nt, Human
uucccacagagauuacauugaa

SEQ ID NO: 1102676 - RNA, 22 nt, Human
cccaggccuggucugggccagu

SEQ ID NO: 1102677 - RNA, 21 nt, Human
cacacagugaucuauccacau

SEQ ID NO: 1102678 - RNA, 22 nt, Human
ggcccagcgaggccaccuacag

SEQ ID NO: 1102679 - RNA, 22 nt, Human
agggacucccugggccgacacg

SEQ ID NO: 1102680 - RNA, 22 nt, Human
aggaggcugcaacccugaggcc

SEQ ID NO: 1102681 - RNA, 20 nt, Human
uucaugggagcaaagaggcc

SEQ ID NO: 1102682 - RNA, 22 nt, Human
uacacaucacuguaucuuucag

SEQ ID NO: 1102683 - RNA, 22 nt, Human
ucccagccuuucuuuucugcug

SEQ ID NO: 1102684 - RNA, 22 nt, Human
uggcagugucuuaucaggagug

SEQ ID NO: 1102685 - RNA, 22 nt, Human
gcuggcagcuggaaguugggcu

SEQ ID NO: 1102686 - RNA, 22 nt, Human
agucacaguuucccugagagag

SEQ ID NO: 1102687 - RNA, 22 nt, Human
gguguugggcucacugguccuu

SEQ ID NO: 1102688 - RNA, 22 nt, Human
gcaguguuuguguucucacaug

SEQ ID NO: 1102689 - RNA, 22 nt, Human
guccucuggaagaugaguucuu

SEQ ID NO: 1102690 - RNA, 22 nt, Human
cacacagacagcucucugaaga

SEQ ID NO: 1102691 - RNA, 21 nt, Human
acacacugaguuuuccacugu

SEQ ID NO: 1102692 - RNA, 22 nt, Human
uggucucugcaggccaggcuca

SEQ ID NO: 1102693 - RNA, 22 nt, Human
agggcugaagggaggugcucau

SEQ ID NO: 1102694 - RNA, 22 nt, Human
gucaggacucugacccgucccg

SEQ ID NO: 1102695 - RNA, 22 nt, Human
uacacauccauguuuugacuuu

SEQ ID NO: 1102696 - RNA, 22 nt, Human
aggggugugcauccuggaggau

SEQ ID NO: 1102697 - RNA, 18 nt, Human
cuccuccacagccccugc

SEQ ID NO: 1102698 - RNA, 22 nt, Human
ucuggcagggucagggcccagg

SEQ ID NO: 1102699 - RNA, 22 nt, Human
uuccuggcgccacggagccggu

SEQ ID NO: 1102700 - RNA, 22 nt, Human
ccacacagucaguuuccaagaa

SEQ ID NO: 1102701 - RNA, 22 nt, Human
uuccuggccaagcagaguggaa

SEQ ID NO: 1102702 - RNA, 22 nt, Human
cccuggcagagggggcaggugc

SEQ ID NO: 1102703 - RNA, 22 nt, Human
cugagcagugguucuugagcgc

SEQ ID NO: 1102704 - RNA, 22 nt, Human
acccacaccuccguauaucacu

SEQ ID NO: 1102705 - RNA, 22 nt, Human
gagggugucugcguaacuggca

SEQ ID NO: 1102706 - RNA, 22 nt, Human
guggcagugaaggucauagcau

SEQ ID NO: 1102707 - RNA, 22 nt, Human
cacccacauggaaauucacagu

SEQ ID NO: 1102708 - RNA, 22 nt, Human
ucacacagcuccuuuccuuagu

SEQ ID NO: 1102709 - RNA, 22 nt, Human
guggcagugggaugcuaucagg

SEQ ID NO: 1102710 - RNA, 22 nt, Human
cgcauacauagaaacacacaga

SEQ ID NO: 1102711 - RNA, 22 nt, Human
uccacccugcuuuugucuuuga

SEQ ID NO: 1102712 - RNA, 22 nt, Human
ucuggcagugaagucaugaggu

SEQ ID NO: 1102713 - RNA, 22 nt, Human
gaagagaaaggcaaggaguuuu

SEQ ID NO: 1102714 - RNA, 23 nt, Human
uugggaaauaguuaagacaugag

SEQ ID NO: 1102715 - RNA, 22 nt, Human
ucuggcagaggaaggaggccug

SEQ ID NO: 1102716 - RNA, 22 nt, Human
gucacaggcaguaacuaggacc

SEQ ID NO: 1102717 - RNA, 22 nt, Human
ucacacacauaaucuaagauua

SEQ ID NO: 1102718 - RNA, 22 nt, Human
gcacacaguagggauucaauga

SEQ ID NO: 1102719 - RNA, 22 nt, Human
gcacauaaagggcaugggaggu

SEQ ID NO: 1102720 - RNA, 22 nt, Human
uuccugccccugagagcuccca

SEQ ID NO: 1102721 - RNA, 22 nt, Human
gaggagcucugcuccauccuuc

SEQ ID NO: 1102722 - RNA, 22 nt, Human
aucacagagcucccuuccacug

SEQ ID NO: 1102723 - RNA, 22 nt, Human
ccaggccucuggcugcuuaguc

SEQ ID NO: 1102724 - RNA, 22 nt, Human
acagguggcuuauuggcugauu

SEQ ID NO: 1102725 - RNA, 22 nt, Human
acaggugguagaguggaaagag

SEQ ID NO: 1102726 - RNA, 22 nt, Human
acuggcagggggagccccgaga

SEQ ID NO: 1102727 - RNA, 22 nt, Human
uuccuggcucacagcagugggg

SEQ ID NO: 1102728 - RNA, 22 nt, Human
acccacacaucucuaauucagu

SEQ ID NO: 1102729 - RNA, 22 nt, Human
uccaggcucuaggcugcucucc

SEQ ID NO: 1102730 - RNA, 22 nt, Human
acacucuguaaugucacacucc

SEQ ID NO: 1102731 - RNA, 22 nt, Human
gccuggcaaggcccuguugacu

SEQ ID NO: 1102732 - RNA, 21 nt, Human
ucacguggucacaugagcuuu

SEQ ID NO: 1102733 - RNA, 22 nt, Human
acaucacagagcccagauaaag

SEQ ID NO: 1102734 - RNA, 22 nt, Human
gacacagagcucacagucuccu

SEQ ID NO: 1102735 - RNA, 22 nt, Human
acuggcagcagcagcccuuggg

SEQ ID NO: 1102736 - RNA, 22 nt, Human
cuccaggccccuggccuucugc

SEQ ID NO: 1102737 - RNA, 22 nt, Human
uuccacauuccuuacauucaua

SEQ ID NO: 1102738 - RNA, 22 nt, Human
gccagguugcugacgacgaucu

SEQ ID NO: 1102739 - RNA, 22 nt, Human
acagacuggccugucucgcacc

SEQ ID NO: 1102740 - RNA, 19 nt, Human
ccuuccuccccagggccau

SEQ ID NO: 1102741 - RNA, 22 nt, Human
agacacagcugcaggagguggg

SEQ ID NO: 1102742 - RNA, 22 nt, Human
auggcagagggauugaacagcu

SEQ ID NO: 1102743 - RNA, 22 nt, Human
cacaucccuggaguuacccagu

SEQ ID NO: 1102744 - RNA, 22 nt, Human
uuggagagauuuaggucucagu

SEQ ID NO: 1102745 - RNA, 20 nt, Human
uggccucugagaugccacgg

SEQ ID NO: 1102746 - RNA, 22 nt, Human
uccugagcugccgcaucagcag

SEQ ID NO: 1102747 - RNA, 22 nt, Human
gaaagaagcuuuagauggcuau

SEQ ID NO: 1102748 - RNA, 22 nt, Human
ccuggcagguggcgcccucggc

SEQ ID NO: 1102749 - RNA, 22 nt, Human
uccaggcuaauuuugcauuguu

SEQ ID NO: 1102750 - RNA, 22 nt, Human
uccuggcauugugcagggugug

SEQ ID NO: 1102751 - RNA, 22 nt, Human
uaaaggguagguuuuacuguaa

SEQ ID NO: 1102752 - RNA, 20 nt, Human
ucuggcaggugaacgagcug

SEQ ID NO: 1102753 - RNA, 22 nt, Human
gacccggcuccaggcccagcag

SEQ ID NO: 1102754 - RNA, 19 nt, Human
uccuggcacaguggaacca

SEQ ID NO: 1102755 - RNA, 22 nt, Human
cuggcaguauuaagagaaguga

SEQ ID NO: 1102756 - RNA, 22 nt, Human
uauguaaaguagauggcaggua

SEQ ID NO: 1102757 - RNA, 22 nt, Human
ucuggcaggguguguauuuaca

SEQ ID NO: 1102758 - RNA, 22 nt, Human
gagagaaaagggggaauugauu

SEQ ID NO: 1102759 - RNA, 22 nt, Human
ugcuccagugccugccccacag

SEQ ID NO: 1102760 - RNA, 22 nt, Human
ucaucacaauuuuaugacccuc

SEQ ID NO: 1102761 - RNA, 22 nt, Human
gcuggcagaauuucuucuugcu

SEQ ID NO: 1102762 - RNA, 22 nt, Human
cuccuggcaguuccccuuguca

SEQ ID NO: 1102763 - RNA, 22 nt, Human
uccuggcagggucuaggucuag

SEQ ID NO: 1102764 - RNA, 22 nt, Human
ccuggcagcuccguggccuucc

SEQ ID NO: 1102765 - RNA, 22 nt, Human
guccuggcccaggaguacacau

SEQ ID NO: 1102766 - RNA, 22 nt, Human
gcacauaacugaccacaucuaa

SEQ ID NO: 1102767 - RNA, 20 nt, Human
acaaagacuggaaaagcaag

SEQ ID NO: 1102768 - RNA, 22 nt, Human
cauuacaaccccaaauuacaaa

SEQ ID NO: 1102769 - RNA, 22 nt, Human
ugcuggcacguggaccaggaga

SEQ ID NO: 1102770 - RNA, 22 nt, Human
ccacacagauaaguguuuucua

SEQ ID NO: 1102771 - RNA, 22 nt, Human
agaggccggccgagcccauggg

SEQ ID NO: 1102772 - RNA, 22 nt, Human
acacauaagaaacuacaaagag

SEQ ID NO: 1102773 - RNA, 22 nt, Human
agaggcuucucggauggggcag

SEQ ID NO: 1102774 - RNA, 22 nt, Human
acuggcagcuguaggaugcaug

SEQ ID NO: 1102775 - RNA, 22 nt, Human
uggccugccacugccacgccac

SEQ ID NO: 1102776 - RNA, 22 nt, Human
agguagggaagaaggcaugaaa

SEQ ID NO: 1102777 - RNA, 22 nt, Human
ggcaaggggucaggcugagaca

SEQ ID NO: 1102778 - RNA, 22 nt, Human
ucuggcaggauaucgaagugaa

SEQ ID NO: 1102779 - RNA, 22 nt, Human
gcccacacaccagcucaggagg

SEQ ID NO: 1102780 - RNA, 22 nt, Human
uggcagagagagugcagucgac

SEQ ID NO: 1102781 - RNA, 22 nt, Human
ugccucucuaacccaugcccaa

SEQ ID NO: 1102782 - RNA, 22 nt, Human
cacagagacagaagcacuuaug

SEQ ID NO: 1102783 - RNA, 22 nt, Human
ugguccugccccgugcacagag

SEQ ID NO: 1102784 - RNA, 22 nt, Human
gccacagguacuaugggagaga

SEQ ID NO: 1102785 - RNA, 20 nt, Human
gcuggcagaugucuugagau

SEQ ID NO: 1102786 - RNA, 21 nt, Human
acacagaggcaucaucacuuu

SEQ ID NO: 1102787 - RNA, 22 nt, Human
cagggacaauggcagagccuga

SEQ ID NO: 1102788 - RNA, 22 nt, Human
gcuggcaggagaccauacccua

SEQ ID NO: 1102789 - RNA, 22 nt, Human
guccucuguguaggcugcagac

SEQ ID NO: 1102790 - RNA, 22 nt, Human
cugagccagggccacacaugga

SEQ ID NO: 1102791 - RNA, 22 nt, Human
ccacacagggggaugaguuauu

SEQ ID NO: 1102792 - RNA, 22 nt, Human
gucacacagggccuccaaauca

SEQ ID NO: 1102793 - RNA, 21 nt, Human
aggcugcuggcucaggguccu

SEQ ID NO: 1102794 - RNA, 19 nt, Human
agaggccucagcagcuggc

SEQ ID NO: 1102795 - RNA, 22 nt, Human
guccucuggugaaagcauuccc

SEQ ID NO: 1102796 - RNA, 22 nt, Human
uguaaacauauguauguaugua

SEQ ID NO: 1102797 - RNA, 22 nt, Human
gacacagaaggucacauguuca

SEQ ID NO: 1102798 - RNA, 22 nt, Human
cugccucuauaggaguccacca

SEQ ID NO: 1102799 - RNA, 22 nt, Human
ucuggcaguggaugagggcagc

SEQ ID NO: 1102800 - RNA, 19 nt, Human
guccucucaacaacccggg

SEQ ID NO: 1102801 - RNA, 22 nt, Human
gcacauacugcaaagauuacua

SEQ ID NO: 1102802 - RNA, 22 nt, Human
guccuggcccacuggcaggcug

SEQ ID NO: 1102803 - RNA, 22 nt, Human
uuccuggcagaggccccgacag

SEQ ID NO: 1102804 - RNA, 20 nt, Human
aaaagagugcuucaacugcu

SEQ ID NO: 1102805 - RNA, 22 nt, Human
ggaggacacuggcucugccuuc

SEQ ID NO: 1102806 - RNA, 22 nt, Human
ccuggcaguggugaagaagagg

SEQ ID NO: 1102807 - RNA, 22 nt, Human
accugccuucucaaggacauga

SEQ ID NO: 1102808 - RNA, 22 nt, Human
uccacacacauuucuaugugca

SEQ ID NO: 1102809 - RNA, 22 nt, Human
agcccagcuuugaaccauauca

SEQ ID NO: 1102810 - RNA, 22 nt, Human
uccaggcuuuuucaugcugucu

SEQ ID NO: 1102811 - RNA, 22 nt, Human
ucuggcagggguucugcacuug

SEQ ID NO: 1102812 - RNA, 22 nt, Human
cagccaagaaccacagacccag

SEQ ID NO: 1102813 - RNA, 19 nt, Human
uggcagguagugagcaguc

SEQ ID NO: 1102814 - RNA, 22 nt, Human
ccuggcagcagcacaugccuuc

SEQ ID NO: 1102815 - RNA, 22 nt, Human
gagacaucauaaugaaguuucc

SEQ ID NO: 1102816 - RNA, 22 nt, Human
agggcugacagugaggagucaa

SEQ ID NO: 1102817 - RNA, 22 nt, Human
ucccaccccuugacucuuuaag

SEQ ID NO: 1102818 - RNA, 22 nt, Human
ucacacagcugacagagccuuu

SEQ ID NO: 1102819 - RNA, 22 nt, Human
cugccugcugcccuccagagcc

SEQ ID NO: 1102820 - RNA, 22 nt, Human
accugccuauggagccacaugg

SEQ ID NO: 1102821 - RNA, 22 nt, Human
guugggaaggugaacaugaugc

SEQ ID NO: 1102822 - RNA, 22 nt, Human
uacauuccuguuagcaucuaag

SEQ ID NO: 1102823 - RNA, 22 nt, Human
ucuccacacuuucucucccagg

SEQ ID NO: 1102824 - RNA, 21 nt, Human
ucuggcaggcacgggcccagc

SEQ ID NO: 1102825 - RNA, 22 nt, Human
cucucugggcccaguuggcacc

SEQ ID NO: 1102826 - RNA, 22 nt, Human
cccacccucaagggugucuaua

SEQ ID NO: 1102827 - RNA, 22 nt, Human
ggcaagagggcagauggagugc

SEQ ID NO: 1102828 - RNA, 22 nt, Human
gacacagaauuuacucccgaua

SEQ ID NO: 1102829 - RNA, 22 nt, Human
gaccugccugagcugccucugc

SEQ ID NO: 1102830 - RNA, 22 nt, Human
guccucuggccuuucccaggac

SEQ ID NO: 1102831 - RNA, 20 nt, Human
cccacacccuucccacuugg

SEQ ID NO: 1102832 - RNA, 22 nt, Human
aguguugggucuuuagaauuua

SEQ ID NO: 1102833 - RNA, 21 nt, Human
agagucugagugugcaagggc

SEQ ID NO: 1102834 - RNA, 22 nt, Human
cuccaggcucguccaagaucga

SEQ ID NO: 1102835 - RNA, 22 nt, Human
ccauucauacaauuuuguucua

SEQ ID NO: 1102836 - RNA, 22 nt, Human
ccuggcugguggcagcgacaag

SEQ ID NO: 1102837 - RNA, 22 nt, Human
gauggccuggguccccuuccgg

SEQ ID NO: 1102838 - RNA, 22 nt, Human
gcacacagcuagauuaccauuc

SEQ ID NO: 1102839 - RNA, 22 nt, Human
auacauucaaaggaaggauaga

SEQ ID NO: 1102840 - RNA, 22 nt, Human
gucuggaaggaggagauggagc

SEQ ID NO: 1102841 - RNA, 19 nt, Human
cugagagaugcuucacaca

SEQ ID NO: 1102842 - RNA, 22 nt, Human
acacacagaguuuauacaggca

SEQ ID NO: 1102843 - RNA, 22 nt, Human
uucccacauucuuuacauucau

SEQ ID NO: 1102844 - RNA, 22 nt, Human
cacacacucuuccuggcaccua

SEQ ID NO: 1102845 - RNA, 22 nt, Human
guacacacuguuugaucauuuc

SEQ ID NO: 1102846 - RNA, 22 nt, Human
aaaagagugacugauaaguaua

SEQ ID NO: 1102847 - RNA, 22 nt, Human
aggccuccagccacaugccagu

SEQ ID NO: 1102848 - RNA, 22 nt, Human
guccucugauuucuagguauau

SEQ ID NO: 1102849 - RNA, 22 nt, Human
gaggcugcuuugaugacaggag

SEQ ID NO: 1102850 - RNA, 22 nt, Human
agaaagaggaugcagaucucau

SEQ ID NO: 1102851 - RNA, 23 nt, Human
uuccaggcagagcagggauuaga

SEQ ID NO: 1102852 - RNA, 22 nt, Human
caauacugaguuuacauucauc

SEQ ID NO: 1102853 - RNA, 22 nt, Human
ccagccucacuggcaucaccua

SEQ ID NO: 1102854 - RNA, 22 nt, Human
guccucugaaguugugcaaugc

SEQ ID NO: 1102855 - RNA, 21 nt, Human
uccuguaagcuuggguggcuc

SEQ ID NO: 1102856 - RNA, 22 nt, Human
gcacacauucggauucuuaacc

SEQ ID NO: 1102857 - RNA, 22 nt, Human
uggcacagggcuuggucgcuca

SEQ ID NO: 1102858 - RNA, 22 nt, Human
ccuccagcgcgauccacuccgg

SEQ ID NO: 1102859 - RNA, 22 nt, Human
aaagaucaaguaggcauggccu

SEQ ID NO: 1102860 - RNA, 22 nt, Human
ucaggagcucuucccuggugug

SEQ ID NO: 1102861 - RNA, 19 nt, Human
guccuggcgccgccacacc

SEQ ID NO: 1102862 - RNA, 22 nt, Human
gagaaagaugaagaguggcguu

SEQ ID NO: 1102863 - RNA, 22 nt, Human
caccagggccccaggcugugcc

SEQ ID NO: 1102864 - RNA, 22 nt, Human
uuccaggcuauccggugaaggg

SEQ ID NO: 1102865 - RNA, 22 nt, Human
cccacacucugagaaaugcuga

SEQ ID NO: 1102866 - RNA, 22 nt, Human
cuggcaguuugccaggagcucg

SEQ ID NO: 1102867 - RNA, 19 nt, Human
ccuugccugucccugcagc

SEQ ID NO: 1102868 - RNA, 22 nt, Human
ggcugaguugagaggauuacuu

SEQ ID NO: 1102869 - RNA, 22 nt, Human
uggccucugggaaagcagauuc

SEQ ID NO: 1102870 - RNA, 22 nt, Human
acuggcagugucguuuacauga

SEQ ID NO: 1102871 - RNA, 21 nt, Human
ccacucaugacuccacucacc

SEQ ID NO: 1102872 - RNA, 22 nt, Human
ccuggcaggccccuccuggauu

SEQ ID NO: 1102873 - RNA, 17 nt, Human
ccauacugacauauuga

SEQ ID NO: 1102874 - RNA, 22 nt, Human
gcuggcaguaaaggguuuggca

SEQ ID NO: 1102875 - RNA, 22 nt, Human
cacacacuguuaauguaggagu

SEQ ID NO: 1102876 - RNA, 21 nt, Human
agaugcugaugcugcaggucc

SEQ ID NO: 1102877 - RNA, 18 nt, Human
uccugccugugccccagg

SEQ ID NO: 1102878 - RNA, 22 nt, Human
ucaucacauaugucaugauuug

SEQ ID NO: 1102879 - RNA, 22 nt, Human
uggcagagcccagacuccaguc

SEQ ID NO: 1102880 - RNA, 22 nt, Human
ggccucucaugcccagagccaa

SEQ ID NO: 1102881 - RNA, 22 nt, Human
ggugccagaguggcccaggggc

SEQ ID NO: 1102882 - RNA, 22 nt, Human
ggagaagaggagcuggaagccu

SEQ ID NO: 1102883 - RNA, 22 nt, Human
auccaggccccaagaccccgac

SEQ ID NO: 1102884 - RNA, 22 nt, Human
aacacauaggcagagcaugaca

SEQ ID NO: 1102885 - RNA, 22 nt, Human
uccaggcaaaaaccaacuacag

SEQ ID NO: 1102886 - RNA, 22 nt, Human
acaucugaggagaccagccucu

SEQ ID NO: 1102887 - RNA, 22 nt, Human
auagggccuaaaaaguauugcu

SEQ ID NO: 1102888 - RNA, 17 nt, Human
uuaagguggaucagcac

SEQ ID NO: 1102889 - RNA, 20 nt, Human
acuggcagccugccugcugu

SEQ ID NO: 1102890 - RNA, 22 nt, Human
uccccacaucucugcaucaggc

SEQ ID NO: 1102891 - RNA, 22 nt, Human
acacacagcgccuaccaugugc

SEQ ID NO: 1102892 - RNA, 22 nt, Human
ccuggcaggacuguuguaagaa

SEQ ID NO: 1102893 - RNA, 22 nt, Human
guccucugcccaggucaagguu

SEQ ID NO: 1102894 - RNA, 22 nt, Human
gcacauacccacugucaagcac

SEQ ID NO: 1102895 - RNA, 22 nt, Human
cuuccucuagccuaguaaugcc

SEQ ID NO: 1102896 - RNA, 22 nt, Human
aaauacugcugcuauuccuuuu

SEQ ID NO: 1102897 - RNA, 22 nt, Human
ccuggcagaaagaguuacaccu

SEQ ID NO: 1102898 - RNA, 22 nt, Human
uccuucccaggugucgccgccu

SEQ ID NO: 1102899 - RNA, 22 nt, Human
caggcuggagugcaauggcaca

SEQ ID NO: 1102900 - RNA, 22 nt, Human
ccuggcagggcugcaguaaugg

SEQ ID NO: 1102901 - RNA, 17 nt, Human
gcccacccuuaggagcu

SEQ ID NO: 1102902 - RNA, 22 nt, Human
gcacacaugcaugcacaggagu

SEQ ID NO: 1102903 - RNA, 22 nt, Human
ugguccuggaagguccugaggg

SEQ ID NO: 1102904 - RNA, 22 nt, Human
gagacacacauucuggagagaa

SEQ ID NO: 1102905 - RNA, 22 nt, Human
gacacagauaucucugagauua

SEQ ID NO: 1102906 - RNA, 22 nt, Human
cccagccuuugcuuccugguuc

SEQ ID NO: 1102907 - RNA, 22 nt, Human
auccucuguggauuacaccuag

SEQ ID NO: 1102908 - RNA, 18 nt, Human
acaggcugugggaauggu

SEQ ID NO: 1102909 - RNA, 22 nt, Human
agcacugugauuuauaacauuu

SEQ ID NO: 1102910 - RNA, 22 nt, Human
ucuggcaguuccuuguugauau

SEQ ID NO: 1102911 - RNA, 22 nt, Human
uuccagccaugguuucccuaug

SEQ ID NO: 1102912 - RNA, 22 nt, Human
ucuggcagcucaguucaggucu

SEQ ID NO: 1102913 - RNA, 22 nt, Human
auuccacacaguaauacucaau

SEQ ID NO: 1102914 - RNA, 19 nt, Human
acuggcagggcugcggugg

SEQ ID NO: 1102915 - RNA, 22 nt, Human
cuccuggcuuucccagaccagg

SEQ ID NO: 1102916 - RNA, 22 nt, Human
gugggagaaauuagcucuaguu

SEQ ID NO: 1102917 - RNA, 22 nt, Human
gaggagcugagccacguccugg

SEQ ID NO: 1102918 - RNA, 22 nt, Human
gccccaccuugagagcagaaac

SEQ ID NO: 1102919 - RNA, 22 nt, Human
acuggcagccacaacuggcagg

SEQ ID NO: 1102920 - RNA, 22 nt, Human
gucacaggccuggaugaggggc

SEQ ID NO: 1102921 - RNA, 21 nt, Human
cccuugccugcacuccucggc

SEQ ID NO: 1102922 - RNA, 22 nt, Human
acaugacuuuucucuuccagag

SEQ ID NO: 1102923 - RNA, 22 nt, Human
acuggcaguggcagcagaaaga

SEQ ID NO: 1102924 - RNA, 22 nt, Human
ucuggcagaaggcagaaauuca

SEQ ID NO: 1102925 - RNA, 22 nt, Human
acacacucaauugcauaagcac

SEQ ID NO: 1102926 - RNA, 22 nt, Human
agcacagggacaaugccaggug

SEQ ID NO: 1102927 - RNA, 22 nt, Human
cuaugagaagaaaacaagauua

SEQ ID NO: 1102928 - RNA, 22 nt, Human
cagcccaaagccccaggcuaga

SEQ ID NO: 1102929 - RNA, 22 nt, Human
aggacaagcuaaaggacuuccu

SEQ ID NO: 1102930 - RNA, 19 nt, Human
acacauuugcacaauccac

SEQ ID NO: 1102931 - RNA, 22 nt, Human
uacugacacaaagccaaucccu

SEQ ID NO: 1102932 - RNA, 21 nt, Human
gggcagaggggccuccugggu

SEQ ID NO: 1102933 - RNA, 22 nt, Human
ccuggcaguuuugcccaggauu

SEQ ID NO: 1102934 - RNA, 19 nt, Human
ccagcccacagugacuuuc

SEQ ID NO: 1102935 - RNA, 22 nt, Human
cagguuggucggcaaguacaca

SEQ ID NO: 1102936 - RNA, 22 nt, Human
uuccaggcucccuuggaggugu

SEQ ID NO: 1102937 - RNA, 22 nt, Human
gaggagcuggcagcgucuccgc

SEQ ID NO: 1102938 - RNA, 22 nt, Human
caggucccugcgccccggccuc

SEQ ID NO: 1102939 - RNA, 22 nt, Human
acuggcagaggauagcacuaau

SEQ ID NO: 1102940 - RNA, 22 nt, Human
cuccaggccauggcugcggagg

SEQ ID NO: 1102941 - RNA, 22 nt, Human
cacaauuuuaauacacagucaa

SEQ ID NO: 1102942 - RNA, 19 nt, Human
cagcccucuuaccacugug

SEQ ID NO: 1102943 - RNA, 22 nt, Human
aacaaaagccgaaguagguguc

SEQ ID NO: 1102944 - RNA, 22 nt, Human
uguuggaauuaggauacagagg

SEQ ID NO: 1102945 - RNA, 22 nt, Human
acuggcagaacuggugauuguc

SEQ ID NO: 1102946 - RNA, 21 nt, Human
ucuggcagcaguuuguugagu

SEQ ID NO: 1102947 - RNA, 22 nt, Human
aggagcugcagauucugccuug

SEQ ID NO: 1102948 - RNA, 22 nt, Human
uggcacucacucucagagucug

SEQ ID NO: 1102949 - RNA, 22 nt, Human
agcacaggcuuuggugugaggg

SEQ ID NO: 1102950 - RNA, 22 nt, Human
uuggaaaguuuuuacugaagac

SEQ ID NO: 1102951 - RNA, 18 nt, Human
ccuggcagccaugcgcgc

SEQ ID NO: 1102952 - RNA, 22 nt, Human
cacacagaugguaagggaggga

SEQ ID NO: 1102953 - RNA, 22 nt, Human
ucccacauuacccugacugaca

SEQ ID NO: 1102954 - RNA, 23 nt, Human
cauccaggagcugagucugacug

SEQ ID NO: 1102955 - RNA, 22 nt, Human
gcacacaggggaguucucagaa

SEQ ID NO: 1102956 - RNA, 22 nt, Human
ccugccucccagagguccucua

SEQ ID NO: 1102957 - RNA, 22 nt, Human
gaggagcucaugaaagcggugu

SEQ ID NO: 1102958 - RNA, 20 nt, Human
ugccuggccuuucucugccc

SEQ ID NO: 1102959 - RNA, 22 nt, Human
caucacagguccugaugacauu

SEQ ID NO: 1102960 - RNA, 22 nt, Human
ucuggcaggcaaucggcucugg

SEQ ID NO: 1102961 - RNA, 22 nt, Human
uccugugccaucucuagagacu

SEQ ID NO: 1102962 - RNA, 19 nt, Human
ucuggcagguaauuaggga

SEQ ID NO: 1102963 - RNA, 22 nt, Human
cacauuccuggugcucagcagc

SEQ ID NO: 1102964 - RNA, 22 nt, Human
guggcaguuuugacaucacaaa

SEQ ID NO: 1102965 - RNA, 22 nt, Human
agggaagaagcugguaguaggu

SEQ ID NO: 1102966 - RNA, 22 nt, Human
cagcccaggccgacaguuccuc

SEQ ID NO: 1102967 - RNA, 22 nt, Human
acacacaugcaugcuugccauu

SEQ ID NO: 1102968 - RNA, 22 nt, Human
uacacaacugacaaccauucug

SEQ ID NO: 1102969 - RNA, 22 nt, Human
gccgggaccaaggccacggagc

SEQ ID NO: 1102970 - RNA, 22 nt, Human
gcuggcagaagagcugguucaa

SEQ ID NO: 1102971 - RNA, 17 nt, Human
ugccagccugucccagg

SEQ ID NO: 1102972 - RNA, 22 nt, Human
uuuaaauuuagaagaaacacug

SEQ ID NO: 1102973 - RNA, 22 nt, Human
aacacagaucaaaauauuuccu

SEQ ID NO: 1102974 - RNA, 22 nt, Human
cccagccucuguuugcuccucu

SEQ ID NO: 1102975 - RNA, 22 nt, Human
ggaggacaggggcugcagcaca

SEQ ID NO: 1102976 - RNA, 22 nt, Human
ccugccuguacuagagacccag

SEQ ID NO: 1102977 - RNA, 22 nt, Human
ggcagugagaggucuccugguc

SEQ ID NO: 1102978 - RNA, 22 nt, Human
ucacacaugaguaaauacaggg

SEQ ID NO: 1102979 - RNA, 22 nt, Human
ggugccagugggucucaggaua

SEQ ID NO: 1102980 - RNA, 22 nt, Human
cacuguccaauagauacauaau

SEQ ID NO: 1102981 - RNA, 22 nt, Human
cuccuggcucgcccccagcuga

SEQ ID NO: 1102982 - RNA, 22 nt, Human
ccccacaccugccgggcagcag

SEQ ID NO: 1102983 - RNA, 22 nt, Human
cuuggcaguuucggaaggauga

SEQ ID NO: 1102984 - RNA, 19 nt, Human
ugccuggcaccagcuccac

SEQ ID NO: 1102985 - RNA, 21 nt, Human
uccugccuuaguccagagcag

SEQ ID NO: 1102986 - RNA, 22 nt, Human
cucagccccaauucuccccauu

SEQ ID NO: 1102987 - RNA, 22 nt, Human
acacacuggcccccaguacuga

SEQ ID NO: 1102988 - RNA, 22 nt, Human
gcccacacagcagauccuuugg

SEQ ID NO: 1102989 - RNA, 20 nt, Human
cugcuccacccggcucucag

SEQ ID NO: 1102990 - RNA, 22 nt, Human
acuggcagaacgugaugcgggu

SEQ ID NO: 1102991 - RNA, 22 nt, Human
ucacauacacuaggauauuuuu

SEQ ID NO: 1102992 - RNA, 22 nt, Human
uggcagugguaccggcucucag

SEQ ID NO: 1102993 - RNA, 22 nt, Human
aguguggcaggaaugacuagaa

SEQ ID NO: 1102994 - RNA, 22 nt, Human
uuccaggcugaugggccacagg

SEQ ID NO: 1102995 - RNA, 22 nt, Human
ccauacacacaccaaauuugua

SEQ ID NO: 1102996 - RNA, 22 nt, Human
ugcagagagaccccugggccag

SEQ ID NO: 1102997 - RNA, 22 nt, Human
gcacucuccuggcugccacagu

SEQ ID NO: 1102998 - RNA, 22 nt, Human
gagaaagauguaggcugggagg

SEQ ID NO: 1102999 - RNA, 22 nt, Human
ugagggacucccggcccugcca

SEQ ID NO: 1103000 - RNA, 22 nt, Human
ucccagccuggacccugccagu

SEQ ID NO: 1103001 - RNA, 20 nt, Human
ucacacaugguaagcuauga

SEQ ID NO: 1103002 - RNA, 22 nt, Human
uccugagcaacacagcuaagug

SEQ ID NO: 1103003 - RNA, 22 nt, Human
ugagagucucagaccuccuggu

SEQ ID NO: 1103004 - RNA, 22 nt, Human
acaucacacgccuuccaggagg

SEQ ID NO: 1103005 - RNA, 22 nt, Human
acuggcagagguuggacaccau

SEQ ID NO: 1103006 - RNA, 22 nt, Human
ccuggcuccugccucugcaggg

SEQ ID NO: 1103007 - RNA, 23 nt, Human
ggacacauuuauuucagaauuca

SEQ ID NO: 1103008 - RNA, 22 nt, Human
gcagggacagggcagggccuuu

SEQ ID NO: 1103009 - RNA, 22 nt, Human
aagagccagcuagugaagaggc

SEQ ID NO: 1103010 - RNA, 22 nt, Human
gcuggcagggugguugagagag

SEQ ID NO: 1103011 - RNA, 22 nt, Human
cacauacaaggcacacuggagg

SEQ ID NO: 1103012 - RNA, 21 nt, Human
ccuagccucuuacccagcuuu

SEQ ID NO: 1103013 - RNA, 22 nt, Human
cacauacauucauguuacucua

SEQ ID NO: 1103014 - RNA, 22 nt, Human
auacacacugcuauccuuuuuu

SEQ ID NO: 1103015 - RNA, 22 nt, Human
uccaggcuagguuuacaggaca

SEQ ID NO: 1103016 - RNA, 22 nt, Human
agcccaggucuggcccagccug

SEQ ID NO: 1103017 - RNA, 22 nt, Human
gccuccggaguugcagugucuu

SEQ ID NO: 1103018 - RNA, 22 nt, Human
cuugggaaugcuaacagaugac

SEQ ID NO: 1103019 - RNA, 22 nt, Human
ccuggcagccucagccaauucu

SEQ ID NO: 1103020 - RNA, 22 nt, Human
uacacacaugcauuugccuuau

SEQ ID NO: 1103021 - RNA, 22 nt, Human
gcuggcagguaaagccccgggg

SEQ ID NO: 1103022 - RNA, 22 nt, Human
gggccccuugcugcucugcugg

SEQ ID NO: 1103023 - RNA, 22 nt, Human
cugccugcucuauccaggccug

SEQ ID NO: 1103024 - RNA, 22 nt, Human
uccuggcagcccgcaggugcug

SEQ ID NO: 1103025 - RNA, 20 nt, Human
gcuccaggucagagaggacg

SEQ ID NO: 1103026 - RNA, 22 nt, Human
cuuacaaauacacuuaggagag

SEQ ID NO: 1103027 - RNA, 22 nt, Human
ucuggcaggucaaucauucuuu

SEQ ID NO: 1103028 - RNA, 22 nt, Human
gcuggcaggguucucacugaaa

SEQ ID NO: 1103029 - RNA, 22 nt, Human
gguuccuucugaggucccugua

SEQ ID NO: 1103030 - RNA, 22 nt, Human
gcuggcaggauagaagucuaau

SEQ ID NO: 1103031 - RNA, 21 nt, Human
aacacauccagaguauuugac

SEQ ID NO: 1103032 - RNA, 22 nt, Human
cccugagcgugaggaggaagua

SEQ ID NO: 1103033 - RNA, 21 nt, Human
gggagggauggaaaugauguu

SEQ ID NO: 1103034 - RNA, 22 nt, Human
cagcccaggucucucuuccagu

SEQ ID NO: 1103035 - RNA, 22 nt, Human
uauucccauuccacuuaucaag

SEQ ID NO: 1103036 - RNA, 19 nt, Human
acuggcaguuucugcaugg

SEQ ID NO: 1103037 - RNA, 22 nt, Human
agcacaggaacauggagauggg

SEQ ID NO: 1103038 - RNA, 22 nt, Human
cagguuggggacuuaggaugac

SEQ ID NO: 1103039 - RNA, 19 nt, Human
ccagucccauacaggagau

SEQ ID NO: 1103040 - RNA, 22 nt, Human
cuccugaggacuucuauugggu

SEQ ID NO: 1103041 - RNA, 22 nt, Human
uccaggcuugagaccaggcucu

SEQ ID NO: 1103042 - RNA, 22 nt, Human
uccaaggcuccggcccuggcgu

SEQ ID NO: 1103043 - RNA, 22 nt, Human
aggaggcugggcacaguggccu

SEQ ID NO: 1103044 - RNA, 22 nt, Human
uacacagauuucaguaucauca

SEQ ID NO: 1103045 - RNA, 22 nt, Human
cacacauuucagaugcuacaau

SEQ ID NO: 1103046 - RNA, 22 nt, Human
ucccugccugacagcacccacc

SEQ ID NO: 1103047 - RNA, 21 nt, Human
guacacacagguggaugggcu

SEQ ID NO: 1103048 - RNA, 22 nt, Human
gcuccaggaggaugaccuuccu

SEQ ID NO: 1103049 - RNA, 22 nt, Human
aucacagagauugcuuuuaaaa

SEQ ID NO: 1103050 - RNA, 23 nt, Human
ucacauaauccuucauccacagg

SEQ ID NO: 1103051 - RNA, 22 nt, Human
cagaaagaccugggcucaagag

SEQ ID NO: 1103052 - RNA, 22 nt, Human
cuccuggcacucaguguggaag

SEQ ID NO: 1103053 - RNA, 22 nt, Human
uggcagagaacacggcugaucu

SEQ ID NO: 1103054 - RNA, 21 nt, Human
ccagcccagcugugucccagc

SEQ ID NO: 1103055 - RNA, 22 nt, Human
ucaggauggagggaagcacaga

SEQ ID NO: 1103056 - RNA, 22 nt, Human
uggccuccccuaacagccucuu

SEQ ID NO: 1103057 - RNA, 22 nt, Human
ucccacacagcccgcucaccgg

SEQ ID NO: 1103058 - RNA, 22 nt, Human
aggaggcugaacuagggucugg

SEQ ID NO: 1103059 - RNA, 22 nt, Human
cagguggguguaugaaugcaaa

SEQ ID NO: 1103060 - RNA, 21 nt, Human
acacacucugagucuucuauu

SEQ ID NO: 1103061 - RNA, 22 nt, Human
gagauggccagugccaggacaa

SEQ ID NO: 1103062 - RNA, 20 nt, Human
ccccacacuauugagcacuu

SEQ ID NO: 1103063 - RNA, 22 nt, Human
cagccaggauggagaacuguug

SEQ ID NO: 1103064 - RNA, 22 nt, Human
ccucugccaccucccacgaggc

SEQ ID NO: 1103065 - RNA, 22 nt, Human
aagaggucauaccagauaaggg

SEQ ID NO: 1103066 - RNA, 20 nt, Human
agggcugagaagggacuagc

SEQ ID NO: 1103067 - RNA, 21 nt, Human
ucacacacguuuccaagggca

SEQ ID NO: 1103068 - RNA, 22 nt, Human
ggcagagguagcuggaaccagg

SEQ ID NO: 1103069 - RNA, 22 nt, Human
cauacauuuauacacaucuaug

SEQ ID NO: 1103070 - RNA, 22 nt, Human
cagacagagucuucccaucagu

SEQ ID NO: 1103071 - RNA, 22 nt, Human
ucacauaaauuuaccagaugau

SEQ ID NO: 1103072 - RNA, 22 nt, Human
uccaggcaagggaggagcaugg

SEQ ID NO: 1103073 - RNA, 22 nt, Human
ccuggcagaauauuaaagugca

SEQ ID NO: 1103074 - RNA, 22 nt, Human
gaggggcuggguagggcaaccc

SEQ ID NO: 1103075 - RNA, 22 nt, Human
ucuggcaguugccgcuucaguc

SEQ ID NO: 1103076 - RNA, 19 nt, Human
acauucccaucagcaaugu

SEQ ID NO: 1103077 - RNA, 22 nt, Human
uacacacuuacuggagaugaag

SEQ ID NO: 1103078 - RNA, 22 nt, Human
acauacacaagcguacaugaac

SEQ ID NO: 1103079 - RNA, 22 nt, Human
ggagucugcucccagacaugau

SEQ ID NO: 1103080 - RNA, 22 nt, Human
uccuggcacuuugggggcucgc

SEQ ID NO: 1103081 - RNA, 22 nt, Human
uccaggcucccucaggaugcac

SEQ ID NO: 1103082 - RNA, 22 nt, Human
gggacaauggaggccucucucc

SEQ ID NO: 1103083 - RNA, 22 nt, Human
cuggcagguuuggugucuggug

SEQ ID NO: 1103084 - RNA, 22 nt, Human
ucuggcagaucuucccacguuu

SEQ ID NO: 1103085 - RNA, 22 nt, Human
gagaccucuugguaucgcuagg

SEQ ID NO: 1103086 - RNA, 22 nt, Human
auuccacagcuacaucaaucua

SEQ ID NO: 1103087 - RNA, 22 nt, Human
ugggacucacucuuuuggccag

SEQ ID NO: 1103088 - RNA, 22 nt, Human
gaggagcuguucccucaccucu

SEQ ID NO: 1103089 - RNA, 22 nt, Human
uugggaucucaaauccagcuau

SEQ ID NO: 1103090 - RNA, 22 nt, Human
ccuucucucugaagaccccaaa

SEQ ID NO: 1103091 - RNA, 22 nt, Human
ucuugggauagugucucauggc

SEQ ID NO: 1103092 - RNA, 22 nt, Human
gggccccuuguaucucuggcuc

SEQ ID NO: 1103093 - RNA, 22 nt, Human
ucccacauaugcaauccugaau

SEQ ID NO: 1103094 - RNA, 22 nt, Human
uccugagcuacaguaguaugau

SEQ ID NO: 1103095 - RNA, 22 nt, Human
ccuggcaguucaucaaauggca

SEQ ID NO: 1103096 - RNA, 22 nt, Human
ccaggcccugcuccucacacca

SEQ ID NO: 1103097 - RNA, 22 nt, Human
cuggccucuguguucaccauag

SEQ ID NO: 1103098 - RNA, 22 nt, Human
aagucguggcaggcuugcacga

SEQ ID NO: 1103099 - RNA, 22 nt, Human
ccuggcagguuacaaccaguua

SEQ ID NO: 1103100 - RNA, 20 nt, Human
ucccucccuccagcucuggg

SEQ ID NO: 1103101 - RNA, 22 nt, Human
acuggcagagggaaaaccauuc

SEQ ID NO: 1103102 - RNA, 22 nt, Human
acagguggaggcuuuaggaggu

SEQ ID NO: 1103103 - RNA, 22 nt, Human
ucccacaggaaaguagacauug

SEQ ID NO: 1103104 - RNA, 22 nt, Human
ugacaggaggcuugaggccagg

SEQ ID NO: 1103105 - RNA, 22 nt, Human
guacacacaaucucuggucagu

SEQ ID NO: 1103106 - RNA, 22 nt, Human
guccucuguuuccaucugacuu

SEQ ID NO: 1103107 - RNA, 23 nt, Human
acauacauggagauaaagugaug

SEQ ID NO: 1103108 - RNA, 22 nt, Human
gccccacagccugcggucucag

SEQ ID NO: 1103109 - RNA, 18 nt, Human
uccuggcagucagagagg

SEQ ID NO: 1103110 - RNA, 22 nt, Human
cuggcaugaaauggcaucucau

SEQ ID NO: 1103111 - RNA, 22 nt, Human
uguaaacagccccauggagagc

SEQ ID NO: 1103112 - RNA, 21 nt, Human
ucuggcaggaagacggauggg

SEQ ID NO: 1103113 - RNA, 22 nt, Human
ucuggcagcagcaucaguggcu

SEQ ID NO: 1103114 - RNA, 22 nt, Human
cacacaucaaccuagacauugu

SEQ ID NO: 1103115 - RNA, 22 nt, Human
uuguaaacugcugcaggagugc

SEQ ID NO: 1103116 - RNA, 22 nt, Human
cuccuggcaggcugagugaaau

SEQ ID NO: 1103117 - RNA, 22 nt, Human
accugccuaucagcugccugcu

SEQ ID NO: 1103118 - RNA, 22 nt, Human
ccaggcccaggguacugaccaa

SEQ ID NO: 1103119 - RNA, 18 nt, Human
ggcagggaaaagauaggg

SEQ ID NO: 1103120 - RNA, 22 nt, Human
cuguccagcuuggcuccugggg

SEQ ID NO: 1103121 - RNA, 22 nt, Human
cacacaucuuaucccaguuauu

SEQ ID NO: 1103122 - RNA, 22 nt, Human
uuccaggcaugucagacauagg

SEQ ID NO: 1103123 - RNA, 22 nt, Human
ccucagcugcuucccuggagcc

SEQ ID NO: 1103124 - RNA, 22 nt, Human
aaagagucuggcacuguaccag

SEQ ID NO: 1103125 - RNA, 22 nt, Human
cccugagcucaggcccuugggg

SEQ ID NO: 1103126 - RNA, 22 nt, Human
uccuggcaguaauuugauguug

SEQ ID NO: 1103127 - RNA, 22 nt, Human
acacaucagaaauaugaaugag

SEQ ID NO: 1103128 - RNA, 18 nt, Human
gacaaaaguacagacaga

SEQ ID NO: 1103129 - RNA, 22 nt, Human
uggcagagucaucacaucugga

SEQ ID NO: 1103130 - RNA, 22 nt, Human
acugagagucaagauagcaugg

SEQ ID NO: 1103131 - RNA, 22 nt, Human
ccuggcaggcaagaggaaggga

SEQ ID NO: 1103132 - RNA, 21 nt, Human
uccccacauuucuaaacagac

SEQ ID NO: 1103133 - RNA, 22 nt, Human
uccugcagccacugcaggcaga

SEQ ID NO: 1103134 - RNA, 22 nt, Human
acacaucaugccaaguuucacc

SEQ ID NO: 1103135 - RNA, 22 nt, Human
ucauggcacuuagcacaguccu

SEQ ID NO: 1103136 - RNA, 22 nt, Human
gccuggcacaggaauuaggagg

SEQ ID NO: 1103137 - RNA, 22 nt, Human
acacacagguaaaggagccugg

SEQ ID NO: 1103138 - RNA, 18 nt, Human
ccuagccuccaagcucau

SEQ ID NO: 1103139 - RNA, 22 nt, Human
uccuggcagaaauggggcugug

SEQ ID NO: 1103140 - RNA, 22 nt, Human
aggaagaacagauaauggacgc

SEQ ID NO: 1103141 - RNA, 22 nt, Human
ccuccuggcuuuucccauugaa

SEQ ID NO: 1103142 - RNA, 22 nt, Human
aggaaagauggaaggaggauaa

SEQ ID NO: 1103143 - RNA, 22 nt, Human
cccacacauuuuucacuuaccg

SEQ ID NO: 1103144 - RNA, 22 nt, Human
ugccugccaugcagaaagcuga

SEQ ID NO: 1103145 - RNA, 17 nt, Human
gcaucacagauaacacg

SEQ ID NO: 1103146 - RNA, 22 nt, Human
uucauugcaguucuucagguua

SEQ ID NO: 1103147 - RNA, 22 nt, Human
guugggaaggcaagaaguagaa

SEQ ID NO: 1103148 - RNA, 22 nt, Human
ucccacccauccugcaucucuu

SEQ ID NO: 1103149 - RNA, 22 nt, Human
ccagguccuguuuucaccacag

SEQ ID NO: 1103150 - RNA, 22 nt, Human
gcccacaccauuuauucuuugu

SEQ ID NO: 1103151 - RNA, 22 nt, Human
cacauacugagaaucacaccca

SEQ ID NO: 1103152 - RNA, 20 nt, Seoul virus
ucauguggaguuugcuauua

SEQ ID NO: 1103153 - RNA, 22 nt, Seoul virus
aaagaugaaauuaugugcaauc

SEQ ID NO: 1103154 - RNA, 22 nt, Human
acacacaugguauuguucagaa

SEQ ID NO: 1103155 - RNA, 22 nt, Human
cacuguccaugcuugcuaaccc

SEQ ID NO: 1103156 - RNA, 22 nt, Human
cuuacacagucuggcacuucuu

SEQ ID NO: 1103157 - RNA, 22 nt, Human
uuccuggcucacagcagugggg

SEQ ID NO: 1103158 - RNA, 22 nt, Human
gcagggacagggcagggccuuu

SEQ ID NO: 1103159 - RNA, 22 nt, Human
cccugccucugaagcugcucag

SEQ ID NO: 1103160 - RNA, 22 nt, Human
ccacacagggggaugaguuauu

SEQ ID NO: 1103161 - RNA, 22 nt, Human
augacugcucugggcucccaug

SEQ ID NO: 1103162 - RNA, 22 nt, Human
gagggugucugcguaacuggca

SEQ ID NO: 1103163 - RNA, 17 nt, Human
uccaggcagcaacugag

SEQ ID NO: 1103164 - RNA, 22 nt, Human
cugccugccacguucagcugua

SEQ ID NO: 1103165 - RNA, 22 nt, Human
ugacaggaggcuugaggccagg

SEQ ID NO: 1103166 - RNA, 20 nt, Human
ucccucccuccagcucuggg

SEQ ID NO: 1103167 - RNA, 22 nt, Human
cccuuccucccaggcuucugug

SEQ ID NO: 1103168 - RNA, 22 nt, Human
ucuggcagagauauccauccca

SEQ ID NO: 1103169 - RNA, 22 nt, Human
gucacaggccuggaugaggggc

SEQ ID NO: 1103170 - RNA, 22 nt, Human
gccuccggaguugcagugucuu

SEQ ID NO: 1103171 - RNA, 22 nt, Human
ugccugccaugcagaaagcuga

SEQ ID NO: 1103172 - RNA, 22 nt, Human
ucacacagcugacagagccuuu

SEQ ID NO: 1103173 - RNA, 21 nt, Human
ucuggcaguggucuuucaaau

SEQ ID NO: 1103174 - RNA, 18 nt, Human
cuccuggcugauggugag

SEQ ID NO: 1103175 - RNA, 22 nt, Human
uucaguuccauuucaggugggu

SEQ ID NO: 1103176 - RNA, 22 nt, Human
gacacagaaggucacauguuca

SEQ ID NO: 1103177 - RNA, 22 nt, Human
agcacaggcuuuggugugaggg

SEQ ID NO: 1103178 - RNA, 22 nt, Human
uccaggcuuuuucaugcugucu

SEQ ID NO: 1103179 - RNA, 22 nt, Human
gaggagcucaugaaagcggugu

SEQ ID NO: 1103180 - RNA, 22 nt, Human
ccuggcagaauauuaaagugca

SEQ ID NO: 1103181 - RNA, 22 nt, Human
uuccaggcaugucagacauagg

SEQ ID NO: 1103182 - RNA, 22 nt, Human
cuggcagguuuggugucuggug

SEQ ID NO: 1103183 - RNA, 22 nt, Human
cacauuccuggugcucagcagc

SEQ ID NO: 1103184 - RNA, 20 nt, Human
accccacagaguccauugca

SEQ ID NO: 1103185 - RNA, 22 nt, Human
aagagcacuaacagagcugaua

SEQ ID NO: 1103186 - RNA, 22 nt, Human
gcuggcagagacaagaagacua

SEQ ID NO: 1103187 - RNA, 22 nt, Human
ccagcccugccagagagagcug

SEQ ID NO: 1103188 - RNA, 22 nt, Human
uacacacagaggccaugggauu

SEQ ID NO: 1103189 - RNA, 22 nt, Human
uuggaaaguuuuuacugaagac

SEQ ID NO: 1103190 - RNA, 22 nt, Human
ccaccccaaaugaagaccucuc

SEQ ID NO: 1103191 - RNA, 22 nt, Human
ccucugccaccucccacgaggc

SEQ ID NO: 1103192 - RNA, 22 nt, Human
acuggcaguggcagcagaaaga

SEQ ID NO: 1103193 - RNA, 22 nt, Human
gcacacauucggauucuuaacc

SEQ ID NO: 1103194 - RNA, 22 nt, Human
cccagcccaucucaaaggucua

SEQ ID NO: 1103195 - RNA, 22 nt, Human
cugccugcuuaccaugcaucag

SEQ ID NO: 1103196 - RNA, 22 nt, Human
gccacagguacuaugggagaga

SEQ ID NO: 1103197 - RNA, 22 nt, Human
cagcccagccuugucucuuuau

SEQ ID NO: 1103198 - RNA, 22 nt, Human
acacagaguuugacacauggga

SEQ ID NO: 1103199 - RNA, 22 nt, Human
agguagggaagaaggcaugaaa

SEQ ID NO: 1103200 - RNA, 22 nt, Human
cgcauacauagaaacacacaga

SEQ ID NO: 1103201 - RNA, 22 nt, Human
agucacaguuucccugagagag

SEQ ID NO: 1103202 - RNA, 22 nt, Human
guugggaaggugaacaugaugc

SEQ ID NO: 1103203 - RNA, 22 nt, Human
auggccugaugcaccuguccca

SEQ ID NO: 1103204 - RNA, 22 nt, Human
ucacacacauuugcugucugau

SEQ ID NO: 1103205 - RNA, 22 nt, Human
gcuggcaggguucucacugaaa

SEQ ID NO: 1103206 - RNA, 20 nt, Human
aaaagagugcuucaacugcu

SEQ ID NO: 1103207 - RNA, 22 nt, Human
guacacacuauuuaaaguguuu

SEQ ID NO: 1103208 - RNA, 18 nt, Human
gacaaaaguacagacaga

SEQ ID NO: 1103209 - RNA, 22 nt, Human
cauucccacguguucuuugcuu

SEQ ID NO: 1103210 - RNA, 22 nt, Human
cuggccucagagggucauggug

SEQ ID NO: 1103211 - RNA, 22 nt, Human
cuccuggcaggcugagugaaau

SEQ ID NO: 1103212 - RNA, 22 nt, Human
ccacccuaacaauccuuacugu

SEQ ID NO: 1103213 - RNA, 22 nt, Human
agcagguugugauacacucaga

SEQ ID NO: 1103214 - RNA, 22 nt, Human
cuggcacgcccacguaggcacu

SEQ ID NO: 1103215 - RNA, 22 nt, Human
ggagcugaggcugaggccucac

SEQ ID NO: 1103216 - RNA, 22 nt, Human
cacccacauggaaauucacagu

SEQ ID NO: 1103217 - RNA, 18 nt, Human
ggcagggaaaagauaggg

SEQ ID NO: 1103218 - RNA, 22 nt, Human
gcacacaguauaugcucauuaa

SEQ ID NO: 1103219 - RNA, 19 nt, Human
agaggccucagcagcuggc

SEQ ID NO: 1103220 - RNA, 22 nt, Human
aggccacaguacuuugcagacc

SEQ ID NO: 1103221 - RNA, 20 nt, Human
cccagccccuaccuguugcc

SEQ ID NO: 1103222 - RNA, 22 nt, Human
uacacagaaccugguguacagu

SEQ ID NO: 1103223 - RNA, 22 nt, Human
uguuggaauuaggauacagagg

SEQ ID NO: 1103224 - RNA, 22 nt, Human
acacauaagaaacuacaaagag

SEQ ID NO: 1103225 - RNA, 22 nt, Human
gcacacacuguuuuccucacau

SEQ ID NO: 1103226 - RNA, 22 nt, Human
acacaucaugccaaguuucacc

SEQ ID NO: 1103227 - RNA, 22 nt, Human
cagaaagaccugggcucaagag

SEQ ID NO: 1103228 - RNA, 22 nt, Human
cugagcagugguucuugagcgc

SEQ ID NO: 1103229 - RNA, 22 nt, Human
guccucuguguaggcugcagac

SEQ ID NO: 1103230 - RNA, 20 nt, Human
gcuccaggucagagaggacg

SEQ ID NO: 1103231 - RNA, 22 nt, Human
ccuggcagacugugagggcagg

SEQ ID NO: 1103232 - RNA, 19 nt, Human
ccacacagugugcaauuua

SEQ ID NO: 1103233 - RNA, 22 nt, Human
uccaggcucuaggcugcucucc

SEQ ID NO: 1103234 - RNA, 22 nt, Human
aagucguggcaggcuugcacga

SEQ ID NO: 1103235 - RNA, 22 nt, Human
uuccaggcucccuuggaggugu

SEQ ID NO: 1103236 - RNA, 18 nt, Human
uccuggcagucagagagg

SEQ ID NO: 1103237 - RNA, 22 nt, Human
auggccuggggauuccugagca

SEQ ID NO: 1103238 - RNA, 22 nt, Human
guggcagugggaugcuaucagg

SEQ ID NO: 1103239 - RNA, 22 nt, Human
uacacagauaugugaucaauca

SEQ ID NO: 1103240 - RNA, 22 nt, Human
agggagacacaugaggaaguca

SEQ ID NO: 1103241 - RNA, 22 nt, Human
cccagccuacucugccauagca

SEQ ID NO: 1103242 - RNA, 22 nt, Human
cacacaucaaccuagacauugu

SEQ ID NO: 1103243 - RNA, 22 nt, Human
ucccacauaugcaauccugaau

SEQ ID NO: 1103244 - RNA, 22 nt, Human
uuuaaauuuagaagaaacacug

SEQ ID NO: 1103245 - RNA, 22 nt, Human
cuccuggcacugucuugaccca

SEQ ID NO: 1103246 - RNA, 22 nt, Human
gccuggcacaguagggacccaa

SEQ ID NO: 1103247 - RNA, 22 nt, Human
agcacagggacaaugccaggug

SEQ ID NO: 1103248 - RNA, 22 nt, Human
acacaucagaaauaugaaugag

SEQ ID NO: 1103249 - RNA, 22 nt, Human
gcuccaggaggaugaccuuccu

SEQ ID NO: 1103250 - RNA, 22 nt, Human
uggccuccccuaacagccucuu

SEQ ID NO: 1103251 - RNA, 22 nt, Human
gguucccggaucuccgaguccc

SEQ ID NO: 1103252 - RNA, 22 nt, Human
gaggcugcuuugaugacaggag

SEQ ID NO: 1103253 - RNA, 22 nt, Human
gagccugaugaaacaggcagac

SEQ ID NO: 1103254 - RNA, 22 nt, Human
aggggugugcauccuggaggau

SEQ ID NO: 1103255 - RNA, 22 nt, Human
ucccagccuuccagucugguuu

SEQ ID NO: 1103256 - RNA, 22 nt, Human
auguuggagucguaaggcaugg

SEQ ID NO: 1103257 - RNA, 22 nt, Human
cagguggguguaugaaugcaaa

SEQ ID NO: 1103258 - RNA, 22 nt, Human
uuccacauuccuuacauucaua

SEQ ID NO: 1103259 - RNA, 22 nt, Human
acauacacaugaauauauuuuu

SEQ ID NO: 1103260 - RNA, 22 nt, Human
guccuggcugguucuguggggc

SEQ ID NO: 1103261 - RNA, 22 nt, Human
ggaggacaggggcugcagcaca

SEQ ID NO: 1103262 - RNA, 22 nt, Human
ggcacagggggcugaggacuag

SEQ ID NO: 1103263 - RNA, 22 nt, Human
cuccucuggguccugguggcca

SEQ ID NO: 1103264 - RNA, 22 nt, Human
cuggcaguuggcauuggcaucu

SEQ ID NO: 1103265 - RNA, 22 nt, Human
uggcagugggaauggacaaaca

SEQ ID NO: 1103266 - RNA, 22 nt, Human
ggagcugaaggggugggcucag

SEQ ID NO: 1103267 - RNA, 22 nt, Human
gcuggcaguuuccucaccgagg

SEQ ID NO: 1103268 - RNA, 20 nt, Human
auacacaugcagacagaugc

SEQ ID NO: 1103269 - RNA, 22 nt, Human
acagaguccuagcugcaaagaa

SEQ ID NO: 1103270 - RNA, 22 nt, Human
uugggaaguuuaaugacagacu

SEQ ID NO: 1103271 - RNA, 22 nt, Human
gaugccuggcacccagcaagga

SEQ ID NO: 1103272 - RNA, 22 nt, Human
uuccuggccuaagguaggugac

SEQ ID NO: 1103273 - RNA, 22 nt, Human
uccuggcauccgugggucugug

SEQ ID NO: 1103274 - RNA, 22 nt, Human
acacacaugcaugcuugccauu

SEQ ID NO: 1103275 - RNA, 22 nt, Human
ccaggcccaggguacugaccaa

SEQ ID NO: 1103276 - RNA, 22 nt, Human
uggccucugugggagcugagca

SEQ ID NO: 1103277 - RNA, 22 nt, Human
ucuggcagagucagugcacaca

SEQ ID NO: 1103278 - RNA, 22 nt, Human
uauguaaaguagauggcaggua

SEQ ID NO: 1103279 - RNA, 22 nt, Human
ucaucacauaugucaugauuug

SEQ ID NO: 1103280 - RNA, 22 nt, Human
uccuggcagagggcggccucga

SEQ ID NO: 1103281 - RNA, 22 nt, Human
gcacacaugcaugcacaggagu

SEQ ID NO: 1103282 - RNA, 22 nt, Human
gcuggcaggauagaagucuaau

SEQ ID NO: 1103283 - RNA, 22 nt, Human
cccacccugggaagcuaggcag

SEQ ID NO: 1103284 - RNA, 17 nt, Human
uugggagagaaagguau

SEQ ID NO: 1103285 - RNA, 22 nt, Human
uccccaccuaagauacccaucu

SEQ ID NO: 1103286 - RNA, 23 nt, Human
uguaaacaucacccccuggaguu

SEQ ID NO: 1103287 - RNA, 22 nt, Human
agggccccauagucacugcccg

SEQ ID NO: 1103288 - RNA, 22 nt, Human
cccuuccuugauuuuaacugga

SEQ ID NO: 1103289 - RNA, 21 nt, Human
guacacacagguggaugggcu

SEQ ID NO: 1103290 - RNA, 22 nt, Human
ggcagugagaggucuccugguc

SEQ ID NO: 1103291 - RNA, 22 nt, Human
uuccuggcagaggccccgacag

SEQ ID NO: 1103292 - RNA, 22 nt, Human
cacuguccaauagauacauaau

SEQ ID NO: 1103293 - RNA, 22 nt, Human
guacacacuguuugaucauuuc

SEQ ID NO: 1103294 - RNA, 22 nt, Human
ccuggcagguuacaaccaguua

SEQ ID NO: 1103295 - RNA, 22 nt, Human
cuccaggccauggcugcggagg

SEQ ID NO: 1103296 - RNA, 18 nt, Human
uguagagccagguuugcc

SEQ ID NO: 1103297 - RNA, 22 nt, Human
cagccaggauggagaacuguug

SEQ ID NO: 1103298 - RNA, 22 nt, Human
acuggcagggggagccccgaga

SEQ ID NO: 1103299 - RNA, 22 nt, Human
uggcgucucucauaaguaugug

SEQ ID NO: 1103300 - RNA, 22 nt, Human
aaagaucaauagauaaagcuac

SEQ ID NO: 1103301 - RNA, 22 nt, Human
cuggcaggagcauucacagagg

SEQ ID NO: 1103302 - RNA, 22 nt, Human
gagaaagaugaagaguggcguu

SEQ ID NO: 1103303 - RNA, 19 nt, Human
ccagcccacagugacuuuc

SEQ ID NO: 1103304 - RNA, 22 nt, Human
cccagccuuugcuuccugguuc

SEQ ID NO: 1103305 - RNA, 19 nt, Human
acauucccaucagcaaugu

SEQ ID NO: 1103306 - RNA, 20 nt, Human
ucuggcaggugaacgagcug

SEQ ID NO: 1103307 - RNA, 22 nt, Human
agcacaggaacauggagauggg

SEQ ID NO: 1103308 - RNA, 22 nt, Human
ucccacccauccugcaucucuu

SEQ ID NO: 1103309 - RNA, 22 nt, Human
uucccacauucuuuacauucau

SEQ ID NO: 1103310 - RNA, 22 nt, Human
gcuggcagggacagcugcgugu

SEQ ID NO: 1103311 - RNA, 22 nt, Human
ccagcccuuagauaaaccuggc

SEQ ID NO: 1103312 - RNA, 18 nt, Human
acucugcggaggccccag

SEQ ID NO: 1103313 - RNA, 22 nt, Human
cugccugcucaccagggcucug

SEQ ID NO: 1103314 - RNA, 22 nt, Human
ucuggcagagugauaggauaag

SEQ ID NO: 1103315 - RNA, 22 nt, Human
uuccaggccgggcaggaaacac

SEQ ID NO: 1103316 - RNA, 22 nt, Human
ccuggcagacagcacugaagcu

SEQ ID NO: 1103317 - RNA, 22 nt, Human
gaagagaaaggcaaggaguuuu

SEQ ID NO: 1103318 - RNA, 22 nt, Human
gguggcauaagaacacuaaaga

SEQ ID NO: 1103319 - RNA, 22 nt, Human
acacacuuuaaauuaaaccucu

SEQ ID NO: 1103320 - RNA, 22 nt, Human
gaggcacagucccgaggcaagg

SEQ ID NO: 1103321 - RNA, 18 nt, Human
cuccuccacagccccugc

SEQ ID NO: 1103322 - RNA, 22 nt, Human
ucacacagcuccuuuccuuagu

SEQ ID NO: 1103323 - RNA, 22 nt, Human
gguuccuucugaggucccugua

SEQ ID NO: 1103324 - RNA, 22 nt, Human
acuggcagagacccugauggcc

SEQ ID NO: 1103325 - RNA, 22 nt, Human
cuccaggcucguccaagaucga

SEQ ID NO: 1103326 - RNA, 22 nt, Human
uccuggcagugcuuguuuugga

SEQ ID NO: 1103327 - RNA, 22 nt, Human
ucuggcagcgaagcguguacuu

SEQ ID NO: 1103328 - RNA, 22 nt, Human
agggcugacaaauggcagugac

SEQ ID NO: 1103329 - RNA, 22 nt, Human
cacacacugacaccuuaucuug

SEQ ID NO: 1103330 - RNA, 22 nt, Human
uucccacagagauuacauugaa

SEQ ID NO: 1103331 - RNA, 22 nt, Human
cuggcagucugguggaaggccu

SEQ ID NO: 1103332 - RNA, 22 nt, Human
gagauggccagugccaggacaa

SEQ ID NO: 1103333 - RNA, 18 nt, Human
cccacacagcaguagcuc

SEQ ID NO: 1103334 - RNA, 22 nt, Human
ucccacacuacacgguuguugg

SEQ ID NO: 1103335 - RNA, 19 nt, Human
ucuggcagguaauuaggga

SEQ ID NO: 1103336 - RNA, 22 nt, Human
ccuggcaggcuggggacagugc

SEQ ID NO: 1103337 - RNA, 22 nt, Human
ucuggcagugaagucaugaggu

SEQ ID NO: 1103338 - RNA, 22 nt, Human
cugccucuauaggaguccacca

SEQ ID NO: 1103339 - RNA, 22 nt, Human
aggcaguguguagcuggaagag

SEQ ID NO: 1103340 - RNA, 22 nt, Human
cuuacaaauacacuuaggagag

SEQ ID NO: 1103341 - RNA, 22 nt, Human
gagagaaaagggggaauugauu

SEQ ID NO: 1103342 - RNA, 17 nt, Human
gccuucucugcccucac

SEQ ID NO: 1103343 - RNA, 22 nt, Human
gggccccuugcugcucugcugg

SEQ ID NO: 1103344 - RNA, 22 nt, Human
uccaggaggaggaaggcugcca

SEQ ID NO: 1103345 - RNA, 22 nt, Human
uccaggcuccccugcgugcucc

SEQ ID NO: 1103346 - RNA, 22 nt, Human
cccugagcucaggcccuugggg

SEQ ID NO: 1103347 - RNA, 22 nt, Human
gccgggaccaaggccacggagc

SEQ ID NO: 1103348 - RNA, 22 nt, Human
ggggcugagucagugggaagag

SEQ ID NO: 1103349 - RNA, 22 nt, Human
aggcacaggaggugguaagaag

SEQ ID NO: 1103350 - RNA, 22 nt, Human
guccucugggagccuugagccu

SEQ ID NO: 1103351 - RNA, 22 nt, Human
aggacacacagaauacaaaucc

SEQ ID NO: 1103352 - RNA, 19 nt, Human
uggcagguagugagcaguc

SEQ ID NO: 1103353 - RNA, 22 nt, Human
guccucugucccuggggcacgg

SEQ ID NO: 1103354 - RNA, 22 nt, Human
aagagccagcuagugaagaggc

SEQ ID NO: 1103355 - RNA, 21 nt, Human
uccccacauuucuaaacagac

SEQ ID NO: 1103356 - RNA, 22 nt, Human
cuggccucuguguucaccauag

SEQ ID NO: 1103357 - RNA, 22 nt, Human
ucuggcagugagcaacuugaca

SEQ ID NO: 1103358 - RNA, 22 nt, Human
ccuggcagcaggugggcccgug

SEQ ID NO: 1103359 - RNA, 22 nt, Human
gaggcacauauauacagagccc

SEQ ID NO: 1103360 - RNA, 22 nt, Human
ggccucucagggcagagacccu

SEQ ID NO: 1103361 - RNA, 22 nt, Human
acauacacaagcguacaugaac

SEQ ID NO: 1103362 - RNA, 22 nt, Human
cacacacucuuccuggcaccua

SEQ ID NO: 1103363 - RNA, 22 nt, Human
ucuggcaggaccaugaagcgua

SEQ ID NO: 1103364 - RNA, 22 nt, Human
ggaggacacuggcucugccuuc

SEQ ID NO: 1103365 - RNA, 22 nt, Human
cccacccucaagggugucuaua

SEQ ID NO: 1103366 - RNA, 22 nt, Human
gccccaccuugagagcagaaac

SEQ ID NO: 1103367 - RNA, 22 nt, Human
gcuggcagugugaaugacaagc

SEQ ID NO: 1103368 - RNA, 22 nt, Human
cacacagaaccgcucgccacuu

SEQ ID NO: 1103369 - RNA, 18 nt, Human
acacacacaccuguguau

SEQ ID NO: 1103370 - RNA, 22 nt, Human
gaggcugcggggaggagccugc

SEQ ID NO: 1103371 - RNA, 22 nt, Human
ugggacucacucuuuuggccag

SEQ ID NO: 1103372 - RNA, 22 nt, Human
ucuggcagcucaguucaggucu

SEQ ID NO: 1103373 - RNA, 21 nt, Human
cccuugccugcacuccucggc

SEQ ID NO: 1103374 - RNA, 22 nt, Human
ccuggcagcgugccgagcugcg

SEQ ID NO: 1103375 - RNA, 22 nt, Human
cucuccagccuuuagcccacgc

SEQ ID NO: 1103376 - RNA, 18 nt, Human
acaggcugugggaauggu

SEQ ID NO: 1103377 - RNA, 22 nt, Human
gcacauaacugaccacaucuaa

SEQ ID NO: 1103378 - RNA, 22 nt, Human
gagaaagauguaggcugggagg

SEQ ID NO: 1103379 - RNA, 22 nt, Human
guccucuguuuccaucugacuu

SEQ ID NO: 1103380 - RNA, 22 nt, Human
ccuggcuccugccucugcaggg

SEQ ID NO: 1103381 - RNA, 18 nt, Human
aggaaagaaaggcaggug

SEQ ID NO: 1103382 - RNA, 22 nt, Human
uacacaucacuguaucuuucag

SEQ ID NO: 1103383 - RNA, 22 nt, Human
acagguggggcacuuggagccu

SEQ ID NO: 1103384 - RNA, 19 nt, Human
guccuggcgccgccacacc

SEQ ID NO: 1103385 - RNA, 22 nt, Human
gagaaagauuguccuucagggg

SEQ ID NO: 1103386 - RNA, 22 nt, Human
uccugcagccacugcaggcaga

SEQ ID NO: 1103387 - RNA, 22 nt, Human
gacucugggcugagccagggcc

SEQ ID NO: 1103388 - RNA, 22 nt, Human
aggacaagcuaaaggacuuccu

SEQ ID NO: 1103389 - RNA, 22 nt, Human
gucacaggcaguaacuaggacc

SEQ ID NO: 1103390 - RNA, 23 nt, Human
uccaggagcaugcuggcuggcga

SEQ ID NO: 1103391 - RNA, 23 nt, Human
uuccaggcagagcagggauuaga

SEQ ID NO: 1103392 - RNA, 22 nt, Human
acuggcagccacaacuggcagg

SEQ ID NO: 1103393 - RNA, 22 nt, Human
ccuggcagguggagguugcagu

SEQ ID NO: 1103394 - RNA, 22 nt, Human
gagacaucauaaugaaguuucc

SEQ ID NO: 1103395 - RNA, 22 nt, Human
uauuacagaaucaggcauaacu

SEQ ID NO: 1103396 - RNA, 22 nt, Human
accugccuauggagccacaugg

SEQ ID NO: 1103397 - RNA, 22 nt, Human
uccugagcugccgcaucagcag

SEQ ID NO: 1103398 - RNA, 22 nt, Human
agggcugaagggaggugcucau

SEQ ID NO: 1103399 - RNA, 22 nt, Human
ucccacaccugucuauuccuag

SEQ ID NO: 1103400 - RNA, 16 nt, Human
ucacauacuuccuugc

SEQ ID NO: 1103401 - RNA, 21 nt, Human
ugacugaggcuucuucacaca

SEQ ID NO: 1103402 - RNA, 22 nt, Human
cagucccaugagcccagaacau

SEQ ID NO: 1103403 - RNA, 22 nt, Human
acuggcagaacgugaugcgggu

SEQ ID NO: 1103404 - RNA, 22 nt, Human
guugggaaggcaagaaguagaa

SEQ ID NO: 1103405 - RNA, 22 nt, Human
uggcagagcccagacuccaguc

SEQ ID NO: 1103406 - RNA, 22 nt, Human
aucucccagccacagcauucuu

SEQ ID NO: 1103407 - RNA, 22 nt, Human
ugaguagagaauucagcuaagg

SEQ ID NO: 1103408 - RNA, 22 nt, Human
aacacagaucaaaauauuuccu

SEQ ID NO: 1103409 - RNA, 22 nt, Human
auggcagaccuccuggccacaa

SEQ ID NO: 1103410 - RNA, 22 nt, Human
cacaacuuuaggaaccacauuc

SEQ ID NO: 1103411 - RNA, 22 nt, Human
agacacagcugcaggagguggg

SEQ ID NO: 1103412 - RNA, 19 nt, Human
cugagagaugcuucacaca

SEQ ID NO: 1103413 - RNA, 22 nt, Human
ccuggcaggccccuccuggauu

SEQ ID NO: 1103414 - RNA, 22 nt, Human
uggccugccacugccacgccac

SEQ ID NO: 1103415 - RNA, 22 nt, Human
caggcuggagugcaauggcaca

SEQ ID NO: 1103416 - RNA, 22 nt, Human
acacacuguaaggacuaucacu

SEQ ID NO: 1103417 - RNA, 22 nt, Human
uacaaaaggaagagggaucuua

SEQ ID NO: 1103418 - RNA, 22 nt, Human
ccccacaccugccgggcagcag

SEQ ID NO: 1103419 - RNA, 22 nt, Human
acagacuggccugucucgcacc

SEQ ID NO: 1103420 - RNA, 22 nt, Human
gcuggcaggagccuuucccuuu

SEQ ID NO: 1103421 - RNA, 22 nt, Human
cuggccucauagccaagcugug

SEQ ID NO: 1103422 - RNA, 22 nt, Human
caggacaaagcccuuugagaaa

SEQ ID NO: 1103423 - RNA, 22 nt, Human
ucacauaaauuuaccagaugau

SEQ ID NO: 1103424 - RNA, 22 nt, Human
agaaagaggaugcagaucucau

SEQ ID NO: 1103425 - RNA, 22 nt, Human
uccaaggcuccggcccuggcgu

SEQ ID NO: 1103426 - RNA, 17 nt, Human
ugcuggcaacauacaaa

SEQ ID NO: 1103427 - RNA, 22 nt, Human
gguguugggcucacugguccuu

SEQ ID NO: 1103428 - RNA, 22 nt, Human
acacaucuuagacugaaauaug

SEQ ID NO: 1103429 - RNA, 22 nt, Human
auuccacagcuacaucaaucua

SEQ ID NO: 1103430 - RNA, 21 nt, Human
ccuagccucuuacccagcuuu

SEQ ID NO: 1103431 - RNA, 22 nt, Human
ugcuccagugccugccccacag

SEQ ID NO: 1103432 - RNA, 22 nt, Human
gccuggcaauggccucaggaag

SEQ ID NO: 1103433 - RNA, 22 nt, Human
cuggccuggggggacacauccc

SEQ ID NO: 1103434 - RNA, 22 nt, Human
acuggcagagggaaaaccauuc

SEQ ID NO: 1103435 - RNA, 22 nt, Human
ccuggcagcuccuccccggcgg

SEQ ID NO: 1103436 - RNA, 22 nt, Human
ucccaccccggucaagggcuga

SEQ ID NO: 1103437 - RNA, 22 nt, Human
gacacagaauuuacucccgaua

SEQ ID NO: 1103438 - RNA, 22 nt, Human
gacugccucaguuucccugcag

SEQ ID NO: 1103439 - RNA, 22 nt, Human
uccccaccccagaacuacuagg

SEQ ID NO: 1103440 - RNA, 22 nt, Human
gggccccuuguaucucuggcuc

SEQ ID NO: 1103441 - RNA, 22 nt, Human
gaggggcuggguagggcaaccc

SEQ ID NO: 1103442 - RNA, 22 nt, Human
ccuggcagcagcacaugccuuc

SEQ ID NO: 1103443 - RNA, 22 nt, Human
gcacacaggcaguuuccagcca

SEQ ID NO: 1103444 - RNA, 22 nt, Human
uuccagcccgcgacuuguucag

SEQ ID NO: 1103445 - RNA, 22 nt, Human
gguggcagaggugcaucagccc

SEQ ID NO: 1103446 - RNA, 22 nt, Human
cuguccuccagacgacaguccc

SEQ ID NO: 1103447 - RNA, 22 nt, Human
uccaggcuaauuuugcauuguu

SEQ ID NO: 1103448 - RNA, 22 nt, Human
cccagccucuguuugcuccucu

SEQ ID NO: 1103449 - RNA, 22 nt, Human
uccuggcagaaauggggcugug

SEQ ID NO: 1103450 - RNA, 22 nt, Human
aaaaagucugcaaaggagguug

SEQ ID NO: 1103451 - RNA, 22 nt, Human
acaucacagagcccagauaaag

SEQ ID NO: 1103452 - RNA, 22 nt, Human
guccucuguuagaaaugugcuu

SEQ ID NO: 1103453 - RNA, 22 nt, Human
ucccacaugugaauccucaggu

SEQ ID NO: 1103454 - RNA, 22 nt, Human
uccaggccauugacugcauccu

SEQ ID NO: 1103455 - RNA, 22 nt, Human
uacacaucccagacucccagga

SEQ ID NO: 1103456 - RNA, 19 nt, Human
acuggcagggcugcggugg

SEQ ID NO: 1103457 - RNA, 22 nt, Human
acuggcagaauugaauaguugu

SEQ ID NO: 1103458 - RNA, 20 nt, Human
aagagucuuuacugagcuaa

SEQ ID NO: 1103459 - RNA, 22 nt, Human
acacacaugccuuuccuaagua

SEQ ID NO: 1103460 - RNA, 19 nt, Human
uccuggcacaguggaacca

SEQ ID NO: 1103461 - RNA, 20 nt, Human
ccccacacuauugagcacuu

SEQ ID NO: 1103462 - RNA, 22 nt, Human
cacauaagaaaugaauaugaga

SEQ ID NO: 1103463 - RNA, 22 nt, Human
acacaucucaggggacacucuc

SEQ ID NO: 1103464 - RNA, 22 nt, Human
acacucacccucccacugccug

SEQ ID NO: 1103465 - RNA, 21 nt, Human
acauacauaccuuaccaccuu

SEQ ID NO: 1103466 - RNA, 22 nt, Human
uuccaggcugaugggccacagg

SEQ ID NO: 1103467 - RNA, 22 nt, Human
cucugagcagaggccguggcua

SEQ ID NO: 1103468 - RNA, 22 nt, Human
acuggcagagguuggacaccau

SEQ ID NO: 1103469 - RNA, 22 nt, Human
cacccacauuccaucacucugc

SEQ ID NO: 1103470 - RNA, 22 nt, Human
cacaauguauauguauaucaaa

SEQ ID NO: 1103471 - RNA, 22 nt, Human
cacacaucuuaucccaguuauu

SEQ ID NO: 1103472 - RNA, 22 nt, Human
agacacagucugucuggaggag

SEQ ID NO: 1103473 - RNA, 22 nt, Human
cucagccccaauucuccccauu

SEQ ID NO: 1103474 - RNA, 22 nt, Human
ggcaaggggucaggcugagaca

SEQ ID NO: 1103475 - RNA, 22 nt, Human
guggcagugaaggucauagcau

SEQ ID NO: 1103476 - RNA, 22 nt, Human
ccagguccuguuuucaccacag

SEQ ID NO: 1103477 - RNA, 22 nt, Human
ugcucuguauucuauggcaguu

SEQ ID NO: 1103478 - RNA, 19 nt, Human
gcuggcagaauuuugaacc

SEQ ID NO: 1103479 - RNA, 23 nt, Human
uugggaaauaguuaagacaugag

SEQ ID NO: 1103480 - RNA, 22 nt, Human
gauggcagguaguggucucauc

SEQ ID NO: 1103481 - RNA, 22 nt, Human
ggugccagaguggcccaggggc

SEQ ID NO: 1103482 - RNA, 22 nt, Human
gugggagaaauuagcucuaguu

SEQ ID NO: 1103483 - RNA, 22 nt, Human
ccagcccugucaccaacuggag

SEQ ID NO: 1103484 - RNA, 20 nt, Human
cccacacccuucccacuugg

SEQ ID NO: 1103485 - RNA, 22 nt, Human
gacacauaugcguauaguuuag

SEQ ID NO: 1103486 - RNA, 22 nt, Human
guccucugcuucaugcccugau

SEQ ID NO: 1103487 - RNA, 22 nt, Human
ccugccuguacuagagacccag

SEQ ID NO: 1103488 - RNA, 22 nt, Human
uggcaguggauaggggagcggu

SEQ ID NO: 1103489 - RNA, 19 nt, Human
cagcccucuuaccacugug

SEQ ID NO: 1103490 - RNA, 22 nt, Human
ucccuccccacuucugagcuuu

SEQ ID NO: 1103491 - RNA, 22 nt, Human
aggcaguggagcuggaauaggc

SEQ ID NO: 1103492 - RNA, 22 nt, Human
ugcagagagauccucaggguuu

SEQ ID NO: 1103493 - RNA, 23 nt, Human
acuccccagucucuucuugccaa

SEQ ID NO: 1103494 - RNA, 22 nt, Human
cacaauuuuaauacacagucaa

SEQ ID NO: 1103495 - RNA, 22 nt, Human
ccagcccuugcugaaggguggc

SEQ ID NO: 1103496 - RNA, 22 nt, Human
ccuggcagcuaagugcuuugag

SEQ ID NO: 1103497 - RNA, 20 nt, Human
ucacacaugguaagcuauga

SEQ ID NO: 1103498 - RNA, 21 nt, Human
ucacacacguuuccaagggca

SEQ ID NO: 1103499 - RNA, 22 nt, Human
aucccacaccccuacaacauau

SEQ ID NO: 1103500 - RNA, 22 nt, Human
cccugccuugggguccacaccg

SEQ ID NO: 1103501 - RNA, 22 nt, Human
uggcagagagagugcagucgac

SEQ ID NO: 1103502 - RNA, 22 nt, Human
uccuggcacccuuggguuggag

SEQ ID NO: 1103503 - RNA, 21 nt, Human
uccugccuuaguccagagcag

SEQ ID NO: 1103504 - RNA, 22 nt, Human
gccuggcaggccuguuggggcu

SEQ ID NO: 1103505 - RNA, 22 nt, Human
agaggccuccgaaaggugggcu

SEQ ID NO: 1103506 - RNA, 22 nt, Human
gcacacaggggaguucucagaa

SEQ ID NO: 1103507 - RNA, 21 nt, Human
ucacguggucacaugagcuuu

SEQ ID NO: 1103508 - RNA, 22 nt, Human
ugaccaggauacugcagggaug

SEQ ID NO: 1103509 - RNA, 21 nt, Human
aacacauccagaguauuugac

SEQ ID NO: 1103510 - RNA, 22 nt, Human
ucccagccaggcucuaccacuu

SEQ ID NO: 1103511 - RNA, 22 nt, Human
aaagaucacgucccaggacucg

SEQ ID NO: 1103512 - RNA, 22 nt, Human
uauucccauuccacuuaucaag

SEQ ID NO: 1103513 - RNA, 22 nt, Human
caaauacuacgauucuugcagu

SEQ ID NO: 1103514 - RNA, 22 nt, Human
aacacauauuuauauaugcaca

SEQ ID NO: 1103515 - RNA, 22 nt, Human
cacauacauacguauguauaca

SEQ ID NO: 1103516 - RNA, 22 nt, Human
gagaaagacguaggcugggagg

SEQ ID NO: 1103517 - RNA, 22 nt, Human
uggcacucacucucagagucug

SEQ ID NO: 1103518 - RNA, 18 nt, Human
ccuggcagccaugcgcgc

SEQ ID NO: 1103519 - RNA, 20 nt, Human
uucaugggagcaaagaggcc

SEQ ID NO: 1103520 - RNA, 22 nt, Human
gacacauagaucuaucucacuc

SEQ ID NO: 1103521 - RNA, 22 nt, Human
caggagggcccgagacucuucc

SEQ ID NO: 1103522 - RNA, 22 nt, Human
ucacacaugcuaagccagagau

SEQ ID NO: 1103523 - RNA, 22 nt, Human
uggcaggaaaguaacagagcac

SEQ ID NO: 1103524 - RNA, 22 nt, Human
cacaucccuggaguuacccagu

SEQ ID NO: 1103525 - RNA, 22 nt, Human
guccucugagggggcugcacgc

SEQ ID NO: 1103526 - RNA, 22 nt, Human
acaggugguaaaauggacuguc

SEQ ID NO: 1103527 - RNA, 21 nt, Human
aaagagcccgcugagagguuc

SEQ ID NO: 1103528 - RNA, 22 nt, Human
auacacacugcuauccuuuuuu

SEQ ID NO: 1103529 - RNA, 22 nt, Human
acaggugguagaguggaaagag

SEQ ID NO: 1103530 - RNA, 21 nt, Human
ucuggcaggaagacggauggg

SEQ ID NO: 1103531 - RNA, 22 nt, Human
guccucugcccaggucaagguu

SEQ ID NO: 1103532 - RNA, 22 nt, Human
cuccuggcuuucccagaccagg

SEQ ID NO: 1103533 - RNA, 22 nt, Human
uaaaggguagguuuuacuguaa

SEQ ID NO: 1103534 - RNA, 22 nt, Human
ucaggcccuuugcugcugcccc

SEQ ID NO: 1103535 - RNA, 22 nt, Human
gcacucuccuggcugccacagu

SEQ ID NO: 1103536 - RNA, 22 nt, Human
cacauacugagaaucacaccca

SEQ ID NO: 1103537 - RNA, 22 nt, Human
gcuccaggugucccagguaaaa

SEQ ID NO: 1103538 - RNA, 22 nt, Human
uacacagauuucaguaucauca

SEQ ID NO: 1103539 - RNA, 22 nt, Human
ggagcugaaccccaucgugcug

SEQ ID NO: 1103540 - RNA, 22 nt, Human
agaggccugugugcuccagugg

SEQ ID NO: 1103541 - RNA, 22 nt, Human
cagguuggggacuuaggaugac

SEQ ID NO: 1103542 - RNA, 22 nt, Human
uccaggcuugagaccaggcucu

SEQ ID NO: 1103543 - RNA, 22 nt, Human
cucuccagaauaugccgccgug

SEQ ID NO: 1103544 - RNA, 22 nt, Human
cacacacaguuuuguauucugu

SEQ ID NO: 1103545 - RNA, 22 nt, Human
guacacacuauguauuguacac

SEQ ID NO: 1103546 - RNA, 22 nt, Human
cagcacagugaccagacccacu

SEQ ID NO: 1103547 - RNA, 20 nt, Human
agaggcuuccuugggaggag

SEQ ID NO: 1103548 - RNA, 22 nt, Human
cacacugucagguaaauaacac

SEQ ID NO: 1103549 - RNA, 20 nt, Human
gauacacagcacagagggcc

SEQ ID NO: 1103550 - RNA, 22 nt, Human
cacacacuguuaauguaggagu

SEQ ID NO: 1103551 - RNA, 23 nt, Human
uuggagagggugaguagugucag

SEQ ID NO: 1103552 - RNA, 22 nt, Human
ugcagagagaccccugggccag

SEQ ID NO: 1103553 - RNA, 22 nt, Human
ugguaagaacccaucagagaag

SEQ ID NO: 1103554 - RNA, 22 nt, Human
gccacauagaggaggauauuaa

SEQ ID NO: 1103555 - RNA, 22 nt, Human
ucauggcacuuagcacaguccu

SEQ ID NO: 1103556 - RNA, 22 nt, Human
ucacacacauaaucuaagauua

SEQ ID NO: 1103557 - RNA, 22 nt, Human
aaagagucguguuccagguuug

SEQ ID NO: 1103558 - RNA, 22 nt, Human
ucacauacacuaggauauuuuu

SEQ ID NO: 1103559 - RNA, 22 nt, Human
ggcccagccucagacaugcccu

SEQ ID NO: 1103560 - RNA, 22 nt, Human
guggcagucgcugacagauaca

SEQ ID NO: 1103561 - RNA, 21 nt, Human
acacacugaguuuuccacugu

SEQ ID NO: 1103562 - RNA, 22 nt, Human
ucuccacacuuucucucccagg

SEQ ID NO: 1103563 - RNA, 22 nt, Human
ucuggcagcaagucuguuucuc

SEQ ID NO: 1103564 - RNA, 19 nt, Human
gugggacagacauuacaua

SEQ ID NO: 1103565 - RNA, 22 nt, Human
ucuggcaggguguguauuuaca

SEQ ID NO: 1103566 - RNA, 22 nt, Human
ccaggccucuggcugcuuaguc

SEQ ID NO: 1103567 - RNA, 21 nt, Human
agagucugagugugcaagggc

SEQ ID NO: 1103568 - RNA, 22 nt, Human
cuguccagcuuggcuccugggg

SEQ ID NO: 1103569 - RNA, 22 nt, Human
ccacacagucaguuuccaagaa

SEQ ID NO: 1103570 - RNA, 22 nt, Human
acaucugaggagaccagccucu

SEQ ID NO: 1103571 - RNA, 22 nt, Human
ucccagccuggacccugccagu

SEQ ID NO: 1103572 - RNA, 22 nt, Human
uacauuccuguuagcaucuaag

SEQ ID NO: 1103573 - RNA, 22 nt, Human
uugggaucucaaauccagcuau

SEQ ID NO: 1103574 - RNA, 22 nt, Human
caccagggccccaggcugugcc

SEQ ID NO: 1103575 - RNA, 22 nt, Human
gccuggcaaggcccuguugacu

SEQ ID NO: 1103576 - RNA, 22 nt, Human
ccuggcagguagcauugaggag

SEQ ID NO: 1103577 - RNA, 22 nt, Human
uccacccugcuuuugucuuuga

SEQ ID NO: 1103578 - RNA, 22 nt, Human
aacaaaagccgaaguagguguc

SEQ ID NO: 1103579 - RNA, 22 nt, Human
gcuggcaggagaaacggggugc

SEQ ID NO: 1103580 - RNA, 22 nt, Human
gcccagccuccaagcuccaagg

SEQ ID NO: 1103581 - RNA, 20 nt, Human
gagucacagaagaagcugaa

SEQ ID NO: 1103582 - RNA, 22 nt, Human
guccucugaaguugugcaaugc

SEQ ID NO: 1103583 - RNA, 22 nt, Human
gagaccucuugguaucgcuagg

SEQ ID NO: 1103584 - RNA, 22 nt, Human
gcccucucuucugcagccucca

SEQ ID NO: 1103585 - RNA, 22 nt, Human
cacugucccuguuuccuggaaa

SEQ ID NO: 1103586 - RNA, 22 nt, Human
auagggccuaaaaaguauugcu

SEQ ID NO: 1103587 - RNA, 22 nt, Human
acuggcaggcugcuggccggcg

SEQ ID NO: 1103588 - RNA, 22 nt, Human
cuggcaguuugccaggagcucg

SEQ ID NO: 1103589 - RNA, 22 nt, Human
uagacacaucuucauccacaau

SEQ ID NO: 1103590 - RNA, 22 nt, Human
acacauuugcauaauaccucau

SEQ ID NO: 1103591 - RNA, 22 nt, Human
uccucuccaugucucacgccac

SEQ ID NO: 1103592 - RNA, 22 nt, Human
aagugccaucauagcauggcug

SEQ ID NO: 1103593 - RNA, 22 nt, Human
ggcacagagcuuugucccaguu

SEQ ID NO: 1103594 - RNA, 19 nt, Human
ccuugccugucccugcagc

SEQ ID NO: 1103595 - RNA, 22 nt, Human
aauggcagaggcaaagauggua

SEQ ID NO: 1103596 - RNA, 22 nt, Human
uuccuggcgccacggagccggu

SEQ ID NO: 1103597 - RNA, 22 nt, Human
gcccacacagcagauccuuugg

SEQ ID NO: 1103598 - RNA, 19 nt, Human
gggagcugaggucuuuggu

SEQ ID NO: 1103599 - RNA, 21 nt, Human
aggcugcuggcucaggguccu

SEQ ID NO: 1103600 - RNA, 22 nt, Human
aaaagagucuuaggcagucaua

SEQ ID NO: 1103601 - RNA, 22 nt, Human
gcagccucaaacuccccagcuc

SEQ ID NO: 1103602 - RNA, 22 nt, Human
uccugugccaucucuagagacu

SEQ ID NO: 1103603 - RNA, 22 nt, Human
ccucucagcgauuccucuugga

SEQ ID NO: 1103604 - RNA, 22 nt, Human
uccuggcagcccgcaggugcug

SEQ ID NO: 1103605 - RNA, 22 nt, Human
aggaggcugcaacccugaggcc

SEQ ID NO: 1103606 - RNA, 22 nt, Human
gccuggcauauaguaguugugc

SEQ ID NO: 1103607 - RNA, 22 nt, Human
ggcagagguagcuggaaccagg

SEQ ID NO: 1103608 - RNA, 22 nt, Human
ccuccccaugacccggugcugg

SEQ ID NO: 1103609 - RNA, 20 nt, Human
ugccuggccuuucucugccc

SEQ ID NO: 1103610 - RNA, 22 nt, Human
gaaagaagcuuuagauggcuau

SEQ ID NO: 1103611 - RNA, 22 nt, Human
gcuggcagggugguugagagag

SEQ ID NO: 1103612 - RNA, 22 nt, Human
uacacagacucuucaauucaga

SEQ ID NO: 1103613 - RNA, 22 nt, Human
cccacccugggcuacacaucca

SEQ ID NO: 1103614 - RNA, 22 nt, Human
cagggacaauggcagagccuga

SEQ ID NO: 1103615 - RNA, 22 nt, Human
uacacacuuacuggagaugaag

SEQ ID NO: 1103616 - RNA, 22 nt, Human
uccaggcuagguuuacaggaca

SEQ ID NO: 1103617 - RNA, 18 nt, Human
gccugcucugcucucccc

SEQ ID NO: 1103618 - RNA, 22 nt, Human
uccaggcucccucaggaugcac

SEQ ID NO: 1103619 - RNA, 22 nt, Human
ucuccugggaggacaaggaagg

SEQ ID NO: 1103620 - RNA, 22 nt, Human
auggccugcagugcugccacag

SEQ ID NO: 1103621 - RNA, 22 nt, Human
cuccuggcaguuccccuuguca

SEQ ID NO: 1103622 - RNA, 19 nt, Human
ccagucccauacaggagau

SEQ ID NO: 1103623 - RNA, 22 nt, Human
agcccagcuuugaaccauauca

SEQ ID NO: 1103624 - RNA, 22 nt, Human
ucaggagcucuucccuggugug

SEQ ID NO: 1103625 - RNA, 22 nt, Human
ucuggcaguggaugagggcagc

SEQ ID NO: 1103626 - RNA, 22 nt, Human
guccucugggcuuugagcaguc

SEQ ID NO: 1103627 - RNA, 22 nt, Human
aacacauaggcagagcaugaca

SEQ ID NO: 1103628 - RNA, 22 nt, Human
ugguccugccccgugcacagag

SEQ ID NO: 1103629 - RNA, 22 nt, Human
ucuggcaguuccuuguugauau

SEQ ID NO: 1103630 - RNA, 22 nt, Human
guacacacaaucucuggucagu

SEQ ID NO: 1103631 - RNA, 22 nt, Human
gcuggcaguguauuguuagcug

SEQ ID NO: 1103632 - RNA, 22 nt, Human
ucccagccuuucuuuucugcug

SEQ ID NO: 1103633 - RNA, 22 nt, Human
auccuggcccagguguggaggg

SEQ ID NO: 1103634 - RNA, 21 nt, Human
gggagggauggaaaugauguu

SEQ ID NO: 1103635 - RNA, 19 nt, Human
uccuggcauuuguaggaaa

SEQ ID NO: 1103636 - RNA, 22 nt, Human
cauacauuuauacacaucuaug

SEQ ID NO: 1103637 - RNA, 22 nt, Human
cagugggggggccaugcugcag

SEQ ID NO: 1103638 - RNA, 22 nt, Human
gaggacucugggcguguauggg

SEQ ID NO: 1103639 - RNA, 22 nt, Human
ucccugccugacagcacccacc

SEQ ID NO: 1103640 - RNA, 21 nt, Human
uccuguaagcuuggguggcuc

SEQ ID NO: 1103641 - RNA, 21 nt, Human
cacacagugaucuauccacau

SEQ ID NO: 1103642 - RNA, 22 nt, Human
cccacacacauuuaugauagga

SEQ ID NO: 1103643 - RNA, 22 nt, Human
gaaagacuuccuuugagaguac

SEQ ID NO: 1103644 - RNA, 22 nt, Human
uugggaagaauggaggugguua

SEQ ID NO: 1103645 - RNA, 23 nt, Human
ucacauaauccuucauccacagg

SEQ ID NO: 1103646 - RNA, 22 nt, Human
cugccugcucuauccaggccug

SEQ ID NO: 1103647 - RNA, 22 nt, Human
ccacacagauaaguguuuucua

SEQ ID NO: 1103648 - RNA, 22 nt, Human
ugcagagaaaacuccuggguac

SEQ ID NO: 1103649 - RNA, 22 nt, Human
gcuggcagguaaagccccgggg

SEQ ID NO: 1103650 - RNA, 22 nt, Human
ugccugacugcugccaccacua

SEQ ID NO: 1103651 - RNA, 22 nt, Human
ccccacccucgcuccauuucgg

SEQ ID NO: 1103652 - RNA, 22 nt, Human
ucuggcaggacaugcugaccau

SEQ ID NO: 1103653 - RNA, 22 nt, Human
aggguagggcccggagacagac

SEQ ID NO: 1103654 - RNA, 22 nt, Human
gaggcuguuaggagggacucug

SEQ ID NO: 1103655 - RNA, 17 nt, Human
ugccagccugucccagg

SEQ ID NO: 1103656 - RNA, 22 nt, Human
ucuggcagcaagauaacaaugg

SEQ ID NO: 1103657 - RNA, 22 nt, Human
uauucccagccucuuucuaucu

SEQ ID NO: 1103658 - RNA, 22 nt, Human
gcacacaguagggauucaauga

SEQ ID NO: 1103659 - RNA, 22 nt, Human
ccuucuucuguguggcccaaga

SEQ ID NO: 1103660 - RNA, 22 nt, Human
acccacacaucucuaauucagu

SEQ ID NO: 1103661 - RNA, 22 nt, Human
uggcagagagacucuccuugau

SEQ ID NO: 1103662 - RNA, 22 nt, Human
ugggagaaacugucucucccac

SEQ ID NO: 1103663 - RNA, 22 nt, Human
auccaggcgaaugcagaaggcc

SEQ ID NO: 1103664 - RNA, 19 nt, Human
ccuuccuccccagggccau

SEQ ID NO: 1103665 - RNA, 16 nt, Human
gcacacacaucaauga

SEQ ID NO: 1103666 - RNA, 22 nt, Human
ccuugcucaagcuagugacggg

SEQ ID NO: 1103667 - RNA, 22 nt, Human
gaccugccugagcugccucugc

SEQ ID NO: 1103668 - RNA, 22 nt, Human
ccuccagcgcgauccacuccgg

SEQ ID NO: 1103669 - RNA, 22 nt, Human
ccucucccgggugccgcugggc

SEQ ID NO: 1103670 - RNA, 22 nt, Human
agcacugugauuuauaacauuu

SEQ ID NO: 1103671 - RNA, 22 nt, Human
agcccaggucuggcccagccug

SEQ ID NO: 1103672 - RNA, 22 nt, Human
cuccuggcucgcccccagcuga

SEQ ID NO: 1103673 - RNA, 22 nt, Human
cagcccaggccgacaguuccuc

SEQ ID NO: 1103674 - RNA, 22 nt, Human
acagguggaggcuuuaggaggu

SEQ ID NO: 1103675 - RNA, 22 nt, Human
ucuggcagaggaaggaggccug

SEQ ID NO: 1103676 - RNA, 22 nt, Human
ggagccugaaaagucugcauuu

SEQ ID NO: 1103677 - RNA, 22 nt, Human
acuggcagguccaucgcccuuu

SEQ ID NO: 1103678 - RNA, 22 nt, Human
gaggagcuguucccucaccucu

SEQ ID NO: 1103679 - RNA, 22 nt, Human
aggccuccagccacaugccagu

SEQ ID NO: 1103680 - RNA, 22 nt, Human
cccuuccugggugucccggagu

SEQ ID NO: 1103681 - RNA, 22 nt, Human
gcacauaaagggcaugggaggu

SEQ ID NO: 1103682 - RNA, 23 nt, Human
guccucuggagagaaaggcagua

SEQ ID NO: 1103683 - RNA, 21 nt, Human
acacagaggcaucaucacuuu

SEQ ID NO: 1103684 - RNA, 22 nt, Human
agggcugacagugaggagucaa

SEQ ID NO: 1103685 - RNA, 21 nt, Human
uucucuccauaugcccagccc

SEQ ID NO: 1103686 - RNA, 22 nt, Human
ccauacacacaccaaauuugua

SEQ ID NO: 1103687 - RNA, 22 nt, Human
caugagauaauuuuucuccagu

SEQ ID NO: 1103688 - RNA, 22 nt, Human
aggaggcuuuugcaggugccac

SEQ ID NO: 1103689 - RNA, 22 nt, Human
aagaggucauaccagauaaggg

SEQ ID NO: 1103690 - RNA, 17 nt, Human
gcccacccuuaggagcu

SEQ ID NO: 1103691 - RNA, 22 nt, Human
ccuggcagguggcgcccucggc

SEQ ID NO: 1103692 - RNA, 22 nt, Human
uguaaacauaccagagccaagu

SEQ ID NO: 1103693 - RNA, 22 nt, Human
gacacagacaguuagagguaau

SEQ ID NO: 1103694 - RNA, 22 nt, Human
aggcuggauuuauggggacuuc

SEQ ID NO: 1103695 - RNA, 20 nt, Human
uuccacaucuuugcacaugc

SEQ ID NO: 1103696 - RNA, 22 nt, Human
gcccacaccauuuauucuuugu

SEQ ID NO: 1103697 - RNA, 22 nt, Human
gcacacacaugugaguacaugc

SEQ ID NO: 1103698 - RNA, 22 nt, Human
cagcccaggucucucuuccagu

SEQ ID NO: 1103699 - RNA, 22 nt, Human
acuggcaguagagggagcgcau

SEQ ID NO: 1103700 - RNA, 22 nt, Human
uccccacaucucugcaucaggc

SEQ ID NO: 1103701 - RNA, 17 nt, Human
cccaggccgccgggagc

SEQ ID NO: 1103702 - RNA, 22 nt, Human
acaucacacgccuuccaggagg

SEQ ID NO: 1103703 - RNA, 22 nt, Human
cagcccaaagccccaggcuaga

SEQ ID NO: 1103704 - RNA, 22 nt, Human
acaaauccagugaacuccagug

SEQ ID NO: 1103705 - RNA, 22 nt, Human
guccucugggcagcugccccac

SEQ ID NO: 1103706 - RNA, 22 nt, Human
gacuguggggggcggacacaag

SEQ ID NO: 1103707 - RNA, 22 nt, Human
cacagagacagaagcacuuaug

SEQ ID NO: 1103708 - RNA, 22 nt, Human
cuugccucccucagcucacagc

SEQ ID NO: 1103709 - RNA, 22 nt, Human
ccaucacaguccccaucgugau

SEQ ID NO: 1103710 - RNA, 22 nt, Human
guccucuguagggcugggccac

SEQ ID NO: 1103711 - RNA, 22 nt, Human
uggcaucuccgacagucuugau

SEQ ID NO: 1103712 - RNA, 22 nt, Human
cuaugagaagaaaacaagauua

SEQ ID NO: 1103713 - RNA, 22 nt, Human
uggaaagaggaagugcccagca

SEQ ID NO: 1103714 - RNA, 20 nt, Human
cacaacuguccacaugcucc

SEQ ID NO: 1103715 - RNA, 22 nt, Human
ucccacacagcccgcucaccgg

SEQ ID NO: 1103716 - RNA, 17 nt, Human
uuaagguggaucagcac

SEQ ID NO: 1103717 - RNA, 22 nt, Human
acccacaccuccguauaucacu

SEQ ID NO: 1103718 - RNA, 22 nt, Human
ccuggcaggcaagaggaaggga

SEQ ID NO: 1103719 - RNA, 22 nt, Human
gacccauauaggacccuccaaa

SEQ ID NO: 1103720 - RNA, 22 nt, Human
acaguucccgucuugcacagcu

SEQ ID NO: 1103721 - RNA, 22 nt, Human
gcuccaggagagggaagcagau

SEQ ID NO: 1103722 - RNA, 22 nt, Human
guccuggcccaggaguacacau

SEQ ID NO: 1103723 - RNA, 22 nt, Human
ucuggcaggucaaucauucuuu

SEQ ID NO: 1103724 - RNA, 22 nt, Human
gcuggcagucccaucagcuggg

SEQ ID NO: 1103725 - RNA, 22 nt, Human
cucucugggcccaguuggcacc

SEQ ID NO: 1103726 - RNA, 22 nt, Human
cugagccagggccacacaugga

SEQ ID NO: 1103727 - RNA, 21 nt, Human
cagcccagcccauugacagug

SEQ ID NO: 1103728 - RNA, 22 nt, Human
auccucuguggauuacaccuag

SEQ ID NO: 1103729 - RNA, 22 nt, Human
cgcugauaaacgucacguuccc

SEQ ID NO: 1103730 - RNA, 22 nt, Human
ucacacauuucucaaguguagg

SEQ ID NO: 1103731 - RNA, 22 nt, Human
acaugacuuuucucuuccagag

SEQ ID NO: 1103732 - RNA, 22 nt, Human
uccccacacagauacagaguag

SEQ ID NO: 1103733 - RNA, 22 nt, Human
uggcagugucuuaucaggagug

SEQ ID NO: 1103734 - RNA, 18 nt, Human
uccugccugugccccagg

SEQ ID NO: 1103735 - RNA, 22 nt, Human
ccaggcugggcggggaaccugg

SEQ ID NO: 1103736 - RNA, 21 nt, Human
ucuggcaggcacgggcccagc

SEQ ID NO: 1103737 - RNA, 22 nt, Human
ucccugcccucagugcacccgg

SEQ ID NO: 1103738 - RNA, 22 nt, Human
ucccaccccuugacucuuuaag

SEQ ID NO: 1103739 - RNA, 22 nt, Human
aaauacugcugcuauuccuuuu

SEQ ID NO: 1103740 - RNA, 22 nt, Human
cugcaggagcaaagccucugcu

SEQ ID NO: 1103741 - RNA, 22 nt, Human
uggcagagucaucacaucugga

SEQ ID NO: 1103742 - RNA, 22 nt, Human
uuccagccaugguuucccuaug

SEQ ID NO: 1103743 - RNA, 22 nt, Human
ggcccagcgaggccaccuacag

SEQ ID NO: 1103744 - RNA, 22 nt, Human
cucucuccuuagcugcagacca

SEQ ID NO: 1103745 - RNA, 21 nt, Human
agaugcugaugcugcaggucc

SEQ ID NO: 1103746 - RNA, 22 nt, Human
ggagucugcucccagacaugau

SEQ ID NO: 1103747 - RNA, 22 nt, Human
gauggccuggguccccuuccgg

SEQ ID NO: 1103748 - RNA, 22 nt, Human
acacacucaauugcauaagcac

SEQ ID NO: 1103749 - RNA, 21 nt, Human
gggcagaggggccuccugggu

SEQ ID NO: 1103750 - RNA, 22 nt, Human
caggauggucucgaucuccuga

SEQ ID NO: 1103751 - RNA, 22 nt, Human
gccuggcacucaaucaucugcu

SEQ ID NO: 1103752 - RNA, 22 nt, Human
uccccacacuuucacuccuggc

SEQ ID NO: 1103753 - RNA, 22 nt, Human
aggaagaaccuaagaaagucuc

SEQ ID NO: 1103754 - RNA, 22 nt, Human
uggcagagaacacacaugauuc

SEQ ID NO: 1103755 - RNA, 22 nt, Human
gcacaggaugauggguugaggg

SEQ ID NO: 1103756 - RNA, 22 nt, Human
uagauacaggcucucugagccu

SEQ ID NO: 1103757 - RNA, 22 nt, Human
acuccugggugcugaccagcgu

SEQ ID NO: 1103758 - RNA, 22 nt, Human
aggcaggggagcuggaagggua

SEQ ID NO: 1103759 - RNA, 22 nt, Human
cuggcaugaaauggcaucucau

SEQ ID NO: 1103760 - RNA, 22 nt, Human
guggcaguuuugacaucacaaa

SEQ ID NO: 1103761 - RNA, 23 nt, Human
uccuuccuuugagaggcuccauc

SEQ ID NO: 1103762 - RNA, 22 nt, Human
cacacauuucagaugcuacaau

SEQ ID NO: 1103763 - RNA, 22 nt, Human
agucuagggugggguccacagg

SEQ ID NO: 1103764 - RNA, 22 nt, Human
ucuuuuucugcacacguguccc

SEQ ID NO: 1103765 - RNA, 22 nt, Human
uucauugcaguucuucagguua

SEQ ID NO: 1103766 - RNA, 22 nt, Human
uggcagggugccaguugcgagu

SEQ ID NO: 1103767 - RNA, 22 nt, Human
auuccacacaguaauacucaau

SEQ ID NO: 1103768 - RNA, 22 nt, Human
uggaaagagguagaggaucugg

SEQ ID NO: 1103769 - RNA, 22 nt, Human
ucuggcaggcaaucggcucugg

SEQ ID NO: 1103770 - RNA, 22 nt, Human
cccagccuuccacccuggacua

SEQ ID NO: 1103771 - RNA, 20 nt, Human
aaagagcccuuggagcaggc

SEQ ID NO: 1103772 - RNA, 22 nt, Human
uccuggcaaagauguugguguu

SEQ ID NO: 1103773 - RNA, 22 nt, Human
gcacauacugcaaagauuacua

SEQ ID NO: 1103774 - RNA, 22 nt, Human
aggaagaacagauaauggacgc

SEQ ID NO: 1103775 - RNA, 22 nt, Human
auccaggccccaagaccccgac

SEQ ID NO: 1103776 - RNA, 22 nt, Human
gacacagagcucacagucuccu

SEQ ID NO: 1103777 - RNA, 22 nt, Human
gaggagcugggacccugucauc

SEQ ID NO: 1103778 - RNA, 22 nt, Human
cccacacaaaucauggggagaa

SEQ ID NO: 1103779 - RNA, 22 nt, Human
uuccugccccugagagcuccca

SEQ ID NO: 1103780 - RNA, 22 nt, Human
ucuggcagaaggcagaaauuca

SEQ ID NO: 1103781 - RNA, 22 nt, Human
accugccuaucagcugccugcu

SEQ ID NO: 1103782 - RNA, 22 nt, Human
ucuggcaguuugagaaaggcua

SEQ ID NO: 1103783 - RNA, 22 nt, Human
acagguccucaagucagcuggg

SEQ ID NO: 1103784 - RNA, 22 nt, Human
caggucccugcgccccggccuc

SEQ ID NO: 1103785 - RNA, 22 nt, Human
ccacacuaaacugcucaaacca

SEQ ID NO: 1103786 - RNA, 22 nt, Human
ucccacacuugaaacaaggcug

SEQ ID NO: 1103787 - RNA, 22 nt, Human
ccagccucacuggcaucaccua

SEQ ID NO: 1103788 - RNA, 22 nt, Human
ccacagaccuuggcuuccaccu

SEQ ID NO: 1103789 - RNA, 19 nt, Human
gcuggcagauguggccgug

SEQ ID NO: 1103790 - RNA, 22 nt, Human
cuccugaggacuucuauugggu

SEQ ID NO: 1103791 - RNA, 19 nt, Human
ugccuggcaccagcuccac

SEQ ID NO: 1103792 - RNA, 22 nt, Human
acaucacaguaguuaagccaga

SEQ ID NO: 1103793 - RNA, 22 nt, Human
ccucagcugcuucccuggagcc

SEQ ID NO: 1103794 - RNA, 20 nt, Human
acaaagacuggaaaagcaag

SEQ ID NO: 1103795 - RNA, 22 nt, Human
cucaccccacuaccccuuggug

SEQ ID NO: 1103796 - RNA, 22 nt, Human
ggagaagaggagcuggaagccu

SEQ ID NO: 1103797 - RNA, 22 nt, Human
ccuggcaguuuugcccaggauu

SEQ ID NO: 1103798 - RNA, 22 nt, Human
uugggaagaaacauguccauca

SEQ ID NO: 1103799 - RNA, 22 nt, Human
ucacacacauggauaguauuuu

SEQ ID NO: 1103800 - RNA, 22 nt, Human
acacauaagccuaaucaucucc

SEQ ID NO: 1103801 - RNA, 22 nt, Human
uccuucccaggugucgccgccu

SEQ ID NO: 1103802 - RNA, 19 nt, Human
acacauuugcacaauccac

SEQ ID NO: 1103803 - RNA, 22 nt, Human
ucaggcccuucucccaggacuc

SEQ ID NO: 1103804 - RNA, 22 nt, Human
cagguuggucggcaaguacaca

SEQ ID NO: 1103805 - RNA, 22 nt, Human
gauggccuuguuuucucccuuc

SEQ ID NO: 1103806 - RNA, 20 nt, Human
ccuggcaggcggguuacuua

SEQ ID NO: 1103807 - RNA, 22 nt, Human
agaggcuucucggauggggcag

SEQ ID NO: 1103808 - RNA, 22 nt, Human
ccaggcccugcuccucacacca

SEQ ID NO: 1103809 - RNA, 22 nt, Human
uacugacacaaagccaaucccu

SEQ ID NO: 1103810 - RNA, 22 nt, Human
aucacagagauugcuuuuaaaa

SEQ ID NO: 1103811 - RNA, 22 nt, Human
cagacagagucuucccaucagu

SEQ ID NO: 1103812 - RNA, 22 nt, Human
gcuggcagacugggggcagaac

SEQ ID NO: 1103813 - RNA, 22 nt, Human
gugugggaaggcuaggaugcug

SEQ ID NO: 1103814 - RNA, 22 nt, Human
ugagagucucagaccuccuggu

SEQ ID NO: 1103815 - RNA, 22 nt, Human
aggcugcuucagcugcagggag

SEQ ID NO: 1103816 - RNA, 22 nt, Human
acauaaugagcucuuuauaaau

SEQ ID NO: 1103817 - RNA, 22 nt, Human
uucccacaguguugaauccucu

SEQ ID NO: 1103818 - RNA, 22 nt, Human
cccgagugucuacucacuccca

SEQ ID NO: 1103819 - RNA, 22 nt, Human
ccacaucauggauacaguuaug

SEQ ID NO: 1103820 - RNA, 22 nt, Human
caauacugaguuuacauucauc

SEQ ID NO: 1103821 - RNA, 22 nt, Human
uguaaagaaagacgcagaguua

SEQ ID NO: 1103822 - RNA, 22 nt, Human
ugcacaggugagacucaggaag

SEQ ID NO: 1103823 - RNA, 22 nt, Human
acacagaugcauuacacaucua

SEQ ID NO: 1103824 - RNA, 22 nt, Human
ggagacucggguucuagccuug

SEQ ID NO: 1103825 - RNA, 22 nt, Human
uacaaaaguaauuacgguuuuu

SEQ ID NO: 1103826 - RNA, 22 nt, Human
gccuggcacaggaauuaggagg

SEQ ID NO: 1103827 - RNA, 22 nt, Human
uccugagcuacaguaguaugau

SEQ ID NO: 1103828 - RNA, 22 nt, Human
cacacagacagcucucugaaga

SEQ ID NO: 1103829 - RNA, 22 nt, Human
ucuggcagguucccauguuaug

SEQ ID NO: 1103830 - RNA, 21 nt, Human
acacacucugagucuucuauu

SEQ ID NO: 1103831 - RNA, 22 nt, Human
auccccacgauauagccaaagc

SEQ ID NO: 1103832 - RNA, 22 nt, Human
gcuggcagguccaagauagagc

SEQ ID NO: 1103833 - RNA, 22 nt, Human
acacacagaguuuauacaggca

SEQ ID NO: 1103834 - RNA, 22 nt, Human
ucccacauuacccugacugaca

SEQ ID NO: 1103835 - RNA, 22 nt, Human
cuuggcaggguggaggaugcag

SEQ ID NO: 1103836 - RNA, 22 nt, Human
ccccacccaccuaagagaaacu

SEQ ID NO: 1103837 - RNA, 22 nt, Human
acacacagaaggaagccccacu

SEQ ID NO: 1103838 - RNA, 22 nt, Human
acuggcagcuguaggaugcaug

SEQ ID NO: 1103839 - RNA, 22 nt, Human
aguugggaguuauagacucuau

SEQ ID NO: 1103840 - RNA, 22 nt, Human
gcccacacaccagcucaggagg

SEQ ID NO: 1103841 - RNA, 22 nt, Human
ccacauacaaauggggugcugu

SEQ ID NO: 1103842 - RNA, 22 nt, Human
guugggaagcagauggaugagc

SEQ ID NO: 1103843 - RNA, 22 nt, Human
caggaguggugugagggacucc

SEQ ID NO: 1103844 - RNA, 20 nt, Human
gcuggcagaugucuugagau

SEQ ID NO: 1103845 - RNA, 22 nt, Human
acugagagucaagauagcaugg

SEQ ID NO: 1103846 - RNA, 22 nt, Human
uacacauccauguuuugacuuu

SEQ ID NO: 1103847 - RNA, 22 nt, Human
acuggcaguuugagaaugcauu

SEQ ID NO: 1103848 - RNA, 22 nt, Human
uuggagagauuuaggucucagu

SEQ ID NO: 1103849 - RNA, 22 nt, Human
agcacaggaccaaggaagcugu

SEQ ID NO: 1103850 - RNA, 20 nt, Human
cugcuccacccggcucucag

SEQ ID NO: 1103851 - RNA, 22 nt, Human
ucuggcagugauuucugugauc

SEQ ID NO: 1103852 - RNA, 22 nt, Human
caucacagaaauaaacauaccu

SEQ ID NO: 1103853 - RNA, 22 nt, Human
ccuggcagcauugguagagauu

SEQ ID NO: 1103854 - RNA, 20 nt, Human
uggccucugagaugccacgg

SEQ ID NO: 1103855 - RNA, 22 nt, Human
ugcagagaagaggacaguucua

SEQ ID NO: 1103856 - RNA, 22 nt, Human
gcuccaggcagcauaguggaug

SEQ ID NO: 1103857 - RNA, 19 nt, Human
guccucucaacaacccggg

SEQ ID NO: 1103858 - RNA, 22 nt, Human
ugccucucuaacccaugcccaa

SEQ ID NO: 1103859 - RNA, 18 nt, Human
ccuagccuccaagcucau

SEQ ID NO: 1103860 - RNA, 22 nt, Human
cuugggaaugcuaacagaugac

SEQ ID NO: 1103861 - RNA, 22 nt, Human
ucuugggauagugucucauggc

SEQ ID NO: 1103862 - RNA, 22 nt, Human
cuucccacuaguaucacagagc

SEQ ID NO: 1103863 - RNA, 21 nt, Human
uccacccucucugcucccagu

SEQ ID NO: 1103864 - RNA, 22 nt, Human
gccccacagccugcggucucag

SEQ ID NO: 1103865 - RNA, 22 nt, Human
ccucccuucaguagagcccaau

SEQ ID NO: 1103866 - RNA, 22 nt, Human
uggccucugggaaagcagauuc

SEQ ID NO: 1103867 - RNA, 22 nt, Human
cuggcaguauuaagagaaguga

SEQ ID NO: 1103868 - RNA, 22 nt, Human
cugagagaucaagccacaggau

SEQ ID NO: 1103869 - RNA, 22 nt, Human
gaaaagaguccugugugaggag

SEQ ID NO: 1103870 - RNA, 22 nt, Human
gcuggcagaauuucuucuugcu

SEQ ID NO: 1103871 - RNA, 22 nt, Human
aggaggcuguggagcacuccau

SEQ ID NO: 1103872 - RNA, 22 nt, Human
aagagagaacucccuucgccag

SEQ ID NO: 1103873 - RNA, 22 nt, Human
cuuccucuagccuaguaaugcc

SEQ ID NO: 1103874 - RNA, 22 nt, Human
cccuggcagagggggcaggugc

SEQ ID NO: 1103875 - RNA, 22 nt, Human
ccuggcagcgccgaagcuggcc

SEQ ID NO: 1103876 - RNA, 22 nt, Human
auacauucaaaggaaggauaga

SEQ ID NO: 1103877 - RNA, 22 nt, Human
cugccugccuuggccuccagga

SEQ ID NO: 1103878 - RNA, 22 nt, Human
cagccaagaaccacagacccag

SEQ ID NO: 1103879 - RNA, 22 nt, Human
uccuggcaguaauuugauguug

SEQ ID NO: 1103880 - RNA, 22 nt, Human
cccagcccccgagugucuggaa

SEQ ID NO: 1103881 - RNA, 15 nt, Human
cacacagacagcuug

SEQ ID NO: 1103882 - RNA, 22 nt, Human
aggccccaaagcagugcaagua

SEQ ID NO: 1103883 - RNA, 22 nt, Human
guccuggcccacuggcaggcug

SEQ ID NO: 1103884 - RNA, 22 nt, Human
ccuggcagggcugcaguaaugg

SEQ ID NO: 1103885 - RNA, 22 nt, Human
ccuggcaguucaucaaauggca

SEQ ID NO: 1103886 - RNA, 22 nt, Human
gagaggcuggcagugccagguu

SEQ ID NO: 1103887 - RNA, 22 nt, Human
cacacaguaggcacucauuaau

SEQ ID NO: 1103888 - RNA, 22 nt, Human
aaagaaucagaagucucaaaca

SEQ ID NO: 1103889 - RNA, 22 nt, Human
gcugcgccggaucccacguucc

SEQ ID NO: 1103890 - RNA, 22 nt, Human
cccccaaaguuugcacggauaa

SEQ ID NO: 1103891 - RNA, 22 nt, Human
ggcaagagggcagauggagugc

SEQ ID NO: 1103892 - RNA, 22 nt, Human
aguguggcaggaaugacuagaa

SEQ ID NO: 1103893 - RNA, 22 nt, Human
ucuggcaggccuugucaaucug

SEQ ID NO: 1103894 - RNA, 22 nt, Human
cccacacucugagaaaugcuga

SEQ ID NO: 1103895 - RNA, 22 nt, Human
gcugcuaagcguuucuguucca

SEQ ID NO: 1103896 - RNA, 22 nt, Human
cuccucuguauugauugggacu

SEQ ID NO: 1103897 - RNA, 22 nt, Human
cacauacauucauguuacucua

SEQ ID NO: 1103898 - RNA, 22 nt, Human
guccucuggccuuucccaggac

SEQ ID NO: 1103899 - RNA, 22 nt, Human
uggcacaguccugggugccugc

SEQ ID NO: 1103900 - RNA, 22 nt, Human
cacaaaaguaggaggcaggcgg

SEQ ID NO: 1103901 - RNA, 22 nt, Human
aaaagagugacugauaaguaua

SEQ ID NO: 1103902 - RNA, 22 nt, Human
uggcagugguaccggcucucag

SEQ ID NO: 1103903 - RNA, 22 nt, Human
guccucuggaagaugaguucuu

SEQ ID NO: 1103904 - RNA, 22 nt, Human
ccugaccuauuuuucucagcug

SEQ ID NO: 1103905 - RNA, 22 nt, Human
cacauacaaggcacacuggagg

SEQ ID NO: 1103906 - RNA, 22 nt, Human
acacacagguaaaggagccugg

SEQ ID NO: 1103907 - RNA, 22 nt, Human
ccuggcagaaagaguuacaccu

SEQ ID NO: 1103908 - RNA, 22 nt, Human
accugccucagugcagcuggau

SEQ ID NO: 1103909 - RNA, 22 nt, Human
ucccugccuccuggcagugcca

SEQ ID NO: 1103910 - RNA, 22 nt, Human
ucaggauggagggaagcacaga

SEQ ID NO: 1103911 - RNA, 22 nt, Human
ccuggcagucaggggaguccuu

SEQ ID NO: 1103912 - RNA, 22 nt, Human
gccuccggagucacagugucuu

SEQ ID NO: 1103913 - RNA, 22 nt, Human
auggcagagggauugaacagcu

SEQ ID NO: 1103914 - RNA, 23 nt, Human
acacugucucauggauagacugc

SEQ ID NO: 1103915 - RNA, 21 nt, Human
agugccaguagguauggagga

SEQ ID NO: 1103916 - RNA, 22 nt, Human
ugcuggcacguggaccaggaga

SEQ ID NO: 1103917 - RNA, 22 nt, Human
ccaggcuguaagagugauguug

SEQ ID NO: 1103918 - RNA, 22 nt, Human
aaagagucaaaggcaugucucu

SEQ ID NO: 1103919 - RNA, 22 nt, Human
acagguggccccgagggagugg

SEQ ID NO: 1103920 - RNA, 22 nt, Human
guccucugacucagccuuggga

SEQ ID NO: 1103921 - RNA, 23 nt, Human
ugagggacaugguggcuucugag

SEQ ID NO: 1103922 - RNA, 22 nt, Human
agaggccggccgagcccauggg

SEQ ID NO: 1103923 - RNA, 22 nt, Human
ggccucucaugcccagagccaa

SEQ ID NO: 1103924 - RNA, 22 nt, Human
uccacacacauuucuaugugca

SEQ ID NO: 1103925 - RNA, 20 nt, Human
agggcugagaagggacuagc

SEQ ID NO: 1103926 - RNA, 22 nt, Human
gaggagcugcagggggagucua

SEQ ID NO: 1103927 - RNA, 22 nt, Human
agacaagaaacugggagucucu

SEQ ID NO: 1103928 - RNA, 22 nt, Human
aggaaagauggaaggaggauaa

SEQ ID NO: 1103929 - RNA, 22 nt, Human
uacacaucucugucaguaguga

SEQ ID NO: 1103930 - RNA, 22 nt, Human
gcuggcagccaagugaagaggg

SEQ ID NO: 1103931 - RNA, 22 nt, Human
ucacacaugaguaaauacaggg

SEQ ID NO: 1103932 - RNA, 22 nt, Human
aagagagagugcgcucacagaa

SEQ ID NO: 1103933 - RNA, 22 nt, Human
acugccaaugguaguuugaugg

SEQ ID NO: 1103934 - RNA, 22 nt, Human
uguaaacauauguauguaugua

SEQ ID NO: 1103935 - RNA, 22 nt, Human
ccuggcaggacuguuguaagaa

SEQ ID NO: 1103936 - RNA, 22 nt, Human
uuguaaacugcugcaggagugc

SEQ ID NO: 1103937 - RNA, 22 nt, Human
gacacuucaccuuucccagccu

SEQ ID NO: 1103938 - RNA, 22 nt, Human
gcuggcagagagcuggugagga

SEQ ID NO: 1103939 - RNA, 22 nt, Human
ccucuccuugcacccgucccgc

SEQ ID NO: 1103940 - RNA, 22 nt, Human
ucccagccacaguuuccaccug

SEQ ID NO: 1103941 - RNA, 22 nt, Human
caucacagguccugaugacauu

SEQ ID NO: 1103942 - RNA, 23 nt, Human
acauacauggagauaaagugaug

SEQ ID NO: 1103943 - RNA, 22 nt, Human
gcuggcagcauuagacccuggg

SEQ ID NO: 1103944 - RNA, 22 nt, Human
gcuggcaguaaaggguuuggca

SEQ ID NO: 1103945 - RNA, 22 nt, Human
uuccaggcuucucuggggcguc

SEQ ID NO: 1103946 - RNA, 22 nt, Human
acuggcagaggauagcacuaau

SEQ ID NO: 1103947 - RNA, 22 nt, Human
auacaugacucacacauucugc

SEQ ID NO: 1103948 - RNA, 22 nt, Human
auggcagauggcuggagcaggu

SEQ ID NO: 1103949 - RNA, 22 nt, Human
uuggaacaugccgggguccagg

SEQ ID NO: 1103950 - RNA, 22 nt, Human
cggcuggugucgggcacagcaa

SEQ ID NO: 1103951 - RNA, 22 nt, Human
gaggagcucugcuccauccuuc

SEQ ID NO: 1103952 - RNA, 22 nt, Human
uaagaacaguagaacaguaggu

SEQ ID NO: 1103953 - RNA, 22 nt, Human
aggaggcugaacuagggucugg

SEQ ID NO: 1103954 - RNA, 22 nt, Human
ucuggcagcagcaucaguggcu

SEQ ID NO: 1103955 - RNA, 21 nt, Human
ucuggcagcaguuuguugagu

SEQ ID NO: 1103956 - RNA, 22 nt, Human
ccuggcagcuccguggccuucc

SEQ ID NO: 1103957 - RNA, 22 nt, Human
ccccacacucuuuacauucaua

SEQ ID NO: 1103958 - RNA, 22 nt, Human
acacucuguaaugucacacucc

SEQ ID NO: 1103959 - RNA, 22 nt, Human
ugccugccucuggcagcccugc

SEQ ID NO: 1103960 - RNA, 22 nt, Human
ccauucauacaauuuuguucua

SEQ ID NO: 1103961 - RNA, 22 nt, Human
acuggcagaacuggugauuguc

SEQ ID NO: 1103962 - RNA, 22 nt, Human
gacacagauaucucugagauua

SEQ ID NO: 1103963 - RNA, 22 nt, Human
cccacacauuuuucacuuaccg

SEQ ID NO: 1103964 - RNA, 22 nt, Human
cugccugcugcccuccagagcc

SEQ ID NO: 1103965 - RNA, 23 nt, Human
uaaauuaccuuuccagugcaggg

SEQ ID NO: 1103966 - RNA, 22 nt, Human
uggucucugcaggccaggcuca

SEQ ID NO: 1103967 - RNA, 21 nt, Human
ccacucaugacuccacucacc

SEQ ID NO: 1103968 - RNA, 22 nt, Human
uuccuggccaagcagaguggaa

SEQ ID NO: 1103969 - RNA, 22 nt, Human
gcuggcagaagagcugguucaa

SEQ ID NO: 1103970 - RNA, 22 nt, Human
cugccugcaggacaccucgcua

SEQ ID NO: 1103971 - RNA, 22 nt, Human
acacauacauggggaagaugag

SEQ ID NO: 1103972 - RNA, 22 nt, Human
gccuccuguuaugccaugugcc

SEQ ID NO: 1103973 - RNA, 22 nt, Human
gacaaaaguguuuugaacaagg

SEQ ID NO: 1103974 - RNA, 22 nt, Human
uccaggcaaaaaccaacuacag

SEQ ID NO: 1103975 - RNA, 22 nt, Human
agagggugcuggagagacauug

SEQ ID NO: 1103976 - RNA, 22 nt, Human
ccuggcagccucagccaauucu

SEQ ID NO: 1103977 - RNA, 22 nt, Human
auggcagacgaggcagcagggg

SEQ ID NO: 1103978 - RNA, 22 nt, Human
ucaggcccagagucacggaucc

SEQ ID NO: 1103979 - RNA, 22 nt, Human
agggacucccugggccgacacg

SEQ ID NO: 1103980 - RNA, 22 nt, Human
ccugccucccagagguccucua

SEQ ID NO: 1103981 - RNA, 22 nt, Human
acacacuggcccccaguacuga

SEQ ID NO: 1103982 - RNA, 21 nt, Human
ccuggcagaagccugauaugc

SEQ ID NO: 1103983 - RNA, 22 nt, Human
ugccagccagggaagcucaccc

SEQ ID NO: 1103984 - RNA, 22 nt, Human
aggaggcugggcacaguggccu

SEQ ID NO: 1103985 - RNA, 22 nt, Human
acuggcagugucguuuacauga

SEQ ID NO: 1103986 - RNA, 22 nt, Human
acaauucugaugguuucccagu

SEQ ID NO: 1103987 - RNA, 22 nt, Human
uggcaguggcucagagugcaga

SEQ ID NO: 1103988 - RNA, 22 nt, Human
acccacccuacuagcagugucc

SEQ ID NO: 1103989 - RNA, 23 nt, Human
ccuggcagcaaacgaggagguua

SEQ ID NO: 1103990 - RNA, 22 nt, Human
ccuggcugguggcagcgacaag

SEQ ID NO: 1103991 - RNA, 22 nt, Human
cuuggcagagggcugggcucag

SEQ ID NO: 1103992 - RNA, 22 nt, Human
ucccacccccuccaaggaggaa

SEQ ID NO: 1103993 - RNA, 22 nt, Human
cacauacuuguguguacauaug

SEQ ID NO: 1103994 - RNA, 22 nt, Human
acuggcagcagcagcccuuggg

SEQ ID NO: 1103995 - RNA, 22 nt, Human
ucaucacaauuuuaugacccuc

SEQ ID NO: 1103996 - RNA, 22 nt, Human
gggacaauggaggccucucucc

SEQ ID NO: 1103997 - RNA, 22 nt, Human
ucacauacugaaaguccaguga

SEQ ID NO: 1103998 - RNA, 22 nt, Human
aaagaucaaguaggcauggccu

SEQ ID NO: 1103999 - RNA, 22 nt, Human
ggccucagagaaggcugugcgg

SEQ ID NO: 1104000 - RNA, 22 nt, Human
ggugccaggcuguagucagggu

SEQ ID NO: 1104001 - RNA, 22 nt, Human
ucuggcagggguucugcacuug

SEQ ID NO: 1104002 - RNA, 22 nt, Human
cuccugaggaaaagcuugguca

SEQ ID NO: 1104003 - RNA, 22 nt, Human
ggccucucugagagcagacguu

SEQ ID NO: 1104004 - RNA, 22 nt, Human
aguguugggucuuuagaauuua

SEQ ID NO: 1104005 - RNA, 22 nt, Human
guccacagagggcugggcaggc

SEQ ID NO: 1104006 - RNA, 22 nt, Human
guccuggcaccucacuggcuac

SEQ ID NO: 1104007 - RNA, 23 nt, Human
ggacacauuuauuucagaauuca

SEQ ID NO: 1104008 - RNA, 22 nt, Human
gccuccuggaagucacauguuu

SEQ ID NO: 1104009 - RNA, 22 nt, Human
cccagccugugacagccguccu

SEQ ID NO: 1104010 - RNA, 22 nt, Human
gcacauacccacugucaagcac

SEQ ID NO: 1104011 - RNA, 22 nt, Human
uuccuggcauagagagggcaca

SEQ ID NO: 1104012 - RNA, 22 nt, Human
gaggagcugagccacguccugg

SEQ ID NO: 1104013 - RNA, 22 nt, Human
uacacacaugcauuugccuuau

SEQ ID NO: 1104014 - RNA, 20 nt, Human
acuggcagccugccugcugu

SEQ ID NO: 1104015 - RNA, 22 nt, Human
ggagcugaguucuucagccggg

SEQ ID NO: 1104016 - RNA, 22 nt, Human
gacccggcuccaggcccagcag

SEQ ID NO: 1104017 - RNA, 22 nt, Human
ccagugcccagcugcccaggca

SEQ ID NO: 1104018 - RNA, 22 nt, Human
uccuggcauugugcagggugug

SEQ ID NO: 1104019 - RNA, 23 nt, Human
cauccaggagcugagucugacug

SEQ ID NO: 1104020 - RNA, 22 nt, Human
cuccuggcacucaguguggaag

SEQ ID NO: 1104021 - RNA, 22 nt, Human
ucaucacauguguagucauccc

SEQ ID NO: 1104022 - RNA, 23 nt, Human
gcccacccucagcguccucacgg

SEQ ID NO: 1104023 - RNA, 22 nt, Human
gcacacagcuagauuaccauuc

SEQ ID NO: 1104024 - RNA, 22 nt, Human
guccucugaaagaugaaccaug

SEQ ID NO: 1104025 - RNA, 19 nt, Human
acuggcagcuguagucugu

SEQ ID NO: 1104026 - RNA, 22 nt, Human
gaggagcuggcagcgucuccgc

SEQ ID NO: 1104027 - RNA, 22 nt, Human
guccucugauuucuagguauau

SEQ ID NO: 1104028 - RNA, 22 nt, Human
uguaaacagccccauggagagc

SEQ ID NO: 1104029 - RNA, 22 nt, Human
cccugagcgugaggaggaagua

SEQ ID NO: 1104030 - RNA, 22 nt, Human
agggaagaagcugguaguaggu

SEQ ID NO: 1104031 - RNA, 17 nt, Human
gcaucacagauaacacg

SEQ ID NO: 1104032 - RNA, 22 nt, Human
cugcaggacgaccgccucaucu

SEQ ID NO: 1104033 - RNA, 22 nt, Human
gccagguugcugacgacgaucu

SEQ ID NO: 1104034 - RNA, 22 nt, Human
acacacagcgccuaccaugugc

SEQ ID NO: 1104035 - RNA, 22 nt, Human
auaauggccgggggcugaaugc

SEQ ID NO: 1104036 - RNA, 22 nt, Human
uuccaggcuauccggugaaggg

SEQ ID NO: 1104037 - RNA, 22 nt, Human
gcuggcagcuggaaguugggcu

SEQ ID NO: 1104038 - RNA, 22 nt, Human
ucuggcaguaauaggggagaga

SEQ ID NO: 1104039 - RNA, 22 nt, Human
ccuggcagcuguuuggcuuggc

SEQ ID NO: 1104040 - RNA, 22 nt, Human
agacacauaggaccacacugug

SEQ ID NO: 1104041 - RNA, 22 nt, Human
ggugccagugggucucaggaua

SEQ ID NO: 1104042 - RNA, 22 nt, Human
guccucuggugaaagcauuccc

SEQ ID NO: 1104043 - RNA, 22 nt, Human
uucuuucaauagcuggcauaug

SEQ ID NO: 1104044 - RNA, 22 nt, Human
acacacacaagcagguugugga

SEQ ID NO: 1104045 - RNA, 22 nt, Human
agagucccagggacacuccaga

SEQ ID NO: 1104046 - RNA, 17 nt, Human
agccugccccaugcugc

SEQ ID NO: 1104047 - RNA, 22 nt, Human
ucuggcagaagugcugucagua

SEQ ID NO: 1104048 - RNA, 22 nt, Human
cccuuccuugugacuggugggg

SEQ ID NO: 1104049 - RNA, 22 nt, Human
guuaggaacacuggagccuaaa

SEQ ID NO: 1104050 - RNA, 22 nt, Human
ugagggacucccggcccugcca

SEQ ID NO: 1104051 - RNA, 18 nt, Human
gacacauccccaggccuc

SEQ ID NO: 1104052 - RNA, 22 nt, Human
aaauuacagaucaccaaugcau

SEQ ID NO: 1104053 - RNA, 22 nt, Human
ccuggcagcccagagcgccgcu

SEQ ID NO: 1104054 - RNA, 22 nt, Human
ucuggcagggucagggcccagg

SEQ ID NO: 1104055 - RNA, 22 nt, Human
uccugagccugacaaucaccau

SEQ ID NO: 1104056 - RNA, 22 nt, Human
ugguccuggaagguccugaggg

SEQ ID NO: 1104057 - RNA, 19 nt, Human
acuggcaguuucugcaugg

SEQ ID NO: 1104058 - RNA, 22 nt, Human
gucaggacucugacccgucccg

SEQ ID NO: 1104059 - RNA, 22 nt, Human
acacacuguugcucauccaggc

SEQ ID NO: 1104060 - RNA, 22 nt, Human
cagucacauagguauacacaua

SEQ ID NO: 1104061 - RNA, 21 nt, Human
ccagcccagcugugucccagc

SEQ ID NO: 1104062 - RNA, 22 nt, Human
cccagcccacgguccugggugg

SEQ ID NO: 1104063 - RNA, 22 nt, Human
gcuugggaagggcccuguguac

SEQ ID NO: 1104064 - RNA, 22 nt, Human
gacacagagggcaccagauaug

SEQ ID NO: 1104065 - RNA, 22 nt, Human
cacacagaugguaagggaggga

SEQ ID NO: 1104066 - RNA, 22 nt, Human
uggcaguagauccagucucucu

SEQ ID NO: 1104067 - RNA, 22 nt, Human
ccugccuucagcccugaagucu

SEQ ID NO: 1104068 - RNA, 22 nt, Human
uccuggcacuuugggggcucgc

SEQ ID NO: 1104069 - RNA, 22 nt, Human
cuccaggccccuggccuucugc

SEQ ID NO: 1104070 - RNA, 22 nt, Human
cccagcaugcacgcugacacuc

SEQ ID NO: 1104071 - RNA, 22 nt, Human
ucccuccuggccgucaccgcug

SEQ ID NO: 1104072 - RNA, 22 nt, Human
gcuggcaggauaacuucuaagc

SEQ ID NO: 1104073 - RNA, 22 nt, Human
cccacacacuggcugcugccaa

SEQ ID NO: 1104074 - RNA, 22 nt, Human
agagcacagaagaauaggugcu

SEQ ID NO: 1104075 - RNA, 22 nt, Human
ccacaaaacugugugucaaaga

SEQ ID NO: 1104076 - RNA, 22 nt, Human
ggcugaguugagaggauuacuu

SEQ ID NO: 1104077 - RNA, 22 nt, Human
uggcagagaacacggcugaucu

SEQ ID NO: 1104078 - RNA, 22 nt, Human
uuccuggccccaccccuggaga

SEQ ID NO: 1104079 - RNA, 22 nt, Human
cuuggcaguuucggaaggauga

SEQ ID NO: 1104080 - RNA, 22 nt, Human
uccugccuguuuaccuguacuu

SEQ ID NO: 1104081 - RNA, 22 nt, Human
gcaguguuuguguucucacaug

SEQ ID NO: 1104082 - RNA, 22 nt, Human
uccaggcaagggaggagcaugg

SEQ ID NO: 1104083 - RNA, 22 nt, Human
agugccccaugggugccugggg

SEQ ID NO: 1104084 - RNA, 22 nt, Human
cccaggccagaacuugguugcu

SEQ ID NO: 1104085 - RNA, 22 nt, Human
cauuacaaccccaaauuacaaa

SEQ ID NO: 1104086 - RNA, 22 nt, Human
aucacaauguacguuaaaaugu

SEQ ID NO: 1104087 - RNA, 22 nt, Human
ucuggcaguugccgcuucaguc

SEQ ID NO: 1104088 - RNA, 22 nt, Human
uccugagcaacacagcuaagug

SEQ ID NO: 1104089 - RNA, 22 nt, Human
ccuggcaguggugaagaagagg

SEQ ID NO: 1104090 - RNA, 17 nt, Human
ccauacugacauauuga

SEQ ID NO: 1104091 - RNA, 22 nt, Human
ucuggcagcucuccucggcgga

SEQ ID NO: 1104092 - RNA, 22 nt, Human
cccaggccuggucugggccagu

SEQ ID NO: 1104093 - RNA, 22 nt, Human
gcuggcagagcucugggcuggg

SEQ ID NO: 1104094 - RNA, 22 nt, Human
uccugagcccuguaggacccug

SEQ ID NO: 1104095 - RNA, 22 nt, Human
uacacaacugacaaccauucug

SEQ ID NO: 1104096 - RNA, 22 nt, Human
gccucaggccgcccugcugcuc

SEQ ID NO: 1104097 - RNA, 22 nt, Human
ugcacaggaggcuguggagaag

SEQ ID NO: 1104098 - RNA, 22 nt, Human
aaagagucuggcacuguaccag

SEQ ID NO: 1104099 - RNA, 22 nt, Human
ugagagucuguuccucuugcag

SEQ ID NO: 1104100 - RNA, 22 nt, Human
uggcacagggcuuggucgcuca

SEQ ID NO: 1104101 - RNA, 22 nt, Human
acaagagcauugcagguguguu

SEQ ID NO: 1104102 - RNA, 22 nt, Human
aucacagagcucccuuccacug

SEQ ID NO: 1104103 - RNA, 22 nt, Human
uccuggcagggucuaggucuag

SEQ ID NO: 1104104 - RNA, 22 nt, Human
gagacacacauucuggagagaa

SEQ ID NO: 1104105 - RNA, 22 nt, Human
ggagagaauuccauggacaugu

SEQ ID NO: 1104106 - RNA, 22 nt, Human
cugagggucaacuugauuguau

SEQ ID NO: 1104107 - RNA, 22 nt, Human
ccuucucucugaagaccccaaa

SEQ ID NO: 1104108 - RNA, 22 nt, Human
gucuggaaggaggagauggagc

SEQ ID NO: 1104109 - RNA, 22 nt, Human
cucaucaccacauauaacaaag

SEQ ID NO: 1104110 - RNA, 22 nt, Human
gucacacagggccuccaaauca

SEQ ID NO: 1104111 - RNA, 22 nt, Human
accugccuucucaaggacauga

SEQ ID NO: 1104112 - RNA, 22 nt, Human
gcuggcaggagaccauacccua

SEQ ID NO: 1104113 - RNA, 22 nt, Human
aggagcugcagauucugccuug

SEQ ID NO: 1104114 - RNA, 22 nt, Human
ucuggcaggauaucgaagugaa

SEQ ID NO: 1104115 - RNA, 23 nt, Human
aguguugguugggaagccaagca

SEQ ID NO: 1104116 - RNA, 22 nt, Human
agccagggucucucgcucuguu

SEQ ID NO: 1104117 - RNA, 22 nt, Human
ucuggcagcuauccucuggcca

SEQ ID NO: 1104118 - RNA, 22 nt, Human
acaucccacagaaacauacaua

SEQ ID NO: 1104119 - RNA, 22 nt, Human
ucccacaggaaaguagacauug

SEQ ID NO: 1104120 - RNA, 22 nt, Human
cagguugguauucaucuccaca

SEQ ID NO: 1104121 - RNA, 22 nt, Human
uguggggaagaguaugacuugg

SEQ ID NO: 1104122 - RNA, 22 nt, Human
ccuccuggcuuuucccauugaa

SEQ ID NO: 1104123 - RNA, 22 nt, Human
uccacccugcuuucuuaucucc

SEQ ID NO: 1104124 - RNA, 22 nt, Human
agaggcuuggaggugcaagguu

SEQ ID NO: 1104125 - RNA, 22 nt, Human
uccugagcacagagacaaggaa

SEQ ID NO: 1104126 - RNA, 22 nt, Human
ucuggcagaucuucccacguuu

SEQ ID NO: 1104127 - RNA, 22 nt, Human
gccuggcaggggccugggagug

SEQ ID NO: 1104128 - RNA, 22 nt, Human
uccccacagcagaagaucugag

SEQ ID NO: 1104129 - RNA, 22 nt, Human
guccucuggagguuuuuaggug

SEQ ID NO: 1104130 - RNA, 18 nt, Human
ggccucuggacuggcagc

SEQ ID NO: 1104131 - RNA, 22 nt, Human
cacacacuggagcaaggagaug

SEQ ID NO: 1104132 - RNA, 22 nt, Human
acagguggcuuauuggcugauu

SEQ ID NO: 1104133 - RNA, 21 nt, Human
caggaacauucuuuacauuua

SEQ ID NO: 1104134 - RNA, 22 nt, Human
cagacuuaccuaaggucacaca

SEQ ID NO: 1104135 - RNA, 22 nt, Human
auuguauacaagcuuaauuguu

SEQ ID NO: 1104136 - RNA, 22 nt, Human
uauaagaaacaaggcaaauuuu

SEQ ID NO: 1104137 - RNA, 22 nt, Human
aaggauuuuuggaaugagaugg

SEQ ID NO: 1104138 - RNA, 22 nt, Human
agucaagguggaccagaaaaau

SEQ ID NO: 1104139 - RNA, 22 nt, Human
auagcaaaggacaauagucagu

SEQ ID NO: 1104140 - RNA, 22 nt, Human
auuuacagacguggauuagugc

SEQ ID NO: 1104141 - RNA, 22 nt, Human
uggaaauacaagaaguauguca

SEQ ID NO: 1104142 - RNA, 22 nt, Human
augaacaguacaaagcacagac

SEQ ID NO: 1104143 - RNA, 22 nt, Human
auaggacuuuguaucaggauga

SEQ ID NO: 1104144 - RNA, 22 nt, Human
gaauacaaauaauaccaaggug

SEQ ID NO: 1104145 - RNA, 22 nt, Human
cagcaguacuucucagagguau

SEQ ID NO: 1104146 - RNA, 22 nt, Human
acagagacacggaagcuaaaga

SEQ ID NO: 1104147 - RNA, 22 nt, Human
cuuccagugcauagguagauca

SEQ ID NO: 1104148 - RNA, 22 nt, Human
gcagagcacccugcagugguau

SEQ ID NO: 1104149 - RNA, 22 nt, Human
uagcuguucucuguaaauugga

SEQ ID NO: 1104150 - RNA, 20 nt, Human
gagcagugagccagggaaag

SEQ ID NO: 1104151 - RNA, 22 nt, Human
auuagguaguauaaucuuuguu

SEQ ID NO: 1104152 - RNA, 22 nt, Human
uacugcaaaccauuuacaguag

SEQ ID NO: 1104153 - RNA, 22 nt, Human
aagagagaacucccuucgccag

SEQ ID NO: 1104154 - RNA, 19 nt, Human
gcuguuaaggacccucgga

SEQ ID NO: 1104155 - RNA, 22 nt, Human
ugcucccaaaccugacaggcuc

SEQ ID NO: 1104156 - RNA, 22 nt, Human
acagaguaucuaucaggaguau

SEQ ID NO: 1104157 - RNA, 21 nt, Human
uaagaacauuaucuucuuccu

SEQ ID NO: 1104158 - RNA, 22 nt, Human
cuucacaaaauauuucauuaua

SEQ ID NO: 1104159 - RNA, 21 nt, Human
ugcuccaggagggggcagucc

SEQ ID NO: 1104160 - RNA, 22 nt, Human
gaagaaguguaagucuguuuca

SEQ ID NO: 1104161 - RNA, 22 nt, Human
agaguuuacagaaauaagcugu

SEQ ID NO: 1104162 - RNA, 22 nt, Human
guuaacaacacugugagugcug

SEQ ID NO: 1104163 - RNA, 22 nt, Human
ucauacauguuguguucaaaug

SEQ ID NO: 1104164 - RNA, 22 nt, Human
agagugaaguaauuguuaggau

SEQ ID NO: 1104165 - RNA, 22 nt, Human
uauaaacuccucuugcauuccu

SEQ ID NO: 1104166 - RNA, 22 nt, Human
uguaauguuagaaacaauugcu

SEQ ID NO: 1104167 - RNA, 18 nt, Human
accugauuggcgcagccc

SEQ ID NO: 1104168 - RNA, 22 nt, Human
caggaacagcaccaggagcuag

SEQ ID NO: 1104169 - RNA, 22 nt, Human
cugagcaggacagugggagacc

SEQ ID NO: 1104170 - RNA, 22 nt, Human
uuuacagagaauguacauaaag

SEQ ID NO: 1104171 - RNA, 22 nt, Human
cagagcagcagagcuuccaugg

SEQ ID NO: 1104172 - RNA, 22 nt, Human
uucaacaacuugguucaaaugg

SEQ ID NO: 1104173 - RNA, 15 nt, Human
gccuugaaugugaau

SEQ ID NO: 1104174 - RNA, 22 nt, Human
uccuagaauauuuguggagguu

SEQ ID NO: 1104175 - RNA, 20 nt, Human
cagagcagugcccaggcggc

SEQ ID NO: 1104176 - RNA, 22 nt, Human
ggcuuuggggguguccaagaaa

SEQ ID NO: 1104177 - RNA, 22 nt, Human
guagcagagggcccagguaacu

SEQ ID NO: 1104178 - RNA, 22 nt, Human
cugagguagggacgugccguag

SEQ ID NO: 1104179 - RNA, 22 nt, Human
gguuuguggagcuggaaacacu

SEQ ID NO: 1104180 - RNA, 22 nt, Human
aaggcauggcaggguuuacaca

SEQ ID NO: 1104181 - RNA, 22 nt, Human
aguacaagugaugugguaaaaa

SEQ ID NO: 1104182 - RNA, 22 nt, Human
cauuaacacuuuggauuuagac

SEQ ID NO: 1104183 - RNA, 22 nt, Human
cagagcugagucuucaagguug

SEQ ID NO: 1104184 - RNA, 22 nt, Human
caggaacacaaugagucucaaa

SEQ ID NO: 1104185 - RNA, 22 nt, Human
acaagucaguggaauuaauauu

SEQ ID NO: 1104186 - RNA, 22 nt, Human
aaaucaugguggaagaaacaga

SEQ ID NO: 1104187 - RNA, 22 nt, Human
augugauacuccuucuagugga

SEQ ID NO: 1104188 - RNA, 21 nt, Human
ugcauauauaagugcauacac

SEQ ID NO: 1104189 - RNA, 22 nt, Human
aaaacuuucagggauacagaaa

SEQ ID NO: 1104190 - RNA, 22 nt, Human
uccugagauaggaguugaaggc

SEQ ID NO: 1104191 - RNA, 22 nt, Human
cuauacagcagcuuacuaguua

SEQ ID NO: 1104192 - RNA, 22 nt, Human
cauccauagauugagagauggu

SEQ ID NO: 1104193 - RNA, 22 nt, Human
aguaauggguugaaauuuaguu

SEQ ID NO: 1104194 - RNA, 22 nt, Human
ugucauggacuggauuucugcu

SEQ ID NO: 1104195 - RNA, 22 nt, Human
augacuuaaucauacuugcauu

SEQ ID NO: 1104196 - RNA, 22 nt, Human
uaagucauagauuaauggccac

SEQ ID NO: 1104197 - RNA, 22 nt, Human
auacaugacucacacauucugc

SEQ ID NO: 1104198 - RNA, 22 nt, Human
cugagguagaggaaauguagcu

SEQ ID NO: 1104199 - RNA, 22 nt, Human
auauaugaagaagucuugauua

SEQ ID NO: 1104200 - RNA, 22 nt, Human
ucauggcucuaaagacauagau

SEQ ID NO: 1104201 - RNA, 22 nt, Human
agguuuggguucauugcuggcu

SEQ ID NO: 1104202 - RNA, 22 nt, Human
aguaacagguguacagacuauc

SEQ ID NO: 1104203 - RNA, 22 nt, Human
gcaguaaauugagagucauguu

SEQ ID NO: 1104204 - RNA, 22 nt, Human
aucagagcugcauuuuagagcc

SEQ ID NO: 1104205 - RNA, 22 nt, Human
aaacccugagacuuggggccag

SEQ ID NO: 1104206 - RNA, 22 nt, Human
aguguuaaggcugguugcuaua

SEQ ID NO: 1104207 - RNA, 22 nt, Human
agcagcaggugaccucgaugcc

SEQ ID NO: 1104208 - RNA, 22 nt, Human
ugcuccugaacacagcccuaug

SEQ ID NO: 1104209 - RNA, 22 nt, Human
ugagaacaaaguugaaaguuug

SEQ ID NO: 1104210 - RNA, 22 nt, Human
agagaagcagggagucaucugu

SEQ ID NO: 1104211 - RNA, 22 nt, Human
caaauguuugguggcauuuugu

SEQ ID NO: 1104212 - RNA, 22 nt, Human
aacacuaaaggucaguuagaag

SEQ ID NO: 1104213 - RNA, 22 nt, Human
acagggcaccugagguaggaag

SEQ ID NO: 1104214 - RNA, 22 nt, Human
uaaagcaaugaaaguuuugcag

SEQ ID NO: 1104215 - RNA, 22 nt, Human
agagaagagucuugucaaauua

SEQ ID NO: 1104216 - RNA, 22 nt, Human
cagagcagaaaccugggugauu

SEQ ID NO: 1104217 - RNA, 22 nt, Human
uuccaaguuaggcgagcuggug

SEQ ID NO: 1104218 - RNA, 20 nt, Human
acaacuuaguugagagacua

SEQ ID NO: 1104219 - RNA, 22 nt, Human
uggcuccguuguacaggcugga

SEQ ID NO: 1104220 - RNA, 22 nt, Human
agagucaguuaugucaagugcu

SEQ ID NO: 1104221 - RNA, 22 nt, Human
aagauuuaccacuuuauucaag

SEQ ID NO: 1104222 - RNA, 22 nt, Human
aucauccauggcugaucauaaa

SEQ ID NO: 1104223 - RNA, 22 nt, Human
aacacaguuucugcauugguag

SEQ ID NO: 1104224 - RNA, 17 nt, Human
ugagcaguagaagaugc

SEQ ID NO: 1104225 - RNA, 17 nt, Human
acuuguauugugcuuua

SEQ ID NO: 1104226 - RNA, 22 nt, Human
caaacuuacuguguuuaaagag

SEQ ID NO: 1104227 - RNA, 22 nt, Human
gcaccgagaaggaagcaugccu

SEQ ID NO: 1104228 - RNA, 22 nt, Human
agaacagaggccuuauguuuca

SEQ ID NO: 1104229 - RNA, 22 nt, Human
aaugaguuuguucuauuauuug

SEQ ID NO: 1104230 - RNA, 22 nt, Human
gcauuuaaauuugaacuucaga

SEQ ID NO: 1104231 - RNA, 22 nt, Human
cuuaagacaggcucaaagauua

SEQ ID NO: 1104232 - RNA, 22 nt, Sin Nombre virus
uauaagaucacauuugauguug

SEQ ID NO: 1104233 - RNA, 23 nt, Sin Nombre virus
auaacaaauuacugucuuccuug

SEQ ID NO: 1104234 - RNA, 22 nt, Sin Nombre virus
auaagcaaugcuuuuauuauau

SEQ ID NO: 1104235 - RNA, 22 nt, Human
aaggcaguagguguuucaaacu

SEQ ID NO: 1104236 - RNA, 22 nt, Human
caggauggucuucauuuggcuc

SEQ ID NO: 1104237 - RNA, 22 nt, Human
ggguacuuaauauuuacggggu

SEQ ID NO: 1104238 - RNA, 22 nt, Human
uaagcugugggagauuggcaua

SEQ ID NO: 1104239 - RNA, 22 nt, Human
cucaggauagauuguccucuca

SEQ ID NO: 1104240 - RNA, 20 nt, Human
ggggcugcaugcagagaaga

SEQ ID NO: 1104241 - RNA, 22 nt, Human
aaguggacuaauacaaggacua

SEQ ID NO: 1104242 - RNA, 22 nt, Human
aucaggaugaagcuguagcgaa

SEQ ID NO: 1104243 - RNA, 22 nt, Human
uggagacugugcuaagggaguu

SEQ ID NO: 1104244 - RNA, 22 nt, Human
uaaggccaaggggccauagucu

SEQ ID NO: 1104245 - RNA, 22 nt, Human
acauacacaagcguacaugaac

SEQ ID NO: 1104246 - RNA, 22 nt, Human
uucccacagagauuacauugaa

SEQ ID NO: 1104247 - RNA, 22 nt, Human
gcacauaaagggcaugggaggu

SEQ ID NO: 1104248 - RNA, 22 nt, Human
cuuacagagaagaaaauguagu

SEQ ID NO: 1104249 - RNA, 20 nt, Human
ucacaucuggcagcugauga

SEQ ID NO: 1104250 - RNA, 22 nt, Human
aucacagagauugcuuuuaaaa

SEQ ID NO: 1104251 - RNA, 22 nt, Human
augaggcaguacacacaaagcc

SEQ ID NO: 1104252 - RNA, 22 nt, Human
agggacuuguguccuauguaug

SEQ ID NO: 1104253 - RNA, 21 nt, Human
ugacugaggcuucuucacaca

SEQ ID NO: 1104254 - RNA, 22 nt, Human
uucaggaugcagagguuguagu

SEQ ID NO: 1104255 - RNA, 21 nt, Human
uuugaaagcuacaucuauagc

SEQ ID NO: 1104256 - RNA, 22 nt, Human
uguggaaaauuggaacguuccu

SEQ ID NO: 1104257 - RNA, 22 nt, Human
cugguacaaaaugcugauauca

SEQ ID NO: 1104258 - RNA, 22 nt, Human
ccucaggauacaggagccacag

SEQ ID NO: 1104259 - RNA, 22 nt, Human
acucaggaaaugaagacugguu

SEQ ID NO: 1104260 - RNA, 22 nt, Human
auggcagaccuccuggccacaa

SEQ ID NO: 1104261 - RNA, 22 nt, Human
aacacagaucaaaauauuuccu

SEQ ID NO: 1104262 - RNA, 22 nt, Human
uauuuucuggacagucuugcuu

SEQ ID NO: 1104263 - RNA, 22 nt, Human
ugucucugaggugagggucagc

SEQ ID NO: 1104264 - RNA, 22 nt, Human
uugaagagugccuuccagacau

SEQ ID NO: 1104265 - RNA, 22 nt, Human
ugagagucucagaccuccuggu

SEQ ID NO: 1104266 - RNA, 22 nt, Human
ugaaggccuaacuuccagugcu

SEQ ID NO: 1104267 - RNA, 22 nt, Human
aucacauugccagugauuaccc

SEQ ID NO: 1104268 - RNA, 22 nt, Human
cugccaucugagccaaaagugc

SEQ ID NO: 1104269 - RNA, 22 nt, Human
gcaucuaaauaaacgugggagu

SEQ ID NO: 1104270 - RNA, 19 nt, Human
ugaguucugugguucucaa

SEQ ID NO: 1104271 - RNA, 20 nt, Human
auacacaugcagacagaugc

SEQ ID NO: 1104272 - RNA, 22 nt, Human
gaaggccacggaauggagcugg

SEQ ID NO: 1104273 - RNA, 23 nt, Human
ugaguucucaucuuggcuucuau

SEQ ID NO: 1104274 - RNA, 22 nt, Human
gaggccaaguuggagaccaggu

SEQ ID NO: 1104275 - RNA, 22 nt, Human
gacacauaugcguauaguuuag

SEQ ID NO: 1104276 - RNA, 22 nt, Human
caaggccacugcucagguuucc

SEQ ID NO: 1104277 - RNA, 22 nt, Human
ccagaccacccuggccaugcac

SEQ ID NO: 1104278 - RNA, 22 nt, Human
cuucaggauuuaggaagaugaa

SEQ ID NO: 1104279 - RNA, 22 nt, Human
cauggcugcgagaagagugggu

SEQ ID NO: 1104280 - RNA, 22 nt, Human
uucccacauucuuuacauucau

SEQ ID NO: 1104281 - RNA, 22 nt, Human
ucucccaggcugcccuguggac

SEQ ID NO: 1104282 - RNA, 22 nt, Human
uguuugaauuuugcuaacgugu

SEQ ID NO: 1104283 - RNA, 20 nt, Human
ccccacacuauugagcacuu

SEQ ID NO: 1104284 - RNA, 22 nt, Human
caggguggggaaauagcgcccu

SEQ ID NO: 1104285 - RNA, 22 nt, Human
gacacagacaguuagagguaau

SEQ ID NO: 1104286 - RNA, 21 nt, Human
cucaggauggcggccuggugg

SEQ ID NO: 1104287 - RNA, 22 nt, Human
aguggaccagaagacugaagcu

SEQ ID NO: 1104288 - RNA, 22 nt, Human
gaaaggugccccauaggcagga

SEQ ID NO: 1104289 - RNA, 22 nt, Human
acaucacaguaguuaagccaga

SEQ ID NO: 1104290 - RNA, 22 nt, Human
aaaggagacuucagaucuccuu

SEQ ID NO: 1104291 - RNA, 22 nt, Human
gccacauagaggaggauauuaa

SEQ ID NO: 1104292 - RNA, 22 nt, Human
cuugaaagucacaugcagcccu

SEQ ID NO: 1104293 - RNA, 22 nt, Human
uucuccucuguuggccuucccu

SEQ ID NO: 1104294 - RNA, 22 nt, Human
ccucaggaaaugaauaaauggc

SEQ ID NO: 1104295 - RNA, 22 nt, Human
cucaggaugcaauuccaucaag

SEQ ID NO: 1104296 - RNA, 22 nt, Human
aaggccagcuuguagggcuggu

SEQ ID NO: 1104297 - RNA, 22 nt, Human
auugaaagauaggcuacugugg

SEQ ID NO: 1104298 - RNA, 22 nt, Human
ucacacagcuccuuuccuuagu

SEQ ID NO: 1104299 - RNA, 22 nt, Human
cacaucccuggaguuacccagu

SEQ ID NO: 1104300 - RNA, 22 nt, Human
cucacugucuguacuagcugau

SEQ ID NO: 1104301 - RNA, 22 nt, Human
uaaggccagcaugaaugcagca

SEQ ID NO: 1104302 - RNA, 22 nt, Human
auccucuguggauuacaccuag

SEQ ID NO: 1104303 - RNA, 22 nt, Human
cucaacagcucugccauacucc

SEQ ID NO: 1104304 - RNA, 19 nt, Human
uggagacugagagugagca

SEQ ID NO: 1104305 - RNA, 22 nt, Human
ucccacauuacccugacugaca

SEQ ID NO: 1104306 - RNA, 22 nt, Human
uuagccauggacugaauugacu

SEQ ID NO: 1104307 - RNA, 22 nt, Human
cacauuccuggugcucagcagc

SEQ ID NO: 1104308 - RNA, 22 nt, Human
cagaaggcuggcagauugagau

SEQ ID NO: 1104309 - RNA, 22 nt, Human
gucaggauuauuuuauuaaaag

SEQ ID NO: 1104310 - RNA, 20 nt, Human
ugaaggccagcagcauaggg

SEQ ID NO: 1104311 - RNA, 22 nt, Human
gcugucccgcugacuuccagcu

SEQ ID NO: 1104312 - RNA, 22 nt, Human
cacaauguauauguauaucaaa

SEQ ID NO: 1104313 - RNA, 22 nt, Human
auugaaaggcaaaguaggaagc

SEQ ID NO: 1104314 - RNA, 19 nt, Human
uuugaaaggauuguuauuu

SEQ ID NO: 1104315 - RNA, 22 nt, Human
aagugagugguaaggagcaugg

SEQ ID NO: 1104316 - RNA, 22 nt, Human
agugugagcccuggaguggugc

SEQ ID NO: 1104317 - RNA, 22 nt, Human
acacacagaguuuauacaggca

SEQ ID NO: 1104318 - RNA, 22 nt, Human
aaaggccacacugcucuuucuc

SEQ ID NO: 1104319 - RNA, 22 nt, Human
agcagagccugggcuaggggug

SEQ ID NO: 1104320 - RNA, 22 nt, Human
uuagaaagaacuuuagauauca

SEQ ID NO: 1104321 - RNA, 22 nt, Human
uccauucauucauugaugaaca

SEQ ID NO: 1104322 - RNA, 17 nt, Human
uuugaaaggaugucagu

SEQ ID NO: 1104323 - RNA, 22 nt, Human
aggggcucaaagugugcaggga

SEQ ID NO: 1104324 - RNA, 21 nt, Human
cagcccagcccauugacagug

SEQ ID NO: 1104325 - RNA, 22 nt, Human
uauuuguugaguuguuaugucu

SEQ ID NO: 1104326 - RNA, 20 nt, Human
gggagucuggaugaaagaug

SEQ ID NO: 1104327 - RNA, 22 nt, Human
acacacuggcccccaguacuga

SEQ ID NO: 1104328 - RNA, 22 nt, Human
agaggccaugcuagaggccugg

SEQ ID NO: 1104329 - RNA, 22 nt, Human
cacucaggguacaauggagggc

SEQ ID NO: 1104330 - RNA, 22 nt, Human
cacacaucuuaucccaguuauu

SEQ ID NO: 1104331 - RNA, 22 nt, Human
agaccauggccauccuaggaaa

SEQ ID NO: 1104332 - RNA, 22 nt, Human
cacauacuuguguguacauaug

SEQ ID NO: 1104333 - RNA, 22 nt, Human
caggauggccccggggcugugc

SEQ ID NO: 1104334 - RNA, 22 nt, Human
uugaaaggugaacaugaugcac

SEQ ID NO: 1104335 - RNA, 22 nt, Human
ucacacaugcuaagccagagau

SEQ ID NO: 1104336 - RNA, 22 nt, Human
acccacacaucucuaauucagu

SEQ ID NO: 1104337 - RNA, 22 nt, Human
cagauccacccuuguagugaca

SEQ ID NO: 1104338 - RNA, 22 nt, Human
cacacauuucagaugcuacaau

SEQ ID NO: 1104339 - RNA, 22 nt, Human
aggcucagaggugagcaucugc

SEQ ID NO: 1104340 - RNA, 22 nt, Human
uuucauugcagagucugugugc

SEQ ID NO: 1104341 - RNA, 20 nt, Human
ucauuguguugccaauuccc

SEQ ID NO: 1104342 - RNA, 22 nt, Human
cagagccacuuggagaugagaa

SEQ ID NO: 1104343 - RNA, 22 nt, Human
uuagccaugugggaaaaacagc

SEQ ID NO: 1104344 - RNA, 22 nt, Human
ucacauaaauuuaccagaugau

SEQ ID NO: 1104345 - RNA, 22 nt, Human
gaaggccacaagagaaguuaag

SEQ ID NO: 1104346 - RNA, 22 nt, Human
cuugaaagauuuggccucugug

SEQ ID NO: 1104347 - RNA, 21 nt, Human
ugaaugaggaggauggcauuu

SEQ ID NO: 1104348 - RNA, 22 nt, Human
ugucucugggugauucaguccu

SEQ ID NO: 1104349 - RNA, 22 nt, Human
ucucgacagccuggcacagugg

SEQ ID NO: 1104350 - RNA, 22 nt, Human
cuggcuuucucugugguguuca

SEQ ID NO: 1104351 - RNA, 22 nt, Human
ccaggcugggcuacaaguugag

SEQ ID NO: 1104352 - RNA, 22 nt, Human
ugagagucuguuccucuugcag

SEQ ID NO: 1104353 - RNA, 22 nt, Human
uccccacagcagaagaucugag

SEQ ID NO: 1104354 - RNA, 22 nt, Human
gagagucuaggaaccucauaua

SEQ ID NO: 1104355 - RNA, 22 nt, Human
cuugaaagcacuuaguaaauua

SEQ ID NO: 1104356 - RNA, 22 nt, Human
ucucuguaguugggcagcugcu

SEQ ID NO: 1104357 - RNA, 22 nt, Human
cuuacacagucuggcacuucuu

SEQ ID NO: 1104358 - RNA, 20 nt, Human
gagauggacagaugaagggg

SEQ ID NO: 1104359 - RNA, 22 nt, Human
cagucucucagcuuucagcugu

SEQ ID NO: 1104360 - RNA, 22 nt, Human
guccucugucccuggggcacgg

SEQ ID NO: 1104361 - RNA, 22 nt, Human
ucauuuguucucauucucuacu

SEQ ID NO: 1104362 - RNA, 22 nt, Human
gguggagcuggaccaggagagg

SEQ ID NO: 1104363 - RNA, 22 nt, Human
cacauaagaaaugaauaugaga

SEQ ID NO: 1104364 - RNA, 21 nt, Human
acauacauaccuuaccaccuu

SEQ ID NO: 1104365 - RNA, 22 nt, Human
uugaaggacauccuauuucuag

SEQ ID NO: 1104366 - RNA, 17 nt, Human
gccucugcuugugucau

SEQ ID NO: 1104367 - RNA, 20 nt, Human
ccucaggaugagggugagca

SEQ ID NO: 1104368 - RNA, 20 nt, Human
aucaggauucuugcuuuguu

SEQ ID NO: 1104369 - RNA, 22 nt, Human
guguugaugacauuuuagaaac

SEQ ID NO: 1104370 - RNA, 22 nt, Human
cucaggaugaaagucaugguga

SEQ ID NO: 1104371 - RNA, 22 nt, Human
uacugacacaaagccaaucccu

SEQ ID NO: 1104372 - RNA, 22 nt, Human
gcugcuaagcguuucuguucca

SEQ ID NO: 1104373 - RNA, 22 nt, Human
acacauacauggggaagaugag

SEQ ID NO: 1104374 - RNA, 22 nt, Human
cucaucaccacauauaacaaag

SEQ ID NO: 1104375 - RNA, 22 nt, Human
gucuccugagacugcagucacc

SEQ ID NO: 1104376 - RNA, 22 nt, Human
ucacacauuucucaaguguagg

SEQ ID NO: 1104377 - RNA, 22 nt, Human
uagauuuuacuucugucauuac

SEQ ID NO: 1104378 - RNA, 22 nt, Human
cucccagagaccaagcugagaa

SEQ ID NO: 1104379 - RNA, 22 nt, Human
caaggccaagguuuugugaacu

SEQ ID NO: 1104380 - RNA, 22 nt, Human
gagccaaggguugccauggaga

SEQ ID NO: 1104381 - RNA, 22 nt, Human
guccucuguagggcugggccac

SEQ ID NO: 1104382 - RNA, 22 nt, Human
uaaggccaccguuauagaacca

SEQ ID NO: 1104383 - RNA, 20 nt, Human
cucaggauugucuagccccu

SEQ ID NO: 1104384 - RNA, 22 nt, Human
cagugucuccagaugcuccaau

SEQ ID NO: 1104385 - RNA, 22 nt, Human
gaggcugaggguuagagaguca

SEQ ID NO: 1104386 - RNA, 22 nt, Human
agucucagaaaagaagcaugga

SEQ ID NO: 1104387 - RNA, 22 nt, Human
uggcacaguccugggugccugc

SEQ ID NO: 1104388 - RNA, 22 nt, Human
acacauuugcauaauaccucau

SEQ ID NO: 1104389 - RNA, 22 nt, Human
aaggcaguacuuuauguccaua

SEQ ID NO: 1104390 - RNA, 22 nt, Human
uuuuuguagucauuagaagagg

SEQ ID NO: 1104391 - RNA, 22 nt, Human
gcagagcuucuguccuucagga

SEQ ID NO: 1104392 - RNA, 22 nt, Human
uugaaagugccaaguccuagug

SEQ ID NO: 1104393 - RNA, 22 nt, Human
ucacacaugaguaaauacaggg

SEQ ID NO: 1104394 - RNA, 22 nt, Human
ggagcuguucaggacugcuuca

SEQ ID NO: 1104395 - RNA, 22 nt, Human
ccacaucauggauacaguuaug

SEQ ID NO: 1104396 - RNA, 22 nt, Human
ccaagaugaucuuuacaguguu

SEQ ID NO: 1104397 - RNA, 22 nt, Human
uuugaaagucaaccuuccaguu

SEQ ID NO: 1104398 - RNA, 23 nt, Human
ucucaagaggaagcagggcucau

SEQ ID NO: 1104399 - RNA, 22 nt, Human
uucaugugaauauauuugucuu

SEQ ID NO: 1104400 - RNA, 22 nt, Human
acugccaaugguaguuugaugg

SEQ ID NO: 1104401 - RNA, 22 nt, Human
cucccaggggaacuaucaagua

SEQ ID NO: 1104402 - RNA, 22 nt, Human
aucaggaucugcaucauaagaa

SEQ ID NO: 1104403 - RNA, 22 nt, Human
caagaugggcaccccagcaccu

SEQ ID NO: 1104404 - RNA, 22 nt, Human
ucagauggcacacagagccugc

SEQ ID NO: 1104405 - RNA, 22 nt, Human
aggcacaggaaugucauccagu

SEQ ID NO: 1104406 - RNA, 22 nt, Human
cccauucauccucgcuuccuuc

SEQ ID NO: 1104407 - RNA, 22 nt, Human
aaaggaagaugccaggacucug

SEQ ID NO: 1104408 - RNA, 22 nt, Human
uuucuucucgacaccuuauccc

SEQ ID NO: 1104409 - RNA, 22 nt, Human
uacuuccuguuuccaugucugu

SEQ ID NO: 1104410 - RNA, 22 nt, Human
uagcuaucuguguccagaucca

SEQ ID NO: 1104411 - RNA, 21 nt, Human
ggcagccucuguggaagggga

SEQ ID NO: 1104412 - RNA, 22 nt, Human
caggauggugugagugugagga

SEQ ID NO: 1104413 - RNA, 22 nt, Human
agaccaagaaaggaugaggauc

SEQ ID NO: 1104414 - RNA, 22 nt, Human
cucaggauggaagccuacagga

SEQ ID NO: 1104415 - RNA, 22 nt, Human
gucacacagggccuccaaauca

SEQ ID NO: 1104416 - RNA, 22 nt, Human
cacucaggcugugucaggagga

SEQ ID NO: 1104417 - RNA, 22 nt, Human
gaggcugauucggggaacagca

SEQ ID NO: 1104418 - RNA, 21 nt, Human
cucaggaucuuauauauuagu

SEQ ID NO: 1104419 - RNA, 22 nt, Human
ugaaagguuauuuaggucugcu

SEQ ID NO: 1104420 - RNA, 22 nt, Human
cucaggaugucggugacuauug

SEQ ID NO: 1104421 - RNA, 22 nt, Human
auggagacgcaagggaccuagg

SEQ ID NO: 1104422 - RNA, 22 nt, Human
ucaggaauccagacagggcaca

SEQ ID NO: 1104423 - RNA, 22 nt, Human
uguugagacugagggagucagc

SEQ ID NO: 1104424 - RNA, 22 nt, Human
acucaggaaauugagauaaugg

SEQ ID NO: 1104425 - RNA, 22 nt, Human
uggaaugacagagagucugaau

SEQ ID NO: 1104426 - RNA, 22 nt, Human
ggccagagaauaugccuuacgu

SEQ ID NO: 1104427 - RNA, 23 nt, Human
ucagagagcuguugagagcugcc

SEQ ID NO: 1104428 - RNA, 22 nt, Human
caggaugagaggcccagggaag

SEQ ID NO: 1104429 - RNA, 22 nt, Human
aaaggcaggcuuucacaucuca

SEQ ID NO: 1104430 - RNA, 22 nt, Human
gaaggccaguuuugagauaggu

SEQ ID NO: 1104431 - RNA, 22 nt, Human
gcuguucucuguaacaugcauu

SEQ ID NO: 1104432 - RNA, 19 nt, Human
uuugaaagaguuuuauugg

SEQ ID NO: 1104433 - RNA, 22 nt, Human
gccacaggcacuuaagggcugg

SEQ ID NO: 1104434 - RNA, 22 nt, Human
gagagguccauuccccugucag

SEQ ID NO: 1104435 - RNA, 22 nt, Human
cagaccagcucuaugaacccaa

SEQ ID NO: 1104436 - RNA, 22 nt, Human
agacucaagacugcagaagacg

SEQ ID NO: 1104437 - RNA, 22 nt, Human
ugguccugccccgugcacagag

SEQ ID NO: 1104438 - RNA, 22 nt, Human
cuggaggcacccuuagagaggc

SEQ ID NO: 1104439 - RNA, 22 nt, Human
ugauugaacugagcuucaagau

SEQ ID NO: 1104440 - RNA, 22 nt, Human
guugaaagagcauggacuugaa

SEQ ID NO: 1104441 - RNA, 22 nt, Human
ucucauugguauauacaugugu

SEQ ID NO: 1104442 - RNA, 22 nt, Human
uuccagccaugguuucccuaug

SEQ ID NO: 1104443 - RNA, 22 nt, Human
accauuuuggguauuuucagag

SEQ ID NO: 1104444 - RNA, 22 nt, Human
acaugacuuuucucuuccagag

SEQ ID NO: 1104445 - RNA, 22 nt, Human
acauuuuuuagagucccacauu

SEQ ID NO: 1104446 - RNA, 22 nt, Human
cuugaaagcuuugcgucuucua

SEQ ID NO: 1104447 - RNA, 22 nt, Human
cuccucuguauugauugggacu

SEQ ID NO: 1104448 - RNA, 22 nt, Human
ccaggaugacccccacuuuccu

SEQ ID NO: 1104449 - RNA, 23 nt, Human
uaaauuaccuuuccagugcaggg

SEQ ID NO: 1104450 - RNA, 22 nt, Human
auucauuugcuauuguguaugg

SEQ ID NO: 1104451 - RNA, 22 nt, Human
agaccaugggcucugaagagca

SEQ ID NO: 1104452 - RNA, 22 nt, Human
uagacacaucuucauccacaau

SEQ ID NO: 1104453 - RNA, 22 nt, Human
guacauuucucuuguucuuauu

SEQ ID NO: 1104454 - RNA, 19 nt, Human
caggaaugagguaauggcu

SEQ ID NO: 1104455 - RNA, 22 nt, Human
guccucuggccuuucccaggac

SEQ ID NO: 1104456 - RNA, 22 nt, Human
uccccacaucucugcaucaggc

SEQ ID NO: 1104457 - RNA, 22 nt, Human
cucuggcuucuaccuugcaguu

SEQ ID NO: 1104458 - RNA, 22 nt, Human
ggauggagguucucagaugcuc

SEQ ID NO: 1104459 - RNA, 19 nt, Human
agggaguuuauauuugcac

SEQ ID NO: 1104460 - RNA, 22 nt, Human
acacaucucaggggacacucuc

SEQ ID NO: 1104461 - RNA, 21 nt, Human
auugaaagucaacaaucaguu

SEQ ID NO: 1104462 - RNA, 22 nt, Human
aaaggccaccaacaugaagcau

SEQ ID NO: 1104463 - RNA, 22 nt, Human
ucccacacuacacgguuguugg

SEQ ID NO: 1104464 - RNA, 22 nt, Human
uguauuuuuagaccuuuagacc

SEQ ID NO: 1104465 - RNA, 22 nt, Human
uucaugugaucacagauuguaa

SEQ ID NO: 1104466 - RNA, 22 nt, Human
aaggccagacaggaccacaucu

SEQ ID NO: 1104467 - RNA, 22 nt, Human
uugaaagaagaagcugcgaugu

SEQ ID NO: 1104468 - RNA, 22 nt, Human
uuagccauauagaaaaagagcu

SEQ ID NO: 1104469 - RNA, 22 nt, Human
acagucuugagcaucagccaga

SEQ ID NO: 1104470 - RNA, 19 nt, Human
cucucacucgccacauccu

SEQ ID NO: 1104471 - RNA, 22 nt, Human
ucuccacacuuucucucccagg

SEQ ID NO: 1104472 - RNA, 22 nt, Human
ggagugucagaaacaguguccu

SEQ ID NO: 1104473 - RNA, 21 nt, Human
cacacagugaucuauccacau

SEQ ID NO: 1104474 - RNA, 22 nt, Human
gagggucccugcucagggccag

SEQ ID NO: 1104475 - RNA, 22 nt, Human
ucaauucaacacaugcacauug

SEQ ID NO: 1104476 - RNA, 20 nt, Human
cucaggauacugcaaaguug

SEQ ID NO: 1104477 - RNA, 22 nt, Human
ucaggauggcuucugcaucaaa

SEQ ID NO: 1104478 - RNA, 22 nt, Human
gcucagagcuugaaguuccacu

SEQ ID NO: 1104479 - RNA, 22 nt, Human
uuuguuuagaugguaaaucagu

SEQ ID NO: 1104480 - RNA, 20 nt, Human
augugagggguugaaguggg

SEQ ID NO: 1104481 - RNA, 22 nt, Human
gcucaggaaauaguuuaguguu

SEQ ID NO: 1104482 - RNA, 22 nt, Human
acauaccauacauggugagaug

SEQ ID NO: 1104483 - RNA, 22 nt, Human
ucauggauggccgggaggugau

SEQ ID NO: 1104484 - RNA, 22 nt, Human
aauggcagaggcaaagauggua

SEQ ID NO: 1104485 - RNA, 22 nt, Human
aagagagaacucccuucgccag

SEQ ID NO: 1104486 - RNA, 20 nt, Human
ccucaguguccuggacuggg

SEQ ID NO: 1104487 - RNA, 22 nt, Human
ucacagacacagggagaagcau

SEQ ID NO: 1104488 - RNA, 22 nt, Human
gaaccucagugaaacuggaggu

SEQ ID NO: 1104489 - RNA, 22 nt, Human
aggguccugggugcaguugcuu

SEQ ID NO: 1104490 - RNA, 22 nt, Human
agucucugucguagaucagcgu

SEQ ID NO: 1104491 - RNA, 22 nt, Human
ccugccugcaccuucucugggg

SEQ ID NO: 1104492 - RNA, 22 nt, Human
caggauggagaguuguugguug

SEQ ID NO: 1104493 - RNA, 22 nt, Human
uggcaucucaaacaggcagauu

SEQ ID NO: 1104494 - RNA, 22 nt, Human
auggcagacgaggcagcagggg

SEQ ID NO: 1104495 - RNA, 22 nt, Human
aaaggccacuugaaggauuuuu

SEQ ID NO: 1104496 - RNA, 21 nt, Human
gacaaagugaagcaggcagga

SEQ ID NO: 1104497 - RNA, 22 nt, Human
ucagccucucugaguccagacc

SEQ ID NO: 1104498 - RNA, 17 nt, Human
gcaucacagauaacacg

SEQ ID NO: 1104499 - RNA, 22 nt, Human
aucugccucuucuucauugcga

SEQ ID NO: 1104500 - RNA, 22 nt, Human
ugcucuguauucuauggcaguu

SEQ ID NO: 1104501 - RNA, 22 nt, Human
uuccacauuccuuacauucaua

SEQ ID NO: 1104502 - RNA, 22 nt, Human
gucaggaucaaauugaaguuau

SEQ ID NO: 1104503 - RNA, 22 nt, Human
agcccagcuuugaaccauauca

SEQ ID NO: 1104504 - RNA, 17 nt, Human
ugaaggccaugaccacg

SEQ ID NO: 1104505 - RNA, 22 nt, Human
aucucccagccacagcauucuu

SEQ ID NO: 1104506 - RNA, 22 nt, Human
ccucugcucugguccaugugcu

SEQ ID NO: 1104507 - RNA, 22 nt, Human
guucuugccagcauccucaggu

SEQ ID NO: 1104508 - RNA, 22 nt, Human
ugguaaauauguccauucucuu

SEQ ID NO: 1104509 - RNA, 22 nt, Human
acauuuuuauucaucaaagcag

SEQ ID NO: 1104510 - RNA, 22 nt, Human
uauaucaccaaaaacaguucug

SEQ ID NO: 1104511 - RNA, 22 nt, Human
gccccacagccugcggucucag

SEQ ID NO: 1104512 - RNA, 22 nt, Human
ggcacagagcccagcuuccuag

SEQ ID NO: 1104513 - RNA, 22 nt, Human
ggcagugagaggucuccugguc

SEQ ID NO: 1104514 - RNA, 22 nt, Human
guugaaagaucauguggcugcc

SEQ ID NO: 1104515 - RNA, 22 nt, Human
gucaggaugcuauuguuauuaa

SEQ ID NO: 1104516 - RNA, 18 nt, Human
ggccucuggacuggcagc

SEQ ID NO: 1104517 - RNA, 22 nt, Human
uagcuuuccuuguugccugugc

SEQ ID NO: 1104518 - RNA, 22 nt, Human
gagaggucaucucccaucagca

SEQ ID NO: 1104519 - RNA, 22 nt, Human
ccacuguuuuucaguuaacuuu

SEQ ID NO: 1104520 - RNA, 22 nt, Human
uugauguacagaauuguucaca

SEQ ID NO: 1104521 - RNA, 22 nt, Human
caaggccagagccagcgauaag

SEQ ID NO: 1104522 - RNA, 20 nt, Human
ucagaugggagugagccauc

SEQ ID NO: 1104523 - RNA, 22 nt, Human
cauuuguuuagaagucuuuaua

SEQ ID NO: 1104524 - RNA, 22 nt, Human
ucucaggaagauuagggcuaag

SEQ ID NO: 1104525 - RNA, 22 nt, Human
cagauggaacacagaaaggaga

SEQ ID NO: 1104526 - RNA, 22 nt, Human
auucauuuagguauucacuuac

SEQ ID NO: 1104527 - RNA, 22 nt, Human
ggcucagaccucccagcuccag

SEQ ID NO: 1104528 - RNA, 19 nt, Human
ucauuguugguuugucggg

SEQ ID NO: 1104529 - RNA, 22 nt, Human
uuuacaaccucauauucugaug

SEQ ID NO: 1104530 - RNA, 22 nt, Human
aagauggaguaguguaaugguu

SEQ ID NO: 1104531 - RNA, 22 nt, Human
cucaggauccaucuccugcccu

SEQ ID NO: 1104532 - RNA, 22 nt, Human
gaaucucaaggcuugugaggau

SEQ ID NO: 1104533 - RNA, 22 nt, Human
gaaggccauuuuuagguagaau

SEQ ID NO: 1104534 - RNA, 23 nt, Human
auugaugacuugauuacacuuuu

SEQ ID NO: 1104535 - RNA, 20 nt, Human
caucaucacaugagccaauu

SEQ ID NO: 1104536 - RNA, 22 nt, Human
gucccauaaguagugcaacuug

SEQ ID NO: 1104537 - RNA, 22 nt, Human
aaccauuugccauuaucuuaag

SEQ ID NO: 1104538 - RNA, 22 nt, Human
ucucagucagccuugauguccc

SEQ ID NO: 1104539 - RNA, 22 nt, Human
uuugaaagccuggcuuuucucu

SEQ ID NO: 1104540 - RNA, 22 nt, Human
ugcuuucaaaggcuuucuagau

SEQ ID NO: 1104541 - RNA, 22 nt, Human
uuuuuauaugaaggauagugcg

SEQ ID NO: 1104542 - RNA, 22 nt, Human
gugaaggacuagcauggagggc

SEQ ID NO: 1104543 - RNA, 22 nt, Human
acacucacccucccacugccug

SEQ ID NO: 1104544 - RNA, 22 nt, Human
uucccucuccuacucaggaaag

SEQ ID NO: 1104545 - RNA, 22 nt, Human
guccucugauuucuagguauau

SEQ ID NO: 1104546 - RNA, 22 nt, Human
ccauccuaucugaccuacuugu

SEQ ID NO: 1104547 - RNA, 22 nt, Human
uuugaaagcaccauuugaguag

SEQ ID NO: 1104548 - RNA, 22 nt, Human
uuucacagguacaaacacuccu

SEQ ID NO: 1104549 - RNA, 22 nt, Human
gcacauaacugaccacaucuaa

SEQ ID NO: 1104550 - RNA, 22 nt, Human
cuggccuggggggacacauccc

SEQ ID NO: 1104551 - RNA, 22 nt, Human
ggcucagagaccugcgaucuga

SEQ ID NO: 1104552 - RNA, 22 nt, Human
uucaggauucucucccauuuac

SEQ ID NO: 1104553 - RNA, 22 nt, Human
ucacacacauggauaguauuuu

SEQ ID NO: 1104554 - RNA, 22 nt, Human
aaggaguuuggguagucauaca

SEQ ID NO: 1104555 - RNA, 22 nt, Human
aaggcaguuugggccaccaucu

SEQ ID NO: 1104556 - RNA, 20 nt, Human
ucacacaugguaagcuauga

SEQ ID NO: 1104557 - RNA, 22 nt, Human
acuuuugguucuguaacuguga

SEQ ID NO: 1104558 - RNA, 22 nt, Human
gcacacagcuagauuaccauuc

SEQ ID NO: 1104559 - RNA, 22 nt, Human
ugauuuuuagcuauucugaaga

SEQ ID NO: 1104560 - RNA, 22 nt, Human
cucugcaugccuugcucagaca

SEQ ID NO: 1104561 - RNA, 22 nt, Human
uggcgucucucauaaguaugug

SEQ ID NO: 1104562 - RNA, 22 nt, Human
cuuccucuagccuaguaaugcc

SEQ ID NO: 1104563 - RNA, 22 nt, Human
gaggacaggagacucacuguuu

SEQ ID NO: 1104564 - RNA, 22 nt, Human
cacaauuuuaauacacagucaa

SEQ ID NO: 1104565 - RNA, 22 nt, Human
gacacuucaccuuucccagccu

SEQ ID NO: 1104566 - RNA, 22 nt, Human
augaaggcaguuaaacgucauc

SEQ ID NO: 1104567 - RNA, 17 nt, Human
cauuuguugaucaguug

SEQ ID NO: 1104568 - RNA, 22 nt, Human
ccacacuaaacugcucaaacca

SEQ ID NO: 1104569 - RNA, 22 nt, Human
cagaguucaaagccugcuggga

SEQ ID NO: 1104570 - RNA, 22 nt, Human
cucagagaggcaguggaaguca

SEQ ID NO: 1104571 - RNA, 22 nt, Human
uccauuuuguagguaugcuaca

SEQ ID NO: 1104572 - RNA, 22 nt, Human
aggcacaggccucagcacccag

SEQ ID NO: 1104573 - RNA, 22 nt, Human
aucacagagcucccuuccacug

SEQ ID NO: 1104574 - RNA, 22 nt, Human
agagacagaggcaauauagcuu

SEQ ID NO: 1104575 - RNA, 22 nt, Human
agggcaguucaacuucauagug

SEQ ID NO: 1104576 - RNA, 20 nt, Human
cccacacccuucccacuugg

SEQ ID NO: 1104577 - RNA, 22 nt, Human
uucuuugaguuaguacagucca

SEQ ID NO: 1104578 - RNA, 22 nt, Human
gugggagcuuuggcaucaggcu

SEQ ID NO: 1104579 - RNA, 22 nt, Human
cccacacacuggcugcugccaa

SEQ ID NO: 1104580 - RNA, 22 nt, Human
uggcagagagacucuccuugau

SEQ ID NO: 1104581 - RNA, 20 nt, Human
accaauguuagcuuaguacu

SEQ ID NO: 1104582 - RNA, 22 nt, Human
ucaucacaauuuuaugacccuc

SEQ ID NO: 1104583 - RNA, 22 nt, Human
aaucuguuuaguucugcguaug

SEQ ID NO: 1104584 - RNA, 22 nt, Human
gccucugcaauuacauugugcc

SEQ ID NO: 1104585 - RNA, 22 nt, Human
cacucuccagcacaccccauuu

SEQ ID NO: 1104586 - RNA, 22 nt, Human
auacauucaaaggaaggauaga

SEQ ID NO: 1104587 - RNA, 22 nt, Human
aauggccagcaacaggagugaa

SEQ ID NO: 1104588 - RNA, 22 nt, Human
gcacacaugcaugcacaggagu

SEQ ID NO: 1104589 - RNA, 21 nt, Human
uuugaaagcccuauguuuuca

SEQ ID NO: 1104590 - RNA, 22 nt, Human
aucaggaucagggcuagcagag

SEQ ID NO: 1104591 - RNA, 22 nt, Human
gugguaauuuaauccuacacug

SEQ ID NO: 1104592 - RNA, 22 nt, Human
ccaggcugccgaggaaagaaag

SEQ ID NO: 1104593 - RNA, 22 nt, Human
acacauuuacauguuuacguau

SEQ ID NO: 1104594 - RNA, 22 nt, Human
aguggcaggcggagauguagga

SEQ ID NO: 1104595 - RNA, 22 nt, Human
uuuguuuagaaagagauuggug

SEQ ID NO: 1104596 - RNA, 22 nt, Human
uuugaaaggagcuuuauccaga

SEQ ID NO: 1104597 - RNA, 22 nt, Human
caggaugaagggcaaaggcaag

SEQ ID NO: 1104598 - RNA, 22 nt, Human
gagaccucuugguaucgcuagg

SEQ ID NO: 1104599 - RNA, 22 nt, Human
aaugucugcucuacucaggagg

SEQ ID NO: 1104600 - RNA, 22 nt, Human
uucacagacuuuccauagauug

SEQ ID NO: 1104601 - RNA, 22 nt, Human
ccuucauugcaucuuuaagaga

SEQ ID NO: 1104602 - RNA, 22 nt, Human
uuugaaagagcugauacaugaa

SEQ ID NO: 1104603 - RNA, 22 nt, Human
uggcagagcccagacuccaguc

SEQ ID NO: 1104604 - RNA, 22 nt, Human
uucacagacauugcagacugaa

SEQ ID NO: 1104605 - RNA, 22 nt, Human
agucucugccagcuuguccucu

SEQ ID NO: 1104606 - RNA, 22 nt, Human
aggcacagcacaccuggccccc

SEQ ID NO: 1104607 - RNA, 22 nt, Human
uucauugugauucuuggcuagc

SEQ ID NO: 1104608 - RNA, 22 nt, Human
uguuuuaaucucccauugcucu

SEQ ID NO: 1104609 - RNA, 22 nt, Human
uugagaagaggcuuuguaggaa

SEQ ID NO: 1104610 - RNA, 21 nt, Human
aacacauccagaguauuugac

SEQ ID NO: 1104611 - RNA, 22 nt, Human
ucaggaugguguggaggaaaua

SEQ ID NO: 1104612 - RNA, 22 nt, Human
ugaaagguuaaaaguaguauug

SEQ ID NO: 1104613 - RNA, 22 nt, Human
aucaggaugacuauaaggcugc

SEQ ID NO: 1104614 - RNA, 22 nt, Human
ccuugcucaagcuagugacggg

SEQ ID NO: 1104615 - RNA, 22 nt, Human
ucugcaucauuuuucagagccg

SEQ ID NO: 1104616 - RNA, 22 nt, Human
uucuagaugauaaaccagcagc

SEQ ID NO: 1104617 - RNA, 18 nt, Human
cccacacagcaguagcuc

SEQ ID NO: 1104618 - RNA, 22 nt, Human
guccucugggcagcugccccac

SEQ ID NO: 1104619 - RNA, 22 nt, Human
cagaaccaggaacugauggaga

SEQ ID NO: 1104620 - RNA, 22 nt, Human
gagacaucauaaugaaguuucc

SEQ ID NO: 1104621 - RNA, 22 nt, Human
cucacugugccuuuucccaaac

SEQ ID NO: 1104622 - RNA, 22 nt, Human
aucaggaucaugcuggguggga

SEQ ID NO: 1104623 - RNA, 22 nt, Human
aucaggauagugguuaccuggg

SEQ ID NO: 1104624 - RNA, 22 nt, Human
gcacacacuguuuuccucacau

SEQ ID NO: 1104625 - RNA, 22 nt, Human
caggauagaaaggccauggagu

SEQ ID NO: 1104626 - RNA, 22 nt, Human
caaggccaagucucugugaaga

SEQ ID NO: 1104627 - RNA, 22 nt, Human
ugggagcccaagggagcugccg

SEQ ID NO: 1104628 - RNA, 22 nt, Human
cgccucagccguggucaucuuc

SEQ ID NO: 1104629 - RNA, 21 nt, Human
gaacauuuggguuguuucuac

SEQ ID NO: 1104630 - RNA, 22 nt, Human
uuccagcccgcgacuuguucag

SEQ ID NO: 1104631 - RNA, 20 nt, Human
ugugaaagcaguagaaugac

SEQ ID NO: 1104632 - RNA, 22 nt, Human
uacacacaugcauuugccuuau

SEQ ID NO: 1104633 - RNA, 22 nt, Human
uugcugaaaacaguggguauug

SEQ ID NO: 1104634 - RNA, 22 nt, Human
auggcagagggauugaacagcu

SEQ ID NO: 1104635 - RNA, 22 nt, Human
ucuucauuccguagauauuuau

SEQ ID NO: 1104636 - RNA, 22 nt, Human
uuaaagggccgauuuccaggcc

SEQ ID NO: 1104637 - RNA, 22 nt, Human
agacacauaggaccacacugug

SEQ ID NO: 1104638 - RNA, 20 nt, Human
ucacuaguaaccaucugcuu

SEQ ID NO: 1104639 - RNA, 22 nt, Human
aaucuguucuacucuauucaga

SEQ ID NO: 1104640 - RNA, 22 nt, Human
gaucauuugcaggaaacauuaa

SEQ ID NO: 1104641 - RNA, 22 nt, Human
aaugagacacgugaagcagaug

SEQ ID NO: 1104642 - RNA, 22 nt, Human
cuuucauucuuagauauuagug

SEQ ID NO: 1104643 - RNA, 22 nt, Human
ucaucacauguguagucauccc

SEQ ID NO: 1104644 - RNA, 20 nt, Human
gaguuccccauuucuccugg

SEQ ID NO: 1104645 - RNA, 22 nt, Human
uacauaguauucacauuguuuu

SEQ ID NO: 1104646 - RNA, 23 nt, Human
aggauguaggauguauggcagag

SEQ ID NO: 1104647 - RNA, 22 nt, Human
ggucagagggugggcugccugu

SEQ ID NO: 1104648 - RNA, 22 nt, Human
uuugaaaggaaguuaauacuuu

SEQ ID NO: 1104649 - RNA, 22 nt, Human
uugaauaguguuuucaguauac

SEQ ID NO: 1104650 - RNA, 22 nt, Human
cugccuccugccgugcagcuuc

SEQ ID NO: 1104651 - RNA, 23 nt, Human
aaggccagaauuucaauggugcc

SEQ ID NO: 1104652 - RNA, 18 nt, Human
agucuucugauccauuuu

SEQ ID NO: 1104653 - RNA, 22 nt, Human
ggcccagccucagacaugcccu

SEQ ID NO: 1104654 - RNA, 22 nt, Human
agaggccagguccagaguuugu

SEQ ID NO: 1104655 - RNA, 22 nt, Human
cugucauugagccugucagggc

SEQ ID NO: 1104656 - RNA, 22 nt, Human
cccacccugggcuacacaucca

SEQ ID NO: 1104657 - RNA, 22 nt, Human
cucccagagagcaggugggccg

SEQ ID NO: 1104658 - RNA, 19 nt, Human
ucugccucuggucaggcuc

SEQ ID NO: 1104659 - RNA, 22 nt, Human
ccauacacacaccaaauuugua

SEQ ID NO: 1104660 - RNA, 22 nt, Human
ucucaggaaauaggauuugagu

SEQ ID NO: 1104661 - RNA, 19 nt, Human
ugcauaaauuauauacuuu

SEQ ID NO: 1104662 - RNA, 22 nt, Human
auugaaagcacaaagaacaagu

SEQ ID NO: 1104663 - RNA, 22 nt, Human
acacacaugguauuguucagaa

SEQ ID NO: 1104664 - RNA, 21 nt, Human
acacacucugagucuucuauu

SEQ ID NO: 1104665 - RNA, 22 nt, Human
aaggagaaaugguagaugugca

SEQ ID NO: 1104666 - RNA, 20 nt, Human
caguccaaucagaggccacc

SEQ ID NO: 1104667 - RNA, 22 nt, Human
aggcacaguuucauccccgggc

SEQ ID NO: 1104668 - RNA, 22 nt, Human
uguggaaaagaauaagggagau

SEQ ID NO: 1104669 - RNA, 22 nt, Human
cagucucuaaaucaaucugaau

SEQ ID NO: 1104670 - RNA, 20 nt, Human
ccagaagagaugaucaucca

SEQ ID NO: 1104671 - RNA, 22 nt, Human
uacugccuggagcauuggugcu

SEQ ID NO: 1104672 - RNA, 19 nt, Human
ugaaauggcaguugcuaaa

SEQ ID NO: 1104673 - RNA, 22 nt, Human
cacacacuggagcaaggagaug

SEQ ID NO: 1104674 - RNA, 22 nt, Human
ggaggccagggacccagucagc

SEQ ID NO: 1104675 - RNA, 22 nt, Human
ggcagaagauaggacagggaau

SEQ ID NO: 1104676 - RNA, 22 nt, Human
cucaggaugcaggucacaggac

SEQ ID NO: 1104677 - RNA, 21 nt, Human
acucaggagacuaacuauguc

SEQ ID NO: 1104678 - RNA, 18 nt, Human
guaggucaguaccaagca

SEQ ID NO: 1104679 - RNA, 22 nt, Human
caaggccagggaauuuuucugg

SEQ ID NO: 1104680 - RNA, 22 nt, Human
uuugaaagcuacuuucggguca

SEQ ID NO: 1104681 - RNA, 21 nt, Human
uuagaaagcucacuacaguua

SEQ ID NO: 1104682 - RNA, 22 nt, Human
gucaggauuuuaaaaucccagu

SEQ ID NO: 1104683 - RNA, 21 nt, Human
uucuccccagcgaauccucgg

SEQ ID NO: 1104684 - RNA, 22 nt, Human
uuagccauuaauguccugugca

SEQ ID NO: 1104685 - RNA, 18 nt, Human
caugucugcgccacaagg

SEQ ID NO: 1104686 - RNA, 22 nt, Human
uuucuuguaagauguuuauuaa

SEQ ID NO: 1104687 - RNA, 22 nt, Human
cucaggauuaaggaaucuaaau

SEQ ID NO: 1104688 - RNA, 22 nt, Human
aggacacacagaauacaaaucc

SEQ ID NO: 1104689 - RNA, 22 nt, Human
agucuccuuggccucaaugccu

SEQ ID NO: 1104690 - RNA, 22 nt, Human
aucacugucgucaucugagauu

SEQ ID NO: 1104691 - RNA, 22 nt, Human
gggagcugaauggcaauggaga

SEQ ID NO: 1104692 - RNA, 22 nt, Human
gacccauauaggacccuccaaa

SEQ ID NO: 1104693 - RNA, 22 nt, Human
uggcagagaacacggcugaucu

SEQ ID NO: 1104694 - RNA, 22 nt, Human
ucacaguaaaagcauggaagag

SEQ ID NO: 1104695 - RNA, 22 nt, Human
ucacuguugaccuggaaguggg

SEQ ID NO: 1104696 - RNA, 22 nt, Human
ucccacaggaaaguagacauug

SEQ ID NO: 1104697 - RNA, 22 nt, Human
acaauucugaugguuucccagu

SEQ ID NO: 1104698 - RNA, 22 nt, Human
uugagaagaauguguugaguuu

SEQ ID NO: 1104699 - RNA, 22 nt, Human
cuugaaagcacuccuuugacug

SEQ ID NO: 1104700 - RNA, 22 nt, Human
uacacauccauguuuugacuuu

SEQ ID NO: 1104701 - RNA, 22 nt, Human
aaggcaguaggaucuuccacag

SEQ ID NO: 1104702 - RNA, 22 nt, Human
cacugucccuguuuccuggaaa

SEQ ID NO: 1104703 - RNA, 22 nt, Human
cacauacauucauguuacucua

SEQ ID NO: 1104704 - RNA, 20 nt, Human
cagagccaagagcagcaucu

SEQ ID NO: 1104705 - RNA, 22 nt, Human
uucaggauuauacucucuuccc

SEQ ID NO: 1104706 - RNA, 22 nt, Human
uuuuuggguccaggcuguaucu

SEQ ID NO: 1104707 - RNA, 22 nt, Human
gaucauuuugaugcccuuuuag

SEQ ID NO: 1104708 - RNA, 22 nt, Human
cagcccaggccgacaguuccuc

SEQ ID NO: 1104709 - RNA, 22 nt, Human
caucacagguccugaugacauu

SEQ ID NO: 1104710 - RNA, 20 nt, Human
acaggggcagcacaauaaug

SEQ ID NO: 1104711 - RNA, 22 nt, Human
acccacaccuccguauaucacu

SEQ ID NO: 1104712 - RNA, 22 nt, Human
cacagagacagaagcacuuaug

SEQ ID NO: 1104713 - RNA, 22 nt, Human
ucuuagaaauuccccaguggcu

SEQ ID NO: 1104714 - RNA, 22 nt, Human
uccaugucuucaugugucuaac

SEQ ID NO: 1104715 - RNA, 22 nt, Human
aucacauucuuucaaagcaguc

SEQ ID NO: 1104716 - RNA, 22 nt, Human
aucacauuguuagcauagacug

SEQ ID NO: 1104717 - RNA, 22 nt, Human
guccucugaaguugugcaaugc

SEQ ID NO: 1104718 - RNA, 22 nt, Human
aguggcagagccaaguagagcc

SEQ ID NO: 1104719 - RNA, 22 nt, Human
aucaggaugcugucaguuacca

SEQ ID NO: 1104720 - RNA, 22 nt, Human
aagugaagaaauacaugagaau

SEQ ID NO: 1104721 - RNA, 22 nt, Human
ggagcuguuggcagcuaucuug

SEQ ID NO: 1104722 - RNA, 22 nt, Human
ggccagaaguuggaaaagagcc

SEQ ID NO: 1104723 - RNA, 17 nt, Human
ucauuuguugugacuag

SEQ ID NO: 1104724 - RNA, 22 nt, Human
uuggaaagcaagcuggacauac

SEQ ID NO: 1104725 - RNA, 22 nt, Human
ccucaugguacuuacuguagcu

SEQ ID NO: 1104726 - RNA, 22 nt, Human
cuguaugaggaucagacuggac

SEQ ID NO: 1104727 - RNA, 22 nt, Human
cucaggauagcugcgcagccug

SEQ ID NO: 1104728 - RNA, 22 nt, Human
acucaggaagaaagcagcuggu

SEQ ID NO: 1104729 - RNA, 23 nt, Human
uuugaaaguaucaacucgccuga

SEQ ID NO: 1104730 - RNA, 22 nt, Human
agaguucugcucuucucaguga

SEQ ID NO: 1104731 - RNA, 22 nt, Human
ucuccuccuuuuuucaacauag

SEQ ID NO: 1104732 - RNA, 22 nt, Human
ggccagcagucacagggucaga

SEQ ID NO: 1104733 - RNA, 22 nt, Human
uucaggauccccuugaugggcu

SEQ ID NO: 1104734 - RNA, 22 nt, Human
ucaggaugagcucauaacuaug

SEQ ID NO: 1104735 - RNA, 22 nt, Human
agucccuguacuuuccacugcc

SEQ ID NO: 1104736 - RNA, 22 nt, Human
cacauacauacguauguauaca

SEQ ID NO: 1104737 - RNA, 21 nt, Human
ucauuugugaucugauuucca

SEQ ID NO: 1104738 - RNA, 17 nt, Human
guccuacccauggucua

SEQ ID NO: 1104739 - RNA, 21 nt, Human
ucucugugucuuuaagcugga

SEQ ID NO: 1104740 - RNA, 22 nt, Human
gggagucugggcuagacuccuu

SEQ ID NO: 1104741 - RNA, 21 nt, Human
guacacacagguggaugggcu

SEQ ID NO: 1104742 - RNA, 22 nt, Human
augaaggcuguguagauggaug

SEQ ID NO: 1104743 - RNA, 19 nt, Human
uaaggccaaaaguaagugu

SEQ ID NO: 1104744 - RNA, 22 nt, Human
caguuucuuggaugccaauuuc

SEQ ID NO: 1104745 - RNA, 22 nt, Human
ugaaggcccuaucuccauauac

SEQ ID NO: 1104746 - RNA, 16 nt, Human
ucacauacuuccuugc

SEQ ID NO: 1104747 - RNA, 22 nt, Human
caagauggagaagcagcaaggg

SEQ ID NO: 1104748 - RNA, 17 nt, Human
uuucuccuuccaucuca

SEQ ID NO: 1104749 - RNA, 22 nt, Human
agaccauagggaccucagguug

SEQ ID NO: 1104750 - RNA, 22 nt, Human
uccauuuuucaugacuccucaa

SEQ ID NO: 1104751 - RNA, 19 nt, Human
ugagaggcuuaaggcagcu

SEQ ID NO: 1104752 - RNA, 22 nt, Human
uguaggccuauguccagcaauu

SEQ ID NO: 1104753 - RNA, 22 nt, Human
acauuucuaguuguucaucucc

SEQ ID NO: 1104754 - RNA, 22 nt, Human
acacacucaauugcauaagcac

SEQ ID NO: 1104755 - RNA, 22 nt, Human
ucuggcuuucauuuguuuaaag

SEQ ID NO: 1104756 - RNA, 22 nt, Human
aaaggccaauaaagacaagcug

SEQ ID NO: 1104757 - RNA, 22 nt, Human
cagagggcucuuggcugccugc

SEQ ID NO: 1104758 - RNA, 22 nt, Human
ucaggauguuaauauagcauua

SEQ ID NO: 1104759 - RNA, 22 nt, Human
uugcugaauugaauccuuuggu

SEQ ID NO: 1104760 - RNA, 22 nt, Human
uuuuuaguagagguggguuuca

SEQ ID NO: 1104761 - RNA, 22 nt, Human
uucuaugccauguucagcuacu

SEQ ID NO: 1104762 - RNA, 22 nt, Human
uccccaccccagaacuacuagg

SEQ ID NO: 1104763 - RNA, 22 nt, Human
ucucuguacaguacaugccgug

SEQ ID NO: 1104764 - RNA, 22 nt, Human
gcacacacaugugaguacaugc

SEQ ID NO: 1104765 - RNA, 22 nt, Human
uuagccauuuuauacaagugua

SEQ ID NO: 1104766 - RNA, 22 nt, Human
ucuacagacagagcagguggga

SEQ ID NO: 1104767 - RNA, 22 nt, Human
ucuuagcauuucauaacaacug

SEQ ID NO: 1104768 - RNA, 22 nt, Human
aauaugcauuaacuguguacau

SEQ ID NO: 1104769 - RNA, 22 nt, Human
caaggccacuccagagacuggu

SEQ ID NO: 1104770 - RNA, 22 nt, Human
ucuacugcacuggugucucauc

SEQ ID NO: 1104771 - RNA, 22 nt, Human
cccacacaaaucauggggagaa

SEQ ID NO: 1104772 - RNA, 22 nt, Human
uggaguuccuuugaaaggcucu

SEQ ID NO: 1104773 - RNA, 22 nt, Human
cacacacaguuuuguauucugu

SEQ ID NO: 1104774 - RNA, 22 nt, Human
cugcagagcaaguaacauccuc

SEQ ID NO: 1104775 - RNA, 22 nt, Human
cucucagacugaagggccugug

SEQ ID NO: 1104776 - RNA, 22 nt, Human
cccagcaugcacgcugacacuc

SEQ ID NO: 1104777 - RNA, 22 nt, Human
uucaggauucugugucugacaa

SEQ ID NO: 1104778 - RNA, 16 nt, Human
gcacacacaucaauga

SEQ ID NO: 1104779 - RNA, 22 nt, Human
uugaaaguagcagcugcauaug

SEQ ID NO: 1104780 - RNA, 22 nt, Human
aaggcagucugguuucaaagca

SEQ ID NO: 1104781 - RNA, 22 nt, Human
cucaucugauaaaucacucuua

SEQ ID NO: 1104782 - RNA, 22 nt, Human
uugcugaaguuaaugcuugcaa

SEQ ID NO: 1104783 - RNA, 23 nt, Human
uccuuccuuugagaggcuccauc

SEQ ID NO: 1104784 - RNA, 22 nt, Human
ugcugugagguugagaaggaag

SEQ ID NO: 1104785 - RNA, 22 nt, Human
aggcuggagggcaauggcaaga

SEQ ID NO: 1104786 - RNA, 22 nt, Human
cucaggauguacuacagaaggc

SEQ ID NO: 1104787 - RNA, 21 nt, Human
ggauggauagggaagagauuu

SEQ ID NO: 1104788 - RNA, 22 nt, Human
cacauacugagaaucacaccca

SEQ ID NO: 1104789 - RNA, 19 nt, Human
caagugaagccugggaugg

SEQ ID NO: 1104790 - RNA, 22 nt, Human
ucucagucuuugcaaggaugcu

SEQ ID NO: 1104791 - RNA, 22 nt, Human
ccccaggacacauggaccaagu

SEQ ID NO: 1104792 - RNA, 22 nt, Human
cugcuucuccaaaguaggacuu

SEQ ID NO: 1104793 - RNA, 22 nt, Human
ucucaggagccacagcgggagu

SEQ ID NO: 1104794 - RNA, 22 nt, Human
ggcacagagcuuugucccaguu

SEQ ID NO: 1104795 - RNA, 22 nt, Human
ggagcacuauaauagagauuuu

SEQ ID NO: 1104796 - RNA, 22 nt, Human
uccccacacagauacagaguag

SEQ ID NO: 1104797 - RNA, 17 nt, Human
aaucuguuuacagucag

SEQ ID NO: 1104798 - RNA, 17 nt, Human
cucacggaggaugaauc

SEQ ID NO: 1104799 - RNA, 22 nt, Human
agucucugggcaugguugugac

SEQ ID NO: 1104800 - RNA, 22 nt, Human
gaaggccaagaggcuccaagau

SEQ ID NO: 1104801 - RNA, 22 nt, Human
ucccagccuggacccugccagu

SEQ ID NO: 1104802 - RNA, 20 nt, Human
uuugucuguuaaguguuucu

SEQ ID NO: 1104803 - RNA, 21 nt, Human
ucacuagugccuucugucauu

SEQ ID NO: 1104804 - RNA, 22 nt, Human
auacuguuuugugacuuaucuu

SEQ ID NO: 1104805 - RNA, 22 nt, Human
aaguugagaugucauaggagac

SEQ ID NO: 1104806 - RNA, 22 nt, Human
gaccauuugcuaguaaauugca

SEQ ID NO: 1104807 - RNA, 22 nt, Human
acacagaguuugacacauggga

SEQ ID NO: 1104808 - RNA, 19 nt, Human
ugugaaagcuaguguucuu

SEQ ID NO: 1104809 - RNA, 22 nt, Human
gaccaaggaagaggggagccag

SEQ ID NO: 1104810 - RNA, 19 nt, Human
aucugccuguuaucacaua

SEQ ID NO: 1104811 - RNA, 22 nt, Human
uuagcaucugcuguaagcuuau

SEQ ID NO: 1104812 - RNA, 22 nt, Human
gccugcagaacugugaggcaau

SEQ ID NO: 1104813 - RNA, 22 nt, Human
cccuguacagucucuguggcac

SEQ ID NO: 1104814 - RNA, 22 nt, Human
acaucccacagaaacauacaua

SEQ ID NO: 1104815 - RNA, 22 nt, Human
ugaugaaacugagguuccaaga

SEQ ID NO: 1104816 - RNA, 23 nt, Human
aggcccaacucugugagggcugc

SEQ ID NO: 1104817 - RNA, 22 nt, Human
gcagaggggaagcugaggaauu

SEQ ID NO: 1104818 - RNA, 22 nt, Human
uaacaucuuuagcagcucgaac

SEQ ID NO: 1104819 - RNA, 20 nt, Human
gcccaagguccagaaggggg

SEQ ID NO: 1104820 - RNA, 22 nt, Human
ccaggauggggagcagauagaa

SEQ ID NO: 1104821 - RNA, 22 nt, Human
cuagcaucagaugagaagcugu

SEQ ID NO: 1104822 - RNA, 22 nt, Human
uacacaacugacaaccauucug

SEQ ID NO: 1104823 - RNA, 20 nt, Human
gucaggauuaguaaacucug

SEQ ID NO: 1104824 - RNA, 23 nt, Human
uggagcugacagucagagggagg

SEQ ID NO: 1104825 - RNA, 22 nt, Human
gcaggggcuaaggacacagaga

SEQ ID NO: 1104826 - RNA, 22 nt, Human
cagucacauagguauacacaua

SEQ ID NO: 1104827 - RNA, 22 nt, Human
ucccacaccugucuauuccuag

SEQ ID NO: 1104828 - RNA, 22 nt, Human
uucauguguauggaacauuuuu

SEQ ID NO: 1104829 - RNA, 22 nt, Human
auguggaggaaaugaguguaca

SEQ ID NO: 1104830 - RNA, 22 nt, Human
caucacagaaauaaacauaccu

SEQ ID NO: 1104831 - RNA, 22 nt, Human
ccacagaccuuggcuuccaccu

SEQ ID NO: 1104832 - RNA, 18 nt, Human
gucacuguguuucugagc

SEQ ID NO: 1104833 - RNA, 22 nt, Human
uuuuaucuaccuaugcucauuu

SEQ ID NO: 1104834 - RNA, 22 nt, Human
uaaggccaaacuauuauaguuc

SEQ ID NO: 1104835 - RNA, 22 nt, Human
ucacacagcugacagagccuuu

SEQ ID NO: 1104836 - RNA, 22 nt, Human
aagugggaauagaaaugaaggu

SEQ ID NO: 1104837 - RNA, 22 nt, Human
gcccacacagcagauccuuugg

SEQ ID NO: 1104838 - RNA, 22 nt, Human
cacauacaaggcacacuggagg

SEQ ID NO: 1104839 - RNA, 20 nt, Human
ucaggaugugcugagugaag

SEQ ID NO: 1104840 - RNA, 22 nt, Human
aucacuguguauguauaugcag

SEQ ID NO: 1104841 - RNA, 22 nt, Human
cauucccacguguucuuugcuu

SEQ ID NO: 1104842 - RNA, 22 nt, Human
ucagugaucuaaggguauggcc

SEQ ID NO: 1104843 - RNA, 22 nt, Human
uuaauuuuaaccuguuuguguc

SEQ ID NO: 1104844 - RNA, 22 nt, Human
ucagucucuggggcuucuguuu

SEQ ID NO: 1104845 - RNA, 23 nt, Human
guccucuggagagaaaggcagua

SEQ ID NO: 1104846 - RNA, 22 nt, Human
acaggccacaguggagucucug

SEQ ID NO: 1104847 - RNA, 23 nt, Human
uucauuugucuacuucacuuguu

SEQ ID NO: 1104848 - RNA, 22 nt, Human
ucacacacauuugcugucugau

SEQ ID NO: 1104849 - RNA, 22 nt, Human
guccucugagggggcugcacgc

SEQ ID NO: 1104850 - RNA, 22 nt, Human
gaacccaggcuuuugaggcugu

SEQ ID NO: 1104851 - RNA, 23 nt, Human
uugaaagguagcuggcagcuaga

SEQ ID NO: 1104852 - RNA, 22 nt, Human
ggcccagcgaggccaccuacag

SEQ ID NO: 1104853 - RNA, 22 nt, Human
aaggcaguaaaaucuaccuugc

SEQ ID NO: 1104854 - RNA, 17 nt, Human
aggccagaugaggcaag

SEQ ID NO: 1104855 - RNA, 22 nt, Human
uaaaggguagguuuuacuguaa

SEQ ID NO: 1104856 - RNA, 22 nt, Human
uauguaaaguagauggcaggua

SEQ ID NO: 1104857 - RNA, 22 nt, Human
guaguucugcagugucaccuga

SEQ ID NO: 1104858 - RNA, 22 nt, Human
uugauagguuuuauguauaguu

SEQ ID NO: 1104859 - RNA, 22 nt, Human
cucuccucugaaguggugaccc

SEQ ID NO: 1104860 - RNA, 22 nt, Human
caagauggguguugugaugguu

SEQ ID NO: 1104861 - RNA, 22 nt, Human
aaauacugcugcuauuccuuuu

SEQ ID NO: 1104862 - RNA, 22 nt, Human
ucacauucucagcaucuauaca

SEQ ID NO: 1104863 - RNA, 22 nt, Human
cucaggauugugccuagggaga

SEQ ID NO: 1104864 - RNA, 22 nt, Human
gauugaaacauaggcagucgag

SEQ ID NO: 1104865 - RNA, 22 nt, Human
uggagcugggguuugaaucugg

SEQ ID NO: 1104866 - RNA, 22 nt, Human
ugaaagggguugaguuacagcu

SEQ ID NO: 1104867 - RNA, 21 nt, Human
uuugaaagugggugauucuuu

SEQ ID NO: 1104868 - RNA, 22 nt, Human
cuucccacuaguaucacagagc

SEQ ID NO: 1104869 - RNA, 19 nt, Human
uucaggauugacccuacug

SEQ ID NO: 1104870 - RNA, 22 nt, Human
acacacagguaaaggagccugg

SEQ ID NO: 1104871 - RNA, 22 nt, Human
agguccagcuguugcagccucc

SEQ ID NO: 1104872 - RNA, 22 nt, Human
uugggcucaggaguuugagacc

SEQ ID NO: 1104873 - RNA, 22 nt, Human
gcucaggacuggaggagcgggg

SEQ ID NO: 1104874 - RNA, 22 nt, Human
gcucacugccauucucuagaug

SEQ ID NO: 1104875 - RNA, 19 nt, Human
guugaaaguaggugagggu

SEQ ID NO: 1104876 - RNA, 22 nt, Human
uucaauucaauucuaaauauau

SEQ ID NO: 1104877 - RNA, 22 nt, Human
ucuccucuauuucuguauguau

SEQ ID NO: 1104878 - RNA, 22 nt, Human
agauggagaccuuggaugaacu

SEQ ID NO: 1104879 - RNA, 22 nt, Human
uucauugucucuguuugccuuc

SEQ ID NO: 1104880 - RNA, 22 nt, Human
ucacacagauugguagagcuga

SEQ ID NO: 1104881 - RNA, 22 nt, Human
ggauggcaggacaaggacccag

SEQ ID NO: 1104882 - RNA, 22 nt, Human
aaaggugacacucugccagcug

SEQ ID NO: 1104883 - RNA, 21 nt, Human
acagucuccccagaucucucc

SEQ ID NO: 1104884 - RNA, 22 nt, Human
gacccggcuccaggcccagcag

SEQ ID NO: 1104885 - RNA, 22 nt, Human
uugaauaguuuuggauagcaua

SEQ ID NO: 1104886 - RNA, 22 nt, Human
uuugaaaggugucgagaugugu

SEQ ID NO: 1104887 - RNA, 22 nt, Human
ggcucagacucccaggcccucu

SEQ ID NO: 1104888 - RNA, 22 nt, Human
gucagagagggcacgugcacac

SEQ ID NO: 1104889 - RNA, 22 nt, Human
aaaggccacugcaagggaaggu

SEQ ID NO: 1104890 - RNA, 22 nt, Human
ccauccugcauugcuauucaga

SEQ ID NO: 1104891 - RNA, 22 nt, Human
ccuggauucaagucuuucuuuc

SEQ ID NO: 1104892 - RNA, 22 nt, Human
uugaaaggguuaaagugguaaa

SEQ ID NO: 1104893 - RNA, 22 nt, Human
gaaggucaccuccccucucugg

SEQ ID NO: 1104894 - RNA, 21 nt, Human
uccuguaagcuuggguggcuc

SEQ ID NO: 1104895 - RNA, 22 nt, Human
guccucuguuuccaucugacuu

SEQ ID NO: 1104896 - RNA, 19 nt, Human
caggaugaucccaugacac

SEQ ID NO: 1104897 - RNA, 22 nt, Human
gcccagccuccaagcuccaagg

SEQ ID NO: 1104898 - RNA, 22 nt, Human
uucccaugccuggccccuaucc

SEQ ID NO: 1104899 - RNA, 22 nt, Human
gccauuuucugucuuguuuauu

SEQ ID NO: 1104900 - RNA, 23 nt, Human
uggacgccgacuuuggaggcgcu

SEQ ID NO: 1104901 - RNA, 22 nt, Human
ccagaggaaaaauaucucccua

SEQ ID NO: 1104902 - RNA, 22 nt, Human
caaggccaugagcagcgagugu

SEQ ID NO: 1104903 - RNA, 22 nt, Human
agucucugcaugccugcugugc

SEQ ID NO: 1104904 - RNA, 22 nt, Human
uucauuaguucugaagaugucu

SEQ ID NO: 1104905 - RNA, 22 nt, Human
acacacuuuaaauuaaaccucu

SEQ ID NO: 1104906 - RNA, 22 nt, Human
caggaaugaggucguaaguguc

SEQ ID NO: 1104907 - RNA, 22 nt, Human
guccucugaaagaugaaccaug

SEQ ID NO: 1104908 - RNA, 22 nt, Human
ucaggauaaaauguaauggcaa

SEQ ID NO: 1104909 - RNA, 22 nt, Human
acaucucaugaaugauaaauca

SEQ ID NO: 1104910 - RNA, 22 nt, Human
caguuucuauggcugggcucug

SEQ ID NO: 1104911 - RNA, 22 nt, Human
uacuuucuguccuucuguuaaa

SEQ ID NO: 1104912 - RNA, 22 nt, Human
gaccauuuguugaaaagauuau

SEQ ID NO: 1104913 - RNA, 22 nt, Human
aggccagacagcuagaaacagg

SEQ ID NO: 1104914 - RNA, 22 nt, Human
uugugguuaaccgcacauuuuu

SEQ ID NO: 1104915 - RNA, 22 nt, Human
aguggacucuucccagugcuug

SEQ ID NO: 1104916 - RNA, 20 nt, Human
uucaggauucuagaccacac

SEQ ID NO: 1104917 - RNA, 22 nt, Human
gaggggcagagguagagaacaa

SEQ ID NO: 1104918 - RNA, 22 nt, Human
caaggccauaagagauacaaaa

SEQ ID NO: 1104919 - RNA, 22 nt, Human
cccacacauuuuucacuuaccg

SEQ ID NO: 1104920 - RNA, 22 nt, Human
uuugaaaguucuucugacacua

SEQ ID NO: 1104921 - RNA, 21 nt, Human
uucucuccauaugcccagccc

SEQ ID NO: 1104922 - RNA, 22 nt, Human
aauugcuaaagauuauguuuuc

SEQ ID NO: 1104923 - RNA, 22 nt, Human
acacagaugcauuacacaucua

SEQ ID NO: 1104924 - RNA, 22 nt, Human
uauugaugcuuggauugggcca

SEQ ID NO: 1104925 - RNA, 22 nt, Human
cagucucuugcuucauuaguug

SEQ ID NO: 1104926 - RNA, 22 nt, Human
ccuccucugggaagauucagag

SEQ ID NO: 1104927 - RNA, 22 nt, Human
cacacagacagcucucugaaga

SEQ ID NO: 1104928 - RNA, 22 nt, Human
cagcccaggucucucuuccagu

SEQ ID NO: 1104929 - RNA, 22 nt, Human
cucacuguuuaauagcuggauc

SEQ ID NO: 1104930 - RNA, 22 nt, Human
aaggcaguuaauuuggcuagaa

SEQ ID NO: 1104931 - RNA, 19 nt, Human
ucaucucacagggccuggc

SEQ ID NO: 1104932 - RNA, 22 nt, Human
aucugccugagucuagguuuuc

SEQ ID NO: 1104933 - RNA, 22 nt, Human
agggaguuagaaauccaggaua

SEQ ID NO: 1104934 - RNA, 23 nt, Human
ugaaggccuggaggacgcguugu

SEQ ID NO: 1104935 - RNA, 22 nt, Human
cuacuucuaaguacauggugau

SEQ ID NO: 1104936 - RNA, 22 nt, Human
cugucauuuaagacauucugga

SEQ ID NO: 1104937 - RNA, 22 nt, Human
ucacagacauggugagguaaca

SEQ ID NO: 1104938 - RNA, 22 nt, Human
acaucacagagcccagauaaag

SEQ ID NO: 1104939 - RNA, 22 nt, Human
cagagcucuauguucauggagg

SEQ ID NO: 1104940 - RNA, 22 nt, Human
ggacagaggguugacagaguau

SEQ ID NO: 1104941 - RNA, 19 nt, Human
ucuuucauuucuagcucug

SEQ ID NO: 1104942 - RNA, 22 nt, Human
uuuuucaagacaaccugcaugu

SEQ ID NO: 1104943 - RNA, 22 nt, Human
uacacacagaggccaugggauu

SEQ ID NO: 1104944 - RNA, 22 nt, Human
cagugcugggcagaggagagcg

SEQ ID NO: 1104945 - RNA, 22 nt, Human
gaccauuuuuacagagcauuca

SEQ ID NO: 1104946 - RNA, 22 nt, Human
cagagccauuauggagacuugc

SEQ ID NO: 1104947 - RNA, 22 nt, Human
caaugugguggcagaugucagu

SEQ ID NO: 1104948 - RNA, 18 nt, Human
ugaauagggguuugcaga

SEQ ID NO: 1104949 - RNA, 22 nt, Human
ucaggaggccaccaggaccugu

SEQ ID NO: 1104950 - RNA, 22 nt, Human
ccucagggaaugggaggcuggg

SEQ ID NO: 1104951 - RNA, 23 nt, Human
ggacacauuuauuucagaauuca

SEQ ID NO: 1104952 - RNA, 22 nt, Human
uggcuucuugggaugggucauu

SEQ ID NO: 1104953 - RNA, 18 nt, Human
acacacacaccuguguau

SEQ ID NO: 1104954 - RNA, 22 nt, Human
aucuccaggcauuucaagagac

SEQ ID NO: 1104955 - RNA, 22 nt, Human
uagauacaggcucucugagccu

SEQ ID NO: 1104956 - RNA, 22 nt, Human
cuguauuuguccucuauuuauu

SEQ ID NO: 1104957 - RNA, 22 nt, Human
uugcaucuagggcaacccagag

SEQ ID NO: 1104958 - RNA, 22 nt, Human
ucaggagggugacaggcccugg

SEQ ID NO: 1104959 - RNA, 22 nt, Human
gcucaggaucagccaccucuuu

SEQ ID NO: 1104960 - RNA, 23 nt, Human
ucacauaauccuucauccacagg

SEQ ID NO: 1104961 - RNA, 22 nt, Human
ugcagagaaaacuccuggguac

SEQ ID NO: 1104962 - RNA, 22 nt, Human
acacacacaagcagguugugga

SEQ ID NO: 1104963 - RNA, 18 nt, Human
ugagaggcagguagagga

SEQ ID NO: 1104964 - RNA, 22 nt, Human
cagaauggcuuuuauggcucag

SEQ ID NO: 1104965 - RNA, 22 nt, Human
auacacacugcuauccuuuuuu

SEQ ID NO: 1104966 - RNA, 22 nt, Human
ucuucauuuuauagcaucugug

SEQ ID NO: 1104967 - RNA, 22 nt, Human
auuucacucauucauguuacuu

SEQ ID NO: 1104968 - RNA, 20 nt, Human
cucuccucacccgugucagg

SEQ ID NO: 1104969 - RNA, 22 nt, Human
cagacagagucuucccaucagu

SEQ ID NO: 1104970 - RNA, 22 nt, Human
cacauuuaauccuuuauaagua

SEQ ID NO: 1104971 - RNA, 23 nt, Human
uguugaaguaacuguuacauaga

SEQ ID NO: 1104972 - RNA, 22 nt, Human
cucacugacgaggaagcugaga

SEQ ID NO: 1104973 - RNA, 17 nt, Human
acucaggaucugggagu

SEQ ID NO: 1104974 - RNA, 22 nt, Human
caugucuguguacacaugcaca

SEQ ID NO: 1104975 - RNA, 22 nt, Human
aggcaguuuaggcagcgauuua

SEQ ID NO: 1104976 - RNA, 20 nt, Human
accccacagaguccauugca

SEQ ID NO: 1104977 - RNA, 19 nt, Human
ugaggggcucacagucuca

SEQ ID NO: 1104978 - RNA, 22 nt, Human
caguggagagacuuuuacucuu

SEQ ID NO: 1104979 - RNA, 22 nt, Human
cagaccucaguccucaguagga

SEQ ID NO: 1104980 - RNA, 22 nt, Human
cagaguggcgacccccucagcu

SEQ ID NO: 1104981 - RNA, 22 nt, Human
agugauggugagugagaagcuc

SEQ ID NO: 1104982 - RNA, 22 nt, Human
ccuccuuuccuguuuuccugag

SEQ ID NO: 1104983 - RNA, 22 nt, Human
cugcuucugggaugauggagua

SEQ ID NO: 1104984 - RNA, 22 nt, Human
uacacaucacuguaucuuucag

SEQ ID NO: 1104985 - RNA, 22 nt, Human
cagucccuaguggagcucacag

SEQ ID NO: 1104986 - RNA, 22 nt, Human
aaagccagagcaagcugucaca

SEQ ID NO: 1104987 - RNA, 23 nt, Human
acacauuuuucccguucugaggu

SEQ ID NO: 1104988 - RNA, 22 nt, Human
ucccacacagcccgcucaccgg

SEQ ID NO: 1104989 - RNA, 22 nt, Human
uauucccagccucuuucuaucu

SEQ ID NO: 1104990 - RNA, 22 nt, Human
aggccagcaagaaagagagucu

SEQ ID NO: 1104991 - RNA, 22 nt, Human
auagcuguuagauuggggucga

SEQ ID NO: 1104992 - RNA, 22 nt, Human
uuauggcauauuccucauugua

SEQ ID NO: 1104993 - RNA, 19 nt, Human
acacauuugcacaauccac

SEQ ID NO: 1104994 - RNA, 22 nt, Human
guccucugcuucaugcccugau

SEQ ID NO: 1104995 - RNA, 22 nt, Human
uuggaugaagucuagcuuuagu

SEQ ID NO: 1104996 - RNA, 22 nt, Human
gaaggccauuagagccugugcc

SEQ ID NO: 1104997 - RNA, 22 nt, Human
gucuccugagccuugacugcaa

SEQ ID NO: 1104998 - RNA, 20 nt, Human
ucucagcauaagaacccuuc

SEQ ID NO: 1104999 - RNA, 22 nt, Human
uucaggaugcucagaguagucu

SEQ ID NO: 1105000 - RNA, 22 nt, Human
ggauggcagucugcaugagaaa

SEQ ID NO: 1105001 - RNA, 22 nt, Human
cuguuaaucugcuugcaugaug

SEQ ID NO: 1105002 - RNA, 22 nt, Human
cugagccagcuggcaugugcua

SEQ ID NO: 1105003 - RNA, 22 nt, Human
caagauggaguccgggaaugug

SEQ ID NO: 1105004 - RNA, 19 nt, Human
uuagccauccacagugaaa

SEQ ID NO: 1105005 - RNA, 22 nt, Human
uucuuucucaacaugaauguuu

SEQ ID NO: 1105006 - RNA, 22 nt, Human
uacacagaaccugguguacagu

SEQ ID NO: 1105007 - RNA, 22 nt, Human
ucacaguaucacacaaggauua

SEQ ID NO: 1105008 - RNA, 22 nt, Human
uugcugaaaucuaugacauccu

SEQ ID NO: 1105009 - RNA, 22 nt, Human
acauaaugagcucuuuauaaau

SEQ ID NO: 1105010 - RNA, 22 nt, Human
ucucaggacuuugggaagcuca

SEQ ID NO: 1105011 - RNA, 22 nt, Human
ccucacugaagaggugacauuu

SEQ ID NO: 1105012 - RNA, 22 nt, Human
auugaaagcauggauuuggauu

SEQ ID NO: 1105013 - RNA, 22 nt, Human
cacacacucuuccuggcaccua

SEQ ID NO: 1105014 - RNA, 22 nt, Human
ugcauaaagugccauaguauua

SEQ ID NO: 1105015 - RNA, 22 nt, Human
ucagagaguuagugucuuagcu

SEQ ID NO: 1105016 - RNA, 22 nt, Human
guccucuguuagaaaugugcuu

SEQ ID NO: 1105017 - RNA, 22 nt, Human
auugaaagauuuugggcucaug

SEQ ID NO: 1105018 - RNA, 22 nt, Human
uccauuuucaucucauguauaa

SEQ ID NO: 1105019 - RNA, 22 nt, Human
agucaauucuuuucaacucaag

SEQ ID NO: 1105020 - RNA, 22 nt, Human
aagcuggagaguuaggugaaua

SEQ ID NO: 1105021 - RNA, 22 nt, Human
uggaguucauccaugacagcuu

SEQ ID NO: 1105022 - RNA, 22 nt, Human
uucaggauccccaccgcguuua

SEQ ID NO: 1105023 - RNA, 22 nt, Human
uggcagagagagugcagucgac

SEQ ID NO: 1105024 - RNA, 22 nt, Human
gccaugcuugguaugcugugag

SEQ ID NO: 1105025 - RNA, 22 nt, Human
agucucugcugguugugccuau

SEQ ID NO: 1105026 - RNA, 22 nt, Human
ucaggaugaccacgagccucua

SEQ ID NO: 1105027 - RNA, 22 nt, Human
ugaaagguagcuggccucauag

SEQ ID NO: 1105028 - RNA, 22 nt, Human
agcauccaacaggagggaaggg

SEQ ID NO: 1105029 - RNA, 22 nt, Human
aucaggauuauuaaaucuggau

SEQ ID NO: 1105030 - RNA, 22 nt, Human
aagcgccaugguuccugcgcag

SEQ ID NO: 1105031 - RNA, 22 nt, Human
uucucacuauguauguagauug

SEQ ID NO: 1105032 - RNA, 22 nt, Human
uggcagagucaucacaucugga

SEQ ID NO: 1105033 - RNA, 22 nt, Human
ucauuuaauagcuuuugucuuu

SEQ ID NO: 1105034 - RNA, 22 nt, Human
uucaggaucacuaaacccucca

SEQ ID NO: 1105035 - RNA, 22 nt, Human
uucuuuugggaauuacguaugc

SEQ ID NO: 1105036 - RNA, 22 nt, Human
uggcagagaacacacaugauuc

SEQ ID NO: 1105037 - RNA, 22 nt, Human
uguucauuuggcccuuuuguau

SEQ ID NO: 1105038 - RNA, 22 nt, Human
aaaggugacugcagcagcuauu

SEQ ID NO: 1105039 - RNA, 22 nt, Human
cagucccaugagcccagaacau

SEQ ID NO: 1105040 - RNA, 22 nt, Human
cgcugauaaacgucacguuccc

SEQ ID NO: 1105041 - RNA, 22 nt, Human
cucagccccaauucuccccauu

SEQ ID NO: 1105042 - RNA, 22 nt, Human
cucugcauuuuaacagaugauu

SEQ ID NO: 1105043 - RNA, 22 nt, Human
gcacacaguagggauucaauga

SEQ ID NO: 1105044 - RNA, 19 nt, Human
gugggacagacauuacaua

SEQ ID NO: 1105045 - RNA, 22 nt, Human
uucaggauuguguuuuuccuga

SEQ ID NO: 1105046 - RNA, 22 nt, Human
cccucuacagggaagcgcuuuc

SEQ ID NO: 1105047 - RNA, 22 nt, Human
acagguccucaagucagcuggg

SEQ ID NO: 1105048 - RNA, 22 nt, Human
aaaggccaagcaugagguggac

SEQ ID NO: 1105049 - RNA, 22 nt, Human
ucacacagguuugcaaugauuu

SEQ ID NO: 1105050 - RNA, 22 nt, Human
aucaggauucaccccagagcug

SEQ ID NO: 1105051 - RNA, 22 nt, Human
cucacugugaccucagcagaca

SEQ ID NO: 1105052 - RNA, 22 nt, Human
aggccagaugucgggcuagaag

SEQ ID NO: 1105053 - RNA, 22 nt, Human
gucaggauuauaauccccaugg

SEQ ID NO: 1105054 - RNA, 20 nt, Human
uguuaaaggacacuugcuuu

SEQ ID NO: 1105055 - RNA, 22 nt, Human
ggaggcugagaaguccaagauc

SEQ ID NO: 1105056 - RNA, 22 nt, Human
uuugaaaguguuuacuugggaa

SEQ ID NO: 1105057 - RNA, 21 nt, Human
cucuugugucagagccagagg

SEQ ID NO: 1105058 - RNA, 22 nt, Human
uucacagauguauuggaacucc

SEQ ID NO: 1105059 - RNA, 22 nt, Human
uggaagggagugacagucagag

SEQ ID NO: 1105060 - RNA, 22 nt, Human
cacacugucagguaaauaacac

SEQ ID NO: 1105061 - RNA, 22 nt, Human
ggcugaaggaugaaagcugcag

SEQ ID NO: 1105062 - RNA, 22 nt, Human
aaguguagauuauggagugucu

SEQ ID NO: 1105063 - RNA, 22 nt, Human
cagucuucuaaccuagcagccu

SEQ ID NO: 1105064 - RNA, 22 nt, Human
gacacauagaucuaucucacuc

SEQ ID NO: 1105065 - RNA, 22 nt, Human
ucacauacacuaggauauuuuu

SEQ ID NO: 1105066 - RNA, 21 nt, Human
ucacaucuauguuaagcaaac

SEQ ID NO: 1105067 - RNA, 21 nt, Human
uccccacauuucuaaacagac

SEQ ID NO: 1105068 - RNA, 22 nt, Human
aaugucugagucucuguauccc

SEQ ID NO: 1105069 - RNA, 22 nt, Human
aaaggccacacagagcagggag

SEQ ID NO: 1105070 - RNA, 22 nt, Human
ccaggcugcagucaaggggcau

SEQ ID NO: 1105071 - RNA, 22 nt, Human
ugugaaggagaugaagggagug

SEQ ID NO: 1105072 - RNA, 22 nt, Human
uauuuucuguggaggaccagau

SEQ ID NO: 1105073 - RNA, 22 nt, Human
gugguaauagagcuccaaacua

SEQ ID NO: 1105074 - RNA, 22 nt, Human
ucacacacauaaucuaagauua

SEQ ID NO: 1105075 - RNA, 22 nt, Human
cugagggucaacuugauuguau

SEQ ID NO: 1105076 - RNA, 22 nt, Human
uaccauuucauucuuuccucau

SEQ ID NO: 1105077 - RNA, 20 nt, Human
gauacacagcacagagggcc

SEQ ID NO: 1105078 - RNA, 22 nt, Human
acagucucuccacacugcaggg

SEQ ID NO: 1105079 - RNA, 22 nt, Human
caucaucaaaagugacagagaa

SEQ ID NO: 1105080 - RNA, 21 nt, Human
aaaggccauaaucacggagca

SEQ ID NO: 1105081 - RNA, 22 nt, Human
gccucugcccuccugggacugc

SEQ ID NO: 1105082 - RNA, 19 nt, Human
caaggccaccauuucuccg

SEQ ID NO: 1105083 - RNA, 22 nt, Human
uaaguggaagguuauaugcuaa

SEQ ID NO: 1105084 - RNA, 22 nt, Human
caaggccaguucaccaagggca

SEQ ID NO: 1105085 - RNA, 22 nt, Human
uacacaucccagacucccagga

SEQ ID NO: 1105086 - RNA, 22 nt, Human
gggcacagaagucuaagacauc

SEQ ID NO: 1105087 - RNA, 22 nt, Human
gacacagaaggucacauguuca

SEQ ID NO: 1105088 - RNA, 22 nt, Human
cuaugagaagaaaacaagauua

SEQ ID NO: 1105089 - RNA, 22 nt, Human
cucaggaucgcuugcccuaggg

SEQ ID NO: 1105090 - RNA, 20 nt, Human
ucagugauuuugaagaggaa

SEQ ID NO: 1105091 - RNA, 22 nt, Human
uuugaaagcaggugugggaggg

SEQ ID NO: 1105092 - RNA, 22 nt, Human
uuuaaauuuagaagaaacacug

SEQ ID NO: 1105093 - RNA, 22 nt, Human
guugaaugaaucauucuaugua

SEQ ID NO: 1105094 - RNA, 22 nt, Human
ucucaggaagugauauugagac

SEQ ID NO: 1105095 - RNA, 22 nt, Human
guccucuggugaaagcauuccc

SEQ ID NO: 1105096 - RNA, 22 nt, Human
caaauacuacgauucuugcagu

SEQ ID NO: 1105097 - RNA, 22 nt, Human
acacacaugcaugcuugccauu

SEQ ID NO: 1105098 - RNA, 22 nt, Human
gaucauuuacuuguucuggacu

SEQ ID NO: 1105099 - RNA, 22 nt, Human
aggccagaaauuuggaguaugu

SEQ ID NO: 1105100 - RNA, 22 nt, Human
ugucucugauaaguaguucagu

SEQ ID NO: 1105101 - RNA, 22 nt, Human
cucaggauucucgacacucaca

SEQ ID NO: 1105102 - RNA, 23 nt, Human
agaugagccaacaccuccaugcc

SEQ ID NO: 1105103 - RNA, 22 nt, Human
uaaggccaggcuguggucggca

SEQ ID NO: 1105104 - RNA, 22 nt, Human
guccucugacucagccuuggga

SEQ ID NO: 1105105 - RNA, 22 nt, Human
auucaaguggcugcuauguuaa

SEQ ID NO: 1105106 - RNA, 22 nt, Human
uggggcucaccuaggcuggaag

SEQ ID NO: 1105107 - RNA, 22 nt, Human
cccccaaaguuugcacggauaa

SEQ ID NO: 1105108 - RNA, 22 nt, Human
uuuguuaaauauuuauugagug

SEQ ID NO: 1105109 - RNA, 22 nt, Human
uccccacacuuucacuccuggc

SEQ ID NO: 1105110 - RNA, 22 nt, Human
uacuuuuuagcacagugugugc

SEQ ID NO: 1105111 - RNA, 22 nt, Human
ucucacuggguauaaaugagua

SEQ ID NO: 1105112 - RNA, 22 nt, Human
uugaauaggacucagcagugau

SEQ ID NO: 1105113 - RNA, 22 nt, Human
ucacugcucuccaauguggagu

SEQ ID NO: 1105114 - RNA, 22 nt, Human
ucagguggcuuggagggggacg

SEQ ID NO: 1105115 - RNA, 22 nt, Human
ucccacauaugcaauccugaau

SEQ ID NO: 1105116 - RNA, 22 nt, Human
caagauggacauaaggagagaa

SEQ ID NO: 1105117 - RNA, 22 nt, Human
gugguaaucggauucuuaccgg

SEQ ID NO: 1105118 - RNA, 22 nt, Human
gagugucugaauuagagcacaa

SEQ ID NO: 1105119 - RNA, 22 nt, Human
auacaugacucacacauucugc

SEQ ID NO: 1105120 - RNA, 22 nt, Human
uucaggaugaaagugugcaaca

SEQ ID NO: 1105121 - RNA, 22 nt, Human
uucaggaucauuuguuuuaucu

SEQ ID NO: 1105122 - RNA, 22 nt, Human
ccucacugcuauguguuugcuc

SEQ ID NO: 1105123 - RNA, 22 nt, Human
acacauaagaaacuacaaagag

SEQ ID NO: 1105124 - RNA, 22 nt, Human
gugcuuucugcugcauuccucu

SEQ ID NO: 1105125 - RNA, 22 nt, Human
cagucucucugaaguauuaaga

SEQ ID NO: 1105126 - RNA, 22 nt, Human
agcacugugauuuauaacauuu

SEQ ID NO: 1105127 - RNA, 22 nt, Human
gcucaggaucccaggggugugc

SEQ ID NO: 1105128 - RNA, 23 nt, Human
ggagugcaauggcgccaucucgg

SEQ ID NO: 1105129 - RNA, 22 nt, Human
uggugguuaugcgcuuuguggg

SEQ ID NO: 1105130 - RNA, 19 nt, Human
uugaaagauuagcuuucua

SEQ ID NO: 1105131 - RNA, 22 nt, Human
uauucccauuccacuuaucaag

SEQ ID NO: 1105132 - RNA, 22 nt, Human
gucaggaugagggaugaggagu

SEQ ID NO: 1105133 - RNA, 18 nt, Human
ccucagggagagagacgc

SEQ ID NO: 1105134 - RNA, 22 nt, Human
gcacacaggggaguucucagaa

SEQ ID NO: 1105135 - RNA, 22 nt, Human
agacucaagcagauaggaauua

SEQ ID NO: 1105136 - RNA, 22 nt, Human
cagaaggcuuuguggaguagac

SEQ ID NO: 1105137 - RNA, 22 nt, Human
uacacacuuacuggagaugaag

SEQ ID NO: 1105138 - RNA, 22 nt, Human
uucaauucugcucugaucuuag

SEQ ID NO: 1105139 - RNA, 22 nt, Human
ugaguagagaauucagcuaagg

SEQ ID NO: 1105140 - RNA, 22 nt, Human
cacacagaugguaagggaggga

SEQ ID NO: 1105141 - RNA, 22 nt, Human
gucaggauuaaugggaguaugc

SEQ ID NO: 1105142 - RNA, 22 nt, Human
gucaggauuugaacucaggucu

SEQ ID NO: 1105143 - RNA, 22 nt, Human
cauuuguuggucagauuguagu

SEQ ID NO: 1105144 - RNA, 22 nt, Human
cuguccuccagacgacaguccc

SEQ ID NO: 1105145 - RNA, 22 nt, Human
ccacacagucaguuuccaagaa

SEQ ID NO: 1105146 - RNA, 22 nt, Human
aaccauuugcaguuacugagac

SEQ ID NO: 1105147 - RNA, 22 nt, Human
ucccacaugugaauccucaggu

SEQ ID NO: 1105148 - RNA, 22 nt, Human
ugcuucuggaaacaguggcugu

SEQ ID NO: 1105149 - RNA, 22 nt, Human
auguagagcaguguuguccaau

SEQ ID NO: 1105150 - RNA, 22 nt, Human
gagggagugccagagggccagc

SEQ ID NO: 1105151 - RNA, 22 nt, Human
uugaaagucacaauggcauuaa

SEQ ID NO: 1105152 - RNA, 22 nt, Human
uucuacaugguugcucagaggg

SEQ ID NO: 1105153 - RNA, 20 nt, Human
uucacagaggacucagguca

SEQ ID NO: 1105154 - RNA, 22 nt, Human
acagagagaaacaaucagcagc

SEQ ID NO: 1105155 - RNA, 22 nt, Human
cacacacugacaccuuaucuug

SEQ ID NO: 1105156 - RNA, 22 nt, Human
gaggccuggagccgccuaggcg

SEQ ID NO: 1105157 - RNA, 22 nt, Human
ugaaaggugacauuucuuggau

SEQ ID NO: 1105158 - RNA, 22 nt, Human
cuguauuucccacauucucuau

SEQ ID NO: 1105159 - RNA, 20 nt, Human
agaggccaguuaggagucua

SEQ ID NO: 1105160 - RNA, 22 nt, Human
aauggccagcugggagaguuga

SEQ ID NO: 1105161 - RNA, 22 nt, Human
uugaaaguuaucuagauucuga

SEQ ID NO: 1105162 - RNA, 22 nt, Human
uugauuaaacaggcauauucaa

SEQ ID NO: 1105163 - RNA, 21 nt, Human
gggcagaggggccuccugggu

SEQ ID NO: 1105164 - RNA, 22 nt, Human
acagacuggccugucucgcacc

SEQ ID NO: 1105165 - RNA, 22 nt, Human
uaaggccaauuaacaaccaggg

SEQ ID NO: 1105166 - RNA, 22 nt, Human
gaccauuucuaggaaucagacu

SEQ ID NO: 1105167 - RNA, 22 nt, Human
uucaggaugacaccauguccag

SEQ ID NO: 1105168 - RNA, 22 nt, Human
auccccacgauauagccaaagc

SEQ ID NO: 1105169 - RNA, 22 nt, Human
cuugaaagucagcagaguggau

SEQ ID NO: 1105170 - RNA, 22 nt, Human
uacacagacucuucaauucaga

SEQ ID NO: 1105171 - RNA, 22 nt, Human
guccucugcccaggucaagguu

SEQ ID NO: 1105172 - RNA, 22 nt, Human
uccauuuucuugcucuagguaa

SEQ ID NO: 1105173 - RNA, 22 nt, Human
guugaaaguagaugcuauuugg

SEQ ID NO: 1105174 - RNA, 22 nt, Human
uagcugcugcagcacagggagg

SEQ ID NO: 1105175 - RNA, 22 nt, Human
caauacugaguuuacauucauc

SEQ ID NO: 1105176 - RNA, 22 nt, Human
gcacauacccacugucaagcac

SEQ ID NO: 1105177 - RNA, 22 nt, Human
caaggccaaagggccacuguca

SEQ ID NO: 1105178 - RNA, 21 nt, Human
gauugaaaccauggcagugag

SEQ ID NO: 1105179 - RNA, 22 nt, Human
cucaagacugaucgcaguggaa

SEQ ID NO: 1105180 - RNA, 22 nt, Human
gauggcagucaaccaggugagg

SEQ ID NO: 1105181 - RNA, 22 nt, Human
acucaggagggaucagcuauca

SEQ ID NO: 1105182 - RNA, 22 nt, Human
auagggccuaaaaaguauugcu

SEQ ID NO: 1105183 - RNA, 22 nt, Human
aucaggaucacagaaacuuuua

SEQ ID NO: 1105184 - RNA, 22 nt, Human
cagugauguuucugcaucagag

SEQ ID NO: 1105185 - RNA, 22 nt, Human
gucaggaugggcagccaaacua

SEQ ID NO: 1105186 - RNA, 22 nt, Human
ucccacacuugaaacaaggcug

SEQ ID NO: 1105187 - RNA, 22 nt, Human
ccccacacucuuuacauucaua

SEQ ID NO: 1105188 - RNA, 22 nt, Human
ugaguucuaguggcugcagauu

SEQ ID NO: 1105189 - RNA, 22 nt, Human
ucauuucaaguucugacagcua

SEQ ID NO: 1105190 - RNA, 22 nt, Human
cucaggauuuaaaggggcacuc

SEQ ID NO: 1105191 - RNA, 22 nt, Human
ucagagagugcaaaauauagcu

SEQ ID NO: 1105192 - RNA, 22 nt, Human
auugaggcagcauaguucaggg

SEQ ID NO: 1105193 - RNA, 22 nt, Human
caggaugagguagaggcagaua

SEQ ID NO: 1105194 - RNA, 22 nt, Human
augaggcaaucaugguccaguu

SEQ ID NO: 1105195 - RNA, 22 nt, Human
acacacaugccuuuccuaagua

SEQ ID NO: 1105196 - RNA, 18 nt, Human
gaugggagcaagagaaga

SEQ ID NO: 1105197 - RNA, 22 nt, Human
cccacacucugagaaaugcuga

SEQ ID NO: 1105198 - RNA, 21 nt, Human
cucaaagaccaaaaguguaga

SEQ ID NO: 1105199 - RNA, 22 nt, Human
gaaaggccauuucugaggguuu

SEQ ID NO: 1105200 - RNA, 22 nt, Human
ugaaggcccagccacagaaugg

SEQ ID NO: 1105201 - RNA, 21 nt, Human
ucacagacuggucagugaggc

SEQ ID NO: 1105202 - RNA, 22 nt, Human
gucaggauuggggucaugaguc

SEQ ID NO: 1105203 - RNA, 22 nt, Human
aucaggaucugggagccugaaa

SEQ ID NO: 1105204 - RNA, 22 nt, Human
ucagagaguuacacaaauuguu

SEQ ID NO: 1105205 - RNA, 22 nt, Human
guacacacuguuugaucauuuc

SEQ ID NO: 1105206 - RNA, 22 nt, Human
guagccauuggcaaugaagccu

SEQ ID NO: 1105207 - RNA, 22 nt, Human
cugaaugaggaaaagagugagg

SEQ ID NO: 1105208 - RNA, 20 nt, Human
uggcaucucucaauuguagg

SEQ ID NO: 1105209 - RNA, 22 nt, Human
uaaggccagccagcaaaucugu

SEQ ID NO: 1105210 - RNA, 22 nt, Human
acuaagugauucuaagcaucuu

SEQ ID NO: 1105211 - RNA, 22 nt, Human
cggagccugcuuguugcagcug

SEQ ID NO: 1105212 - RNA, 22 nt, Human
ucaggaugguccuuuaugagaa

SEQ ID NO: 1105213 - RNA, 22 nt, Human
acacauaagccuaaucaucucc

SEQ ID NO: 1105214 - RNA, 22 nt, Human
caguuuuugccauuaagaguaa

SEQ ID NO: 1105215 - RNA, 22 nt, Human
uucaggauggcggauguugggg

SEQ ID NO: 1105216 - RNA, 22 nt, Human
uuucugcugugcuuucuugcgu

SEQ ID NO: 1105217 - RNA, 22 nt, Human
uuugaaagacagaauauuuuug

SEQ ID NO: 1105218 - RNA, 22 nt, Human
gaaucucaguggaagcaggaag

SEQ ID NO: 1105219 - RNA, 20 nt, Human
cacaacuguccacaugcucc

SEQ ID NO: 1105220 - RNA, 22 nt, Human
uucacagucacccuucuccaug

SEQ ID NO: 1105221 - RNA, 22 nt, Human
cacacaucaaccuagacauugu

SEQ ID NO: 1105222 - RNA, 22 nt, Human
gaugccuccaaaugagggcaga

SEQ ID NO: 1105223 - RNA, 20 nt, Human
ugaaggccauuuguuccaga

SEQ ID NO: 1105224 - RNA, 22 nt, Human
ucacugcugcugccaugaugga

SEQ ID NO: 1105225 - RNA, 22 nt, Human
acaguucccgucuugcacagcu

SEQ ID NO: 1105226 - RNA, 22 nt, Human
cagcacagugaccagacccacu

SEQ ID NO: 1105227 - RNA, 22 nt, Human
ucaucugucccaggcuuuuuuc

SEQ ID NO: 1105228 - RNA, 22 nt, Human
acaaauccagugaacuccagug

SEQ ID NO: 1105229 - RNA, 23 nt, Human
ucucaggacacacaugucuauca

SEQ ID NO: 1105230 - RNA, 21 nt, Human
uccuuccuugagguccuuucc

SEQ ID NO: 1105231 - RNA, 22 nt, Human
acacacagaaggaagccccacu

SEQ ID NO: 1105232 - RNA, 22 nt, Human
uauguguuugacacccugcaag

SEQ ID NO: 1105233 - RNA, 22 nt, Human
acuugcauuauauuuaucacaa

SEQ ID NO: 1105234 - RNA, 21 nt, Human
ccacucaugacuccacucacc

SEQ ID NO: 1105235 - RNA, 22 nt, Human
cugcuuccauaaauaaugugcu

SEQ ID NO: 1105236 - RNA, 22 nt, Human
gccugcagauauauaggauggu

SEQ ID NO: 1105237 - RNA, 22 nt, Human
uggaguucucaggugagggcuu

SEQ ID NO: 1105238 - RNA, 21 nt, Human
acacacugaguuuuccacugu

SEQ ID NO: 1105239 - RNA, 22 nt, Human
ucacugucugaaagaaauggcc

SEQ ID NO: 1105240 - RNA, 22 nt, Human
gggacuucauagcuaggcacuu

SEQ ID NO: 1105241 - RNA, 22 nt, Human
ugguaauuaauuugauagguuc

SEQ ID NO: 1105242 - RNA, 22 nt, Human
cacagacccagaagggaugaag

SEQ ID NO: 1105243 - RNA, 22 nt, Human
acacacagcgccuaccaugugc

SEQ ID NO: 1105244 - RNA, 22 nt, Human
acauuuaaccaaacuguuuaau

SEQ ID NO: 1105245 - RNA, 22 nt, Human
gcacacauucggauucuuaacc

SEQ ID NO: 1105246 - RNA, 22 nt, Human
guugacagcuggugagcugcua

SEQ ID NO: 1105247 - RNA, 22 nt, Human
uugaaaggaauacagaggccua

SEQ ID NO: 1105248 - RNA, 22 nt, Human
aaggccagaguacuagaggcug

SEQ ID NO: 1105249 - RNA, 22 nt, Human
cuacagacccaccuuggaagaa

SEQ ID NO: 1105250 - RNA, 18 nt, Human
uguagagccagguuugcc

SEQ ID NO: 1105251 - RNA, 22 nt, Human
uugaaagaggcaaaguuugauc

SEQ ID NO: 1105252 - RNA, 22 nt, Human
uugcaucuaccauaucaaagau

SEQ ID NO: 1105253 - RNA, 22 nt, Human
uccacacacauuucuaugugca

SEQ ID NO: 1105254 - RNA, 22 nt, Human
cagugauggauauggagaaguc

SEQ ID NO: 1105255 - RNA, 22 nt, Human
ucuacugugguccuuguaacca

SEQ ID NO: 1105256 - RNA, 22 nt, Human
ccacauacaaauggggugcugu

SEQ ID NO: 1105257 - RNA, 22 nt, Human
uggcacagggcuuggucgcuca

SEQ ID NO: 1105258 - RNA, 23 nt, Human
acauacauggagauaaagugaug

SEQ ID NO: 1105259 - RNA, 22 nt, Human
aguccaaggagagacagcauuu

SEQ ID NO: 1105260 - RNA, 22 nt, Human
cccacacacauuuaugauagga

SEQ ID NO: 1105261 - RNA, 22 nt, Human
auucaaguccagcuucucuaca

SEQ ID NO: 1105262 - RNA, 22 nt, Human
ccuucuucuguguggcccaaga

SEQ ID NO: 1105263 - RNA, 22 nt, Human
uucaggauaguggugaguggca

SEQ ID NO: 1105264 - RNA, 22 nt, Human
caggauggucagaugcauuguc

SEQ ID NO: 1105265 - RNA, 22 nt, Human
uucuugcaggucacucacugag

SEQ ID NO: 1105266 - RNA, 22 nt, Human
auguuggagucguaaggcaugg

SEQ ID NO: 1105267 - RNA, 21 nt, Human
cgcagagcgaacuugcggcgc

SEQ ID NO: 1105268 - RNA, 22 nt, Human
uugguuuaggaacuggcuugga

SEQ ID NO: 1105269 - RNA, 22 nt, Human
aucugccuccaaguccaugugu

SEQ ID NO: 1105270 - RNA, 22 nt, Human
ucaucucaaaacccaaggggca

SEQ ID NO: 1105271 - RNA, 22 nt, Human
uuugaaagggacaaagucacug

SEQ ID NO: 1105272 - RNA, 22 nt, Human
ucauggcacuuagcacaguccu

SEQ ID NO: 1105273 - RNA, 22 nt, Human
cucaugauguagcgaaugagaa

SEQ ID NO: 1105274 - RNA, 22 nt, Human
auaauggccgggggcugaaugc

SEQ ID NO: 1105275 - RNA, 22 nt, Human
ucucaggaucuaauacauggua

SEQ ID NO: 1105276 - RNA, 22 nt, Human
ucacaucucccuggaggacaca

SEQ ID NO: 1105277 - RNA, 22 nt, Human
acacauuucucuuuuuguaagu

SEQ ID NO: 1105278 - RNA, 22 nt, Human
cagucucagaggugggaguggg

SEQ ID NO: 1105279 - RNA, 22 nt, Human
uugaagaggacuuugcagcugu

SEQ ID NO: 1105280 - RNA, 18 nt, Human
acucaggaaaugaugaca

SEQ ID NO: 1105281 - RNA, 23 nt, Human
uguaaacaucacccccuggaguu

SEQ ID NO: 1105282 - RNA, 19 nt, Human
ccagcccacagugacuuuc

SEQ ID NO: 1105283 - RNA, 22 nt, Human
uccagccuaggggaacagcugc

SEQ ID NO: 1105284 - RNA, 22 nt, Human
caggauggagggagggcuguua

SEQ ID NO: 1105285 - RNA, 22 nt, Human
ggugaguugggguucacagguc

SEQ ID NO: 1105286 - RNA, 17 nt, Human
acagagcacaucaagau

SEQ ID NO: 1105287 - RNA, 22 nt, Human
cagaugaggcaaccucauugcu

SEQ ID NO: 1105288 - RNA, 18 nt, Human
gacacauccccaggccuc

SEQ ID NO: 1105289 - RNA, 22 nt, Human
uggggcuccuccuggcaggagg

SEQ ID NO: 1105290 - RNA, 17 nt, Human
caaggccagcaucuuca

SEQ ID NO: 1105291 - RNA, 22 nt, Human
ugaaggccagcucuuuaucagc

SEQ ID NO: 1105292 - RNA, 22 nt, Human
uuuuaucuucauuccuaucuac

SEQ ID NO: 1105293 - RNA, 22 nt, Human
gcccacacaccagcucaggagg

SEQ ID NO: 1105294 - RNA, 22 nt, Human
augaguucaauuguuucaguca

SEQ ID NO: 1105295 - RNA, 22 nt, Human
ccagaggaggggggucuuucug

SEQ ID NO: 1105296 - RNA, 22 nt, Human
gucaggaugacaagugcuuuca

SEQ ID NO: 1105297 - RNA, 22 nt, Human
augaaggcuguguggagccccc

SEQ ID NO: 1105298 - RNA, 22 nt, Human
ugcagagagauccucaggguuu

SEQ ID NO: 1105299 - RNA, 22 nt, Human
caagagagaugcagcucacuca

SEQ ID NO: 1105300 - RNA, 22 nt, Human
aucugccugcaguggagguggg

SEQ ID NO: 1105301 - RNA, 22 nt, Human
cagaccagaaggaagccgacaa

SEQ ID NO: 1105302 - RNA, 22 nt, Human
ucucaagaucucaagauggccc

SEQ ID NO: 1105303 - RNA, 22 nt, Human
auacuguuucucuucuacauga

SEQ ID NO: 1105304 - RNA, 22 nt, Human
gucaggauguuuauucuccagu

SEQ ID NO: 1105305 - RNA, 22 nt, Human
gaaggccacaaaaaaugucaua

SEQ ID NO: 1105306 - RNA, 23 nt, Human
cccauuuucauguuaacuccugg

SEQ ID NO: 1105307 - RNA, 22 nt, Human
uccauuuucuaaguaucacuua

SEQ ID NO: 1105308 - RNA, 19 nt, Human
uggcaucuguaaaauggug

SEQ ID NO: 1105309 - RNA, 22 nt, Human
ucucacuuuccagacuuuucaa

SEQ ID NO: 1105310 - RNA, 22 nt, Human
ugaaggaaugaguauacuguuu

SEQ ID NO: 1105311 - RNA, 22 nt, Human
uaaggccaauuacauauguuca

SEQ ID NO: 1105312 - RNA, 22 nt, Human
agagggagcccagucauagcug

SEQ ID NO: 1105313 - RNA, 22 nt, Human
ugaguaauaaacugucuugcuc

SEQ ID NO: 1105314 - RNA, 22 nt, Human
uuguaaacugcugcaggagugc

SEQ ID NO: 1105315 - RNA, 22 nt, Human
augcaucuauucccaagggcag

SEQ ID NO: 1105316 - RNA, 22 nt, Human
uucacagaugccugaugugugg

SEQ ID NO: 1105317 - RNA, 22 nt, Human
auugaaaguccuaucuaaggga

SEQ ID NO: 1105318 - RNA, 22 nt, Human
ugaaugaguuuggcugcuguuc

SEQ ID NO: 1105319 - RNA, 22 nt, Human
guugaaagcuuuucauuuaguu

SEQ ID NO: 1105320 - RNA, 18 nt, Human
cucaccauucugcccaau

SEQ ID NO: 1105321 - RNA, 22 nt, Human
cuuguaauuauaauguacuguu

SEQ ID NO: 1105322 - RNA, 22 nt, Human
gacacagagcucacagucuccu

SEQ ID NO: 1105323 - RNA, 22 nt, Human
aagcuggaacaucuugaggaag

SEQ ID NO: 1105324 - RNA, 22 nt, Human
agacccagaaagcagcugcauu

SEQ ID NO: 1105325 - RNA, 22 nt, Human
acauuuaaauaccuauguuucu

SEQ ID NO: 1105326 - RNA, 22 nt, Human
caaggccaguccauuuuggaag

SEQ ID NO: 1105327 - RNA, 22 nt, Human
gcucaggaaaacagucuaguaa

SEQ ID NO: 1105328 - RNA, 22 nt, Human
aagagagagugcgcucacagaa

SEQ ID NO: 1105329 - RNA, 22 nt, Human
ugucaaauuuuuauugcaguau

SEQ ID NO: 1105330 - RNA, 22 nt, Human
ucagagagccucaggcacugcc

SEQ ID NO: 1105331 - RNA, 22 nt, Human
ccagaagaccccguccaccucc

SEQ ID NO: 1105332 - RNA, 22 nt, Human
caguuucuacgaaggucaaccc

SEQ ID NO: 1105333 - RNA, 22 nt, Human
aggcacaguggcucacaccugu

SEQ ID NO: 1105334 - RNA, 22 nt, Human
gacacagauaucucugagauua

SEQ ID NO: 1105335 - RNA, 22 nt, Human
uaaggccauuauggugggcccg

SEQ ID NO: 1105336 - RNA, 22 nt, Human
ucauuuaauaauuuuugaguag

SEQ ID NO: 1105337 - RNA, 21 nt, Human
acacagaggcaucaucacuuu

SEQ ID NO: 1105338 - RNA, 22 nt, Human
cacacacuguuaauguaggagu

SEQ ID NO: 1105339 - RNA, 22 nt, Human
cacccacauggaaauucacagu

SEQ ID NO: 1105340 - RNA, 22 nt, Human
aggaaacuccccuacaucucaa

SEQ ID NO: 1105341 - RNA, 22 nt, Human
aucugccuggcuccaggugagc

SEQ ID NO: 1105342 - RNA, 22 nt, Human
guacacacuauguauuguacac

SEQ ID NO: 1105343 - RNA, 22 nt, Human
uucccacaguguugaauccucu

SEQ ID NO: 1105344 - RNA, 22 nt, Human
gacuucuauuaauaccucuacu

SEQ ID NO: 1105345 - RNA, 22 nt, Human
ugaugaaauguugaggcaguga

SEQ ID NO: 1105346 - RNA, 22 nt, Human
ucucucagaggaagaggcagug

SEQ ID NO: 1105347 - RNA, 22 nt, Human
ucucacugcaaauauuauguau

SEQ ID NO: 1105348 - RNA, 22 nt, Human
augaggcauuccacucaaacuc

SEQ ID NO: 1105349 - RNA, 22 nt, Human
ugcagagagaccccugggccag

SEQ ID NO: 1105350 - RNA, 22 nt, Human
uuccagcaggcagacaggagau

SEQ ID NO: 1105351 - RNA, 22 nt, Human
cucaggauuuacuaauuucaag

SEQ ID NO: 1105352 - RNA, 22 nt, Human
gaaaggccagcucacagaugag

SEQ ID NO: 1105353 - RNA, 22 nt, Human
gcucaggacccaggugugaccu

SEQ ID NO: 1105354 - RNA, 22 nt, Human
uuugaaagaauuuauguacuuu

SEQ ID NO: 1105355 - RNA, 20 nt, Human
cauuuguuagcuuucuacug

SEQ ID NO: 1105356 - RNA, 22 nt, Human
cucacuguccaacaggcuuuac

SEQ ID NO: 1105357 - RNA, 18 nt, Human
ccagguggugacagagau

SEQ ID NO: 1105358 - RNA, 22 nt, Human
uuugaaaggaauuaggaugaca

SEQ ID NO: 1105359 - RNA, 23 nt, Human
acacugucucauggauagacugc

SEQ ID NO: 1105360 - RNA, 22 nt, Human
agaggagugggaagcagugcaa

SEQ ID NO: 1105361 - RNA, 20 nt, Human
uucaugggagcaaagaggcc

SEQ ID NO: 1105362 - RNA, 22 nt, Human
cauuuguuaauuacuauuaucu

SEQ ID NO: 1105363 - RNA, 22 nt, Human
uacacaucucugucaguaguga

SEQ ID NO: 1105364 - RNA, 22 nt, Human
uaagaacaguagaacaguaggu

SEQ ID NO: 1105365 - RNA, 22 nt, Human
ggacuucuaagugccagacacu

SEQ ID NO: 1105366 - RNA, 22 nt, Human
aaggccaacuaggaugagcuag

SEQ ID NO: 1105367 - RNA, 22 nt, Human
acaguggagaaggcaugaggcu

SEQ ID NO: 1105368 - RNA, 22 nt, Human
gggacaauggaggccucucucc

SEQ ID NO: 1105369 - RNA, 22 nt, Human
gcccacaccauuuauucuuugu

SEQ ID NO: 1105370 - RNA, 22 nt, Human
gucaggaucucccaguacauau

SEQ ID NO: 1105371 - RNA, 22 nt, Human
gaggaaccaaaucagcuugcac

SEQ ID NO: 1105372 - RNA, 22 nt, Human
agauggaguuaguaccagaguc

SEQ ID NO: 1105373 - RNA, 22 nt, Human
ccucaggaaccacauugcugcu

SEQ ID NO: 1105374 - RNA, 22 nt, Human
ucagauggguuuugaaggaugu

SEQ ID NO: 1105375 - RNA, 22 nt, Human
uugguuuagagagugugguuac

SEQ ID NO: 1105376 - RNA, 23 nt, Human
acagacaacacugaugagagaaa

SEQ ID NO: 1105377 - RNA, 17 nt, Human
ccauacugacauauuga

SEQ ID NO: 1105378 - RNA, 22 nt, Human
acaucacacgccuuccaggagg

SEQ ID NO: 1105379 - RNA, 22 nt, Human
cuugaaagaagggucuuuuaau

SEQ ID NO: 1105380 - RNA, 22 nt, Human
gcuccucugucaaaugagagug

SEQ ID NO: 1105381 - RNA, 22 nt, Human
ucacaguuauagucuguagaau

SEQ ID NO: 1105382 - RNA, 22 nt, Human
ucagucucaucaacucuauucc

SEQ ID NO: 1105383 - RNA, 22 nt, Human
guugaaaguggagaaccugguu

SEQ ID NO: 1105384 - RNA, 22 nt, Human
aggcacagagaaugcccuccau

SEQ ID NO: 1105385 - RNA, 22 nt, Human
gcucacugcaaccucugcuucc

SEQ ID NO: 1105386 - RNA, 22 nt, Human
guccucuggaagaugaguucuu

SEQ ID NO: 1105387 - RNA, 22 nt, Human
aguucucagcuuaguaugcugu

SEQ ID NO: 1105388 - RNA, 22 nt, Human
caggauggucucgaucuccuga

SEQ ID NO: 1105389 - RNA, 22 nt, Human
gaggaaccaaucugugauauuc

SEQ ID NO: 1105390 - RNA, 22 nt, Human
ccucaggauccgcaggugcagu

SEQ ID NO: 1105391 - RNA, 22 nt, Human
cacacaguaggcacucauuaau

SEQ ID NO: 1105392 - RNA, 22 nt, Human
acucaggaaaugagaggcucuc

SEQ ID NO: 1105393 - RNA, 22 nt, Human
aaugucugccagaacugaucau

SEQ ID NO: 1105394 - RNA, 22 nt, Human
aaggccagccugagagcuaaca

SEQ ID NO: 1105395 - RNA, 22 nt, Human
cccagcccccgagugucuggaa

SEQ ID NO: 1105396 - RNA, 22 nt, Human
aucaggauagucuguaaauugu

SEQ ID NO: 1105397 - RNA, 22 nt, Human
acacauuucuaaauuuuuaccg

SEQ ID NO: 1105398 - RNA, 22 nt, Human
ccaggcugagcaugauuggagc

SEQ ID NO: 1105399 - RNA, 22 nt, Human
accgaaggaaacuggaaccguu

SEQ ID NO: 1105400 - RNA, 22 nt, Human
gaaggccauugcguccugggau

SEQ ID NO: 1105401 - RNA, 22 nt, Human
uugcugaagugaagguauguuu

SEQ ID NO: 1105402 - RNA, 22 nt, Human
cuucugcaauaaguuuuggucc

SEQ ID NO: 1105403 - RNA, 22 nt, Human
caaggccauauugccuguaugu

SEQ ID NO: 1105404 - RNA, 19 nt, Human
ucucugcuucucuuggcau

SEQ ID NO: 1105405 - RNA, 22 nt, Human
auucaaguucuucugucuuugc

SEQ ID NO: 1105406 - RNA, 22 nt, Human
aucaggauccaccuugagccug

SEQ ID NO: 1105407 - RNA, 22 nt, Human
aucaggaucacugggagucuug

SEQ ID NO: 1105408 - RNA, 22 nt, Human
uucaggauaugugauaucugaa

SEQ ID NO: 1105409 - RNA, 22 nt, Human
aggaugaauaacugaaauggug

SEQ ID NO: 1105410 - RNA, 23 nt, Human
ucuccuccuagauacagucaugg

SEQ ID NO: 1105411 - RNA, 22 nt, Human
cgcauacauagaaacacacaga

SEQ ID NO: 1105412 - RNA, 22 nt, Human
agaggccaggcugcagagggau

SEQ ID NO: 1105413 - RNA, 22 nt, Human
uugaaaguccuucuugaguuac

SEQ ID NO: 1105414 - RNA, 22 nt, Human
uuagccauuaaauuacaaggug

SEQ ID NO: 1105415 - RNA, 22 nt, Human
ggauggcauguugggcucuguu

SEQ ID NO: 1105416 - RNA, 22 nt, Human
guccucugggagccuugagccu

SEQ ID NO: 1105417 - RNA, 22 nt, Human
uacacagauaugugaucaauca

SEQ ID NO: 1105418 - RNA, 22 nt, Human
aaacauuugcaacucgguuugg

SEQ ID NO: 1105419 - RNA, 22 nt, Human
ugguccuggaagguccugaggg

SEQ ID NO: 1105420 - RNA, 22 nt, Human
uuugaaaggguuaugagacuga

SEQ ID NO: 1105421 - RNA, 22 nt, Human
cagagggcacaugguuuccuca

SEQ ID NO: 1105422 - RNA, 22 nt, Human
acacacuguaaggacuaucacu

SEQ ID NO: 1105423 - RNA, 22 nt, Human
uuuuaucugcuucauuaguuga

SEQ ID NO: 1105424 - RNA, 22 nt, Human
uucauugugaacacauucugcc

SEQ ID NO: 1105425 - RNA, 22 nt, Human
acacaucagaaauaugaaugag

SEQ ID NO: 1105426 - RNA, 22 nt, Human
aucccaugagaccacguuggcu

SEQ ID NO: 1105427 - RNA, 22 nt, Human
acacaucuuagacugaaauaug

SEQ ID NO: 1105428 - RNA, 22 nt, Human
acugccauuggucaaaugagug

SEQ ID NO: 1105429 - RNA, 19 nt, Human
aucugccuuagugcugcug

SEQ ID NO: 1105430 - RNA, 22 nt, Human
ugaguucucacccauucuucuu

SEQ ID NO: 1105431 - RNA, 22 nt, Human
agucacuguucugucaugucaa

SEQ ID NO: 1105432 - RNA, 22 nt, Human
uguaaacauauguauguaugua

SEQ ID NO: 1105433 - RNA, 22 nt, Human
gcacauacugcaaagauuacua

SEQ ID NO: 1105434 - RNA, 22 nt, Human
uugugaguagugccgcaauaaa

SEQ ID NO: 1105435 - RNA, 23 nt, Human
ucaggauauugugugccaaggug

SEQ ID NO: 1105436 - RNA, 22 nt, Human
uaaggccaaguucauauacaac

SEQ ID NO: 1105437 - RNA, 22 nt, Human
uuaucacuuaugagcuuuuugc

SEQ ID NO: 1105438 - RNA, 22 nt, Human
caucucaugggcaugccaagcu

SEQ ID NO: 1105439 - RNA, 22 nt, Human
aucaggaugacaacugcugggu

SEQ ID NO: 1105440 - RNA, 22 nt, Human
ccuggcuccugccucugcaggg

SEQ ID NO: 1105441 - RNA, 21 nt, Human
uugaaaguaaauucagcagcu

SEQ ID NO: 1105442 - RNA, 22 nt, Human
gauggcagcagcagccagggau

SEQ ID NO: 1105443 - RNA, 22 nt, Human
uugcaaaggggaauaaagcaau

SEQ ID NO: 1105444 - RNA, 22 nt, Human
ugcuucugggcaaaugugugug

SEQ ID NO: 1105445 - RNA, 22 nt, Human
cagcccagccuugucucuuuau

SEQ ID NO: 1105446 - RNA, 21 nt, Human
ccagcccagcugugucccagc

SEQ ID NO: 1105447 - RNA, 22 nt, Human
uucaggauucuuucagacuggg

SEQ ID NO: 1105448 - RNA, 21 nt, Human
ucuugaaaauuguagcaguuu

SEQ ID NO: 1105449 - RNA, 22 nt, Human
caggguggcacaucacagcauu

SEQ ID NO: 1105450 - RNA, 22 nt, Human
auuccacacaguaauacucaau

SEQ ID NO: 1105451 - RNA, 22 nt, Human
gcuccucuucucccacugaaug

SEQ ID NO: 1105452 - RNA, 22 nt, Human
gcagagcuccccaagacaccaa

SEQ ID NO: 1105453 - RNA, 22 nt, Human
caacauuucaaggucuuuagga

SEQ ID NO: 1105454 - RNA, 22 nt, Human
uguaaagaaagacgcagaguua

SEQ ID NO: 1105455 - RNA, 22 nt, Human
uccauuuuagaagaaaauccac

SEQ ID NO: 1105456 - RNA, 20 nt, Human
guugaaaguaauaugaugcu

SEQ ID NO: 1105457 - RNA, 21 nt, Human
uucuucaugaugauuaauggc

SEQ ID NO: 1105458 - RNA, 22 nt, Human
auguucuguuuuguaauucaua

SEQ ID NO: 1105459 - RNA, 19 nt, Human
ccacacagugugcaauuua

SEQ ID NO: 1105460 - RNA, 22 nt, Human
gagagucuagugcaccuaguuu

SEQ ID NO: 1105461 - RNA, 22 nt, Human
guacacacaaucucuggucagu

SEQ ID NO: 1105462 - RNA, 22 nt, Human
augugaggaagaaagagguaag

SEQ ID NO: 1105463 - RNA, 22 nt, Human
agaccaagugcaggugccacua

SEQ ID NO: 1105464 - RNA, 22 nt, Human
ucucaggaauagaguggcagca

SEQ ID NO: 1105465 - RNA, 21 nt, Human
gcucagaguauugcacuguuu

SEQ ID NO: 1105466 - RNA, 20 nt, Human
uugauaggcagcuugucagg

SEQ ID NO: 1105467 - RNA, 22 nt, Human
gucacuguauccagguuccagc

SEQ ID NO: 1105468 - RNA, 22 nt, Human
agcccaggucuggcccagccug

SEQ ID NO: 1105469 - RNA, 22 nt, Human
cucaggauauugggcuggagca

SEQ ID NO: 1105470 - RNA, 22 nt, Human
uugguuuacuaggauucaaauu

SEQ ID NO: 1105471 - RNA, 22 nt, Human
uuucauuuugguuaugccauaa

SEQ ID NO: 1105472 - RNA, 22 nt, Human
ugauugaagaggugaggaaguu

SEQ ID NO: 1105473 - RNA, 22 nt, Human
gaggccaaucaauagggcaaua

SEQ ID NO: 1105474 - RNA, 22 nt, Human
ucaccgccuugcccggccgggc

SEQ ID NO: 1105475 - RNA, 22 nt, Human
aaggaaccuggaguagagggag

SEQ ID NO: 1105476 - RNA, 22 nt, Human
aggccagaaaugucagggagug

SEQ ID NO: 1105477 - RNA, 22 nt, Human
aacacauaggcagagcaugaca

SEQ ID NO: 1105478 - RNA, 16 nt, Human
cuuccucuucacuggc

SEQ ID NO: 1105479 - RNA, 22 nt, Human
cacuguccaugcuugcuaaccc

SEQ ID NO: 1105480 - RNA, 22 nt, Human
guaucacuuuugagagugagaa

SEQ ID NO: 1105481 - RNA, 22 nt, Human
cauuacaaccccaaauuacaaa

SEQ ID NO: 1105482 - RNA, 22 nt, Human
ugaaggccacuuccugugagcu

SEQ ID NO: 1105483 - RNA, 22 nt, Human
gaugccucuuuuggcugaauua

SEQ ID NO: 1105484 - RNA, 23 nt, Human
ucuugaaaagccuacagcaguuc

SEQ ID NO: 1105485 - RNA, 22 nt, Human
cagcuuucaucagugacacuca

SEQ ID NO: 1105486 - RNA, 22 nt, Human
agaccgagaaguucuccaggcc

SEQ ID NO: 1105487 - RNA, 22 nt, Human
ugaugaaaauaugauucugagg

SEQ ID NO: 1105488 - RNA, 22 nt, Human
uucaggauggaguaccuuuuau

SEQ ID NO: 1105489 - RNA, 22 nt, Human
agaggccggccgagcccauggg

SEQ ID NO: 1105490 - RNA, 22 nt, Human
aucaggauggguuuggcuuagg

SEQ ID NO: 1105491 - RNA, 22 nt, Human
aucccacaccccuacaacauau

SEQ ID NO: 1105492 - RNA, 22 nt, Human
aguggcagagugcacucaggca

SEQ ID NO: 1105493 - RNA, 22 nt, Human
ucacuucacacccacuaucaug

SEQ ID NO: 1105494 - RNA, 22 nt, Human
cacaacuuuaggaaccacauuc

SEQ ID NO: 1105495 - RNA, 22 nt, Human
auugaaagauauacuguucuca

SEQ ID NO: 1105496 - RNA, 22 nt, Human
ucuccucucuuaccugguacaa

SEQ ID NO: 1105497 - RNA, 22 nt, Human
ucuacuguagugaugcugcagu

SEQ ID NO: 1105498 - RNA, 22 nt, Human
auugaaagguuuugagcagaua

SEQ ID NO: 1105499 - RNA, 22 nt, Human
uuagccauugucagcacauggc

SEQ ID NO: 1105500 - RNA, 22 nt, Human
uuugaaagggaaauaaacuccu

SEQ ID NO: 1105501 - RNA, 22 nt, Human
gauggcagguaguggucucauc

SEQ ID NO: 1105502 - RNA, 22 nt, Human
auugaaagagaauguagcucuu

SEQ ID NO: 1105503 - RNA, 22 nt, Human
ugagagggcccagagcacacca

SEQ ID NO: 1105504 - RNA, 22 nt, Human
gacacagagggcaccagauaug

SEQ ID NO: 1105505 - RNA, 21 nt, Human
cuugaaagguagagucuacag

SEQ ID NO: 1105506 - RNA, 22 nt, Human
cuccucuggguccugguggcca

SEQ ID NO: 1105507 - RNA, 22 nt, Human
gcacacaguauaugcucauuaa

SEQ ID NO: 1105508 - RNA, 22 nt, Human
aaaggaagauugagcuuuucca

SEQ ID NO: 1105509 - RNA, 22 nt, Human
uucacagaauggcaaguuaugg

SEQ ID NO: 1105510 - RNA, 22 nt, Human
ucaggauguccaaaauccagcc

SEQ ID NO: 1105511 - RNA, 22 nt, Human
gacacagaauuuacucccgaua

SEQ ID NO: 1105512 - RNA, 22 nt, Human
cagaguggcacucugcuggaug

SEQ ID NO: 1105513 - RNA, 22 nt, Human
acucaggaaaaauguagugaua

SEQ ID NO: 1105514 - RNA, 22 nt, Human
cacuguccaauagauacauaau

SEQ ID NO: 1105515 - RNA, 22 nt, Human
aucacaauguacguuaaaaugu

SEQ ID NO: 1105516 - RNA, 22 nt, Human
acugagagucaagauagcaugg

SEQ ID NO: 1105517 - RNA, 22 nt, Human
ucagagaguuggaaagaauuaa

SEQ ID NO: 1105518 - RNA, 22 nt, Human
uucacauuggugauauguuucu

SEQ ID NO: 1105519 - RNA, 22 nt, Human
caucaucaaaacaaauggaguc

SEQ ID NO: 1105520 - RNA, 22 nt, Human
guccucuggagguuuuuaggug

SEQ ID NO: 1105521 - RNA, 22 nt, Human
ugaugaauaaacuugagaguca

SEQ ID NO: 1105522 - RNA, 22 nt, Human
gucacuguuuccuauuauauuu

SEQ ID NO: 1105523 - RNA, 22 nt, Human
caggaugguggcaugaucagaa

SEQ ID NO: 1105524 - RNA, 22 nt, Human
agucuucucauuucacaugcuu

SEQ ID NO: 1105525 - RNA, 22 nt, Human
acagucuugcuguauggucagg

SEQ ID NO: 1105526 - RNA, 22 nt, Human
cgucuuccucuuacgaugcgcu

SEQ ID NO: 1105527 - RNA, 22 nt, Human
aaauuacagaucaccaaugcau

SEQ ID NO: 1105528 - RNA, 22 nt, Human
ccaucacaguccccaucgugau

SEQ ID NO: 1105529 - RNA, 22 nt, Human
uuugaaaguccuaggagagucc

SEQ ID NO: 1105530 - RNA, 22 nt, Human
ugaaggccucugguacaugcca

SEQ ID NO: 1105531 - RNA, 22 nt, Human
acauacacaugaauauauuuuu

SEQ ID NO: 1105532 - RNA, 22 nt, Human
aaaggccauuacuugcuuuuag

SEQ ID NO: 1105533 - RNA, 22 nt, Human
uacacagauuucaguaucauca

SEQ ID NO: 1105534 - RNA, 22 nt, Human
agaccaagacuauaaugagagg

SEQ ID NO: 1105535 - RNA, 22 nt, Human
ucagagaggcaauacuguuuaa

SEQ ID NO: 1105536 - RNA, 22 nt, Human
uuugaaagaaaccagugaguga

SEQ ID NO: 1105537 - RNA, 22 nt, Human
uucaggaucaaguugccaguag

SEQ ID NO: 1105538 - RNA, 22 nt, Human
cagcccaaagccccaggcuaga

SEQ ID NO: 1105539 - RNA, 22 nt, Human
gaaaggcaguacagcugagccu

SEQ ID NO: 1105540 - RNA, 22 nt, Human
uugaaaguuuauggagucugca

SEQ ID NO: 1105541 - RNA, 22 nt, Human
aucaggauuacacggggaugcu

SEQ ID NO: 1105542 - RNA, 19 nt, Human
cugagagaugcuucacaca

SEQ ID NO: 1105543 - RNA, 21 nt, Human
gcugcaucaaucuacccaggg

SEQ ID NO: 1105544 - RNA, 22 nt, Human
gaggccaggagugcuguaaguu

SEQ ID NO: 1105545 - RNA, 22 nt, Human
aggcaguuguugcugagcagcu

SEQ ID NO: 1105546 - RNA, 22 nt, Human
ggccagaggugguacauagcuu

SEQ ID NO: 1105547 - RNA, 22 nt, Human
ccaggcugugguuuagauagag

SEQ ID NO: 1105548 - RNA, 22 nt, Human
acacacuguugcucauccaggc

SEQ ID NO: 1105549 - RNA, 22 nt, Human
aguuggagugaacaugagauug

SEQ ID NO: 1105550 - RNA, 23 nt, Human
ucguugaauagcaauagcacaac

SEQ ID NO: 1105551 - RNA, 22 nt, Human
aucaggauguuuggcugucaua

SEQ ID NO: 1105552 - RNA, 20 nt, Human
uuccacaucuuugcacaugc

SEQ ID NO: 1105553 - RNA, 22 nt, Human
guccucuguguaggcugcagac

SEQ ID NO: 1105554 - RNA, 22 nt, Human
ugguaauuuacgcauuucugua

SEQ ID NO: 1105555 - RNA, 22 nt, Human
gcuccucuauuccccacauuuu

SEQ ID NO: 1105556 - RNA, 15 nt, Human
uucaggauaugacuc

SEQ ID NO: 1105557 - RNA, 22 nt, Human
auuccacagcuacaucaaucua

SEQ ID NO: 1105558 - RNA, 21 nt, Human
cacucaggguaugugccaggc

SEQ ID NO: 1105559 - RNA, 22 nt, Human
accauguguuuuacacauggua

SEQ ID NO: 1105560 - RNA, 21 nt, Human
uaaggccaagucuauuucugu

SEQ ID NO: 1105561 - RNA, 22 nt, Human
guacacacuauuuaaaguguuu

SEQ ID NO: 1105562 - RNA, 22 nt, Human
aaaggccaugguuggaguguuu

SEQ ID NO: 1105563 - RNA, 22 nt, Human
cauacauuuauacacaucuaug

SEQ ID NO: 1105564 - RNA, 22 nt, Human
agagugucugguagcugcucug

SEQ ID NO: 1105565 - RNA, 22 nt, Human
ucucugguuauuaacuaacucc

SEQ ID NO: 1105566 - RNA, 23 nt, Human
caguggagacucaugcuuccuua

SEQ ID NO: 1105567 - RNA, 22 nt, Human
guugaaagaugucuugguuccc

SEQ ID NO: 1105568 - RNA, 22 nt, Human
ccucagaugucuuaaggcacug

SEQ ID NO: 1105569 - RNA, 22 nt, Human
ccacacagauaaguguuuucua

SEQ ID NO: 1105570 - RNA, 22 nt, Human
agcugcuacugcucugccagag

SEQ ID NO: 1105571 - RNA, 22 nt, Human
cucagaauuuagggcucugagg

SEQ ID NO: 1105572 - RNA, 22 nt, Human
cagccaagaaccacagacccag

SEQ ID NO: 1105573 - RNA, 22 nt, Human
ucauuuuucacacagggucacc

SEQ ID NO: 1105574 - RNA, 22 nt, Human
cuggccucagagggucauggug

SEQ ID NO: 1105575 - RNA, 22 nt, Human
aucaggauucaguaucuccagc

SEQ ID NO: 1105576 - RNA, 22 nt, Human
ugugaaagcaagucuaguucuc

SEQ ID NO: 1105577 - RNA, 22 nt, Human
ugcagagaagaggacaguucua

SEQ ID NO: 1105578 - RNA, 22 nt, Human
ucugaaggugcuagagaaagcu

SEQ ID NO: 1105579 - RNA, 22 nt, Human
gccagagguucaacaacugucu

SEQ ID NO: 1105580 - RNA, 22 nt, Human
cacacagaaccgcucgccacuu

SEQ ID NO: 1105581 - RNA, 22 nt, Human
uucaauucuaaacuaauauucu

SEQ ID NO: 1105582 - RNA, 21 nt, Human
ucacacacguuuccaagggca

SEQ ID NO: 1105583 - RNA, 22 nt, Human
caaggccacguucugcaugcgg

SEQ ID NO: 1105584 - RNA, 22 nt, Human
cucuccucagaacaggcccucu

SEQ ID NO: 1105585 - RNA, 22 nt, Human
ucuuuuggguucuuaugauuua

SEQ ID NO: 1105586 - RNA, 22 nt, Human
augaggcaucugcagucacuag

SEQ ID NO: 1105587 - RNA, 22 nt, Human
acacucuguaaugucacacucc

SEQ ID NO: 1105588 - RNA, 22 nt, Human
gaggaaccacucugagaagcca

SEQ ID NO: 1105589 - RNA, 17 nt, Human
ucaggauguagcaguag

SEQ ID NO: 1105590 - RNA, 22 nt, Human
cugagagaucaagccacaggau

SEQ ID NO: 1105591 - RNA, 22 nt, Human
uugagaagaaauaguuugcaau

SEQ ID NO: 1105592 - RNA, 22 nt, Human
cauucucaauaguagaugagua

SEQ ID NO: 1105593 - RNA, 22 nt, Human
agauggagaaugacaauuaagg

SEQ ID NO: 1105594 - RNA, 22 nt, Human
ucaauucugguccucaggaacu

SEQ ID NO: 1105595 - RNA, 22 nt, Human
gcuugaaaauucauagguauuu

SEQ ID NO: 1105596 - RNA, 15 nt, Human
cacacagacagcuug

SEQ ID NO: 1105597 - RNA, 20 nt, Human
aguuauaguaucuagccaug

SEQ ID NO: 1105598 - RNA, 22 nt, Human
ucacauacugaaaguccaguga

SEQ ID NO: 1105599 - RNA, 22 nt, Human
ucuuuuggaaaugaugugcagg

SEQ ID NO: 1105600 - RNA, 22 nt, Human
aaggaaccauuugugugcaugg

SEQ ID NO: 1105601 - RNA, 22 nt, Human
gcacacaggcaguuuccagcca

SEQ ID NO: 1105602 - RNA, 19 nt, Human
agcuuccauauucucuagu

SEQ ID NO: 1105603 - RNA, 22 nt, Human
aacacauauuuauauaugcaca

SEQ ID NO: 1105604 - RNA, 22 nt, Human
auaucacaguaguuguuuaguu

SEQ ID NO: 1105605 - RNA, 22 nt, Human
uuuuuuaguuaggucagaaugu

SEQ ID NO: 1105606 - RNA, 22 nt, Human
gucaggauuuacaaacuucagu

SEQ ID NO: 1105607 - RNA, 22 nt, Human
caaggccaguuucuccuaguca

SEQ ID NO: 1105608 - RNA, 22 nt, Human
ccccacaccugccgggcagcag

SEQ ID NO: 1105609 - RNA, 21 nt, Human
ucucugguuggaguugugcca

SEQ ID NO: 1105610 - RNA, 22 nt, Human
uuuguuuacucauucauugaug

SEQ ID NO: 1105611 - RNA, 19 nt, Human
acauuuaaauucagaucuc

SEQ ID NO: 1105612 - RNA, 22 nt, Human
ccaccccaaaugaagaccucuc

SEQ ID NO: 1105613 - RNA, 22 nt, Human
gcaugucaugucauguaggaau

SEQ ID NO: 1105614 - RNA, 22 nt, Human
ugaaggccagggauuugcagcc

SEQ ID NO: 1105615 - RNA, 22 nt, Human
cauagagugauguaagguaugu

SEQ ID NO: 1105616 - RNA, 22 nt, Human
aagauggagcacgagcagaagc

SEQ ID NO: 1105617 - RNA, 22 nt, Human
guccucugggcuuugagcaguc

SEQ ID NO: 1105618 - RNA, 22 nt, Human
ucugguaaccuuuaucccuccu

SEQ ID NO: 1105619 - RNA, 22 nt, Human
aaaggccagguuggcugguauu

SEQ ID NO: 1105620 - RNA, 22 nt, Human
cagagccaggucuaggagucuc

SEQ ID NO: 1105621 - RNA, 22 nt, Human
agucaauuaucucuaggucauc

SEQ ID NO: 1105622 - RNA, 22 nt, Human
augugaggcagcacggagauua

SEQ ID NO: 1105623 - RNA, 22 nt, Human
ccacacagggggaugaguuauu

SEQ ID NO: 1105624 - RNA, 22 nt, Human
uuaacaugucuugacuucaucu

SEQ ID NO: 1105625 - RNA, 22 nt, Human
cauuuguuaaccaguguggauu

SEQ ID NO: 1105626 - RNA, 22 nt, Human
uacauuccuguuagcaucuaag

SEQ ID NO: 1105627 - RNA, 22 nt, Human
cacccacauuccaucacucugc

SEQ ID NO: 1105628 - RNA, 22 nt, Human
acaucugaggagaccagccucu

SEQ ID NO: 1105629 - RNA, 19 nt, Human
acauucccaucagcaaugu

SEQ ID NO: 1105630 - RNA, 22 nt, Human
uccauuuuagagaugaagaaac

SEQ ID NO: 1105631 - RNA, 22 nt, Human
auggcagauggcuggagcaggu

SEQ ID NO: 1105632 - RNA, 22 nt, Human
cucucuguuaugcuuucaugaa

SEQ ID NO: 1105633 - RNA, 22 nt, Human
ugaaggccagcagagugaaggc

SEQ ID NO: 1105634 - RNA, 17 nt, Human
aaggccauuuccaccca

SEQ ID NO: 1105635 - RNA, 22 nt, Human
acucaggaauggggcugggacu

SEQ ID NO: 1105636 - RNA, 22 nt, Human
caggaugggauguagugggccc

SEQ ID NO: 1105637 - RNA, 22 nt, Human
ucauuguuauguuuugcugucu

SEQ ID NO: 1105638 - RNA, 22 nt, Human
uuagaaagcuuuccauagucaa

SEQ ID NO: 1105639 - RNA, 21 nt, Human
aucacauuggcuguuauuauu

SEQ ID NO: 1105640 - RNA, 22 nt, Human
uguaaacauaccagagccaagu

SEQ ID NO: 1105641 - RNA, 22 nt, Human
ucauuuguacuugugugcuugu

SEQ ID NO: 1105642 - RNA, 22 nt, Human
gucuucuguaagaugagguccc

SEQ ID NO: 1105643 - RNA, 22 nt, Human
gcucaggagcucuugguggcgc

SEQ ID NO: 1105644 - RNA, 22 nt, Human
gaaggccacuuuguguugagaa

SEQ ID NO: 1105645 - RNA, 22 nt, Human
ccucaggggucacugugaggag

SEQ ID NO: 1105646 - RNA, 22 nt, Human
ucaucacauaugucaugauuug

SEQ ID NO: 1105647 - RNA, 22 nt, Human
ucagggugaaccaggcaggaau

SEQ ID NO: 1105648 - RNA, 22 nt, Human
agagucccagggacacuccaga

SEQ ID NO: 1105649 - RNA, 22 nt, Human
auugaaagaguuuucugcugca

SEQ ID NO: 1105650 - RNA, 22 nt, Human
ggagcugugcagugacuacaga

SEQ ID NO: 1105651 - RNA, 20 nt, Human
aggcucagcugagcucuugg

SEQ ID NO: 1105652 - RNA, 22 nt, Human
acacaucaugccaaguuucacc

SEQ ID NO: 1105653 - RNA, 22 nt, Human
uguaaacagccccauggagagc

SEQ ID NO: 1105654 - RNA, 22 nt, Human
uguugaagauaaaguucucauu

SEQ ID NO: 1105655 - RNA, 22 nt, Human
gaggaacccagcugggguugcc

SEQ ID NO: 1105656 - RNA, 20 nt, Human
caggaugauuggacacgaug

SEQ ID NO: 1105657 - RNA, 22 nt, Human
uuagccaugcccuagaagagga

SEQ ID NO: 1105658 - RNA, 22 nt, Human
gcucaggaccgaggggugggaa

SEQ ID NO: 1105659 - RNA, 22 nt, Human
uuuguuaauucuuauguuagag

SEQ ID NO: 1105660 - RNA, 19 nt, Human
uggggcuguguuuugaccc

SEQ ID NO: 1105661 - RNA, 22 nt, Human
gagguauaguucuauuagauga

SEQ ID NO: 1105662 - RNA, 22 nt, Human
cuacauuauguuuauugggacu

SEQ ID NO: 1105663 - RNA, 22 nt, Human
ugaaauguggagaugguaagua

SEQ ID NO: 1105664 - RNA, 22 nt, Human
aagaaaagguaaccgcuuaucu

SEQ ID NO: 1105665 - RNA, 22 nt, Human
aaauacaguggcagcagauaau

SEQ ID NO: 1105666 - RNA, 22 nt, Human
ccccaacccugguuccguggcg

SEQ ID NO: 1105667 - RNA, 22 nt, Human
uacaccagauuauuuauaacau

SEQ ID NO: 1105668 - RNA, 22 nt, Human
auguuugaaauuguaaguauau

SEQ ID NO: 1105669 - RNA, 22 nt, Human
caggaacacaaugagucucaaa

SEQ ID NO: 1105670 - RNA, 22 nt, Human
uagaugaacagaaagccacugu

SEQ ID NO: 1105671 - RNA, 22 nt, Human
ugugugaacucucugauguaca

SEQ ID NO: 1105672 - RNA, 22 nt, Human
uauagcagcaugauuuauaguc

SEQ ID NO: 1105673 - RNA, 22 nt, Human
guucaguuauuucugaagauau

SEQ ID NO: 1105674 - RNA, 22 nt, Human
ugucauuggugaucugaugccu

SEQ ID NO: 1105675 - RNA, 22 nt, Human
ugagaugaagugauguaaaaca

SEQ ID NO: 1105676 - RNA, 22 nt, Human
uucaguuuugcuuuuaaucaug

SEQ ID NO: 1105677 - RNA, 22 nt, Human
uagaaaagccccagcuggaggg

SEQ ID NO: 1105678 - RNA, 22 nt, Human
gaaaauaguucaucacaaugau

SEQ ID NO: 1105679 - RNA, 22 nt, Human
caggaaugguuaaucuaaagug

SEQ ID NO: 1105680 - RNA, 22 nt, Human
gcgagaaacuaagugcccuuug

SEQ ID NO: 1105681 - RNA, 22 nt, Human
uugaauaguuuuggauagcaua

SEQ ID NO: 1105682 - RNA, 22 nt, Human
aaacacaucauucaugucguca

SEQ ID NO: 1105683 - RNA, 22 nt, Human
cuauacagcagcuuacuaguua

SEQ ID NO: 1105684 - RNA, 22 nt, Human
caggaacagcaccaggagcuag

SEQ ID NO: 1105685 - RNA, 22 nt, Human
agagcaauuagcuuagguaaaa

SEQ ID NO: 1105686 - RNA, 22 nt, Human
ucagagaaguaggcuaauggug

SEQ ID NO: 1105687 - RNA, 22 nt, Human
caauguuuuuccuuccuuaaua

SEQ ID NO: 1105688 - RNA, 22 nt, Human
aaguccagguccucauuccauc

SEQ ID NO: 1105689 - RNA, 22 nt, Human
uuaaggaacuugucuuucucuu

SEQ ID NO: 1105690 - RNA, 22 nt, Human
guacauauccuuuacguuuugu

SEQ ID NO: 1105691 - RNA, 22 nt, Human
caggaaugccaaccagugcaug

SEQ ID NO: 1105692 - RNA, 22 nt, Human
ugcauuaagaauuucugaggau

SEQ ID NO: 1105693 - RNA, 22 nt, Human
uguucaguuugcuaucauaauc

SEQ ID NO: 1105694 - RNA, 22 nt, Human
uuggaaguucuuagccuuuuca

SEQ ID NO: 1105695 - RNA, 22 nt, Human
agagucaguuaugucaagugcu

SEQ ID NO: 1105696 - RNA, 19 nt, Human
uaugaaguugauaaaaguu

SEQ ID NO: 1105697 - RNA, 22 nt, Human
uccaagaagcuuacaaucuaau

SEQ ID NO: 1105698 - RNA, 22 nt, Human
agucaguaugacuuauaguucu

SEQ ID NO: 1105699 - RNA, 22 nt, Human
uacauguuauuucacuauuggu

SEQ ID NO: 1105700 - RNA, 22 nt, Human
gugcauauguguguauacaaac

SEQ ID NO: 1105701 - RNA, 22 nt, Human
uguggaauguccucagcauccu

SEQ ID NO: 1105702 - RNA, 21 nt, Human
aaagugguaaggauuauuuug

SEQ ID NO: 1105703 - RNA, 22 nt, Human
aauacagauggcaugugaagau

SEQ ID NO: 1105704 - RNA, 22 nt, Human
aucaucaucuaaauugugucgc

SEQ ID NO: 1105705 - RNA, 22 nt, Human
uugcauauccuccaacacaugg

SEQ ID NO: 1105706 - RNA, 22 nt, Human
caugcauuucuaccaaggaaua

SEQ ID NO: 1105707 - RNA, 22 nt, Human
aaugaaacuauauuuagagagg

SEQ ID NO: 1105708 - RNA, 22 nt, Human
gcaccgagaaggaagcaugccu

SEQ ID NO: 1105709 - RNA, 22 nt, Human
caguggaugucucauaguguga

SEQ ID NO: 1105710 - RNA, 21 nt, Human
caggaacauucuuuacauuua

SEQ ID NO: 1105711 - RNA, 22 nt, Human
uuuaaaccuaucuaagaaauag

SEQ ID NO: 1105712 - RNA, 22 nt, Human
agaaaagaggcuuucuaagcau

SEQ ID NO: 1105713 - RNA, 22 nt, Human
acagagacacggaagcuaaaga

SEQ ID NO: 1105714 - RNA, 22 nt, Human
agagaagagucuugucaaauua

SEQ ID NO: 1105715 - RNA, 22 nt, Human
cugugaauguuauaucucaaug

SEQ ID NO: 1105716 - RNA, 21 nt, Human
ugcauauauaagugcauacac

SEQ ID NO: 1105717 - RNA, 22 nt, Human
auguaguauuuggaaauguaaa

SEQ ID NO: 1105718 - RNA, 21 nt, Human
caaaagagacugauucuugga

SEQ ID NO: 1105719 - RNA, 18 nt, Human
uauaaacacacuuagguu

SEQ ID NO: 1105720 - RNA, 22 nt, Human
guaugugucuuagaacuuggga

SEQ ID NO: 1105721 - RNA, 22 nt, Human
caaacuuacuguguuuaaagag

SEQ ID NO: 1105722 - RNA, 22 nt, Human
aaaagagccacuuaugaccuca

SEQ ID NO: 1105723 - RNA, 22 nt, Human
gagcaacacauugaaugaggau

SEQ ID NO: 1105724 - RNA, 22 nt, Human
cuucacaaaauauuucauuaua

SEQ ID NO: 1105725 - RNA, 22 nt, Human
cagagcugucauuugccaguga

SEQ ID NO: 1105726 - RNA, 22 nt, Human
cugagguagaggaaauguagcu

SEQ ID NO: 1105727 - RNA, 22 nt, Tula virus
ccauuuaagagugcacuugaug

SEQ ID NO: 1105728 - RNA, 22 nt, Tula virus
agcaugugcaauuagacauucu

SEQ ID NO: 1105729 - RNA, 22 nt, Tula virus
accgagaagacucaaacacaga

SEQ ID NO: 1105730 - RNA, 22 nt, Human
uagaaaagccccagcuggaggg

SEQ ID NO: 1105731 - RNA, 22 nt, Human
aagaaaagguaaccgcuuaucu

SEQ ID NO: 1105732 - RNA, 22 nt, Human
uucacugugauguuuaagagaa

SEQ ID NO: 1105733 - RNA, 22 nt, Human
cagcacauggauggaguuagga

SEQ ID NO: 1105734 - RNA, 20 nt, Human
ucacuguaacauuugggggg

SEQ ID NO: 1105735 - RNA, 22 nt, Human
aagcaccuggguuauaucuuag

SEQ ID NO: 1105736 - RNA, 22 nt, Human
agaauccuggagaagcuguacc

SEQ ID NO: 1105737 - RNA, 21 nt, Human
uuggccgugcagaugaacagc

SEQ ID NO: 1105738 - RNA, 21 nt, Human
ccuuugaguguguuugaagua

SEQ ID NO: 1105739 - RNA, 22 nt, Human
agagaagagucuugucaaauua

SEQ ID NO: 1105740 - RNA, 22 nt, Human
agcacuggaaaguuaagaguuu

SEQ ID NO: 1105741 - RNA, 22 nt, Human
augaagcugguuuuggcuuggg

SEQ ID NO: 1105742 - RNA, 22 nt, Human
gucaccuugaacaggcuacuca

SEQ ID NO: 1105743 - RNA, 22 nt, Human
gagcacugagcuggaauuggag

SEQ ID NO: 1105744 - RNA, 22 nt, Human
ucuucaugucucugcuugaguc

SEQ ID NO: 1105745 - RNA, 22 nt, Human
ccuuugagccugggcgcggacc

SEQ ID NO: 1105746 - RNA, 22 nt, Human
gagcagcaggccagguugcagg

SEQ ID NO: 1105747 - RNA, 22 nt, Human
gcacugggggcagcagugaggg

SEQ ID NO: 1105748 - RNA, 22 nt, Human
cccuugagccuggaggagcucu

SEQ ID NO: 1105749 - RNA, 22 nt, Human
ggcacuggcaaagcaaagucug

SEQ ID NO: 1105750 - RNA, 22 nt, Human
ugggaagauaugagugaccaac

SEQ ID NO: 1105751 - RNA, 22 nt, Human
augcaacuacccccaggauuuu

SEQ ID NO: 1105752 - RNA, 22 nt, Human
agaaagcacccugcacuuucug

SEQ ID NO: 1105753 - RNA, 22 nt, Human
cuggccagggugcgaucguggu

SEQ ID NO: 1105754 - RNA, 22 nt, Human
agggcacucugcagggaccacc

SEQ ID NO: 1105755 - RNA, 22 nt, Human
agucacuguuuaaucuagcuaa

SEQ ID NO: 1105756 - RNA, 22 nt, Human
gggagccagcagggcauggagc

SEQ ID NO: 1105757 - RNA, 22 nt, Human
aguguauuugccuauaaaaaug

SEQ ID NO: 1105758 - RNA, 22 nt, Human
auucauucugaccucaagagaa

SEQ ID NO: 1105759 - RNA, 22 nt, Human
aauacagugaaagugagcaagg

SEQ ID NO: 1105760 - RNA, 21 nt, Human
aaagugguaaggauuauuuug

SEQ ID NO: 1105761 - RNA, 22 nt, Human
ugcuuucaaugaauuguauacu

SEQ ID NO: 1105762 - RNA, 22 nt, Human
uuuguguuguacuucugugcau

SEQ ID NO: 1105763 - RNA, 21 nt, Human
uucugagacucauuugaacuc

SEQ ID NO: 1105764 - RNA, 22 nt, Human
uuuguguuggaagaaaugcuac

SEQ ID NO: 1105765 - RNA, 22 nt, Human
uucagauaagucaaguuaguau

SEQ ID NO: 1105766 - RNA, 22 nt, Human
aggaaauuuugaaucagugucu

SEQ ID NO: 1105767 - RNA, 22 nt, Human
gauccacaggaaccaaaacgca

SEQ ID NO: 1105768 - RNA, 22 nt, Human
uacagcuugauguuuguguguu

SEQ ID NO: 1105769 - RNA, 22 nt, Human
uguacacauuaagcucuuuaga

SEQ ID NO: 1105770 - RNA, 22 nt, Human
aaugaaacuauauuuagagagg

SEQ ID NO: 1105771 - RNA, 18 nt, Human
ucugaaggaaugauucca

SEQ ID NO: 1105772 - RNA, 22 nt, Human
uuucauuauaaaaaguuggcuu

SEQ ID NO: 1105773 - RNA, 21 nt, Human
cgaaguuugggcagagggguc

SEQ ID NO: 1105774 - RNA, 22 nt, Human
uuccaauaaaauguuauuugca

SEQ ID NO: 1105775 - RNA, 22 nt, Human
uuguagucuaggauagauuuuu

SEQ ID NO: 1105776 - RNA, 22 nt, Human
uugcuggaguagaaaacuuaac

SEQ ID NO: 1105777 - RNA, 22 nt, Human
gucauggaggauugugaguggu

SEQ ID NO: 1105778 - RNA, 22 nt, Human
uuuugucagugagaacagaguu

SEQ ID NO: 1105779 - RNA, 22 nt, Human
uuauuccauagaagucaaggaa

SEQ ID NO: 1105780 - RNA, 22 nt, Human
ucauuuacacuucacaaaugga

SEQ ID NO: 1105781 - RNA, 22 nt, Human
uaagggaacagcuucaaacuca

SEQ ID NO: 1105782 - RNA, 17 nt, Human
uuucugcaugauuggac

SEQ ID NO: 1105783 - RNA, 22 nt, Human
auaggcauaacacugauguccu

SEQ ID NO: 1105784 - RNA, 22 nt, Human
uuguguacucaccagcacauac

SEQ ID NO: 1105785 - RNA, 23 nt, Human
gacagagugagaccuugucuuac

SEQ ID NO: 1105786 - RNA, 22 nt, Human
cugguuuuccaauguuuugacu

SEQ ID NO: 1105787 - RNA, 22 nt, Human
auuaauaucccccgccguucug

SEQ ID NO: 1105788 - RNA, 22 nt, Human
acugagcaggguuccgcaugga

SEQ ID NO: 1105789 - RNA, 22 nt, Human
gugggugucaguaucuuuaacg

SEQ ID NO: 1105790 - RNA, 22 nt, Human
gcauucuugguggagugcuaaa

SEQ ID NO: 1105791 - RNA, 22 nt, Human
uuccuucuucauuguguuacag

SEQ ID NO: 1105792 - RNA, 21 nt, Human
acaguacuugagaucuuuuga

SEQ ID NO: 1105793 - RNA, 18 nt, Human
gacaaaaguacagacaga

SEQ ID NO: 1105794 - RNA, 22 nt, Human
uuuacagagaauguacauaaag

SEQ ID NO: 1105795 - RNA, 22 nt, Human
cuuguuuucuucugcagucuau

SEQ ID NO: 1105796 - RNA, 22 nt, Human
uguuuuaagggucaacugucac

SEQ ID NO: 1105797 - RNA, 22 nt, Human
uaaaugaaaggguuuaauuuau

SEQ ID NO: 1105798 - RNA, 22 nt, Human
gucucuaucauagcugaacccu

SEQ ID NO: 1105799 - RNA, 23 nt, Human
caaaaugcuaugugcccaaugca

SEQ ID NO: 1105800 - RNA, 22 nt, Human
auuuccuauacaguuguccaua

SEQ ID NO: 1105801 - RNA, 22 nt, Human
uuaccacagugccugucuaaug

SEQ ID NO: 1105802 - RNA, 22 nt, Human
gcaaggaagcagaguugcuauc

SEQ ID NO: 1105803 - RNA, 22 nt, Human
cauaacauccuugcuacuuuga

SEQ ID NO: 1105804 - RNA, 18 nt, Human
ucaguccuccauagagcu

SEQ ID NO: 1105805 - RNA, 22 nt, Human
aaaaugcucaucagcgauggcu

SEQ ID NO: 1105806 - RNA, 22 nt, Human
cauuguguauuucuguaguacu

SEQ ID NO: 1105807 - RNA, 22 nt, Human
cugcaucaguggauaugauggu

SEQ ID NO: 1105808 - RNA, 22 nt, Human
uccuuagagugguugugcuaug

SEQ ID NO: 1105809 - RNA, 22 nt, Human
aaauugcuugagauuagucucc

SEQ ID NO: 1105810 - RNA, 22 nt, Human
ccucuaaauuguuugaaguugg

SEQ ID NO: 1105811 - RNA, 22 nt, Human
aguucaugugguuuaacuuaau

SEQ ID NO: 1105812 - RNA, 22 nt, Human
gcuuucuuuucaagaauguauu

SEQ ID NO: 1105813 - RNA, 22 nt, Human
agauguuuauaacucaugagug

SEQ ID NO: 1105814 - RNA, 22 nt, Human
acaauuucuaauauagaucuua

SEQ ID NO: 1105815 - RNA, 22 nt, Human
guuaaaugcagauucugacuca

SEQ ID NO: 1105816 - RNA, 22 nt, Human
uaacacauagauauuuuaacuu

SEQ ID NO: 1105817 - RNA, 22 nt, Human
agugaaauaugcccauugcugu

SEQ ID NO: 1105818 - RNA, 22 nt, Human
gaugaaggggcuggugcccucu

SEQ ID NO: 1105819 - RNA, 22 nt, Human
auucuugauauagauaguuaau

SEQ ID NO: 1105820 - RNA, 22 nt, Human
uuuaaaccuaucuaagaaauag

SEQ ID NO: 1105821 - RNA, 22 nt, Human
uacuacauacagaauuuagaga

SEQ ID NO: 1105822 - RNA, 22 nt, Human
auacagaagaccccuccgucau

SEQ ID NO: 1105823 - RNA, 22 nt, Human
uaaaguuuauuggcaccaccau

SEQ ID NO: 1105824 - RNA, 22 nt, Human
cucuggaucugcccugacgcca

SEQ ID NO: 1105825 - RNA, 22 nt, Human
uuuacaaggcaguuauuuuccu

SEQ ID NO: 1105826 - RNA, 22 nt, Human
uggaaauaguugugagucaggc

SEQ ID NO: 1105827 - RNA, 22 nt, Human
gcugaaguugccuauuuuaaua

SEQ ID NO: 1105828 - RNA, 22 nt, Human
ugacucauauuucauggauacg

SEQ ID NO: 1105829 - RNA, 22 nt, Human
ugcuugacuuaguuucucauuu

SEQ ID NO: 1105830 - RNA, 22 nt, Human
uaguggauguucagagauuuga

SEQ ID NO: 1105831 - RNA, 19 nt, Human
uuacaugacauaugaagga

SEQ ID NO: 1105832 - RNA, 18 nt, Human
uauaaacacacuuagguu

SEQ ID NO: 1105833 - RNA, 22 nt, Human
cugguuaauccauaaacagaga

SEQ ID NO: 1105834 - RNA, 22 nt, Human
cuaguucugccauucaguguca

SEQ ID NO: 1105835 - RNA, 22 nt, Human
uccuuggcaugccgucuucucc

SEQ ID NO: 1105836 - RNA, 22 nt, Human
gaugucuucagauggcaagaga

SEQ ID NO: 1105837 - RNA, 22 nt, Human
aaaucaugguggaagaaacaga

SEQ ID NO: 1105838 - RNA, 22 nt, Human
cgauuuccgcuugaucugaucu

SEQ ID NO: 1105839 - RNA, 22 nt, Human
auguaugagagauucuuuuauu

SEQ ID NO: 1105840 - RNA, 22 nt, Human
uucguuuaguccacaaaugcau

SEQ ID NO: 1105841 - RNA, 22 nt, Human
auacuucuuuagcauauugaac

SEQ ID NO: 1105842 - RNA, 22 nt, Human
ugugagacguaggccaucgagg

SEQ ID NO: 1105843 - RNA, 22 nt, Human
caugucacaauucuuaauggga

SEQ ID NO: 1105844 - RNA, 19 nt, Human
uaugaaguugauaaaaguu

SEQ ID NO: 1105845 - RNA, 22 nt, Human
auugaagacuugguauccgugg

SEQ ID NO: 1105846 - RNA, 22 nt, Human
uuuaaacuaacaguacacguug

SEQ ID NO: 1105847 - RNA, 22 nt, Human
acaugcauaaacuacuucuuau

SEQ ID NO: 1105848 - RNA, 22 nt, Human
acaaacuucccagacaagcucc

SEQ ID NO: 1105849 - RNA, 22 nt, Human
auggcauuugaaucugucuuuu

SEQ ID NO: 1105850 - RNA, 22 nt, Human
agcaauguuggccuauauaccu

SEQ ID NO: 1105851 - RNA, 20 nt, Human
acagagauccucucuuuauc

SEQ ID NO: 1105852 - RNA, 22 nt, Human
uacuuucuagcucuccccaguu

SEQ ID NO: 1105853 - RNA, 22 nt, Human
gaaaauaguucaucacaaugau

SEQ ID NO: 1105854 - RNA, 22 nt, Human
agcuauggguguggguuccauu

SEQ ID NO: 1105855 - RNA, 22 nt, Human
aaagucuuaauguaaguuuagu

SEQ ID NO: 1105856 - RNA, 22 nt, Human
guuuugaauacuacuagaacuu

SEQ ID NO: 1105857 - RNA, 22 nt, Human
uauagugucucuagaucaaaga

SEQ ID NO: 1105858 - RNA, 22 nt, Human
uuguacacacaggaacaaacgu

SEQ ID NO: 1105859 - RNA, 22 nt, Human
cugugaauguuauaucucaaug

SEQ ID NO: 1105860 - RNA, 22 nt, Human
uucugauuguuggaggaugcuu

SEQ ID NO: 1105861 - RNA, 22 nt, Human
ucgucugugaaauugggauaag

SEQ ID NO: 1105862 - RNA, 22 nt, Human
ucguuauagaacauucuugggu

SEQ ID NO: 1105863 - RNA, 22 nt, Human
uuuccagucucugccuccaagg

SEQ ID NO: 1105864 - RNA, 22 nt, Human
aagaaaagguaaccgcuuaucu

SEQ ID NO: 1105865 - RNA, 22 nt, Human
acuggaaaguauucuuucacug

SEQ ID NO: 1105866 - RNA, 22 nt, Human
gucauuuuugacuuugaaguga

SEQ ID NO: 1105867 - RNA, 22 nt, Human
ucccagaacccugccagguccu

SEQ ID NO: 1105868 - RNA, 22 nt, Human
cuucuccgacaaccgacgccgg

SEQ ID NO: 1105869 - RNA, 22 nt, Human
uagcauuuagaacaccuugaga

SEQ ID NO: 1105870 - RNA, 22 nt, Human
uuaaguauauccauuugacugg

SEQ ID NO: 1105871 - RNA, 22 nt, Human
cuaaauguuuuaucuuccuggc

SEQ ID NO: 1105872 - RNA, 23 nt, Human
gggcagcuuaagcuuguuuuucu

SEQ ID NO: 1105873 - RNA, 22 nt, Human
ucacacuuuauuuauuucaugc

SEQ ID NO: 1105874 - RNA, 22 nt, Human
guuucuccucugugucuuguuu

SEQ ID NO: 1105875 - RNA, 22 nt, Human
cuguauaugugcauacacacac

SEQ ID NO: 1105876 - RNA, 22 nt, Human
gcauuuaaauuugaacuucaga

SEQ ID NO: 1105877 - RNA, 22 nt, Human
acaggaaaugaaaugguaucua

SEQ ID NO: 1105878 - RNA, 17 nt, Human
gcaggcacugcugccug

SEQ ID NO: 1105879 - RNA, 22 nt, Human
augaauaaaacauuuuaaucag

SEQ ID NO: 1105880 - RNA, 22 nt, Human
gacauuuauuggauuuuacgag

SEQ ID NO: 1105881 - RNA, 22 nt, Human
acagaagugacaauuucuuggg

SEQ ID NO: 1105882 - RNA, 19 nt, Human
aaauccaagcucaggccuc

SEQ ID NO: 1105883 - RNA, 22 nt, Human
ucacuaugcccagaauacaguu

SEQ ID NO: 1105884 - RNA, 22 nt, Human
caguauuucauucagaauuguu

SEQ ID NO: 1105885 - RNA, 22 nt, Human
uagcuguucucuguaaauugga

SEQ ID NO: 1105886 - RNA, 22 nt, Human
gagaauacaaccagaagcugag

SEQ ID NO: 1105887 - RNA, 22 nt, Human
auuuuagagaaacaaacguagg

SEQ ID NO: 1105888 - RNA, 19 nt, Human
cugaaacacagagagggcu

SEQ ID NO: 1105889 - RNA, 22 nt, Human
cauugcuuugugcauauuuaaa

SEQ ID NO: 1105890 - RNA, 22 nt, Human
auacuaagcucauuacauuuug

SEQ ID NO: 1105891 - RNA, 22 nt, Human
acagcuucgaggaucucauccc

SEQ ID NO: 1105892 - RNA, 22 nt, Human
accaguuaaagaauaugaggcc

SEQ ID NO: 1105893 - RNA, 22 nt, Human
uuuuuugucuugaagaaauggu

SEQ ID NO: 1105894 - RNA, 22 nt, Human
caaacuuacuguguuuaaagag

SEQ ID NO: 1105895 - RNA, 22 nt, Human
cauggaaggcaaaagacacaga

SEQ ID NO: 1105896 - RNA, 22 nt, Human
cagaugaggcaaccucauugcu

SEQ ID NO: 1105897 - RNA, 22 nt, Human
uccaaggacauuguucuaguug

SEQ ID NO: 1105898 - RNA, 22 nt, Human
auuucagaguagaucguuauuu

SEQ ID NO: 1105899 - RNA, 22 nt, Human
acuggauucucuuacacagaug

SEQ ID NO: 1105900 - RNA, 22 nt, Human
acaucucacuucuuugaaggcu

SEQ ID NO: 1105901 - RNA, 22 nt, Human
uuugacaggaauucucucuagg

SEQ ID NO: 1105902 - RNA, 22 nt, Human
uggaaacacccacgcaugcaua

SEQ ID NO: 1105903 - RNA, 22 nt, Human
uaaccaagcaaacuuucauugu

SEQ ID NO: 1105904 - RNA, 22 nt, Human
gauauucauaggcagguauuua

SEQ ID NO: 1105905 - RNA, 22 nt, Human
uugagauagguggaaucucuuu

SEQ ID NO: 1105906 - RNA, 22 nt, Human
ucuaugaaccucugcaaugaca

SEQ ID NO: 1105907 - RNA, 22 nt, Human
ccuuugugaauaugcagaaaau

SEQ ID NO: 1105908 - RNA, 22 nt, Human
gcuguauuuauaugaaggcaug

SEQ ID NO: 1105909 - RNA, 22 nt, Human
cuacauuauguuuauugggacu

SEQ ID NO: 1105910 - RNA, 22 nt, Human
auuucauccauuaagaguacuc

SEQ ID NO: 1105911 - RNA, 22 nt, Human
uuggaauuugagaccaagaaaa

SEQ ID NO: 1105912 - RNA, 22 nt, Human
uuauuuaaaagugguaagauuc

SEQ ID NO: 1105913 - RNA, 19 nt, Human
ucuuucauuucuagcucug

SEQ ID NO: 1105914 - RNA, 21 nt, Human
gucuuuuuaauugcgauuucc

SEQ ID NO: 1105915 - RNA, 20 nt, Human
uccuaacgaggcccauugca

SEQ ID NO: 1105916 - RNA, 22 nt, Human
aucagaagaaauggaugugacu

SEQ ID NO: 1105917 - RNA, 22 nt, Human
uucagucuuguugaaaacuugg

SEQ ID NO: 1105918 - RNA, 22 nt, Human
uaucauuuuacugugacauuuu

SEQ ID NO: 1105919 - RNA, 22 nt, Human
uucacauaaucugcagcaagcg

SEQ ID NO: 1105920 - RNA, 22 nt, Human
agauguuuuuccaggucuaauu

SEQ ID NO: 1105921 - RNA, 22 nt, Human
uuguacuuaaauaugcaaauag

SEQ ID NO: 1105922 - RNA, 17 nt, Human
ucugagaaugcuggagg

SEQ ID NO: 1105923 - RNA, 22 nt, Human
augguuuuguccucuuugguuc

SEQ ID NO: 1105924 - RNA, 19 nt, Human
uuuaaugugugcugcaauc

SEQ ID NO: 1105925 - RNA, 22 nt, Human
caacauuucaaggucuuuagga

SEQ ID NO: 1105926 - RNA, 22 nt, Human
uaaaucccuacaucuguguuuu

SEQ ID NO: 1105927 - RNA, 22 nt, Human
cuuuaguucuagaaagugaaac

SEQ ID NO: 1105928 - RNA, 22 nt, Human
uaacauuucggugacaguggga

SEQ ID NO: 1105929 - RNA, 22 nt, Human
augcacaagguagauuauuauu

SEQ ID NO: 1105930 - RNA, 22 nt, Human
uuugcaaaguccauugaaguua

SEQ ID NO: 1105931 - RNA, 22 nt, Human
cuuucuuucgaagacgugauua

SEQ ID NO: 1105932 - RNA, 22 nt, Human
auucuagaguuucaauccaagg

SEQ ID NO: 1105933 - RNA, 22 nt, Human
aguguucuagcgcugugcuugu

SEQ ID NO: 1105934 - RNA, 22 nt, Human
ucuccauggauuuggaaaugau

SEQ ID NO: 1105935 - RNA, 22 nt, Human
ucuuuuaucuguuguguaacaa

SEQ ID NO: 1105936 - RNA, 22 nt, Human
cugucuacagaugaaauaagca

SEQ ID NO: 1105937 - RNA, 22 nt, Human
ggauguggaccuugccugguga

SEQ ID NO: 1105938 - RNA, 22 nt, Human
uguuaguauuggcaaauuuguu

SEQ ID NO: 1105939 - RNA, 22 nt, Human
gugcauauguguguauacaaac

SEQ ID NO: 1105940 - RNA, 20 nt, Human
caauaauuuacuucccuauu

SEQ ID NO: 1105941 - RNA, 22 nt, Human
uaugcuagauggaaaaauauug

SEQ ID NO: 1105942 - RNA, 22 nt, Human
cuuugcuaauguugcauuuuca

SEQ ID NO: 1105943 - RNA, 22 nt, Human
cuacuguaguuaaaguuuugua

SEQ ID NO: 1105944 - RNA, 22 nt, Human
uuggcaauauuuacugaaguug

SEQ ID NO: 1105945 - RNA, 22 nt, Human
auuguacagacaugggaaacaa

SEQ ID NO: 1105946 - RNA, 17 nt, Human
acuuguauugugcuuua

SEQ ID NO: 1105947 - RNA, 22 nt, Human
ccuuugagccugggcgcggacc

SEQ ID NO: 1105948 - RNA, 22 nt, Human
caugaaaugauauuuggguggg

SEQ ID NO: 1105949 - RNA, 22 nt, Human
cacauuuaugggcugggaggca

SEQ ID NO: 1105950 - RNA, 22 nt, Human
agauuauuuaagacaggaacca

SEQ ID NO: 1105951 - RNA, 22 nt, Human
guugaaauccuaacccccuagu

SEQ ID NO: 1105952 - RNA, 22 nt, Human
auaguagcgagaucucagcuca

SEQ ID NO: 1105953 - RNA, 22 nt, Human
acucucagggcuccagggaaag

SEQ ID NO: 1105954 - RNA, 18 nt, Human
acccauuauauuuguagc

SEQ ID NO: 1105955 - RNA, 22 nt, Human
aaaugcaugugcuauagaugug

SEQ ID NO: 1105956 - RNA, 22 nt, Human
cacaguuuugucuugguuucca

SEQ ID NO: 1105957 - RNA, 22 nt, Human
aaugaguuuguucuauuauuug

SEQ ID NO: 1105958 - RNA, 22 nt, Human
uaugaaggauacaccucugauu

SEQ ID NO: 1105959 - RNA, 22 nt, Human
ugaauaaucuuggguauuaaua

SEQ ID NO: 1105960 - RNA, 22 nt, Human
aaugaacacuuagccuuucuau

SEQ ID NO: 1105961 - RNA, 22 nt, Human
cuagagaaaaagcuuagguacg

SEQ ID NO: 1105962 - RNA, 22 nt, Human
ugcaucuaaguggcuaacaacc

SEQ ID NO: 1105963 - RNA, 22 nt, Human
caauuuuuaaacuaugaaguug

SEQ ID NO: 1105964 - RNA, 18 nt, Human
cgcauguacacgucaugc

SEQ ID NO: 1105965 - RNA, 22 nt, Human
uuugacaugugcuuauaacuuu

SEQ ID NO: 1105966 - RNA, 21 nt, Human
ccacaauucuaguuacauaug

SEQ ID NO: 1105967 - RNA, 22 nt, Human
uugggauacaucuugcugagcc

SEQ ID NO: 1105968 - RNA, 22 nt, Human
caguaaauguccucgcagggaa

SEQ ID NO: 1105969 - RNA, 22 nt, Human
gccagagaggccuuagaaucca

SEQ ID NO: 1105970 - RNA, 22 nt, Human
uaucuguagucucaugguuccu

SEQ ID NO: 1105971 - RNA, 22 nt, Human
acagcugugggcucugcauaua

SEQ ID NO: 1105972 - RNA, 22 nt, Human
agugaauuagccuauuuguaaa

SEQ ID NO: 1105973 - RNA, 22 nt, Human
auuuagacaacaagccuucucc

SEQ ID NO: 1105974 - RNA, 22 nt, Human
ucauuacuuauuaaaagccuug

SEQ ID NO: 1105975 - RNA, 22 nt, Human
gugauuucagguuuuucauacu

SEQ ID NO: 1105976 - RNA, 22 nt, Human
uguuaccauaggucagaacguu

SEQ ID NO: 1105977 - RNA, 23 nt, Human
uaucauuucagcucucugccugg

SEQ ID NO: 1105978 - RNA, 22 nt, Human
guauuaugaaugccgaggcggc

SEQ ID NO: 1105979 - RNA, 22 nt, Human
gacauacagcccucucccuggu

SEQ ID NO: 1105980 - RNA, 22 nt, Human
agaauaaccaguguuucacagu

SEQ ID NO: 1105981 - RNA, 22 nt, Human
agucuauuuuugguucuucggg

SEQ ID NO: 1105982 - RNA, 22 nt, Human
uuuggauugcuuggaugcuucg

SEQ ID NO: 1105983 - RNA, 22 nt, Human
acuaauugaaaugagacuggug

SEQ ID NO: 1105984 - RNA, 22 nt, Human
gaugucuggcuaccacucgcac

SEQ ID NO: 1105985 - RNA, 22 nt, Human
acaagauagcuuagaagauuca

SEQ ID NO: 1105986 - RNA, 22 nt, Human
agagauuccuuuggggaaagca

SEQ ID NO: 1105987 - RNA, 22 nt, Human
guuucuuauuucaacuggaaca

SEQ ID NO: 1105988 - RNA, 22 nt, Human
guggcauugccuucugcaggaa

SEQ ID NO: 1105989 - RNA, 22 nt, Human
uaaagcauguuucaguaagguu

SEQ ID NO: 1105990 - RNA, 22 nt, Human
uucauuacauucaaaaggcauu

SEQ ID NO: 1105991 - RNA, 22 nt, Human
cucaucuggcuucaguaacagu

SEQ ID NO: 1105992 - RNA, 22 nt, Human
ugucauauagaauguucuauga

SEQ ID NO: 1105993 - RNA, 22 nt, Human
auugacuuucccuucuccucau

SEQ ID NO: 1105994 - RNA, 22 nt, Human
uuuccaaagguggcaggaacaa

SEQ ID NO: 1105995 - RNA, 22 nt, Human
aaagcuauuuuauugcagcucu

SEQ ID NO: 1105996 - RNA, 22 nt, Human
cugugcuggcagaccuggaguu

SEQ ID NO: 1105997 - RNA, 22 nt, Human
aggcagagaaaaaccagauaug

SEQ ID NO: 1105998 - RNA, 22 nt, Human
guuuccagccuccuggguaaag

SEQ ID NO: 1105999 - RNA, 22 nt, Human
cuauucaguugugggcaacaau

SEQ ID NO: 1106000 - RNA, 22 nt, Human
aauucauacucuauauugcuuu

SEQ ID NO: 1106001 - RNA, 22 nt, Human
acagugauuggcacugauucag

SEQ ID NO: 1106002 - RNA, 22 nt, Human
gaaccuggcagcccuauaucug

SEQ ID NO: 1106003 - RNA, 22 nt, Human
uugaagcauuugcuauagcauu

SEQ ID NO: 1106004 - RNA, 22 nt, Human
agacugugagaagauggcugcg

SEQ ID NO: 1106005 - RNA, 22 nt, Human
auuaguguuguggcuucauggc

SEQ ID NO: 1106006 - RNA, 22 nt, Human
cacuuuuaacaggagaauuccc

SEQ ID NO: 1106007 - RNA, 22 nt, Human
uagaggaugauccuuccuugcc

SEQ ID NO: 1106008 - RNA, 22 nt, Human
aauacagauggcaugugaagau

SEQ ID NO: 1106009 - RNA, 22 nt, Human
uacugucuuuuccuaaaugggu

SEQ ID NO: 1106010 - RNA, 22 nt, Human
aucaucaucuaaauugugucgc

SEQ ID NO: 1106011 - RNA, 22 nt, Human
caucccugauuccuaguacagu

SEQ ID NO: 1106012 - RNA, 22 nt, Human
uucagaaaggcugugccagcca

SEQ ID NO: 1106013 - RNA, 22 nt, Human
cgcuuuggagucccugcuuuac

SEQ ID NO: 1106014 - RNA, 22 nt, Human
aacacuaaaggucaguuagaag

SEQ ID NO: 1106015 - RNA, 20 nt, Human
gacuucaauuucuaucuuuu

SEQ ID NO: 1106016 - RNA, 22 nt, Human
aacagaaugcaggggaugcugc

SEQ ID NO: 1106017 - RNA, 22 nt, Human
ggacuggucugagagggauuca

SEQ ID NO: 1106018 - RNA, 22 nt, Human
guuguuuuugaacggugguggc

SEQ ID NO: 1106019 - RNA, 20 nt, Human
ugugguuuuugccaguugaa

SEQ ID NO: 1106020 - RNA, 22 nt, Human
ugaaagaagccucccuuuggag

SEQ ID NO: 1106021 - RNA, 22 nt, Human
gucuguggaguugcuugcugga

SEQ ID NO: 1106022 - RNA, 22 nt, Human
ccagcagccaccuucucgaaau

SEQ ID NO: 1106023 - RNA, 22 nt, Human
cauugcugugggcauuugcugc

SEQ ID NO: 1106024 - RNA, 22 nt, Human
gcuuccuucuaccacaucaugc

SEQ ID NO: 1106025 - RNA, 22 nt, Human
acucacagggccucaguuuucc

SEQ ID NO: 1106026 - RNA, 22 nt, Human
uuccaaggcugcuauuuguuuc

SEQ ID NO: 1106027 - RNA, 22 nt, Human
augaauuguccgauguugugca

SEQ ID NO: 1106028 - RNA, 22 nt, Human
auguauacgugcaggucacagg

SEQ ID NO: 1106029 - RNA, 22 nt, Human
ccauuuguaccauuucuuugua

SEQ ID NO: 1106030 - RNA, 22 nt, Human
augauacaccuaggagugggag

SEQ ID NO: 1106031 - RNA, 22 nt, Human
uuuucuaacaucuaguaauuug

SEQ ID NO: 1106032 - RNA, 22 nt, Human
auuccaaagccugaauaaugga

SEQ ID NO: 1106033 - RNA, 22 nt, Human
uaaaguauaagcauuggaguau

SEQ ID NO: 1106034 - RNA, 22 nt, Human
ucuccucuauuucuguauguau

SEQ ID NO: 1106035 - RNA, 23 nt, Human
auuuccuaaaagauaaucauuac

SEQ ID NO: 1106036 - RNA, 22 nt, Human
uuauuuuguagcucugaucuuu

SEQ ID NO: 1106037 - RNA, 17 nt, Human
ucugagaacuugaagca

SEQ ID NO: 1106038 - RNA, 19 nt, Human
uuugauagggcauaauaua

SEQ ID NO: 1106039 - RNA, 22 nt, Human
acuguagucuaaauauagucuu

SEQ ID NO: 1106040 - RNA, 22 nt, Human
auauaaguguguggcuguuagu

SEQ ID NO: 1106041 - RNA, 22 nt, Human
augugauacuccuucuagugga

SEQ ID NO: 1106042 - RNA, 22 nt, Human
cuucucaaaguugugaaucagg

SEQ ID NO: 1106043 - RNA, 23 nt, Human
ugcaaaauuugcagaguucgaug

SEQ ID NO: 1106044 - RNA, 20 nt, Human
uguauuuaaugaaggcuuuu

SEQ ID NO: 1106045 - RNA, 22 nt, Human
uaucaguagaacaauggacauu

SEQ ID NO: 1106046 - RNA, 22 nt, Human
gacaagaugacaucauggcuuc

SEQ ID NO: 1106047 - RNA, 22 nt, Human
caaauguuugguggcauuuugu

SEQ ID NO: 1106048 - RNA, 22 nt, Human
uuuucaguuccaucucugcucu

SEQ ID NO: 1106049 - RNA, 22 nt, Human
uccugagauaggaguugaaggc

SEQ ID NO: 1106050 - RNA, 22 nt, Human
gaaagagaaccugggccuagau

SEQ ID NO: 1106051 - RNA, 22 nt, Human
guaaaucagugucauuuuagaa

SEQ ID NO: 1106052 - RNA, 22 nt, Human
gaaguucugguguaugugauaa

SEQ ID NO: 1106053 - RNA, 17 nt, Human
auucaugaacauguccu

SEQ ID NO: 1106054 - RNA, 22 nt, Human
auuacugaggcaaaguaguuuu

SEQ ID NO: 1106055 - RNA, 22 nt, Human
auacaugacucacacauucugc

SEQ ID NO: 1106056 - RNA, 22 nt, Human
gucaucaucaggcagaugcugc

SEQ ID NO: 1106057 - RNA, 22 nt, Human
uuuaauuauaucugggcaguua

SEQ ID NO: 1106058 - RNA, 22 nt, Human
cuuuacagauggauaauuguuu

SEQ ID NO: 1106059 - RNA, 22 nt, Human
auccauuugccgugcuaugugc

SEQ ID NO: 1106060 - RNA, 22 nt, Human
auuguacucuagccucugggca

SEQ ID NO: 1106061 - RNA, 19 nt, Human
uaugacaaguacuaguucu

SEQ ID NO: 1106062 - RNA, 22 nt, Human
acaaucagcacugaguuuaucu

SEQ ID NO: 1106063 - RNA, 22 nt, Human
augcauaucuccuaucuccuca

SEQ ID NO: 1106064 - RNA, 22 nt, Human
aaguuacacauuuucauuguaa

SEQ ID NO: 1106065 - RNA, 22 nt, Human
cugaggaucuaauuauuggguc

SEQ ID NO: 1106066 - RNA, 22 nt, Human
uuugagaaacagacgaaagaca

SEQ ID NO: 1106067 - RNA, 22 nt, Human
caguggaugucucauaguguga

SEQ ID NO: 1106068 - RNA, 21 nt, Human
uuggaacaagcagcaguuugc

SEQ ID NO: 1106069 - RNA, 22 nt, Human
ugugucuuuggcgaugucugga

SEQ ID NO: 1106070 - RNA, 22 nt, Human
uauaagaaacaaggcaaauuuu

SEQ ID NO: 1106071 - RNA, 22 nt, Human
agauaucuuacacuuugaaguu

SEQ ID NO: 1106072 - RNA, 22 nt, Human
cuucagagugacucagcaucuu

SEQ ID NO: 1106073 - RNA, 22 nt, Human
auaaugacauucuuagacugga

SEQ ID NO: 1106074 - RNA, 22 nt, Human
uuccuuuucuucuaccacaugu

SEQ ID NO: 1106075 - RNA, 22 nt, Human
uggaaauacaagaaguauguca

SEQ ID NO: 1106076 - RNA, 22 nt, Human
guuugagauggguuauugcucu

SEQ ID NO: 1106077 - RNA, 22 nt, Human
ugugugcacaaagaguacaugg

SEQ ID NO: 1106078 - RNA, 22 nt, Human
ucuauuaaugauucaauagugu

SEQ ID NO: 1106079 - RNA, 22 nt, Human
uaaauacuuuuacuccacugau

SEQ ID NO: 1106080 - RNA, 22 nt, Human
gaaggcaagcagcauaaauguc

SEQ ID NO: 1106081 - RNA, 18 nt, Human
cgauguguaugugauuug

SEQ ID NO: 1106082 - RNA, 22 nt, Human
ugucuucauuccccaugaaguc

SEQ ID NO: 1106083 - RNA, 22 nt, Human
uucuacauugugaaguucuuua

SEQ ID NO: 1106084 - RNA, 21 nt, Human
agcauucaaaagaugccauaa

SEQ ID NO: 1106085 - RNA, 22 nt, Human
ugaaauguggagaugguaagua

SEQ ID NO: 1106086 - RNA, 19 nt, Human
aucaggcuucuauuuucuc

SEQ ID NO: 1106087 - RNA, 22 nt, Human
augaucaagaauuuuguauucc

SEQ ID NO: 1106088 - RNA, 22 nt, Human
aacugcuaacugguuugauacu

SEQ ID NO: 1106089 - RNA, 22 nt, Human
ucccaaguagaugggaauacag

SEQ ID NO: 1106090 - RNA, 22 nt, Human
uguauuucugcuuucucuagua

SEQ ID NO: 1106091 - RNA, 22 nt, Human
caguuuuucaaaauuacaugau

SEQ ID NO: 1106092 - RNA, 22 nt, Human
agggcagagauuaauuaagaca

SEQ ID NO: 1106093 - RNA, 22 nt, Human
uuugccaguauuuuauugauga

SEQ ID NO: 1106094 - RNA, 22 nt, Human
uuacacaacaucuguauuauua

SEQ ID NO: 1106095 - RNA, 22 nt, Human
acucaucuuugaauuuucagua

SEQ ID NO: 1106096 - RNA, 18 nt, Human
gcugaaauucuaaacaaa

SEQ ID NO: 1106097 - RNA, 20 nt, Human
ucuuuuauuggcagauccug

SEQ ID NO: 1106098 - RNA, 22 nt, Human
uuguuuguaaggcucuuagaau

SEQ ID NO: 1106099 - RNA, 22 nt, Human
ugugaagaauuaaugugaauca

SEQ ID NO: 1106100 - RNA, 22 nt, Human
uagauuaucccugauuugucca

SEQ ID NO: 1106101 - RNA, 22 nt, Human
aauuauguuugcuuuagaugga

SEQ ID NO: 1106102 - RNA, 21 nt, Human
aucuuaaaaggucuuaacuuu

SEQ ID NO: 1106103 - RNA, 22 nt, Human
uuauguauggauggcugaaagu

SEQ ID NO: 1106104 - RNA, 22 nt, Human
caguauuuaggauuaggagaga

SEQ ID NO: 1106105 - RNA, 22 nt, Human
uuaguuuccuguggugugaagu

SEQ ID NO: 1106106 - RNA, 22 nt, Human
cuaguauuaagugugaguaaaa

SEQ ID NO: 1106107 - RNA, 18 nt, Human
ucagaggagauaccuaaa

SEQ ID NO: 1106108 - RNA, 22 nt, Human
uaguauuuccuguaagcuauag

SEQ ID NO: 1106109 - RNA, 22 nt, Human
uaucuagagccuggaagucuug

SEQ ID NO: 1106110 - RNA, 22 nt, Human
ugcaucauuaagguacaguugg

SEQ ID NO: 1106111 - RNA, 22 nt, Human
aaaggagacuucagaucuccuu

SEQ ID NO: 1106112 - RNA, 22 nt, Human
aagggaaacuuucacaaugucc

SEQ ID NO: 1106113 - RNA, 22 nt, Human
aagcauuucagguagagauauu

SEQ ID NO: 1106114 - RNA, 22 nt, Human
cuugucuaguuccuggugaugu

SEQ ID NO: 1106115 - RNA, 22 nt, Human
caaacugaacacgaaagucuuu

SEQ ID NO: 1106116 - RNA, 22 nt, Human
uguucuuagguauuugacaguc

SEQ ID NO: 1106117 - RNA, 22 nt, Human
ccaccagaccaccaagagcaac

SEQ ID NO: 1106118 - RNA, 22 nt, Human
aggauugugccuccagucagaa

SEQ ID NO: 1106119 - RNA, 18 nt, Human
agcucacagaucuguuuu

SEQ ID NO: 1106120 - RNA, 22 nt, Human
aaguuauugguggagagcacug

SEQ ID NO: 1106121 - RNA, 22 nt, Human
ugauucaguacuuucucuaacu

SEQ ID NO: 1106122 - RNA, 20 nt, Human
acucuguagguaaugagacu

SEQ ID NO: 1106123 - RNA, 22 nt, Human
aaugguaauauuucauaguugu

SEQ ID NO: 1106124 - RNA, 22 nt, Human
agaauaagccugacgaaaccua

SEQ ID NO: 1106125 - RNA, 17 nt, Human
cauucuguaaucuuucu

SEQ ID NO: 1106126 - RNA, 22 nt, Human
caaaugaugcauggcuagugag

SEQ ID NO: 1106127 - RNA, 22 nt, Human
uaaugccuuucuguacuauaug

SEQ ID NO: 1106128 - RNA, 22 nt, Human
aacaugaugacauuguaagcuu

SEQ ID NO: 1106129 - RNA, 22 nt, Human
aaucugagggaacuugaacucc

SEQ ID NO: 1106130 - RNA, 22 nt, Human
augacuuaaucauacuugcauu

SEQ ID NO: 1106131 - RNA, 22 nt, Human
ugcauguuucuguauguuaaug

SEQ ID NO: 1106132 - RNA, 22 nt, Human
uagaaguuaaaggaauacagaa

SEQ ID NO: 1106133 - RNA, 22 nt, Human
uaagccugcaugaaccaugaga

SEQ ID NO: 1106134 - RNA, 22 nt, Human
aucauuugaacagaauuuguuu

SEQ ID NO: 1106135 - RNA, 22 nt, Human
cuacuucuguggcucuaagaga

SEQ ID NO: 1106136 - RNA, 21 nt, Human
acuguauuguuuucaaggauc

SEQ ID NO: 1106137 - RNA, 22 nt, Human
auuguauacaagcuuaauuguu

SEQ ID NO: 1106138 - RNA, 20 nt, Human
aaagauacuuuuuguaaugg

SEQ ID NO: 1106139 - RNA, 22 nt, Human
aucuaaagugucauaaguagcu

SEQ ID NO: 1106140 - RNA, 22 nt, Human
aucuuuggguacaaacuugccu

SEQ ID NO: 1106141 - RNA, 22 nt, Human
guuuauuggguauuguggagcc

SEQ ID NO: 1106142 - RNA, 22 nt, Human
aacuuucuuugcaucuaaguuu

SEQ ID NO: 1106143 - RNA, 21 nt, Human
uaaacauaaccuuguauggcu

SEQ ID NO: 1106144 - RNA, 22 nt, Human
accacaucgggcggacacuggg

SEQ ID NO: 1106145 - RNA, 22 nt, Human
uaagcuauuccugaagaagguu

SEQ ID NO: 1106146 - RNA, 22 nt, Human
guuuccaggcuuugguaugguu

SEQ ID NO: 1106147 - RNA, 22 nt, Human
aaugauguuuuuaaagaacaua

SEQ ID NO: 1106148 - RNA, 22 nt, Human
aauaaguacuuggggauaacuu

SEQ ID NO: 1106149 - RNA, 22 nt, Human
uucaguaagcacuucuagagcu

SEQ ID NO: 1106150 - RNA, 22 nt, Human
gcaguggccacauggaggagga

SEQ ID NO: 1106151 - RNA, 22 nt, Human
uacauguacaugcauagguaga

SEQ ID NO: 1106152 - RNA, 23 nt, Human
cguuuuuuccucagauguucugg

SEQ ID NO: 1106153 - RNA, 22 nt, Human
uuguaacaguagcugucagcuc

SEQ ID NO: 1106154 - RNA, 22 nt, Human
cauccauagauugagagauggu

SEQ ID NO: 1106155 - RNA, 22 nt, Human
ucuucaugucaugguauauuga

SEQ ID NO: 1106156 - RNA, 22 nt, Human
ucaauuuauguggcuauucauu

SEQ ID NO: 1106157 - RNA, 22 nt, Human
aaaguaauugugguucuugcca

SEQ ID NO: 1106158 - RNA, 22 nt, Human
auauauacuuugacacauucug

SEQ ID NO: 1106159 - RNA, 22 nt, Human
uagauacauacauuuuaaaaug

SEQ ID NO: 1106160 - RNA, 22 nt, Human
uggcuacauuuauacucucauu

SEQ ID NO: 1106161 - RNA, 22 nt, Human
caguuaaacagauugaguguua

SEQ ID NO: 1106162 - RNA, 22 nt, Human
gguuuguugggguccaggccca

SEQ ID NO: 1106163 - RNA, 22 nt, Human
cauuuuccucugcugguguuca

SEQ ID NO: 1106164 - RNA, 22 nt, Human
gaauacaaauaauaccaaggug

SEQ ID NO: 1106165 - RNA, 22 nt, Human
auuuacagacguggauuagugc

SEQ ID NO: 1106166 - RNA, 22 nt, Human
ucagagaaguaggcuaauggug

SEQ ID NO: 1106167 - RNA, 22 nt, Human
ucauugaggaaagguaguggcu

SEQ ID NO: 1106168 - RNA, 22 nt, Human
uauaaacuccucuugcauuccu

SEQ ID NO: 1106169 - RNA, 22 nt, Human
ugaagacaguuuuacucaugag

SEQ ID NO: 1106170 - RNA, 22 nt, Human
cugaucuuaaguaacauuauuu

SEQ ID NO: 1106171 - RNA, 22 nt, Human
uuauugcuaugaugauguguag

SEQ ID NO: 1106172 - RNA, 22 nt, Human
uugagacacaaggcacaguaag

SEQ ID NO: 1106173 - RNA, 22 nt, Human
ucugaaauuuuaguuauagaaa

SEQ ID NO: 1106174 - RNA, 22 nt, Human
auuuacugagguaaauaaacug

SEQ ID NO: 1106175 - RNA, 22 nt, Human
uauggcaagaugacauguucuc

SEQ ID NO: 1106176 - RNA, 22 nt, Human
gacuacaggugugugccaccau

SEQ ID NO: 1106177 - RNA, 22 nt, Human
uucauugauuuccuuggaauaa

SEQ ID NO: 1106178 - RNA, 22 nt, Human
auauggcuguugcacaucuaag

SEQ ID NO: 1106179 - RNA, 22 nt, Human
aaaugcacaauaaaguaaaggc

SEQ ID NO: 1106180 - RNA, 22 nt, Human
uuugaaauguaucaguauaggu

SEQ ID NO: 1106181 - RNA, 22 nt, Human
ucaaaaugccgagugcccaggu

SEQ ID NO: 1106182 - RNA, 22 nt, Human
uaguggguuuauacaauuuaaa

SEQ ID NO: 1106183 - RNA, 22 nt, Human
cauuuuacgacauagggcaggc

SEQ ID NO: 1106184 - RNA, 22 nt, Human
guaaagcaaaauguagagauug

SEQ ID NO: 1106185 - RNA, 22 nt, Human
aguaaaaucaccaucucuuugu

SEQ ID NO: 1106186 - RNA, 22 nt, Human
agaaacaucgcuuaguccucau

SEQ ID NO: 1106187 - RNA, 22 nt, Human
cuauuuucccauaugguugaca

SEQ ID NO: 1106188 - RNA, 22 nt, Human
uaauuuugucacagugacaugc

SEQ ID NO: 1106189 - RNA, 22 nt, Human
uuggaaaugcauuuguuauuau

SEQ ID NO: 1106190 - RNA, 22 nt, Human
aaagugacaaccauuuauuaag

SEQ ID NO: 1106191 - RNA, 22 nt, Human
gcuucccacagcuggacugggg

SEQ ID NO: 1106192 - RNA, 22 nt, Human
auuuuguaucuuacggggacua

SEQ ID NO: 1106193 - RNA, 22 nt, Human
uacauguuauuucacuauuggu

SEQ ID NO: 1106194 - RNA, 22 nt, Human
aguaucagaugugauuaaaggg

SEQ ID NO: 1106195 - RNA, 22 nt, Human
auuuacagccuugccaucuaua

SEQ ID NO: 1106196 - RNA, 21 nt, Human
agagacugucacugcaguacc

SEQ ID NO: 1106197 - RNA, 22 nt, Human
uucuuuuaauuucugucugcag

SEQ ID NO: 1106198 - RNA, 22 nt, Human
ucaaagaucagaugguuguagg

SEQ ID NO: 1106199 - RNA, 22 nt, Human
cuucuucagaggccagccucug

SEQ ID NO: 1106200 - RNA, 22 nt, Human
guaugugucuuagaacuuggga

SEQ ID NO: 1106201 - RNA, 22 nt, Human
cucagagagacaaugugggaca

SEQ ID NO: 1106202 - RNA, 22 nt, Human
ugagaacaaaguugaaaguuug

SEQ ID NO: 1106203 - RNA, 22 nt, Human
uugacguccucgauggggaacu

SEQ ID NO: 1106204 - RNA, 21 nt, Human
ugucagcaacaauacuuucuc

SEQ ID NO: 1106205 - RNA, 22 nt, Human
uagugucuuccaggacauggua

SEQ ID NO: 1106206 - RNA, 22 nt, Human
auguuuguguuucccauucagg

SEQ ID NO: 1106207 - RNA, 22 nt, Human
auacaggaugcugaacaucucu

SEQ ID NO: 1106208 - RNA, 22 nt, Human
gaguuugugggaauggaguauu

SEQ ID NO: 1106209 - RNA, 22 nt, Human
cgggcagugcccagcggggcag

SEQ ID NO: 1106210 - RNA, 22 nt, Human
uuugggcuguacaauuucugua

SEQ ID NO: 1106211 - RNA, 22 nt, Human
aacacaguuucugcauugguag

SEQ ID NO: 1106212 - RNA, 22 nt, Human
gaugaguucuuucuauucuauu

SEQ ID NO: 1106213 - RNA, 22 nt, Human
acauuuaaugauccuacuguga

SEQ ID NO: 1106214 - RNA, 22 nt, Human
aaguuugucucauuugaucuuc

SEQ ID NO: 1106215 - RNA, 22 nt, Human
acaguacucuaaugaaaagugc

SEQ ID NO: 1106216 - RNA, 22 nt, Human
ugaaucaaugaauugcacuuca

SEQ ID NO: 1106217 - RNA, 22 nt, Human
aaugugcugguaacugcuuugc

SEQ ID NO: 1106218 - RNA, 22 nt, Human
uucacguuguugaagaaaauac

SEQ ID NO: 1106219 - RNA, 22 nt, Human
caaagccaggcuuucuaaugua

SEQ ID NO: 1106220 - RNA, 22 nt, Human
uucuaagaaauggaaaacgauu

SEQ ID NO: 1106221 - RNA, 22 nt, Human
acauuguugagccucuuguuca

SEQ ID NO: 1106222 - RNA, 19 nt, Human
uccuugacuguauucagag

SEQ ID NO: 1106223 - RNA, 22 nt, Human
ugcaaauauuccaugcuguuca

SEQ ID NO: 1106224 - RNA, 22 nt, Human
aucauuuaguggggcauuggaa

SEQ ID NO: 1106225 - RNA, 22 nt, Human
agauuucaauggauauugcaag

SEQ ID NO: 1106226 - RNA, 22 nt, Human
acaaguuucauuguuuagaacc

SEQ ID NO: 1106227 - RNA, 22 nt, Human
guaauagucucaaacuccugga

SEQ ID NO: 1106228 - RNA, 22 nt, Human
ucugagagcuguagaagccuau

SEQ ID NO: 1106229 - RNA, 22 nt, Human
aaguuacaggagaaagagauca

SEQ ID NO: 1106230 - RNA, 22 nt, Human
ggagucugugucuugaagcagu

SEQ ID NO: 1106231 - RNA, 22 nt, Human
uaucuuaaaaaucgaagcagau

SEQ ID NO: 1106232 - RNA, 22 nt, Human
uucaaacacugcuuugagaggg

SEQ ID NO: 1106233 - RNA, 22 nt, Human
cagucucuugcuucauuaguug

SEQ ID NO: 1106234 - RNA, 22 nt, Human
ucucuuugacccuuuagcucca

SEQ ID NO: 1106235 - RNA, 22 nt, Human
ccaaaauauuagugcuuaagua

SEQ ID NO: 1106236 - RNA, 22 nt, Human
gauuuucauuauagcuaguuuc

SEQ ID NO: 1106237 - RNA, 22 nt, Human
gcauuacuucuuucauagguca

SEQ ID NO: 1106238 - RNA, 22 nt, Human
cauuuacauuuaagguuaauau

SEQ ID NO: 1106239 - RNA, 22 nt, Human
aaaugcacugaauauuccaaau

SEQ ID NO: 1106240 - RNA, 22 nt, Human
cccgaccucgcaaagcgcacuc

SEQ ID NO: 1106241 - RNA, 22 nt, Human
gcugauggcuugcuggcugaca

SEQ ID NO: 1106242 - RNA, 22 nt, Human
uuccaggacuggguguuugaag

SEQ ID NO: 1106243 - RNA, 22 nt, Human
cagaaacacuguauuuagggaa

SEQ ID NO: 1106244 - RNA, 22 nt, Human
ggaaguuuguauacuggccucu

SEQ ID NO: 1106245 - RNA, 23 nt, Human
acucguggaauucucugcgaucg

SEQ ID NO: 1106246 - RNA, 22 nt, Human
cuaagaaggaggaaaagugcca

SEQ ID NO: 1106247 - RNA, 22 nt, Human
uguauauacacacucccauguu

SEQ ID NO: 1106248 - RNA, 22 nt, Human
ccaaacauuucaaauuuagaga

SEQ ID NO: 1106249 - RNA, 22 nt, Human
uuuuccuuaacagagggagaaa

SEQ ID NO: 1106250 - RNA, 22 nt, Human
gaguaaaagaugaggcaguaga

SEQ ID NO: 1106251 - RNA, 22 nt, Human
acuucagugugguauaaaacgu

SEQ ID NO: 1106252 - RNA, 22 nt, Human
aaagacuaaccaguugucaaaa

SEQ ID NO: 1106253 - RNA, 22 nt, Human
cauuuugugcuagacacuaugg

SEQ ID NO: 1106254 - RNA, 22 nt, Human
ugguaugcuuauuaucuucaac

SEQ ID NO: 1106255 - RNA, 22 nt, Human
agagaauuaacauuccauggcu

SEQ ID NO: 1106256 - RNA, 22 nt, Human
uucaguaugcugaaugauuuuu

SEQ ID NO: 1106257 - RNA, 22 nt, Human
aagcauuuuagauaaagcauca

SEQ ID NO: 1106258 - RNA, 22 nt, Human
guuauguaaucuaacacucagu

SEQ ID NO: 1106259 - RNA, 22 nt, Human
acaguucuguccuagacuucgu

SEQ ID NO: 1106260 - RNA, 22 nt, Human
guuuccuuuuggaauuagagcu

SEQ ID NO: 1106261 - RNA, 22 nt, Human
uggaauuaucugaagugauuug

SEQ ID NO: 1106262 - RNA, 22 nt, Human
acucauuugcaugaugugcuau

SEQ ID NO: 1106263 - RNA, 22 nt, Human
ugucauuggugaucugaugccu

SEQ ID NO: 1106264 - RNA, 23 nt, Human
auaauaacgucugucuugucucu

SEQ ID NO: 1106265 - RNA, 22 nt, Human
aguucaauuguuuuguaaaagu

SEQ ID NO: 1106266 - RNA, 20 nt, Human
uuacagaaaugauguuauuu

SEQ ID NO: 1106267 - RNA, 22 nt, Human
gauguaucugagcugcuuaggu

SEQ ID NO: 1106268 - RNA, 22 nt, Human
cuuauguaaacuacagauaaua

SEQ ID NO: 1106269 - RNA, 19 nt, Human
cauaauacaguggaucuga

SEQ ID NO: 1106270 - RNA, 23 nt, Human
cauuugauccucacaauaaaugg

SEQ ID NO: 1106271 - RNA, 22 nt, Human
ucacuagugguuucuggugguu

SEQ ID NO: 1106272 - RNA, 22 nt, Human
cuuucugaggagacgggcuuug

SEQ ID NO: 1106273 - RNA, 22 nt, Human
ggaguucaaaucuuuuggaucu

SEQ ID NO: 1106274 - RNA, 19 nt, Human
cuucuggauccgcagggcc

SEQ ID NO: 1106275 - RNA, 22 nt, Human
uaaaaucaugacagauugacau

SEQ ID NO: 1106276 - RNA, 22 nt, Human
ucauuccuccagcgggagucca

SEQ ID NO: 1106277 - RNA, 22 nt, Human
aauagcaaaugcucauuugaaa

SEQ ID NO: 1106278 - RNA, 22 nt, Human
cuucauuucaggcugaagaaua

SEQ ID NO: 1106279 - RNA, 22 nt, Human
auuuacucgugcuucauugaau

SEQ ID NO: 1106280 - RNA, 22 nt, Human
auauaguuggguuucauucuac

SEQ ID NO: 1106281 - RNA, 22 nt, Human
uuucauguuggauacuguuuca

SEQ ID NO: 1106282 - RNA, 22 nt, Human
cacuguuuuacauguuauuuaa

SEQ ID NO: 1106283 - RNA, 22 nt, Human
uaucaguccaggguuuugugac

SEQ ID NO: 1106284 - RNA, 23 nt, Human
uagauccuuccaacuacucuuac

SEQ ID NO: 1106285 - RNA, 22 nt, Human
uagauucugacccucuuuuuac

SEQ ID NO: 1106286 - RNA, 22 nt, Human
gucacaguggggucacagugug

SEQ ID NO: 1106287 - RNA, 22 nt, Human
cuugugaaaugccagauaaucu

SEQ ID NO: 1106288 - RNA, 20 nt, Human
uacaauauucccacuuugcu

SEQ ID NO: 1106289 - RNA, 22 nt, Human
aggacaaaggaccagaucugga

SEQ ID NO: 1106290 - RNA, 23 nt, Human
auaugucaugcaccagcacuuua

SEQ ID NO: 1106291 - RNA, 22 nt, Human
uuggauggagguucaagcacua

SEQ ID NO: 1106292 - RNA, 22 nt, Human
uaaguauuggccuauagcuaga

SEQ ID NO: 1106293 - RNA, 22 nt, Human
ucuccucuccuuucauguuguu

SEQ ID NO: 1106294 - RNA, 23 nt, Human
aaugaguugggcagcauacaggc

SEQ ID NO: 1106295 - RNA, 22 nt, Human
uaggauaugcauuuuuauacau

SEQ ID NO: 1106296 - RNA, 22 nt, Human
uaacuucucugagccucauucc

SEQ ID NO: 1106297 - RNA, 22 nt, Human
auuaguagcacacagagaucag

SEQ ID NO: 1106298 - RNA, 22 nt, Human
uucuguaauucuguuaguuuca

SEQ ID NO: 1106299 - RNA, 22 nt, Human
ccauccaugguguugguuguau

SEQ ID NO: 1106300 - RNA, 22 nt, Human
auacaacagaaaaugauuauuc

SEQ ID NO: 1106301 - RNA, 21 nt, Human
ucaauuauggaugugugcaaa

SEQ ID NO: 1106302 - RNA, 19 nt, Human
aguguuuauguagugccua

SEQ ID NO: 1106303 - RNA, 22 nt, Human
auagcaaaggacaauagucagu

SEQ ID NO: 1106304 - RNA, 22 nt, Human
uguaauguuagaaacaauugcu

SEQ ID NO: 1106305 - RNA, 22 nt, Human
augaaaacggaccagagcuauu

SEQ ID NO: 1106306 - RNA, 22 nt, Human
uacaccagauuauuuauaacau

SEQ ID NO: 1106307 - RNA, 22 nt, Human
acugguuuuggaaaucaguaca

SEQ ID NO: 1106308 - RNA, 22 nt, Human
ccugaaaugaguucugcucacu

SEQ ID NO: 1106309 - RNA, 22 nt, Human
gaucuguccuggcaguuaacac

SEQ ID NO: 1106310 - RNA, 22 nt, Human
aucagugacuucuuccaaaguu

SEQ ID NO: 1106311 - RNA, 22 nt, Human
ugugagauuuuauuugauaugc

SEQ ID NO: 1106312 - RNA, 19 nt, Human
auucuucucuuccugcugu

SEQ ID NO: 1106313 - RNA, 22 nt, Human
ucagaacauccugguuuaaaau

SEQ ID NO: 1106314 - RNA, 23 nt, Human
auagaccauugucucacacuuca

SEQ ID NO: 1106315 - RNA, 22 nt, Human
aggcuauuuccacucuucucau

SEQ ID NO: 1106316 - RNA, 22 nt, Human
aaaacuuucagggauacagaaa

SEQ ID NO: 1106317 - RNA, 22 nt, Human
auaacugagugagcagcgacuc

SEQ ID NO: 1106318 - RNA, 22 nt, Human
uuugggaaacuuaggggucaga

SEQ ID NO: 1106319 - RNA, 22 nt, Human
uaaacagagaugccugggucug

SEQ ID NO: 1106320 - RNA, 22 nt, Human
acaggauuaauaaaaaauugua

SEQ ID NO: 1106321 - RNA, 22 nt, Human
acauuuguuucucuagaguagg

SEQ ID NO: 1106322 - RNA, 22 nt, Human
ugucuuaugcugcauagacuau

SEQ ID NO: 1106323 - RNA, 22 nt, Human
agaaaagaggcuuucuaagcau

SEQ ID NO: 1106324 - RNA, 22 nt, Human
guaguucuuucucaauguucaa

SEQ ID NO: 1106325 - RNA, 22 nt, Human
gcaaaacagucgaugccuccca

SEQ ID NO: 1106326 - RNA, 22 nt, Human
uugcucuauguuuguaaacaga

SEQ ID NO: 1106327 - RNA, 22 nt, Human
aaaauuaagugucugggaagcc

SEQ ID NO: 1106328 - RNA, 22 nt, Human
auauuuguuuggcagaguucag

SEQ ID NO: 1106329 - RNA, 22 nt, Human
aacaucuagguucucaucgaua

SEQ ID NO: 1106330 - RNA, 22 nt, Human
uguaucauauggggaagcuuca

SEQ ID NO: 1106331 - RNA, 22 nt, Human
gcacaaaagguacuucauguag

SEQ ID NO: 1106332 - RNA, 22 nt, Human
aagacagugacagucacaauug

SEQ ID NO: 1106333 - RNA, 22 nt, Human
caugucaagacugaagauccag

SEQ ID NO: 1106334 - RNA, 22 nt, Human
cuuugugauaguguuaagacca

SEQ ID NO: 1106335 - RNA, 22 nt, Human
guacauauccuuuacguuuugu

SEQ ID NO: 1106336 - RNA, 22 nt, Human
gucuugcacuuaccuaagaacu

SEQ ID NO: 1106337 - RNA, 20 nt, Human
ucauaugugguuguauacaa

SEQ ID NO: 1106338 - RNA, 23 nt, Human
aaacuacauuuauaguuuuucuc

SEQ ID NO: 1106339 - RNA, 22 nt, Human
agccagugucgugugacaugag

SEQ ID NO: 1106340 - RNA, 22 nt, Human
guuaaugcaaagcagagggcaa

SEQ ID NO: 1106341 - RNA, 22 nt, Human
caaaauuguugaugcugcuuug

SEQ ID NO: 1106342 - RNA, 20 nt, Human
caacacugcccauuguuugc

SEQ ID NO: 1106343 - RNA, 18 nt, Human
agguauaugaaucucuuu

SEQ ID NO: 1106344 - RNA, 22 nt, Human
ugcauaaacuucucugguguga

SEQ ID NO: 1106345 - RNA, 22 nt, Human
gaaaugucaagauauguuugga

SEQ ID NO: 1106346 - RNA, 22 nt, Human
gagaugugucagguccuggggg

SEQ ID NO: 1106347 - RNA, 22 nt, Human
cagcugacaagaguccuuggag

SEQ ID NO: 1106348 - RNA, 22 nt, Human
gcacugagcuuuggaggagcag

SEQ ID NO: 1106349 - RNA, 22 nt, Human
gggcagagguucaacuucaaca

SEQ ID NO: 1106350 - RNA, 22 nt, Human
cugguuuuuagugcuuaggagu

SEQ ID NO: 1106351 - RNA, 22 nt, Human
uguaaagaaagacgcagaguua

SEQ ID NO: 1106352 - RNA, 22 nt, Human
ucauacauguuguguucaaaug

SEQ ID NO: 1106353 - RNA, 22 nt, Human
aauuccagcugauugacuuucc

SEQ ID NO: 1106354 - RNA, 22 nt, Human
augauugaaaaugacauugcca

SEQ ID NO: 1106355 - RNA, 22 nt, Human
gaaacuguauguaguuuuuggg

SEQ ID NO: 1106356 - RNA, 22 nt, Human
acauucaugcaccuuccuaucc

SEQ ID NO: 1106357 - RNA, 18 nt, Human
ucuuccaacacugacacc

SEQ ID NO: 1106358 - RNA, 22 nt, Human
cagcuggacugggauguagcga

SEQ ID NO: 1106359 - RNA, 22 nt, Human
agacauauuggcuugcuuuaau

SEQ ID NO: 1106360 - RNA, 22 nt, Human
agcuuucuauauaugaguugcu

SEQ ID NO: 1106361 - RNA, 22 nt, Human
uauuuguuucuaguggcagcaa

SEQ ID NO: 1106362 - RNA, 18 nt, Human
gaacagcaauuucauguu

SEQ ID NO: 1106363 - RNA, 22 nt, Human
ccucucauagucuguauccuuu

SEQ ID NO: 1106364 - RNA, 22 nt, Human
aacagguagggacucuaacuug

SEQ ID NO: 1106365 - RNA, 22 nt, Human
ucaugauaauacaggccuucua

SEQ ID NO: 1106366 - RNA, 22 nt, Human
gagaugggcgagaagguggacu

SEQ ID NO: 1106367 - RNA, 22 nt, Human
uucaaacaguguagaauauaug

SEQ ID NO: 1106368 - RNA, 18 nt, Human
aguaaauguuaaauauug

SEQ ID NO: 1106369 - RNA, 22 nt, Human
cagacugaaaaucccugguagu

SEQ ID NO: 1106370 - RNA, 22 nt, Human
aaauacaguggcagcagauaau

SEQ ID NO: 1106371 - RNA, 22 nt, Human
auguuguugaacucuuugcaug

SEQ ID NO: 1106372 - RNA, 22 nt, Human
uagaucuuucacuacuguguag

SEQ ID NO: 1106373 - RNA, 23 nt, Human
ggacaugucucuggguauuuuga

SEQ ID NO: 1106374 - RNA, 22 nt, Human
uacaguaaccagucuacuuaga

SEQ ID NO: 1106375 - RNA, 22 nt, Human
uagcaucuguacugacauaauc

SEQ ID NO: 1106376 - RNA, 21 nt, Human
cuuuucuagucccagccccgc

SEQ ID NO: 1106377 - RNA, 21 nt, Human
agauuguauggaggugagagg

SEQ ID NO: 1106378 - RNA, 22 nt, Human
uuuaauuuucugggcccagcag

SEQ ID NO: 1106379 - RNA, 22 nt, Human
uuuccagaaauaccauuuggug

SEQ ID NO: 1106380 - RNA, 22 nt, Human
cacugguugccucuuucuguuc

SEQ ID NO: 1106381 - RNA, 22 nt, Human
auugucgucaauggacacauag

SEQ ID NO: 1106382 - RNA, 22 nt, Human
caggcuguguuccuggaacccc

SEQ ID NO: 1106383 - RNA, 22 nt, Human
ucuuauaccccuaaacugcagc

SEQ ID NO: 1106384 - RNA, 22 nt, Human
aauaguguauuuuucaaaauua

SEQ ID NO: 1106385 - RNA, 22 nt, Human
uugauggacagggaccacuguc

SEQ ID NO: 1106386 - RNA, 22 nt, Human
uauucacagcugccgcacucag

SEQ ID NO: 1106387 - RNA, 23 nt, Human
ucugaccucguuugcuguguucu

SEQ ID NO: 1106388 - RNA, 19 nt, Human
agcaguggagccaugccug

SEQ ID NO: 1106389 - RNA, 22 nt, Human
uagcauuucacugaucuucacu

SEQ ID NO: 1106390 - RNA, 22 nt, Human
cuggagaacagagcuguuuaga

SEQ ID NO: 1106391 - RNA, 22 nt, Human
agagcaauuagcuuagguaaaa

SEQ ID NO: 1106392 - RNA, 17 nt, Human
ccuuucuucccagaggg

SEQ ID NO: 1106393 - RNA, 22 nt, Human
auuuccaggaguugaggucuga

SEQ ID NO: 1106394 - RNA, 22 nt, Human
guuucgucaggcuuauucuauc

SEQ ID NO: 1106395 - RNA, 22 nt, Human
cuuaagacaggcucaaagauua

SEQ ID NO: 1106396 - RNA, 22 nt, Human
accagagucaauuauuuugcca

SEQ ID NO: 1106397 - RNA, 22 nt, Human
uauucauguguuggaaaggaac

SEQ ID NO: 1106398 - RNA, 22 nt, Human
augaacugcaguauaaacuugg

SEQ ID NO: 1106399 - RNA, 22 nt, Human
ucuuuuccuugaugguuaaaua

SEQ ID NO: 1106400 - RNA, 22 nt, Human
guaugucuuaggguucaguaac

SEQ ID NO: 1106401 - RNA, 22 nt, Human
auggauggaacucugcuguggu

SEQ ID NO: 1106402 - RNA, 22 nt, Human
aaacacaucauucaugucguca

SEQ ID NO: 1106403 - RNA, 21 nt, Human
gcucuguguuacaaguugggg

SEQ ID NO: 1106404 - RNA, 22 nt, Human
ucuaugucucuggaaggagugu

SEQ ID NO: 1106405 - RNA, 22 nt, Human
ucucagucuuugcaaggaugcu

SEQ ID NO: 1106406 - RNA, 22 nt, Human
caggaaauucccagaaggacug

SEQ ID NO: 1106407 - RNA, 22 nt, Human
uucagaaagugaaucuuguuau

SEQ ID NO: 1106408 - RNA, 20 nt, Human
agcauuuagccuuuauccac

SEQ ID NO: 1106409 - RNA, 22 nt, Human
cggcagagcccugagucagccu

SEQ ID NO: 1106410 - RNA, 22 nt, Human
uaaaccuuauuugaauaccaac

SEQ ID NO: 1106411 - RNA, 22 nt, Human
uguggaauguccucagcauccu

SEQ ID NO: 1106412 - RNA, 22 nt, Human
ucauggaugauagcuucauugc

SEQ ID NO: 1106413 - RNA, 22 nt, Human
guggcagcggcccaggccgucu

SEQ ID NO: 1106414 - RNA, 22 nt, Human
agugauaggacauauggauuuu

SEQ ID NO: 1106415 - RNA, 22 nt, Human
ucugaauucuuagaauuaaagg

SEQ ID NO: 1106416 - RNA, 22 nt, Human
uggaucuugaugcuccaagagu

SEQ ID NO: 1106417 - RNA, 22 nt, Human
aaugagaauguaagugaagaga

SEQ ID NO: 1106418 - RNA, 22 nt, Human
aaacaguguguuucagagaggc

SEQ ID NO: 1106419 - RNA, 22 nt, Human
uaaaaguuagcuaggacaaagu

SEQ ID NO: 1106420 - RNA, 22 nt, Human
gaaggaagcugucuggaugugu

SEQ ID NO: 1106421 - RNA, 22 nt, Human
gagucacauacuauguaauaga

SEQ ID NO: 1106422 - RNA, 22 nt, Human
ucuguaaacacccguaagcuuu

SEQ ID NO: 1106423 - RNA, 22 nt, Human
caauaguaaauuacggaggaga

SEQ ID NO: 1106424 - RNA, 22 nt, Human
uguucauucugugaccugguuc

SEQ ID NO: 1106425 - RNA, 22 nt, Human
aucuucaaggaaaaaauacagu

SEQ ID NO: 1106426 - RNA, 22 nt, Human
aguaacuuaagcaauuguguau

SEQ ID NO: 1106427 - RNA, 22 nt, Human
uugauuugauuguaauggcucu

SEQ ID NO: 1106428 - RNA, 23 nt, Human
aaauugucguaagguggagaugu

SEQ ID NO: 1106429 - RNA, 22 nt, Human
uuuguagauuuucucuccagua

SEQ ID NO: 1106430 - RNA, 22 nt, Human
ggaagcaaauuccagaaccaca

SEQ ID NO: 1106431 - RNA, 22 nt, Human
cuuauuggucccaggaggagaa

SEQ ID NO: 1106432 - RNA, 22 nt, Human
uuuagcaaggagaaauaauccu

SEQ ID NO: 1106433 - RNA, 22 nt, Human
gaaggagaggauugugaggcug

SEQ ID NO: 1106434 - RNA, 22 nt, Human
aaugcuuuuugcgaaaugugca

SEQ ID NO: 1106435 - RNA, 22 nt, Human
augcaauaguaauucuagucug

SEQ ID NO: 1106436 - RNA, 22 nt, Human
uuucacaugguacugccuguuu

SEQ ID NO: 1106437 - RNA, 22 nt, Human
ucagucucuggggcuucuguuu

SEQ ID NO: 1106438 - RNA, 22 nt, Human
ccaggacacgauuuuuagucug

SEQ ID NO: 1106439 - RNA, 22 nt, Human
agaauguaagaaugcaaagauu

SEQ ID NO: 1106440 - RNA, 22 nt, Human
ucaucaucauucucccccacuu

SEQ ID NO: 1106441 - RNA, 22 nt, Human
gcagaagucagaccaucugaau

SEQ ID NO: 1106442 - RNA, 22 nt, Human
aauuagaagcuguuagcaaaau

SEQ ID NO: 1106443 - RNA, 22 nt, Human
uaccaaaaccaagccauuaucu

SEQ ID NO: 1106444 - RNA, 22 nt, Human
gagaauguuaauguugaaguau

SEQ ID NO: 1106445 - RNA, 22 nt, Human
aaugagauggaggacucuuaau

SEQ ID NO: 1106446 - RNA, 22 nt, Human
cuaguuuuaagcuccuugaggu

SEQ ID NO: 1106447 - RNA, 22 nt, Human
acugaaauuuauauuuugggca

SEQ ID NO: 1106448 - RNA, 22 nt, Human
ucuaguuagugguugauacugu

SEQ ID NO: 1106449 - RNA, 16 nt, Human
ccagaugaaugggagu

SEQ ID NO: 1106450 - RNA, 22 nt, Human
uagaaaagccccagcuggaggg

SEQ ID NO: 1106451 - RNA, 22 nt, Human
augauuuguuaacagacuuaau

SEQ ID NO: 1106452 - RNA, 22 nt, Human
guauuucuuuacauaugcucau

SEQ ID NO: 1106453 - RNA, 22 nt, Human
aagcuguuagggagugguaggu

SEQ ID NO: 1106454 - RNA, 22 nt, Human
ucaauucugccucuaaauauuu

SEQ ID NO: 1106455 - RNA, 22 nt, Human
uuugagaagauaggggaauacu

SEQ ID NO: 1106456 - RNA, 22 nt, Human
guuaacaacacugugagugcug

SEQ ID NO: 1106457 - RNA, 22 nt, Human
uccucauucuuggugcaucaaa

SEQ ID NO: 1106458 - RNA, 22 nt, Human
auuucagagugagagugcucaa

SEQ ID NO: 1106459 - RNA, 22 nt, Human
guggaaauuuuaggaucaucuu

SEQ ID NO: 1106460 - RNA, 22 nt, Human
uuguccuuaccucaaucuggaa

SEQ ID NO: 1106461 - RNA, 22 nt, Human
agaugguucagaauuauaaaga

SEQ ID NO: 1106462 - RNA, 22 nt, Human
aauggagugguucuugcccucu

SEQ ID NO: 1106463 - RNA, 22 nt, Human
uucuucauucccuuacuuccga

SEQ ID NO: 1106464 - RNA, 22 nt, Human
caauguuuuuccuuccuuaaua

SEQ ID NO: 1106465 - RNA, 22 nt, Human
uaauccaaaacugaaucugugg

SEQ ID NO: 1106466 - RNA, 22 nt, Human
uuggggaagcuuugaaauacuu

SEQ ID NO: 1106467 - RNA, 22 nt, Human
ccagaaugugugaaauuugaug

SEQ ID NO: 1106468 - RNA, 22 nt, Human
gugguuguuuccagguuugaaa

SEQ ID NO: 1106469 - RNA, 22 nt, Human
aaaacauuuuacugccaucuca

SEQ ID NO: 1106470 - RNA, 22 nt, Human
gaagccaaguccucgaguuuca

SEQ ID NO: 1106471 - RNA, 22 nt, Human
uuggaaauguagaaaagcagau

SEQ ID NO: 1106472 - RNA, 22 nt, Human
uacuuugagaugaugcugaucg

SEQ ID NO: 1106473 - RNA, 22 nt, Human
guucuucaaagugacaacuaaa

SEQ ID NO: 1106474 - RNA, 22 nt, Human
cacaguuuuaucuuauacugau

SEQ ID NO: 1106475 - RNA, 22 nt, Human
ugugugaacucucugauguaca

SEQ ID NO: 1106476 - RNA, 22 nt, Human
uggaaaauauuuaggugaauga

SEQ ID NO: 1106477 - RNA, 22 nt, Human
ugauuccugugcuuauuccagu

SEQ ID NO: 1106478 - RNA, 22 nt, Human
aggcauuacaucuaaauauuua

SEQ ID NO: 1106479 - RNA, 22 nt, Human
ucucacacuaaugcucuaucag

SEQ ID NO: 1106480 - RNA, 22 nt, Human
cuacauuuacacaguuaggcuu

SEQ ID NO: 1106481 - RNA, 22 nt, Human
ugcuuuauucgacaucugguag

SEQ ID NO: 1106482 - RNA, 22 nt, Human
agaaguaucaggaagauucuca

SEQ ID NO: 1106483 - RNA, 23 nt, Human
aacucuggcuagcauagaauaga

SEQ ID NO: 1106484 - RNA, 22 nt, Human
ugugguuuugguucagaaacaa

SEQ ID NO: 1106485 - RNA, 22 nt, Human
ucuuauugugaugaugaagaac

SEQ ID NO: 1106486 - RNA, 22 nt, Human
gaaguauuucugaguugcccag

SEQ ID NO: 1106487 - RNA, 22 nt, Human
cucuaaauguggucugcagaua

SEQ ID NO: 1106488 - RNA, 22 nt, Human
ggcaauuacguauuagucaugu

SEQ ID NO: 1106489 - RNA, 22 nt, Human
uuuugaauaauucagaaacagc

SEQ ID NO: 1106490 - RNA, 22 nt, Human
uugaugcugucuuucagaauca

SEQ ID NO: 1106491 - RNA, 22 nt, Human
acagaguaucuaucaggaguau

SEQ ID NO: 1106492 - RNA, 22 nt, Human
aauaucaucucucuuuucugca

SEQ ID NO: 1106493 - RNA, 22 nt, Human
uuuguugguugcacuggugggu

SEQ ID NO: 1106494 - RNA, 22 nt, Human
uacaucucaucugugcucuccg

SEQ ID NO: 1106495 - RNA, 22 nt, Human
ugauuuacaguagugucuaaac

SEQ ID NO: 1106496 - RNA, 22 nt, Human
gaauaauugugaugcuugaagu

SEQ ID NO: 1106497 - RNA, 22 nt, Human
ucuuagaaacuguaucgauuag

SEQ ID NO: 1106498 - RNA, 22 nt, Human
uuuucaguugugcucucuaguu

SEQ ID NO: 1106499 - RNA, 22 nt, Human
cuuccagugcauagguagauca

SEQ ID NO: 1106500 - RNA, 22 nt, Human
gaacaguuucccuguagaaaau

SEQ ID NO: 1106501 - RNA, 20 nt, Human
uauuucugggcaaccauuua

SEQ ID NO: 1106502 - RNA, 22 nt, Human
guucuucagauuccauuucagu

SEQ ID NO: 1106503 - RNA, 22 nt, Human
cagagaauaaaagggcauuccu

SEQ ID NO: 1106504 - RNA, 22 nt, Human
aauaucuagccuuuagcagcuu

SEQ ID NO: 1106505 - RNA, 22 nt, Human
aagucaauuaguaaacuuggaa

SEQ ID NO: 1106506 - RNA, 22 nt, Human
cagcaguacuucucagagguau

SEQ ID NO: 1106507 - RNA, 22 nt, Human
uguucaguuugcuaucauaauc

SEQ ID NO: 1106508 - RNA, 22 nt, Human
auguacaaucuaucacaagaag

SEQ ID NO: 1106509 - RNA, 22 nt, Human
gcaucugauccaauagauauau

SEQ ID NO: 1106510 - RNA, 22 nt, Human
uagaagaugccuuaaaguugaa

SEQ ID NO: 1106511 - RNA, 22 nt, Human
caaagaugccaaaaggaagaca

SEQ ID NO: 1106512 - RNA, 22 nt, Human
aggcauuuaaagauguaagacu

SEQ ID NO: 1106513 - RNA, 22 nt, Human
ucuucaugaaauugauugcuua

SEQ ID NO: 1106514 - RNA, 22 nt, Human
agagaagagucuugucaaauua

SEQ ID NO: 1106515 - RNA, 22 nt, Human
uccaugacagcgugagaguuug

SEQ ID NO: 1106516 - RNA, 22 nt, Human
gcuuuuauuucuucacaaaagu

SEQ ID NO: 1106517 - RNA, 22 nt, Human
gugacagaaacagggcuagaau

SEQ ID NO: 1106518 - RNA, 21 nt, Human
uggacauuuacccuucaggga

SEQ ID NO: 1106519 - RNA, 22 nt, Human
gugaagaugccucaggugaccc

SEQ ID NO: 1106520 - RNA, 22 nt, Human
uucaguuuugcuuuuaaucaug

SEQ ID NO: 1106521 - RNA, 22 nt, Human
aaagaugucauacacauuaaga

SEQ ID NO: 1106522 - RNA, 22 nt, Human
gcaguuaccuauuuuguagaaa

SEQ ID NO: 1106523 - RNA, 18 nt, Human
cuggucucccuucgcuuu

SEQ ID NO: 1106524 - RNA, 22 nt, Human
guuggacaguuugggaagggag

SEQ ID NO: 1106525 - RNA, 22 nt, Human
agcuuuauuugucauucacggc

SEQ ID NO: 1106526 - RNA, 22 nt, Human
aggaauuugggguuacaugaug

SEQ ID NO: 1106527 - RNA, 22 nt, Human
cuguuuauucucaucuaaaaug

SEQ ID NO: 1106528 - RNA, 22 nt, Human
uacuggacacguauauauagau

SEQ ID NO: 1106529 - RNA, 22 nt, Human
agggagcugcucugcuuccgug

SEQ ID NO: 1106530 - RNA, 22 nt, Human
caaagaagagauuuacagagcu

SEQ ID NO: 1106531 - RNA, 22 nt, Human
acaccacaaguaacucuuuucc

SEQ ID NO: 1106532 - RNA, 22 nt, Human
uuucuaguggguauucccuguu

SEQ ID NO: 1106533 - RNA, 22 nt, Human
ucuaauuuuggcauuuuaaccu

SEQ ID NO: 1106534 - RNA, 22 nt, Human
gugcuaugauuggacagaauag

SEQ ID NO: 1106535 - RNA, 22 nt, Human
aucaugcagcaacaagcaaggc

SEQ ID NO: 1106536 - RNA, 22 nt, Human
uacauuuauaaggcuucucugu

SEQ ID NO: 1106537 - RNA, 22 nt, Human
uaauuucagugcaagcucacgg

SEQ ID NO: 1106538 - RNA, 17 nt, Human
ucuggaugucauggaag

SEQ ID NO: 1106539 - RNA, 23 nt, Human
uggaaacauucugaauguccauc

SEQ ID NO: 1106540 - RNA, 22 nt, Human
aaucaggagugugcacuuugau

SEQ ID NO: 1106541 - RNA, 22 nt, Human
acuuuggugcgaagucacuuua

SEQ ID NO: 1106542 - RNA, 22 nt, Human
uauggauauaaucagacuggaa

SEQ ID NO: 1106543 - RNA, 22 nt, Human
agaacagaggccuuauguuuca

SEQ ID NO: 1106544 - RNA, 22 nt, Human
auccuucaaaaggaauagcagg

SEQ ID NO: 1106545 - RNA, 22 nt, Human
aucucuguaaaccauaaauuga

SEQ ID NO: 1106546 - RNA, 22 nt, Human
augaaacaacagacuuggucaa

SEQ ID NO: 1106547 - RNA, 22 nt, Human
aagaugauuauguagauuggga

SEQ ID NO: 1106548 - RNA, 18 nt, Human
gguguguaacguguuuuc

SEQ ID NO: 1106549 - RNA, 22 nt, Human
aaaugccucauuuucucucacu

SEQ ID NO: 1106550 - RNA, 22 nt, Human
aagaauaagaggauuuagaaca

SEQ ID NO: 1106551 - RNA, 22 nt, Human
caaucaaugcugcuaguuccuu

SEQ ID NO: 1106552 - RNA, 22 nt, Human
aaaucccacucacgaguuuugc

SEQ ID NO: 1106553 - RNA, 22 nt, Human
ggaagcuguuaucaucuguauc

SEQ ID NO: 1106554 - RNA, 22 nt, Human
uugguuaccuucagaaaugagu

SEQ ID NO: 1106555 - RNA, 22 nt, Human
ugugucuaaugacuauuucuuc

SEQ ID NO: 1106556 - RNA, 22 nt, Human
auguaguauuuggaaauguaaa

SEQ ID NO: 1106557 - RNA, 22 nt, Human
guuuacaacaucuuguccuuca

SEQ ID NO: 1106558 - RNA, 22 nt, Human
uuuacgaauggggugacaacuu

SEQ ID NO: 1106559 - RNA, 22 nt, Human
ucuuauugguaaugauggcauu

SEQ ID NO: 1106560 - RNA, 22 nt, Human
uuauuugcccauguuuagcaga

SEQ ID NO: 1106561 - RNA, 22 nt, Human
guguuuggucagacguccgggg

SEQ ID NO: 1106562 - RNA, 22 nt, Human
uggaauguuaaaccucaaugau

SEQ ID NO: 1106563 - RNA, 22 nt, Human
gaaacacucaauuuaguaauuc

SEQ ID NO: 1106564 - RNA, 22 nt, Human
uaggaaauaauucacucuggcu

SEQ ID NO: 1106565 - RNA, 22 nt, Human
uuuuccuucugauacuccauuu

SEQ ID NO: 1106566 - RNA, 22 nt, Human
aggaaaugccgcggcucucuuu

SEQ ID NO: 1106567 - RNA, 20 nt, Human
uuuuccacuccucaaaacag

SEQ ID NO: 1106568 - RNA, 22 nt, Human
ccaucuucucuugaaccuccuu

SEQ ID NO: 1106569 - RNA, 22 nt, Human
uugcaaucagcaguguuuucac

SEQ ID NO: 1106570 - RNA, 22 nt, Human
ucagugauuucuggggugaggg

SEQ ID NO: 1106571 - RNA, 22 nt, Human
accauccaaacugcuuucugug

SEQ ID NO: 1106572 - RNA, 22 nt, Human
auuguuacuggguuaauuugga

SEQ ID NO: 1106573 - RNA, 22 nt, Human
aacagauuguaaccugauagcc

SEQ ID NO: 1106574 - RNA, 22 nt, Human
ccuggaaaaugccacuuucaca

SEQ ID NO: 1106575 - RNA, 22 nt, Human
aauuauugagcaucuacugugu

SEQ ID NO: 1106576 - RNA, 22 nt, Human
uaaugccuuaugucaaauguaa

SEQ ID NO: 1106577 - RNA, 22 nt, Human
auguccagaguaaagcacauuc

SEQ ID NO: 1106578 - RNA, 22 nt, Human
cuucucagagcuuccagaaaac

SEQ ID NO: 1106579 - RNA, 22 nt, Human
augcauugaggaugacaugagu

SEQ ID NO: 1106580 - RNA, 22 nt, Human
aacuagaaagaacauauuucca

SEQ ID NO: 1106581 - RNA, 22 nt, Human
uuguuuaaagaacuucugacuu

SEQ ID NO: 1106582 - RNA, 22 nt, Human
cuuuauguuggggugucuuagu

SEQ ID NO: 1106583 - RNA, 22 nt, Human
ucggggauggugucugagggag

SEQ ID NO: 1106584 - RNA, 22 nt, Human
uauuaugguuguagguuaacaa

SEQ ID NO: 1106585 - RNA, 22 nt, Human
uuacaauuacuugaucucagcu

SEQ ID NO: 1106586 - RNA, 22 nt, Human
uagaagaacaugucaaacuaua

SEQ ID NO: 1106587 - RNA, 20 nt, Human
uaugauaauuacaaaauagu

SEQ ID NO: 1106588 - RNA, 22 nt, Human
guguuuaaugcagaugugggug

SEQ ID NO: 1106589 - RNA, 22 nt, Human
cuugaugaaugaccuggguggu

SEQ ID NO: 1106590 - RNA, 22 nt, Human
uuaagagaagaguaucuagaac

SEQ ID NO: 1106591 - RNA, 22 nt, Human
auugcacaucugcacuacagcc

SEQ ID NO: 1106592 - RNA, 22 nt, Human
uuuauacuccacucugcaagcg

SEQ ID NO: 1106593 - RNA, 18 nt, Human
cagaaaguuauuuacucu

SEQ ID NO: 1106594 - RNA, 22 nt, Human
acuuuagauauuccucuguaca

SEQ ID NO: 1106595 - RNA, 22 nt, Human
guaauucugugugaaucuauua

SEQ ID NO: 1106596 - RNA, 22 nt, Human
cuuuggaaaaauaccuggcaua

SEQ ID NO: 1106597 - RNA, 22 nt, Human
uuuacuuuugguaaggucauuu

SEQ ID NO: 1106598 - RNA, 22 nt, Human
aaggaucauguauauguuuaag

SEQ ID NO: 1106599 - RNA, 22 nt, Human
aauguuacgaucaacaacacau

SEQ ID NO: 1106600 - RNA, 22 nt, Human
uuuuuaagagucuggaaauagu

SEQ ID NO: 1106601 - RNA, 22 nt, Human
agccacauggaccugaugcuag

SEQ ID NO: 1106602 - RNA, 22 nt, Human
gugauuuucuccuccuagaagu

SEQ ID NO: 1106603 - RNA, 22 nt, Human
augaacaguacaaagcacagac

SEQ ID NO: 1106604 - RNA, 22 nt, Human
gaagauuaccugagaccacuug

SEQ ID NO: 1106605 - RNA, 22 nt, Human
auuguugacuugauuacucaac

SEQ ID NO: 1106606 - RNA, 22 nt, Human
ugcuugcugaaaggcauuuaga

SEQ ID NO: 1106607 - RNA, 22 nt, Human
aucuucaaagcacaucguuugu

SEQ ID NO: 1106608 - RNA, 22 nt, Human
gugauuucaaauauagagugag

SEQ ID NO: 1106609 - RNA, 22 nt, Human
cauuguuggcagagggacagag

SEQ ID NO: 1106610 - RNA, 22 nt, Human
ucaucuguuaugggaguuuuug

SEQ ID NO: 1106611 - RNA, 22 nt, Human
aguuauugagugcagagcaggg

SEQ ID NO: 1106612 - RNA, 22 nt, Human
uuguugcugcucaaccucuaua

SEQ ID NO: 1106613 - RNA, 20 nt, Human
uuugauugccccucugacuu

SEQ ID NO: 1106614 - RNA, 19 nt, Human
cagcaaacacuguaaaugg

SEQ ID NO: 1106615 - RNA, 22 nt, Human
cuuguauuaggaagaaugcuuu

SEQ ID NO: 1106616 - RNA, 22 nt, Human
uuugaauauacuucaaacaaag

SEQ ID NO: 1106617 - RNA, 22 nt, Human
uugcauauccuccaacacaugg

SEQ ID NO: 1106618 - RNA, 22 nt, Human
cacaauuuccauugagcagcag

SEQ ID NO: 1106619 - RNA, 22 nt, Human
uaugcuguauucuguauguuag

SEQ ID NO: 1106620 - RNA, 23 nt, Human
acauuacacgcaguaauugcccc

SEQ ID NO: 1106621 - RNA, 22 nt, Human
ugcacccacuuagcugaaguuc

SEQ ID NO: 1106622 - RNA, 22 nt, Human
uauagcagcaugauuuauaguc

SEQ ID NO: 1106623 - RNA, 22 nt, Human
caugcaugccgggcugacagag

SEQ ID NO: 1106624 - RNA, 22 nt, Human
uuuacuguuuacagcuaaugca

SEQ ID NO: 1106625 - RNA, 22 nt, Human
cacgaauggaagggucuuggcu

SEQ ID NO: 1106626 - RNA, 22 nt, Human
augcuugaaaguuauuucauuu

SEQ ID NO: 1106627 - RNA, 23 nt, Human
ugaaagcaaugggucuauaguau

SEQ ID NO: 1106628 - RNA, 22 nt, Human
uuagaaaaaggcuguggucuua

SEQ ID NO: 1106629 - RNA, 23 nt, Human
aacauuuguaaggugauuuuguu

SEQ ID NO: 1106630 - RNA, 22 nt, Human
cagccuuugggucagaagauuc

SEQ ID NO: 1106631 - RNA, 22 nt, Human
uuucaugauuaacuuagugaau

SEQ ID NO: 1106632 - RNA, 22 nt, Human
ugugcuauuuuugcauaugugu

SEQ ID NO: 1106633 - RNA, 22 nt, Human
uguacauauucaagcacuucua

SEQ ID NO: 1106634 - RNA, 21 nt, Human
acaaauuguuuauauaggaag

SEQ ID NO: 1106635 - RNA, 22 nt, Human
acaaaggugagcagaagacaca

SEQ ID NO: 1106636 - RNA, 22 nt, Human
acauuucuccuacuuguuauuu

SEQ ID NO: 1106637 - RNA, 22 nt, Human
augcaguuagguaauagucuca

SEQ ID NO: 1106638 - RNA, 22 nt, Human
guuguacauaugaggauaaguu

SEQ ID NO: 1106639 - RNA, 22 nt, Human
agugaaaaccuaaucaugcagu

SEQ ID NO: 1106640 - RNA, 22 nt, Human
acuuuuaaggggccuugauuua

SEQ ID NO: 1106641 - RNA, 22 nt, Human
ccuuuuauauggcucaucacag

SEQ ID NO: 1106642 - RNA, 22 nt, Human
cagcuauuguucuguauaauga

SEQ ID NO: 1106643 - RNA, 22 nt, Human
auuaaugaaacuuugguuaagc

SEQ ID NO: 1106644 - RNA, 22 nt, Human
ccagguggacggcgaguacagg

SEQ ID NO: 1106645 - RNA, 22 nt, Human
gccucugcaccaguacugugcc

SEQ ID NO: 1106646 - RNA, 22 nt, Human
gagaaagggaacuuacagagug

SEQ ID NO: 1106647 - RNA, 22 nt, Human
uuguugcaagccuggaaucugg

SEQ ID NO: 1106648 - RNA, 22 nt, Human
acaaacagaguugaaaaauagg

SEQ ID NO: 1106649 - RNA, 22 nt, Human
ugucuagaaaugcugagucuca

SEQ ID NO: 1106650 - RNA, 22 nt, Human
caguuuuacccaagcuuauuuu

SEQ ID NO: 1106651 - RNA, 22 nt, Human
ucuguuauaaaucacacugcau

SEQ ID NO: 1106652 - RNA, 22 nt, Human
ugaaaacacuuuaguuuagguc

SEQ ID NO: 1106653 - RNA, 22 nt, Human
uucuuuuaauagagauccugug

SEQ ID NO: 1106654 - RNA, 22 nt, Human
uccagaugcugcacauuccuga

SEQ ID NO: 1106655 - RNA, 22 nt, Human
uaucacauacuucucauccagg

SEQ ID NO: 1106656 - RNA, 22 nt, Human
aggcuuaacuacaauuuuugcc

SEQ ID NO: 1106657 - RNA, 22 nt, Human
agagcuauuucuuaaaagcugu

SEQ ID NO: 1106658 - RNA, 22 nt, Human
uuuauccaccuuacccuguucc

SEQ ID NO: 1106659 - RNA, 22 nt, Human
uccagcagguccgagacaaguu

SEQ ID NO: 1106660 - RNA, 22 nt, Human
ggaaacauuccaagaguugaaa

SEQ ID NO: 1106661 - RNA, 22 nt, Human
cacuguugagcaauguacagug

SEQ ID NO: 1106662 - RNA, 22 nt, Human
uacaaagugauuuuggaauuga

SEQ ID NO: 1106663 - RNA, 22 nt, Human
agaugacuaacauaguauugcu

SEQ ID NO: 1106664 - RNA, 21 nt, Human
caaaagagacugauucuugga

SEQ ID NO: 1106665 - RNA, 22 nt, Human
cuucuuaaaguugucacagcug

SEQ ID NO: 1106666 - RNA, 22 nt, Human
auagucuuagaaucuugagugu

SEQ ID NO: 1106667 - RNA, 22 nt, Human
gaauguuuaaaaggugcaguuu

SEQ ID NO: 1106668 - RNA, 20 nt, Human
aaaaacaguaaugcugaaga

SEQ ID NO: 1106669 - RNA, 22 nt, Human
uggagcagccuuuucuaagcaa

SEQ ID NO: 1106670 - RNA, 22 nt, Human
uucucaaagugugcucccugga

SEQ ID NO: 1106671 - RNA, 22 nt, Human
ucaguaaaugagcaaaaauuuc

SEQ ID NO: 1106672 - RNA, 22 nt, Human
uuugcagagugcagaagcaucu

SEQ ID NO: 1106673 - RNA, 22 nt, Human
auugagaaaauucgagcaaguu

SEQ ID NO: 1106674 - RNA, 22 nt, Human
uacuuugucauucuaaccuucc

SEQ ID NO: 1106675 - RNA, 22 nt, Human
ucucaucugccauuugcaggag

SEQ ID NO: 1106676 - RNA, 22 nt, Human
uaauucuagauugacauuuuga

SEQ ID NO: 1106677 - RNA, 22 nt, Human
caucaguuccugccccugcccc

SEQ ID NO: 1106678 - RNA, 22 nt, Human
ugauaguaucugauuauuucac

SEQ ID NO: 1106679 - RNA, 22 nt, Human
cauguguauuauucuuguggaa

SEQ ID NO: 1106680 - RNA, 22 nt, Human
cagaaccaggaacugauggaga

SEQ ID NO: 1106681 - RNA, 22 nt, Human
caugugguauugugagauccac

SEQ ID NO: 1106682 - RNA, 22 nt, Human
auccuggguaaguuccuuuuaa

SEQ ID NO: 1106683 - RNA, 22 nt, Human
uguguacauguaucaacuaucg

SEQ ID NO: 1106684 - RNA, 22 nt, Human
guuuuguucaugaacauugggu

SEQ ID NO: 1106685 - RNA, 21 nt, Human
uucacaguggauaacuuucug

SEQ ID NO: 1106686 - RNA, 22 nt, Human
caauuaccaguaauugagguuu

SEQ ID NO: 1106687 - RNA, 22 nt, Human
uuaaaagaauccuguuauccuc

SEQ ID NO: 1106688 - RNA, 20 nt, Human
agugauuuguuaguacauug

SEQ ID NO: 1106689 - RNA, 22 nt, Human
gaauuguacugcaaucagggga

SEQ ID NO: 1106690 - RNA, 22 nt, Human
acauuuuuggguugaugucuga

SEQ ID NO: 1106691 - RNA, 22 nt, Human
agauauguuaggcuuguucccu

SEQ ID NO: 1106692 - RNA, 21 nt, Human
gcaggguuugugcugugaguu

SEQ ID NO: 1106693 - RNA, 22 nt, Human
gaaaggagaggguuaaggagcu

SEQ ID NO: 1106694 - RNA, 22 nt, Human
uauuuggauagacagggagaug

SEQ ID NO: 1106695 - RNA, 22 nt, Human
uugauguaauacuuugcaacca

SEQ ID NO: 1106696 - RNA, 22 nt, Human
aaauccaucaaaucuucuagaa

SEQ ID NO: 1106697 - RNA, 22 nt, Human
auugugcaccuacugugugcag

SEQ ID NO: 1106698 - RNA, 22 nt, Human
acauucucuuuuagaaagcugu

SEQ ID NO: 1106699 - RNA, 22 nt, Human
cuuuacagugaacuugcuuguc

SEQ ID NO: 1106700 - RNA, 22 nt, Human
ggaaaaugggaaccugaagcca

SEQ ID NO: 1106701 - RNA, 22 nt, Human
acaagucaguggaauuaauauu

SEQ ID NO: 1106702 - RNA, 22 nt, Human
guucuuaaagauucaucaagca

SEQ ID NO: 1106703 - RNA, 22 nt, Human
uuagaaaucaccucugaagauc

SEQ ID NO: 1106704 - RNA, 22 nt, Human
caguauguuuauuagaacugca

SEQ ID NO: 1106705 - RNA, 22 nt, Human
uucaacaacuugguucaaaugg

SEQ ID NO: 1106706 - RNA, 22 nt, Human
cacaucauguuaauucauuaca

SEQ ID NO: 1106707 - RNA, 22 nt, Human
gucaaaacaaaguuaagaauuc

SEQ ID NO: 1106708 - RNA, 22 nt, Human
uugcuugaacccaggaagugga

SEQ ID NO: 1106709 - RNA, 22 nt, Human
aucaagggcgcgugguucggcg

SEQ ID NO: 1106710 - RNA, 22 nt, Human
uuuauucucuaguuggucagau

SEQ ID NO: 1106711 - RNA, 17 nt, Human
uaaguccuaguuauuuu

SEQ ID NO: 1106712 - RNA, 22 nt, Human
cugauggagagugugauuuggg

SEQ ID NO: 1106713 - RNA, 22 nt, Human
cauaaauuguacccauuccaac

SEQ ID NO: 1106714 - RNA, 22 nt, Human
uaaaacuagugguugggacuaa

SEQ ID NO: 1106715 - RNA, 22 nt, Human
uuuugguaauuaaguagauauu

SEQ ID NO: 1106716 - RNA, 22 nt, Human
aauguuugaacuuugcauauuu

SEQ ID NO: 1106717 - RNA, 22 nt, Human
uacuguauacuacugcuguucu

SEQ ID NO: 1106718 - RNA, 22 nt, Human
uaucuguuuuuacagugucuuu

SEQ ID NO: 1106719 - RNA, 22 nt, Human
cacauuuaaagguugaagcuga

SEQ ID NO: 1106720 - RNA, 22 nt, Human
acugcauuugguaaagucaaga

SEQ ID NO: 1106721 - RNA, 22 nt, Human
ggaaacugcuuacacuagaggg

SEQ ID NO: 1106722 - RNA, 22 nt, Human
uaacaaaguauuguuuguguau

SEQ ID NO: 1106723 - RNA, 22 nt, Human
uguuccugacggccaaagaggu

SEQ ID NO: 1106724 - RNA, 22 nt, Human
acagaauugggguucuugggga

SEQ ID NO: 1106725 - RNA, 22 nt, Human
uggauguuugaaguugcaugug

SEQ ID NO: 1106726 - RNA, 22 nt, Human
gaaauguuggacacuugaaauu

SEQ ID NO: 1106727 - RNA, 22 nt, Human
guguaucaaagcacagacuuca

SEQ ID NO: 1106728 - RNA, 23 nt, Human
uuguucuuggaucuuccugaagc

SEQ ID NO: 1106729 - RNA, 22 nt, Human
uagaugaacagaaagccacugu

SEQ ID NO: 1106730 - RNA, 22 nt, Human
uaccauuucaguaaaaacuuag

SEQ ID NO: 1106731 - RNA, 22 nt, Human
uuuggaaaugagaagccaccuu

SEQ ID NO: 1106732 - RNA, 22 nt, Human
uucuaguuacagaagccuugcu

SEQ ID NO: 1106733 - RNA, 22 nt, Human
ucucuuaauuguaaugguuccu

SEQ ID NO: 1106734 - RNA, 22 nt, Human
uaucuguauucugacagucacu

SEQ ID NO: 1106735 - RNA, 22 nt, Human
ugguuuguauauguuugugaga

SEQ ID NO: 1106736 - RNA, 22 nt, Human
uccaagaagcuuacaaucuaau

SEQ ID NO: 1106737 - RNA, 22 nt, Human
uaaaugcaguacaaauuguucu

SEQ ID NO: 1106738 - RNA, 22 nt, Human
gaugauuacacuuuuaaaacag

SEQ ID NO: 1106739 - RNA, 23 nt, Human
uggagaauucagucuuuguuuug

SEQ ID NO: 1106740 - RNA, 22 nt, Human
caugcuggucagccaguggaug

SEQ ID NO: 1106741 - RNA, 22 nt, Human
uauuuggugaaucuauggucag

SEQ ID NO: 1106742 - RNA, 22 nt, Human
ucuccccaguauggauucucug

SEQ ID NO: 1106743 - RNA, 22 nt, Human
aucuguucuucaaaauauuaca

SEQ ID NO: 1106744 - RNA, 22 nt, Human
uucuuugcccauguuuccuaag

SEQ ID NO: 1106745 - RNA, 22 nt, Human
cuaccugguacauagaaauguu

SEQ ID NO: 1106746 - RNA, 22 nt, Human
aguacuuuuuguucaauugugc

SEQ ID NO: 1106747 - RNA, 22 nt, Human
auuucagcagcccauguuugga

SEQ ID NO: 1106748 - RNA, 22 nt, Human
uccguuuucacacugcuauaaa

SEQ ID NO: 1106749 - RNA, 22 nt, Human
gaauguuauugaacuacgagcu

SEQ ID NO: 1106750 - RNA, 22 nt, Human
cauuaacacuuuggauuuagac

SEQ ID NO: 1106751 - RNA, 22 nt, Human
ugcucuguucaguguaucuugu

SEQ ID NO: 1106752 - RNA, 22 nt, Human
gucuuaagaaugaaugcugaga

SEQ ID NO: 1106753 - RNA, 22 nt, Human
uuugagaagcauggcuguauuc

SEQ ID NO: 1106754 - RNA, 22 nt, Human
guagagcagggagcaggaagcu

SEQ ID NO: 1106755 - RNA, 23 nt, Human
aguacauuugacccaaauaagcu

SEQ ID NO: 1106756 - RNA, 22 nt, Human
guggcuaggcccaacggcagga

SEQ ID NO: 1106757 - RNA, 22 nt, Human
cagucauuaugggaguuaaucc

SEQ ID NO: 1106758 - RNA, 22 nt, Human
cuucuaauucuuauguaagcuu

SEQ ID NO: 1106759 - RNA, 18 nt, Human
ucagacaaguuagacagg

SEQ ID NO: 1106760 - RNA, 22 nt, Human
uugaauaguuuuggauagcaua

SEQ ID NO: 1106761 - RNA, 22 nt, Human
ugagaugaagugauguaaaaca

SEQ ID NO: 1106762 - RNA, 22 nt, Human
gagcuuuucccgucuuucucgu

SEQ ID NO: 1106763 - RNA, 22 nt, Human
uucucugaguacguuucagugu

SEQ ID NO: 1106764 - RNA, 22 nt, Human
cucagagaagauggaugaggua

SEQ ID NO: 1106765 - RNA, 22 nt, Human
ugaauaugugacuuugauuuca

SEQ ID NO: 1106766 - RNA, 23 nt, Human
agugaugucacccacagacaagg

SEQ ID NO: 1106767 - RNA, 22 nt, Human
guguuucccuggcacaagaacc

SEQ ID NO: 1106768 - RNA, 22 nt, Human
uaccaggagcccccuucugguc

SEQ ID NO: 1106769 - RNA, 22 nt, Human
auuugugggacuauaaugcagg

SEQ ID NO: 1106770 - RNA, 22 nt, Human
cuuuacuucagcaagcuuuccu

SEQ ID NO: 1106771 - RNA, 22 nt, Human
uagugucucuuccuguuugaaa

SEQ ID NO: 1106772 - RNA, 22 nt, Human
acuagaaacuaauggauuauua

SEQ ID NO: 1106773 - RNA, 22 nt, Human
uaaguauguuagaaaaucaagu

SEQ ID NO: 1106774 - RNA, 22 nt, Human
uuuacagcuacuguccuauuuc

SEQ ID NO: 1106775 - RNA, 22 nt, Human
acagauccugguuacagccauu

SEQ ID NO: 1106776 - RNA, 22 nt, Human
aagucauugguagcuugauagg

SEQ ID NO: 1106777 - RNA, 22 nt, Human
gcuuccaaugcuucuaucacau

SEQ ID NO: 1106778 - RNA, 22 nt, Human
acaguccuguacaggccauauc

SEQ ID NO: 1106779 - RNA, 22 nt, Human
aacaguaugugagauuuacaca

SEQ ID NO: 1106780 - RNA, 22 nt, Human
cauucauaggaggagaugauua

SEQ ID NO: 1106781 - RNA, 22 nt, Human
agcaaauaauugucuuugaggg

SEQ ID NO: 1106782 - RNA, 18 nt, Human
guagauccuugagcuacc

SEQ ID NO: 1106783 - RNA, 22 nt, Human
gccugagauucccggagccgug

SEQ ID NO: 1106784 - RNA, 22 nt, Human
cagaguccugcaccagcuccag

SEQ ID NO: 1106785 - RNA, 22 nt, Human
uguacauacauagauauacaca

SEQ ID NO: 1106786 - RNA, 22 nt, Human
uucagcacuggacagcgagucu

SEQ ID NO: 1106787 - RNA, 22 nt, Human
uuacuguagcuugacauauguc

SEQ ID NO: 1106788 - RNA, 22 nt, Human
uucuuucugggguccuucggcu

SEQ ID NO: 1106789 - RNA, 22 nt, Human
uuuccuacugcccuauacacac

SEQ ID NO: 1106790 - RNA, 22 nt, Human
auguaagagcuuugcagggaaa

SEQ ID NO: 1106791 - RNA, 21 nt, Human
uaaaagaugacaagacagcuc

SEQ ID NO: 1106792 - RNA, 22 nt, Human
uugcuauuuugagagucauagu

SEQ ID NO: 1106793 - RNA, 22 nt, Human
guccaucuaaguauccagccug

SEQ ID NO: 1106794 - RNA, 22 nt, Human
aaauugaauuugggaaacauug

SEQ ID NO: 1106795 - RNA, 22 nt, Human
ucguuaaucagcaccagaauuc

SEQ ID NO: 1106796 - RNA, 22 nt, Human
auuagguaguauaaucuuuguu

SEQ ID NO: 1106797 - RNA, 18 nt, Human
acagggagggcgcugggg

SEQ ID NO: 1106798 - RNA, 22 nt, Human
ucuuugcagaauuuaacuuugc

SEQ ID NO: 1106799 - RNA, 22 nt, Human
uucuguuuauaauuugcaguug

SEQ ID NO: 1106800 - RNA, 22 nt, Human
agaguuuacagaaauaagcugu

SEQ ID NO: 1106801 - RNA, 20 nt, Human
caucaacaccuugucagccu

SEQ ID NO: 1106802 - RNA, 22 nt, Human
gaguaauuuucuuaaaacauca

SEQ ID NO: 1106803 - RNA, 22 nt, Human
ugauuugaauuuuaaaacacug

SEQ ID NO: 1106804 - RNA, 22 nt, Human
aaauugcauuuuaaagguagau

SEQ ID NO: 1106805 - RNA, 23 nt, Human
uuaagacuggcugaacuuaguag

SEQ ID NO: 1106806 - RNA, 19 nt, Human
auagaguagaguaucuguu

SEQ ID NO: 1106807 - RNA, 22 nt, Human
auauacacuguuucaguugaag

SEQ ID NO: 1106808 - RNA, 22 nt, Human
uuauuuaaaauguagguuggga

SEQ ID NO: 1106809 - RNA, 22 nt, Human
aagagagaacucccuucgccag

SEQ ID NO: 1106810 - RNA, 22 nt, Human
acuucccacugcagugacugag

SEQ ID NO: 1106811 - RNA, 22 nt, Human
uuagcacugucugguuaucuug

SEQ ID NO: 1106812 - RNA, 22 nt, Human
ugaauagagcugcaguggacau

SEQ ID NO: 1106813 - RNA, 22 nt, Human
augaugaagcaugguuacacug

SEQ ID NO: 1106814 - RNA, 22 nt, Human
uuucuacacuucgugguguuuu

SEQ ID NO: 1106815 - RNA, 22 nt, Human
guuauucuauuaaugugauugu

SEQ ID NO: 1106816 - RNA, 22 nt, Human
uaucuuugguagcuuuccuaag

SEQ ID NO: 1106817 - RNA, 22 nt, Human
gagaugaagaggcccuuggagu

SEQ ID NO: 1106818 - RNA, 22 nt, Human
gauuugucuauauucaaauaug

SEQ ID NO: 1106819 - RNA, 22 nt, Human
gauucugaaauuaacagacugg

SEQ ID NO: 1106820 - RNA, 22 nt, Human
uuuuaauccucuugguaucuua

SEQ ID NO: 1106821 - RNA, 22 nt, Human
uauacuacgcaccaaacaaagg

SEQ ID NO: 1106822 - RNA, 22 nt, Human
acauauuuugaaagcuuucuaa

SEQ ID NO: 1106823 - RNA, 22 nt, Human
auagacacagcuaugauuugag

SEQ ID NO: 1106824 - RNA, 22 nt, Human
cauuuagaagucuuagaacuau

SEQ ID NO: 1106825 - RNA, 22 nt, Human
uuggaggaagcucaugggggau

SEQ ID NO: 1106826 - RNA, 22 nt, Human
ggauguuuauccuaucuuaguu

SEQ ID NO: 1106827 - RNA, 22 nt, Human
cuccagauuccguuuauucagg

SEQ ID NO: 1106828 - RNA, 22 nt, Human
uuaguguccagaguuuuuauua

SEQ ID NO: 1106829 - RNA, 22 nt, Human
uuucucggcagagaugaugggc

SEQ ID NO: 1106830 - RNA, 22 nt, Human
uuucucuuucaaucugcaguac

SEQ ID NO: 1106831 - RNA, 22 nt, Human
augaaacucuagcuuucagcac

SEQ ID NO: 1106832 - RNA, 22 nt, Human
cucaaaauccauaaaaucaggu

SEQ ID NO: 1106833 - RNA, 22 nt, Human
acacaucagaaauaugaaugag

SEQ ID NO: 1106834 - RNA, 22 nt, Human
aaggauuuuuggaaugagaugg

SEQ ID NO: 1106835 - RNA, 22 nt, Human
guggcauuugggagaugcgugg

SEQ ID NO: 1106836 - RNA, 22 nt, Human
aucuaugugggaaucauaauag

SEQ ID NO: 1106837 - RNA, 22 nt, Human
acauucuacaguuaaccauuag

SEQ ID NO: 1106838 - RNA, 18 nt, Human
ggaaaaggagugucuagc

SEQ ID NO: 1106839 - RNA, 20 nt, Human
acagaugaggaugcggaggc

SEQ ID NO: 1106840 - RNA, 22 nt, Human
guuauacuuaugugcaaaaaua

SEQ ID NO: 1106841 - RNA, 22 nt, Human
cucacucaguuuuuaguucauc

SEQ ID NO: 1106842 - RNA, 22 nt, Human
agacuucucuaacuugaggacc

SEQ ID NO: 1106843 - RNA, 20 nt, Human
ucucuaacaugaaugcuauc

SEQ ID NO: 1106844 - RNA, 22 nt, Human
ccagaucccuguuugccucugg

SEQ ID NO: 1106845 - RNA, 22 nt, Human
uuccagaacaauguggacguau

SEQ ID NO: 1106846 - RNA, 23 nt, Human
cuuuccuuucuuugacacccagc

SEQ ID NO: 1106847 - RNA, 22 nt, Human
uggcacagcuugucauaaacuc

SEQ ID NO: 1106848 - RNA, 22 nt, Human
uaguuacuuuugcucuucauua

SEQ ID NO: 1106849 - RNA, 22 nt, Human
caauaauugcuuuccagaguua

SEQ ID NO: 1106850 - RNA, 22 nt, Human
gcucccugguauugcugccacu

SEQ ID NO: 1106851 - RNA, 22 nt, Human
uuuguucaccuagcaaacuuuu

SEQ ID NO: 1106852 - RNA, 22 nt, Human
cauaacuugguguuggaaacug

SEQ ID NO: 1106853 - RNA, 22 nt, Human
caguuuuaugaaugcuuauuag

SEQ ID NO: 1106854 - RNA, 22 nt, Human
uuauugagcacauaguaugugg

SEQ ID NO: 1106855 - RNA, 19 nt, Human
ucaaagucugagucacuuu

SEQ ID NO: 1106856 - RNA, 22 nt, Human
accuuuaugaaacagcugucgu

SEQ ID NO: 1106857 - RNA, 22 nt, Human
guucuccaggggcuguucaucu

SEQ ID NO: 1106858 - RNA, 22 nt, Human
uaaagacaauuucgagcuguag

SEQ ID NO: 1106859 - RNA, 22 nt, Human
auaucuaggcugaauguaaaau

SEQ ID NO: 1106860 - RNA, 22 nt, Human
agaguuauccuguccuagggga

SEQ ID NO: 1106861 - RNA, 22 nt, Human
agagccuguucggaggcgcccc

SEQ ID NO: 1106862 - RNA, 22 nt, Human
uauucacaaaaugagguccuca

SEQ ID NO: 1106863 - RNA, 22 nt, Human
agaacauaucuguuuucuaacu

SEQ ID NO: 1106864 - RNA, 20 nt, Human
uuucacaaugaacaugucuc

SEQ ID NO: 1106865 - RNA, 22 nt, Human
auccuaaagcagacagcagguu

SEQ ID NO: 1106866 - RNA, 22 nt, Human
aucaacuuguccuugauguuaa

SEQ ID NO: 1106867 - RNA, 22 nt, Human
caacuuuagaccccaaguagcu

SEQ ID NO: 1106868 - RNA, 22 nt, Human
aacagaaaucauuuagggcucu

SEQ ID NO: 1106869 - RNA, 22 nt, Human
guucacauccuugugaggauuu

SEQ ID NO: 1106870 - RNA, 21 nt, Human
uuccuggaggcagaaacguga

SEQ ID NO: 1106871 - RNA, 22 nt, Human
caugggaauaaaguuauuucaa

SEQ ID NO: 1106872 - RNA, 22 nt, Human
ugucauggacuggauuucugcu

SEQ ID NO: 1106873 - RNA, 22 nt, Human
cuucucuuggguguggugucuu

SEQ ID NO: 1106874 - RNA, 22 nt, Human
gguuauuaguuucaccuggacu

SEQ ID NO: 1106875 - RNA, 22 nt, Human
auagcuuugagggcuccuuagg

SEQ ID NO: 1106876 - RNA, 22 nt, Human
agauugucauugacgaugagca

SEQ ID NO: 1106877 - RNA, 22 nt, Human
auacaugugugugcauacaugu

SEQ ID NO: 1106878 - RNA, 22 nt, Human
uuucuucucacccaggacagag

SEQ ID NO: 1106879 - RNA, 22 nt, Human
gaagcgugcagguccguauacu

SEQ ID NO: 1106880 - RNA, 22 nt, Human
auguuugaaauuguaaguauau

SEQ ID NO: 1106881 - RNA, 22 nt, Human
ucucauuuacuuccacaggcug

SEQ ID NO: 1106882 - RNA, 21 nt, Human
acugaacuuguguucuagagg

SEQ ID NO: 1106883 - RNA, 22 nt, Human
cuagaaguuuggguccauuaag

SEQ ID NO: 1106884 - RNA, 22 nt, Human
cuucauuaaugucuauaaguuu

SEQ ID NO: 1106885 - RNA, 22 nt, Human
ggagcgugcacuccaggcccuu

SEQ ID NO: 1106886 - RNA, 22 nt, Human
uagauaccugcuggaccucauu

SEQ ID NO: 1106887 - RNA, 22 nt, Human
cgucauuuguaaaugaucaaga

SEQ ID NO: 1106888 - RNA, 21 nt, Human
ugcauauauaagugcauacac

SEQ ID NO: 1106889 - RNA, 21 nt, Human
uaccaagaaguuugggaaagc

SEQ ID NO: 1106890 - RNA, 22 nt, Human
cuucaguucuaaaguagaaugu

SEQ ID NO: 1106891 - RNA, 22 nt, Human
cagaugaaguaggugacgagca

SEQ ID NO: 1106892 - RNA, 22 nt, Human
acuuuucuuaucagaaaggcca

SEQ ID NO: 1106893 - RNA, 22 nt, Human
agagacauagcacaguuuuucg

SEQ ID NO: 1106894 - RNA, 22 nt, Human
ccagacuggggcuccuugaggg

SEQ ID NO: 1106895 - RNA, 22 nt, Human
agcauucuguggucuucuaugg

SEQ ID NO: 1106896 - RNA, 19 nt, Human
auacacguguauacauaca

SEQ ID NO: 1106897 - RNA, 22 nt, Human
gcagagcugucuaagucacuuc

SEQ ID NO: 1106898 - RNA, 22 nt, Human
acagugcugaucuagacugacc

SEQ ID NO: 1106899 - RNA, 22 nt, Human
uuugaaaggagcuuuauccaga

SEQ ID NO: 1106900 - RNA, 22 nt, Human
aucauuaacccuugaugcuggg

SEQ ID NO: 1106901 - RNA, 22 nt, Human
ucauaggaguagcagugagagg

SEQ ID NO: 1106902 - RNA, 22 nt, Human
aagugucuucugauggggugug

SEQ ID NO: 1106903 - RNA, 22 nt, Human
ucauuguuucugcuuuucauga

SEQ ID NO: 1106904 - RNA, 22 nt, Human
uaugccuaccuccaaaauauau

SEQ ID NO: 1106905 - RNA, 22 nt, Human
uacugaaagagugguggacucu

SEQ ID NO: 1106906 - RNA, 22 nt, Human
auguaacauaugugaucgcauu

SEQ ID NO: 1106907 - RNA, 22 nt, Human
agaaaucugacugcugugcaca

SEQ ID NO: 1106908 - RNA, 22 nt, Human
ucauuacaagauuuccaauuug

SEQ ID NO: 1106909 - RNA, 22 nt, Human
aggauaauaauaaucucguuua

SEQ ID NO: 1106910 - RNA, 22 nt, Human
uacauuguguuaaaacagaaga

SEQ ID NO: 1106911 - RNA, 22 nt, Human
cuucauuuggcaggcuggccuc

SEQ ID NO: 1106912 - RNA, 22 nt, Human
gaucgauucagugugccuaccc

SEQ ID NO: 1106913 - RNA, 22 nt, Human
caaacauuuguuggaaccccug

SEQ ID NO: 1106914 - RNA, 22 nt, Human
aaacaucuucucuugauucuuu

SEQ ID NO: 1106915 - RNA, 22 nt, Human
uuuuguguugccauguuaagca

SEQ ID NO: 1106916 - RNA, 22 nt, Human
gagcuguucugugauugaucua

SEQ ID NO: 1106917 - RNA, 22 nt, Human
ugacauuugagagagauauaca

SEQ ID NO: 1106918 - RNA, 22 nt, Human
guggauggagcuggaagccauu

SEQ ID NO: 1106919 - RNA, 22 nt, Human
gagucgagcagaaagccgucgg

SEQ ID NO: 1106920 - RNA, 22 nt, Human
gauguauagcuuuaacugaccc

SEQ ID NO: 1106921 - RNA, 22 nt, Human
aguuuacccacuguugaaauua

SEQ ID NO: 1106922 - RNA, 21 nt, Human
ucacuagugccuucugucauu

SEQ ID NO: 1106923 - RNA, 22 nt, Human
acugauuucagggaugagaaga

SEQ ID NO: 1106924 - RNA, 22 nt, Human
auauaugaagaagucuugauua

SEQ ID NO: 1106925 - RNA, 22 nt, Human
uuuggcaagcgaguacuuucug

SEQ ID NO: 1106926 - RNA, 22 nt, Human
acauagcuuaaaugagaagaua

SEQ ID NO: 1106927 - RNA, 22 nt, Human
cucagugaauuggaggauggcc

SEQ ID NO: 1106928 - RNA, 22 nt, Human
augcuacauuuugguuuauaaa

SEQ ID NO: 1106929 - RNA, 22 nt, Human
agauaaaguccaaacuguguag

SEQ ID NO: 1106930 - RNA, 22 nt, Human
agucaguaugacuuauaguucu

SEQ ID NO: 1106931 - RNA, 22 nt, Human
gucuuuuuuacaccuuacauca

SEQ ID NO: 1106932 - RNA, 22 nt, Human
uaaagugaaguucagaauggcu

SEQ ID NO: 1106933 - RNA, 22 nt, Human
uuaaggaacuugucuuucucuu

SEQ ID NO: 1106934 - RNA, 22 nt, Human
auccauuuuuucagaaugcucu

SEQ ID NO: 1106935 - RNA, 22 nt, Human
uuuuucaagacaaccugcaugu

SEQ ID NO: 1106936 - RNA, 22 nt, Human
aauggcaaaguguuuucauacc

SEQ ID NO: 1106937 - RNA, 22 nt, Human
auauaccucauucuuugagugc

SEQ ID NO: 1106938 - RNA, 22 nt, Human
uuguauuaaaauguguuucugu

SEQ ID NO: 1106939 - RNA, 22 nt, Human
cucugccagccaaagucaucac

SEQ ID NO: 1106940 - RNA, 22 nt, Human
uuuccucacacagaagaucuug

SEQ ID NO: 1106941 - RNA, 22 nt, Human
aagcaauucacaguucacuuaa

SEQ ID NO: 1106942 - RNA, 22 nt, Human
ucagauggaaugaugccacugc

SEQ ID NO: 1106943 - RNA, 22 nt, Human
aucauccauggcugaucauaaa

SEQ ID NO: 1106944 - RNA, 22 nt, Human
aauugguuugaauaaauaaaga

SEQ ID NO: 1106945 - RNA, 22 nt, Human
auuccucagcaggccuuuuguu

SEQ ID NO: 1106946 - RNA, 22 nt, Human
uauuucagcucuuuggauuauc

SEQ ID NO: 1106947 - RNA, 22 nt, Human
uguuugcucugacuaucuugcg

SEQ ID NO: 1106948 - RNA, 22 nt, Human
uuucacauacaguguauaguag

SEQ ID NO: 1106949 - RNA, 22 nt, Human
uauaugcagauuuucaucaucg

SEQ ID NO: 1106950 - RNA, 22 nt, Human
uuacuaguggagaaacugaggc

SEQ ID NO: 1106951 - RNA, 19 nt, Human
acaguuugggaaaugagca

SEQ ID NO: 1106952 - RNA, 22 nt, Human
gauggaggagauggcagggugc

SEQ ID NO: 1106953 - RNA, 22 nt, Human
uuacaguuuacauaagaauugu

SEQ ID NO: 1106954 - RNA, 22 nt, Human
gagguauaguucuauuagauga

SEQ ID NO: 1106955 - RNA, 22 nt, Human
uaucugucgggagucuuccgga

SEQ ID NO: 1106956 - RNA, 22 nt, Human
auuauguagcuaaaaauugugu

SEQ ID NO: 1106957 - RNA, 22 nt, Human
aaacucuacauggucgcaaaaa

SEQ ID NO: 1106958 - RNA, 22 nt, Human
agagacuguaaugagagguaca

SEQ ID NO: 1106959 - RNA, 22 nt, Human
gccaggaugacuauacaacagc

SEQ ID NO: 1106960 - RNA, 22 nt, Human
uuucucagccuccuugcuggag

SEQ ID NO: 1106961 - RNA, 22 nt, Human
guucucucagcgauagugaugg

SEQ ID NO: 1106962 - RNA, 22 nt, Human
guuuccaagucucucaacaccc

SEQ ID NO: 1106963 - RNA, 23 nt, Human
cuguuauauggguguuaugugcu

SEQ ID NO: 1106964 - RNA, 22 nt, Human
auuuccagcagcauauuugucu

SEQ ID NO: 1106965 - RNA, 22 nt, Human
aguuauguccucagcaaaucaa

SEQ ID NO: 1106966 - RNA, 22 nt, Human
gcagcucacagucuccgccauc

SEQ ID NO: 1106967 - RNA, 22 nt, Human
ucuuugcauggacauguguuuu

SEQ ID NO: 1106968 - RNA, 22 nt, Human
auguucaaguaccuuugugucu

SEQ ID NO: 1106969 - RNA, 22 nt, Human
auguacauuauucgagugaugg

SEQ ID NO: 1106970 - RNA, 22 nt, Human
caaauacaaauacgggcagcuu

SEQ ID NO: 1106971 - RNA, 22 nt, Human
gaauguuaaugcacuucuagcu

SEQ ID NO: 1106972 - RNA, 22 nt, Human
auuauugcaagcagugaaggga

SEQ ID NO: 1106973 - RNA, 22 nt, Human
gggcuuuaggggccagugacca

SEQ ID NO: 1106974 - RNA, 22 nt, Human
auggaguugagcucuguugucc

SEQ ID NO: 1106975 - RNA, 20 nt, Human
cucuuuucacucucaguggu

SEQ ID NO: 1106976 - RNA, 22 nt, Human
cuauacagcagcuuacuaguua

SEQ ID NO: 1106977 - RNA, 22 nt, Human
aucauugaguaaaaugaauaca

SEQ ID NO: 1106978 - RNA, 22 nt, Human
uuguacaaauaggaaccucuga

SEQ ID NO: 1106979 - RNA, 22 nt, Human
ucacuguuaauaaauagcaaag

SEQ ID NO: 1106980 - RNA, 22 nt, Human
agcuaguauuucauugaggauu

SEQ ID NO: 1106981 - RNA, 22 nt, Human
guggcauuuuagaacagcugac

SEQ ID NO: 1106982 - RNA, 22 nt, Human
uccagagaacgaugaaagcugg

SEQ ID NO: 1106983 - RNA, 22 nt, Human
uuucuacauuuguaaccagauu

SEQ ID NO: 1106984 - RNA, 22 nt, Human
acaugacagugacuuuauaaga

SEQ ID NO: 1106985 - RNA, 22 nt, Human
aggucuacaugcuuaauauauc

SEQ ID NO: 1106986 - RNA, 22 nt, Human
uugcaucagcaggcauaauugg

SEQ ID NO: 1106987 - RNA, 22 nt, Human
ugguaaaugucuaacaaucacu

SEQ ID NO: 1106988 - RNA, 22 nt, Human
auucagaaauagaaaauuugau

SEQ ID NO: 1106989 - RNA, 22 nt, Human
ugcccguucauucauacuuaac

SEQ ID NO: 1106990 - RNA, 22 nt, Human
ugcugcuuguuuuguaaauaaa

SEQ ID NO: 1106991 - RNA, 22 nt, Human
ugcaagagcccaaacuauauac

SEQ ID NO: 1106992 - RNA, 22 nt, Human
cucaggucuuaguucugucauc

SEQ ID NO: 1106993 - RNA, 22 nt, Human
ugagaauacugcauuguuagga

SEQ ID NO: 1106994 - RNA, 22 nt, Human
uaaucuuagacauguauuuuuc

SEQ ID NO: 1106995 - RNA, 22 nt, Human
ugcaauuagcguauuaguuuau

SEQ ID NO: 1106996 - RNA, 22 nt, Human
aaucuguugucaggaauccaca

SEQ ID NO: 1106997 - RNA, 22 nt, Human
uucgcuuugcccguugucauuu

SEQ ID NO: 1106998 - RNA, 22 nt, Human
uuguaagacuguagaaugcaaa

SEQ ID NO: 1106999 - RNA, 22 nt, Human
augaaaacagccuccugugaua

SEQ ID NO: 1107000 - RNA, 22 nt, Human
ugaaaugccuaugaagucagga

SEQ ID NO: 1107001 - RNA, 22 nt, Human
caucuuuguuuuggauauaauc

SEQ ID NO: 1107002 - RNA, 20 nt, Human
cuuguuaaauaugcagguag

SEQ ID NO: 1107003 - RNA, 22 nt, Human
gcuuuggaaauauagacucaag

SEQ ID NO: 1107004 - RNA, 22 nt, Human
aaugaaacuaguagaaucuuug

SEQ ID NO: 1107005 - RNA, 22 nt, Human
cacucucacaugcccugucagu

SEQ ID NO: 1107006 - RNA, 22 nt, Human
ucuuuugagggccagaggaaga

SEQ ID NO: 1107007 - RNA, 22 nt, Human
acucuguuugcagguagcucag

SEQ ID NO: 1107008 - RNA, 21 nt, Human
uugauuuagcagaucuagcug

SEQ ID NO: 1107009 - RNA, 22 nt, Human
uuagacaucaagaagccaaugu

SEQ ID NO: 1107010 - RNA, 22 nt, Human
gucguucucugccagggcguug

SEQ ID NO: 1107011 - RNA, 22 nt, Human
cagaaagugauuugcuauucca

SEQ ID NO: 1107012 - RNA, 22 nt, Human
uguucauaucauuuugaaagcu

SEQ ID NO: 1107013 - RNA, 21 nt, Human
guucaauagcucuuugaaugc

SEQ ID NO: 1107014 - RNA, 22 nt, Human
acaguaaucugggaacuuguua

SEQ ID NO: 1107015 - RNA, 22 nt, Human
aauguuaaguuuagauuauaac

SEQ ID NO: 1107016 - RNA, 22 nt, Human
gaaacauuuguugaguacuugc

SEQ ID NO: 1107017 - RNA, 22 nt, Human
aagauuuaccacuuuauucaag

SEQ ID NO: 1107018 - RNA, 22 nt, Human
cagaggauauaugguuuguaug

SEQ ID NO: 1107019 - RNA, 22 nt, Human
uauuacaguucgaguuucuagg

SEQ ID NO: 1107020 - RNA, 22 nt, Human
caagacuucaccgcucugugcu

SEQ ID NO: 1107021 - RNA, 22 nt, Human
aauggcuguucucugugauugg

SEQ ID NO: 1107022 - RNA, 22 nt, Human
uaaaguuggaccugauuuuauu

SEQ ID NO: 1107023 - RNA, 22 nt, Human
cugcuuuaaaacugauacauga

SEQ ID NO: 1107024 - RNA, 22 nt, Human
ucuaaacuuguaaacaagcaua

SEQ ID NO: 1107025 - RNA, 18 nt, Human
cuacauucauaggaaagg

SEQ ID NO: 1107026 - RNA, 22 nt, Human
uuugacaacugugcaguuugua

SEQ ID NO: 1107027 - RNA, 22 nt, Human
gauacuuuguggaauccuggau

SEQ ID NO: 1107028 - RNA, 22 nt, Human
uuuguaguuguggaugcugaag

SEQ ID NO: 1107029 - RNA, 22 nt, Human
aaauuaacuaucacuuuuguga

SEQ ID NO: 1107030 - RNA, 22 nt, Human
uuacaguuaaugugacuaacca

SEQ ID NO: 1107031 - RNA, 22 nt, Human
uggauaaaaugacauuaccuga

SEQ ID NO: 1107032 - RNA, 22 nt, Human
aacuuucugaaaagcuugauca

SEQ ID NO: 1107033 - RNA, 22 nt, Human
ugcaaaaagagcgaggagcccu

SEQ ID NO: 1107034 - RNA, 22 nt, Human
acaacuuuaauggguuucagcu

SEQ ID NO: 1107035 - RNA, 22 nt, Human
uauccaaaggaacaaucacagc

SEQ ID NO: 1107036 - RNA, 22 nt, Human
caagauauguccuguuacuaag

SEQ ID NO: 1107037 - RNA, 22 nt, Human
gagagaagggggauaugagccu

SEQ ID NO: 1107038 - RNA, 21 nt, Human
cuuuggcaagggagaagucac

SEQ ID NO: 1107039 - RNA, 22 nt, Human
ucuuucagaaacuuugucugcg

SEQ ID NO: 1107040 - RNA, 22 nt, Human
cauagacauugauagguuauau

SEQ ID NO: 1107041 - RNA, 21 nt, Human
acucugaaaauuaauaguuau

SEQ ID NO: 1107042 - RNA, 22 nt, Human
aucauccuagaaggaagcuagg

SEQ ID NO: 1107043 - RNA, 22 nt, Human
gaaugcuggcuuacaggcaguu

SEQ ID NO: 1107044 - RNA, 22 nt, Human
gguuauuguggagaaguuccgg

SEQ ID NO: 1107045 - RNA, 22 nt, Human
uucucuucacagggaucauccu

SEQ ID NO: 1107046 - RNA, 22 nt, Human
auucugcugccuaguuuaugaa

SEQ ID NO: 1107047 - RNA, 22 nt, Human
augugaaagagguguucagugg

SEQ ID NO: 1107048 - RNA, 22 nt, Human
uaagaaacauuuuuaugacagu

SEQ ID NO: 1107049 - RNA, 22 nt, Human
auauguggcauuauuucugagg

SEQ ID NO: 1107050 - RNA, 17 nt, Human
uagauuaaacacggcca

SEQ ID NO: 1107051 - RNA, 22 nt, Human
ugggaagauaugagugaccaac

SEQ ID NO: 1107052 - RNA, 22 nt, Vaccinia virus
acaucgauucccauaugauguu

SEQ ID NO: 1107053 - RNA, 22 nt, Vaccinia virus
gaaaguguaaagacaacgaaua

SEQ ID NO: 1107054 - RNA, 22 nt, Vaccinia virus
uguccgggaacauacgcuucca

SEQ ID NO: 1107055 - RNA, 22 nt, Vaccinia virus
gcuuugaguuuuguugaaucga

SEQ ID NO: 1107056 - RNA, 20 nt, Vaccinia virus
ucgguugcaccuucagaugc

SEQ ID NO: 1107057 - RNA, 22 nt, Human
acacaucagaaauaugaaugag

SEQ ID NO: 1107058 - RNA, 22 nt, Human
uauucacaaaaugagguccuca

SEQ ID NO: 1107059 - RNA, 22 nt, Human
uggaucuugaugcuccaagagu

SEQ ID NO: 1107060 - RNA, 22 nt, Human
uucaguaagcacuucuagagcu

SEQ ID NO: 1107061 - RNA, 22 nt, Human
cagaaccaggaacugauggaga

SEQ ID NO: 1107062 - RNA, 20 nt, Human
uuucacaaugaacaugucuc

SEQ ID NO: 1107063 - RNA, 22 nt, Human
caguuuuaugaaugcuuauuag

SEQ ID NO: 1107064 - RNA, 22 nt, Human
aucuucaaagcacaucguuugu

SEQ ID NO: 1107065 - RNA, 22 nt, Human
augcauaucuccuaucuccuca

SEQ ID NO: 1107066 - RNA, 22 nt, Human
ugcaaaaagagcgaggagcccu

SEQ ID NO: 1107067 - RNA, 22 nt, Human
ggucagugccuaucaugugggc

SEQ ID NO: 1107068 - RNA, 17 nt, Human
ucugagaaugcuggagg

SEQ ID NO: 1107069 - RNA, 22 nt, Human
augaaaacagccuccugugaua

SEQ ID NO: 1107070 - RNA, 22 nt, Human
uucuuuuaauuucugucugcag

SEQ ID NO: 1107071 - RNA, 22 nt, Human
auucugcugccuaguuuaugaa

SEQ ID NO: 1107072 - RNA, 22 nt, Human
cauuguuggcagagggacagag

SEQ ID NO: 1107073 - RNA, 22 nt, Human
uguguacauguaucaacuaucg

SEQ ID NO: 1107074 - RNA, 22 nt, Human
guuuuguucaugaacauugggu

SEQ ID NO: 1107075 - RNA, 22 nt, Human
uucacauaaucugcagcaagcg

SEQ ID NO: 1107076 - RNA, 22 nt, Human
auuguauacaagcuuaauuguu

SEQ ID NO: 1107077 - RNA, 18 nt, Human
ucugaaggaaugauucca

SEQ ID NO: 1107078 - RNA, 19 nt, Human
auagaguagaguaucuguu

SEQ ID NO: 1107079 - RNA, 22 nt, Human
ccagagagggcgccaccuggag

SEQ ID NO: 1107080 - RNA, 22 nt, Human
aacacaguuucugcauugguag

SEQ ID NO: 1107081 - RNA, 22 nt, Human
aacuagaaagaacauauuucca

SEQ ID NO: 1107082 - RNA, 22 nt, Human
cauagacauugauagguuauau

SEQ ID NO: 1107083 - RNA, 22 nt, Human
cugguggaauggcagagggaac

SEQ ID NO: 1107084 - RNA, 22 nt, Human
cuuuggaaaaauaccuggcaua

SEQ ID NO: 1107085 - RNA, 22 nt, Human
gugauuucagguuuuucauacu

SEQ ID NO: 1107086 - RNA, 22 nt, Human
ggauguggaccuugccugguga

SEQ ID NO: 1107087 - RNA, 22 nt, Human
aucauugaguaaaaugaauaca

SEQ ID NO: 1107088 - RNA, 21 nt, Human
ucacuagugccuucugucauu

SEQ ID NO: 1107089 - RNA, 23 nt, Human
agguggagcugugcagccggggc

SEQ ID NO: 1107090 - RNA, 22 nt, Human
ugcccguucauucauacuuaac

SEQ ID NO: 1107091 - RNA, 22 nt, Human
uucagucuuguugaaaacuugg

SEQ ID NO: 1107092 - RNA, 19 nt, Human
auucuucucuuccugcugu

SEQ ID NO: 1107093 - RNA, 22 nt, Human
acauuguugagccucuuguuca

SEQ ID NO: 1107094 - RNA, 22 nt, Human
uagauaccugcuggaccucauu

SEQ ID NO: 1107095 - RNA, 20 nt, Human
acagaugaggaugcggaggc

SEQ ID NO: 1107096 - RNA, 22 nt, Human
gauacuuuguggaauccuggau

SEQ ID NO: 1107097 - RNA, 22 nt, Human
aucauuaacccuugaugcuggg

SEQ ID NO: 1107098 - RNA, 22 nt, Human
aaugauguuuuuaaagaacaua

SEQ ID NO: 1107099 - RNA, 22 nt, Human
gauuuucauuauagcuaguuuc

SEQ ID NO: 1107100 - RNA, 21 nt, Human
ugcauauauaagugcauacac

SEQ ID NO: 1107101 - RNA, 22 nt, Human
uaucuguuuuuacagugucuuu

SEQ ID NO: 1107102 - RNA, 21 nt, Human
cuuuucuagucccagccccgc

SEQ ID NO: 1107103 - RNA, 22 nt, Human
cuucuuaaaguugucacagcug

SEQ ID NO: 1107104 - RNA, 22 nt, Human
cacaauuuccauugagcagcag

SEQ ID NO: 1107105 - RNA, 22 nt, Human
uuucucggcagagaugaugggc

SEQ ID NO: 1107106 - RNA, 22 nt, Human
uuauuuuguagcucugaucuuu

SEQ ID NO: 1107107 - RNA, 22 nt, Human
acucauguccuaggaguaaagc

SEQ ID NO: 1107108 - RNA, 22 nt, Human
cuuuauguuggggugucuuagu

SEQ ID NO: 1107109 - RNA, 22 nt, Human
acuggauucucuuacacagaug

SEQ ID NO: 1107110 - RNA, 22 nt, Human
agagcuauuucuuaaaagcugu

SEQ ID NO: 1107111 - RNA, 22 nt, Human
acauauuuugaaagcuuucuaa

SEQ ID NO: 1107112 - RNA, 22 nt, Human
guaauagucucaaacuccugga

SEQ ID NO: 1107113 - RNA, 22 nt, Human
auuacugaggcaaaguaguuuu

SEQ ID NO: 1107114 - RNA, 22 nt, Human
uagaagaugccuuaaaguugaa

SEQ ID NO: 1107115 - RNA, 20 nt, Human
uauuucugggcaaccauuua

SEQ ID NO: 1107116 - RNA, 22 nt, Human
uagcaggagagaaguuuuaagu

SEQ ID NO: 1107117 - RNA, 22 nt, Human
uuaugcaaaggggccucuuccu

SEQ ID NO: 1107118 - RNA, 22 nt, Human
gugacagaaacagggcuagaau

SEQ ID NO: 1107119 - RNA, 22 nt, Human
uauacuacgcaccaaacaaagg

SEQ ID NO: 1107120 - RNA, 22 nt, Human
uuugccaguauuuuauugauga

SEQ ID NO: 1107121 - RNA, 22 nt, Human
ugagaauacugcauuguuagga

SEQ ID NO: 1107122 - RNA, 23 nt, Human
uuaagacuggcugaacuuaguag

SEQ ID NO: 1107123 - RNA, 22 nt, Human
uaaguauguuagaaaaucaagu

SEQ ID NO: 1107124 - RNA, 22 nt, Human
uugcaucagcaggcauaauugg

SEQ ID NO: 1107125 - RNA, 18 nt, Human
cuacauucauaggaaagg

SEQ ID NO: 1107126 - RNA, 22 nt, Human
uaugccuaccuccaaaauauau

SEQ ID NO: 1107127 - RNA, 22 nt, Human
uacauguacaugcauagguaga

SEQ ID NO: 1107128 - RNA, 23 nt, Human
uagauccuuccaacuacucuuac

SEQ ID NO: 1107129 - RNA, 22 nt, Human
guguuucccuggcacaagaacc

SEQ ID NO: 1107130 - RNA, 22 nt, Human
uucuuuuaauagagauccugug

SEQ ID NO: 1107131 - RNA, 22 nt, Human
auuuccagcagcauauuugucu

SEQ ID NO: 1107132 - RNA, 22 nt, Human
cuugaugaaugaccuggguggu

SEQ ID NO: 1107133 - RNA, 22 nt, Human
acauuuguuucucuagaguagg

SEQ ID NO: 1107134 - RNA, 22 nt, Human
uauuuggugaaucuauggucag

SEQ ID NO: 1107135 - RNA, 22 nt, Human
uucaacaacuugguucaaaugg

SEQ ID NO: 1107136 - RNA, 22 nt, Human
guggaaauuuuaggaucaucuu

SEQ ID NO: 1107137 - RNA, 22 nt, Human
agcuuucuauauaugaguugcu

SEQ ID NO: 1107138 - RNA, 21 nt, Human
acaaauuguuuauauaggaag

SEQ ID NO: 1107139 - RNA, 22 nt, Human
auucauucugaccucaagagaa

SEQ ID NO: 1107140 - RNA, 22 nt, Human
uagugucucuuccuguuugaaa

SEQ ID NO: 1107141 - RNA, 22 nt, Human
cauuuugugcuagacacuaugg

SEQ ID NO: 1107142 - RNA, 22 nt, Human
uuuuccuucugauacuccauuu

SEQ ID NO: 1107143 - RNA, 21 nt, Human
gcucuguguuacaaguugggg

SEQ ID NO: 1107144 - RNA, 22 nt, Human
acugguuuuggaaaucaguaca

SEQ ID NO: 1107145 - RNA, 22 nt, Human
acauucuacaguuaaccauuag

SEQ ID NO: 1107146 - RNA, 22 nt, Human
agaacauaucuguuuucuaacu

SEQ ID NO: 1107147 - RNA, 22 nt, Human
uuuaauuuucugggcccagcag

SEQ ID NO: 1107148 - RNA, 22 nt, Human
aagagagaacucccuucgccag

SEQ ID NO: 1107149 - RNA, 22 nt, Human
ccaggacacgauuuuuagucug

SEQ ID NO: 1107150 - RNA, 22 nt, Human
uguucuuagguauuugacaguc

SEQ ID NO: 1107151 - RNA, 22 nt, Human
aagucauugguagcuugauagg

SEQ ID NO: 1107152 - RNA, 22 nt, Human
ugacauuugagagagauauaca

SEQ ID NO: 1107153 - RNA, 22 nt, Human
uuccaaggcugcuauuuguuuc

SEQ ID NO: 1107154 - RNA, 22 nt, Human
uguuugcucugacuaucuugcg

SEQ ID NO: 1107155 - RNA, 22 nt, Human
ugcacccacuuagcugaaguuc

SEQ ID NO: 1107156 - RNA, 22 nt, Human
aguucaauuguuuuguaaaagu

SEQ ID NO: 1107157 - RNA, 22 nt, Human
uaaaguauaagcauuggaguau

SEQ ID NO: 1107158 - RNA, 22 nt, Human
ucuccucuauuucuguauguau

SEQ ID NO: 1107159 - RNA, 22 nt, Human
gcuuuggaaauauagacucaag

SEQ ID NO: 1107160 - RNA, 22 nt, Human
auauacacuguuucaguugaag

SEQ ID NO: 1107161 - RNA, 22 nt, Human
ccagagaggccuuggcaagaca

SEQ ID NO: 1107162 - RNA, 22 nt, Human
uaaaacuagugguugggacuaa

SEQ ID NO: 1107163 - RNA, 22 nt, Human
uuccagaacaauguggacguau

SEQ ID NO: 1107164 - RNA, 22 nt, Human
auuagguaguauaaucuuuguu

SEQ ID NO: 1107165 - RNA, 22 nt, Human
guuucgucaggcuuauucuauc

SEQ ID NO: 1107166 - RNA, 23 nt, Human
aaauugucguaagguggagaugu

SEQ ID NO: 1107167 - RNA, 22 nt, Human
ucguuauagaacauucuugggu

SEQ ID NO: 1107168 - RNA, 22 nt, Human
ucacaacugggugucuucauca

SEQ ID NO: 1107169 - RNA, 22 nt, Human
acagaauugggguucuugggga

SEQ ID NO: 1107170 - RNA, 22 nt, Human
gagagaagggggauaugagccu

SEQ ID NO: 1107171 - RNA, 23 nt, Human
aaacuacauuuauaguuuuucuc

SEQ ID NO: 1107172 - RNA, 22 nt, Human
aagaauaagaggauuuagaaca

SEQ ID NO: 1107173 - RNA, 22 nt, Human
uuuauacuccacucugcaagcg

SEQ ID NO: 1107174 - RNA, 22 nt, Human
cagaaacacuguauuuagggaa

SEQ ID NO: 1107175 - RNA, 22 nt, Human
ucugagaaugguggauguggug

SEQ ID NO: 1107176 - RNA, 22 nt, Human
augaacaguacaaagcacagac

SEQ ID NO: 1107177 - RNA, 22 nt, Human
augaaaacggaccagagcuauu

SEQ ID NO: 1107178 - RNA, 22 nt, Human
uccaugacagcgugagaguuug

SEQ ID NO: 1107179 - RNA, 22 nt, Human
uacuacauacagaauuuagaga

SEQ ID NO: 1107180 - RNA, 22 nt, Human
uuucauuauaaaaaguuggcuu

SEQ ID NO: 1107181 - RNA, 22 nt, Human
uuuaauuauaucugggcaguua

SEQ ID NO: 1107182 - RNA, 22 nt, Human
uaauucuagauugacauuuuga

SEQ ID NO: 1107183 - RNA, 22 nt, Human
uuuaggaagaguugaguaaauu

SEQ ID NO: 1107184 - RNA, 22 nt, Human
ugugucuuuggcgaugucugga

SEQ ID NO: 1107185 - RNA, 22 nt, Human
uuccaauaaaauguuauuugca

SEQ ID NO: 1107186 - RNA, 21 nt, Human
uaccaagaaguuugggaaagc

SEQ ID NO: 1107187 - RNA, 22 nt, Human
cgaguaauuggaaauuugcuau

SEQ ID NO: 1107188 - RNA, 22 nt, Human
aguuggaagacacccugaaauc

SEQ ID NO: 1107189 - RNA, 22 nt, Human
uuugagaagcauggcuguauuc

SEQ ID NO: 1107190 - RNA, 22 nt, Human
aaauucuguccugaaugccauu

SEQ ID NO: 1107191 - RNA, 22 nt, Human
aaaguaauugugguucuugcca

SEQ ID NO: 1107192 - RNA, 22 nt, Human
uucagcacuggacagcgagucu

SEQ ID NO: 1107193 - RNA, 22 nt, Human
agauaucuuacacuuugaaguu

SEQ ID NO: 1107194 - RNA, 22 nt, Human
aauaguguauuuuucaaaauua

SEQ ID NO: 1107195 - RNA, 19 nt, Human
guuggcacugaaaauggcu

SEQ ID NO: 1107196 - RNA, 18 nt, Human
uuugggauccucuuuucu

SEQ ID NO: 1107197 - RNA, 22 nt, Human
ucuacugagugcugagauuuug

SEQ ID NO: 1107198 - RNA, 22 nt, Human
aaugcugugauuuauuaaguau

SEQ ID NO: 1107199 - RNA, 22 nt, Human
agggagcugcucugcuuccgug

SEQ ID NO: 1107200 - RNA, 22 nt, Human
gcuuucuuuucaagaauguauu

SEQ ID NO: 1107201 - RNA, 22 nt, Human
ccuuugugaauaugcagaaaau

SEQ ID NO: 1107202 - RNA, 22 nt, Human
ggggaagaaauagaacauuuug

SEQ ID NO: 1107203 - RNA, 22 nt, Human
acuuuucuuaucagaaaggcca

SEQ ID NO: 1107204 - RNA, 22 nt, Human
ugauaguaucugauuauuucac

SEQ ID NO: 1107205 - RNA, 22 nt, Human
uagaucuuucacuacuguguag

SEQ ID NO: 1107206 - RNA, 22 nt, Human
gauguaucugagcugcuuaggu

SEQ ID NO: 1107207 - RNA, 22 nt, Human
uuguauuaaaauguguuucugu

SEQ ID NO: 1107208 - RNA, 22 nt, Human
augcaauaguaauucuagucug

SEQ ID NO: 1107209 - RNA, 22 nt, Human
ugugguuuugguucagaaacaa

SEQ ID NO: 1107210 - RNA, 19 nt, Human
ggauaagguuggagugauc

SEQ ID NO: 1107211 - RNA, 22 nt, Human
gauguauagcuuuaacugaccc

SEQ ID NO: 1107212 - RNA, 22 nt, Human
auauaguuggguuucauucuac

SEQ ID NO: 1107213 - RNA, 18 nt, Human
gacaaaaguacagacaga

SEQ ID NO: 1107214 - RNA, 22 nt, Human
caaagaugccaaaaggaagaca

SEQ ID NO: 1107215 - RNA, 22 nt, Human
uucaaacacugcuuugagaggg

SEQ ID NO: 1107216 - RNA, 22 nt, Human
cugaaggacacgugaggagcca

SEQ ID NO: 1107217 - RNA, 22 nt, Human
cagcaguacuucucagagguau

SEQ ID NO: 1107218 - RNA, 22 nt, Human
aaaauuaagugucugggaagcc

SEQ ID NO: 1107219 - RNA, 17 nt, Human
uaaguccuaguuauuuu

SEQ ID NO: 1107220 - RNA, 22 nt, Human
ucuaguuagugguugauacugu

SEQ ID NO: 1107221 - RNA, 22 nt, Human
guggcauuugggagaugcgugg

SEQ ID NO: 1107222 - RNA, 20 nt, Human
uuacagaaaugauguuauuu

SEQ ID NO: 1107223 - RNA, 18 nt, Human
ucuuccaacacugacacc

SEQ ID NO: 1107224 - RNA, 22 nt, Human
ucaguaaaugagcaaaaauuuc

SEQ ID NO: 1107225 - RNA, 22 nt, Human
uuauuuaaaauguagguuggga

SEQ ID NO: 1107226 - RNA, 22 nt, Human
cagacguuggaggaaauauacc

SEQ ID NO: 1107227 - RNA, 22 nt, Human
aucucuguaaaccauaaauuga

SEQ ID NO: 1107228 - RNA, 22 nt, Human
gagagagacauguaaacgcggu

SEQ ID NO: 1107229 - RNA, 22 nt, Human
ugucauauagaauguucuauga

SEQ ID NO: 1107230 - RNA, 22 nt, Human
aguaaaaucaccaucucuuugu

SEQ ID NO: 1107231 - RNA, 22 nt, Human
acauucaugcaccuuccuaucc

SEQ ID NO: 1107232 - RNA, 22 nt, Human
ucagaacauccugguuuaaaau

SEQ ID NO: 1107233 - RNA, 22 nt, Human
gguuauuguggagaaguuccgg

SEQ ID NO: 1107234 - RNA, 22 nt, Human
aagcauuuuagauaaagcauca

SEQ ID NO: 1107235 - RNA, 22 nt, Human
cauucauaggaggagaugauua

SEQ ID NO: 1107236 - RNA, 22 nt, Human
gucuugcacuuaccuaagaacu

SEQ ID NO: 1107237 - RNA, 22 nt, Human
uuaguuuccuguggugugaagu

SEQ ID NO: 1107238 - RNA, 22 nt, Human
aaccauggauuucaguucaccu

SEQ ID NO: 1107239 - RNA, 22 nt, Human
aagcaccuggguuauaucuuag

SEQ ID NO: 1107240 - RNA, 23 nt, Human
cuguuauauggguguuaugugcu

SEQ ID NO: 1107241 - RNA, 22 nt, Human
ucaaagaucagaugguuguagg

SEQ ID NO: 1107242 - RNA, 22 nt, Human
gauuugucuauauucaaauaug

SEQ ID NO: 1107243 - RNA, 22 nt, Human
acaauuucuaauauagaucuua

SEQ ID NO: 1107244 - RNA, 22 nt, Human
uucuacauugugaaguucuuua

SEQ ID NO: 1107245 - RNA, 22 nt, Human
uagauucugacccucuuuuuac

SEQ ID NO: 1107246 - RNA, 18 nt, Human
aaacauggcuuaaaggcu

SEQ ID NO: 1107247 - RNA, 22 nt, Human
ugauuuacaguagugucuaaac

SEQ ID NO: 1107248 - RNA, 18 nt, Human
agguauaugaaucucuuu

SEQ ID NO: 1107249 - RNA, 22 nt, Human
uauggcaagaugacauguucuc

SEQ ID NO: 1107250 - RNA, 22 nt, Human
ucuuugcagaauuuaacuuugc

SEQ ID NO: 1107251 - RNA, 22 nt, Human
uuguuuaaagaacuucugacuu

SEQ ID NO: 1107252 - RNA, 22 nt, Human
auggcuguguuguuccucugaa

SEQ ID NO: 1107253 - RNA, 22 nt, Human
agugucugcgggcagaggagcg

SEQ ID NO: 1107254 - RNA, 22 nt, Human
ugguggcacugacaucagacac

SEQ ID NO: 1107255 - RNA, 22 nt, Human
aauaucuagccuuuagcagcuu

SEQ ID NO: 1107256 - RNA, 22 nt, Human
aagucaauuaguaaacuuggaa

SEQ ID NO: 1107257 - RNA, 22 nt, Human
uuggaaagggauaucuguacuu

SEQ ID NO: 1107258 - RNA, 22 nt, Human
gugauugugaaaacauuaagaa

SEQ ID NO: 1107259 - RNA, 22 nt, Human
caaagaagagauuuacagagcu

SEQ ID NO: 1107260 - RNA, 22 nt, Human
uucagaaagugaaucuuguuau

SEQ ID NO: 1107261 - RNA, 22 nt, Human
agaauguaagaaugcaaagauu

SEQ ID NO: 1107262 - RNA, 22 nt, Human
aaacaucuucucuugauucuuu

SEQ ID NO: 1107263 - RNA, 22 nt, Human
uaaugccuuucuguacuauaug

SEQ ID NO: 1107264 - RNA, 22 nt, Human
uuucuaguggguauucccuguu

SEQ ID NO: 1107265 - RNA, 22 nt, Human
auauaccucauucuuugagugc

SEQ ID NO: 1107266 - RNA, 22 nt, Human
cagcuauuguucuguauaauga

SEQ ID NO: 1107267 - RNA, 22 nt, Human
cauuuagaagucuuagaacuau

SEQ ID NO: 1107268 - RNA, 22 nt, Human
ucucauuuacuuccacaggcug

SEQ ID NO: 1107269 - RNA, 22 nt, Human
uauucauguguuggaaaggaac

SEQ ID NO: 1107270 - RNA, 22 nt, Human
aucauuuaguggggcauuggaa

SEQ ID NO: 1107271 - RNA, 22 nt, Human
ucuaauuuuggcauuuuaaccu

SEQ ID NO: 1107272 - RNA, 21 nt, Human
aucuuaaaaggucuuaacuuu

SEQ ID NO: 1107273 - RNA, 22 nt, Human
aaagaugucauacacauuaaga

SEQ ID NO: 1107274 - RNA, 22 nt, Human
cgggcagugcccagcggggcag

SEQ ID NO: 1107275 - RNA, 22 nt, Human
uuguacaaauaggaaccucuga

SEQ ID NO: 1107276 - RNA, 22 nt, Human
gaauguuauugaacuacgagcu

SEQ ID NO: 1107277 - RNA, 23 nt, Human
cguuuuuuccucagauguucugg

SEQ ID NO: 1107278 - RNA, 22 nt, Human
cuucucaaaguugugaaucagg

SEQ ID NO: 1107279 - RNA, 22 nt, Human
aaggaucauguauauguuuaag

SEQ ID NO: 1107280 - RNA, 20 nt, Human
ucauaugugguuguauacaa

SEQ ID NO: 1107281 - RNA, 22 nt, Human
aagcaacuaaggcaaggaaaug

SEQ ID NO: 1107282 - RNA, 20 nt, Human
ugugguuuuugccaguugaa

SEQ ID NO: 1107283 - RNA, 22 nt, Human
uaagaaacauuuuuaugacagu

SEQ ID NO: 1107284 - RNA, 22 nt, Human
gaaguauuucugaguugcccag

SEQ ID NO: 1107285 - RNA, 22 nt, Human
auucuugauauagauaguuaau

SEQ ID NO: 1107286 - RNA, 22 nt, Human
auuuacucgugcuucauugaau

SEQ ID NO: 1107287 - RNA, 22 nt, Human
uacaucucaucugugcucuccg

SEQ ID NO: 1107288 - RNA, 22 nt, Human
uagcauuuagaacaccuugaga

SEQ ID NO: 1107289 - RNA, 22 nt, Human
uuguaagacuguagaaugcaaa

SEQ ID NO: 1107290 - RNA, 22 nt, Human
uuuccagucucugccuccaagg

SEQ ID NO: 1107291 - RNA, 22 nt, Human
caaucaaugcugcuaguuccuu

SEQ ID NO: 1107292 - RNA, 19 nt, Human
acaguuugggaaaugagca

SEQ ID NO: 1107293 - RNA, 22 nt, Human
uccaagaagcuuacaaucuaau

SEQ ID NO: 1107294 - RNA, 22 nt, Human
auguaugagagauucuuuuauu

SEQ ID NO: 1107295 - RNA, 22 nt, Human
agaguuuacagaaauaagcugu

SEQ ID NO: 1107296 - RNA, 22 nt, Human
uaacuucucugagccucauucc

SEQ ID NO: 1107297 - RNA, 22 nt, Human
uucugauuguuggaggaugcuu

SEQ ID NO: 1107298 - RNA, 22 nt, Human
uuucugugauaggcugcgacgc

SEQ ID NO: 1107299 - RNA, 22 nt, Human
aauacagauggcaugugaagau

SEQ ID NO: 1107300 - RNA, 22 nt, Human
cauaacuugguguuggaaacug

SEQ ID NO: 1107301 - RNA, 22 nt, Human
uugagacacaaggcacaguaag

SEQ ID NO: 1107302 - RNA, 22 nt, Human
uaaaguuggaccugauuuuauu

SEQ ID NO: 1107303 - RNA, 22 nt, Human
aaugagauggaggacucuuaau

SEQ ID NO: 1107304 - RNA, 22 nt, Human
aaggauuuuuggaaugagaugg

SEQ ID NO: 1107305 - RNA, 22 nt, Human
uggcuacauuuauacucucauu

SEQ ID NO: 1107306 - RNA, 22 nt, Human
gaagcgugcagguccguauacu

SEQ ID NO: 1107307 - RNA, 22 nt, Human
caaaugaugcauggcuagugag

SEQ ID NO: 1107308 - RNA, 22 nt, Human
guauuucuuuacauaugcucau

SEQ ID NO: 1107309 - RNA, 22 nt, Human
auguuugaaauuguaaguauau

SEQ ID NO: 1107310 - RNA, 22 nt, Human
uuugaauauacuucaaacaaag

SEQ ID NO: 1107311 - RNA, 22 nt, Human
ugagaugaagugauguaaaaca

SEQ ID NO: 1107312 - RNA, 22 nt, Human
aggaaauuuugaaucagugucu

SEQ ID NO: 1107313 - RNA, 22 nt, Human
aucucccaaauuagccucuuga

SEQ ID NO: 1107314 - RNA, 22 nt, Human
auugaacauuguucuaggaggc

SEQ ID NO: 1107315 - RNA, 22 nt, Human
ucaauuuauguggcuauucauu

SEQ ID NO: 1107316 - RNA, 22 nt, Human
auuuuagagaaacaaacguagg

SEQ ID NO: 1107317 - RNA, 22 nt, Human
uuauuugcccauguuuagcaga

SEQ ID NO: 1107318 - RNA, 22 nt, Human
acauagcuuaaaugagaagaua

SEQ ID NO: 1107319 - RNA, 22 nt, Human
uuuugaauaauucagaaacagc

SEQ ID NO: 1107320 - RNA, 22 nt, Human
ucaugauaauacaggccuucua

SEQ ID NO: 1107321 - RNA, 22 nt, Human
cacuuuuaacaggagaauuccc

SEQ ID NO: 1107322 - RNA, 22 nt, Human
aaaacuuucagggauacagaaa

SEQ ID NO: 1107323 - RNA, 23 nt, Human
acucguggaauucucugcgaucg

SEQ ID NO: 1107324 - RNA, 21 nt, Human
uuccuggaggcagaaacguga

SEQ ID NO: 1107325 - RNA, 18 nt, Human
ucagaggagauaccuaaa

SEQ ID NO: 1107326 - RNA, 22 nt, Human
gacuacaggugugugccaccau

SEQ ID NO: 1107327 - RNA, 22 nt, Human
gcagaagucagaccaucugaau

SEQ ID NO: 1107328 - RNA, 22 nt, Human
cugagauggaguuucgcucuuc

SEQ ID NO: 1107329 - RNA, 22 nt, Human
agaauccuggagaagcuguacc

SEQ ID NO: 1107330 - RNA, 22 nt, Human
cuacauuuacacaguuaggcuu

SEQ ID NO: 1107331 - RNA, 22 nt, Human
aaguuacaggagaaagagauca

SEQ ID NO: 1107332 - RNA, 22 nt, Human
accagagucaauuauuuugcca

SEQ ID NO: 1107333 - RNA, 22 nt, Human
uuuguguuguacuucugugcau

SEQ ID NO: 1107334 - RNA, 22 nt, Human
cauuuacauuuaagguuaauau

SEQ ID NO: 1107335 - RNA, 22 nt, Human
uaaaugaaaggguuuaauuuau

SEQ ID NO: 1107336 - RNA, 22 nt, Human
uuuccacacucacugcacucau

SEQ ID NO: 1107337 - RNA, 22 nt, Human
uacuuucuagcucuccccaguu

SEQ ID NO: 1107338 - RNA, 22 nt, Human
uuauugcuaugaugauguguag

SEQ ID NO: 1107339 - RNA, 22 nt, Human
auuguuacuggguuaauuugga

SEQ ID NO: 1107340 - RNA, 22 nt, Human
ucuaugaaccucugcaaugaca

SEQ ID NO: 1107341 - RNA, 22 nt, Human
ucuuuugagggccagaggaaga

SEQ ID NO: 1107342 - RNA, 22 nt, Human
ccuuuguucacuggagagugga

SEQ ID NO: 1107343 - RNA, 22 nt, Human
cuacuguaguuaaaguuuugua

SEQ ID NO: 1107344 - RNA, 22 nt, Human
uaucuuugguagcuuuccuaag

SEQ ID NO: 1107345 - RNA, 19 nt, Human
cuccacagggauugugauu

SEQ ID NO: 1107346 - RNA, 22 nt, Human
gucacaguggggucacagugug

SEQ ID NO: 1107347 - RNA, 22 nt, Human
agugaaaaccuaaucaugcagu

SEQ ID NO: 1107348 - RNA, 20 nt, Human
uacaauauucccacuuugcu

SEQ ID NO: 1107349 - RNA, 17 nt, Human
ucuggaugucauggaag

SEQ ID NO: 1107350 - RNA, 22 nt, Human
auacuaagcucauuacauuuug

SEQ ID NO: 1107351 - RNA, 22 nt, Human
uuuauccaccuuacccuguucc

SEQ ID NO: 1107352 - RNA, 22 nt, Human
uauaugcagauuuucaucaucg

SEQ ID NO: 1107353 - RNA, 22 nt, Human
augugaaagagguguucagugg

SEQ ID NO: 1107354 - RNA, 22 nt, Human
auuaaauuggacgcugggggaa

SEQ ID NO: 1107355 - RNA, 22 nt, Human
caugugguauugugagauccac

SEQ ID NO: 1107356 - RNA, 22 nt, Human
ucuuugcauggacauguguuuu

SEQ ID NO: 1107357 - RNA, 22 nt, Human
gcucuaugaaccugaaucucac

SEQ ID NO: 1107358 - RNA, 22 nt, Human
cagucucuugcuucauuaguug

SEQ ID NO: 1107359 - RNA, 22 nt, Human
gaaagagaaccugggccuagau

SEQ ID NO: 1107360 - RNA, 22 nt, Human
uaucacauacuucucauccagg

SEQ ID NO: 1107361 - RNA, 22 nt, Human
cuucaguucuaaaguagaaugu

SEQ ID NO: 1107362 - RNA, 20 nt, Human
aaaaacaguaaugcugaaga

SEQ ID NO: 1107363 - RNA, 22 nt, Human
aaugagaauguaagugaagaga

SEQ ID NO: 1107364 - RNA, 22 nt, Human
cauguguauuauucuuguggaa

SEQ ID NO: 1107365 - RNA, 22 nt, Human
gugagcugggugaaugguaggg

SEQ ID NO: 1107366 - RNA, 19 nt, Human
uaugacaaguacuaguucu

SEQ ID NO: 1107367 - RNA, 22 nt, Human
uguuaguauuggcaaauuuguu

SEQ ID NO: 1107368 - RNA, 22 nt, Human
gcuuuugagguccugcucagcc

SEQ ID NO: 1107369 - RNA, 18 nt, Human
aguaaauguuaaauauug

SEQ ID NO: 1107370 - RNA, 22 nt, Human
uuagaaaucaccucugaagauc

SEQ ID NO: 1107371 - RNA, 22 nt, Human
cuaguucugccauucaguguca

SEQ ID NO: 1107372 - RNA, 22 nt, Human
caguauuuaggauuaggagaga

SEQ ID NO: 1107373 - RNA, 22 nt, Human
ccaaaauauuagugcuuaagua

SEQ ID NO: 1107374 - RNA, 19 nt, Human
aaauccaagcucaggccuc

SEQ ID NO: 1107375 - RNA, 22 nt, Human
uucucugaguacguuucagugu

SEQ ID NO: 1107376 - RNA, 22 nt, Human
uuuacaaggcaguuauuuuccu

SEQ ID NO: 1107377 - RNA, 22 nt, Human
agccagugucgugugacaugag

SEQ ID NO: 1107378 - RNA, 22 nt, Human
uaggaaugcagaugcauaauaa

SEQ ID NO: 1107379 - RNA, 22 nt, Human
auguuuguguuucccauucagg

SEQ ID NO: 1107380 - RNA, 20 nt, Human
cuuguuaaauaugcagguag

SEQ ID NO: 1107381 - RNA, 22 nt, Human
gcauuuaaauuugaacuucaga

SEQ ID NO: 1107382 - RNA, 17 nt, Human
cauucuguaaucuuucu

SEQ ID NO: 1107383 - RNA, 22 nt, Human
ucugaauucuuagaauuaaagg

SEQ ID NO: 1107384 - RNA, 22 nt, Human
gagaacuugaacuuuuccucug

SEQ ID NO: 1107385 - RNA, 22 nt, Human
acaugacagugacuuuauaaga

SEQ ID NO: 1107386 - RNA, 22 nt, Human
caagauauguccuguuacuaag

SEQ ID NO: 1107387 - RNA, 22 nt, Human
uguacacauuaagcucuuuaga

SEQ ID NO: 1107388 - RNA, 22 nt, Human
cuaccugguacauagaaauguu

SEQ ID NO: 1107389 - RNA, 22 nt, Human
ucuuuuccuugaugguuaaaua

SEQ ID NO: 1107390 - RNA, 22 nt, Human
uauuuguuucuaguggcagcaa

SEQ ID NO: 1107391 - RNA, 22 nt, Human
cagaugaaguaggugacgagca

SEQ ID NO: 1107392 - RNA, 22 nt, Human
aguucugacucugaaucuggga

SEQ ID NO: 1107393 - RNA, 22 nt, Human
caaauguuugguggcauuuugu

SEQ ID NO: 1107394 - RNA, 22 nt, Human
accuuguuguagguacaaaaga

SEQ ID NO: 1107395 - RNA, 22 nt, Human
uaaaaguuagcuaggacaaagu

SEQ ID NO: 1107396 - RNA, 22 nt, Human
ugcauguuucuguauguuaaug

SEQ ID NO: 1107397 - RNA, 22 nt, Human
auuuacugagguaaauaaacug

SEQ ID NO: 1107398 - RNA, 22 nt, Human
cugaucuuaaguaacauuauuu

SEQ ID NO: 1107399 - RNA, 22 nt, Human
agaaucugcauuuuaacaagau

SEQ ID NO: 1107400 - RNA, 22 nt, Human
augguuuuguccucuuugguuc

SEQ ID NO: 1107401 - RNA, 22 nt, Human
auacaugacucacacauucugc

SEQ ID NO: 1107402 - RNA, 22 nt, Human
guucuucagauuccauuucagu

SEQ ID NO: 1107403 - RNA, 22 nt, Human
aagacacuuucuaaauagaagu

SEQ ID NO: 1107404 - RNA, 22 nt, Human
agaugacuaacauaguauugcu

SEQ ID NO: 1107405 - RNA, 22 nt, Human
uauuuggauagacagggagaug

SEQ ID NO: 1107406 - RNA, 22 nt, Human
uuucacauacaguguauaguag

SEQ ID NO: 1107407 - RNA, 22 nt, Human
cugcaucaguggauaugauggu

SEQ ID NO: 1107408 - RNA, 22 nt, Human
cugcaucacagcaggaggcaca

SEQ ID NO: 1107409 - RNA, 22 nt, Human
acguagcacugagagaugcagg

SEQ ID NO: 1107410 - RNA, 22 nt, Human
gaaaauaguucaucacaaugau

SEQ ID NO: 1107411 - RNA, 22 nt, Human
cuaguauuaagugugaguaaaa

SEQ ID NO: 1107412 - RNA, 22 nt, Human
auuaaugaaacuuugguuaagc

SEQ ID NO: 1107413 - RNA, 22 nt, Human
agugaauuagccuauuuguaaa

SEQ ID NO: 1107414 - RNA, 22 nt, Human
ucuuucagaaacuuugucugcg

SEQ ID NO: 1107415 - RNA, 22 nt, Human
gaauguuaaugcacuucuagcu

SEQ ID NO: 1107416 - RNA, 22 nt, Human
auccuucaaaaggaauagcagg

SEQ ID NO: 1107417 - RNA, 22 nt, Human
uauagcagcaugauuuauaguc

SEQ ID NO: 1107418 - RNA, 22 nt, Human
uacugaaagagugguggacucu

SEQ ID NO: 1107419 - RNA, 22 nt, Human
aaugaaacuauauuuagagagg

SEQ ID NO: 1107420 - RNA, 21 nt, Human
cuagaaagaauguugucgucu

SEQ ID NO: 1107421 - RNA, 22 nt, Human
augugauacuccuucuagugga

SEQ ID NO: 1107422 - RNA, 22 nt, Human
uuacuaguggagaaacugaggc

SEQ ID NO: 1107423 - RNA, 22 nt, Human
augauugaaaaugacauugcca

SEQ ID NO: 1107424 - RNA, 22 nt, Human
uucacguuguugaagaaaauac

SEQ ID NO: 1107425 - RNA, 22 nt, Human
uaaguauuggccuauagcuaga

SEQ ID NO: 1107426 - RNA, 22 nt, Human
cugcauaucaaauuacuccugg

SEQ ID NO: 1107427 - RNA, 22 nt, Human
acucauuugcaugaugugcuau

SEQ ID NO: 1107428 - RNA, 22 nt, Human
ucuguuauaaaucacacugcau

SEQ ID NO: 1107429 - RNA, 22 nt, Human
gccaggaugacuauacaacagc

SEQ ID NO: 1107430 - RNA, 22 nt, Human
cugucuacagaugaaauaagca

SEQ ID NO: 1107431 - RNA, 22 nt, Human
uuucuacacuucgugguguuuu

SEQ ID NO: 1107432 - RNA, 22 nt, Human
ugaauagagcugcaguggacau

SEQ ID NO: 1107433 - RNA, 22 nt, Human
auggauggaacucugcuguggu

SEQ ID NO: 1107434 - RNA, 22 nt, Human
uuaccugagcggauuuguugca

SEQ ID NO: 1107435 - RNA, 22 nt, Human
guuaacaacacugugagugcug

SEQ ID NO: 1107436 - RNA, 22 nt, Human
guuauucuauuaaugugauugu

SEQ ID NO: 1107437 - RNA, 22 nt, Human
auuucagagugagagugcucaa

SEQ ID NO: 1107438 - RNA, 22 nt, Human
caaugcagauaccuuccagaga

SEQ ID NO: 1107439 - RNA, 17 nt, Human
aacaguuaaugggggaa

SEQ ID NO: 1107440 - RNA, 22 nt, Human
ccuuuuauauggcucaucacag

SEQ ID NO: 1107441 - RNA, 22 nt, Human
ugguuuguauauguuugugaga

SEQ ID NO: 1107442 - RNA, 22 nt, Human
caauguuuuuccuuccuuaaua

SEQ ID NO: 1107443 - RNA, 22 nt, Human
ucuuagaaacuguaucgauuag

SEQ ID NO: 1107444 - RNA, 22 nt, Human
gcaaggaagcagaguugcuauc

SEQ ID NO: 1107445 - RNA, 22 nt, Human
auauaugaagaagucuugauua

SEQ ID NO: 1107446 - RNA, 22 nt, Human
aaagcuauuuuauugcagcucu

SEQ ID NO: 1107447 - RNA, 22 nt, Human
gugcuuccuguauugauuccau

SEQ ID NO: 1107448 - RNA, 22 nt, Human
aucauccuagaaggaagcuagg

SEQ ID NO: 1107449 - RNA, 22 nt, Human
uuaaaagaauccuguuauccuc

SEQ ID NO: 1107450 - RNA, 22 nt, Human
aguuauugagugcagagcaggg

SEQ ID NO: 1107451 - RNA, 21 nt, Human
auacaagaagauggcagucug

SEQ ID NO: 1107452 - RNA, 22 nt, Human
cuucucuuggguguggugucuu

SEQ ID NO: 1107453 - RNA, 22 nt, Human
guuaaaugcagauucugacuca

SEQ ID NO: 1107454 - RNA, 22 nt, Human
ggagaugccuuguuucaggaac

SEQ ID NO: 1107455 - RNA, 15 nt, Human
gagaugcucucaggg

SEQ ID NO: 1107456 - RNA, 22 nt, Human
uuuacuucugcauuuccccuag

SEQ ID NO: 1107457 - RNA, 22 nt, Human
uuguagucuaggauagauuuuu

SEQ ID NO: 1107458 - RNA, 22 nt, Human
augcuuccagauugguaggggu

SEQ ID NO: 1107459 - RNA, 22 nt, Human
cuucauuucaggcugaagaaua

SEQ ID NO: 1107460 - RNA, 22 nt, Human
cauaaauuguacccauuccaac

SEQ ID NO: 1107461 - RNA, 22 nt, Human
uaguauuuccuguaagcuauag

SEQ ID NO: 1107462 - RNA, 22 nt, Human
uuuccagaaauaccauuuggug

SEQ ID NO: 1107463 - RNA, 22 nt, Human
uuuugguaauuaaguagauauu

SEQ ID NO: 1107464 - RNA, 20 nt, Human
uugcaaagugaauagcaauu

SEQ ID NO: 1107465 - RNA, 22 nt, Human
caaacuuacuguguuuaaagag

SEQ ID NO: 1107466 - RNA, 22 nt, Human
aauuauugagcaucuacugugu

SEQ ID NO: 1107467 - RNA, 22 nt, Human
gcugcucucucccuaaguuggg

SEQ ID NO: 1107468 - RNA, 22 nt, Human
agaugguucagaauuauaaaga

SEQ ID NO: 1107469 - RNA, 22 nt, Human
ucauuguuucugcuuuucauga

SEQ ID NO: 1107470 - RNA, 22 nt, Human
auucagaaauagaaaauuugau

SEQ ID NO: 1107471 - RNA, 22 nt, Human
ucucuuaauuguaaugguuccu

SEQ ID NO: 1107472 - RNA, 22 nt, Human
ccaaagcuggcuuucaugguuu

SEQ ID NO: 1107473 - RNA, 22 nt, Human
uaucuguauucugacagucacu

SEQ ID NO: 1107474 - RNA, 22 nt, Human
gcauucuugguggagugcuaaa

SEQ ID NO: 1107475 - RNA, 22 nt, Human
auaaugacauucuuagacugga

SEQ ID NO: 1107476 - RNA, 22 nt, Human
ccaaacauuucaaauuuagaga

SEQ ID NO: 1107477 - RNA, 22 nt, Human
guggauggagcuggaagccauu

SEQ ID NO: 1107478 - RNA, 22 nt, Human
gguuauuaguuucaccuggacu

SEQ ID NO: 1107479 - RNA, 21 nt, Human
cgaaguuugggcagagggguc

SEQ ID NO: 1107480 - RNA, 22 nt, Human
aaacacaucauucaugucguca

SEQ ID NO: 1107481 - RNA, 22 nt, Human
agcuaguauuucauugaggauu

SEQ ID NO: 1107482 - RNA, 22 nt, Human
acaaguuucauuguuuagaacc

SEQ ID NO: 1107483 - RNA, 22 nt, Human
auagacgcggccgcugaugcag

SEQ ID NO: 1107484 - RNA, 22 nt, Human
ugugacuaggccugagcucuug

SEQ ID NO: 1107485 - RNA, 19 nt, Human
cagcaaacacuguaaaugg

SEQ ID NO: 1107486 - RNA, 22 nt, Human
uaaguugauuauaaccacugga

SEQ ID NO: 1107487 - RNA, 23 nt, Human
ugcaaaauuugcagaguucgaug

SEQ ID NO: 1107488 - RNA, 22 nt, Human
cauuaacacuuuggauuuagac

SEQ ID NO: 1107489 - RNA, 22 nt, Human
agauugucauugacgaugagca

SEQ ID NO: 1107490 - RNA, 22 nt, Human
aaauuaacuaucacuuuuguga

SEQ ID NO: 1107491 - RNA, 22 nt, Human
uugguuaccuucagaaaugagu

SEQ ID NO: 1107492 - RNA, 22 nt, Human
cuucucagagcuuccagaaaac

SEQ ID NO: 1107493 - RNA, 22 nt, Human
aaguuugucucauuugaucuuc

SEQ ID NO: 1107494 - RNA, 22 nt, Human
cauugcuuugugcauauuuaaa

SEQ ID NO: 1107495 - RNA, 22 nt, Human
caauuuuuaaacuaugaaguug

SEQ ID NO: 1107496 - RNA, 22 nt, Human
guucuucaggcugugcucuaga

SEQ ID NO: 1107497 - RNA, 22 nt, Human
aauggcaaaguguuuucauacc

SEQ ID NO: 1107498 - RNA, 22 nt, Human
guacauauccuuuacguuuugu

SEQ ID NO: 1107499 - RNA, 22 nt, Human
ucagaagucuggacugcuucuc

SEQ ID NO: 1107500 - RNA, 22 nt, Human
auauggcuguugcacaucuaag

SEQ ID NO: 1107501 - RNA, 22 nt, Human
uucagauaagucaaguuaguau

SEQ ID NO: 1107502 - RNA, 22 nt, Human
gaauuguacugcaaucagggga

SEQ ID NO: 1107503 - RNA, 18 nt, Human
guagauccuugagcuacc

SEQ ID NO: 1107504 - RNA, 23 nt, Human
uggaaacauucugaauguccauc

SEQ ID NO: 1107505 - RNA, 22 nt, Human
guaugugucuuagaacuuggga

SEQ ID NO: 1107506 - RNA, 22 nt, Human
cuuucuuucgaagacgugauua

SEQ ID NO: 1107507 - RNA, 22 nt, Human
uguauuucugcuuucucuagua

SEQ ID NO: 1107508 - RNA, 22 nt, Human
uguaucauauggggaagcuuca

SEQ ID NO: 1107509 - RNA, 22 nt, Human
cuuguuuucuucugcagucuau

SEQ ID NO: 1107510 - RNA, 22 nt, Human
acagaguaucuaucaggaguau

SEQ ID NO: 1107511 - RNA, 22 nt, Human
uguacauacauagauauacaca

SEQ ID NO: 1107512 - RNA, 22 nt, Human
uaauuucagugcaagcucacgg

SEQ ID NO: 1107513 - RNA, 22 nt, Human
agaaaucugacugcugugcaca

SEQ ID NO: 1107514 - RNA, 22 nt, Human
ggaaacauuccaagaguugaaa

SEQ ID NO: 1107515 - RNA, 22 nt, Human
agauuauuuaagacaggaacca

SEQ ID NO: 1107516 - RNA, 22 nt, Human
acaguccuguacaggccauauc

SEQ ID NO: 1107517 - RNA, 22 nt, Human
augaugaagcaugguuacacug

SEQ ID NO: 1107518 - RNA, 22 nt, Human
cuuugcuaauguugcauuuuca

SEQ ID NO: 1107519 - RNA, 22 nt, Human
acucccuugguggagaaugcaa

SEQ ID NO: 1107520 - RNA, 22 nt, Human
caguuaaacagauugaguguua

SEQ ID NO: 1107521 - RNA, 22 nt, Human
guuuauuggguauuguggagcc

SEQ ID NO: 1107522 - RNA, 22 nt, Human
gcuuccaaugcuucuaucacau

SEQ ID NO: 1107523 - RNA, 22 nt, Human
uucuaagaaauggaaaacgauu

SEQ ID NO: 1107524 - RNA, 22 nt, Human
cagaggauauaugguuuguaug

SEQ ID NO: 1107525 - RNA, 23 nt, Human
gacagguaaggguugggagaauc

SEQ ID NO: 1107526 - RNA, 22 nt, Human
caauaguaaauuacggaggaga

SEQ ID NO: 1107527 - RNA, 22 nt, Human
uaucaguagaacaauggacauu

SEQ ID NO: 1107528 - RNA, 22 nt, Human
uugacacagucaacuugauuuu

SEQ ID NO: 1107529 - RNA, 22 nt, Human
gucuguggaguugcuugcugga

SEQ ID NO: 1107530 - RNA, 22 nt, Human
auugucgucaauggacacauag

SEQ ID NO: 1107531 - RNA, 22 nt, Human
cuccaggacugaggacagagcu

SEQ ID NO: 1107532 - RNA, 22 nt, Human
aauaucaucucucuuuucugca

SEQ ID NO: 1107533 - RNA, 22 nt, Human
gauauucauaggcagguauuua

SEQ ID NO: 1107534 - RNA, 22 nt, Human
gauccacagcugcgguaggaga

SEQ ID NO: 1107535 - RNA, 22 nt, Human
guacuuucaggcuuucccuuaa

SEQ ID NO: 1107536 - RNA, 22 nt, Human
uaaccaagcaaacuuucauugu

SEQ ID NO: 1107537 - RNA, 22 nt, Human
auuguugacuugauuacucaac

SEQ ID NO: 1107538 - RNA, 22 nt, Human
ugugucuaaugacuauuucuuc

SEQ ID NO: 1107539 - RNA, 21 nt, Human
guucaauagcucuuugaaugc

SEQ ID NO: 1107540 - RNA, 22 nt, Human
uuuuguguugccauguuaagca

SEQ ID NO: 1107541 - RNA, 22 nt, Human
uccaaauagcuggaugauggug

SEQ ID NO: 1107542 - RNA, 22 nt, Human
agauauguuaggcuuguucccu

SEQ ID NO: 1107543 - RNA, 22 nt, Human
gaaguucugguguaugugauaa

SEQ ID NO: 1107544 - RNA, 22 nt, Human
aguacuuuuuguucaauugugc

SEQ ID NO: 1107545 - RNA, 22 nt, Human
uggcacagcuugucauaaacuc

SEQ ID NO: 1107546 - RNA, 22 nt, Human
cauggaaggcaaaagacacaga

SEQ ID NO: 1107547 - RNA, 22 nt, Human
cuuucugaggagacgggcuuug

SEQ ID NO: 1107548 - RNA, 22 nt, Human
agguggaguuaagugugaacug

SEQ ID NO: 1107549 - RNA, 19 nt, Human
ugguggaggugcaccugac

SEQ ID NO: 1107550 - RNA, 22 nt, Human
ggaagcuguuaucaucuguauc

SEQ ID NO: 1107551 - RNA, 22 nt, Human
auguaacauaugugaucgcauu

SEQ ID NO: 1107552 - RNA, 22 nt, Human
aaucaggagugugcacuuugau

SEQ ID NO: 1107553 - RNA, 22 nt, Human
ucuauuaaugauucaauagugu

SEQ ID NO: 1107554 - RNA, 17 nt, Human
ucugagaacuugaagca

SEQ ID NO: 1107555 - RNA, 22 nt, Human
caguuuuacccaagcuuauuuu

SEQ ID NO: 1107556 - RNA, 22 nt, Human
acauuugauauggaguugugua

SEQ ID NO: 1107557 - RNA, 22 nt, Human
ugaauaaucuuggguauuaaua

SEQ ID NO: 1107558 - RNA, 22 nt, Human
cacaguuuugucuugguuucca

SEQ ID NO: 1107559 - RNA, 22 nt, Human
cuucauuaaugucuauaaguuu

SEQ ID NO: 1107560 - RNA, 22 nt, Human
cacauuuaugggcugggaggca

SEQ ID NO: 1107561 - RNA, 22 nt, Human
ucacuagugguuucuggugguu

SEQ ID NO: 1107562 - RNA, 22 nt, Human
gcuguauuuauaugaaggcaug

SEQ ID NO: 1107563 - RNA, 22 nt, Human
uagcaucuguacugacauaauc

SEQ ID NO: 1107564 - RNA, 22 nt, Human
auucuagaguuucaauccaagg

SEQ ID NO: 1107565 - RNA, 22 nt, Human
uugauucugcugaucucggacg

SEQ ID NO: 1107566 - RNA, 22 nt, Human
gaaaacacuuugaucugaaagu

SEQ ID NO: 1107567 - RNA, 22 nt, Human
gucguucucugccagggcguug

SEQ ID NO: 1107568 - RNA, 22 nt, Human
gcaaaacagucgaugccuccca

SEQ ID NO: 1107569 - RNA, 22 nt, Human
aucuguucuucaaaauauuaca

SEQ ID NO: 1107570 - RNA, 22 nt, Human
gcagcucacagucuccgccauc

SEQ ID NO: 1107571 - RNA, 22 nt, Human
ggaguucaaaucuuuuggaucu

SEQ ID NO: 1107572 - RNA, 21 nt, Human
caagacauaugaguacucugg

SEQ ID NO: 1107573 - RNA, 22 nt, Human
ucauuuacacuucacaaaugga

SEQ ID NO: 1107574 - RNA, 22 nt, Human
ucuacuuccgcaaaaggcacau

SEQ ID NO: 1107575 - RNA, 22 nt, Human
augaaacaacagacuuggucaa

SEQ ID NO: 1107576 - RNA, 22 nt, Human
agagaauuaacauuccauggcu

SEQ ID NO: 1107577 - RNA, 22 nt, Human
uaucauuuuacugugacauuuu

SEQ ID NO: 1107578 - RNA, 22 nt, Human
uucuuugcccauguuuccuaag

SEQ ID NO: 1107579 - RNA, 22 nt, Human
aaguuauugguggagagcacug

SEQ ID NO: 1107580 - RNA, 22 nt, Human
ccagaucccuguuugccucugg

SEQ ID NO: 1107581 - RNA, 22 nt, Human
uuguuuguaaggcucuuagaau

SEQ ID NO: 1107582 - RNA, 22 nt, Human
ugcuuuauucgacaucugguag

SEQ ID NO: 1107583 - RNA, 22 nt, Human
uauaaacuccucuugcauuccu

SEQ ID NO: 1107584 - RNA, 22 nt, Human
auguaagagcuuugcagggaaa

SEQ ID NO: 1107585 - RNA, 22 nt, Human
ccagaaugugugaaauuugaug

SEQ ID NO: 1107586 - RNA, 19 nt, Human
augagcuggcauuucaggu

SEQ ID NO: 1107587 - RNA, 22 nt, Human
uuucaaguagagggaucgcuag

SEQ ID NO: 1107588 - RNA, 19 nt, Human
auacacguguauacauaca

SEQ ID NO: 1107589 - RNA, 22 nt, Human
uucaaacaguguagaauauaug

SEQ ID NO: 1107590 - RNA, 22 nt, Human
cucagugaauuggaggauggcc

SEQ ID NO: 1107591 - RNA, 22 nt, Human
augaauuguccgauguugugca

SEQ ID NO: 1107592 - RNA, 22 nt, Human
aauguuugaacuuugcauauuu

SEQ ID NO: 1107593 - RNA, 23 nt, Human
agugaugucacccacagacaagg

SEQ ID NO: 1107594 - RNA, 22 nt, Human
uuugacuccuguguuucuggaa

SEQ ID NO: 1107595 - RNA, 22 nt, Human
aacuuucuuugcaucuaaguuu

SEQ ID NO: 1107596 - RNA, 22 nt, Human
auguccaggaagucuuaacuca

SEQ ID NO: 1107597 - RNA, 22 nt, Human
uuuggauugcuuggaugcuucg

SEQ ID NO: 1107598 - RNA, 22 nt, Human
guuuccaagucucucaacaccc

SEQ ID NO: 1107599 - RNA, 22 nt, Human
augcacaagguagauuauuauu

SEQ ID NO: 1107600 - RNA, 22 nt, Human
cagugccauauugaaagacauu

SEQ ID NO: 1107601 - RNA, 22 nt, Human
auguaguauuuggaaauguaaa

SEQ ID NO: 1107602 - RNA, 22 nt, Human
auuccaaagccugaauaaugga

SEQ ID NO: 1107603 - RNA, 22 nt, Human
accuuuaugaaacagcugucgu

SEQ ID NO: 1107604 - RNA, 20 nt, Human
cucuuuucacucucaguggu

SEQ ID NO: 1107605 - RNA, 22 nt, Human
auuuccaggaguugaggucuga

SEQ ID NO: 1107606 - RNA, 22 nt, Human
aaugacaguggcacagucacuu

SEQ ID NO: 1107607 - RNA, 20 nt, Human
caauaauuuacuucccuauu

SEQ ID NO: 1107608 - RNA, 22 nt, Human
acuuuggugcgaagucacuuua

SEQ ID NO: 1107609 - RNA, 22 nt, Human
aauggcuguucucugugauugg

SEQ ID NO: 1107610 - RNA, 22 nt, Human
aggccagaacagcucugcacca

SEQ ID NO: 1107611 - RNA, 22 nt, Human
gcaucugauccaauagauauau

SEQ ID NO: 1107612 - RNA, 22 nt, Human
gaaccuggcagcccuauaucug

SEQ ID NO: 1107613 - RNA, 22 nt, Human
auuucagcagcccauguuugga

SEQ ID NO: 1107614 - RNA, 22 nt, Human
aaaugccucauuuucucucacu

SEQ ID NO: 1107615 - RNA, 22 nt, Human
cuuuacagauggauaauuguuu

SEQ ID NO: 1107616 - RNA, 22 nt, Human
uaugcuguauucuguauguuag

SEQ ID NO: 1107617 - RNA, 22 nt, Human
cacauuggcaaacgggguugca

SEQ ID NO: 1107618 - RNA, 22 nt, Human
aucuuacaauuacaagacacuc

SEQ ID NO: 1107619 - RNA, 22 nt, Human
uauuaugguuguagguuaacaa

SEQ ID NO: 1107620 - RNA, 22 nt, Human
auauguggcauuauuucugagg

SEQ ID NO: 1107621 - RNA, 22 nt, Human
guuucuuauuucaacuggaaca

SEQ ID NO: 1107622 - RNA, 22 nt, Human
gaguaauuuucuuaaaacauca

SEQ ID NO: 1107623 - RNA, 17 nt, Human
uagauuaaacacggcca

SEQ ID NO: 1107624 - RNA, 22 nt, Human
auacaggaugcugaacaucucu

SEQ ID NO: 1107625 - RNA, 22 nt, Human
uuugcagagugcagaagcaucu

SEQ ID NO: 1107626 - RNA, 22 nt, Human
caucuuuguuuuggauauaauc

SEQ ID NO: 1107627 - RNA, 18 nt, Human
acccauuauauuuguagc

SEQ ID NO: 1107628 - RNA, 22 nt, Human
uugcauauccuccaacacaugg

SEQ ID NO: 1107629 - RNA, 22 nt, Human
cuuguauuaggaagaaugcuuu

SEQ ID NO: 1107630 - RNA, 22 nt, Human
uacauuuauaaggcuucucugu

SEQ ID NO: 1107631 - RNA, 22 nt, Human
uaguuacuuuugcucuucauua

SEQ ID NO: 1107632 - RNA, 22 nt, Human
ucauuacaagauuuccaauuug

SEQ ID NO: 1107633 - RNA, 22 nt, Human
acuaauugaaaugagacuggug

SEQ ID NO: 1107634 - RNA, 22 nt, Human
gaaucucaggggaguuacugga

SEQ ID NO: 1107635 - RNA, 22 nt, Human
aaauccaucaaaucuucuagaa

SEQ ID NO: 1107636 - RNA, 22 nt, Human
agauguuuauaacucaugagug

SEQ ID NO: 1107637 - RNA, 22 nt, Human
agaauaagccugacgaaaccua

SEQ ID NO: 1107638 - RNA, 22 nt, Human
agauguuuuuccaggucuaauu

SEQ ID NO: 1107639 - RNA, 22 nt, Human
uaaggacagcagcuacuuuucc

SEQ ID NO: 1107640 - RNA, 22 nt, Human
aggcauuacaucuaaauauuua

SEQ ID NO: 1107641 - RNA, 22 nt, Human
agaacagaggccuuauguuuca

SEQ ID NO: 1107642 - RNA, 22 nt, Human
augcaucaccgaguugcccacc

SEQ ID NO: 1107643 - RNA, 22 nt, Human
guaguucuuucucaauguucaa

SEQ ID NO: 1107644 - RNA, 22 nt, Human
cacugguugccucuuucuguuc

SEQ ID NO: 1107645 - RNA, 22 nt, Human
uggaaauaguugugagucaggc

SEQ ID NO: 1107646 - RNA, 22 nt, Human
acaucucacuucuuugaaggcu

SEQ ID NO: 1107647 - RNA, 22 nt, Human
aaauugcuugagauuagucucc

SEQ ID NO: 1107648 - RNA, 22 nt, Human
guuuccaggcuuugguaugguu

SEQ ID NO: 1107649 - RNA, 22 nt, Human
cucuaaauguggucugcagaua

SEQ ID NO: 1107650 - RNA, 22 nt, Human
cucaaaauccauaaaaucaggu

SEQ ID NO: 1107651 - RNA, 20 nt, Human
ucuuuuauuggcagauccug

SEQ ID NO: 1107652 - RNA, 22 nt, Human
acagaagugacaauuucuuggg

SEQ ID NO: 1107653 - RNA, 22 nt, Human
ggcaauuacguauuagucaugu

SEQ ID NO: 1107654 - RNA, 23 nt, Human
uggagaauucagucuuuguuuug

SEQ ID NO: 1107655 - RNA, 22 nt, Human
uggaauuaucugaagugauuug

SEQ ID NO: 1107656 - RNA, 22 nt, Human
caaaauuguugaugcugcuuug

SEQ ID NO: 1107657 - RNA, 22 nt, Human
caauaauugcuuuccagaguua

SEQ ID NO: 1107658 - RNA, 22 nt, Human
caugugaccgcugggugagcga

SEQ ID NO: 1107659 - RNA, 22 nt, Human
agugauaggacauauggauuuu

SEQ ID NO: 1107660 - RNA, 22 nt, Human
ugauuccugugcuuauuccagu

SEQ ID NO: 1107661 - RNA, 22 nt, Human
cuuaagacaggcucaaagauua

SEQ ID NO: 1107662 - RNA, 22 nt, Human
gaaugcuggcuuacaggcaguu

SEQ ID NO: 1107663 - RNA, 22 nt, Human
aagcauuucagguagagauauu

SEQ ID NO: 1107664 - RNA, 17 nt, Human
gcuccagaauucuaguc

SEQ ID NO: 1107665 - RNA, 22 nt, Human
ucaauucugccucuaaauauuu

SEQ ID NO: 1107666 - RNA, 19 nt, Human
ucuuucauuucuagcucug

SEQ ID NO: 1107667 - RNA, 22 nt, Human
ugaggaaugugacaaaaccaag

SEQ ID NO: 1107668 - RNA, 22 nt, Human
ucccagaacccugccagguccu

SEQ ID NO: 1107669 - RNA, 22 nt, Human
acauuuaaugauccuacuguga

SEQ ID NO: 1107670 - RNA, 22 nt, Human
cugccaucugagccaaaagugc

SEQ ID NO: 1107671 - RNA, 22 nt, Human
uuggauggagguucaagcacua

SEQ ID NO: 1107672 - RNA, 22 nt, Human
caaauacaaauacgggcagcuu

SEQ ID NO: 1107673 - RNA, 22 nt, Human
uaaaucccuacaucuguguuuu

SEQ ID NO: 1107674 - RNA, 22 nt, Human
auuguacagacaugggaaacaa

SEQ ID NO: 1107675 - RNA, 22 nt, Human
gaaacauuuguugaguacuugc

SEQ ID NO: 1107676 - RNA, 22 nt, Human
uauagugucucuagaucaaaga

SEQ ID NO: 1107677 - RNA, 22 nt, Human
uuguacuuaaauaugcaaauag

SEQ ID NO: 1107678 - RNA, 22 nt, Human
aaagucuuaauguaaguuuagu

SEQ ID NO: 1107679 - RNA, 22 nt, Human
aacaucuagguucucaucgaua

SEQ ID NO: 1107680 - RNA, 22 nt, Human
gaccaaggaagaggggagccag

SEQ ID NO: 1107681 - RNA, 22 nt, Human
aaagacuaaccaguugucaaaa

SEQ ID NO: 1107682 - RNA, 22 nt, Human
caaguaugagaaagcuauuacc

SEQ ID NO: 1107683 - RNA, 22 nt, Human
gucucuaucauagcugaacccu

SEQ ID NO: 1107684 - RNA, 22 nt, Human
augaauaaaacauuuuaaucag

SEQ ID NO: 1107685 - RNA, 22 nt, Human
auuuuguaucuuacggggacua

SEQ ID NO: 1107686 - RNA, 22 nt, Human
uaguggauguucagagauuuga

SEQ ID NO: 1107687 - RNA, 22 nt, Human
cagagaauaaaagggcauuccu

SEQ ID NO: 1107688 - RNA, 22 nt, Human
gacauuuauuggauuuuacgag

SEQ ID NO: 1107689 - RNA, 22 nt, Human
acagugauuggcacugauucag

SEQ ID NO: 1107690 - RNA, 22 nt, Human
gaauaauugugaugcuugaagu

SEQ ID NO: 1107691 - RNA, 22 nt, Human
gaugauuacacuuuuaaaacag

SEQ ID NO: 1107692 - RNA, 22 nt, Human
ugcaaauauuccaugcuguuca

SEQ ID NO: 1107693 - RNA, 22 nt, Human
uugagauagguggaaucucuuu

SEQ ID NO: 1107694 - RNA, 22 nt, Human
guguuuaaugcagaugugggug

SEQ ID NO: 1107695 - RNA, 22 nt, Human
acugagcaggguuccgcaugga

SEQ ID NO: 1107696 - RNA, 22 nt, Human
gcuuccuucuaccacaucaugc

SEQ ID NO: 1107697 - RNA, 22 nt, Human
ucaucuguuaugggaguuuuug

SEQ ID NO: 1107698 - RNA, 22 nt, Human
caguaaauguccucgcagggaa

SEQ ID NO: 1107699 - RNA, 22 nt, Human
uggaaaauauuuaggugaauga

SEQ ID NO: 1107700 - RNA, 22 nt, Human
uugcacauguugguucuugaaa

SEQ ID NO: 1107701 - RNA, 22 nt, Human
uacuguauacuacugcuguucu

SEQ ID NO: 1107702 - RNA, 22 nt, Human
uaaagacaauuucgagcuguag

SEQ ID NO: 1107703 - RNA, 22 nt, Human
auacaugugugugcauacaugu

SEQ ID NO: 1107704 - RNA, 22 nt, Human
uaauuuugucacagugacaugc

SEQ ID NO: 1107705 - RNA, 22 nt, Human
guuauguaaucuaacacucagu

SEQ ID NO: 1107706 - RNA, 22 nt, Human
cucuauucuaauggauucuggg

SEQ ID NO: 1107707 - RNA, 22 nt, Human
acuuccagaaaugauuuaauuu

SEQ ID NO: 1107708 - RNA, 22 nt, Human
aauugguuugaauaaauaaaga

SEQ ID NO: 1107709 - RNA, 22 nt, Human
uuagcacugucugguuaucuug

SEQ ID NO: 1107710 - RNA, 22 nt, Human
agguggagaagagaugggcagu

SEQ ID NO: 1107711 - RNA, 22 nt, Human
ucuuuuaucuguuguguaacaa

SEQ ID NO: 1107712 - RNA, 22 nt, Human
uuuccaaagguggcaggaacaa

SEQ ID NO: 1107713 - RNA, 22 nt, Human
uaaugccuuaugucaaauguaa

SEQ ID NO: 1107714 - RNA, 22 nt, Human
cuccacagccccuccaguggca

SEQ ID NO: 1107715 - RNA, 22 nt, Human
cucacucaguuuuuaguucauc

SEQ ID NO: 1107716 - RNA, 22 nt, Human
uuucuacauuuguaaccagauu

SEQ ID NO: 1107717 - RNA, 22 nt, Human
uguauauacacacucccauguu

SEQ ID NO: 1107718 - RNA, 17 nt, Human
ccuuucuucccagaggg

SEQ ID NO: 1107719 - RNA, 23 nt, Human
gggcagcuuaagcuuguuuuucu

SEQ ID NO: 1107720 - RNA, 22 nt, Human
ugucuagaaaugcugagucuca

SEQ ID NO: 1107721 - RNA, 22 nt, Human
cuugaaagucagcagaguggau

SEQ ID NO: 1107722 - RNA, 22 nt, Human
aauguuaaguuuagauuauaac

SEQ ID NO: 1107723 - RNA, 22 nt, Human
auccuggguaaguuccuuuuaa

SEQ ID NO: 1107724 - RNA, 22 nt, Human
guucaguuauuucugaagauau

SEQ ID NO: 1107725 - RNA, 22 nt, Human
aucagaagaaauggaugugacu

SEQ ID NO: 1107726 - RNA, 18 nt, Human
cuuuagcugucaucuuug

SEQ ID NO: 1107727 - RNA, 22 nt, Human
augaucaagaauuuuguauucc

SEQ ID NO: 1107728 - RNA, 22 nt, Human
aggaaaauggaccagaguuguu

SEQ ID NO: 1107729 - RNA, 20 nt, Human
cauuccugaggaauucaugu

SEQ ID NO: 1107730 - RNA, 22 nt, Human
ugucuucauuccccaugaaguc

SEQ ID NO: 1107731 - RNA, 22 nt, Human
cuuauuggucccaggaggagaa

SEQ ID NO: 1107732 - RNA, 22 nt, Human
guuguuuuugaacggugguggc

SEQ ID NO: 1107733 - RNA, 22 nt, Human
agacugugagaagauggcugcg

SEQ ID NO: 1107734 - RNA, 22 nt, Human
ugugagauuuuauuugauaugc

SEQ ID NO: 1107735 - RNA, 22 nt, Human
ucuucaugaaauugauugcuua

SEQ ID NO: 1107736 - RNA, 22 nt, Human
gugauuuucuccuccuagaagu

SEQ ID NO: 1107737 - RNA, 20 nt, Human
uaugauaauuacaaaauagu

SEQ ID NO: 1107738 - RNA, 21 nt, Human
ccacaauucuaguuacauaug

SEQ ID NO: 1107739 - RNA, 22 nt, Human
uucuguuuauaauuugcaguug

SEQ ID NO: 1107740 - RNA, 22 nt, Human
aauagcaaaugcucauuugaaa

SEQ ID NO: 1107741 - RNA, 22 nt, Human
ggaagcaaauuccagaaccaca

SEQ ID NO: 1107742 - RNA, 22 nt, Human
uaaagugaaguucagaauggcu

SEQ ID NO: 1107743 - RNA, 22 nt, Human
gauucugaaauuaacagacugg

SEQ ID NO: 1107744 - RNA, 22 nt, Human
uaacacauagauauuuuaacuu

SEQ ID NO: 1107745 - RNA, 22 nt, Human
cucaucuggcuucaguaacagu

SEQ ID NO: 1107746 - RNA, 22 nt, Human
gaacaguuucccuguagaaaau

SEQ ID NO: 1107747 - RNA, 22 nt, Human
ugaagacaguuuuacucaugag

SEQ ID NO: 1107748 - RNA, 22 nt, Human
uacagugcuugguaucuaguaa

SEQ ID NO: 1107749 - RNA, 18 nt, Human
gaacagcaauuucauguu

SEQ ID NO: 1107750 - RNA, 22 nt, Human
agucaguaugacuuauaguucu

SEQ ID NO: 1107751 - RNA, 22 nt, Human
guuauacuuaugugcaaaaaua

SEQ ID NO: 1107752 - RNA, 22 nt, Human
acagcuucgaggaucucauccc

SEQ ID NO: 1107753 - RNA, 22 nt, Human
uaaaccuuauuugaauaccaac

SEQ ID NO: 1107754 - RNA, 22 nt, Human
aggauaauaauaaucucguuua

SEQ ID NO: 1107755 - RNA, 22 nt, Human
cuagagaaaaagcuuagguacg

SEQ ID NO: 1107756 - RNA, 22 nt, Human
ucacacaucucagguguuuaau

SEQ ID NO: 1107757 - RNA, 22 nt, Human
cacauuuaaagguugaagcuga

SEQ ID NO: 1107758 - RNA, 22 nt, Human
guaauucugugugaaucuauua

SEQ ID NO: 1107759 - RNA, 21 nt, Human
uaaacauaaccuuguauggcu

SEQ ID NO: 1107760 - RNA, 22 nt, Human
ggaaacugcuuacacuagaggg

SEQ ID NO: 1107761 - RNA, 22 nt, Human
gucauuuuugacuuugaaguga

SEQ ID NO: 1107762 - RNA, 22 nt, Human
guucucucagcgauagugaugg

SEQ ID NO: 1107763 - RNA, 22 nt, Human
uuagacaucaagaagccaaugu

SEQ ID NO: 1107764 - RNA, 22 nt, Human
guggcuaggcccaacggcagga

SEQ ID NO: 1107765 - RNA, 22 nt, Human
uuacaguuuacauaagaauugu

SEQ ID NO: 1107766 - RNA, 22 nt, Human
uccaaggacauuguucuaguug

SEQ ID NO: 1107767 - RNA, 22 nt, Human
agagcaauuagcuuagguaaaa

SEQ ID NO: 1107768 - RNA, 21 nt, Human
acuguauuguuuucaaggauc

SEQ ID NO: 1107769 - RNA, 22 nt, Human
cuaguuuuaagcuccuugaggu

SEQ ID NO: 1107770 - RNA, 22 nt, Human
uuuauucucuaguuggucagau

SEQ ID NO: 1107771 - RNA, 22 nt, Human
uugcuauuuugagagucauagu

SEQ ID NO: 1107772 - RNA, 22 nt, Human
agcaaauaauugucuuugaggg

SEQ ID NO: 1107773 - RNA, 22 nt, Human
gaauacaaauaauaccaaggug

SEQ ID NO: 1107774 - RNA, 22 nt, Human
caugcuggucagccaguggaug

SEQ ID NO: 1107775 - RNA, 20 nt, Human
caacacugcccauuguuugc

SEQ ID NO: 1107776 - RNA, 22 nt, Human
auuuacagccuugccaucuaua

SEQ ID NO: 1107777 - RNA, 22 nt, Human
uauuucagcucuuuggauuauc

SEQ ID NO: 1107778 - RNA, 22 nt, Human
cuguauaugugcauacacacac

SEQ ID NO: 1107779 - RNA, 22 nt, Human
ucacuguuaauaaauagcaaag

SEQ ID NO: 1107780 - RNA, 22 nt, Human
aaugucaacacaagagaaaugc

SEQ ID NO: 1107781 - RNA, 22 nt, Human
ugauauccuuuaaccuggaccg

SEQ ID NO: 1107782 - RNA, 22 nt, Human
aauacagugaaagugagcaagg

SEQ ID NO: 1107783 - RNA, 22 nt, Human
uguuuuaagggucaacugucac

SEQ ID NO: 1107784 - RNA, 22 nt, Human
uugauggacagggaccacuguc

SEQ ID NO: 1107785 - RNA, 22 nt, Human
aagaaaagguaaccgcuuaucu

SEQ ID NO: 1107786 - RNA, 22 nt, Human
agucuauuuuugguucuucggg

SEQ ID NO: 1107787 - RNA, 22 nt, Human
uuuguguuggaagaaaugcuac

SEQ ID NO: 1107788 - RNA, 22 nt, Human
aauucauacucuauauugcuuu

SEQ ID NO: 1107789 - RNA, 22 nt, Human
uuguaacaguagcugucagcuc

SEQ ID NO: 1107790 - RNA, 22 nt, Human
uuuagcaaggagaaauaauccu

SEQ ID NO: 1107791 - RNA, 22 nt, Human
cuccagauuccguuuauucagg

SEQ ID NO: 1107792 - RNA, 23 nt, Human
aucuguguguggguagggaugau

SEQ ID NO: 1107793 - RNA, 22 nt, Human
acuuuuaaggggccuugauuua

SEQ ID NO: 1107794 - RNA, 22 nt, Human
gaacuuuaauuagcuuuugucu

SEQ ID NO: 1107795 - RNA, 22 nt, Human
ugaaucaaugaauugcacuuca

SEQ ID NO: 1107796 - RNA, 22 nt, Human
uugcuggaguagaaaacuuaac

SEQ ID NO: 1107797 - RNA, 23 nt, Human
uaucauuucagcucucugccugg

SEQ ID NO: 1107798 - RNA, 22 nt, Human
uaucaguccaggguuuugugac

SEQ ID NO: 1107799 - RNA, 22 nt, Human
ugaaaacacuuuaguuuagguc

SEQ ID NO: 1107800 - RNA, 22 nt, Human
ccaagagcuucccauagcuucu

SEQ ID NO: 1107801 - RNA, 22 nt, Human
uaucuguagucucaugguuccu

SEQ ID NO: 1107802 - RNA, 22 nt, Human
uagcuguucucuguaaauugga

SEQ ID NO: 1107803 - RNA, 22 nt, Human
uaucuagagccuggaagucuug

SEQ ID NO: 1107804 - RNA, 18 nt, Human
acagggagggcgcugggg

SEQ ID NO: 1107805 - RNA, 22 nt, Human
augauuuguuaacagacuuaau

SEQ ID NO: 1107806 - RNA, 22 nt, Human
guuugagauggguuauugcucu

SEQ ID NO: 1107807 - RNA, 22 nt, Human
accaaauaggcuuccuggguug

SEQ ID NO: 1107808 - RNA, 22 nt, Human
guuuacaacaucuuguccuuca

SEQ ID NO: 1107809 - RNA, 20 nt, Human
acucuguagguaaugagacu

SEQ ID NO: 1107810 - RNA, 22 nt, Human
ugggaagauaugagugaccaac

SEQ ID NO: 1107811 - RNA, 22 nt, Human
caguauguuuauuagaacugca

SEQ ID NO: 1107812 - RNA, 22 nt, Human
uggcuccguuguacaggcugga

SEQ ID NO: 1107813 - RNA, 21 nt, Human
uuuaaggccagcaggagguga

SEQ ID NO: 1107814 - RNA, 22 nt, Human
gugauuucaaauauagagugag

SEQ ID NO: 1107815 - RNA, 22 nt, Human
uucuguaauucuguuaguuuca

SEQ ID NO: 1107816 - RNA, 22 nt, Human
caacuuuagaccccaaguagcu

SEQ ID NO: 1107817 - RNA, 22 nt, Human
uaggauaugcauuuuuauacau

SEQ ID NO: 1107818 - RNA, 22 nt, Human
cgucauuuguaaaugaucaaga

SEQ ID NO: 1107819 - RNA, 22 nt, Human
ucuguaaacacccguaagcuuu

SEQ ID NO: 1107820 - RNA, 19 nt, Human
aggucuaaucauaagacaa

SEQ ID NO: 1107821 - RNA, 21 nt, Human
acaguacuugagaucuuuuga

SEQ ID NO: 1107822 - RNA, 22 nt, Human
uguaauguuagaaacaauugcu

SEQ ID NO: 1107823 - RNA, 22 nt, Human
acaagauagcuuagaagauuca

SEQ ID NO: 1107824 - RNA, 22 nt, Human
acucaucuuugaauuuucagua

SEQ ID NO: 1107825 - RNA, 22 nt, Human
auuugcuuguucaccaguacuu

SEQ ID NO: 1107826 - RNA, 22 nt, Human
uggaaagaggaagugcccagca

SEQ ID NO: 1107827 - RNA, 22 nt, Human
acauucucuuuuagaaagcugu

SEQ ID NO: 1107828 - RNA, 22 nt, Human
aguucaugugguuuaacuuaau

SEQ ID NO: 1107829 - RNA, 18 nt, Human
ucagacaaguuagacagg

SEQ ID NO: 1107830 - RNA, 20 nt, Human
uguauuuaaugaaggcuuuu

SEQ ID NO: 1107831 - RNA, 20 nt, Human
ucucuaacaugaaugcuauc

SEQ ID NO: 1107832 - RNA, 22 nt, Human
cuuccuaaaagcuucaagagaa

SEQ ID NO: 1107833 - RNA, 22 nt, Human
aacagauuguaaccugauagcc

SEQ ID NO: 1107834 - RNA, 22 nt, Human
gugcuaugauuggacagaauag

SEQ ID NO: 1107835 - RNA, 22 nt, Human
cugauggagagugugauuuggg

SEQ ID NO: 1107836 - RNA, 22 nt, Human
uguucaguuugcuaucauaauc

SEQ ID NO: 1107837 - RNA, 22 nt, Human
uugcuugaacccaggaagugga

SEQ ID NO: 1107838 - RNA, 23 nt, Human
auaugucaugcaccagcacuuua

SEQ ID NO: 1107839 - RNA, 22 nt, Human
auauauacuuugacacauucug

SEQ ID NO: 1107840 - RNA, 22 nt, Human
gagaauguuaauguugaaguau

SEQ ID NO: 1107841 - RNA, 22 nt, Human
uuuuucaagacaaccugcaugu

SEQ ID NO: 1107842 - RNA, 22 nt, Human
uuugacaugugcuuauaacuuu

SEQ ID NO: 1107843 - RNA, 22 nt, Human
uuuaaaccuaucuaagaaauag

SEQ ID NO: 1107844 - RNA, 22 nt, Human
uuggaauuugagaccaagaaaa

SEQ ID NO: 1107845 - RNA, 22 nt, Human
uggaaauacaagaaguauguca

SEQ ID NO: 1107846 - RNA, 22 nt, Human
ucaucaucauucucccccacuu

SEQ ID NO: 1107847 - RNA, 22 nt, Human
uagaggaugauccuuccuugcc

SEQ ID NO: 1107848 - RNA, 22 nt, Human
cuuugugauaguguuaagacca

SEQ ID NO: 1107849 - RNA, 22 nt, Human
auuugugggacuauaaugcagg

SEQ ID NO: 1107850 - RNA, 22 nt, Human
auugagaaaauucgagcaaguu

SEQ ID NO: 1107851 - RNA, 22 nt, Human
aucaacuuguccuugauguuaa

SEQ ID NO: 1107852 - RNA, 22 nt, Human
ucccaaguagaugggaauacag

SEQ ID NO: 1107853 - RNA, 22 nt, Human
cauuguguauuucuguaguacu

SEQ ID NO: 1107854 - RNA, 22 nt, Human
uucuucauucccuuacuuccga

SEQ ID NO: 1107855 - RNA, 19 nt, Human
cauaauacaguggaucuga

SEQ ID NO: 1107856 - RNA, 22 nt, Human
uucaguuuugcuuuuaaucaug

SEQ ID NO: 1107857 - RNA, 22 nt, Human
cacaguuuuaucuuauacugau

SEQ ID NO: 1107858 - RNA, 22 nt, Human
ugaguguuguaaccauaugauu

SEQ ID NO: 1107859 - RNA, 22 nt, Human
guccaucuaaguauccagccug

SEQ ID NO: 1107860 - RNA, 22 nt, Human
uuugaagauaaauauggagaaa

SEQ ID NO: 1107861 - RNA, 22 nt, Human
agucuuagaacuacagugccua

SEQ ID NO: 1107862 - RNA, 22 nt, Human
ucaagaaagggcuucaccagga

SEQ ID NO: 1107863 - RNA, 22 nt, Human
ugugugcacaaagaguacaugg

SEQ ID NO: 1107864 - RNA, 22 nt, Human
uuauuccauagaagucaaggaa

SEQ ID NO: 1107865 - RNA, 22 nt, Human
cagucauuaugggaguuaaucc

SEQ ID NO: 1107866 - RNA, 22 nt, Human
aaaacauuuuacugccaucuca

SEQ ID NO: 1107867 - RNA, 22 nt, Human
ugcaucauuaagguacaguugg

SEQ ID NO: 1107868 - RNA, 22 nt, Human
uuaagagaagaguaucuagaac

SEQ ID NO: 1107869 - RNA, 22 nt, Human
uguggaauguccucagcauccu

SEQ ID NO: 1107870 - RNA, 22 nt, Human
cuucuaauucuuauguaagcuu

SEQ ID NO: 1107871 - RNA, 22 nt, Human
uagaaagagcuuugcuuccuuu

SEQ ID NO: 1107872 - RNA, 22 nt, Human
uagaagaacaugucaaacuaua

SEQ ID NO: 1107873 - RNA, 22 nt, Human
gucccauaaguagugcaacuug

SEQ ID NO: 1107874 - RNA, 22 nt, Human
uuuguugguugcacuggugggu

SEQ ID NO: 1107875 - RNA, 22 nt, Human
aaauugaauuugggaaacauug

SEQ ID NO: 1107876 - RNA, 22 nt, Human
aaugaaacuaguagaaucuuug

SEQ ID NO: 1107877 - RNA, 23 nt, Human
ugaaagcaaugggucuauaguau

SEQ ID NO: 1107878 - RNA, 22 nt, Human
uuuuaauccucuugguaucuua

SEQ ID NO: 1107879 - RNA, 22 nt, Human
uugcacagaugcacaugguugc

SEQ ID NO: 1107880 - RNA, 22 nt, Human
uaccauuucaguaaaaacuuag

SEQ ID NO: 1107881 - RNA, 22 nt, Human
gugguuguuuccagguuugaaa

SEQ ID NO: 1107882 - RNA, 22 nt, Human
uguaaagaaagacgcagaguua

SEQ ID NO: 1107883 - RNA, 22 nt, Human
augcggagccccaagcuugaag

SEQ ID NO: 1107884 - RNA, 22 nt, Human
cucugcaaggcccuccaguagc

SEQ ID NO: 1107885 - RNA, 22 nt, Human
gguagacaacuuuguaauagcc

SEQ ID NO: 1107886 - RNA, 22 nt, Human
ugcuugacuuaguuucucauuu

SEQ ID NO: 1107887 - RNA, 22 nt, Human
uguacauauucaagcacuucua

SEQ ID NO: 1107888 - RNA, 22 nt, Human
uaaaugcaguacaaauuguucu

SEQ ID NO: 1107889 - RNA, 22 nt, Human
ucauacauguuguguucaaaug

SEQ ID NO: 1107890 - RNA, 22 nt, Human
gacauacagcccucucccuggu

SEQ ID NO: 1107891 - RNA, 22 nt, Human
uuuggaaaugagaagccaccuu

SEQ ID NO: 1107892 - RNA, 22 nt, Human
aagauuuaccacuuuauucaag

SEQ ID NO: 1107893 - RNA, 22 nt, Human
uaaaguuuauuggcaccaccau

SEQ ID NO: 1107894 - RNA, 22 nt, Human
gugcacagaaacauacaaugug

SEQ ID NO: 1107895 - RNA, 22 nt, Human
gugcauauguguguauacaaac

SEQ ID NO: 1107896 - RNA, 22 nt, Human
auuuccuauacaguuguccaua

SEQ ID NO: 1107897 - RNA, 22 nt, Human
uagugucuuccaggacauggua

SEQ ID NO: 1107898 - RNA, 22 nt, Human
guaugucuuaggguucaguaac

SEQ ID NO: 1107899 - RNA, 23 nt, Human
uuguucuuggaucuuccugaagc

SEQ ID NO: 1107900 - RNA, 22 nt, Human
gccauguucuugaaucuggguc

SEQ ID NO: 1107901 - RNA, 22 nt, Human
uccugagauaggaguugaaggc

SEQ ID NO: 1107902 - RNA, 20 nt, Human
ccacaguggagacuggagac

SEQ ID NO: 1107903 - RNA, 22 nt, Human
uguaccgccuugugggguuggg

SEQ ID NO: 1107904 - RNA, 22 nt, Human
agaauaaccaguguuucacagu

SEQ ID NO: 1107905 - RNA, 22 nt, Human
auagcuuugagggcuccuuagg

SEQ ID NO: 1107906 - RNA, 22 nt, Human
uuaguguccagaguuuuuauua

SEQ ID NO: 1107907 - RNA, 22 nt, Human
guuccuaagcuguggcccugga

SEQ ID NO: 1107908 - RNA, 22 nt, Human
uggauguuugaaguugcaugug

SEQ ID NO: 1107909 - RNA, 22 nt, Human
cagaaagugauuugcuauucca

SEQ ID NO: 1107910 - RNA, 22 nt, Human
auacaccaccuuggaucuuuca

SEQ ID NO: 1107911 - RNA, 22 nt, Human
ugaauaugugacuuugauuuca

SEQ ID NO: 1107912 - RNA, 22 nt, Human
acaaacuucccagacaagcucc

SEQ ID NO: 1107913 - RNA, 22 nt, Human
cuuuacuucagcaagcuuuccu

SEQ ID NO: 1107914 - RNA, 22 nt, Human
agcucuuuuaucaugaggagag

SEQ ID NO: 1107915 - RNA, 22 nt, Human
uuauugagcacauaguaugugg

SEQ ID NO: 1107916 - RNA, 22 nt, Human
aaauacaguggcagcagauaau

SEQ ID NO: 1107917 - RNA, 22 nt, Human
aaaucaugguggaagaaacaga

SEQ ID NO: 1107918 - RNA, 22 nt, Human
uuugggaaacuuaggggucaga

SEQ ID NO: 1107919 - RNA, 22 nt, Human
acugauuucagggaugagaaga

SEQ ID NO: 1107920 - RNA, 20 nt, Human
uccuaacgaggcccauugca

SEQ ID NO: 1107921 - RNA, 22 nt, Human
ggaugacagaugcaggcuuuga

SEQ ID NO: 1107922 - RNA, 22 nt, Human
cauuuuacgacauagggcaggc

SEQ ID NO: 1107923 - RNA, 22 nt, Human
guuuugaauacuacuagaacuu

SEQ ID NO: 1107924 - RNA, 22 nt, Human
uuuggagagaugaaguucugug

SEQ ID NO: 1107925 - RNA, 22 nt, Human
auagcaaaggacaauagucagu

SEQ ID NO: 1107926 - RNA, 22 nt, Human
uaaccuguuaagggcugaccca

SEQ ID NO: 1107927 - RNA, 22 nt, Human
uuacacaacaucuguauuauua

SEQ ID NO: 1107928 - RNA, 21 nt, Human
uaaaagaugacaagacagcuc

SEQ ID NO: 1107929 - RNA, 22 nt, Human
aguguauuugccuauaaaaaug

SEQ ID NO: 1107930 - RNA, 22 nt, Human
ugcaauuagcguauuaguuuau

SEQ ID NO: 1107931 - RNA, 22 nt, Human
ugauucaguacuuucucuaacu

SEQ ID NO: 1107932 - RNA, 22 nt, Human
uguguuuuggaaggaacaugca

SEQ ID NO: 1107933 - RNA, 22 nt, Human
aauuccagcugauugacuuucc

SEQ ID NO: 1107934 - RNA, 22 nt, Human
augcaggaagagcccuggagcu

SEQ ID NO: 1107935 - RNA, 22 nt, Human
acuguagucuaaauauagucuu

SEQ ID NO: 1107936 - RNA, 22 nt, Human
aggaauuugggguuacaugaug

SEQ ID NO: 1107937 - RNA, 22 nt, Human
uugcucuauguuuguaaacaga

SEQ ID NO: 1107938 - RNA, 22 nt, Human
auauaaguguguggcuguuagu

SEQ ID NO: 1107939 - RNA, 22 nt, Human
acaccacaaguaacucuuuucc

SEQ ID NO: 1107940 - RNA, 22 nt, Human
ucacaauacucacucaauggcu

SEQ ID NO: 1107941 - RNA, 21 nt, Human
acugaacuuguguucuagagg

SEQ ID NO: 1107942 - RNA, 22 nt, Human
gauggaggagauggcagggugc

SEQ ID NO: 1107943 - RNA, 22 nt, Human
uucuaguuacagaagccuugcu

SEQ ID NO: 1107944 - RNA, 22 nt, Human
aauggagugguucuugcccucu

SEQ ID NO: 1107945 - RNA, 22 nt, Human
acuucagugugguauaaaacgu

SEQ ID NO: 1107946 - RNA, 22 nt, Human
uagaaaagccccagcuggaggg

SEQ ID NO: 1107947 - RNA, 22 nt, Human
auuauguagcuaaaaauugugu

SEQ ID NO: 1107948 - RNA, 22 nt, Human
ucuucagacuguuguucuuuug

SEQ ID NO: 1107949 - RNA, 22 nt, Human
ucguuaaucagcaccagaauuc

SEQ ID NO: 1107950 - RNA, 22 nt, Human
acuucacagauauuuauuuggu

SEQ ID NO: 1107951 - RNA, 21 nt, Human
agggaaaaggcugagugaggg

SEQ ID NO: 1107952 - RNA, 17 nt, Human
acuuguauugugcuuua

SEQ ID NO: 1107953 - RNA, 19 nt, Human
cugaaacacagagagggcu

SEQ ID NO: 1107954 - RNA, 22 nt, Human
gaggcauaaguagaagagauug

SEQ ID NO: 1107955 - RNA, 22 nt, Human
cuuccagugcauagguagauca

SEQ ID NO: 1107956 - RNA, 22 nt, Human
auugacuuucccuucuccucau

SEQ ID NO: 1107957 - RNA, 22 nt, Human
uuuucuaacaucuaguaauuug

SEQ ID NO: 1107958 - RNA, 22 nt, Human
auuucauccauuaagaguacuc

SEQ ID NO: 1107959 - RNA, 22 nt, Human
guuuuaguggguggccacugau

SEQ ID NO: 1107960 - RNA, 22 nt, Human
uaaaaucaugacagauugacau

SEQ ID NO: 1107961 - RNA, 22 nt, Human
uccguuuucacacugcuauaaa

SEQ ID NO: 1107962 - RNA, 22 nt, Human
aguaacuuaagcaauuguguau

SEQ ID NO: 1107963 - RNA, 22 nt, Human
guaaaucagugucauuuuagaa

SEQ ID NO: 1107964 - RNA, 22 nt, Human
aagugucuucugauggggugug

SEQ ID NO: 1107965 - RNA, 22 nt, Human
aaugaacacuuagccuuucuau

SEQ ID NO: 1107966 - RNA, 22 nt, Human
cugcacagccugucugggggcc

SEQ ID NO: 1107967 - RNA, 22 nt, Human
gucuccuuguggaucucaagga

SEQ ID NO: 1107968 - RNA, 22 nt, Human
uuucucuuucaaucugcaguac

SEQ ID NO: 1107969 - RNA, 22 nt, Human
ucuucaugucaugguauauuga

SEQ ID NO: 1107970 - RNA, 22 nt, Human
aaugaguuuguucuauuauuug

SEQ ID NO: 1107971 - RNA, 22 nt, Human
ugguaugcuuauuaucuucaac

SEQ ID NO: 1107972 - RNA, 22 nt, Human
gaaaugucaagauauguuugga

SEQ ID NO: 1107973 - RNA, 22 nt, Human
aguuauguccucagcaaaucaa

SEQ ID NO: 1107974 - RNA, 19 nt, Human
aguguuuauguagugccua

SEQ ID NO: 1107975 - RNA, 22 nt, Human
cagcugacaagaguccuuggag

SEQ ID NO: 1107976 - RNA, 22 nt, Human
cuagaaguuuggguccauuaag

SEQ ID NO: 1107977 - RNA, 22 nt, Human
aagaugauuauguagauuggga

SEQ ID NO: 1107978 - RNA, 22 nt, Human
uuuacuguuuacagcuaaugca

SEQ ID NO: 1107979 - RNA, 19 nt, Human
agacaaguuuccagaagcc

SEQ ID NO: 1107980 - RNA, 22 nt, Human
aaagugacaaccauuuauuaag

SEQ ID NO: 1107981 - RNA, 22 nt, Human
gagguauaguucuauuagauga

SEQ ID NO: 1107982 - RNA, 19 nt, Human
uuugauagggcauaauaua

SEQ ID NO: 1107983 - RNA, 22 nt, Human
aggucuacaugcuuaauauauc

SEQ ID NO: 1107984 - RNA, 22 nt, Human
caugucacaauucuuaauggga

SEQ ID NO: 1107985 - RNA, 22 nt, Human
auaucuaggcugaauguaaaau

SEQ ID NO: 1107986 - RNA, 22 nt, Human
guucuccaggggcuguucaucu

SEQ ID NO: 1107987 - RNA, 23 nt, Human
aguacauuugacccaaauaagcu

SEQ ID NO: 1107988 - RNA, 22 nt, Human
acauuucuccuacuuguuauuu

SEQ ID NO: 1107989 - RNA, 22 nt, Human
aucuaaagugucauaaguagcu

SEQ ID NO: 1107990 - RNA, 22 nt, Human
caauguacaaaauaauuacaca

SEQ ID NO: 1107991 - RNA, 22 nt, Human
cauaacauccuugcuacuuuga

SEQ ID NO: 1107992 - RNA, 22 nt, Human
uaacauuucggugacaguggga

SEQ ID NO: 1107993 - RNA, 22 nt, Human
accacaucgggcggacacuggg

SEQ ID NO: 1107994 - RNA, 22 nt, Human
ggaaggaucuggcugaaaucca

SEQ ID NO: 1107995 - RNA, 22 nt, Human
auguacauuauucgagugaugg

SEQ ID NO: 1107996 - RNA, 23 nt, Human
acucugacuuaguuauagcuauu

SEQ ID NO: 1107997 - RNA, 22 nt, Human
cuuuacagugaacuugcuuguc

SEQ ID NO: 1107998 - RNA, 22 nt, Human
aauaaguacuuggggauaacuu

SEQ ID NO: 1107999 - RNA, 22 nt, Human
aucauuugaacagaauuuguuu

SEQ ID NO: 1108000 - RNA, 22 nt, Human
ugucuuaugcugcauagacuau

SEQ ID NO: 1108001 - RNA, 22 nt, Human
uuuguagauuuucucuccagua

SEQ ID NO: 1108002 - RNA, 20 nt, Human
auacuuguuuucaggcuuuu

SEQ ID NO: 1108003 - RNA, 22 nt, Human
uuaaguauauccauuugacugg

SEQ ID NO: 1108004 - RNA, 21 nt, Human
gucuuuuuaauugcgauuucc

SEQ ID NO: 1108005 - RNA, 22 nt, Human
uuacaguuaaugugacuaacca

SEQ ID NO: 1108006 - RNA, 22 nt, Human
uuacaauuacuugaucucagcu

SEQ ID NO: 1108007 - RNA, 23 nt, Human
auuuccuaaaagauaaucauuac

SEQ ID NO: 1108008 - RNA, 22 nt, Human
gaagaaguguaagucuguuuca

SEQ ID NO: 1108009 - RNA, 22 nt, Human
ugauuugaauuuuaaaacacug

SEQ ID NO: 1108010 - RNA, 22 nt, Human
uuuguucaccuagcaaacuuuu

SEQ ID NO: 1108011 - RNA, 22 nt, Human
caguuuuucaaaauuacaugau

SEQ ID NO: 1108012 - RNA, 22 nt, Human
uggauaaaaugacauuaccuga

SEQ ID NO: 1108013 - RNA, 22 nt, Human
acaggauuaauaaaaaauugua

SEQ ID NO: 1108014 - RNA, 22 nt, Human
uaauccaaaacugaaucugugg

SEQ ID NO: 1108015 - RNA, 23 nt, Human
auaauaacgucugucuugucucu

SEQ ID NO: 1108016 - RNA, 22 nt, Human
uuggggaagcuuugaaauacuu

SEQ ID NO: 1108017 - RNA, 22 nt, Human
caucccugauuccuaguacagu

SEQ ID NO: 1108018 - RNA, 22 nt, Human
uucaguaugcugaaugauuuuu

SEQ ID NO: 1108019 - RNA, 22 nt, Human
uaggaaauaauucacucuggcu

SEQ ID NO: 1108020 - RNA, 22 nt, Human
ugcaugacaauugccgucaagu

SEQ ID NO: 1108021 - RNA, 22 nt, Human
cuauuuucccauaugguugaca

SEQ ID NO: 1108022 - RNA, 22 nt, Human
gagcaacacauugaaugaggau

SEQ ID NO: 1108023 - RNA, 22 nt, Human
uuuacgaauggggugacaacuu

SEQ ID NO: 1108024 - RNA, 22 nt, Human
guaaagcaaaauguagagauug

SEQ ID NO: 1108025 - RNA, 22 nt, Human
aaacucuacauggucgcaaaaa

SEQ ID NO: 1108026 - RNA, 22 nt, Human
uauaagaaacaaggcaaauuuu

SEQ ID NO: 1108027 - RNA, 22 nt, Human
acaaacagaguugaaaaauagg

SEQ ID NO: 1108028 - RNA, 22 nt, Human
uaccaaaaccaagccauuaucu

SEQ ID NO: 1108029 - RNA, 22 nt, Human
uuugacaacugugcaguuugua

SEQ ID NO: 1108030 - RNA, 22 nt, Human
uggcuguagaaucagagacuug

SEQ ID NO: 1108031 - RNA, 22 nt, Human
cugcacagucauuuccucucaa

SEQ ID NO: 1108032 - RNA, 22 nt, Human
ucugagagcuguagaagccuau

SEQ ID NO: 1108033 - RNA, 22 nt, Human
cucuggaucugcccugacgcca

SEQ ID NO: 1108034 - RNA, 22 nt, Human
cagucucuggugaguugacagu

SEQ ID NO: 1108035 - RNA, 23 nt, Human
gacagagugagaccuugucuuac

SEQ ID NO: 1108036 - RNA, 22 nt, Human
aaguguguauuuuucuucagug

SEQ ID NO: 1108037 - RNA, 22 nt, Human
uacaagcuuuuguguauaaaug

SEQ ID NO: 1108038 - RNA, 22 nt, Human
agagaagagucuugucaaauua

SEQ ID NO: 1108039 - RNA, 22 nt, Human
cuccuuaaagggagcagcagcu

SEQ ID NO: 1108040 - RNA, 22 nt, Human
cuguuuauucucaucuaaaaug

SEQ ID NO: 1108041 - RNA, 23 nt, Human
agaagcagcuucuggaguaucgg

SEQ ID NO: 1108042 - RNA, 22 nt, Human
ucauuccuccagcgggagucca

SEQ ID NO: 1108043 - RNA, 22 nt, Human
aaucuguuuuaaaguuugugcc

SEQ ID NO: 1108044 - RNA, 22 nt, Human
uuugaaaggagcuuuauccaga

SEQ ID NO: 1108045 - RNA, 22 nt, Human
cgauuuccgcuugaucugaucu

SEQ ID NO: 1108046 - RNA, 20 nt, Human
uuugauugccccucugacuu

SEQ ID NO: 1108047 - RNA, 22 nt, Human
cugaggaucuaauuauuggguc

SEQ ID NO: 1108048 - RNA, 22 nt, Human
uugggauacaucuugcugagcc

SEQ ID NO: 1108049 - RNA, 22 nt, Human
uucauugauuuccuuggaauaa

SEQ ID NO: 1108050 - RNA, 22 nt, Human
uccuuggagaaucuuguuuuac

SEQ ID NO: 1108051 - RNA, 22 nt, Human
aaagcagaacugagagagcugg

SEQ ID NO: 1108052 - RNA, 22 nt, Human
acaguaaucugggaacuuguua

SEQ ID NO: 1108053 - RNA, 22 nt, Human
augcuugaaaguuauuucauuu

SEQ ID NO: 1108054 - RNA, 22 nt, Human
uggagcagccuuuucuaagcaa

SEQ ID NO: 1108055 - RNA, 22 nt, Human
cucugaauggacacuccagugu

SEQ ID NO: 1108056 - RNA, 22 nt, Human
uugaagcauuugcuauagcauu

SEQ ID NO: 1108057 - RNA, 22 nt, Human
gauacuugaggagaucaccaca

SEQ ID NO: 1108058 - RNA, 22 nt, Human
aggaaaugccgcggcucucuuu

SEQ ID NO: 1108059 - RNA, 22 nt, Human
agaaacaucgcuuaguccucau

SEQ ID NO: 1108060 - RNA, 22 nt, Human
agagacauagcacaguuuuucg

SEQ ID NO: 1108061 - RNA, 22 nt, Human
uuuuuugucuugaagaaauggu

SEQ ID NO: 1108062 - RNA, 22 nt, Human
caggaaauucccagaaggacug

SEQ ID NO: 1108063 - RNA, 22 nt, Human
ucuaugucucuggaaggagugu

SEQ ID NO: 1108064 - RNA, 22 nt, Human
ugggguagguaugaaaacuagg

SEQ ID NO: 1108065 - RNA, 22 nt, Human
ucugaaauuuuaguuauagaaa

SEQ ID NO: 1108066 - RNA, 22 nt, Human
aucuuuggguacaaacuugccu

SEQ ID NO: 1108067 - RNA, 22 nt, Human
uagauacauacauuuuaaaaug

SEQ ID NO: 1108068 - RNA, 22 nt, Human
ugcauccuguucuagguuuggg

SEQ ID NO: 1108069 - RNA, 19 nt, Human
aacuacagcgcacuguccu

SEQ ID NO: 1108070 - RNA, 22 nt, Human
acuuuagauauuccucuguaca

SEQ ID NO: 1108071 - RNA, 22 nt, Human
uugacuauacucuggcggaaaa

SEQ ID NO: 1108072 - RNA, 22 nt, Human
uuacuguagcuugacauauguc

SEQ ID NO: 1108073 - RNA, 22 nt, Human
agggcagagauuaauuaagaca

SEQ ID NO: 1108074 - RNA, 22 nt, Human
aaaugcaugugcuauagaugug

SEQ ID NO: 1108075 - RNA, 22 nt, Human
gaaacacucaauuuaguaauuc

SEQ ID NO: 1108076 - RNA, 22 nt, Human
auuuacagacguggauuagugc

SEQ ID NO: 1108077 - RNA, 22 nt, Human
caguauuucauucagaauuguu

SEQ ID NO: 1108078 - RNA, 22 nt, Human
auguauacgugcaggucacagg

SEQ ID NO: 1108079 - RNA, 22 nt, Human
ggaaaaugggaaccugaagcca

SEQ ID NO: 1108080 - RNA, 22 nt, Human
aacuuucugaaaagcuugauca

SEQ ID NO: 1108081 - RNA, 22 nt, Human
cuacuucuguggcucuaagaga

SEQ ID NO: 1108082 - RNA, 22 nt, Human
uuauguauggauggcugaaagu

SEQ ID NO: 1108083 - RNA, 22 nt, Human
auuauugcaagcagugaaggga

SEQ ID NO: 1108084 - RNA, 22 nt, Human
ggaaguuuguauacuggccucu

SEQ ID NO: 1108085 - RNA, 22 nt, Human
uuuccuacugcccuauacacac

SEQ ID NO: 1108086 - RNA, 22 nt, Human
aacaguaugugagauuuacaca

SEQ ID NO: 1108087 - RNA, 22 nt, Human
ugagauucuguucagaaaaaug

SEQ ID NO: 1108088 - RNA, 22 nt, Human
uuugaaauguaucaguauaggu

SEQ ID NO: 1108089 - RNA, 22 nt, Human
auuaguagcacacagagaucag

SEQ ID NO: 1108090 - RNA, 20 nt, Human
aaagauacuuuuuguaaugg

SEQ ID NO: 1108091 - RNA, 22 nt, Human
cgaggagugugaaggcuugucg

SEQ ID NO: 1108092 - RNA, 21 nt, Human
agcauucaaaagaugccauaa

SEQ ID NO: 1108093 - RNA, 22 nt, Human
agacauauuggcuugcuuuaau

SEQ ID NO: 1108094 - RNA, 22 nt, Human
cuugaguaaagaaguauuuuag

SEQ ID NO: 1108095 - RNA, 22 nt, Human
uaucuuaaaaaucgaagcagau

SEQ ID NO: 1108096 - RNA, 22 nt, Human
ugucuacaagccuuguucggca

SEQ ID NO: 1108097 - RNA, 22 nt, Human
agcacguucuucauuacuucac

SEQ ID NO: 1108098 - RNA, 22 nt, Human
ucuuauugugaugaugaagaac

SEQ ID NO: 1108099 - RNA, 22 nt, Human
gggcauuucuugucaauguagg

SEQ ID NO: 1108100 - RNA, 22 nt, Human
guucuucaaagugacaacuaaa

SEQ ID NO: 1108101 - RNA, 22 nt, Human
cuggagaacagagcuguuuaga

SEQ ID NO: 1108102 - RNA, 22 nt, Human
uacagcuugauguuuguguguu

SEQ ID NO: 1108103 - RNA, 22 nt, Human
ggauguuuauccuaucuuaguu

SEQ ID NO: 1108104 - RNA, 22 nt, Human
aacugcuaacugguuugauacu

SEQ ID NO: 1108105 - RNA, 22 nt, Human
acaaaggugagcagaagacaca

SEQ ID NO: 1108106 - RNA, 22 nt, Human
aauuauguuugcuuuagaugga

SEQ ID NO: 1108107 - RNA, 21 nt, Human
gacauugagcgugucgcagug

SEQ ID NO: 1108108 - RNA, 22 nt, Human
cacuguuuuacauguuauuuaa

SEQ ID NO: 1108109 - RNA, 22 nt, Human
aauuagaagcuguuagcaaaau

SEQ ID NO: 1108110 - RNA, 22 nt, Human
aggcauuuaaagauguaagacu

SEQ ID NO: 1108111 - RNA, 22 nt, Human
aucuaugugggaaucauaauag

SEQ ID NO: 1108112 - RNA, 22 nt, Human
uuaaggaacuugucuuucucuu

SEQ ID NO: 1108113 - RNA, 22 nt, Human
cuacauuauguuuauugggacu

SEQ ID NO: 1108114 - RNA, 22 nt, Human
ccaucuucucuugaaccuccuu

SEQ ID NO: 1108115 - RNA, 22 nt, Human
cuugugaaaugccagauaaucu

SEQ ID NO: 1108116 - RNA, 23 nt, Human
cauuugauccucacaauaaaugg

SEQ ID NO: 1108117 - RNA, 22 nt, Human
augcuacauuuugguuuauaaa

SEQ ID NO: 1108118 - RNA, 22 nt, Human
auacuucuuuagcauauugaac

SEQ ID NO: 1108119 - RNA, 22 nt, Human
aauucaaggaucuguuaaaucu

SEQ ID NO: 1108120 - RNA, 22 nt, Human
uuucugcagcagacucagugug

SEQ ID NO: 1108121 - RNA, 22 nt, Human
uagcugcuugaccaggcagugg

SEQ ID NO: 1108122 - RNA, 22 nt, Human
uuccuucuucauuguguuacag

SEQ ID NO: 1108123 - RNA, 22 nt, Human
uuaaggcuguggggauuacugc

SEQ ID NO: 1108124 - RNA, 22 nt, Human
uacauguuauuucacuauuggu

SEQ ID NO: 1108125 - RNA, 22 nt, Human
aguaauggguugaaauuuaguu

SEQ ID NO: 1108126 - RNA, 22 nt, Human
aucauccauggcugaucauaaa

SEQ ID NO: 1108127 - RNA, 22 nt, Human
auagucuuagaaucuugagugu

SEQ ID NO: 1108128 - RNA, 22 nt, Human
ggagcgugcacuccaggcccuu

SEQ ID NO: 1108129 - RNA, 22 nt, Human
guauuaugaaugccgaggcggc

SEQ ID NO: 1108130 - RNA, 20 nt, Human
agugauuuguuaguacauug

SEQ ID NO: 1108131 - RNA, 22 nt, Human
uagaaguuaaaggaauacagaa

SEQ ID NO: 1108132 - RNA, 22 nt, Human
ugcaucuaaguggcuaacaacc

SEQ ID NO: 1108133 - RNA, 22 nt, Human
ucuaaacuuguaaacaagcaua

SEQ ID NO: 1108134 - RNA, 22 nt, Human
uaaucuuagacauguauuuuuc

SEQ ID NO: 1108135 - RNA, 22 nt, Human
gaagauuaccugagaccacuug

SEQ ID NO: 1108136 - RNA, 22 nt, Human
caaacauuuguuggaaccccug

SEQ ID NO: 1108137 - RNA, 22 nt, Human
auguuguugaacucuuugcaug

SEQ ID NO: 1108138 - RNA, 22 nt, Human
uuaauggauuggagguuucaau

SEQ ID NO: 1108139 - RNA, 22 nt, Human
cugauccagagccaaccaaggc

SEQ ID NO: 1108140 - RNA, 22 nt, Human
cacaucauguuaauucauuaca

SEQ ID NO: 1108141 - RNA, 22 nt, Human
uuugagaagauaggggaauacu

SEQ ID NO: 1108142 - RNA, 22 nt, Human
ugugagacguaggccaucgagg

SEQ ID NO: 1108143 - RNA, 22 nt, Human
uugaugcugucuuucagaauca

SEQ ID NO: 1108144 - RNA, 23 nt, Human
cuuuccuuucuuugacacccagc

SEQ ID NO: 1108145 - RNA, 22 nt, Human
aguguucuagcgcugugcuugu

SEQ ID NO: 1108146 - RNA, 22 nt, Human
uggaauguuaaaccucaaugau

SEQ ID NO: 1108147 - RNA, 22 nt, Human
gugaagaugccucaggugaccc

SEQ ID NO: 1108148 - RNA, 22 nt, Human
uacaguaaccagucuacuuaga

SEQ ID NO: 1108149 - RNA, 22 nt, Human
ugacucauauuucauggauacg

SEQ ID NO: 1108150 - RNA, 20 nt, Human
uuuuccacuccucaaaacag

SEQ ID NO: 1108151 - RNA, 22 nt, Human
uaucugucgggagucuuccgga

SEQ ID NO: 1108152 - RNA, 22 nt, Human
aguuuacccacuguugaaauua

SEQ ID NO: 1108153 - RNA, 22 nt, Human
ucagucucuggggcuucuguuu

SEQ ID NO: 1108154 - RNA, 22 nt, Human
uuucaugauuaacuuagugaau

SEQ ID NO: 1108155 - RNA, 22 nt, Human
gcagagcugucuaagucacuuc

SEQ ID NO: 1108156 - RNA, 22 nt, Human
uagcauuucacugaucuucacu

SEQ ID NO: 1108157 - RNA, 22 nt, Human
ugaaauguggagaugguaagua

SEQ ID NO: 1108158 - RNA, 22 nt, Human
caacauuucaaggucuuuagga

SEQ ID NO: 1108159 - RNA, 22 nt, Human
uauuacaguucgaguuucuagg

SEQ ID NO: 1108160 - RNA, 22 nt, Human
auccuaaagcagacagcagguu

SEQ ID NO: 1108161 - RNA, 22 nt, Human
uuggaaauguagaaaagcagau

SEQ ID NO: 1108162 - RNA, 22 nt, Human
auauuuguuuggcagaguucag

SEQ ID NO: 1108163 - RNA, 22 nt, Human
agauuucaauggauauugcaag

SEQ ID NO: 1108164 - RNA, 22 nt, Human
uugauguaauacuuugcaacca

SEQ ID NO: 1108165 - RNA, 22 nt, Human
augacuuaaucauacuugcauu

SEQ ID NO: 1108166 - RNA, 22 nt, Human
caguuuccugaagagaaagaau

SEQ ID NO: 1108167 - RNA, 22 nt, Human
uuucacaugguacugccuguuu

SEQ ID NO: 1108168 - RNA, 22 nt, Human
uaccaggagcccccuucugguc

SEQ ID NO: 1108169 - RNA, 22 nt, Human
aggcagagaaaaaccagauaug

SEQ ID NO: 1108170 - RNA, 22 nt, Human
cauccauagauugagagauggu

SEQ ID NO: 1108171 - RNA, 22 nt, Human
ugaaagaagccucccuuuggag

SEQ ID NO: 1108172 - RNA, 22 nt, Human
gagcuuuucccgucuuucucgu

SEQ ID NO: 1108173 - RNA, 22 nt, Human
caugaaaugauauuuggguggg

SEQ ID NO: 1108174 - RNA, 22 nt, Human
uuuacagagaauguacauaaag

SEQ ID NO: 1108175 - RNA, 22 nt, Human
uauggauauaaucagacuggaa

SEQ ID NO: 1108176 - RNA, 22 nt, Human
auaggcauaacacugauguccu

SEQ ID NO: 1108177 - RNA, 22 nt, Human
auugaagacuugguauccgugg

SEQ ID NO: 1108178 - RNA, 22 nt, Human
uucguuuaguccacaaaugcau

SEQ ID NO: 1108179 - RNA, 22 nt, Human
uauccaaaggaacaaucacagc

SEQ ID NO: 1108180 - RNA, 22 nt, Human
gucaucaucaggcagaugcugc

SEQ ID NO: 1108181 - RNA, 22 nt, Human
agaguuauccuguccuagggga

SEQ ID NO: 1108182 - RNA, 22 nt, Human
agaaguaucaggaagauucuca

SEQ ID NO: 1108183 - RNA, 22 nt, Human
cuccagaggcgacuugcaucac

SEQ ID NO: 1108184 - RNA, 22 nt, Human
aaguuacacauuuucauuguaa

SEQ ID NO: 1108185 - RNA, 22 nt, Human
cugguuaauccauaaacagaga

SEQ ID NO: 1108186 - RNA, 21 nt, Human
uugauuuagcagaucuagcug

SEQ ID NO: 1108187 - RNA, 22 nt, Human
caugcauuucuaccaaggaaua

SEQ ID NO: 1108188 - RNA, 22 nt, Human
acuguucacccagcacuagcag

SEQ ID NO: 1108189 - RNA, 22 nt, Human
augcccugggagugcuguacca

SEQ ID NO: 1108190 - RNA, 22 nt, Human
uuccuuuucuucuaccacaugu

SEQ ID NO: 1108191 - RNA, 22 nt, Human
accauccaaacugcuuucugug

SEQ ID NO: 1108192 - RNA, 22 nt, Human
uuggaaaugcauuuguuauuau

SEQ ID NO: 1108193 - RNA, 22 nt, Human
aucagugacuucuuccaaaguu

SEQ ID NO: 1108194 - RNA, 22 nt, Human
uucuuucugggguccuucggcu

SEQ ID NO: 1108195 - RNA, 23 nt, Human
ugucuccaucucauuacuugggg

SEQ ID NO: 1108196 - RNA, 22 nt, Human
ugguaaaugucuaacaaucacu

SEQ ID NO: 1108197 - RNA, 22 nt, Human
aaaucccacucacgaguuuugc

SEQ ID NO: 1108198 - RNA, 22 nt, Human
guuuccagccuccuggguaaag

SEQ ID NO: 1108199 - RNA, 22 nt, Human
auguccagaguaaagcacauuc

SEQ ID NO: 1108200 - RNA, 22 nt, Human
auccauuuuuucagaaugcucu

SEQ ID NO: 1108201 - RNA, 22 nt, Human
cuuuaguucuagaaagugaaac

SEQ ID NO: 1108202 - RNA, 22 nt, Human
ucaaaaugccgagugcccaggu

SEQ ID NO: 1108203 - RNA, 22 nt, Human
cuugucuaguuccuggugaugu

SEQ ID NO: 1108204 - RNA, 22 nt, Human
gaugugucccuuucaacucaga

SEQ ID NO: 1108205 - RNA, 22 nt, Human
gagucacauacuauguaauaga

SEQ ID NO: 1108206 - RNA, 22 nt, Human
aguaucagaugugauuaaaggg

SEQ ID NO: 1108207 - RNA, 22 nt, Human
augauacaccuaggagugggag

SEQ ID NO: 1108208 - RNA, 22 nt, Human
cuuauguaaacuacagauaaua

SEQ ID NO: 1108209 - RNA, 22 nt, Human
uuucauguuggauacuguuuca

SEQ ID NO: 1108210 - RNA, 22 nt, Human
uacaccagauuauuuauaacau

SEQ ID NO: 1108211 - RNA, 22 nt, Human
aaucuguugucaggaauccaca

SEQ ID NO: 1108212 - RNA, 22 nt, Human
uuugagaaacagacgaaagaca

SEQ ID NO: 1108213 - RNA, 19 nt, Human
gcuguuaaggacccucgga

SEQ ID NO: 1108214 - RNA, 22 nt, Human
aacacuaaaggucaguuagaag

SEQ ID NO: 1108215 - RNA, 22 nt, Human
uacuuugucauucuaaccuucc

SEQ ID NO: 1108216 - RNA, 22 nt, Human
uaaauacuuuuacuccacugau

SEQ ID NO: 1108217 - RNA, 22 nt, Human
auguucaaguaccuuugugucu

SEQ ID NO: 1108218 - RNA, 18 nt, Human
uauaaacacacuuagguu

SEQ ID NO: 1108219 - RNA, 22 nt, Human
gauccacaggaaccaaaacgca

SEQ ID NO: 1108220 - RNA, 22 nt, Human
acaacuuuaauggguuucagcu

SEQ ID NO: 1108221 - RNA, 22 nt, Human
uucucuucacagggaucauccu

SEQ ID NO: 1108222 - RNA, 22 nt, Human
uacauuguguuaaaacagaaga

SEQ ID NO: 1108223 - RNA, 22 nt, Human
agauaaaguccaaacuguguag

SEQ ID NO: 1108224 - RNA, 22 nt, Human
gucaaaacaaaguuaagaauuc

SEQ ID NO: 1108225 - RNA, 22 nt, Human
uuuguaguuguggaugcugaag

SEQ ID NO: 1108226 - RNA, 22 nt, Human
uugaauaguuuuggauagcaua

SEQ ID NO: 1108227 - RNA, 19 nt, Human
ucaaagucugagucacuuu

SEQ ID NO: 1108228 - RNA, 22 nt, Human
ugcugcuuguuuuguaaauaaa

SEQ ID NO: 1108229 - RNA, 22 nt, Human
ccucuaaauuguuugaaguugg

SEQ ID NO: 1108230 - RNA, 19 nt, Human
uuacaugacauaugaagga

SEQ ID NO: 1108231 - RNA, 22 nt, Human
aaugcuuuuugcgaaaugugca

SEQ ID NO: 1108232 - RNA, 22 nt, Human
uuugggcuguacaauuucugua

SEQ ID NO: 1108233 - RNA, 22 nt, Human
cuauacagcagcuuacuaguua

SEQ ID NO: 1108234 - RNA, 22 nt, Human
acuagaaacuaauggauuauua

SEQ ID NO: 1108235 - RNA, 22 nt, Human
auacaacagaaaaugauuauuc

SEQ ID NO: 1108236 - RNA, 22 nt, Human
aucaucaucuaaauugugucgc

SEQ ID NO: 1108237 - RNA, 22 nt, Human
uaugcuagauggaaaaauauug

SEQ ID NO: 1108238 - RNA, 22 nt, Human
acaaucagcacugaguuuaucu

SEQ ID NO: 1108239 - RNA, 22 nt, Human
uuagaaaaaggcuguggucuua

SEQ ID NO: 1108240 - RNA, 22 nt, Human
aacaugaugacauuguaagcuu

SEQ ID NO: 1108241 - RNA, 19 nt, Human
uaugaaguugauaaaaguu

SEQ ID NO: 1108242 - RNA, 22 nt, Human
agcuuuauuugucauucacggc

SEQ ID NO: 1108243 - RNA, 22 nt, Human
uuuuuaagagucuggaaauagu

SEQ ID NO: 1108244 - RNA, 22 nt, Human
ucauggaugauagcuucauugc

SEQ ID NO: 1108245 - RNA, 22 nt, Human
uuaccacagugccugucuaaug

SEQ ID NO: 1108246 - RNA, 22 nt, Human
aaugguaauauuucauaguugu

SEQ ID NO: 1108247 - RNA, 22 nt, Human
auccauuugccgugcuaugugc

SEQ ID NO: 1108248 - RNA, 22 nt, Human
agaaaagaggcuuucuaagcau

SEQ ID NO: 1108249 - RNA, 22 nt, Human
cugguuuuuagugcuuaggagu

SEQ ID NO: 1108250 - RNA, 22 nt, Human
aaggcuauaucucaauacuauu

SEQ ID NO: 1108251 - RNA, 22 nt, Human
gaauguuuaaaaggugcaguuu

SEQ ID NO: 1108252 - RNA, 22 nt, Human
aguuagugaagcucaucacagc

SEQ ID NO: 1108253 - RNA, 22 nt, Human
guucuuaaagauucaucaagca

SEQ ID NO: 1108254 - RNA, 21 nt, Human
aaagugguaaggauuauuuug

SEQ ID NO: 1108255 - RNA, 22 nt, Human
ccauccaugguguugguuguau

SEQ ID NO: 1108256 - RNA, 22 nt, Human
uaacaaaguauuguuuguguau

SEQ ID NO: 1108257 - RNA, 21 nt, Human
caaaagagacugauucuugga

SEQ ID NO: 1108258 - RNA, 22 nt, Human
gaugaguucuuucuauucuauu

SEQ ID NO: 1108259 - RNA, 22 nt, Human
ugacauccuacaccccuggguc

SEQ ID NO: 1108260 - RNA, 22 nt, Human
uuauuuaaaagugguaagauuc

SEQ ID NO: 1108261 - RNA, 21 nt, Human
cuuuggcaagggagaagucac

SEQ ID NO: 1108262 - RNA, 22 nt, Human
aucuguaaauaaaaagggaggu

SEQ ID NO: 1108263 - RNA, 22 nt, Human
aucuucaaggaaaaaauacagu

SEQ ID NO: 1108264 - RNA, 22 nt, Human
accaguuaaagaauaugaggcc

SEQ ID NO: 1108265 - RNA, 22 nt, Human
auugcacaucugcacuacagcc

SEQ ID NO: 1108266 - RNA, 21 nt, Human
uucacaguggauaacuuucug

SEQ ID NO: 1108267 - RNA, 22 nt, Human
acauuuuuggguugaugucuga

SEQ ID NO: 1108268 - RNA, 21 nt, Human
ucaauuauggaugugugcaaa

SEQ ID NO: 1108269 - RNA, 23 nt, Human
uacagccaugucgcugauuuaac

SEQ ID NO: 1108270 - RNA, 22 nt, Human
gcacaaaagguacuucauguag

SEQ ID NO: 1108271 - RNA, 22 nt, Human
uagaugaacagaaagccacugu

SEQ ID NO: 1108272 - RNA, 22 nt, Human
cagcugcuguucaguuuuguuu

SEQ ID NO: 1108273 - RNA, 22 nt, Human
uacuuugagaugaugcugaucg

SEQ ID NO: 1108274 - RNA, 17 nt, Human
auucaugaacauguccu

SEQ ID NO: 1108275 - RNA, 22 nt, Human
uuuaaacuaacaguacacguug

SEQ ID NO: 1108276 - RNA, 22 nt, Human
guuggacaguuugggaagggag

SEQ ID NO: 1108277 - RNA, 22 nt, Human
gucuuuuuuacaccuuacauca

SEQ ID NO: 1108278 - RNA, 22 nt, Human
guugaaauccuaacccccuagu

SEQ ID NO: 1108279 - RNA, 22 nt, Human
aucaagggcgcgugguucggcg

SEQ ID NO: 1108280 - RNA, 23 nt, Human
aacauuuguaaggugauuuuguu

SEQ ID NO: 1108281 - RNA, 22 nt, Human
ugugaagaauuaaugugaauca

SEQ ID NO: 1108282 - RNA, 22 nt, Human
gagaauacaaccagaagcugag

SEQ ID NO: 1108283 - RNA, 22 nt, Human
auuucagaguagaucguuauuu

SEQ ID NO: 1108284 - RNA, 21 nt, Human
uggacauuuacccuucaggga

SEQ ID NO: 1108285 - RNA, 22 nt, Human
auguacaaucuaucacaagaag

SEQ ID NO: 1108286 - RNA, 22 nt, Human
guggucaucuaacuaaauuuuc

SEQ ID NO: 1108287 - RNA, 22 nt, Human
gacaagaugacaucauggcuuc

SEQ ID NO: 1108288 - RNA, 22 nt, Human
uugauuugauuguaauggcucu

SEQ ID NO: 1108289 - RNA, 18 nt, Human
ggaaaaggagugucuagc

SEQ ID NO: 1108290 - RNA, 22 nt, Human
uccaagacaagcacauuccugc

SEQ ID NO: 1108291 - RNA, 22 nt, Human
uagauuaucccugauuugucca

SEQ ID NO: 1108292 - RNA, 22 nt, Human
ucuguauaaaguaccgguggca

SEQ ID NO: 1108293 - RNA, 22 nt, Human
uuaaguccuugguaauuuucuu

SEQ ID NO: 1108294 - RNA, 22 nt, Human
auuaguguuguggcuucauggc

SEQ ID NO: 1108295 - RNA, 22 nt, Human
auuaauaucccccgccguucug

SEQ ID NO: 1108296 - RNA, 22 nt, Human
uuuacuuuugguaaggucauuu

SEQ ID NO: 1108297 - RNA, 22 nt, Variola virus
gucguaaagcguuaaaucaaua

SEQ ID NO: 1108298 - RNA, 22 nt, Human
gccugaggaaugcuccugacuu

SEQ ID NO: 1108299 - RNA, 22 nt, Human
gaaugcacuuccaacaucuauu

SEQ ID NO: 1108300 - RNA, 22 nt, Human
ccagagcugauuccugggacuu

SEQ ID NO: 1108301 - RNA, 22 nt, Human
cacugaaggcugcagcucagcc

SEQ ID NO: 1108302 - RNA, 22 nt, Human
cagcagcccacgcgugcugucc

SEQ ID NO: 1108303 - RNA, 22 nt, Human
gucccacaccuugaggggucuu

SEQ ID NO: 1108304 - RNA, 19 nt, Human
agacacacuugauaugugu

SEQ ID NO: 1108305 - RNA, 22 nt, Human
caggggcucccugggugccagu

SEQ ID NO: 1108306 - RNA, 22 nt, Human
cugaagcacagcauauaaauaa

SEQ ID NO: 1108307 - RNA, 22 nt, Human
agcaggagagcagugcgugguc

SEQ ID NO: 1108308 - RNA, 22 nt, Human
ccugaggggcugcaggccagcu

SEQ ID NO: 1108309 - RNA, 22 nt, Human
uuggcuucucuuaacccuaaag

SEQ ID NO: 1108310 - RNA, 22 nt, Human
cagggcuccccgcaccgcagcc

SEQ ID NO: 1108311 - RNA, 22 nt, Human
aggucacacuuggaucauagaa

SEQ ID NO: 1108312 - RNA, 22 nt, Human
accccagcucugagccacacca

SEQ ID NO: 1108313 - RNA, 22 nt, Human
ggaagggccucgggcgugggac

SEQ ID NO: 1108314 - RNA, 22 nt, Human
acagagcuuaggaugacuccca

SEQ ID NO: 1108315 - RNA, 22 nt, Human
cagagccagcccacuguucccg

SEQ ID NO: 1108316 - RNA, 22 nt, Human
aggaccuguaccucagcaucua

SEQ ID NO: 1108317 - RNA, 22 nt, Human
cuggcagggugggcuuugcuuu

SEQ ID NO: 1108318 - RNA, 22 nt, Human
gccuggccugaacuaggaggug

SEQ ID NO: 1108319 - RNA, 22 nt, Human
caggagugaguuggggucuaca

SEQ ID NO: 1108320 - RNA, 22 nt, Human
gagccuggauugaagugggugg

SEQ ID NO: 1108321 - RNA, 22 nt, Human
cuguuuaucccuuuggucagca

SEQ ID NO: 1108322 - RNA, 22 nt, Human
gagcagcugcagugcagacccu

SEQ ID NO: 1108323 - RNA, 22 nt, Human
gccuggagagcacugugcgcuu

SEQ ID NO: 1108324 - RNA, 22 nt, Human
ggacacaguggaagacagcuug

SEQ ID NO: 1108325 - RNA, 22 nt, Human
gccugcagauauauaggauggu

SEQ ID NO: 1108326 - RNA, 22 nt, Human
gcagcagaggcccuacucuuug

SEQ ID NO: 1108327 - RNA, 22 nt, Human
cauguuuucuaggcuuucacaa

SEQ ID NO: 1108328 - RNA, 22 nt, Human
ccuggcugcuauagcagcaugu

SEQ ID NO: 1108329 - RNA, 22 nt, Human
aagaagaugguuaacuuucagu

SEQ ID NO: 1108330 - RNA, 22 nt, Human
cugacucuccucaagcauaaau

SEQ ID NO: 1108331 - RNA, 19 nt, Human
ucccuggcgccucucgggc

SEQ ID NO: 1108332 - RNA, 23 nt, Human
aggugcagcccuggaccugcccc

SEQ ID NO: 1108333 - RNA, 22 nt, Human
caaaauguucuggcaccuuuaa

SEQ ID NO: 1108334 - RNA, 21 nt, Human
uauuucuuugacucucucccu

SEQ ID NO: 1108335 - RNA, 22 nt, Human
gccaggcugcuggcugcugucc

SEQ ID NO: 1108336 - RNA, 22 nt, Human
gcagcaaucuucacagugucau

SEQ ID NO: 1108337 - RNA, 22 nt, Human
ggcuuccuuucacuacccucag

SEQ ID NO: 1108338 - RNA, 22 nt, Human
gugccugguuuggggaguguuc

SEQ ID NO: 1108339 - RNA, 22 nt, Human
ugagaggcagaauggugccugc

SEQ ID NO: 1108340 - RNA, 22 nt, Human
augcuguagaucuuagccucua

SEQ ID NO: 1108341 - RNA, 22 nt, Human
gagggcugaugcuuacuuauuu

SEQ ID NO: 1108342 - RNA, 19 nt, Human
caucuggaugauucuccug

SEQ ID NO: 1108343 - RNA, 22 nt, Human
cucugugauuuugugagccaga

SEQ ID NO: 1108344 - RNA, 22 nt, Human
ugggggagauugugcaucucua

SEQ ID NO: 1108345 - RNA, 22 nt, Human
agcucagcuuccucuccaugcu

SEQ ID NO: 1108346 - RNA, 22 nt, Human
aagugguagacaaagauaauug

SEQ ID NO: 1108347 - RNA, 22 nt, Human
gccuggagaccugcuccucuac

SEQ ID NO: 1108348 - RNA, 22 nt, Human
cagucccagcugcucagaaggc

SEQ ID NO: 1108349 - RNA, 22 nt, Human
gcuggagccuucugcucuguug

SEQ ID NO: 1108350 - RNA, 22 nt, Human
ccaggaagccucagaugcugag

SEQ ID NO: 1108351 - RNA, 22 nt, Human
agaauucugacaauagaauugg

SEQ ID NO: 1108352 - RNA, 22 nt, Human
aaagagcuaacauugccgagau

SEQ ID NO: 1108353 - RNA, 22 nt, Human
uuucauguuuauggaaaaugag

SEQ ID NO: 1108354 - RNA, 22 nt, Human
acaggcucuggggcaggauggc

SEQ ID NO: 1108355 - RNA, 22 nt, Human
caggaacacaaugagucucaaa

SEQ ID NO: 1108356 - RNA, 18 nt, Human
uggcagccagcugcuccu

SEQ ID NO: 1108357 - RNA, 22 nt, Human
ggcuggcucagggcuugagaga

SEQ ID NO: 1108358 - RNA, 22 nt, Human
aaaauggucucagcuggcacca

SEQ ID NO: 1108359 - RNA, 20 nt, Human
ucagggcaugggacagcccc

SEQ ID NO: 1108360 - RNA, 22 nt, Human
uuccaggggcagcagugauggu

SEQ ID NO: 1108361 - RNA, 22 nt, Human
cugucuguuucugauucaaccu

SEQ ID NO: 1108362 - RNA, 22 nt, Human
ccugccugcaccuucucugggg

SEQ ID NO: 1108363 - RNA, 18 nt, Human
gcaggagauggguggggu

SEQ ID NO: 1108364 - RNA, 22 nt, Human
ucaaauaugugauagaagcuaa

SEQ ID NO: 1108365 - RNA, 22 nt, Human
ugccugcugcuaagcucuuugu

SEQ ID NO: 1108366 - RNA, 22 nt, Human
aucuauuaugcugagaaacugu

SEQ ID NO: 1108367 - RNA, 22 nt, Human
gcuggcagggacagcugcgugu

SEQ ID NO: 1108368 - RNA, 22 nt, Human
ccugugucagccccugccucca

SEQ ID NO: 1108369 - RNA, 22 nt, Human
cagggccauuggcguggcuguc

SEQ ID NO: 1108370 - RNA, 22 nt, Human
cugggcacagcguugggcucuu

SEQ ID NO: 1108371 - RNA, 22 nt, Human
acucugagcaucccaagucuua

SEQ ID NO: 1108372 - RNA, 22 nt, Human
auagauacauuagguaacuugu

SEQ ID NO: 1108373 - RNA, 22 nt, Human
ggcucaggggccaggccugucc

SEQ ID NO: 1108374 - RNA, 22 nt, Human
gcugucagaaggugaaggguaa

SEQ ID NO: 1108375 - RNA, 22 nt, Human
ucuguuuaggcaaaauagcuac

SEQ ID NO: 1108376 - RNA, 22 nt, Human
ugggguggauagaaagugaugu

SEQ ID NO: 1108377 - RNA, 20 nt, Human
agauggugaaggccagggag

SEQ ID NO: 1108378 - RNA, 22 nt, Human
gcaggcuggaggcuguucuggg

SEQ ID NO: 1108379 - RNA, 21 nt, Human
agcugccacccuagcuucuga

SEQ ID NO: 1108380 - RNA, 22 nt, Human
uguccucuaauuggccucuugc

SEQ ID NO: 1108381 - RNA, 22 nt, Human
ccucagcugcuucccuggagcc

SEQ ID NO: 1108382 - RNA, 22 nt, Human
uccuggccugucuggaguagcu

SEQ ID NO: 1108383 - RNA, 22 nt, Human
ccagccaggcuggcuguggagg

SEQ ID NO: 1108384 - RNA, 22 nt, Human
gcuuccugucccucagccauga

SEQ ID NO: 1108385 - RNA, 22 nt, Human
gcaggcugugaggcucagaugg

SEQ ID NO: 1108386 - RNA, 22 nt, Human
ucucagaguaauucuuuaaggu

SEQ ID NO: 1108387 - RNA, 21 nt, Human
aggugggagaccauguagguc

SEQ ID NO: 1108388 - RNA, 22 nt, Human
gcacagaacuucucuuaguagg

SEQ ID NO: 1108389 - RNA, 22 nt, Human
caggugccucaggaugagacaa

SEQ ID NO: 1108390 - RNA, 23 nt, Human
uccuuccuuugagaggcuccauc

SEQ ID NO: 1108391 - RNA, 20 nt, Human
ucuggcucuuugcuccuccc

SEQ ID NO: 1108392 - RNA, 22 nt, Human
uuuccuuccagguuccuaaggc

SEQ ID NO: 1108393 - RNA, 22 nt, Human
caggagcucucaucgucagggc

SEQ ID NO: 1108394 - RNA, 22 nt, Human
cuggcaggcagacuucugcaag

SEQ ID NO: 1108395 - RNA, 22 nt, Human
caucagcacuaugauuaaagua

SEQ ID NO: 1108396 - RNA, 22 nt, Human
gaaggcugaugacagauucugc

SEQ ID NO: 1108397 - RNA, 22 nt, Human
gaggagguuccggguggagaag

SEQ ID NO: 1108398 - RNA, 22 nt, Human
acccagcuggaugcauggaggc

SEQ ID NO: 1108399 - RNA, 22 nt, Human
gccuggaguucagccaaguccc

SEQ ID NO: 1108400 - RNA, 18 nt, Human
ccugccagucuggagcag

SEQ ID NO: 1108401 - RNA, 22 nt, Human
aggcuggguaccugucauaugc

SEQ ID NO: 1108402 - RNA, 22 nt, Human
cagaaauggagcccaggaaucu

SEQ ID NO: 1108403 - RNA, 22 nt, Human
aaaaugugaucuacaaaugcaa

SEQ ID NO: 1108404 - RNA, 22 nt, Human
agacaaaggauuaaugaugaug

SEQ ID NO: 1108405 - RNA, 22 nt, Human
acuauacauugaauguuaaggu

SEQ ID NO: 1108406 - RNA, 22 nt, Human
agagccaggaugucuucugggg

SEQ ID NO: 1108407 - RNA, 22 nt, Human
cugugugugucugcagcauacu

SEQ ID NO: 1108408 - RNA, 23 nt, Human
aaguucaagucacagccugucuu

SEQ ID NO: 1108409 - RNA, 22 nt, Human
gcugcaggagcuggagcugugg

SEQ ID NO: 1108410 - RNA, 22 nt, Human
gcagggacaaggcagguguucu

SEQ ID NO: 1108411 - RNA, 22 nt, Human
ucugagaguacgggcugcgcgc

SEQ ID NO: 1108412 - RNA, 22 nt, Human
gaagcagcagcuggggacaguu

SEQ ID NO: 1108413 - RNA, 22 nt, Human
cggcagagcuuccugcucagcg

SEQ ID NO: 1108414 - RNA, 22 nt, Human
uuugcauucuagaaaaauuucu

SEQ ID NO: 1108415 - RNA, 22 nt, Human
aaagguuaguucuuagaagugc

SEQ ID NO: 1108416 - RNA, 19 nt, Human
cccuggcaggcaagccugg

SEQ ID NO: 1108417 - RNA, 22 nt, Human
gcagagccugggggucugcgga

SEQ ID NO: 1108418 - RNA, 17 nt, Human
cugcuuugugcaacgcu

SEQ ID NO: 1108419 - RNA, 22 nt, Human
uuguuuuggaagaacuuacucu

SEQ ID NO: 1108420 - RNA, 22 nt, Human
aguggccagugcugcucugggg

SEQ ID NO: 1108421 - RNA, 22 nt, Human
aaaaagguugauccagauuagg

SEQ ID NO: 1108422 - RNA, 22 nt, Human
ccuguggcacaugcagggauuc

SEQ ID NO: 1108423 - RNA, 22 nt, Human
uggagcucaaaggccuguggga

SEQ ID NO: 1108424 - RNA, 22 nt, Human
gggugcaggcagcccaggcagg

SEQ ID NO: 1108425 - RNA, 22 nt, Human
acagccagaggagccaggcugg

SEQ ID NO: 1108426 - RNA, 23 nt, Human
ccagcucccaggucugaggacug

SEQ ID NO: 1108427 - RNA, 22 nt, Human
auccuugaaugacucugcccuc

SEQ ID NO: 1108428 - RNA, 22 nt, Human
ugaagguggcauaggagagaug

SEQ ID NO: 1108429 - RNA, 22 nt, Human
gauacauuuuaucuccuaacag

SEQ ID NO: 1108430 - RNA, 22 nt, Human
agggcugggcugcuuguuguca

SEQ ID NO: 1108431 - RNA, 22 nt, Human
accagagauggggcuucucugu

SEQ ID NO: 1108432 - RNA, 22 nt, Human
agguccagcuguugcagccucc

SEQ ID NO: 1108433 - RNA, 22 nt, Human
ggcagagaugugggucagaauc

SEQ ID NO: 1108434 - RNA, 22 nt, Human
agcugagcacauucaaacaggu

SEQ ID NO: 1108435 - RNA, 22 nt, Human
cugcccugagucaugccagaug

SEQ ID NO: 1108436 - RNA, 22 nt, Human
cuuuauguccaccagacugcaa

SEQ ID NO: 1108437 - RNA, 22 nt, Human
gcuguccucugaucucuggagg

SEQ ID NO: 1108438 - RNA, 22 nt, Human
cauugcacuccacccuaggcaa

SEQ ID NO: 1108439 - RNA, 22 nt, Human
uggcucaguuccaucaucugga

SEQ ID NO: 1108440 - RNA, 22 nt, Human
uuucagaucauuuuuuaaguac

SEQ ID NO: 1108441 - RNA, 22 nt, Human
cccaggcagucuggcucuaaag

SEQ ID NO: 1108442 - RNA, 19 nt, Human
ugcagcucagggcaggggc

SEQ ID NO: 1108443 - RNA, 22 nt, Human
uacaguucacaguaucauaaau

SEQ ID NO: 1108444 - RNA, 22 nt, Human
ggggcccagcaccccuccucgc

SEQ ID NO: 1108445 - RNA, 22 nt, Human
acuuugugcccaacagaaagaa

SEQ ID NO: 1108446 - RNA, 22 nt, Human
ugggcuggcugaggcauucacu

SEQ ID NO: 1108447 - RNA, 22 nt, Human
ggcaggagaauggcgugaacuc

SEQ ID NO: 1108448 - RNA, 22 nt, Human
gaaaauguuuguccggagcuga

SEQ ID NO: 1108449 - RNA, 22 nt, Human
uggcaggguggcaacuuuuggu

SEQ ID NO: 1108450 - RNA, 22 nt, Human
cagucccaaggaggaagcaguc

SEQ ID NO: 1108451 - RNA, 22 nt, Human
ugauuuccucuacuagcaauua

SEQ ID NO: 1108452 - RNA, 22 nt, Human
ccucuggggguccucagagucu

SEQ ID NO: 1108453 - RNA, 18 nt, Human
acaaauguagugucuuaa

SEQ ID NO: 1108454 - RNA, 22 nt, Human
aaaucacuaaguuauagugugg

SEQ ID NO: 1108455 - RNA, 22 nt, Human
auuguaauuuuagagaaagugg

SEQ ID NO: 1108456 - RNA, 19 nt, Human
ccagcagcuuugauucucu

SEQ ID NO: 1108457 - RNA, 22 nt, Human
uaugcacagaaguuugcugaau

SEQ ID NO: 1108458 - RNA, 22 nt, Human
cacagggccuugugugacugca

SEQ ID NO: 1108459 - RNA, 22 nt, Human
gccuggagcucuccacuugggg

SEQ ID NO: 1108460 - RNA, 22 nt, Human
aauuucaaugcacucaugguug

SEQ ID NO: 1108461 - RNA, 22 nt, Human
agcagccaaaugaagauuuuac

SEQ ID NO: 1108462 - RNA, 22 nt, Human
gcaagcugcuuaagcucauugu

SEQ ID NO: 1108463 - RNA, 22 nt, Human
aggcacugcagauuacaggcgc

SEQ ID NO: 1108464 - RNA, 22 nt, Human
auuuucugguugagguuuaaca

SEQ ID NO: 1108465 - RNA, 22 nt, Human
agaggccagggacacugcucaa

SEQ ID NO: 1108466 - RNA, 22 nt, Human
agagccagcauuugacacuggc

SEQ ID NO: 1108467 - RNA, 22 nt, Human
guguguccaggcgggagucaag

SEQ ID NO: 1108468 - RNA, 21 nt, Human
aggcucagagaucaaacagua

SEQ ID NO: 1108469 - RNA, 23 nt, Human
cugcagccgcguggggacgugga

SEQ ID NO: 1108470 - RNA, 22 nt, Human
auaugaagaauuccaauuugga

SEQ ID NO: 1108471 - RNA, 22 nt, Human
gugcauuggugcgccacuucac

SEQ ID NO: 1108472 - RNA, 22 nt, Human
acuuaguauuuuucagcuuuga

SEQ ID NO: 1108473 - RNA, 22 nt, Human
ggugcagugguguggcaaaggg

SEQ ID NO: 1108474 - RNA, 22 nt, Human
gcuggugccuuguuguuguuac

SEQ ID NO: 1108475 - RNA, 22 nt, Human
acuggcugaaguuuacuuuuug

SEQ ID NO: 1108476 - RNA, 17 nt, Human
uagagcugguucaggag

SEQ ID NO: 1108477 - RNA, 22 nt, Human
ugccagcuccgaggagcugcag

SEQ ID NO: 1108478 - RNA, 21 nt, Human
ggagggcagcccagacuggcu

SEQ ID NO: 1108479 - RNA, 22 nt, Human
ccacugggggcugcaggcacuc

SEQ ID NO: 1108480 - RNA, 22 nt, Human
uaacagaaauaguaggugaggg

SEQ ID NO: 1108481 - RNA, 22 nt, Human
cugcagcuccccugagaucaag

SEQ ID NO: 1108482 - RNA, 22 nt, Human
ucacuuauugcucaucucaugc

SEQ ID NO: 1108483 - RNA, 22 nt, Human
aaggaagacacagaugaaguga

SEQ ID NO: 1108484 - RNA, 22 nt, Human
ugggcugcuuccucagcugaga

SEQ ID NO: 1108485 - RNA, 23 nt, Human
ugucauugugacuacagaaccag

SEQ ID NO: 1108486 - RNA, 22 nt, Human
uggcccugaggggcugugcccc

SEQ ID NO: 1108487 - RNA, 22 nt, Human
gagugagggcagcaggggcugc

SEQ ID NO: 1108488 - RNA, 22 nt, Human
uuccaugugaguacacugugau

SEQ ID NO: 1108489 - RNA, 20 nt, Human
cagcaguggaugagaguuuu

SEQ ID NO: 1108490 - RNA, 22 nt, Human
cagccugcagggcugccuguug

SEQ ID NO: 1108491 - RNA, 22 nt, Human
uggcugggcccccaccugccuc

SEQ ID NO: 1108492 - RNA, 22 nt, Human
ggagcugcuuugaucugaagaa

SEQ ID NO: 1108493 - RNA, 22 nt, Human
agacagcauggagcugauaaca

SEQ ID NO: 1108494 - RNA, 22 nt, Human
gugggccuugcagggugcaggg

SEQ ID NO: 1108495 - RNA, 22 nt, Human
uguuuuguuuaugagagcacag

SEQ ID NO: 1108496 - RNA, 22 nt, Human
ucuuuacaaucuaagcauaguu

SEQ ID NO: 1108497 - RNA, 20 nt, Human
cuguagggugcagcaggcuc

SEQ ID NO: 1108498 - RNA, 22 nt, Human
acugccuugucucuugccuguu

SEQ ID NO: 1108499 - RNA, 22 nt, Human
acugggccuggauuggcguguc

SEQ ID NO: 1108500 - RNA, 22 nt, Human
gcucucuguuauuaagaucuuu

SEQ ID NO: 1108501 - RNA, 22 nt, Human
gacacagcacuguacaaggaau

SEQ ID NO: 1108502 - RNA, 22 nt, Human
auuuuuccaauuaggauaaaga

SEQ ID NO: 1108503 - RNA, 22 nt, Human
gcuggcuguuggagguaccugc

SEQ ID NO: 1108504 - RNA, 19 nt, Human
uaaaaugucuguggucagu

SEQ ID NO: 1108505 - RNA, 22 nt, Human
ggaggccaucuggcuggaggcu

SEQ ID NO: 1108506 - RNA, 22 nt, Human
cagagcaggcccacugcccucc

SEQ ID NO: 1108507 - RNA, 22 nt, Human
uggcugcuuguuuuagugaggc

SEQ ID NO: 1108508 - RNA, 22 nt, Human
ucaccaggcuggaaugcagugg

SEQ ID NO: 1108509 - RNA, 22 nt, Human
accagccugucugagucguggg

SEQ ID NO: 1108510 - RNA, 22 nt, Human
uggcagcagggccccuggagga

SEQ ID NO: 1108511 - RNA, 22 nt, Human
uguguuuugaacucaucuacug

SEQ ID NO: 1108512 - RNA, 22 nt, Human
ucaacacucuuuggcacaguua

SEQ ID NO: 1108513 - RNA, 22 nt, Human
uccucaggaugugggguagaau

SEQ ID NO: 1108514 - RNA, 22 nt, Human
gagcugggacauggguccucuc

SEQ ID NO: 1108515 - RNA, 22 nt, Human
acagggcaugugcaagagacau

SEQ ID NO: 1108516 - RNA, 22 nt, Human
cucaggauguacuacagaaggc

SEQ ID NO: 1108517 - RNA, 22 nt, Human
agaggccaucugcucugugggg

SEQ ID NO: 1108518 - RNA, 22 nt, Human
augguacaaaauguauaaaguc

SEQ ID NO: 1108519 - RNA, 22 nt, Human
aggugcuuggcucgugcacaca

SEQ ID NO: 1108520 - RNA, 22 nt, Human
gggcaagcucuucagaagcucu

SEQ ID NO: 1108521 - RNA, 22 nt, Human
gcuggccuuugaggaagcugcg

SEQ ID NO: 1108522 - RNA, 22 nt, Human
cugagggccuuggcuccugccc

SEQ ID NO: 1108523 - RNA, 22 nt, Human
ucccuggacagccuugccuggg

SEQ ID NO: 1108524 - RNA, 19 nt, Human
uccccagcaccucugaguc

SEQ ID NO: 1108525 - RNA, 22 nt, Human
ugucagugguagacccagaggu

SEQ ID NO: 1108526 - RNA, 22 nt, Human
agggccugcucuaucacucuca

SEQ ID NO: 1108527 - RNA, 22 nt, Human
aguauguauuuuauacuuacag

SEQ ID NO: 1108528 - RNA, 17 nt, Human
acacagccagguucucc

SEQ ID NO: 1108529 - RNA, 22 nt, Human
gguggggcccuggcacugguau

SEQ ID NO: 1108530 - RNA, 18 nt, Human
gguggccuugacuucucu

SEQ ID NO: 1108531 - RNA, 22 nt, Human
agagaagacuuacagccacagu

SEQ ID NO: 1108532 - RNA, 22 nt, Human
agccacagucugaugccugaga

SEQ ID NO: 1108533 - RNA, 22 nt, Human
ugacacagaaauuaagcuguca

SEQ ID NO: 1108534 - RNA, 22 nt, Human
uuuucucuacaaaauaaccagc

SEQ ID NO: 1108535 - RNA, 22 nt, Human
uccguauuugacuauugcaccg

SEQ ID NO: 1108536 - RNA, 22 nt, Human
gcauacagagaggauguggcau

SEQ ID NO: 1108537 - RNA, 22 nt, Human
uaugcacauauaaccugcacug

SEQ ID NO: 1108538 - RNA, 22 nt, Human
caggccugugacaccgugucug

SEQ ID NO: 1108539 - RNA, 23 nt, Human
caugccaguuugugcaggcagau

SEQ ID NO: 1108540 - RNA, 22 nt, Human
uuuauuaugauggacaccuucg

SEQ ID NO: 1108541 - RNA, 22 nt, Human
gaaaguuucuucauuaagaugu

SEQ ID NO: 1108542 - RNA, 18 nt, Human
guucaaggucaagagaga

SEQ ID NO: 1108543 - RNA, 22 nt, Human
agauuuccaucuuuuucaugug

SEQ ID NO: 1108544 - RNA, 22 nt, Human
aggagcugucagagugccagag

SEQ ID NO: 1108545 - RNA, 22 nt, Human
ugguccuggggaucugcaguga

SEQ ID NO: 1108546 - RNA, 22 nt, Human
ggccugcugacccaaguccugu

SEQ ID NO: 1108547 - RNA, 22 nt, Human
cuuuauguuggggugucuuagu

SEQ ID NO: 1108548 - RNA, 22 nt, Human
cagcccugcacgcugccuccgc

SEQ ID NO: 1108549 - RNA, 22 nt, Human
gggaguggauuauguggaccca

SEQ ID NO: 1108550 - RNA, 20 nt, Human
cccucugcuacacugggagc

SEQ ID NO: 1108551 - RNA, 22 nt, Human
ucugcugcugagcacacuccua

SEQ ID NO: 1108552 - RNA, 22 nt, Human
cagcugccugcaacacaagcuu

SEQ ID NO: 1108553 - RNA, 21 nt, Human
gcaaggcuuuuguguuuccca

SEQ ID NO: 1108554 - RNA, 22 nt, Human
uggcagcuggagggcaauggcc

SEQ ID NO: 1108555 - RNA, 22 nt, Human
gagggcagaaaauuaugcggug

SEQ ID NO: 1108556 - RNA, 22 nt, Human
caggacagguguucuagaucag

SEQ ID NO: 1108557 - RNA, 22 nt, Human
ggguccaggucuucaggcagag

SEQ ID NO: 1108558 - RNA, 22 nt, Human
aggagucagauaugggaaaguu

SEQ ID NO: 1108559 - RNA, 22 nt, Human
ccagcugacgaugccuggucuc

SEQ ID NO: 1108560 - RNA, 22 nt, Human
cugccuggaaggagcaagggga

SEQ ID NO: 1108561 - RNA, 22 nt, Human
agaaaaggauugauggaucaga

SEQ ID NO: 1108562 - RNA, 22 nt, Human
ucagggcacauucugcaguggc

SEQ ID NO: 1108563 - RNA, 22 nt, Human
agcugagcauuugauccaccuc

SEQ ID NO: 1108564 - RNA, 22 nt, Human
cucuggaaaaccacuagcagga

SEQ ID NO: 1108565 - RNA, 22 nt, Human
acaaggaggucuggggggcccu

SEQ ID NO: 1108566 - RNA, 22 nt, Human
accaggaggccuggagcacaaa

SEQ ID NO: 1108567 - RNA, 22 nt, Human
ggcagaaggccucccagcuccu

SEQ ID NO: 1108568 - RNA, 22 nt, Human
uggcacugagcagccgcggcag

SEQ ID NO: 1108569 - RNA, 22 nt, Human
ggguggcuccuaugggcauagc

SEQ ID NO: 1108570 - RNA, 22 nt, Human
aaggucauugguucugaauucu

SEQ ID NO: 1108571 - RNA, 22 nt, Human
ucuggcugcugcgugagugcuu

SEQ ID NO: 1108572 - RNA, 19 nt, Human
aguagcagaaagugcagug

SEQ ID NO: 1108573 - RNA, 22 nt, Human
ccugccugguguaagucuaagg

SEQ ID NO: 1108574 - RNA, 21 nt, Human
aucuuuauuacgcagagaaga

SEQ ID NO: 1108575 - RNA, 21 nt, Human
ucucuggaauuagaccauguu

SEQ ID NO: 1108576 - RNA, 22 nt, Human
ccuuggagcggucagcacuggu

SEQ ID NO: 1108577 - RNA, 22 nt, Human
ccagggcacguugggacaguac

SEQ ID NO: 1108578 - RNA, 22 nt, Human
gguugccggggcaggacuggaa

SEQ ID NO: 1108579 - RNA, 19 nt, Human
agaaaucucgagauuuguu

SEQ ID NO: 1108580 - RNA, 22 nt, Human
uguuccaugucuuuguaggacu

SEQ ID NO: 1108581 - RNA, 22 nt, Human
ggcugaguugagaggauuacuu

SEQ ID NO: 1108582 - RNA, 22 nt, Human
aaaugcaccuugcugugagacu

SEQ ID NO: 1108583 - RNA, 22 nt, Human
aggucauuaaaguuaaaugagg

SEQ ID NO: 1108584 - RNA, 18 nt, Human
cagggcuguggggucacu

SEQ ID NO: 1108585 - RNA, 22 nt, Human
agagaaggucacuaaggaccca

SEQ ID NO: 1108586 - RNA, 18 nt, Human
aguggucuguuauaucau

SEQ ID NO: 1108587 - RNA, 22 nt, Human
cauuucuguacauguuuuggug

SEQ ID NO: 1108588 - RNA, 22 nt, Human
agcagggcuucugugccugugc

SEQ ID NO: 1108589 - RNA, 22 nt, Human
gaaaccucuuagccucucuuug

SEQ ID NO: 1108590 - RNA, 22 nt, Human
gaagagcugugauucaggcuua

SEQ ID NO: 1108591 - RNA, 22 nt, Human
cccuuucccuucuggcucaggg

SEQ ID NO: 1108592 - RNA, 22 nt, Human
aaaugcagguaguauuuauuuu

SEQ ID NO: 1108593 - RNA, 19 nt, Human
aggguccagggagcggcuc

SEQ ID NO: 1108594 - RNA, 22 nt, Human
gucaaguuuauccgcucauuca

SEQ ID NO: 1108595 - RNA, 22 nt, Human
uauuggugggggcagagagaga

SEQ ID NO: 1108596 - RNA, 22 nt, Human
gaaaggucuuccggucuuccag

SEQ ID NO: 1108597 - RNA, 22 nt, Human
cuggagagaaaugacaaagcua

SEQ ID NO: 1108598 - RNA, 20 nt, Human
uauaacaguguugggugugu

SEQ ID NO: 1108599 - RNA, 22 nt, Human
gggccaugagagguucaucaac

SEQ ID NO: 1108600 - RNA, 22 nt, Human
ucagaaauguaagcugaugacu

SEQ ID NO: 1108601 - RNA, 22 nt, Human
ugagccuggggccugggcagcg

SEQ ID NO: 1108602 - RNA, 20 nt, Human
gaagcagcuucauguagaca

SEQ ID NO: 1108603 - RNA, 22 nt, Human
agcugccauccgaggugucaga

SEQ ID NO: 1108604 - RNA, 22 nt, Human
gaaaagggcaagagagagggca

SEQ ID NO: 1108605 - RNA, 22 nt, Human
ggucccaggaaucuguguucua

SEQ ID NO: 1108606 - RNA, 22 nt, Human
gcugugcacuaccuauacaucc

SEQ ID NO: 1108607 - RNA, 22 nt, Human
guguaaggugaaaucaacaaau

SEQ ID NO: 1108608 - RNA, 22 nt, Human
ugggccuccaauuccagcggga

SEQ ID NO: 1108609 - RNA, 22 nt, Human
agggcagcuaaggugcugacug

SEQ ID NO: 1108610 - RNA, 22 nt, Human
gcagguggauuaucagaagugc

SEQ ID NO: 1108611 - RNA, 22 nt, Human
gcccagcaggacagagugguuu

SEQ ID NO: 1108612 - RNA, 18 nt, Human
ccagagcuggcuccucgc

SEQ ID NO: 1108613 - RNA, 22 nt, Human
ggagccagcagggugacacuga

SEQ ID NO: 1108614 - RNA, 22 nt, Human
cagcagcuuugccaagucagcc

SEQ ID NO: 1108615 - RNA, 22 nt, Human
cugggcuucucccccuggcaga

SEQ ID NO: 1108616 - RNA, 22 nt, Human
uccuucagggggccgccugcac

SEQ ID NO: 1108617 - RNA, 22 nt, Human
acagaguaggugcugucgacug

SEQ ID NO: 1108618 - RNA, 22 nt, Human
ugcagaagaaugagcuuggagu

SEQ ID NO: 1108619 - RNA, 22 nt, Human
ugcucauuggcgaucugaggga

SEQ ID NO: 1108620 - RNA, 22 nt, Human
ccugggagguggagguugcagc

SEQ ID NO: 1108621 - RNA, 19 nt, Human
ccagagcccgccagauggg

SEQ ID NO: 1108622 - RNA, 22 nt, Human
uagacacaagagaaggguauaa

SEQ ID NO: 1108623 - RNA, 22 nt, Human
cugcacagagcagggcagacac

SEQ ID NO: 1108624 - RNA, 22 nt, Human
ggaaagaccugagauaggaaua

SEQ ID NO: 1108625 - RNA, 22 nt, Human
agagaacacgugcaucugcaau

SEQ ID NO: 1108626 - RNA, 22 nt, Human
aggccuccuggcuccaggccuu

SEQ ID NO: 1108627 - RNA, 21 nt, Human
uagagaaaagaagcuguuccu

SEQ ID NO: 1108628 - RNA, 22 nt, Human
augcagagacagauguggcaug

SEQ ID NO: 1108629 - RNA, 22 nt, Human
guccuggggauuauagaguguu

SEQ ID NO: 1108630 - RNA, 22 nt, Human
auaugugugaugcauggacuaa

SEQ ID NO: 1108631 - RNA, 22 nt, Human
ugaaggcuguuggauggggaag

SEQ ID NO: 1108632 - RNA, 22 nt, Human
agagccaggaucuguuuugggg

SEQ ID NO: 1108633 - RNA, 20 nt, Human
auauguguacguguauacau

SEQ ID NO: 1108634 - RNA, 22 nt, Human
cucagcagagaccagggaggaa

SEQ ID NO: 1108635 - RNA, 22 nt, Human
aggccugagguuccugugcuca

SEQ ID NO: 1108636 - RNA, 22 nt, Human
gggauggacuuggggacuccag

SEQ ID NO: 1108637 - RNA, 22 nt, Human
augcucugggcaggagcccugg

SEQ ID NO: 1108638 - RNA, 22 nt, Human
uuucacauguggaaugccaggu

SEQ ID NO: 1108639 - RNA, 22 nt, Human
agggccugggguagcuuacugc

SEQ ID NO: 1108640 - RNA, 22 nt, Human
uaaauguauaggcacuaaaccu

SEQ ID NO: 1108641 - RNA, 22 nt, Human
cuggcugcaggaugaggcugcc

SEQ ID NO: 1108642 - RNA, 22 nt, Human
ucaggagagaaagaauacaauu

SEQ ID NO: 1108643 - RNA, 22 nt, Human
gcugcucugcuguguaagcagg

SEQ ID NO: 1108644 - RNA, 22 nt, Human
caagggaccugagauggucucu

SEQ ID NO: 1108645 - RNA, 22 nt, Human
uacauguaauuuucauaguaag

SEQ ID NO: 1108646 - RNA, 21 nt, Human
agugaaauugcaucagaggga

SEQ ID NO: 1108647 - RNA, 22 nt, Human
caggccugcaggaaaggcuccc

SEQ ID NO: 1108648 - RNA, 22 nt, Human
agcugcugagccaggcugaugu

SEQ ID NO: 1108649 - RNA, 22 nt, Human
uaauacuuaccuugcagagucu

SEQ ID NO: 1108650 - RNA, 18 nt, Human
ggagagugacagagucgu

SEQ ID NO: 1108651 - RNA, 22 nt, Human
caccuggcuggaagugcuccgg

SEQ ID NO: 1108652 - RNA, 22 nt, Human
auggcagccuguggacagucaa

SEQ ID NO: 1108653 - RNA, 22 nt, Human
aggccugggucucgugccuacc

SEQ ID NO: 1108654 - RNA, 22 nt, Human
gcucuguacgcaggaugagggg

SEQ ID NO: 1108655 - RNA, 22 nt, Human
ugcagaagacacaagguaacgu

SEQ ID NO: 1108656 - RNA, 22 nt, Human
aaggagcucccggcagaccagg

SEQ ID NO: 1108657 - RNA, 22 nt, Human
aucuagaaaguguugaagauca

SEQ ID NO: 1108658 - RNA, 22 nt, Human
cuggggcugcggacgggagccc

SEQ ID NO: 1108659 - RNA, 22 nt, Human
gggugggccacugagcagcgug

SEQ ID NO: 1108660 - RNA, 22 nt, Human
gcccugcugucuucagaguaua

SEQ ID NO: 1108661 - RNA, 22 nt, Human
aauauguucaaaauagaucacu

SEQ ID NO: 1108662 - RNA, 18 nt, Human
aaauguacuguccauggc

SEQ ID NO: 1108663 - RNA, 22 nt, Human
cuuauaguaugauguugagaau

SEQ ID NO: 1108664 - RNA, 22 nt, Human
gccuguccuggaugcucugcaa

SEQ ID NO: 1108665 - RNA, 22 nt, Human
cuccuucccuucaaguguuccu

SEQ ID NO: 1108666 - RNA, 22 nt, Human
gaagcagcaaguauaggacagg

SEQ ID NO: 1108667 - RNA, 22 nt, Human
ggccuucacgugaccuggcgug

SEQ ID NO: 1108668 - RNA, 22 nt, Human
gggguggauuccuacaggucca

SEQ ID NO: 1108669 - RNA, 22 nt, Human
gagacugcauuguccaaggguu

SEQ ID NO: 1108670 - RNA, 22 nt, Human
gccuggaguacuccuugaagug

SEQ ID NO: 1108671 - RNA, 22 nt, Human
ugcagaaguauuccaggcccca

SEQ ID NO: 1108672 - RNA, 22 nt, Human
uggcagccacaucucguggauu

SEQ ID NO: 1108673 - RNA, 22 nt, Human
ugggcccaagagagucuccaac

SEQ ID NO: 1108674 - RNA, 22 nt, Human
agacagagauacuauguuguca

SEQ ID NO: 1108675 - RNA, 22 nt, Human
gcaggcagucaucuuucauauu

SEQ ID NO: 1108676 - RNA, 22 nt, Human
agcucccagaguccucugccca

SEQ ID NO: 1108677 - RNA, 22 nt, Human
cugggaggugaacagaaaaacu

SEQ ID NO: 1108678 - RNA, 22 nt, Human
guaucuuucccaccaaucacaa

SEQ ID NO: 1108679 - RNA, 22 nt, Human
aaaguuugagugauuugacaca

SEQ ID NO: 1108680 - RNA, 22 nt, Human
cuggagccggaccagggacggu

SEQ ID NO: 1108681 - RNA, 22 nt, Human
uggagccugagucagcggaggc

SEQ ID NO: 1108682 - RNA, 22 nt, Human
cuccagggagcuuggaaagacc

SEQ ID NO: 1108683 - RNA, 22 nt, Human
gggagggauuaguucugccugg

SEQ ID NO: 1108684 - RNA, 22 nt, Human
aggcugggaaaccugaaguugu

SEQ ID NO: 1108685 - RNA, 22 nt, Human
uguguauucagcaagcgaaaca

SEQ ID NO: 1108686 - RNA, 22 nt, Human
agggagaaugaccaagguauau

SEQ ID NO: 1108687 - RNA, 22 nt, Human
ugggugaggaugaugaggcagc

SEQ ID NO: 1108688 - RNA, 22 nt, Human
cuuaacagauacaucugugguu

SEQ ID NO: 1108689 - RNA, 22 nt, Human
aguguuguaugggaugacugcu

SEQ ID NO: 1108690 - RNA, 22 nt, Human
gaauuguacgcuuuacauaggu

SEQ ID NO: 1108691 - RNA, 22 nt, Human
ucagccagguaauguggagaug

SEQ ID NO: 1108692 - RNA, 22 nt, Human
agggccagcugaugagaaugag

SEQ ID NO: 1108693 - RNA, 22 nt, Human
gcagggacugugaucucacaga

SEQ ID NO: 1108694 - RNA, 22 nt, Human
aguaauaauuuauauuagggag

SEQ ID NO: 1108695 - RNA, 22 nt, Human
ggcuccucucuggccgcucccg

SEQ ID NO: 1108696 - RNA, 22 nt, Human
cugccuggaaugccagcuucuc

SEQ ID NO: 1108697 - RNA, 22 nt, Human
caguggguccuaaguacaguuc

SEQ ID NO: 1108698 - RNA, 22 nt, Human
uggccugccugggagcagcagg

SEQ ID NO: 1108699 - RNA, 22 nt, Human
ucuggagcuggagggcaaggca

SEQ ID NO: 1108700 - RNA, 22 nt, Human
ucaggcagcuccaggaauggua

SEQ ID NO: 1108701 - RNA, 22 nt, Human
caguagcaggcacucagcacgu

SEQ ID NO: 1108702 - RNA, 22 nt, Human
uggccucugugggagcugagca

SEQ ID NO: 1108703 - RNA, 22 nt, Human
ggagccagggaagcugcuuccu

SEQ ID NO: 1108704 - RNA, 22 nt, Human
gcccugugcgacucuagagguu

SEQ ID NO: 1108705 - RNA, 22 nt, Human
gcugcaggcauuuuccugggca

SEQ ID NO: 1108706 - RNA, 22 nt, Human
uggcccugcuguaucaucugcu

SEQ ID NO: 1108707 - RNA, 22 nt, Human
ggacagcccauacacaugucug

SEQ ID NO: 1108708 - RNA, 22 nt, Human
aaauguagaccuauagggaccu

SEQ ID NO: 1108709 - RNA, 22 nt, Human
cugccugcugccuguggagggu

SEQ ID NO: 1108710 - RNA, 22 nt, Human
aagaugauguuguguuuucacu

SEQ ID NO: 1108711 - RNA, 22 nt, Human
gggcuguggagccgcgagggcu

SEQ ID NO: 1108712 - RNA, 22 nt, Human
ucaaaugcuguauuguaguaau

SEQ ID NO: 1108713 - RNA, 22 nt, Human
cagucccaggguugguucagcu

SEQ ID NO: 1108714 - RNA, 22 nt, Human
gccauccucugagcacuaggca

SEQ ID NO: 1108715 - RNA, 22 nt, Human
gcagacagcauguugggcuauu

SEQ ID NO: 1108716 - RNA, 22 nt, Human
aucauguuccagaaacagugau

SEQ ID NO: 1108717 - RNA, 22 nt, Human
aagcagcacaguaauauuggug

SEQ ID NO: 1108718 - RNA, 22 nt, Human
aaaagacaucuauuucaggcag

SEQ ID NO: 1108719 - RNA, 22 nt, Human
uugaaucauuacaauagauaag

SEQ ID NO: 1108720 - RNA, 21 nt, Human
aaagagguuaauauuguaagu

SEQ ID NO: 1108721 - RNA, 22 nt, Human
aagacagagggaagcaaugaug

SEQ ID NO: 1108722 - RNA, 18 nt, Human
ugcuggcaacuacuauug

SEQ ID NO: 1108723 - RNA, 22 nt, Human
caggaaagguagucacaaugua

SEQ ID NO: 1108724 - RNA, 22 nt, Human
uuccucucaacaugccugccgg

SEQ ID NO: 1108725 - RNA, 22 nt, Human
uucaagaugccagggacgcggc

SEQ ID NO: 1108726 - RNA, 22 nt, Human
caccagcuuugcccacugccca

SEQ ID NO: 1108727 - RNA, 22 nt, Human
aggagaaguaaggcuagaugau

SEQ ID NO: 1108728 - RNA, 22 nt, Human
cgggcuggcugcagcugcugga

SEQ ID NO: 1108729 - RNA, 22 nt, Human
ccaagggcugcugaggugucca

SEQ ID NO: 1108730 - RNA, 22 nt, Human
aggagcuguuuuguucagcaaa

SEQ ID NO: 1108731 - RNA, 22 nt, Human
uagcagcucacagccucccauu

SEQ ID NO: 1108732 - RNA, 22 nt, Human
ggcuccuguccccucagcugcu

SEQ ID NO: 1108733 - RNA, 23 nt, Human
cccagcagauuguaaagugucca

SEQ ID NO: 1108734 - RNA, 22 nt, Human
cucauggauauaagaacuguuu

SEQ ID NO: 1108735 - RNA, 23 nt, Human
ucaugcccaggcuccagauguca

SEQ ID NO: 1108736 - RNA, 22 nt, Human
ugucccauggacacaacuucuu

SEQ ID NO: 1108737 - RNA, 22 nt, Human
ugucugguggguugacaggcag

SEQ ID NO: 1108738 - RNA, 22 nt, Human
gccugccuuuuggaggcacauu

SEQ ID NO: 1108739 - RNA, 20 nt, Human
ggaagcagagaacuguuuuc

SEQ ID NO: 1108740 - RNA, 21 nt, Human
ggugucaguuuuggucauuag

SEQ ID NO: 1108741 - RNA, 17 nt, Human
ggcugcugugcuggugc

SEQ ID NO: 1108742 - RNA, 22 nt, Human
aggagagagaacacuugggucc

SEQ ID NO: 1108743 - RNA, 22 nt, Human
gaaucacgguauucugcacggg

SEQ ID NO: 1108744 - RNA, 22 nt, Human
gagccagcugagcugcacuguc

SEQ ID NO: 1108745 - RNA, 22 nt, Human
ggccucuggcaggcaggcccuc

SEQ ID NO: 1108746 - RNA, 22 nt, Human
ggucaggguauaaucaagugag

SEQ ID NO: 1108747 - RNA, 22 nt, Human
cucagagaagucuuugcuaaac

SEQ ID NO: 1108748 - RNA, 22 nt, Human
caggugggagcgaggagcuacu

SEQ ID NO: 1108749 - RNA, 22 nt, Human
gggcuggugaggcugcccugca

SEQ ID NO: 1108750 - RNA, 22 nt, Human
auuauauugaguauaaccagag

SEQ ID NO: 1108751 - RNA, 22 nt, Human
agaguguuauuugcucuguauu

SEQ ID NO: 1108752 - RNA, 22 nt, Human
gcagggacgccagggacagcaa

SEQ ID NO: 1108753 - RNA, 22 nt, Human
gcuuccucgcugggcagaggca

SEQ ID NO: 1108754 - RNA, 22 nt, Human
ccuggcugucguuuugugaaau

SEQ ID NO: 1108755 - RNA, 22 nt, Human
caggaggaaaugugacccugcu

SEQ ID NO: 1108756 - RNA, 21 nt, Human
gccugccugcgugacccucuu

SEQ ID NO: 1108757 - RNA, 22 nt, Human
agaugcugugucuguucccuug

SEQ ID NO: 1108758 - RNA, 22 nt, Human
ccaaggagcugcaggcacuugu

SEQ ID NO: 1108759 - RNA, 22 nt, Human
ggcaguggcuccucucuacucc

SEQ ID NO: 1108760 - RNA, 22 nt, Human
gcugucacucaccaggccugca

SEQ ID NO: 1108761 - RNA, 22 nt, Human
ccucagagguguggcaucucug

SEQ ID NO: 1108762 - RNA, 19 nt, Human
augauacaggugaaaauug

SEQ ID NO: 1108763 - RNA, 22 nt, Human
gugcauugcgaugcagacgacc

SEQ ID NO: 1108764 - RNA, 22 nt, Human
gcagggacaacugugcaccuga

SEQ ID NO: 1108765 - RNA, 22 nt, Human
ucagggcacaggccuguggguu

SEQ ID NO: 1108766 - RNA, 23 nt, Human
gggggcugguugacucucugcag

SEQ ID NO: 1108767 - RNA, 22 nt, Human
ucucccacugcaagcccaggcu

SEQ ID NO: 1108768 - RNA, 22 nt, Human
uugucugucccagcuugugcau

SEQ ID NO: 1108769 - RNA, 22 nt, Human
cuggcagcuggaggcuagaggc

SEQ ID NO: 1108770 - RNA, 19 nt, Human
cagcucaguuugauucucu

SEQ ID NO: 1108771 - RNA, 22 nt, Human
cuauuucugccuaaugaccugu

SEQ ID NO: 1108772 - RNA, 22 nt, Human
agcugcuguggggcucggccug

SEQ ID NO: 1108773 - RNA, 21 nt, Human
agcuggcagauauggugucug

SEQ ID NO: 1108774 - RNA, 22 nt, Human
gcagggaccugccacugcuguc

SEQ ID NO: 1108775 - RNA, 22 nt, Human
gcucccugcagcugagaguucc

SEQ ID NO: 1108776 - RNA, 23 nt, Human
uggggcugauggagacggaccag

SEQ ID NO: 1108777 - RNA, 22 nt, Human
aaaaaugugaccacaggguguu

SEQ ID NO: 1108778 - RNA, 22 nt, Human
ggaggaccugcuggcccugcaa

SEQ ID NO: 1108779 - RNA, 22 nt, Human
ucuggccuacuggaguccauga

SEQ ID NO: 1108780 - RNA, 19 nt, Human
ugcaggaggacugagcaga

SEQ ID NO: 1108781 - RNA, 22 nt, Human
ugguggccuugauggcaucugc

SEQ ID NO: 1108782 - RNA, 22 nt, Human
auguagcagauauuugugcaca

SEQ ID NO: 1108783 - RNA, 22 nt, Human
uguucuugagccuuuagaccua

SEQ ID NO: 1108784 - RNA, 22 nt, Human
cauacuuugggauaagagugga

SEQ ID NO: 1108785 - RNA, 22 nt, Human
agcaggguuuggggauuggcac

SEQ ID NO: 1108786 - RNA, 19 nt, Human
cugaggcccauguaccaug

SEQ ID NO: 1108787 - RNA, 22 nt, Human
auggcaggcccagguguucauu

SEQ ID NO: 1108788 - RNA, 22 nt, Human
cauucauuuaugaaauaucuau

SEQ ID NO: 1108789 - RNA, 22 nt, Human
ccucacuuuccuuucuccuggg

SEQ ID NO: 1108790 - RNA, 22 nt, Human
ggugaggcagguggcugcugag

SEQ ID NO: 1108791 - RNA, 22 nt, Human
gcugcucugaaaaugacuguug

SEQ ID NO: 1108792 - RNA, 22 nt, Human
agaggccagguccagaguuugu

SEQ ID NO: 1108793 - RNA, 22 nt, Human
ugugccagccucuggcuguguc

SEQ ID NO: 1108794 - RNA, 22 nt, Human
ggcgcuggccacgguggcucug

SEQ ID NO: 1108795 - RNA, 22 nt, Human
ugcaguggaaagacucagacuu

SEQ ID NO: 1108796 - RNA, 22 nt, Human
gcucagaggcacgaccucuugg

SEQ ID NO: 1108797 - RNA, 22 nt, Human
uggcagcuugaaugcagucuuu

SEQ ID NO: 1108798 - RNA, 22 nt, Human
acagagauggcacagagaaggu

SEQ ID NO: 1108799 - RNA, 22 nt, Human
agggcugcaggcaagauauggc

SEQ ID NO: 1108800 - RNA, 22 nt, Human
ggcagccaugcacgcugccugg

SEQ ID NO: 1108801 - RNA, 22 nt, Human
guccucagggaauguggcgggu

SEQ ID NO: 1108802 - RNA, 22 nt, Human
ugcagccuugccuccucccagc

SEQ ID NO: 1108803 - RNA, 22 nt, Human
ucucuucugaaaccugucuuua

SEQ ID NO: 1108804 - RNA, 22 nt, Human
cuggugggaggcaagguggaag

SEQ ID NO: 1108805 - RNA, 22 nt, Human
ugugcccauuacacagaggcau

SEQ ID NO: 1108806 - RNA, 22 nt, Human
gaugcacagugacccugccagu

SEQ ID NO: 1108807 - RNA, 22 nt, Human
cugaagaggacgcagcagcaag

SEQ ID NO: 1108808 - RNA, 22 nt, Human
gggaugucacugugccuggcac

SEQ ID NO: 1108809 - RNA, 22 nt, Human
agcugagcucaggcugauguaa

SEQ ID NO: 1108810 - RNA, 22 nt, Human
cauacauuuugcauauuuacca

SEQ ID NO: 1108811 - RNA, 22 nt, Human
gcagggucgcucuaggagauca

SEQ ID NO: 1108812 - RNA, 22 nt, Human
ccagggagccuggugugucagc

SEQ ID NO: 1108813 - RNA, 22 nt, Human
ugccugggagugaccaagacuc

SEQ ID NO: 1108814 - RNA, 22 nt, Human
ucagcagugcagggugaggcag

SEQ ID NO: 1108815 - RNA, 22 nt, Human
gaaggagcuaaagggagcccug

SEQ ID NO: 1108816 - RNA, 22 nt, Human
cucugucccagacccaccucuc

SEQ ID NO: 1108817 - RNA, 22 nt, Human
augagacuaccuguaauguggc

SEQ ID NO: 1108818 - RNA, 22 nt, Human
gaggccugggagccuguccucc

SEQ ID NO: 1108819 - RNA, 20 nt, Human
aucuggcucagauccugcag

SEQ ID NO: 1108820 - RNA, 22 nt, Human
acagccagguaaaggcauggca

SEQ ID NO: 1108821 - RNA, 22 nt, Human
acaaagugaauugcaucgaguu

SEQ ID NO: 1108822 - RNA, 21 nt, Human
aagagcugucaggaaggcugc

SEQ ID NO: 1108823 - RNA, 22 nt, Human
ggaugcaggaguugaagaagga

SEQ ID NO: 1108824 - RNA, 22 nt, Human
uggcagcauuuuuuccagaaca

SEQ ID NO: 1108825 - RNA, 21 nt, Human
cugagggccgcagcugggcuc

SEQ ID NO: 1108826 - RNA, 22 nt, Human
cuggccuggggccucagcugcu

SEQ ID NO: 1108827 - RNA, 22 nt, Human
uguacaaugccgagacuaacuc

SEQ ID NO: 1108828 - RNA, 22 nt, Human
ugugacagaucuuuaaauaaug

SEQ ID NO: 1108829 - RNA, 22 nt, Human
uggcugccuuucaccucaucuc

SEQ ID NO: 1108830 - RNA, 22 nt, Human
ccagccaguccagcauuggugu

SEQ ID NO: 1108831 - RNA, 22 nt, Human
caggcacugugcugagcucugc

SEQ ID NO: 1108832 - RNA, 22 nt, Human
ucuggcucaucucuccagguaa

SEQ ID NO: 1108833 - RNA, 22 nt, Human
agcugaaggcuagaacagcugg

SEQ ID NO: 1108834 - RNA, 22 nt, Human
aggcucauucuugccucugagc

SEQ ID NO: 1108835 - RNA, 22 nt, Human
gcuuuuucaaaugaaagcuggu

SEQ ID NO: 1108836 - RNA, 22 nt, Human
aaaggucauugaaaaggaggaa

SEQ ID NO: 1108837 - RNA, 21 nt, Human
acagaguaguugaaacagaga

SEQ ID NO: 1108838 - RNA, 22 nt, Human
agcauuuaggagaauuugagaa

SEQ ID NO: 1108839 - RNA, 22 nt, Human
gcagauggcagcccaggcuggg

SEQ ID NO: 1108840 - RNA, 22 nt, Human
acaacaggguaaggcaggccau

SEQ ID NO: 1108841 - RNA, 22 nt, Human
agaauucucuuccauugaaaca

SEQ ID NO: 1108842 - RNA, 22 nt, Human
agcagcugcagagggcuccccc

SEQ ID NO: 1108843 - RNA, 23 nt, Human
uggauaaagcugugcugcauagg

SEQ ID NO: 1108844 - RNA, 23 nt, Human
uggagaugccccacucccugucu

SEQ ID NO: 1108845 - RNA, 22 nt, Human
gcagcagcccagggcucucaga

SEQ ID NO: 1108846 - RNA, 22 nt, Human
caagggcuucaaguggccaaga

SEQ ID NO: 1108847 - RNA, 22 nt, Human
cugccucaugcugccugcagcc

SEQ ID NO: 1108848 - RNA, 22 nt, Human
aaggcugagggcuguaccuggc

SEQ ID NO: 1108849 - RNA, 22 nt, Human
cuuaagaauauugaaguugugg

SEQ ID NO: 1108850 - RNA, 22 nt, Human
ccuuuuucaauauagaauugca

SEQ ID NO: 1108851 - RNA, 22 nt, Human
caggcacuggggaugcugggau

SEQ ID NO: 1108852 - RNA, 22 nt, Human
gcacagggcugccaggcggcuu

SEQ ID NO: 1108853 - RNA, 22 nt, Human
ggcagaggagcuggaaacaugg

SEQ ID NO: 1108854 - RNA, 22 nt, Human
aggagcugagucagcccgacag

SEQ ID NO: 1108855 - RNA, 22 nt, Human
uucuuucccuuccagcagcucc

SEQ ID NO: 1108856 - RNA, 22 nt, Human
cugggccuagcaacagaggagu

SEQ ID NO: 1108857 - RNA, 22 nt, Human
cuuccucccggcccaugcucug

SEQ ID NO: 1108858 - RNA, 22 nt, Human
agguggcuccucccauggcugg

SEQ ID NO: 1108859 - RNA, 22 nt, Human
agcagccagaaauccagaggug

SEQ ID NO: 1108860 - RNA, 22 nt, Human
gcagagacuccacugucuugug

SEQ ID NO: 1108861 - RNA, 21 nt, Human
ucagaguggaagacaguuuga

SEQ ID NO: 1108862 - RNA, 22 nt, Human
ggcuggcuugccaagcucaggg

SEQ ID NO: 1108863 - RNA, 22 nt, Human
agguacagggugaaaguuuaug

SEQ ID NO: 1108864 - RNA, 22 nt, Human
uggcuuccuggacagaugcggu

SEQ ID NO: 1108865 - RNA, 22 nt, Human
ucaugucaguuucuucuauaaa

SEQ ID NO: 1108866 - RNA, 22 nt, Human
gguucacacuaagcuuaagugg

SEQ ID NO: 1108867 - RNA, 20 nt, Human
agggcagagggauuacaggc

SEQ ID NO: 1108868 - RNA, 22 nt, Human
agagaauuuuaaaagccuugaa

SEQ ID NO: 1108869 - RNA, 22 nt, Human
gagaggccauggcugugcagug

SEQ ID NO: 1108870 - RNA, 22 nt, Human
ugcauauuauguguaucugucu

SEQ ID NO: 1108871 - RNA, 22 nt, Human
gaggaggaaacccuguuccucu

SEQ ID NO: 1108872 - RNA, 22 nt, Human
ucucagagcucacaccuccugg

SEQ ID NO: 1108873 - RNA, 22 nt, Human
ugggcugcugucugcacaugcu

SEQ ID NO: 1108874 - RNA, 22 nt, Human
cccaggccagaacuugguugcu

SEQ ID NO: 1108875 - RNA, 22 nt, Human
ucuuagaaugucaacugauguu

SEQ ID NO: 1108876 - RNA, 22 nt, Human
uagggcaguuucauguuaucuu

SEQ ID NO: 1108877 - RNA, 22 nt, Human
acagcagcuggguucccaccau

SEQ ID NO: 1108878 - RNA, 22 nt, Human
ucugagaggcagaccuuccuaa

SEQ ID NO: 1108879 - RNA, 18 nt, Human
aaagaaggauuggagagc

SEQ ID NO: 1108880 - RNA, 22 nt, Human
ccuccagcgcgauccacuccgg

SEQ ID NO: 1108881 - RNA, 22 nt, Human
gcagccacccucaaggcugaau

SEQ ID NO: 1108882 - RNA, 18 nt, Human
gggcaagcggcugucacc

SEQ ID NO: 1108883 - RNA, 22 nt, Human
acagaauucucucugcagaggc

SEQ ID NO: 1108884 - RNA, 22 nt, Human
cagggugccucccgcucgccgg

SEQ ID NO: 1108885 - RNA, 22 nt, Human
gcagggccagggcucaggcugu

SEQ ID NO: 1108886 - RNA, 19 nt, Human
ugcagaagacacaguggug

SEQ ID NO: 1108887 - RNA, 22 nt, Human
uuuuugcaccaaccuaauagaa

SEQ ID NO: 1108888 - RNA, 20 nt, Human
aagagcugacucacaguggu

SEQ ID NO: 1108889 - RNA, 22 nt, Human
cagguaggauggaagggcucaa

SEQ ID NO: 1108890 - RNA, 22 nt, Human
uggccuggaaaaaugcagaugg

SEQ ID NO: 1108891 - RNA, 22 nt, Human
ccugucucuuucaaucugagag

SEQ ID NO: 1108892 - RNA, 22 nt, Human
uugcagcagggugaauucacuc

SEQ ID NO: 1108893 - RNA, 22 nt, Human
gacuuucucuccucccaggugu

SEQ ID NO: 1108894 - RNA, 22 nt, Human
ggggauggugggaaggcaaucu

SEQ ID NO: 1108895 - RNA, 22 nt, Human
gggcaguggguggcugcagccu

SEQ ID NO: 1108896 - RNA, 22 nt, Human
aaaguguaaggaauuuaaguaa

SEQ ID NO: 1108897 - RNA, 22 nt, Human
ugcagcugguuuagaacuagau

SEQ ID NO: 1108898 - RNA, 22 nt, Human
agccaagcugaucuccugcuga

SEQ ID NO: 1108899 - RNA, 22 nt, Human
ccaggacucaguggggaaaggg

SEQ ID NO: 1108900 - RNA, 22 nt, Human
agcugggaugauaaccucaguc

SEQ ID NO: 1108901 - RNA, 22 nt, Human
ggaggcucccacgcagcucaca

SEQ ID NO: 1108902 - RNA, 22 nt, Human
acugaaggcuuucccaagguca

SEQ ID NO: 1108903 - RNA, 22 nt, Human
aacaguaaugugguguuggguu

SEQ ID NO: 1108904 - RNA, 22 nt, Human
cugacucagcagcugaugaucc

SEQ ID NO: 1108905 - RNA, 22 nt, Human
uaaaucccuacaucuguguuuu

SEQ ID NO: 1108906 - RNA, 18 nt, Human
uggagcagguaggcauga

SEQ ID NO: 1108907 - RNA, 22 nt, Human
gcugcucuacccaugcaucugu

SEQ ID NO: 1108908 - RNA, 22 nt, Human
ugcacuggggucccagcgcacg

SEQ ID NO: 1108909 - RNA, 22 nt, Human
uggcugggagcuggaacugggc

SEQ ID NO: 1108910 - RNA, 22 nt, Human
cacaugcauaaggauaauuacu

SEQ ID NO: 1108911 - RNA, 22 nt, Human
cuaauacucauuucuguaacuc

SEQ ID NO: 1108912 - RNA, 22 nt, Human
caggggacauuaaagcuccaua

SEQ ID NO: 1108913 - RNA, 22 nt, Human
ggcacugauuccauucaugaag

SEQ ID NO: 1108914 - RNA, 22 nt, Human
ugguuuauuucucugaaagguu

SEQ ID NO: 1108915 - RNA, 22 nt, Human
aggccugggcaagaaggggcgu

SEQ ID NO: 1108916 - RNA, 22 nt, Human
ggcugugcgggcagccguggga

SEQ ID NO: 1108917 - RNA, 22 nt, Human
aggccugucuggggcucagcca

SEQ ID NO: 1108918 - RNA, 23 nt, Human
agaagcagcuucuggaguaucgg

SEQ ID NO: 1108919 - RNA, 22 nt, Human
gaggaccacagaugagccugca

SEQ ID NO: 1108920 - RNA, 23 nt, Human
gccucugcucugcguuggggacu

SEQ ID NO: 1108921 - RNA, 22 nt, Human
uagccgcuuaauuauuugguga

SEQ ID NO: 1108922 - RNA, 22 nt, Human
uuuaguaaguucacugcaaagc

SEQ ID NO: 1108923 - RNA, 22 nt, Human
aggcuggcccuacuggcugccu

SEQ ID NO: 1108924 - RNA, 22 nt, Human
aggaggccccuccuggguugcu

SEQ ID NO: 1108925 - RNA, 23 nt, Human
cccuggccuuggggcacaggcug

SEQ ID NO: 1108926 - RNA, 21 nt, Human
cagcaaaucauugggcagacu

SEQ ID NO: 1108927 - RNA, 22 nt, Human
acccagaggcggagguugcagu

SEQ ID NO: 1108928 - RNA, 22 nt, Human
caggcagcguccugcuuccugu

SEQ ID NO: 1108929 - RNA, 22 nt, Human
agagcugugcuuugcaccacgu

SEQ ID NO: 1108930 - RNA, 22 nt, Human
caggggcucugggugaugugag

SEQ ID NO: 1108931 - RNA, 22 nt, Human
aaguguauauaugacuuauaaa

SEQ ID NO: 1108932 - RNA, 22 nt, Human
ggucagggcucuuccaguggcu

SEQ ID NO: 1108933 - RNA, 22 nt, Human
aagauuuaccacuuuauucaag

SEQ ID NO: 1108934 - RNA, 22 nt, Human
ggguacaaagauuucauaagau

SEQ ID NO: 1108935 - RNA, 22 nt, Human
gagaggcugaaaucacaggagc

SEQ ID NO: 1108936 - RNA, 20 nt, Human
uuugagaccagucugcccaa

SEQ ID NO: 1108937 - RNA, 22 nt, Human
gacucagugauuugacaugccu

SEQ ID NO: 1108938 - RNA, 22 nt, Human
gaagccaacauuccaaguagaa

SEQ ID NO: 1108939 - RNA, 21 nt, Human
cucuggagucaagagcuucca

SEQ ID NO: 1108940 - RNA, 22 nt, Human
agcaggaaagaaaaaucugugu

SEQ ID NO: 1108941 - RNA, 22 nt, Human
ucaaagucauggcuaguaauga

SEQ ID NO: 1108942 - RNA, 22 nt, Human
acacuuuacagcuuccuuugca

SEQ ID NO: 1108943 - RNA, 22 nt, Human
ucugggcuugguuagggcuguu

SEQ ID NO: 1108944 - RNA, 22 nt, Human
uacaugaacaaaauagcagaaa

SEQ ID NO: 1108945 - RNA, 22 nt, Human
ucuggcucauaggaaggccauu

SEQ ID NO: 1108946 - RNA, 22 nt, Human
ucugugcucuucucaguaucac

SEQ ID NO: 1108947 - RNA, 22 nt, Human
gagcugccuacauugccaagag

SEQ ID NO: 1108948 - RNA, 22 nt, Human
agcaauauuuaaagguuugcaa

SEQ ID NO: 1108949 - RNA, 22 nt, Human
agccacagagcaggagaccuuu

SEQ ID NO: 1108950 - RNA, 22 nt, Human
ggagggcucaauugacuccuga

SEQ ID NO: 1108951 - RNA, 22 nt, Human
uuuucuuauggugaagcacaaa

SEQ ID NO: 1108952 - RNA, 22 nt, Human
gcaggagcccuggcauguucuu

SEQ ID NO: 1108953 - RNA, 22 nt, Human
acuggcaguggcagcagaaaga

SEQ ID NO: 1108954 - RNA, 19 nt, Human
gcugcuggcucuggcugga

SEQ ID NO: 1108955 - RNA, 22 nt, Human
ugugucagaaggcaauggggau

SEQ ID NO: 1108956 - RNA, 22 nt, Human
cuugcaggcagggccuccugga

SEQ ID NO: 1108957 - RNA, 22 nt, Human
cucuccagaucugcugagccag

SEQ ID NO: 1108958 - RNA, 19 nt, Human
uccaaaggacccaccucca

SEQ ID NO: 1108959 - RNA, 22 nt, Human
ccagggcagcagaauuggggca

SEQ ID NO: 1108960 - RNA, 22 nt, Human
cggagcugccugccaagccugc

SEQ ID NO: 1108961 - RNA, 22 nt, Human
uguguuccugccuggcucuggu

SEQ ID NO: 1108962 - RNA, 17 nt, Human
gcagcagagagacccuc

SEQ ID NO: 1108963 - RNA, 22 nt, Human
gcgaaaaauguguaaauauguu

SEQ ID NO: 1108964 - RNA, 22 nt, Human
agcagggggccacagucacagc

SEQ ID NO: 1108965 - RNA, 22 nt, Human
uggcuucuuagaccaguggccu

SEQ ID NO: 1108966 - RNA, 21 nt, Human
agaaaaguagaguuuucagag

SEQ ID NO: 1108967 - RNA, 22 nt, Human
uaaagguaugucuuaaucaaac

SEQ ID NO: 1108968 - RNA, 22 nt, Human
gaggugagaagggggucagaug

SEQ ID NO: 1108969 - RNA, 19 nt, Human
aagaagcaauaagcuguga

SEQ ID NO: 1108970 - RNA, 22 nt, Human
cagcaaaagccagcauaagcuc

SEQ ID NO: 1108971 - RNA, 22 nt, Human
auguaucaugcaggguccauga

SEQ ID NO: 1108972 - RNA, 22 nt, Human
auuguacaugcagugagucauc

SEQ ID NO: 1108973 - RNA, 22 nt, Human
caagagcucccagaccugggca

SEQ ID NO: 1108974 - RNA, 22 nt, Human
ugacacauuaaaugcucacaaa

SEQ ID NO: 1108975 - RNA, 20 nt, Human
cacugaagacuucuugcuca

SEQ ID NO: 1108976 - RNA, 22 nt, Human
gcugcuccgucugagcucuggu

SEQ ID NO: 1108977 - RNA, 22 nt, Human
aaggcacuuaacgugggaggau

SEQ ID NO: 1108978 - RNA, 22 nt, Human
cacugggcguguccugggugag

SEQ ID NO: 1108979 - RNA, 22 nt, Human
uaaaugugagugaugcggugaa

SEQ ID NO: 1108980 - RNA, 22 nt, Human
uucacaggaggguggaugcaug

SEQ ID NO: 1108981 - RNA, 22 nt, Human
aaagccuuggucaucugguucc

SEQ ID NO: 1108982 - RNA, 22 nt, Human
ucaguuuuguauguuguaaguc

SEQ ID NO: 1108983 - RNA, 22 nt, Human
aguuuaugaaacacagauuuga

SEQ ID NO: 1108984 - RNA, 22 nt, Human
ucucacugcaaauauuauguau

SEQ ID NO: 1108985 - RNA, 22 nt, Human
cccagcucuuuuagcggcaucu

SEQ ID NO: 1108986 - RNA, 23 nt, Human
cacaccaggagccgucugggcca

SEQ ID NO: 1108987 - RNA, 22 nt, Human
uguacaaugccagggaacacca

SEQ ID NO: 1108988 - RNA, 22 nt, Human
ucccagagguugagucacuuau

SEQ ID NO: 1108989 - RNA, 22 nt, Human
cuuagaaauaaugguuucaguu

SEQ ID NO: 1108990 - RNA, 22 nt, Human
cacauuucugugagucaauauu

SEQ ID NO: 1108991 - RNA, 22 nt, Human
uggcccugcuuaugucucucuu

SEQ ID NO: 1108992 - RNA, 21 nt, Human
aagaagcaauuuauuggaagg

SEQ ID NO: 1108993 - RNA, 22 nt, Human
ugaggcuggcaaggcugguauu

SEQ ID NO: 1108994 - RNA, 22 nt, Human
aagccaggggcugcuuaggaga

SEQ ID NO: 1108995 - RNA, 22 nt, Human
aaugauggauuuagacaagcug

SEQ ID NO: 1108996 - RNA, 22 nt, Human
cugaagcaaaugaaacagcucu

SEQ ID NO: 1108997 - RNA, 22 nt, Human
cacaaaaguaggaggcaggcgg

SEQ ID NO: 1108998 - RNA, 22 nt, Human
aggagccaagauggggcaagua

SEQ ID NO: 1108999 - RNA, 22 nt, Human
ucagagguaagggcugagagga

SEQ ID NO: 1109000 - RNA, 22 nt, Human
gcagguguggaguggggugagc

SEQ ID NO: 1109001 - RNA, 22 nt, Human
ccagcgcuucccaucagggagg

SEQ ID NO: 1109002 - RNA, 22 nt, Human
gcaggagccacuucagggaugc

SEQ ID NO: 1109003 - RNA, 22 nt, Human
aucagcaagacuaggggaauac

SEQ ID NO: 1109004 - RNA, 22 nt, Human
ucuaaaaaagucuguucacuug

SEQ ID NO: 1109005 - RNA, 22 nt, Human
cugcucugaguauuaacggagg

SEQ ID NO: 1109006 - RNA, 22 nt, Human
aggcacugguccauuuucugca

SEQ ID NO: 1109007 - RNA, 22 nt, Human
gcuucucucucagacugcaagc

SEQ ID NO: 1109008 - RNA, 22 nt, Human
cucaggagacaguguccacaug

SEQ ID NO: 1109009 - RNA, 22 nt, Human
acauuuaaauaugccuuauauu

SEQ ID NO: 1109010 - RNA, 22 nt, Human
uuugcauuguaauauuuaguuc

SEQ ID NO: 1109011 - RNA, 22 nt, Human
cacacauugaauucauucuugu

SEQ ID NO: 1109012 - RNA, 22 nt, Human
auacaucuaugccuuucugaca

SEQ ID NO: 1109013 - RNA, 22 nt, Human
gaaaucugaaucuucuguuggu

SEQ ID NO: 1109014 - RNA, 22 nt, Human
uagggcaggggaggaaucugaa

SEQ ID NO: 1109015 - RNA, 22 nt, Human
acagggccagccugggaccugg

SEQ ID NO: 1109016 - RNA, 22 nt, Human
cacugucuuuugugaagacaau

SEQ ID NO: 1109017 - RNA, 23 nt, Human
agcaauaagaagggauacaugug

SEQ ID NO: 1109018 - RNA, 22 nt, Human
caguccaggccuggaggagcca

SEQ ID NO: 1109019 - RNA, 22 nt, Human
uuacauuuuaguuaaccuguga

SEQ ID NO: 1109020 - RNA, 22 nt, Human
guuuuuccuugcugaggacccg

SEQ ID NO: 1109021 - RNA, 22 nt, Human
ggggcagauggaacagagcaca

SEQ ID NO: 1109022 - RNA, 22 nt, Human
uauguguacaucugguugagca

SEQ ID NO: 1109023 - RNA, 22 nt, Human
gcuggccauagaagccaaagag

SEQ ID NO: 1109024 - RNA, 22 nt, Human
ugcagcaggcacaggacggaag

SEQ ID NO: 1109025 - RNA, 22 nt, Human
agcuuuaugggagcuuagauaa

SEQ ID NO: 1109026 - RNA, 22 nt, Human
caguggcugugaccagggaccu

SEQ ID NO: 1109027 - RNA, 22 nt, Human
agcagggcagcugaugcgcacg

SEQ ID NO: 1109028 - RNA, 22 nt, Human
aggcagcccacaggacacagga

SEQ ID NO: 1109029 - RNA, 22 nt, Human
aaaaauagcuucucuugucccu

SEQ ID NO: 1109030 - RNA, 22 nt, Human
gagaagccgagucagcugagcc

SEQ ID NO: 1109031 - RNA, 22 nt, Human
acugcagggcauccuggccaag

SEQ ID NO: 1109032 - RNA, 22 nt, Human
acaggcugcccgcuccccaccu

SEQ ID NO: 1109033 - RNA, 23 nt, Human
gccagccuugcucuccugcagcc

SEQ ID NO: 1109034 - RNA, 22 nt, Human
uggcucaggauaauuuucccaa

SEQ ID NO: 1109035 - RNA, 22 nt, Human
aaggaggaauuucagggugaau

SEQ ID NO: 1109036 - RNA, 22 nt, Human
uagggcagcugcaucaggcacu

SEQ ID NO: 1109037 - RNA, 22 nt, Human
ucaagcaucuuggucuacgauc

SEQ ID NO: 1109038 - RNA, 22 nt, Human
uugaccauaccuccaggcaguu

SEQ ID NO: 1109039 - RNA, 22 nt, Human
aaaaaucacuuuuauaggcagc

SEQ ID NO: 1109040 - RNA, 22 nt, Human
gugcagagaaaugagaagucga

SEQ ID NO: 1109041 - RNA, 22 nt, Human
cagcagugucuccagcaucaca

SEQ ID NO: 1109042 - RNA, 22 nt, Human
cuacacaguucugccuaauggc

SEQ ID NO: 1109043 - RNA, 22 nt, Human
agguacagaugaaagucuaguu

SEQ ID NO: 1109044 - RNA, 22 nt, Human
agccccucuguggcucugccuc

SEQ ID NO: 1109045 - RNA, 22 nt, Human
ucagaccauccugcuguuagug

SEQ ID NO: 1109046 - RNA, 22 nt, Human
uuccuguauuuugcgaauuuuc

SEQ ID NO: 1109047 - RNA, 22 nt, Human
uuguggcucgugagauguuagg

SEQ ID NO: 1109048 - RNA, 22 nt, Human
agugaguggguuacagauggga

SEQ ID NO: 1109049 - RNA, 22 nt, Human
ggcucagaaacuaaaggcgcug

SEQ ID NO: 1109050 - RNA, 22 nt, Human
uacaaaugaccauagccacuua

SEQ ID NO: 1109051 - RNA, 22 nt, Human
gugccugggcaugagcuuguug

SEQ ID NO: 1109052 - RNA, 22 nt, Human
cagccugacaccagcuuugggc

SEQ ID NO: 1109053 - RNA, 22 nt, Human
gcugucccgaaccccugguaau

SEQ ID NO: 1109054 - RNA, 22 nt, Human
gcccuggccuucaucucagaca

SEQ ID NO: 1109055 - RNA, 22 nt, Human
cugcaagauuggaagaugcaau

SEQ ID NO: 1109056 - RNA, 22 nt, Human
ucugucugcgcuugcccuggug

SEQ ID NO: 1109057 - RNA, 22 nt, Human
ccugccugauuccaggauggcu

SEQ ID NO: 1109058 - RNA, 19 nt, Human
ucuaacagaagugucgucc

SEQ ID NO: 1109059 - RNA, 23 nt, Human
uagagcagggaaaucugucagag

SEQ ID NO: 1109060 - RNA, 22 nt, Human
caggcugagcucuggccugggc

SEQ ID NO: 1109061 - RNA, 22 nt, Human
uuucacauaaauauuaugccua

SEQ ID NO: 1109062 - RNA, 22 nt, Human
gcacugaacuuuaaucauuucu

SEQ ID NO: 1109063 - RNA, 22 nt, Human
uagauuuccucuuccucauucc

SEQ ID NO: 1109064 - RNA, 21 nt, Human
ugguuugcggccaaaguuaaa

SEQ ID NO: 1109065 - RNA, 22 nt, Human
uggcccucagucuugcuccugc

SEQ ID NO: 1109066 - RNA, 22 nt, Human
ucucauguauugcccuggugug

SEQ ID NO: 1109067 - RNA, 22 nt, Human
gccucccuguucuuccacaaua

SEQ ID NO: 1109068 - RNA, 22 nt, Human
agagggaucacccuguuucugg

SEQ ID NO: 1109069 - RNA, 22 nt, Human
agcaaagucaguggaaccaucc

SEQ ID NO: 1109070 - RNA, 22 nt, Human
acaaaugcaaguuuuaugucaa

SEQ ID NO: 1109071 - RNA, 22 nt, Human
gcugucacaucaaggcacuaaa

SEQ ID NO: 1109072 - RNA, 22 nt, Human
uguauauucugccuaaaagcuu

SEQ ID NO: 1109073 - RNA, 22 nt, Human
guccuggcuuaguucgcuguaa

SEQ ID NO: 1109074 - RNA, 22 nt, Human
agccaggcugcaguuggcuggc

SEQ ID NO: 1109075 - RNA, 21 nt, Human
gcagggacaaagcuucaggag

SEQ ID NO: 1109076 - RNA, 22 nt, Human
cugggcacaggggagcagaguc

SEQ ID NO: 1109077 - RNA, 22 nt, Human
ucaaaugcaggucuggucuugg

SEQ ID NO: 1109078 - RNA, 22 nt, Human
gcacugcagguggguggagagg

SEQ ID NO: 1109079 - RNA, 21 nt, Human
ugccagcauguaggcuaguug

SEQ ID NO: 1109080 - RNA, 22 nt, Human
caaugauguuuagauaaaaucc

SEQ ID NO: 1109081 - RNA, 22 nt, Human
uauacuuuccugcaacuuugau

SEQ ID NO: 1109082 - RNA, 23 nt, Human
cuggcucuguagguggcauccuu

SEQ ID NO: 1109083 - RNA, 22 nt, Human
ggcagcucugcuccacaugagu

SEQ ID NO: 1109084 - RNA, 22 nt, Human
caggagugaaaugaggcccagg

SEQ ID NO: 1109085 - RNA, 22 nt, Human
aacaacugaaaagcuuuuucug

SEQ ID NO: 1109086 - RNA, 22 nt, Human
acagggcagagugaaaugcuau

SEQ ID NO: 1109087 - RNA, 22 nt, Human
ucccagccauuccuuuaggugu

SEQ ID NO: 1109088 - RNA, 20 nt, Human
cagagcuguuauggaugaug

SEQ ID NO: 1109089 - RNA, 22 nt, Human
aggagcuggaguccaggcaagu

SEQ ID NO: 1109090 - RNA, 21 nt, Human
ccugugugucugacugggcua

SEQ ID NO: 1109091 - RNA, 22 nt, Human
ggcagcuggggcagugcccugu

SEQ ID NO: 1109092 - RNA, 22 nt, Human
gccuggugugcgccgcgcagcu

SEQ ID NO: 1109093 - RNA, 22 nt, Human
ggcugucucugugacugccacc

SEQ ID NO: 1109094 - RNA, 22 nt, Human
acagacagggcaccugccuccu

SEQ ID NO: 1109095 - RNA, 22 nt, Human
aagugaguggccuggagaggug

SEQ ID NO: 1109096 - RNA, 22 nt, Human
uaauuuaauuccauggauucua

SEQ ID NO: 1109097 - RNA, 22 nt, Human
gagugugggcacgggggccuug

SEQ ID NO: 1109098 - RNA, 22 nt, Human
gaggagcacaugaggcugaggg

SEQ ID NO: 1109099 - RNA, 22 nt, Human
acagaccaaaaaaggauauugg

SEQ ID NO: 1109100 - RNA, 22 nt, Human
cagcagggaagcugugcuguuu

SEQ ID NO: 1109101 - RNA, 22 nt, Human
uaaauguaccuucugccuuacu

SEQ ID NO: 1109102 - RNA, 22 nt, Human
caggucagagucccccuguccu

SEQ ID NO: 1109103 - RNA, 22 nt, Human
ugggcugcugagaaugagagag

SEQ ID NO: 1109104 - RNA, 22 nt, Human
uggcucuggauuaaucuaggaa

SEQ ID NO: 1109105 - RNA, 22 nt, Human
gaggccugguuuccagcauccu

SEQ ID NO: 1109106 - RNA, 22 nt, Human
cagcagagacgguaagcagaac

SEQ ID NO: 1109107 - RNA, 22 nt, Human
uggcagaggaaaaagucacugg

SEQ ID NO: 1109108 - RNA, 19 nt, Human
guaagggcuaauggacuau

SEQ ID NO: 1109109 - RNA, 22 nt, Human
auuagcugaccucuaaggagcc

SEQ ID NO: 1109110 - RNA, 22 nt, Human
cagagcagguaucuuuggugaa

SEQ ID NO: 1109111 - RNA, 22 nt, Human
ccuuucucuaucgacccaucgc

SEQ ID NO: 1109112 - RNA, 22 nt, Human
gaaggccucacucugcagcaua

SEQ ID NO: 1109113 - RNA, 22 nt, Human
ucugggagguaaccaugcugau

SEQ ID NO: 1109114 - RNA, 22 nt, Human
gcagaacauuucacaguaucuu

SEQ ID NO: 1109115 - RNA, 22 nt, Human
uccuucagcuuauuucuuagga

SEQ ID NO: 1109116 - RNA, 22 nt, Human
gcucccugccuacacggaccuu

SEQ ID NO: 1109117 - RNA, 22 nt, Human
cagagacaguuucacagggucu

SEQ ID NO: 1109118 - RNA, 22 nt, Human
auguucaaacuuuuuacacacc

SEQ ID NO: 1109119 - RNA, 22 nt, Human
gccagcuggagugagagugggc

SEQ ID NO: 1109120 - RNA, 22 nt, Human
aggccugagcagaggaguggac

SEQ ID NO: 1109121 - RNA, 22 nt, Human
cagagccauuauggagacuugc

SEQ ID NO: 1109122 - RNA, 21 nt, Human
gcagcuggucucagagcuugc

SEQ ID NO: 1109123 - RNA, 22 nt, Human
ggagugaaucacuagaugcaga

SEQ ID NO: 1109124 - RNA, 22 nt, Human
acauacuuuuuaaaagauugcu

SEQ ID NO: 1109125 - RNA, 22 nt, Human
uucuggaggccccuuccuucuc

SEQ ID NO: 1109126 - RNA, 22 nt, Human
gguggggccugcuccagcggcc

SEQ ID NO: 1109127 - RNA, 22 nt, Human
cugcucugacccuuucaccuuc

SEQ ID NO: 1109128 - RNA, 22 nt, Human
caaagccucugauuucacuugu

SEQ ID NO: 1109129 - RNA, 22 nt, Human
aaaucuggccccuugccuauuu

SEQ ID NO: 1109130 - RNA, 22 nt, Human
ucccagagcaguacuccaggag

SEQ ID NO: 1109131 - RNA, 18 nt, Human
ugggauggagaguaacug

SEQ ID NO: 1109132 - RNA, 22 nt, Human
guccugggaaggaagccaggga

SEQ ID NO: 1109133 - RNA, 22 nt, Human
ucuggcucuguguccucaccca

SEQ ID NO: 1109134 - RNA, 22 nt, Human
gcaggagcagucaggggcagcu

SEQ ID NO: 1109135 - RNA, 22 nt, Human
gcagcuguguaaugagcccaca

SEQ ID NO: 1109136 - RNA, 22 nt, Human
ucaggggcuugaggugcauguc

SEQ ID NO: 1109137 - RNA, 22 nt, Human
cacugcucgcugcagcauggcc

SEQ ID NO: 1109138 - RNA, 22 nt, Human
ccagugcacagccaggcaggug

SEQ ID NO: 1109139 - RNA, 22 nt, Human
cauugacaguucuuuaaguugc

SEQ ID NO: 1109140 - RNA, 21 nt, Human
caugaagccgguucccuguuu

SEQ ID NO: 1109141 - RNA, 22 nt, Human
aaagcaguauauugguaguugu

SEQ ID NO: 1109142 - RNA, 22 nt, Human
cagaggccccagaacuagcucu

SEQ ID NO: 1109143 - RNA, 22 nt, Human
cagggccugcuuccuucuuguu

SEQ ID NO: 1109144 - RNA, 22 nt, Human
gggccccuuguaucucuggcuc

SEQ ID NO: 1109145 - RNA, 22 nt, Human
ugggcuggcugaacuucaaccu

SEQ ID NO: 1109146 - RNA, 21 nt, Human
gccacugcacuccagccuggg

SEQ ID NO: 1109147 - RNA, 22 nt, Human
aggcagccagauggcagccugc

SEQ ID NO: 1109148 - RNA, 22 nt, Human
cagagguaccagcagccucugg

SEQ ID NO: 1109149 - RNA, 22 nt, Human
ucucagagaccugaacucccug

SEQ ID NO: 1109150 - RNA, 23 nt, Human
ggggccugcaccggucugcgcgg

SEQ ID NO: 1109151 - RNA, 22 nt, Human
cugcaggcaucuaacugugggc

SEQ ID NO: 1109152 - RNA, 22 nt, Human
uggccucuggcugaggacuaac

SEQ ID NO: 1109153 - RNA, 22 nt, Human
ccagaagucaggaaugagucuu

SEQ ID NO: 1109154 - RNA, 20 nt, Human
caaugcacacagcugcuucu

SEQ ID NO: 1109155 - RNA, 22 nt, Human
ccaaggagaaaugcugugcuuu

SEQ ID NO: 1109156 - RNA, 22 nt, Human
uggccuggaaccuggcagggac

SEQ ID NO: 1109157 - RNA, 22 nt, Human
aaggagugcaugacucagagua

SEQ ID NO: 1109158 - RNA, 18 nt, Human
auuuugaacaaugcugua

SEQ ID NO: 1109159 - RNA, 22 nt, Human
gcugggagcaaguacucaucuu

SEQ ID NO: 1109160 - RNA, 22 nt, Human
cugagccagcuggcaugugcua

SEQ ID NO: 1109161 - RNA, 22 nt, Human
cacagaaguuucauagucucga

SEQ ID NO: 1109162 - RNA, 20 nt, Human
gcuuccuucccagcccccac

SEQ ID NO: 1109163 - RNA, 22 nt, Human
ccugucuguaucgguucagagu

SEQ ID NO: 1109164 - RNA, 18 nt, Human
auggucucauacugggag

SEQ ID NO: 1109165 - RNA, 22 nt, Human
ggcucagguuuccuucccagcu

SEQ ID NO: 1109166 - RNA, 22 nt, Human
gcagcuggaagugacacucugu

SEQ ID NO: 1109167 - RNA, 22 nt, Human
cugaggugcuagggucccugcu

SEQ ID NO: 1109168 - RNA, 22 nt, Human
guuugaaaaaagcaguauguaa

SEQ ID NO: 1109169 - RNA, 22 nt, Human
ugccugcucuuaccacucuccc

SEQ ID NO: 1109170 - RNA, 22 nt, Human
ccuagagcucugcuuuaucuaa

SEQ ID NO: 1109171 - RNA, 22 nt, Human
ccagacuguggaguuccuggug

SEQ ID NO: 1109172 - RNA, 22 nt, Human
uuagaaaucaccucugaagauc

SEQ ID NO: 1109173 - RNA, 22 nt, Human
ggcuucucgugccgaagcaaga

SEQ ID NO: 1109174 - RNA, 22 nt, Human
uacauggugguggcacuugacu

SEQ ID NO: 1109175 - RNA, 22 nt, Human
gggcacugcuuugcucugucac

SEQ ID NO: 1109176 - RNA, 22 nt, Human
ucagcugccccaguggccccag

SEQ ID NO: 1109177 - RNA, 18 nt, Human
uuucacaaccuccagagg

SEQ ID NO: 1109178 - RNA, 22 nt, Human
ggagacaguauggcuuguagcu

SEQ ID NO: 1109179 - RNA, 22 nt, Human
auaaggcauauagucacuuuuu

SEQ ID NO: 1109180 - RNA, 22 nt, Human
cugucaguucuuccagauagag

SEQ ID NO: 1109181 - RNA, 22 nt, Human
agagugaaguuuuugaaaguga

SEQ ID NO: 1109182 - RNA, 22 nt, Human
ucuggccaggauggcaagacca

SEQ ID NO: 1109183 - RNA, 22 nt, Human
gccaccagguuagauccagccu

SEQ ID NO: 1109184 - RNA, 20 nt, Human
cacaggcuauaugagagcca

SEQ ID NO: 1109185 - RNA, 22 nt, Human
ucagagcuaaggggagagcaaa

SEQ ID NO: 1109186 - RNA, 19 nt, Human
ucauaaggagagaggaaau

SEQ ID NO: 1109187 - RNA, 22 nt, Human
agccuccaguagcugaagagac

SEQ ID NO: 1109188 - RNA, 22 nt, Human
uuguuacagcagugauuucaga

SEQ ID NO: 1109189 - RNA, 22 nt, Human
agugaaauccuggucaacaggu

SEQ ID NO: 1109190 - RNA, 22 nt, Human
ugcauuaugcuacccagaagcu

SEQ ID NO: 1109191 - RNA, 22 nt, Human
agcagcauagaagcugggagga

SEQ ID NO: 1109192 - RNA, 22 nt, Human
uuaacagauguuuauggagcau

SEQ ID NO: 1109193 - RNA, 22 nt, Human
uaguccaguaaaacagcuaacg

SEQ ID NO: 1109194 - RNA, 21 nt, Human
agguggggcugcaccucugcu

SEQ ID NO: 1109195 - RNA, 22 nt, Human
aaaugcacagguuuuaaauccu

SEQ ID NO: 1109196 - RNA, 22 nt, Human
cacauggggcgcugcauuggcc

SEQ ID NO: 1109197 - RNA, 22 nt, Human
gagggggagaugugcacacacu

SEQ ID NO: 1109198 - RNA, 20 nt, Human
agaagcugauacugauggaa

SEQ ID NO: 1109199 - RNA, 22 nt, Human
aucaguuuauacuuauaaaucu

SEQ ID NO: 1109200 - RNA, 22 nt, Human
uggcucagaggggaagugguuu

SEQ ID NO: 1109201 - RNA, 22 nt, Human
cauguacaaaaggcaaaugccu

SEQ ID NO: 1109202 - RNA, 22 nt, Human
uguaucaaaccaaauuaauucu

SEQ ID NO: 1109203 - RNA, 22 nt, Human
ucugucugacaggguaugaacu

SEQ ID NO: 1109204 - RNA, 22 nt, Human
cuguccuguggaccugaggacg

SEQ ID NO: 1109205 - RNA, 22 nt, Human
gcugucccaugguugcaagaug

SEQ ID NO: 1109206 - RNA, 22 nt, Human
cugagcauggccgguccauggu

SEQ ID NO: 1109207 - RNA, 22 nt, Human
gcagccacacuguuacagaaug

SEQ ID NO: 1109208 - RNA, 22 nt, Human
acaaauguggacauggauaaug

SEQ ID NO: 1109209 - RNA, 22 nt, Human
caguggguggcuaaguggcuga

SEQ ID NO: 1109210 - RNA, 22 nt, Human
uccuauugguagacauuucugu

SEQ ID NO: 1109211 - RNA, 22 nt, Human
uggggugggcaugcgcuguccu

SEQ ID NO: 1109212 - RNA, 22 nt, Human
gcagcagagaacacaaugaugg

SEQ ID NO: 1109213 - RNA, 22 nt, Human
gagccagcgccuugccucuggg

SEQ ID NO: 1109214 - RNA, 22 nt, Human
cucucuggaagggggagcugau

SEQ ID NO: 1109215 - RNA, 22 nt, Human
augcacagcagugaguucagug

SEQ ID NO: 1109216 - RNA, 22 nt, Human
auugcagcuggucaggguaauu

SEQ ID NO: 1109217 - RNA, 22 nt, Human
aguggcagagcaggugcuggaa

SEQ ID NO: 1109218 - RNA, 22 nt, Human
uccuuccugcaggccaaguccu

SEQ ID NO: 1109219 - RNA, 22 nt, Human
augggguggaguccgggcagcg

SEQ ID NO: 1109220 - RNA, 22 nt, Human
cugugcuuaccugcccagguga

SEQ ID NO: 1109221 - RNA, 22 nt, Human
aacaaaugaccugauuucuucc

SEQ ID NO: 1109222 - RNA, 20 nt, Human
cugugcuuuggaaccuggaa

SEQ ID NO: 1109223 - RNA, 22 nt, Human
gcagcacauauaaacaaagaga

SEQ ID NO: 1109224 - RNA, 22 nt, Human
uacaaaguuugagaaugcuuuc

SEQ ID NO: 1109225 - RNA, 23 nt, Human
gugcaugugucuuuacaguagca

SEQ ID NO: 1109226 - RNA, 22 nt, Human
agaggucagaacaggaaagugu

SEQ ID NO: 1109227 - RNA, 22 nt, Human
uggcccugacuuggaggccuga

SEQ ID NO: 1109228 - RNA, 23 nt, Human
uuacuuuugcaccaaccuaauau

SEQ ID NO: 1109229 - RNA, 22 nt, Human
auguacauuuuccuaauguuuu

SEQ ID NO: 1109230 - RNA, 22 nt, Human
uguaauggaagugggauugcau

SEQ ID NO: 1109231 - RNA, 22 nt, Human
caucacugacgcugagauucca

SEQ ID NO: 1109232 - RNA, 22 nt, Human
gcugucacacauggccccagcu

SEQ ID NO: 1109233 - RNA, 22 nt, Human
ugggcacuauggcucugugcac

SEQ ID NO: 1109234 - RNA, 22 nt, Human
uagcagggucucaggagucagg

SEQ ID NO: 1109235 - RNA, 22 nt, Human
ugcaggccggcccuaggccuca

SEQ ID NO: 1109236 - RNA, 22 nt, Human
caggguggaagcuguagagugg

SEQ ID NO: 1109237 - RNA, 22 nt, Human
ugacagaacagguugggagcaa

SEQ ID NO: 1109238 - RNA, 22 nt, Human
ugucucugccagcuagcagaau

SEQ ID NO: 1109239 - RNA, 22 nt, Human
gcucugagauugagccuuuggu

SEQ ID NO: 1109240 - RNA, 22 nt, Human
gcaggcugaugacuggaguugg

SEQ ID NO: 1109241 - RNA, 22 nt, Human
accauuuaauaaguauuuccau

SEQ ID NO: 1109242 - RNA, 22 nt, Human
guuugcauuccaauuuagggga

SEQ ID NO: 1109243 - RNA, 22 nt, Human
uuuccauauucugcgucugcca

SEQ ID NO: 1109244 - RNA, 22 nt, Human
uggagcagcaucacuuugagcu

SEQ ID NO: 1109245 - RNA, 22 nt, Human
ucucaggggccuggaguccugg

SEQ ID NO: 1109246 - RNA, 22 nt, Human
uaacagaaaggcucaggugcuc

SEQ ID NO: 1109247 - RNA, 22 nt, Human
ugcugcacaauuggaaaguauc

SEQ ID NO: 1109248 - RNA, 22 nt, Human
auucuggauuaucaguccacca

SEQ ID NO: 1109249 - RNA, 22 nt, Human
auagaacagaaacagaugcaca

SEQ ID NO: 1109250 - RNA, 22 nt, Human
cagcagcugauggggaagugau

SEQ ID NO: 1109251 - RNA, 22 nt, Human
ugcagcauucuuggccacuacu

SEQ ID NO: 1109252 - RNA, 22 nt, Human
gggucuggcaugcugagaugga

SEQ ID NO: 1109253 - RNA, 22 nt, Human
ccuuagagaguacugggcugcc

SEQ ID NO: 1109254 - RNA, 22 nt, Human
gaacaguaucaguagugccagu

SEQ ID NO: 1109255 - RNA, 22 nt, Human
cgaugguucuggcugcuuguau

SEQ ID NO: 1109256 - RNA, 22 nt, Human
cccugcagaccaaugccauaga

SEQ ID NO: 1109257 - RNA, 22 nt, Human
aagcagggugucuugacccaug

SEQ ID NO: 1109258 - RNA, 22 nt, Human
cuucucucccuggcacucagac

SEQ ID NO: 1109259 - RNA, 22 nt, Human
acaaaugccauauauaaauucu

SEQ ID NO: 1109260 - RNA, 22 nt, Human
gcaggcaguuauuuaguagaau

SEQ ID NO: 1109261 - RNA, 22 nt, Human
uggcucagcgguggcagcagac

SEQ ID NO: 1109262 - RNA, 22 nt, Human
ggacacaagcuccggggcugca

SEQ ID NO: 1109263 - RNA, 22 nt, Human
ccagcugaggcagccacacagg

SEQ ID NO: 1109264 - RNA, 22 nt, Human
uaacagaaauuuuaguuagggg

SEQ ID NO: 1109265 - RNA, 17 nt, Human
cagggcugucugccuag

SEQ ID NO: 1109266 - RNA, 22 nt, Human
cagcaugguggagcugcucuuu

SEQ ID NO: 1109267 - RNA, 22 nt, Human
ccugucaguugcugucagggau

SEQ ID NO: 1109268 - RNA, 23 nt, Human
gccuggccaccccagggcugcuu

SEQ ID NO: 1109269 - RNA, 22 nt, Human
gcaguggcaugaugugggcuca

SEQ ID NO: 1109270 - RNA, 22 nt, Human
ggcucugguugaccaugauggc

SEQ ID NO: 1109271 - RNA, 22 nt, Human
aagcugccuuccaugugaggaa

SEQ ID NO: 1109272 - RNA, 17 nt, Human
cagugcagagcccuuuc

SEQ ID NO: 1109273 - RNA, 22 nt, Human
gguggcuggaggagcugaugga

SEQ ID NO: 1109274 - RNA, 22 nt, Human
agcauggggcuccgcaaugaac

SEQ ID NO: 1109275 - RNA, 19 nt, Human
ccucugcgcuguccugcuc

SEQ ID NO: 1109276 - RNA, 22 nt, Human
aaggcacuagcaagcugccugg

SEQ ID NO: 1109277 - RNA, 22 nt, Human
gacagacauuuccugauccaau

SEQ ID NO: 1109278 - RNA, 22 nt, Human
ugcuguuauacuuagcugguua

SEQ ID NO: 1109279 - RNA, 22 nt, Human
cugcuggggucagagcacuggg

SEQ ID NO: 1109280 - RNA, 22 nt, Human
ccucuccaguuuuaacgugacc

SEQ ID NO: 1109281 - RNA, 22 nt, Human
ucacauuuucauauucucugag

SEQ ID NO: 1109282 - RNA, 22 nt, Human
uggccugguuauauugcuauca

SEQ ID NO: 1109283 - RNA, 22 nt, Human
ugcaggagcugugcggugaggg

SEQ ID NO: 1109284 - RNA, 22 nt, Human
ccuguggcugccacuuggguga

SEQ ID NO: 1109285 - RNA, 22 nt, Human
gcucaggaccgaggggugggaa

SEQ ID NO: 1109286 - RNA, 22 nt, Human
gcaggagccaggccgagcuggu

SEQ ID NO: 1109287 - RNA, 21 nt, Human
ccugggagaucagcugccuuc

SEQ ID NO: 1109288 - RNA, 22 nt, Human
ccugagguggcugcagcacugc

SEQ ID NO: 1109289 - RNA, 22 nt, Human
ggcuggcuggcugguagacaag

SEQ ID NO: 1109290 - RNA, 22 nt, Human
gccucugcccuccugggacugc

SEQ ID NO: 1109291 - RNA, 23 nt, Human
cagggcugggcuugguguuaggc

SEQ ID NO: 1109292 - RNA, 22 nt, Human
aaaugcacaggagaaccaauuc

SEQ ID NO: 1109293 - RNA, 22 nt, Human
ccaggccuggaccaugccaggg

SEQ ID NO: 1109294 - RNA, 22 nt, Human
gccucugcgccucagccgaccu

SEQ ID NO: 1109295 - RNA, 22 nt, Human
gugaggugggcuggccagagac

SEQ ID NO: 1109296 - RNA, 22 nt, Human
ucagaggacaagcucccuggug

SEQ ID NO: 1109297 - RNA, 19 nt, Human
ggucucagugcagcugcag

SEQ ID NO: 1109298 - RNA, 22 nt, Human
gugcagugagcagugcagcacc

SEQ ID NO: 1109299 - RNA, 22 nt, Human
cagggcuguuagcugcugcucu

SEQ ID NO: 1109300 - RNA, 22 nt, Human
uaaugcacaugacugaacuauu

SEQ ID NO: 1109301 - RNA, 19 nt, Human
ggcucucccuugagagagc

SEQ ID NO: 1109302 - RNA, 22 nt, Human
gugcaggggaucagguugcagc

SEQ ID NO: 1109303 - RNA, 22 nt, Human
gccaaagcagucuugccucugc

SEQ ID NO: 1109304 - RNA, 22 nt, Human
aggcucagcccaagguggagag

SEQ ID NO: 1109305 - RNA, 22 nt, Human
cagagugagggccugcaccugc

SEQ ID NO: 1109306 - RNA, 22 nt, Human
gaggggcugggcagucccugga

SEQ ID NO: 1109307 - RNA, 22 nt, Human
acugugugggccgcucacuggg

SEQ ID NO: 1109308 - RNA, 22 nt, Human
gguggcagucuuaagagaucuu

SEQ ID NO: 1109309 - RNA, 20 nt, Human
guggccucucacauucugag

SEQ ID NO: 1109310 - RNA, 22 nt, Human
gcugccuguugaagggucugug

SEQ ID NO: 1109311 - RNA, 22 nt, Human
ugguggcuucugaggauggcga

SEQ ID NO: 1109312 - RNA, 22 nt, Human
agaggccuccgaaaggugggcu

SEQ ID NO: 1109313 - RNA, 22 nt, Human
uuccuguccgcaauggccuggg

SEQ ID NO: 1109314 - RNA, 22 nt, Human
uagccuucucaagacaaaguug

SEQ ID NO: 1109315 - RNA, 22 nt, Human
gcuggcagucccaucagcuggg

SEQ ID NO: 1109316 - RNA, 18 nt, Human
uccagcgugcuccagggc

SEQ ID NO: 1109317 - RNA, 22 nt, Human
gccuucaggaaaucaguccuug

SEQ ID NO: 1109318 - RNA, 22 nt, Human
ugcuggaggggccugaccagga

SEQ ID NO: 1109319 - RNA, 20 nt, Human
caggccucugggggcccugg

SEQ ID NO: 1109320 - RNA, 22 nt, Human
auuuacagaugaugcuauuuga

SEQ ID NO: 1109321 - RNA, 22 nt, Human
aaagaacaucggagugggcggg

SEQ ID NO: 1109322 - RNA, 20 nt, Human
ccuggcugcauucaggacgg

SEQ ID NO: 1109323 - RNA, 22 nt, Human
gagccuguguuuccuguagcca

SEQ ID NO: 1109324 - RNA, 22 nt, Human
cagggcugaaaucaagguguag

SEQ ID NO: 1109325 - RNA, 22 nt, Human
ucacacguccuugcuacuccuc

SEQ ID NO: 1109326 - RNA, 22 nt, Human
guaauugacucagcucuguuca

SEQ ID NO: 1109327 - RNA, 19 nt, Human
agccuggagggcuggucac

SEQ ID NO: 1109328 - RNA, 22 nt, Human
agggcugcuauguugauucaga

SEQ ID NO: 1109329 - RNA, 22 nt, Human
aggugcagaaaaaaguccuuua

SEQ ID NO: 1109330 - RNA, 22 nt, Human
ucugccuguucaagucuucuag

SEQ ID NO: 1109331 - RNA, 22 nt, Human
cucucugguacauagaguuugg

SEQ ID NO: 1109332 - RNA, 20 nt, Human
ucauccaggacaggaguggc

SEQ ID NO: 1109333 - RNA, 22 nt, Human
ucucagagcaucauuuucuuag

SEQ ID NO: 1109334 - RNA, 22 nt, Human
ggagcuguaacgagccauugcu

SEQ ID NO: 1109335 - RNA, 20 nt, Human
ugcuguaagauuagagagcu

SEQ ID NO: 1109336 - RNA, 17 nt, Human
uccuggcucugccacug

SEQ ID NO: 1109337 - RNA, 23 nt, Human
aaaugcagggucgcagguuacag

SEQ ID NO: 1109338 - RNA, 22 nt, Human
cugggccuggcguuccaggcug

SEQ ID NO: 1109339 - RNA, 22 nt, Human
accaucagucauugucaguggg

SEQ ID NO: 1109340 - RNA, 22 nt, Human
ugccugucagggggagugggaa

SEQ ID NO: 1109341 - RNA, 22 nt, Human
acagagaugcaaguguguauuu

SEQ ID NO: 1109342 - RNA, 22 nt, Human
uuauuaaugaguacaaguuauu

SEQ ID NO: 1109343 - RNA, 22 nt, Human
ucugagcuggagcccaucaccu

SEQ ID NO: 1109344 - RNA, 22 nt, Human
agcugggaggugggcagugaga

SEQ ID NO: 1109345 - RNA, 22 nt, Human
cagcaggguagguuguaucagu

SEQ ID NO: 1109346 - RNA, 22 nt, Human
cccagcuugcccaggacugagg

SEQ ID NO: 1109347 - RNA, 18 nt, Human
agucucagcggaggagua

SEQ ID NO: 1109348 - RNA, 22 nt, Human
gggcuggcaggaccugggcuga

SEQ ID NO: 1109349 - RNA, 22 nt, Human
cugagagcagggacuugagcca

SEQ ID NO: 1109350 - RNA, 22 nt, Human
ucagacaguuugcagugugccu

SEQ ID NO: 1109351 - RNA, 22 nt, Human
aguguuccuugcuuucccagag

SEQ ID NO: 1109352 - RNA, 22 nt, Human
acugucuguccugcucuccgug

SEQ ID NO: 1109353 - RNA, 22 nt, Human
gcagauggcucagacacugggg

SEQ ID NO: 1109354 - RNA, 22 nt, Human
acacugcucacuucuucccuug

SEQ ID NO: 1109355 - RNA, 22 nt, Human
cccucugcaggcuggaccugcc

SEQ ID NO: 1109356 - RNA, 22 nt, Human
uagcagcuuaaguaauuagaau

SEQ ID NO: 1109357 - RNA, 22 nt, Human
uccagggcugacuugggagagg

SEQ ID NO: 1109358 - RNA, 22 nt, Human
uuuuagauugggaaauguaaag

SEQ ID NO: 1109359 - RNA, 22 nt, Human
uucuuucacucaagaaggaucu

SEQ ID NO: 1109360 - RNA, 22 nt, Human
acaaagucucuaauaaucuucu

SEQ ID NO: 1109361 - RNA, 22 nt, Human
cacaggugcuccucggggagcu

SEQ ID NO: 1109362 - RNA, 22 nt, Human
auaacagagagcuacugaacug

SEQ ID NO: 1109363 - RNA, 22 nt, Human
guccugucccccaaggcugugg

SEQ ID NO: 1109364 - RNA, 22 nt, Human
aaagccuugcccgucacuggga

SEQ ID NO: 1109365 - RNA, 21 nt, Human
agacagaacaacugcucucca

SEQ ID NO: 1109366 - RNA, 22 nt, Human
cagaggccauauuucuucacuc

SEQ ID NO: 1109367 - RNA, 22 nt, Human
cuggugguucaggagaauggcu

SEQ ID NO: 1109368 - RNA, 21 nt, Human
aggcccagcuuuccucuugcu

SEQ ID NO: 1109369 - RNA, 22 nt, Human
ccuggcucuguccucgcgcaaa

SEQ ID NO: 1109370 - RNA, 22 nt, Human
agcaccuucacaggcucucagg

SEQ ID NO: 1109371 - RNA, 22 nt, Human
aaugaacacagcccucuacuuu

SEQ ID NO: 1109372 - RNA, 22 nt, Human
gugcccugaguggguaggagag

SEQ ID NO: 1109373 - RNA, 22 nt, Human
cugugcuggcagaccuggaguu

SEQ ID NO: 1109374 - RNA, 22 nt, Human
agagggagcccagucauagcug

SEQ ID NO: 1109375 - RNA, 22 nt, Human
cagggccacuguagaugaggag

SEQ ID NO: 1109376 - RNA, 22 nt, Human
caggcagcaucagucugcugua

SEQ ID NO: 1109377 - RNA, 22 nt, Human
agcaggugacagggcuguggug

SEQ ID NO: 1109378 - RNA, 22 nt, Human
ugggggagccuucacaguagcu

SEQ ID NO: 1109379 - RNA, 22 nt, Human
caaggcaggcaguucacuugag

SEQ ID NO: 1109380 - RNA, 22 nt, Human
uacuuacagagcuuauaaguua

SEQ ID NO: 1109381 - RNA, 22 nt, Human
gcuccuggucuggagcuucaag

SEQ ID NO: 1109382 - RNA, 22 nt, Human
ucucuggaauuggcugaggcaa

SEQ ID NO: 1109383 - RNA, 22 nt, Human
uccuuccucggggacccagauc

SEQ ID NO: 1109384 - RNA, 22 nt, Human
gagcagcucugggugacccagu

SEQ ID NO: 1109385 - RNA, 22 nt, Human
uggcucagcagguuagaaacua

SEQ ID NO: 1109386 - RNA, 22 nt, Human
caggcagccugcggucugcaca

SEQ ID NO: 1109387 - RNA, 22 nt, Human
aaacaaguguaaacuagucugu

SEQ ID NO: 1109388 - RNA, 22 nt, Human
acauucuagaagucuuugcaau

SEQ ID NO: 1109389 - RNA, 23 nt, Human
ggccuguguuuugucugaaguac

SEQ ID NO: 1109390 - RNA, 20 nt, Human
gagccuuccccucaccacug

SEQ ID NO: 1109391 - RNA, 23 nt, Human
ccaggccucucagagggugugcc

SEQ ID NO: 1109392 - RNA, 22 nt, Human
cccagcucucgcacuuacuagc

SEQ ID NO: 1109393 - RNA, 22 nt, Human
gcucccagaaccaaggcugggg

SEQ ID NO: 1109394 - RNA, 22 nt, Human
ugaagaugucagcagggguggu

SEQ ID NO: 1109395 - RNA, 22 nt, Human
uggccugcccagagcagcucug

SEQ ID NO: 1109396 - RNA, 22 nt, Human
ccagggugggguccaggaacca

SEQ ID NO: 1109397 - RNA, 22 nt, Human
gagcuggcuaauacugacuuau

SEQ ID NO: 1109398 - RNA, 22 nt, Human
ccagccuccauguagauagcug

SEQ ID NO: 1109399 - RNA, 22 nt, Human
agugaaaacacuaguucuugcc

SEQ ID NO: 1109400 - RNA, 22 nt, Human
agauacaugucaagagacuuau

SEQ ID NO: 1109401 - RNA, 22 nt, Human
ccaggcugugguuuagauagag

SEQ ID NO: 1109402 - RNA, 22 nt, Human
agggcugcuccuccuucaggcc

SEQ ID NO: 1109403 - RNA, 22 nt, Human
gggcacagcugcuacccagugc

SEQ ID NO: 1109404 - RNA, 22 nt, Human
gcuggcucccauugguccuucc

SEQ ID NO: 1109405 - RNA, 21 nt, Human
acaguucaugauaacuccauc

SEQ ID NO: 1109406 - RNA, 22 nt, Human
ucaguggagcuaagcaugagau

SEQ ID NO: 1109407 - RNA, 22 nt, Human
caagaugaaacuacagggagga

SEQ ID NO: 1109408 - RNA, 23 nt, Human
uggcagcagaucuuaaagugacc

SEQ ID NO: 1109409 - RNA, 22 nt, Human
ucacuuauaaaaugcaagaucu

SEQ ID NO: 1109410 - RNA, 22 nt, Human
caggacaguauaggcuuuagga

SEQ ID NO: 1109411 - RNA, 22 nt, Human
ugacaccacaacuagccauuga

SEQ ID NO: 1109412 - RNA, 22 nt, Human
ucaggcugguggucagauggcu

SEQ ID NO: 1109413 - RNA, 22 nt, Human
uguuaaucaaucaacaguauua

SEQ ID NO: 1109414 - RNA, 22 nt, Human
gggucagcugcugggggcugac

SEQ ID NO: 1109415 - RNA, 22 nt, Human
agggugccugcugcagguucag

SEQ ID NO: 1109416 - RNA, 22 nt, Human
cagcuugggaguuugguuuuau

SEQ ID NO: 1109417 - RNA, 22 nt, Human
ccuggcagguggagguugcagu

SEQ ID NO: 1109418 - RNA, 22 nt, Human
uauuuauaaucugccaaagaga

SEQ ID NO: 1109419 - RNA, 22 nt, Human
acaugcuuucuagguccuucug

SEQ ID NO: 1109420 - RNA, 22 nt, Human
agaagcugacagaugcagcagg

SEQ ID NO: 1109421 - RNA, 22 nt, Human
ccugcagacacuuguccagcaa

SEQ ID NO: 1109422 - RNA, 22 nt, Human
cacguuuuaugacagaagaagc

SEQ ID NO: 1109423 - RNA, 22 nt, Human
gcuggggagcuagaccucagca

SEQ ID NO: 1109424 - RNA, 22 nt, Human
agggugcauguuugcaagagug

SEQ ID NO: 1109425 - RNA, 22 nt, Human
agagccaggcaggcaauguuga

SEQ ID NO: 1109426 - RNA, 22 nt, Human
agagccuggggauuggcaaggg

SEQ ID NO: 1109427 - RNA, 19 nt, Human
acucaagucuaaugaaauc

SEQ ID NO: 1109428 - RNA, 22 nt, Human
ccugugucuuccccacuggugu

SEQ ID NO: 1109429 - RNA, 22 nt, Human
aagagcugcaucuaagccauga

SEQ ID NO: 1109430 - RNA, 22 nt, Human
gccugggagugcacagugaggu

SEQ ID NO: 1109431 - RNA, 22 nt, Human
aagggcagcuuaaauugguagc

SEQ ID NO: 1109432 - RNA, 22 nt, Human
gcugcccaguucugcugcugcc

SEQ ID NO: 1109433 - RNA, 22 nt, Human
ucucagggccucccucuguuuc

SEQ ID NO: 1109434 - RNA, 22 nt, Human
auucuaggcuugaaacaugaag

SEQ ID NO: 1109435 - RNA, 22 nt, Human
ucaggcagaggauggggagcgu

SEQ ID NO: 1109436 - RNA, 22 nt, Human
caaugguggugucagaagagau

SEQ ID NO: 1109437 - RNA, 22 nt, Human
agauacaucauuuauaccuuca

SEQ ID NO: 1109438 - RNA, 22 nt, Human
ugcuagaauaccuaccuggagg

SEQ ID NO: 1109439 - RNA, 22 nt, Human
caggccagugugcuucccaggc

SEQ ID NO: 1109440 - RNA, 22 nt, Human
uggccuggugcucaggcaguag

SEQ ID NO: 1109441 - RNA, 22 nt, Human
ugcauuucagaagaaaauucgg

SEQ ID NO: 1109442 - RNA, 22 nt, Human
ccuggaugauccaugucaugga

SEQ ID NO: 1109443 - RNA, 22 nt, Human
agaacagcaguuaugguucauu

SEQ ID NO: 1109444 - RNA, 22 nt, Human
acucacauuucaucaggccaag

SEQ ID NO: 1109445 - RNA, 22 nt, Human
cagggccaagcugcagcaucug

SEQ ID NO: 1109446 - RNA, 22 nt, Human
augucacagcucccauuccucc

SEQ ID NO: 1109447 - RNA, 22 nt, Human
agucucagaaaagaagcaugga

SEQ ID NO: 1109448 - RNA, 22 nt, Human
ugggccugggagggcagacgcu

SEQ ID NO: 1109449 - RNA, 22 nt, Human
gagcugccugugugccaugaug

SEQ ID NO: 1109450 - RNA, 22 nt, Human
acuuccuggcguagcugacauu

SEQ ID NO: 1109451 - RNA, 22 nt, Human
cuggaagggucuacuuagcaga

SEQ ID NO: 1109452 - RNA, 22 nt, Human
ccuggcagacugugagggcagg

SEQ ID NO: 1109453 - RNA, 21 nt, Human
aaguaaaucagagaaauaacc

SEQ ID NO: 1109454 - RNA, 22 nt, Human
ccagcccucacugaggccucuc

SEQ ID NO: 1109455 - RNA, 22 nt, Human
cauuacauuucaaaauguuucc

SEQ ID NO: 1109456 - RNA, 20 nt, Human
gggcaguggcgcuaucucag

SEQ ID NO: 1109457 - RNA, 22 nt, Human
cccagggauuauaaaggugaaa

SEQ ID NO: 1109458 - RNA, 21 nt, Human
accaggcuugugggagggagc

SEQ ID NO: 1109459 - RNA, 18 nt, Human
gagaggcccggcugugcc

SEQ ID NO: 1109460 - RNA, 18 nt, Human
cccucuccugcuaguggg

SEQ ID NO: 1109461 - RNA, 21 nt, Human
agcuggugucagagcucuggg

SEQ ID NO: 1109462 - RNA, 22 nt, Human
gcaaugauauugaagugaugaa

SEQ ID NO: 1109463 - RNA, 23 nt, Human
ugccagaggcagucacaguggug

SEQ ID NO: 1109464 - RNA, 23 nt, Human
aggauguaggauguauggcagag

SEQ ID NO: 1109465 - RNA, 22 nt, Human
caguggcgugaucucugcucac

SEQ ID NO: 1109466 - RNA, 22 nt, Human
ucacagcaaaagugugcagagc

SEQ ID NO: 1109467 - RNA, 22 nt, Human
gcugagggcauguguggcgacu

SEQ ID NO: 1109468 - RNA, 22 nt, Human
caaaagauacuugcaucuaacu

SEQ ID NO: 1109469 - RNA, 22 nt, Human
cagaggcucaccagccuuucac

SEQ ID NO: 1109470 - RNA, 22 nt, Human
ccagaggugcugggagaggucu

SEQ ID NO: 1109471 - RNA, 22 nt, Human
gggcagaggcucuggcccaucc

SEQ ID NO: 1109472 - RNA, 21 nt, Human
uucaagauauuuaaaaggugg

SEQ ID NO: 1109473 - RNA, 22 nt, Human
uucauuccuucuguaccuugcc

SEQ ID NO: 1109474 - RNA, 22 nt, Human
aauguguagggugccuguuuuu

SEQ ID NO: 1109475 - RNA, 22 nt, Human
auuuagaaauuccaaaaguauu

SEQ ID NO: 1109476 - RNA, 22 nt, Human
ggaaaaggccacagggacacau

SEQ ID NO: 1109477 - RNA, 22 nt, Human
gccugucugcagggcugucauu

SEQ ID NO: 1109478 - RNA, 21 nt, Human
gcucccuggcugugugaccug

SEQ ID NO: 1109479 - RNA, 22 nt, Human
agggaggauaguagucaguuua

SEQ ID NO: 1109480 - RNA, 22 nt, Human
aggcucagauucacauuugguu

SEQ ID NO: 1109481 - RNA, 22 nt, Human
ucccagccggugccuggguccc

SEQ ID NO: 1109482 - RNA, 22 nt, Human
aaugugguuaacccauuuaaga

SEQ ID NO: 1109483 - RNA, 22 nt, Human
uggagccagcccaggccccucu

SEQ ID NO: 1109484 - RNA, 22 nt, Human
uugggcucaggaguuugagacc

SEQ ID NO: 1109485 - RNA, 21 nt, Human
gaugaagcaaucuuucuguug

SEQ ID NO: 1109486 - RNA, 22 nt, Human
caguacuuggucaaggaagcag

SEQ ID NO: 1109487 - RNA, 22 nt, Human
gcagagccagaauggccaggac

SEQ ID NO: 1109488 - RNA, 22 nt, Human
caggugggagccacagcguaca

SEQ ID NO: 1109489 - RNA, 21 nt, Human
uggcagggguaguaguacagc

SEQ ID NO: 1109490 - RNA, 22 nt, Human
cagugggugaugaguccugggg

SEQ ID NO: 1109491 - RNA, 22 nt, Human
gcucccagcauugcuucccagg

SEQ ID NO: 1109492 - RNA, 22 nt, Human
agaggcagcagucauacuacag

SEQ ID NO: 1109493 - RNA, 22 nt, Human
agcagcugaccagugaguccug

SEQ ID NO: 1109494 - RNA, 22 nt, Human
cagagcugggcauggugaaagg

SEQ ID NO: 1109495 - RNA, 20 nt, Human
aagggcagagggaacagacu

SEQ ID NO: 1109496 - RNA, 22 nt, Human
ugcugaggucaccuugcugcua

SEQ ID NO: 1109497 - RNA, 22 nt, Human
uagcauuuauggucaugugucc

SEQ ID NO: 1109498 - RNA, 22 nt, Human
uaugcauagguaucuauacuca

SEQ ID NO: 1109499 - RNA, 22 nt, Human
uugcauguuauuuaaucuguau

SEQ ID NO: 1109500 - RNA, 22 nt, Human
gcucccugcacucugcagcccu

SEQ ID NO: 1109501 - RNA, 22 nt, Human
ccuucugcucccuggccagggc

SEQ ID NO: 1109502 - RNA, 22 nt, Human
caggcagaagaaguggaaggac

SEQ ID NO: 1109503 - RNA, 22 nt, Human
agaaaucaauaucuauauguug

SEQ ID NO: 1109504 - RNA, 22 nt, Human
ccagagcccagcacacggugcu

SEQ ID NO: 1109505 - RNA, 22 nt, Human
augcacgccccacacuggugug

SEQ ID NO: 1109506 - RNA, 22 nt, Human
gucaccaggucugaugcagcca

SEQ ID NO: 1109507 - RNA, 22 nt, Human
gaaggaaaucugugauuuaugc

SEQ ID NO: 1109508 - RNA, 22 nt, Human
uccuuucccuuuccauccuggc

SEQ ID NO: 1109509 - RNA, 19 nt, Human
uccuucagucagaucuggg

SEQ ID NO: 1109510 - RNA, 22 nt, Human
aaaugucugagacuucugaacu

SEQ ID NO: 1109511 - RNA, 22 nt, Human
ugccuggaugugcuggccucac

SEQ ID NO: 1109512 - RNA, 22 nt, Human
gaguuauuucagaaggaaagau

SEQ ID NO: 1109513 - RNA, 22 nt, Human
cuccucugucuaccacgagggu

SEQ ID NO: 1109514 - RNA, 22 nt, Human
ucauacauaacuuguacaguga

SEQ ID NO: 1109515 - RNA, 22 nt, Human
uacaaaugaguuguaugaacca

SEQ ID NO: 1109516 - RNA, 20 nt, Human
accccagccccucuaucuga

SEQ ID NO: 1109517 - RNA, 22 nt, Human
uccuugaaaagaaugucuccau

SEQ ID NO: 1109518 - RNA, 23 nt, Human
aagcugccagucugaagccuggg

SEQ ID NO: 1109519 - RNA, 22 nt, Human
ggggcagcucccgagggcagga

SEQ ID NO: 1109520 - RNA, 22 nt, Human
agcagagcugcaguggccugcu

SEQ ID NO: 1109521 - RNA, 20 nt, Human
uauuugaaauggccaagugu

SEQ ID NO: 1109522 - RNA, 22 nt, Human
uaagcauaacuaaaaaugauuu

SEQ ID NO: 1109523 - RNA, 21 nt, Human
cucacaggaugcaguguuacu

SEQ ID NO: 1109524 - RNA, 22 nt, Human
auggccuggccagagcucugcu

SEQ ID NO: 1109525 - RNA, 22 nt, Human
uggacaggaucugagacugaga

SEQ ID NO: 1109526 - RNA, 22 nt, Human
ucagcagggcugugguguggcu

SEQ ID NO: 1109527 - RNA, 22 nt, Human
agagccagcauuugggcccugc

SEQ ID NO: 1109528 - RNA, 23 nt, Human
ccagcuccgugagccucgggcuc

SEQ ID NO: 1109529 - RNA, 22 nt, Human
gcagaggcauuucugacgcugc

SEQ ID NO: 1109530 - RNA, 22 nt, Human
gaaggcuugcagcucuguggca

SEQ ID NO: 1109531 - RNA, 22 nt, Human
aaggcagcaccgccuccugaaa

SEQ ID NO: 1109532 - RNA, 22 nt, Human
gcagcugagagaagaacagggc

SEQ ID NO: 1109533 - RNA, 22 nt, Human
agaggcugcacuugcucaugau

SEQ ID NO: 1109534 - RNA, 22 nt, Human
agucucugcugguugugccuau

SEQ ID NO: 1109535 - RNA, 22 nt, Human
agagaggcugggcguagggcuu

SEQ ID NO: 1109536 - RNA, 22 nt, Human
gggcuucucccuaaggacucug

SEQ ID NO: 1109537 - RNA, 22 nt, Human
gcugauuauuacaugucugugg

SEQ ID NO: 1109538 - RNA, 22 nt, Human
aucaaaaugcuccagugauggu

SEQ ID NO: 1109539 - RNA, 22 nt, Human
gcuggcagagacaagaagacua

SEQ ID NO: 1109540 - RNA, 22 nt, Human
ccagccagccuugaucugagua

SEQ ID NO: 1109541 - RNA, 22 nt, Human
gaggcccaggucaagcagccac

SEQ ID NO: 1109542 - RNA, 22 nt, Human
gagccagguuugaaucucaguc

SEQ ID NO: 1109543 - RNA, 22 nt, Human
ugucucuggcccaugagcagag

SEQ ID NO: 1109544 - RNA, 22 nt, Human
ucuggcucaaaauacguacucu

SEQ ID NO: 1109545 - RNA, 22 nt, Human
gcucuggaagcaucugagagga

SEQ ID NO: 1109546 - RNA, 22 nt, Human
agaagcagacucugaggcaagg

SEQ ID NO: 1109547 - RNA, 21 nt, Human
aggcuguccuuugccagcccu

SEQ ID NO: 1109548 - RNA, 22 nt, Human
ggaggccaaggugggcggauca

SEQ ID NO: 1109549 - RNA, 22 nt, Human
uggcucagauaauucaaggggc

SEQ ID NO: 1109550 - RNA, 21 nt, Human
gagccuucccucugcccuuuc

SEQ ID NO: 1109551 - RNA, 22 nt, Human
gccacaggcacuuaagggcugg

SEQ ID NO: 1109552 - RNA, 23 nt, Human
cagugcagggcaacucagacucc

SEQ ID NO: 1109553 - RNA, 22 nt, Human
ucugagagccucuagccuaagu

SEQ ID NO: 1109554 - RNA, 22 nt, Human
aaaaauguuaucuacuguccga

SEQ ID NO: 1109555 - RNA, 22 nt, Human
gcucacagccggcuggcagggg

SEQ ID NO: 1109556 - RNA, 22 nt, Human
agcagccaauuggaggaugaag

SEQ ID NO: 1109557 - RNA, 22 nt, Human
ccagcccuguaaggaugaggca

SEQ ID NO: 1109558 - RNA, 22 nt, Human
uggcucaguuaggucagaaaca

SEQ ID NO: 1109559 - RNA, 22 nt, Human
ugcagaccucccauggcugccu

SEQ ID NO: 1109560 - RNA, 22 nt, Human
aaguuucauguggagguagacu

SEQ ID NO: 1109561 - RNA, 22 nt, Human
gcaggaugaaggcagaggcuga

SEQ ID NO: 1109562 - RNA, 22 nt, Human
guccugggccugcugaggcuga

SEQ ID NO: 1109563 - RNA, 21 nt, Human
gcagcaguguucuagaauacu

SEQ ID NO: 1109564 - RNA, 22 nt, Human
uacaagagguauauagaaacag

SEQ ID NO: 1109565 - RNA, 22 nt, Human
gugggcaaggucccugccagcu

SEQ ID NO: 1109566 - RNA, 22 nt, Human
uagucccauuuugagguauuug

SEQ ID NO: 1109567 - RNA, 22 nt, Human
uucagucagugacuaagcaguu

SEQ ID NO: 1109568 - RNA, 22 nt, Human
augauacaucuucaugucagug

SEQ ID NO: 1109569 - RNA, 22 nt, Human
uucaagguaugguagcugguca

SEQ ID NO: 1109570 - RNA, 22 nt, Human
ccagcuucucucugaugcagcu

SEQ ID NO: 1109571 - RNA, 22 nt, Human
acagcuggaggccccauugucc

SEQ ID NO: 1109572 - RNA, 22 nt, Human
gccugccugaaggcuguaccag

SEQ ID NO: 1109573 - RNA, 20 nt, Human
guccugggagccacagcaca

SEQ ID NO: 1109574 - RNA, 22 nt, Human
ccuggcugccgagugugcagcg

SEQ ID NO: 1109575 - RNA, 22 nt, Human
uccagccuuucuacucacugag

SEQ ID NO: 1109576 - RNA, 22 nt, Human
aggguggccaugagggagagau

SEQ ID NO: 1109577 - RNA, 22 nt, Human
cuggcucccguuguccuugaag

SEQ ID NO: 1109578 - RNA, 22 nt, Human
cauuuagacauuugauuugggg

SEQ ID NO: 1109579 - RNA, 23 nt, Human
gagugcagaauagacaugcagug

SEQ ID NO: 1109580 - RNA, 22 nt, Human
caggagacuauggcccaaggcc

SEQ ID NO: 1109581 - RNA, 22 nt, Human
gccugaagaacagcugugagga

SEQ ID NO: 1109582 - RNA, 22 nt, Human
aguccuucaagaaaucuggaaa

SEQ ID NO: 1109583 - RNA, 22 nt, Human
acagccagggucucaggaggcg

SEQ ID NO: 1109584 - RNA, 22 nt, Human
augaguaaaaccacuauuuaca

SEQ ID NO: 1109585 - RNA, 22 nt, Human
ccucuggucccagcucugcugc

SEQ ID NO: 1109586 - RNA, 22 nt, Human
ucccuggacaacagacuucacu

SEQ ID NO: 1109587 - RNA, 22 nt, Human
ggcccuguccuggcugucuccg

SEQ ID NO: 1109588 - RNA, 22 nt, Human
aauguguagauguugcauuccu

SEQ ID NO: 1109589 - RNA, 22 nt, Human
agcagggcaaagucaggcuaac

SEQ ID NO: 1109590 - RNA, 22 nt, Human
ggcugcagguugguuggcagcu

SEQ ID NO: 1109591 - RNA, 23 nt, Human
ccagcccuccaccagcucuaggc

SEQ ID NO: 1109592 - RNA, 22 nt, Human
caguagccacuagacacaugua

SEQ ID NO: 1109593 - RNA, 22 nt, Human
aguuuguaucaauuugcuuuau

SEQ ID NO: 1109594 - RNA, 22 nt, Human
gugauuucaaauauagagugag

SEQ ID NO: 1109595 - RNA, 22 nt, Human
cagccuccugggacacucaccg

SEQ ID NO: 1109596 - RNA, 22 nt, Human
ucagagcuuuggagaccaggaa

SEQ ID NO: 1109597 - RNA, 22 nt, Human
guggauggacaugggcaagagg

SEQ ID NO: 1109598 - RNA, 22 nt, Human
aaagcugcugccaaucaggcuu

SEQ ID NO: 1109599 - RNA, 22 nt, Human
aagcuccccgaaacccaccucu

SEQ ID NO: 1109600 - RNA, 22 nt, Human
uagucaaaccucagaauacccc

SEQ ID NO: 1109601 - RNA, 22 nt, Human
caggcacucauucagagaggug

SEQ ID NO: 1109602 - RNA, 22 nt, Human
caaaugcuggcccugcuacuua

SEQ ID NO: 1109603 - RNA, 22 nt, Human
aggcagggucuugcuauguugc

SEQ ID NO: 1109604 - RNA, 22 nt, Human
gcaggagugacauggaugugga

SEQ ID NO: 1109605 - RNA, 22 nt, Human
cugggccagggaggugucugua

SEQ ID NO: 1109606 - RNA, 22 nt, Human
gcucccaccuccagccugaguu

SEQ ID NO: 1109607 - RNA, 22 nt, Human
auaguauuuaauaguuagcuca

SEQ ID NO: 1109608 - RNA, 22 nt, Human
gcucagggaacuuuuugcaggc

SEQ ID NO: 1109609 - RNA, 22 nt, Human
cagaguguaucuguguaagcau

SEQ ID NO: 1109610 - RNA, 19 nt, Human
uagucuuuauucuuaauuu

SEQ ID NO: 1109611 - RNA, 22 nt, Human
cagccucuaagcacagccucuc

SEQ ID NO: 1109612 - RNA, 22 nt, Human
cagcugcaggaacaaaaaugug

SEQ ID NO: 1109613 - RNA, 22 nt, Human
gagaggcuaugagguucugugu

SEQ ID NO: 1109614 - RNA, 22 nt, Human
uacaguaaagcugcuaugaauu

SEQ ID NO: 1109615 - RNA, 22 nt, Human
gagaagcaaucaguggccaccc

SEQ ID NO: 1109616 - RNA, 23 nt, Human
cauuucugggagauuuauaaaau

SEQ ID NO: 1109617 - RNA, 22 nt, Human
uagcugucaccagaaauggcca

SEQ ID NO: 1109618 - RNA, 22 nt, Human
uucuuuccaaccagauauuggu

SEQ ID NO: 1109619 - RNA, 22 nt, Human
ucaguuuuuguuugccagauag

SEQ ID NO: 1109620 - RNA, 22 nt, Human
gcaggccuccccugcuggagcu

SEQ ID NO: 1109621 - RNA, 22 nt, Human
acugucugcccugagaugccag

SEQ ID NO: 1109622 - RNA, 22 nt, Human
ccaucagcuccaguaucuucug

SEQ ID NO: 1109623 - RNA, 22 nt, Human
uggcaccugaacuuagaggugu

SEQ ID NO: 1109624 - RNA, 22 nt, Human
ggccugcugcuaugacuuccug

SEQ ID NO: 1109625 - RNA, 22 nt, Human
ccugggagagccaucuguggcc

SEQ ID NO: 1109626 - RNA, 22 nt, Human
aaguucaaggcucuagaguucc

SEQ ID NO: 1109627 - RNA, 22 nt, Human
uauuucuuguuauucucguuga

SEQ ID NO: 1109628 - RNA, 22 nt, Human
uggccuggcccugaggcccugu

SEQ ID NO: 1109629 - RNA, 22 nt, Human
caggcagcugacugucagauau

SEQ ID NO: 1109630 - RNA, 22 nt, Human
ggagccuguggccgucacgacu

SEQ ID NO: 1109631 - RNA, 19 nt, Human
ucccuuccugucgggcucc

SEQ ID NO: 1109632 - RNA, 22 nt, Human
uggagcccagggugagaaggag

SEQ ID NO: 1109633 - RNA, 22 nt, Human
cagccaggacagggaaacuagu

SEQ ID NO: 1109634 - RNA, 22 nt, Human
gcugagcuagaaaaggaccaca

SEQ ID NO: 1109635 - RNA, 22 nt, Human
gagcuuaggccagggacaggga

SEQ ID NO: 1109636 - RNA, 22 nt, Human
uacaaagugugcccaugcugag

SEQ ID NO: 1109637 - RNA, 16 nt, Human
agcagggcgggaagga

SEQ ID NO: 1109638 - RNA, 22 nt, Human
gcagcuguggguuccaagucua

SEQ ID NO: 1109639 - RNA, 22 nt, Human
ugagcuuacuucuguacacaga

SEQ ID NO: 1109640 - RNA, 22 nt, Human
ggcacagggaggcccuggugug

SEQ ID NO: 1109641 - RNA, 22 nt, Human
ccacucugauuuuggcuccacu

SEQ ID NO: 1109642 - RNA, 21 nt, Human
cucaggauggcggccuggugg

SEQ ID NO: 1109643 - RNA, 22 nt, Human
uacaguagaauuuuuaguaacu

SEQ ID NO: 1109644 - RNA, 22 nt, Human
aagauguaucaguuaagucuuc

SEQ ID NO: 1109645 - RNA, 22 nt, Human
aggcugggaaauguauuccagc

SEQ ID NO: 1109646 - RNA, 22 nt, Human
uagaaaucagcaggcauaugua

SEQ ID NO: 1109647 - RNA, 22 nt, Human
uguagaaagaauauguuucaua

SEQ ID NO: 1109648 - RNA, 22 nt, Human
ucauugcaagcucauuuaucug

SEQ ID NO: 1109649 - RNA, 22 nt, Human
guaacaaaguuucuaggugcug

SEQ ID NO: 1109650 - RNA, 22 nt, Human
cccaccccuggacaggugagug

SEQ ID NO: 1109651 - RNA, 23 nt, Human
ucccagggaaggugagcgaggcu

SEQ ID NO: 1109652 - RNA, 22 nt, Human
gcuggccucaucacugacuucu

SEQ ID NO: 1109653 - RNA, 22 nt, Human
ccccagccuuccaugggaauug

SEQ ID NO: 1109654 - RNA, 21 nt, Human
uccuucaguucugcacuuucu

SEQ ID NO: 1109655 - RNA, 22 nt, Human
gccuggaguggacuuggccccu

SEQ ID NO: 1109656 - RNA, 22 nt, Human
cacagggcagaggguccguggc

SEQ ID NO: 1109657 - RNA, 21 nt, Human
gcugucucuggcuccugggaa

SEQ ID NO: 1109658 - RNA, 22 nt, Human
ucacuuagauggggaucaucac

SEQ ID NO: 1109659 - RNA, 22 nt, Human
gggccacauugaagggugggua

SEQ ID NO: 1109660 - RNA, 22 nt, Human
agagcaggcauaaagcuuugaa

SEQ ID NO: 1109661 - RNA, 22 nt, Human
ugagccugcaauaagcacagcc

SEQ ID NO: 1109662 - RNA, 22 nt, Human
ugucacauguguggcauuuuuc

SEQ ID NO: 1109663 - RNA, 22 nt, Human
uggaggaugccuggggaggccu

SEQ ID NO: 1109664 - RNA, 22 nt, Human
uccuugaauauaauaacaguag

SEQ ID NO: 1109665 - RNA, 22 nt, Human
agaggcuccuucacucuggcac

SEQ ID NO: 1109666 - RNA, 22 nt, Human
cacacaugagucuccccauugg

SEQ ID NO: 1109667 - RNA, 22 nt, Human
acccaggagcaggcugggcagu

SEQ ID NO: 1109668 - RNA, 22 nt, Human
gcauuuaaauuugaacuucaga

SEQ ID NO: 1109669 - RNA, 22 nt, Human
gaggccuggcucugcccuccug

SEQ ID NO: 1109670 - RNA, 22 nt, Human
acugccaggauggcacuagagg

SEQ ID NO: 1109671 - RNA, 22 nt, Human
gugacagaguuuuagaucucau

SEQ ID NO: 1109672 - RNA, 22 nt, Human
ccugcuggccaguggagggcug

SEQ ID NO: 1109673 - RNA, 22 nt, Human
aaaagguaguugccaaauaagg

SEQ ID NO: 1109674 - RNA, 22 nt, Human
gccaggcuggccagcaccuucu

SEQ ID NO: 1109675 - RNA, 22 nt, Human
acugaaggucucagcaaggaug

SEQ ID NO: 1109676 - RNA, 21 nt, Human
aggagcuguguuagcuggucg

SEQ ID NO: 1109677 - RNA, 22 nt, Human
auguauguuaguguauuaucua

SEQ ID NO: 1109678 - RNA, 22 nt, Human
ugccuggcaaugccagaagcca

SEQ ID NO: 1109679 - RNA, 22 nt, Human
agacaucagcuugugugcaggg

SEQ ID NO: 1109680 - RNA, 22 nt, Human
ggcaaaaaguucccaucagugu

SEQ ID NO: 1109681 - RNA, 22 nt, Human
agccagacauggcuccugcucc

SEQ ID NO: 1109682 - RNA, 22 nt, Human
gagcagagacaguacaacuggc

SEQ ID NO: 1109683 - RNA, 22 nt, Human
ugcuggcucaguuugcagacuc

SEQ ID NO: 1109684 - RNA, 19 nt, Human
gggcagaauggcaucucag

SEQ ID NO: 1109685 - RNA, 22 nt, Human
gugucccaaagauuagaaauca

SEQ ID NO: 1109686 - RNA, 22 nt, Human
cagagcuggagggaacccuggc

SEQ ID NO: 1109687 - RNA, 22 nt, Human
cugcuuuguaaaauagacauaa

SEQ ID NO: 1109688 - RNA, 22 nt, Human
aaaugguauuuacucuguauua

SEQ ID NO: 1109689 - RNA, 22 nt, Human
gcucaggagcugacagccucaa

SEQ ID NO: 1109690 - RNA, 22 nt, Human
aagcaaaagguuacacuucugg

SEQ ID NO: 1109691 - RNA, 22 nt, Human
ugccucugggugaccaaggagc

SEQ ID NO: 1109692 - RNA, 22 nt, Human
ggaggccuugaggccaggagcu

SEQ ID NO: 1109693 - RNA, 22 nt, Human
gcuccugucuuggggcacuggc

SEQ ID NO: 1109694 - RNA, 22 nt, Human
cuggcaggaaguuagaugguaa

SEQ ID NO: 1109695 - RNA, 22 nt, Human
agccaugcaccuuacucuugcu

SEQ ID NO: 1109696 - RNA, 22 nt, Human
ucacaggcuccagggccuggau

SEQ ID NO: 1109697 - RNA, 22 nt, Human
cacucugcgcugggcgccagcg

SEQ ID NO: 1109698 - RNA, 22 nt, Human
cuggcucaccuccgcuccagca

SEQ ID NO: 1109699 - RNA, 22 nt, Human
uggggagugaugccucggauaa

SEQ ID NO: 1109700 - RNA, 22 nt, Human
caggaggccaacugugggacuu

SEQ ID NO: 1109701 - RNA, 22 nt, Human
agcugcuaugacaacaccagcc

SEQ ID NO: 1109702 - RNA, 20 nt, Human
gugaccagaagacagugggu

SEQ ID NO: 1109703 - RNA, 22 nt, Human
cugaggcuggggaagggaagug

SEQ ID NO: 1109704 - RNA, 22 nt, Human
uggaaagaaaguaaaggcguau

SEQ ID NO: 1109705 - RNA, 22 nt, Human
ggcuucugccacgagagggaag

SEQ ID NO: 1109706 - RNA, 22 nt, Human
aagcagaugggacuccaaggca

SEQ ID NO: 1109707 - RNA, 22 nt, Human
cagguggguguaugaaugcaaa

SEQ ID NO: 1109708 - RNA, 22 nt, Human
ccugagggaaggaugcuaccca

SEQ ID NO: 1109709 - RNA, 22 nt, Human
uaaagguacgaagugagggauu

SEQ ID NO: 1109710 - RNA, 21 nt, Human
gugguuauuuucauuagcauc

SEQ ID NO: 1109711 - RNA, 20 nt, Human
guaaaauauggucuuugggu

SEQ ID NO: 1109712 - RNA, 22 nt, Human
caaaagcaguucuaucugaguu

SEQ ID NO: 1109713 - RNA, 22 nt, Human
uggaggccagagguacugggac

SEQ ID NO: 1109714 - RNA, 22 nt, Human
cugcucuggucucuucauguuu

SEQ ID NO: 1109715 - RNA, 22 nt, Human
gcugguccacucccuggaggcu

SEQ ID NO: 1109716 - RNA, 21 nt, Human
gcaugccugcaucuuaguguu

SEQ ID NO: 1109717 - RNA, 19 nt, Human
gcuucccaccagccagccc

SEQ ID NO: 1109718 - RNA, 22 nt, Human
ccucauggccuugagcugaggg

SEQ ID NO: 1109719 - RNA, 22 nt, Human
uggggacacagagccaaacuau

SEQ ID NO: 1109720 - RNA, 22 nt, Human
aaaguguacuaugucaugaaca

SEQ ID NO: 1109721 - RNA, 23 nt, Human
agaggccaacuucuugccccucc

SEQ ID NO: 1109722 - RNA, 22 nt, Human
agagcugugaaaaugagguuug

SEQ ID NO: 1109723 - RNA, 22 nt, Human
uugucuguaaagacggccacca

SEQ ID NO: 1109724 - RNA, 22 nt, Human
gggaggucagggugccugcugg

SEQ ID NO: 1109725 - RNA, 22 nt, Human
ccagcugagaaguguaaaguga

SEQ ID NO: 1109726 - RNA, 22 nt, Human
ggaggccaggaaggcucggaga

SEQ ID NO: 1109727 - RNA, 22 nt, Human
cugugcauugucuugucuguag

SEQ ID NO: 1109728 - RNA, 22 nt, Human
aggcuccuugcucacaggcuca

SEQ ID NO: 1109729 - RNA, 22 nt, Human
cagagcuggguuugggaaaccu

SEQ ID NO: 1109730 - RNA, 22 nt, Human
gcuuuauguaaguccaaaggca

SEQ ID NO: 1109731 - RNA, 22 nt, Human
acugggaguucuccaugucccu

SEQ ID NO: 1109732 - RNA, 22 nt, Human
gauccuugcacuugacuuggca

SEQ ID NO: 1109733 - RNA, 22 nt, Human
gauuucaccugaucuugucauc

SEQ ID NO: 1109734 - RNA, 20 nt, Human
cuuggccuacuuagcuuugu

SEQ ID NO: 1109735 - RNA, 22 nt, Human
caggcagcugggucaccguccc

SEQ ID NO: 1109736 - RNA, 18 nt, Human
cucucuggucuggauccc

SEQ ID NO: 1109737 - RNA, 22 nt, Human
agaaaugggccuugggacacaa

SEQ ID NO: 1109738 - RNA, 22 nt, Human
uccagagggcgauggcuggggg

SEQ ID NO: 1109739 - RNA, 23 nt, Human
gcucagagguuuuucucuggaug

SEQ ID NO: 1109740 - RNA, 22 nt, Human
aaaaccaggcguuuccuauuau

SEQ ID NO: 1109741 - RNA, 22 nt, Human
auucuguauuucuaauaagauc

SEQ ID NO: 1109742 - RNA, 22 nt, Human
ugcagggcuuccucuuggaguu

SEQ ID NO: 1109743 - RNA, 22 nt, Human
cuggggaggcagggcugccccu

SEQ ID NO: 1109744 - RNA, 22 nt, Human
agcagagcccuuccauggccuu

SEQ ID NO: 1109745 - RNA, 22 nt, Human
cuuucucugugugguaaagggc

SEQ ID NO: 1109746 - RNA, 22 nt, Human
cagaagccugccucagaugcac

SEQ ID NO: 1109747 - RNA, 22 nt, Human
ccuggcugggccugauuucuca

SEQ ID NO: 1109748 - RNA, 22 nt, Human
gagagugaaggcuucccagcaa

SEQ ID NO: 1109749 - RNA, 21 nt, Human
cagaggccucaugcucugugc

SEQ ID NO: 1109750 - RNA, 22 nt, Human
aggagccuccuucucaugugca

SEQ ID NO: 1109751 - RNA, 21 nt, Human
ugcuggccucaagggugacuu

SEQ ID NO: 1109752 - RNA, 22 nt, Human
cagcuccccucuguggggcagu

SEQ ID NO: 1109753 - RNA, 22 nt, Human
gagauuggccuggcuugccaac

SEQ ID NO: 1109754 - RNA, 22 nt, Human
uucacaggcuuggagguggggg

SEQ ID NO: 1109755 - RNA, 22 nt, Human
ccugccaggccagugagcuucc

SEQ ID NO: 1109756 - RNA, 21 nt, Human
cagugcucaaucugacagugg

SEQ ID NO: 1109757 - RNA, 17 nt, Human
acaagcaguggccaugg

SEQ ID NO: 1109758 - RNA, 22 nt, Human
acccugagggguauagcagaag

SEQ ID NO: 1109759 - RNA, 22 nt, Human
gcagggccuuagcagcggcugc

SEQ ID NO: 1109760 - RNA, 22 nt, Human
ucagaagccggaagugcuccuc

SEQ ID NO: 1109761 - RNA, 22 nt, Human
ugccugagugauguggcagcca

SEQ ID NO: 1109762 - RNA, 22 nt, Human
uggcgugcccuccagacuuggc

SEQ ID NO: 1109763 - RNA, 22 nt, Human
cccucagcuucucccugcagcu

SEQ ID NO: 1109764 - RNA, 22 nt, Human
ugugugccagccuacgaggagc

SEQ ID NO: 1109765 - RNA, 22 nt, Human
gucccucugugucccugcaguc

SEQ ID NO: 1109766 - RNA, 22 nt, Human
ggcuggucacaccacugcaggg

SEQ ID NO: 1109767 - RNA, 22 nt, Human
cauaccuuucucaagcacaugu

SEQ ID NO: 1109768 - RNA, 19 nt, Human
ccuggcccugcugcgcggg

SEQ ID NO: 1109769 - RNA, 21 nt, Human
ggagauggguaucgccugggc

SEQ ID NO: 1109770 - RNA, 22 nt, Human
cuguccuaugaguacucacuag

SEQ ID NO: 1109771 - RNA, 23 nt, Human
agggcugaugccauugcagcucu

SEQ ID NO: 1109772 - RNA, 22 nt, Human
cagagccaacgccaccugccca

SEQ ID NO: 1109773 - RNA, 21 nt, Human
acagagccgggcacaaagcug

SEQ ID NO: 1109774 - RNA, 22 nt, Human
ucagaaauagucuuuaaaauga

SEQ ID NO: 1109775 - RNA, 21 nt, Human
ccagacuggccuaugugguag

SEQ ID NO: 1109776 - RNA, 22 nt, Human
ccaaaguccuuucuccaccugc

SEQ ID NO: 1109777 - RNA, 22 nt, Human
cugggagcccgcguccuggugg

SEQ ID NO: 1109778 - RNA, 22 nt, Human
cgagaguggacagggcgcagcu

SEQ ID NO: 1109779 - RNA, 22 nt, Human
agggcuggccacaugauuuggu

SEQ ID NO: 1109780 - RNA, 17 nt, Human
gcucccugaggacagcu

SEQ ID NO: 1109781 - RNA, 22 nt, Human
ugaccaaaggugguuuauuugg

SEQ ID NO: 1109782 - RNA, 22 nt, Human
gaggccugaaaggggaccuaug

SEQ ID NO: 1109783 - RNA, 22 nt, Human
ugguccagaugccuuggcuuua

SEQ ID NO: 1109784 - RNA, 23 nt, Human
auggagcugguacuagcuaccuc

SEQ ID NO: 1109785 - RNA, 22 nt, Human
ucuggccaacaaaaacuaaguc

SEQ ID NO: 1109786 - RNA, 22 nt, Human
uggagccaugccuggccuuucc

SEQ ID NO: 1109787 - RNA, 22 nt, Human
agccaaggacacggagccuccu

SEQ ID NO: 1109788 - RNA, 22 nt, Human
agcuugccucuuaaucaccuca

SEQ ID NO: 1109789 - RNA, 22 nt, Human
acagaggucauggagaguucuc

SEQ ID NO: 1109790 - RNA, 22 nt, Human
ugcugccaagcccgugcuccug

SEQ ID NO: 1109791 - RNA, 22 nt, Human
ggugacugguuuaucuggcagu

SEQ ID NO: 1109792 - RNA, 22 nt, Human
cuccauugaacauccucucaga

SEQ ID NO: 1109793 - RNA, 22 nt, Human
ucccagacaaucauuggccacc

SEQ ID NO: 1109794 - RNA, 22 nt, Human
gagcugucuggggacucugggu

SEQ ID NO: 1109795 - RNA, 22 nt, Human
gggagcuggagcuggaagacuc

SEQ ID NO: 1109796 - RNA, 22 nt, Human
ucagccugcuccaagugcugcc

SEQ ID NO: 1109797 - RNA, 22 nt, Human
cagggccaagccccuuuggcug

SEQ ID NO: 1109798 - RNA, 22 nt, Human
gcaccuggcugcccagguggag

SEQ ID NO: 1109799 - RNA, 19 nt, Human
acuuugcaugugugucuaa

SEQ ID NO: 1109800 - RNA, 22 nt, Human
agcagggcagguaaggaucaga

SEQ ID NO: 1109801 - RNA, 22 nt, Human
ugggcucauggcccagcacugg

SEQ ID NO: 1109802 - RNA, 22 nt, Human
agugcagugguuaggagccagg

SEQ ID NO: 1109803 - RNA, 21 nt, Human
ucucugggaggacuugugaga

SEQ ID NO: 1109804 - RNA, 22 nt, Human
uuauguauggauggcugaaagu

SEQ ID NO: 1109805 - RNA, 22 nt, Human
cuuacauugugugcaugagggg

SEQ ID NO: 1109806 - RNA, 22 nt, Human
cugcugcauuacucuucucaag

SEQ ID NO: 1109807 - RNA, 22 nt, Human
uauaauccauucauugauuucu

SEQ ID NO: 1109808 - RNA, 22 nt, Human
agugcauauaugaagaguauga

SEQ ID NO: 1109809 - RNA, 22 nt, Human
aagggagguaaagcuauuuaaa

SEQ ID NO: 1109810 - RNA, 18 nt, Human
gugagcagagagcaucac

SEQ ID NO: 1109811 - RNA, 22 nt, Human
cacugaguucccugacauuuca

SEQ ID NO: 1109812 - RNA, 22 nt, Human
ugcaaacuauugguagagaugg

SEQ ID NO: 1109813 - RNA, 22 nt, Human
agaggcugucccuugcuauucc

SEQ ID NO: 1109814 - RNA, 22 nt, Human
ggggcagagucuggacuguugu

SEQ ID NO: 1109815 - RNA, 22 nt, Human
uggcagagaacacacaugauuc

SEQ ID NO: 1109816 - RNA, 22 nt, Human
uccugagauguggagcuccaug

SEQ ID NO: 1109817 - RNA, 22 nt, Human
gcaggauggugcccuuucugcc

SEQ ID NO: 1109818 - RNA, 22 nt, Human
aucuggcuccuacacuugaaga

SEQ ID NO: 1109819 - RNA, 22 nt, Human
gaggccuggugugucucccgcu

SEQ ID NO: 1109820 - RNA, 22 nt, Human
uaaacauggauucugaucacag

SEQ ID NO: 1109821 - RNA, 22 nt, Human
cugggcaggagggcucuaugga

SEQ ID NO: 1109822 - RNA, 22 nt, Human
acagaauucuaguauguggcuu

SEQ ID NO: 1109823 - RNA, 22 nt, Human
augggaggaugcucgggugcuc

SEQ ID NO: 1109824 - RNA, 22 nt, Human
ugucauuuucuaaucuguuguc

SEQ ID NO: 1109825 - RNA, 18 nt, Human
acaggccucaguccugca

SEQ ID NO: 1109826 - RNA, 23 nt, Human
uagggcagcugggagggacaugc

SEQ ID NO: 1109827 - RNA, 22 nt, Human
uagaggugacacugagaccaua

SEQ ID NO: 1109828 - RNA, 22 nt, Human
auaaggcaucucucaguuagca

SEQ ID NO: 1109829 - RNA, 23 nt, Human
guggccuccccggaaugccucgc

SEQ ID NO: 1109830 - RNA, 20 nt, Human
caggcacacucauuccugcu

SEQ ID NO: 1109831 - RNA, 21 nt, Human
uccucugcagugagguggccu

SEQ ID NO: 1109832 - RNA, 22 nt, Human
ugcugucuguuuacuggcuaua

SEQ ID NO: 1109833 - RNA, 22 nt, Human
guggcuugaccaucccugcuac

SEQ ID NO: 1109834 - RNA, 22 nt, Human
gcagugggcaacaagagcugga

SEQ ID NO: 1109835 - RNA, 22 nt, Human
acugaguguaggacuuugaguu

SEQ ID NO: 1109836 - RNA, 20 nt, Human
acaggagaucugaggaaagg

SEQ ID NO: 1109837 - RNA, 22 nt, Human
ggcugggcuccgggagcaugcg

SEQ ID NO: 1109838 - RNA, 22 nt, Human
uuuccuuccaaaugcccgggag

SEQ ID NO: 1109839 - RNA, 22 nt, Human
auaucuuuguaugguucagcag

SEQ ID NO: 1109840 - RNA, 22 nt, Human
uggggcugaggagccucacucu

SEQ ID NO: 1109841 - RNA, 22 nt, Human
aggcucuguuauucuagagggc

SEQ ID NO: 1109842 - RNA, 22 nt, Human
gagcucauccccaugguccguc

SEQ ID NO: 1109843 - RNA, 19 nt, Human
gggaaauucacuugcuucc

SEQ ID NO: 1109844 - RNA, 17 nt, Human
ugcauguccuuuguucc

SEQ ID NO: 1109845 - RNA, 22 nt, Human
cuggcugcaggaaggagugggc

SEQ ID NO: 1109846 - RNA, 22 nt, Human
cagccacguagcccuuggccgu

SEQ ID NO: 1109847 - RNA, 22 nt, Human
gcucaggaaggcucaaccagga

SEQ ID NO: 1109848 - RNA, 22 nt, Human
gucugagaaucuugcauaucau

SEQ ID NO: 1109849 - RNA, 22 nt, Human
uggccagguguggguucucaga

SEQ ID NO: 1109850 - RNA, 22 nt, Human
gcuggccugggcucaagaccag

SEQ ID NO: 1109851 - RNA, 22 nt, Human
gggcagagaaauggacaguugg

SEQ ID NO: 1109852 - RNA, 22 nt, Human
guguuuccucuagaagccaugg

SEQ ID NO: 1109853 - RNA, 22 nt, Human
acaguaauuaaaauggaucugc

SEQ ID NO: 1109854 - RNA, 22 nt, Human
agagucuuccaggcagccugag

SEQ ID NO: 1109855 - RNA, 21 nt, Human
ugcaggcaggcagagaugcug

SEQ ID NO: 1109856 - RNA, 22 nt, Human
cuggagcuaauaauccaucuga

SEQ ID NO: 1109857 - RNA, 17 nt, Human
uuccaguuuaguauugu

SEQ ID NO: 1109858 - RNA, 22 nt, Human
uaaaucacuccuaauaaucagu

SEQ ID NO: 1109859 - RNA, 23 nt, Human
uggaccugaaccagugccucugu

SEQ ID NO: 1109860 - RNA, 21 nt, Human
ucuuuccugcccaguugcccu

SEQ ID NO: 1109861 - RNA, 22 nt, Human
ucucuucuuguguuuuccugcc

SEQ ID NO: 1109862 - RNA, 22 nt, Human
ccugugccauccugagcauccc

SEQ ID NO: 1109863 - RNA, 22 nt, Human
ugcaggugguuuggacacugcu

SEQ ID NO: 1109864 - RNA, 22 nt, Human
uggcagaguuggagguggaaga

SEQ ID NO: 1109865 - RNA, 22 nt, Human
ggcagggcuugucucugugaug

SEQ ID NO: 1109866 - RNA, 22 nt, Human
aaggcagcccuggcucagccug

SEQ ID NO: 1109867 - RNA, 22 nt, Human
agcugccacauggugucacugu

SEQ ID NO: 1109868 - RNA, 22 nt, Human
uggcucagauuuuuguaggcuu

SEQ ID NO: 1109869 - RNA, 22 nt, Human
ugcccaaguccuccaccgaggu

SEQ ID NO: 1109870 - RNA, 22 nt, Human
uccugcagaccucagucagguc

SEQ ID NO: 1109871 - RNA, 22 nt, Human
uugagggucuggaucugcugcu

SEQ ID NO: 1109872 - RNA, 22 nt, Human
gagagcugcauucucagacaca

SEQ ID NO: 1109873 - RNA, 22 nt, Human
aagaacaguguccugggacucg

SEQ ID NO: 1109874 - RNA, 22 nt, Human
uauugaaauccauuacguucuu

SEQ ID NO: 1109875 - RNA, 22 nt, Human
ccagggcaaaugagaucauagc

SEQ ID NO: 1109876 - RNA, 22 nt, Human
gcuggcuuugcacugggugcau

SEQ ID NO: 1109877 - RNA, 22 nt, Human
aaggcugaggagggccugcagg

SEQ ID NO: 1109878 - RNA, 22 nt, Human
ugugaaaggagccauagacagu

SEQ ID NO: 1109879 - RNA, 22 nt, Human
ucagaaauacuaucagcuuuug

SEQ ID NO: 1109880 - RNA, 19 nt, Human
cugagagaugcuucacaca

SEQ ID NO: 1109881 - RNA, 22 nt, Human
gcuguggcuguacagagaccau

SEQ ID NO: 1109882 - RNA, 22 nt, Human
uguaggaguccaaucaggagac

SEQ ID NO: 1109883 - RNA, 20 nt, Human
aauuuacucacagaaugaau

SEQ ID NO: 1109884 - RNA, 22 nt, Human
cugucccucaucaccucugggu

SEQ ID NO: 1109885 - RNA, 22 nt, Human
ugucagaacucuauugaugucc

SEQ ID NO: 1109886 - RNA, 22 nt, Human
uaguccauuuucacacugcuga

SEQ ID NO: 1109887 - RNA, 22 nt, Human
ggcugcugggaauaugccagcu

SEQ ID NO: 1109888 - RNA, 22 nt, Human
aggagagaauguuccaggcuug

SEQ ID NO: 1109889 - RNA, 22 nt, Human
acauauuuccaugcagcauguc

SEQ ID NO: 1109890 - RNA, 22 nt, Human
gauuuccuagacauggggcaga

SEQ ID NO: 1109891 - RNA, 22 nt, Human
ggcaucuguccaucucuccagc

SEQ ID NO: 1109892 - RNA, 22 nt, Human
caguacuuugcaucauuccacu

SEQ ID NO: 1109893 - RNA, 20 nt, Human
auuccauaguuggcacuuuu

SEQ ID NO: 1109894 - RNA, 22 nt, Human
caggccugucugcacaugaggc

SEQ ID NO: 1109895 - RNA, 20 nt, Human
aguaccuuuuguauguuacc

SEQ ID NO: 1109896 - RNA, 22 nt, Human
uugacagcuauuuugcuuugau

SEQ ID NO: 1109897 - RNA, 22 nt, Human
ccaggugggaggaaagcagaga

SEQ ID NO: 1109898 - RNA, 22 nt, Human
caaggcaggaagccugucuuau

SEQ ID NO: 1109899 - RNA, 21 nt, Human
agggagcuauuuauaguaagc

SEQ ID NO: 1109900 - RNA, 21 nt, Human
agagucugcauuucugacaag

SEQ ID NO: 1109901 - RNA, 22 nt, Human
cuguuuuugugcugugucuccc

SEQ ID NO: 1109902 - RNA, 22 nt, Human
gccuuccugcagcucugagcgu

SEQ ID NO: 1109903 - RNA, 22 nt, Human
ugaaaguuacaggaaaacagau

SEQ ID NO: 1109904 - RNA, 22 nt, Human
ucucaggggauucacuggcacc

SEQ ID NO: 1109905 - RNA, 22 nt, Human
cauuccuuaacguggggagucu

SEQ ID NO: 1109906 - RNA, 22 nt, Human
aagagcuggcccaaucugagca

SEQ ID NO: 1109907 - RNA, 22 nt, Human
cugggugguucuaacuguugau

SEQ ID NO: 1109908 - RNA, 22 nt, Human
gagcuuccauggacgccaucug

SEQ ID NO: 1109909 - RNA, 22 nt, Human
ugcugugagguugagaaggaag

SEQ ID NO: 1109910 - RNA, 19 nt, Human
gaucuuugccaauuuaagc

SEQ ID NO: 1109911 - RNA, 22 nt, Human
augcccaaugucacaauuuuug

SEQ ID NO: 1109912 - RNA, 22 nt, Human
agaaggaguguacaggucaugc

SEQ ID NO: 1109913 - RNA, 22 nt, Human
cagggcagggccacacccccug

SEQ ID NO: 1109914 - RNA, 22 nt, Human
augaccccuaaaauuuacuguc

SEQ ID NO: 1109915 - RNA, 22 nt, Human
uugaagcagcucaggaggcuua

SEQ ID NO: 1109916 - RNA, 22 nt, Human
uaggagaggugaauggcacacu

SEQ ID NO: 1109917 - RNA, 22 nt, Human
ucucagaguuuagagcugagcc

SEQ ID NO: 1109918 - RNA, 22 nt, Human
accagguggccccagcgugguu

SEQ ID NO: 1109919 - RNA, 22 nt, Human
acagauugaucuugagaauuau

SEQ ID NO: 1109920 - RNA, 22 nt, Human
uggcagagucaucacaucugga

SEQ ID NO: 1109921 - RNA, 22 nt, Human
agcagcagaggucagaaaggua

SEQ ID NO: 1109922 - RNA, 22 nt, Human
ucaggcugagaaaaucuggacc

SEQ ID NO: 1109923 - RNA, 18 nt, Human
ggcugagguugacuagaa

SEQ ID NO: 1109924 - RNA, 22 nt, Human
ucuggcucagggcucugaggga

SEQ ID NO: 1109925 - RNA, 22 nt, Human
cauuaucugccauugacaccau

SEQ ID NO: 1109926 - RNA, 22 nt, Human
uagauaaauuagaaaguuuacu

SEQ ID NO: 1109927 - RNA, 22 nt, Human
ggagccugcgggagcucccauu

SEQ ID NO: 1109928 - RNA, 22 nt, Human
ucugggcacugcugagccugua

SEQ ID NO: 1109929 - RNA, 22 nt, Human
uuguuacaucuuauguaagugg

SEQ ID NO: 1109930 - RNA, 22 nt, Human
ccucugaguccucccugguugc

SEQ ID NO: 1109931 - RNA, 21 nt, Human
uggaaagauucaaagaccagg

SEQ ID NO: 1109932 - RNA, 22 nt, Human
ugagcuuacgugggaacagacu

SEQ ID NO: 1109933 - RNA, 22 nt, Human
ugagagugauugguucgaaugu

SEQ ID NO: 1109934 - RNA, 22 nt, Human
cucuggcuucuaccuugcaguu

SEQ ID NO: 1109935 - RNA, 20 nt, Human
ggcugcugugggcagagagg

SEQ ID NO: 1109936 - RNA, 22 nt, Human
augcccgauaccuaguuaacuc

SEQ ID NO: 1109937 - RNA, 22 nt, Human
uauuauguagaguaaggguuaa

SEQ ID NO: 1109938 - RNA, 22 nt, Human
ccagcccuccuccaucagagga

SEQ ID NO: 1109939 - RNA, 22 nt, Human
gccugugacucgucuugggcca

SEQ ID NO: 1109940 - RNA, 22 nt, Human
gucugucucucuccagagugca

SEQ ID NO: 1109941 - RNA, 22 nt, Human
guccucugcccaggucaagguu

SEQ ID NO: 1109942 - RNA, 22 nt, Human
gugauuccuauuaguacaugca

SEQ ID NO: 1109943 - RNA, 22 nt, Human
gagacugauggggcucccagaa

SEQ ID NO: 1109944 - RNA, 22 nt, Human
aaaugucuaucuggcauauucc

SEQ ID NO: 1109945 - RNA, 22 nt, Human
gcugccugccuugccuggagga

SEQ ID NO: 1109946 - RNA, 22 nt, Human
cugucccagauguucucagcac

SEQ ID NO: 1109947 - RNA, 22 nt, Human
gaugcagggcuggcaggagcuu

SEQ ID NO: 1109948 - RNA, 22 nt, Human
aggcucugcagugcuggaggac

SEQ ID NO: 1109949 - RNA, 22 nt, Human
ugcugcuccugccuggcuccca

SEQ ID NO: 1109950 - RNA, 22 nt, Human
uaagaacaguagaacaguaggu

SEQ ID NO: 1109951 - RNA, 19 nt, Human
ggaaacaggggccagagga

SEQ ID NO: 1109952 - RNA, 20 nt, Human
cucugcuuuaggagagucag

SEQ ID NO: 1109953 - RNA, 20 nt, Human
agggcagcuugaggagccgg

SEQ ID NO: 1109954 - RNA, 21 nt, Human
ucccugcuuucuggcccaguc

SEQ ID NO: 1109955 - RNA, 22 nt, Human
cugcaggcugagcgccugccgg

SEQ ID NO: 1109956 - RNA, 22 nt, Human
gccuggagaagauggaacuagc

SEQ ID NO: 1109957 - RNA, 22 nt, Human
cccucugccucugaguaggaca

SEQ ID NO: 1109958 - RNA, 22 nt, Human
aauguauaaaguguuaauaacu

SEQ ID NO: 1109959 - RNA, 19 nt, Human
cugucaggggcuggauguu

SEQ ID NO: 1109960 - RNA, 22 nt, Human
ccugucucccuggcauggcuca

SEQ ID NO: 1109961 - RNA, 22 nt, Human
auaauuuacaacugcuuuuaau

SEQ ID NO: 1109962 - RNA, 22 nt, Human
gccugggagagggauagugcag

SEQ ID NO: 1109963 - RNA, 22 nt, Human
acccagcucuuugauggucuug

SEQ ID NO: 1109964 - RNA, 22 nt, Human
gcuggcucuucaguggagauag

SEQ ID NO: 1109965 - RNA, 22 nt, Human
aaaugcacucugcuucugugac

SEQ ID NO: 1109966 - RNA, 22 nt, Human
cagcuucugagcaagccagggg

SEQ ID NO: 1109967 - RNA, 22 nt, Human
gcacugaaauuauaugcauuug

SEQ ID NO: 1109968 - RNA, 18 nt, Human
cagaagcaggcagugcag

SEQ ID NO: 1109969 - RNA, 22 nt, Human
uaauccacaauagagauuaucu

SEQ ID NO: 1109970 - RNA, 22 nt, Human
cugccucuauaggaguccacca

SEQ ID NO: 1109971 - RNA, 22 nt, Human
auggacaggaacucccuuggca

SEQ ID NO: 1109972 - RNA, 22 nt, Human
guuugcauauuugcacaggaau

SEQ ID NO: 1109973 - RNA, 22 nt, Human
gcugccacgaucucugcuguag

SEQ ID NO: 1109974 - RNA, 22 nt, Human
uggcagagaauaaaucuugacu

SEQ ID NO: 1109975 - RNA, 22 nt, Human
gcucccagcuggagccucaaca

SEQ ID NO: 1109976 - RNA, 21 nt, Human
uggcacugcuuagcagguucc

SEQ ID NO: 1109977 - RNA, 22 nt, Human
aaaugcacagagccuuagagau

SEQ ID NO: 1109978 - RNA, 22 nt, Human
auguacacaugcaugcaugugc

SEQ ID NO: 1109979 - RNA, 22 nt, Human
uacaguaacauguuguacaagc

SEQ ID NO: 1109980 - RNA, 22 nt, Human
ggccuugggcagacacgucaca

SEQ ID NO: 1109981 - RNA, 22 nt, Human
cuggggugagcagaaacagggg

SEQ ID NO: 1109982 - RNA, 22 nt, Human
agcaagcuaccuagauagucua

SEQ ID NO: 1109983 - RNA, 22 nt, Human
cauuacaugguccaggauauau

SEQ ID NO: 1109984 - RNA, 22 nt, Human
cuguagccaguuuggccucacc

SEQ ID NO: 1109985 - RNA, 22 nt, Human
gggccugugcacaguucuguua

SEQ ID NO: 1109986 - RNA, 22 nt, Human
cuggcucauuuuagcaucaggu

SEQ ID NO: 1109987 - RNA, 22 nt, Human
cagaggccaccuguggccacug

SEQ ID NO: 1109988 - RNA, 22 nt, Human
agcauuuaugacuaauguaaaa

SEQ ID NO: 1109989 - RNA, 22 nt, Human
gcaggaguguggugggacaucc

SEQ ID NO: 1109990 - RNA, 22 nt, Human
gcuaccugagcaagagcuucaa

SEQ ID NO: 1109991 - RNA, 22 nt, Human
aagcugccuugcugaggagaaa

SEQ ID NO: 1109992 - RNA, 22 nt, Human
cuggacagaaaaggccacugga

SEQ ID NO: 1109993 - RNA, 22 nt, Human
acucugggccccagguggagcu

SEQ ID NO: 1109994 - RNA, 22 nt, Human
acagaauauugguuacuguugc

SEQ ID NO: 1109995 - RNA, 22 nt, Human
auaaaaguuuccaaucaugccu

SEQ ID NO: 1109996 - RNA, 22 nt, Human
gugcagggagcccagaaggucc

SEQ ID NO: 1109997 - RNA, 23 nt, Human
ugcucugggaggcccuggagagc

SEQ ID NO: 1109998 - RNA, 22 nt, Human
ccaaggaguagagcaggaagcu

SEQ ID NO: 1109999 - RNA, 20 nt, Human
gucucaaguaucucacaguc

SEQ ID NO: 1110000 - RNA, 22 nt, Human
ucucccacuggccuuguaugau

SEQ ID NO: 1110001 - RNA, 22 nt, Human
gggcagcugcagggauggugac

SEQ ID NO: 1110002 - RNA, 17 nt, Human
uguggccuucugagcuu

SEQ ID NO: 1110003 - RNA, 22 nt, Human
agcuguguggugucugacagcu

SEQ ID NO: 1110004 - RNA, 22 nt, Human
uugauacagcagccugugaucc

SEQ ID NO: 1110005 - RNA, 22 nt, Human
gccuggagugcaguggcgugau

SEQ ID NO: 1110006 - RNA, 22 nt, Human
uaugcacauucacacaaaaaug

SEQ ID NO: 1110007 - RNA, 23 nt, Human
ugggaguguugggaucucugcuc

SEQ ID NO: 1110008 - RNA, 22 nt, Human
gagggcugauaacaggaauaca

SEQ ID NO: 1110009 - RNA, 17 nt, Human
ccaggugggaggugggg

SEQ ID NO: 1110010 - RNA, 22 nt, Human
uuuauuguuguuagucauaagu

SEQ ID NO: 1110011 - RNA, 22 nt, Human
cugggguggaggagcuccccug

SEQ ID NO: 1110012 - RNA, 18 nt, Human
gcccagaggucugggccc

SEQ ID NO: 1110013 - RNA, 22 nt, Human
ccugccugacagagaagguuca

SEQ ID NO: 1110014 - RNA, 22 nt, Human
cagggcaggacagauacauuac

SEQ ID NO: 1110015 - RNA, 23 nt, Human
auuugagaaaguauuuuuaagac

SEQ ID NO: 1110016 - RNA, 22 nt, Human
auagucuuagucuauaguuuug

SEQ ID NO: 1110017 - RNA, 22 nt, Human
ggcagagcuuguuccuucuguu

SEQ ID NO: 1110018 - RNA, 22 nt, Human
cagcaugcaaguccagaugugg

SEQ ID NO: 1110019 - RNA, 22 nt, Human
aagcugccagauucagucugcu

SEQ ID NO: 1110020 - RNA, 22 nt, Human
auguuuauguugggcuauauuu

SEQ ID NO: 1110021 - RNA, 22 nt, Human
cacugaagaugcgacuagugcu

SEQ ID NO: 1110022 - RNA, 22 nt, Human
agagcugaggauccagcugagc

SEQ ID NO: 1110023 - RNA, 21 nt, Human
gccacguuucagucuucucag

SEQ ID NO: 1110024 - RNA, 22 nt, Human
cccugcagcuuuugcauaguca

SEQ ID NO: 1110025 - RNA, 22 nt, Human
guggccucugugcuccugccua

SEQ ID NO: 1110026 - RNA, 22 nt, Human
ccacagcugaccgcaggugagc

SEQ ID NO: 1110027 - RNA, 20 nt, Human
aggcugccaggucucacauc

SEQ ID NO: 1110028 - RNA, 22 nt, Human
aggcacugaccugcuuccuuga

SEQ ID NO: 1110029 - RNA, 19 nt, Human
agcagccauagacaauaug

SEQ ID NO: 1110030 - RNA, 22 nt, Human
acagaauacuacagacugguua

SEQ ID NO: 1110031 - RNA, 22 nt, Human
ucaugcaaggcugaaacauggu

SEQ ID NO: 1110032 - RNA, 22 nt, Human
acagauauaaacuauaguagug

SEQ ID NO: 1110033 - RNA, 22 nt, Human
ugcuggcuguauaugugagagu

SEQ ID NO: 1110034 - RNA, 22 nt, Human
ccaggagcagggcuggcugcac

SEQ ID NO: 1110035 - RNA, 22 nt, Human
aauuaguauugcgauucauuag

SEQ ID NO: 1110036 - RNA, 22 nt, Human
ugcuggcccuggcucagggaac

SEQ ID NO: 1110037 - RNA, 22 nt, Human
ucucaggaagauuagggcuaag

SEQ ID NO: 1110038 - RNA, 22 nt, Human
cuggaaggcucugcugccuguc

SEQ ID NO: 1110039 - RNA, 22 nt, Human
gagcaggcuugcagagaagggg

SEQ ID NO: 1110040 - RNA, 22 nt, Human
cagaagcagugagagaugugca

SEQ ID NO: 1110041 - RNA, 22 nt, Human
uuccuggugguggugacagcac

SEQ ID NO: 1110042 - RNA, 22 nt, Human
gcaggaaagguugagacuuugc

SEQ ID NO: 1110043 - RNA, 22 nt, Human
caggauccuggcugcauggacg

SEQ ID NO: 1110044 - RNA, 19 nt, Human
cuggggcuuugguacugcc

SEQ ID NO: 1110045 - RNA, 22 nt, Human
cccucccaagcacucugacaua

SEQ ID NO: 1110046 - RNA, 22 nt, Human
gccacguugccacccgggugac

SEQ ID NO: 1110047 - RNA, 22 nt, Human
ccagggccaguaagauuggcau

SEQ ID NO: 1110048 - RNA, 22 nt, Human
gcccagcuuuuugaggcaggca

SEQ ID NO: 1110049 - RNA, 22 nt, Human
gaguguucccacaccccaguug

SEQ ID NO: 1110050 - RNA, 22 nt, Human
cugcuccacaccuccauuuccu

SEQ ID NO: 1110051 - RNA, 22 nt, Human
gcucaggaaauaguuuaguguu

SEQ ID NO: 1110052 - RNA, 22 nt, Human
cuucccagacgggguggcagcc

SEQ ID NO: 1110053 - RNA, 22 nt, Human
cucuugaagcaggggccaguuc

SEQ ID NO: 1110054 - RNA, 19 nt, Human
uugguggugguuuugguuc

SEQ ID NO: 1110055 - RNA, 22 nt, Human
uggcagucggacuucuaucuca

SEQ ID NO: 1110056 - RNA, 22 nt, Human
uggagcaggcaucuuucucucu

SEQ ID NO: 1110057 - RNA, 20 nt, Human
agcccuguuuccuggagaga

SEQ ID NO: 1110058 - RNA, 22 nt, Human
cagagcugcacauucuaugaug

SEQ ID NO: 1110059 - RNA, 22 nt, Human
agcagggcagugaucagaaagg

SEQ ID NO: 1110060 - RNA, 22 nt, Human
acaguaaugauucugagucucu

SEQ ID NO: 1110061 - RNA, 22 nt, Human
uagggcagagcuuguacacgau

SEQ ID NO: 1110062 - RNA, 22 nt, Human
aaggcacuuuuccugagaugau

SEQ ID NO: 1110063 - RNA, 18 nt, Human
cuuuaugugcagagcuuu

SEQ ID NO: 1110064 - RNA, 22 nt, Human
uaaaucucacuggguauauugg

SEQ ID NO: 1110065 - RNA, 22 nt, Human
guggugcaggccagcaggggcg

SEQ ID NO: 1110066 - RNA, 22 nt, Human
auuguguaauuuucagcucaua

SEQ ID NO: 1110067 - RNA, 22 nt, Human
agaggccuuucuguugagugaa

SEQ ID NO: 1110068 - RNA, 22 nt, Human
gccuccugagaagccacaggcu

SEQ ID NO: 1110069 - RNA, 22 nt, Human
ugggcagcagcaaagccagacu

SEQ ID NO: 1110070 - RNA, 22 nt, Human
agucucagcaagcauggcuagu

SEQ ID NO: 1110071 - RNA, 22 nt, Human
gcucugggauuaccagccuuag

SEQ ID NO: 1110072 - RNA, 22 nt, Human
cugggcugcgggcgccccucca

SEQ ID NO: 1110073 - RNA, 22 nt, Human
ggaugcugggagacagcaggca

SEQ ID NO: 1110074 - RNA, 22 nt, Human
ccucugcucugguccaugugcu

SEQ ID NO: 1110075 - RNA, 22 nt, Human
cagucccaccaggaucgcucuu

SEQ ID NO: 1110076 - RNA, 22 nt, Human
ucaggcagaccaccgugggcag

SEQ ID NO: 1110077 - RNA, 22 nt, Human
ccagcaugagacgaugaugaag

SEQ ID NO: 1110078 - RNA, 22 nt, Human
aagucauugguagcuugauagg

SEQ ID NO: 1110079 - RNA, 22 nt, Human
ucaaugaugcugaagguagcgu

SEQ ID NO: 1110080 - RNA, 22 nt, Human
uacauucuacuuuuucacuccc

SEQ ID NO: 1110081 - RNA, 22 nt, Human
ugaggugaccgcagaugggaag

SEQ ID NO: 1110082 - RNA, 22 nt, Human
ccugagagagaagcgaccuggu

SEQ ID NO: 1110083 - RNA, 22 nt, Human
caugccaguuuugagaugcacc

SEQ ID NO: 1110084 - RNA, 21 nt, Human
ccuccaggugauuccgugcuc

SEQ ID NO: 1110085 - RNA, 22 nt, Human
aaggugucacugggacaggaaa

SEQ ID NO: 1110086 - RNA, 22 nt, Human
uuguuucaugaguguaaaggga

SEQ ID NO: 1110087 - RNA, 22 nt, Human
acuucuugggacccuggcaccg

SEQ ID NO: 1110088 - RNA, 22 nt, Human
auaauuuaaauuaguaugugau

SEQ ID NO: 1110089 - RNA, 22 nt, Human
gccuggcaaggcccuguugacu

SEQ ID NO: 1110090 - RNA, 22 nt, Human
cagcugaguuacucugaggucu

SEQ ID NO: 1110091 - RNA, 22 nt, Human
uaguuauuauuguuacuaucag

SEQ ID NO: 1110092 - RNA, 22 nt, Human
gccaggcuggucuugaacuccu

SEQ ID NO: 1110093 - RNA, 22 nt, Human
agaaugcuccagagcugaaaga

SEQ ID NO: 1110094 - RNA, 22 nt, Human
gcugggagccccgagccagcgc

SEQ ID NO: 1110095 - RNA, 22 nt, Human
aggcugccaaagcuucugucuc

SEQ ID NO: 1110096 - RNA, 22 nt, Human
ggccuugggaggagggucagaa

SEQ ID NO: 1110097 - RNA, 22 nt, Human
acauuuaggauguuuugagaga

SEQ ID NO: 1110098 - RNA, 22 nt, Human
caggccacaaguuggguucaag

SEQ ID NO: 1110099 - RNA, 22 nt, Human
ugcaccauuuugucaggcuacu

SEQ ID NO: 1110100 - RNA, 22 nt, Human
cagugggaagggcagaggcuuu

SEQ ID NO: 1110101 - RNA, 22 nt, Human
cugcuuccaugcaauggcaguc

SEQ ID NO: 1110102 - RNA, 22 nt, Human
gcagcuggcccugacacgcaga

SEQ ID NO: 1110103 - RNA, 22 nt, Human
ucaggugguccuaagugccauc

SEQ ID NO: 1110104 - RNA, 22 nt, Human
cucuggccugcuuccucaggua

SEQ ID NO: 1110105 - RNA, 22 nt, Human
uggaaggcaacggagugagcug

SEQ ID NO: 1110106 - RNA, 22 nt, Human
gccugcagugagugcagaaggu

SEQ ID NO: 1110107 - RNA, 20 nt, Human
ucccuggaggugguggcauc

SEQ ID NO: 1110108 - RNA, 22 nt, Human
ugcaccauuaauuuaugugaga

SEQ ID NO: 1110109 - RNA, 22 nt, Human
ucucagggcagcaaggaagcau

SEQ ID NO: 1110110 - RNA, 22 nt, Human
cacccacccacugcucauuggc

SEQ ID NO: 1110111 - RNA, 22 nt, Human
cagacaugauguaagcagaggc

SEQ ID NO: 1110112 - RNA, 22 nt, Human
guguacaugagaaaucaacuuu

SEQ ID NO: 1110113 - RNA, 22 nt, Human
gcucaggaucccaggggugugc

SEQ ID NO: 1110114 - RNA, 22 nt, Human
gccagcugguaggcaccuagcc

SEQ ID NO: 1110115 - RNA, 22 nt, Human
acccuuucuuacucacacgcuc

SEQ ID NO: 1110116 - RNA, 22 nt, Human
augggaggcagacacuaaguuc

SEQ ID NO: 1110117 - RNA, 22 nt, Human
uacauguaagacaugagacucu

SEQ ID NO: 1110118 - RNA, 22 nt, Human
ggagggcaucaaucaggccugg

SEQ ID NO: 1110119 - RNA, 22 nt, Human
ucuucuuccucauuuauacaua

SEQ ID NO: 1110120 - RNA, 22 nt, Human
ccagcugguguuccuuaggacc

SEQ ID NO: 1110121 - RNA, 19 nt, Human
ccaggccaucccaguuccc

SEQ ID NO: 1110122 - RNA, 22 nt, Human
ucuuggagaauggcagagaagc

SEQ ID NO: 1110123 - RNA, 22 nt, Human
ggaggugaggccguagggugug

SEQ ID NO: 1110124 - RNA, 19 nt, Human
auagaaaggguuaaagaca

SEQ ID NO: 1110125 - RNA, 22 nt, Human
caguacuuuucuggcuuucuac

SEQ ID NO: 1110126 - RNA, 22 nt, Human
ugagccagaguggagugugccu

SEQ ID NO: 1110127 - RNA, 22 nt, Human
cucaggauuaaggaaucuaaau

SEQ ID NO: 1110128 - RNA, 22 nt, Human
agcagggccaacaguaaacacc

SEQ ID NO: 1110129 - RNA, 22 nt, Human
ccugcugugaaacuggcauaug

SEQ ID NO: 1110130 - RNA, 22 nt, Human
uaaaugcaguacaaauuguucu

SEQ ID NO: 1110131 - RNA, 22 nt, Human
gcugucuggguugagggcccug

SEQ ID NO: 1110132 - RNA, 22 nt, Human
ugggcucugcugcguaccaguu

SEQ ID NO: 1110133 - RNA, 22 nt, Human
guguggcuaccucagaggagca

SEQ ID NO: 1110134 - RNA, 22 nt, Human
acccacgaagaugagcggcaug

SEQ ID NO: 1110135 - RNA, 22 nt, Human
ccagagaccagaacauggggau

SEQ ID NO: 1110136 - RNA, 22 nt, Human
ccugagagcauuccacacugaa

SEQ ID NO: 1110137 - RNA, 23 nt, Human
uugauacagaagaaucaguuugu

SEQ ID NO: 1110138 - RNA, 22 nt, Human
acaugcauucucuaaaagcaaa

SEQ ID NO: 1110139 - RNA, 22 nt, Human
uccuggaggcaaaugagcacau

SEQ ID NO: 1110140 - RNA, 22 nt, Human
agccucugcuggcccuggcacu

SEQ ID NO: 1110141 - RNA, 22 nt, Human
caaagguaaagaucugcugugg

SEQ ID NO: 1110142 - RNA, 22 nt, Human
aguuuuucuccccuggcuucau

SEQ ID NO: 1110143 - RNA, 22 nt, Human
gggugggguguaucggauccua

SEQ ID NO: 1110144 - RNA, 22 nt, Human
cagguggcaugacugccuacaa

SEQ ID NO: 1110145 - RNA, 22 nt, Human
augagcuucccagacaggaugg

SEQ ID NO: 1110146 - RNA, 22 nt, Human
ucauugcaguagggagagaccc

SEQ ID NO: 1110147 - RNA, 22 nt, Human
cugcuggccuagcccauccucu

SEQ ID NO: 1110148 - RNA, 22 nt, Human
cccugcugucaggugcugggag

SEQ ID NO: 1110149 - RNA, 22 nt, Human
gccuccugaaaggaagagcucc

SEQ ID NO: 1110150 - RNA, 22 nt, Human
ggcuggcacucuguccaguguc

SEQ ID NO: 1110151 - RNA, 22 nt, Human
uuacaaagagaaguuguagaau

SEQ ID NO: 1110152 - RNA, 22 nt, Human
acaaugcaccagcaucuucacc

SEQ ID NO: 1110153 - RNA, 22 nt, Human
ucagcuggcaguucagaggcug

SEQ ID NO: 1110154 - RNA, 22 nt, Human
agguaaagacugcaaggagaau

SEQ ID NO: 1110155 - RNA, 21 nt, Human
cuggacugaggagacagucgc

SEQ ID NO: 1110156 - RNA, 22 nt, Human
uacaguaaccuuauuugucauu

SEQ ID NO: 1110157 - RNA, 22 nt, Human
gcuggccugggcagaggcuaug

SEQ ID NO: 1110158 - RNA, 20 nt, Human
uccagcugggaacagcugau

SEQ ID NO: 1110159 - RNA, 20 nt, Human
agggucaguagcacagagcu

SEQ ID NO: 1110160 - RNA, 20 nt, Human
caagcccucuuuagccugcc

SEQ ID NO: 1110161 - RNA, 22 nt, Human
agggccugcaucaggagcuugg

SEQ ID NO: 1110162 - RNA, 22 nt, Human
uccagggauguccuguagcacu

SEQ ID NO: 1110163 - RNA, 22 nt, Human
cugggcuggagugcaauggcgc

SEQ ID NO: 1110164 - RNA, 22 nt, Human
ugcagcagacugaguaugagaa

SEQ ID NO: 1110165 - RNA, 22 nt, Human
cugcucuguucccccaucaucu

SEQ ID NO: 1110166 - RNA, 22 nt, Human
gcugucacauuuggagcacugg

SEQ ID NO: 1110167 - RNA, 22 nt, Human
gccagccuucuguggccugcaa

SEQ ID NO: 1110168 - RNA, 22 nt, Human
gagcuucccucugcagucccug

SEQ ID NO: 1110169 - RNA, 20 nt, Human
agaggcuuccuugggaggag

SEQ ID NO: 1110170 - RNA, 22 nt, Human
cuuugcaauagaggcacacaug

SEQ ID NO: 1110171 - RNA, 22 nt, Human
agggcagaggcggacacggaag

SEQ ID NO: 1110172 - RNA, 22 nt, Human
gcugagguggcugccuuaguaa

SEQ ID NO: 1110173 - RNA, 22 nt, Human
cagucacauggaugauggauag

SEQ ID NO: 1110174 - RNA, 23 nt, Human
ccacagagcugccaauuccugug

SEQ ID NO: 1110175 - RNA, 22 nt, Human
cagauggccagaggcagcugca

SEQ ID NO: 1110176 - RNA, 22 nt, Human
aacuagaaccacuuguauuucc

SEQ ID NO: 1110177 - RNA, 22 nt, Human
acuggagcccguggaggcgcag

SEQ ID NO: 1110178 - RNA, 22 nt, Human
ggccucugccccagccacaccu

SEQ ID NO: 1110179 - RNA, 22 nt, Human
gcugccugguuucucagcugca

SEQ ID NO: 1110180 - RNA, 22 nt, Human
cugaaggaagcagaagcgaggu

SEQ ID NO: 1110181 - RNA, 22 nt, Human
caccugagugucaguauucuca

SEQ ID NO: 1110182 - RNA, 22 nt, Human
aaagguuaagguguucaagaaa

SEQ ID NO: 1110183 - RNA, 22 nt, Human
uaaaauguagcuucuaggcugg

SEQ ID NO: 1110184 - RNA, 22 nt, Human
guggagcccugccuugcucaug

SEQ ID NO: 1110185 - RNA, 22 nt, Human
gaggguccccaugcagagcuca

SEQ ID NO: 1110186 - RNA, 22 nt, Human
ucaugacaucuguuuaucucaa

SEQ ID NO: 1110187 - RNA, 22 nt, Human
ucagagugugagacauauugga

SEQ ID NO: 1110188 - RNA, 22 nt, Human
uuccauaaaggugauaguauac

SEQ ID NO: 1110189 - RNA, 22 nt, Human
gagggcagagacagugauucac

SEQ ID NO: 1110190 - RNA, 22 nt, Human
aagggcugcuguagaagcagag

SEQ ID NO: 1110191 - RNA, 22 nt, Human
ccagccuucugagcugccugga

SEQ ID NO: 1110192 - RNA, 22 nt, Human
uugcuuuguggugguucuucca

SEQ ID NO: 1110193 - RNA, 22 nt, Human
aagaggucauaccagauaaggg

SEQ ID NO: 1110194 - RNA, 22 nt, Human
ggcaugggccgaggugccuccu

SEQ ID NO: 1110195 - RNA, 22 nt, Human
gaguggggucugggcaucaguc

SEQ ID NO: 1110196 - RNA, 22 nt, Human
cagggccagccgcagcauccac

SEQ ID NO: 1110197 - RNA, 21 nt, Human
cugugcuucuuccuaagccag

SEQ ID NO: 1110198 - RNA, 22 nt, Human
agaaaucagaacccugaaguuc

SEQ ID NO: 1110199 - RNA, 22 nt, Human
ugcagggcuaagucagagccug

SEQ ID NO: 1110200 - RNA, 19 nt, Human
acaaagcugugagcagcuu

SEQ ID NO: 1110201 - RNA, 22 nt, Human
ucugggcugggagcguguggac

SEQ ID NO: 1110202 - RNA, 22 nt, Human
cccuggggcugagggauggccg

SEQ ID NO: 1110203 - RNA, 22 nt, Human
uccaggagguuuggaggaagca

SEQ ID NO: 1110204 - RNA, 22 nt, Human
cugaggccucuguucaccagaa

SEQ ID NO: 1110205 - RNA, 22 nt, Human
ggggcacacuuuugguagauau

SEQ ID NO: 1110206 - RNA, 19 nt, Human
cagcaauaaugccagaugg

SEQ ID NO: 1110207 - RNA, 19 nt, Human
ccuuggaguuccaggugga

SEQ ID NO: 1110208 - RNA, 21 nt, Human
aacauuucaggauccaaauug

SEQ ID NO: 1110209 - RNA, 22 nt, Human
cagcaucuuucucuucuggagu

SEQ ID NO: 1110210 - RNA, 22 nt, Human
agccagggauggcagugcccag

SEQ ID NO: 1110211 - RNA, 22 nt, Human
ggagaugguggaagcuggugca

SEQ ID NO: 1110212 - RNA, 22 nt, Human
ccuggcaggccccuccuggauu

SEQ ID NO: 1110213 - RNA, 22 nt, Human
aaaaaugaauucuucaguggca

SEQ ID NO: 1110214 - RNA, 22 nt, Human
cucagaguggggcucccugagg

SEQ ID NO: 1110215 - RNA, 22 nt, Human
ucuggcucuccagugcucuuag

SEQ ID NO: 1110216 - RNA, 22 nt, Human
ugcucugguccucccucggcgc

SEQ ID NO: 1110217 - RNA, 22 nt, Human
guccuggggauacagaagugaa

SEQ ID NO: 1110218 - RNA, 22 nt, Human
ugggccugccccaggcuucagc

SEQ ID NO: 1110219 - RNA, 22 nt, Human
cucuguccuugcacaguuccua

SEQ ID NO: 1110220 - RNA, 22 nt, Human
gcugccugcucggcuccuggga

SEQ ID NO: 1110221 - RNA, 20 nt, Human
gcucccugguagaaauguuu

SEQ ID NO: 1110222 - RNA, 22 nt, Human
agugcacaccuuaguacaaagu

SEQ ID NO: 1110223 - RNA, 22 nt, Human
auggggcuguucucugcccugc

SEQ ID NO: 1110224 - RNA, 22 nt, Human
gacaggguacgggcuaggcaca

SEQ ID NO: 1110225 - RNA, 22 nt, Human
ccagaggugccacagaaagagc

SEQ ID NO: 1110226 - RNA, 22 nt, Human
uggagcugaacuuugaggccag

SEQ ID NO: 1110227 - RNA, 22 nt, Human
ugggaauggaugcuaagugcua

SEQ ID NO: 1110228 - RNA, 22 nt, Human
acauuucuucccuuuagcagaa

SEQ ID NO: 1110229 - RNA, 22 nt, Human
gcucugugggugaguagaaucu

SEQ ID NO: 1110230 - RNA, 22 nt, Human
agcucccagaaggcccugcgcc

SEQ ID NO: 1110231 - RNA, 22 nt, Human
ugcagaagaauguaggcauaag

SEQ ID NO: 1110232 - RNA, 22 nt, Human
augcacagacccaaaggccauc

SEQ ID NO: 1110233 - RNA, 22 nt, Human
cugagccaugagccugcgccca

SEQ ID NO: 1110234 - RNA, 21 nt, Human
aagagcuggaucaaggauaag

SEQ ID NO: 1110235 - RNA, 22 nt, Human
uggcuggggagccccgacuccc

SEQ ID NO: 1110236 - RNA, 22 nt, Human
gacacauagaucuaucucacuc

SEQ ID NO: 1110237 - RNA, 22 nt, Human
accccagcccugcuucugggag

SEQ ID NO: 1110238 - RNA, 22 nt, Human
cugggccugguagggcuugaaa

SEQ ID NO: 1110239 - RNA, 22 nt, Human
ugggcugcccugaugguccuca

SEQ ID NO: 1110240 - RNA, 22 nt, Human
ucccagagcagaugugcuaaag

SEQ ID NO: 1110241 - RNA, 22 nt, Human
caaagugcuggaauuacaggug

SEQ ID NO: 1110242 - RNA, 22 nt, Human
gccagccugugcuuggccaggc

SEQ ID NO: 1110243 - RNA, 22 nt, Human
uaaugcacauagaaguacuuag

SEQ ID NO: 1110244 - RNA, 22 nt, Human
cugccucugcgucccacagagu

SEQ ID NO: 1110245 - RNA, 22 nt, Human
cccucuggcucuucucaggccg

SEQ ID NO: 1110246 - RNA, 22 nt, Human
uuguuuugcuaaagggucauca

SEQ ID NO: 1110247 - RNA, 22 nt, Human
uggcagagcuggcugcggauga

SEQ ID NO: 1110248 - RNA, 22 nt, Human
aauaauuuuagcucagaguugu

SEQ ID NO: 1110249 - RNA, 22 nt, Human
ucugagggcuugaggggaagua

SEQ ID NO: 1110250 - RNA, 17 nt, Human
cugucugcgcaugaggu

SEQ ID NO: 1110251 - RNA, 22 nt, Human
aacaugaagguaggaugguuuu

SEQ ID NO: 1110252 - RNA, 22 nt, Human
cgcagcagccccgugguaggug

SEQ ID NO: 1110253 - RNA, 22 nt, Human
guacauuucauuuaaaugaugu

SEQ ID NO: 1110254 - RNA, 22 nt, Human
ggcucuggugaggguaggagau

SEQ ID NO: 1110255 - RNA, 22 nt, Human
augggcugugagguccggcagg

SEQ ID NO: 1110256 - RNA, 22 nt, Human
uccuuugacuucuugcagucca

SEQ ID NO: 1110257 - RNA, 22 nt, Human
agcauuuaauuacaguuuaauu

SEQ ID NO: 1110258 - RNA, 22 nt, Human
ccugggaggcugugggucugcu

SEQ ID NO: 1110259 - RNA, 22 nt, Human
ucagcaauccucccacaggugg

SEQ ID NO: 1110260 - RNA, 22 nt, Human
ggccucuguuuggagccaggau

SEQ ID NO: 1110261 - RNA, 22 nt, Human
gaguguuccagaaacuggcccu

SEQ ID NO: 1110262 - RNA, 22 nt, Human
aaagaucagucugaagcaacau

SEQ ID NO: 1110263 - RNA, 22 nt, Human
aggccuuccucggagacaggga

SEQ ID NO: 1110264 - RNA, 22 nt, Human
cagggcugugcccaucuucccc

SEQ ID NO: 1110265 - RNA, 22 nt, Human
aaggcacugaacuuaaauucug

SEQ ID NO: 1110266 - RNA, 22 nt, Human
ccuggcagucaggggaguccuu

SEQ ID NO: 1110267 - RNA, 22 nt, Human
gcagcagagcuuuguccuggcu

SEQ ID NO: 1110268 - RNA, 22 nt, Human
gugccugggguugagcuaugaa

SEQ ID NO: 1110269 - RNA, 22 nt, Human
agcagcaugaugacagagucuc

SEQ ID NO: 1110270 - RNA, 22 nt, Human
aguuuuuccguggcuacgauaa

SEQ ID NO: 1110271 - RNA, 23 nt, Human
ccuucagaagaaguaacaggggc

SEQ ID NO: 1110272 - RNA, 22 nt, Human
agggcacaagacucugagcccc

SEQ ID NO: 1110273 - RNA, 22 nt, Human
ccuuggaggacugcugcuucuu

SEQ ID NO: 1110274 - RNA, 22 nt, Human
uggcaguggcucagagugcaga

SEQ ID NO: 1110275 - RNA, 21 nt, Human
augacagaugcugcagaucgu

SEQ ID NO: 1110276 - RNA, 22 nt, Human
uuugcuauaaaagggucacacg

SEQ ID NO: 1110277 - RNA, 22 nt, Human
cacccaggcuggagugcagggg

SEQ ID NO: 1110278 - RNA, 22 nt, Human
cugagucucccggcaguggagg

SEQ ID NO: 1110279 - RNA, 22 nt, Human
ucacauuuguuccucugcacuu

SEQ ID NO: 1110280 - RNA, 22 nt, Human
uccuucaggccucauucucaua

SEQ ID NO: 1110281 - RNA, 22 nt, Human
ucuccuuuaagauuuccucagg

SEQ ID NO: 1110282 - RNA, 22 nt, Human
ugacccugcuucuuggugcagg

SEQ ID NO: 1110283 - RNA, 22 nt, Human
cagcucccaguggcagcuccuu

SEQ ID NO: 1110284 - RNA, 22 nt, Human
gucacacuagggccaaguggag

SEQ ID NO: 1110285 - RNA, 22 nt, Human
agagccugcagcugugaagaaa

SEQ ID NO: 1110286 - RNA, 22 nt, Human
accuuucaaaguggcuaucacu

SEQ ID NO: 1110287 - RNA, 22 nt, Human
uccugagauaaaucucauguga

SEQ ID NO: 1110288 - RNA, 22 nt, Human
cagcucucacacccuccuccca

SEQ ID NO: 1110289 - RNA, 17 nt, Human
gcagugaaaagagauca

SEQ ID NO: 1110290 - RNA, 22 nt, Human
gagccuggauugucaccgacuu

SEQ ID NO: 1110291 - RNA, 22 nt, Human
gagcucccaggccccagcaagg

SEQ ID NO: 1110292 - RNA, 22 nt, Human
cagcagugugcaggugugcugg

SEQ ID NO: 1110293 - RNA, 22 nt, Human
ccaaggagcucauauucuuguu

SEQ ID NO: 1110294 - RNA, 21 nt, Human
uugcaccaugauaaauucaga

SEQ ID NO: 1110295 - RNA, 22 nt, Human
guguauaacuaucuaucuagua

SEQ ID NO: 1110296 - RNA, 22 nt, Human
uugcauugauguuccuucuugc

SEQ ID NO: 1110297 - RNA, 22 nt, Human
uccaguggguugcugagggagg

SEQ ID NO: 1110298 - RNA, 22 nt, Human
uguacaguguagucaugagguu

SEQ ID NO: 1110299 - RNA, 21 nt, Human
cccagggaagccgcagucacc

SEQ ID NO: 1110300 - RNA, 22 nt, Human
ggcugccuggaccuccucuuuc

SEQ ID NO: 1110301 - RNA, 22 nt, Human
auuuaguguguauugcuauuau

SEQ ID NO: 1110302 - RNA, 21 nt, Human
uuuuuucuugcgugaggccug

SEQ ID NO: 1110303 - RNA, 22 nt, Human
cugccacuagcuuucacaucuu

SEQ ID NO: 1110304 - RNA, 22 nt, Human
agcaauaugacauugcuacauc

SEQ ID NO: 1110305 - RNA, 22 nt, Human
ucuuccucuagaucugaggccc

SEQ ID NO: 1110306 - RNA, 22 nt, Human
aggccuggccugggcggcauug

SEQ ID NO: 1110307 - RNA, 22 nt, Human
ccugggugacccgugagcgucc

SEQ ID NO: 1110308 - RNA, 21 nt, Human
uggcagaguugaguaguuaug

SEQ ID NO: 1110309 - RNA, 22 nt, Human
agcaucuggucaugagugagaa

SEQ ID NO: 1110310 - RNA, 22 nt, Human
ggccagagagccgcuguuagga

SEQ ID NO: 1110311 - RNA, 22 nt, Human
caggccugagacaucugagaua

SEQ ID NO: 1110312 - RNA, 22 nt, Human
gacagggcgcccagccuguuuc

SEQ ID NO: 1110313 - RNA, 22 nt, Human
aacaaauggggccuuguaugaa

SEQ ID NO: 1110314 - RNA, 22 nt, Human
aguuuuuccugauuuuacagaa

SEQ ID NO: 1110315 - RNA, 22 nt, Human
agagccugugggagaugcagcu

SEQ ID NO: 1110316 - RNA, 22 nt, Human
ccagggugugggcgucggcacg

SEQ ID NO: 1110317 - RNA, 18 nt, Human
ucaagacaucaugaaaua

SEQ ID NO: 1110318 - RNA, 22 nt, Human
uggaaggagcuaaggaccuggg

SEQ ID NO: 1110319 - RNA, 22 nt, Human
cccagccucuguuugcuccucu

SEQ ID NO: 1110320 - RNA, 22 nt, Human
ugagaguauuuuggcauuauca

SEQ ID NO: 1110321 - RNA, 22 nt, Human
caaugauggcuaggcagcugcu

SEQ ID NO: 1110322 - RNA, 19 nt, Human
uccuuugaauaucaguuga

SEQ ID NO: 1110323 - RNA, 22 nt, Human
agagcuggauggucaagauggc

SEQ ID NO: 1110324 - RNA, 22 nt, Human
cugaggugcuauggaggauacg

SEQ ID NO: 1110325 - RNA, 22 nt, Human
uuggccuuaaccucucugugcc

SEQ ID NO: 1110326 - RNA, 22 nt, Human
gagcucugggaaacaaagugua

SEQ ID NO: 1110327 - RNA, 22 nt, Human
augcacaagaggcuagaaaaga

SEQ ID NO: 1110328 - RNA, 18 nt, Human
aucuuuccauagcauguu

SEQ ID NO: 1110329 - RNA, 17 nt, Human
gccucugcuugugucau

SEQ ID NO: 1110330 - RNA, 22 nt, Human
auuucuuccucugucaguaacu

SEQ ID NO: 1110331 - RNA, 22 nt, Human
uguguccuucugggagucccag

SEQ ID NO: 1110332 - RNA, 22 nt, Human
uccuuuuuaagucguuguggua

SEQ ID NO: 1110333 - RNA, 22 nt, Human
gaagcagcuaggaucuucauuu

SEQ ID NO: 1110334 - RNA, 22 nt, Human
auccuucaaggggcugacagcu

SEQ ID NO: 1110335 - RNA, 18 nt, Human
uggcagagugucuguucu

SEQ ID NO: 1110336 - RNA, 22 nt, Human
gaguuauuggguggaaagguag

SEQ ID NO: 1110337 - RNA, 22 nt, Human
augcagguugggcaaguguggg

SEQ ID NO: 1110338 - RNA, 22 nt, Human
gcccagcagaucucagugucuc

SEQ ID NO: 1110339 - RNA, 22 nt, Human
ccagcacugcucucagacugag

SEQ ID NO: 1110340 - RNA, 22 nt, Human
caguacuuguccucagguguua

SEQ ID NO: 1110341 - RNA, 22 nt, Human
agcaccugcuuaaugugcagug

SEQ ID NO: 1110342 - RNA, 22 nt, Human
agagcugggugaagugccauca

SEQ ID NO: 1110343 - RNA, 22 nt, Human
aggaaagggguagguguggacg

SEQ ID NO: 1110344 - RNA, 22 nt, Human
gggaggcuggcucuggccacag

SEQ ID NO: 1110345 - RNA, 22 nt, Human
uagccggguguugugucaugca

SEQ ID NO: 1110346 - RNA, 22 nt, Human
cugaggucuagacaccccaggg

SEQ ID NO: 1110347 - RNA, 22 nt, Human
gagguggguguaucacagguca

SEQ ID NO: 1110348 - RNA, 22 nt, Human
aggggugaaggcccgauaggag

SEQ ID NO: 1110349 - RNA, 22 nt, Human
gagccuggauagccuuguucca

SEQ ID NO: 1110350 - RNA, 22 nt, Human
cugggcugucccaaccccaucc

SEQ ID NO: 1110351 - RNA, 22 nt, Human
uggcccugucccuggagccugg

SEQ ID NO: 1110352 - RNA, 22 nt, Human
ugugccuggcauucugggcuuc

SEQ ID NO: 1110353 - RNA, 22 nt, Human
ccuggcuuccuggagcucacaa

SEQ ID NO: 1110354 - RNA, 22 nt, Human
cugccuuccaaccccagacucc

SEQ ID NO: 1110355 - RNA, 18 nt, Human
ugugguggagcugccuuc

SEQ ID NO: 1110356 - RNA, 22 nt, Human
uguguacaggccuugcuagacu

SEQ ID NO: 1110357 - RNA, 22 nt, Human
agggcagccaugagccuucagg

SEQ ID NO: 1110358 - RNA, 22 nt, Human
gccuucaguaguauccucauga

SEQ ID NO: 1110359 - RNA, 22 nt, Human
aauaauuuccagccaacuggaa

SEQ ID NO: 1110360 - RNA, 22 nt, Human
gaaauguguuguucauuucuaa

SEQ ID NO: 1110361 - RNA, 22 nt, Human
cagagcugcuucccaguuugug

SEQ ID NO: 1110362 - RNA, 22 nt, Human
gcagcugaaagggaucucuaca

SEQ ID NO: 1110363 - RNA, 22 nt, Human
aaugaacaggugaaugucagau

SEQ ID NO: 1110364 - RNA, 22 nt, Human
gcugcccagcaggccccagggg

SEQ ID NO: 1110365 - RNA, 20 nt, Human
agcagcuguguuuucauccu

SEQ ID NO: 1110366 - RNA, 22 nt, Human
gcaggguaggugacagguaguc

SEQ ID NO: 1110367 - RNA, 22 nt, Human
cccucugccugcgcccuggugu

SEQ ID NO: 1110368 - RNA, 22 nt, Human
aggaggcuguggagcacuccau

SEQ ID NO: 1110369 - RNA, 22 nt, Human
gcagagcccuggggguauggug

SEQ ID NO: 1110370 - RNA, 22 nt, Human
aaaugcagauugucauucagga

SEQ ID NO: 1110371 - RNA, 22 nt, Human
caggcagggagcuggaaaggau

SEQ ID NO: 1110372 - RNA, 22 nt, Human
uccuugaagaaugauucuugga

SEQ ID NO: 1110373 - RNA, 22 nt, Human
cugcccugugaggguccuuggg

SEQ ID NO: 1110374 - RNA, 20 nt, Human
agguggcuccugcugggggu

SEQ ID NO: 1110375 - RNA, 22 nt, Human
caaggcugcugcgggucgcacc

SEQ ID NO: 1110376 - RNA, 22 nt, Human
ucaucacauaugucaugauuug

SEQ ID NO: 1110377 - RNA, 22 nt, Human
uacauugugauguuucaauaca

SEQ ID NO: 1110378 - RNA, 17 nt, Human
ccucccacaccgcccug

SEQ ID NO: 1110379 - RNA, 22 nt, Human
cauugcacuuuggguccaggac

SEQ ID NO: 1110380 - RNA, 22 nt, Human
ucaggcugccuaucagacugug

SEQ ID NO: 1110381 - RNA, 22 nt, Human
aagaagagaaaugugcugcugg

SEQ ID NO: 1110382 - RNA, 19 nt, Human
gcuuuuuguugucaaaggu

SEQ ID NO: 1110383 - RNA, 22 nt, Human
ggggaggcugaugugggcaaag

SEQ ID NO: 1110384 - RNA, 22 nt, Human
ggccugaggcaauagucagaca

SEQ ID NO: 1110385 - RNA, 22 nt, Human
ggagcugggaauuggaucaucu

SEQ ID NO: 1110386 - RNA, 22 nt, Human
cacuggggugggccugguagag

SEQ ID NO: 1110387 - RNA, 22 nt, Human
acagagaaagugggcugaagau

SEQ ID NO: 1110388 - RNA, 22 nt, Human
agggcagagauuaauuaagaca

SEQ ID NO: 1110389 - RNA, 22 nt, Human
aaagccuugagauccuauaguu

SEQ ID NO: 1110390 - RNA, 22 nt, Human
uagagcuggccgggacagcugg

SEQ ID NO: 1110391 - RNA, 22 nt, Human
ugggccuguugccugaguccau

SEQ ID NO: 1110392 - RNA, 22 nt, Human
uaacagaauuugcuaaacuccg

SEQ ID NO: 1110393 - RNA, 22 nt, Human
accugaggccuccccagcagac

SEQ ID NO: 1110394 - RNA, 22 nt, Human
ccucucaucauuaucgcuuugu

SEQ ID NO: 1110395 - RNA, 18 nt, Human
gagguccugcucuagccc

SEQ ID NO: 1110396 - RNA, 22 nt, Human
cagcugggagcuccauuagaua

SEQ ID NO: 1110397 - RNA, 22 nt, Human
cccuggaggagcuuagagcuug

SEQ ID NO: 1110398 - RNA, 22 nt, Human
caggaaagagcugccaggcagg

SEQ ID NO: 1110399 - RNA, 22 nt, Human
cuggcugcuggccugaggaugc

SEQ ID NO: 1110400 - RNA, 22 nt, Human
cagagaccccgcugcccuucug

SEQ ID NO: 1110401 - RNA, 22 nt, Human
aagagcuguaugccauaugauu

SEQ ID NO: 1110402 - RNA, 22 nt, Human
ucugggagagcugcugucagag

SEQ ID NO: 1110403 - RNA, 21 nt, Human
agagcugggacuugccugaga

SEQ ID NO: 1110404 - RNA, 22 nt, Human
uguauagaguuggaagaugacu

SEQ ID NO: 1110405 - RNA, 22 nt, Human
ggcaggaggaagaguuagcacc

SEQ ID NO: 1110406 - RNA, 22 nt, Human
gacagggccgcagauggagacu

SEQ ID NO: 1110407 - RNA, 23 nt, Human
gcaggugguucgaacagaaguuu

SEQ ID NO: 1110408 - RNA, 22 nt, Human
ucucugggauaaacugggccag

SEQ ID NO: 1110409 - RNA, 22 nt, Human
caguuuuucaaaauuacaugau

SEQ ID NO: 1110410 - RNA, 22 nt, Human
ggcugggcaggucugcacaggg

SEQ ID NO: 1110411 - RNA, 22 nt, Human
gcuggccugucuagagccuuac

SEQ ID NO: 1110412 - RNA, 22 nt, Human
ccuuccaggagucucugcaggu

SEQ ID NO: 1110413 - RNA, 22 nt, Human
ccagagugacgugaagugugaa

SEQ ID NO: 1110414 - RNA, 22 nt, Human
cuggugucugcucccucacagc

SEQ ID NO: 1110415 - RNA, 22 nt, Human
guaucuuuccacaucuucagua

SEQ ID NO: 1110416 - RNA, 22 nt, Human
agcaccugcuaugugucaggga

SEQ ID NO: 1110417 - RNA, 22 nt, Human
uaagaacaguguuucaucucua

SEQ ID NO: 1110418 - RNA, 22 nt, Human
ccaggcagccaagugugugugu

SEQ ID NO: 1110419 - RNA, 22 nt, Human
acagccugcugccugcuucuug

SEQ ID NO: 1110420 - RNA, 22 nt, Human
aggcccugggcaguucuguagc

SEQ ID NO: 1110421 - RNA, 22 nt, Human
cagaauaugacaagauuuuccu

SEQ ID NO: 1110422 - RNA, 22 nt, Human
ugcagaggaccauuguccugga

SEQ ID NO: 1110423 - RNA, 22 nt, Human
ucagcagaggggaaggcaucug

SEQ ID NO: 1110424 - RNA, 22 nt, Human
cuggcucccucgcugaggugcu

SEQ ID NO: 1110425 - RNA, 22 nt, Human
augacagaggagugcaggugau

SEQ ID NO: 1110426 - RNA, 20 nt, Human
cagucccaauccagggccag

SEQ ID NO: 1110427 - RNA, 22 nt, Human
ggcuagaacuuuacacuuugca

SEQ ID NO: 1110428 - RNA, 22 nt, Human
gcuggagccaagcugcucuugg

SEQ ID NO: 1110429 - RNA, 19 nt, Human
ccaggccuccugggagguc

SEQ ID NO: 1110430 - RNA, 18 nt, Human
acugugguuuauguguag

SEQ ID NO: 1110431 - RNA, 22 nt, Human
ugagugccugaacauagaguag

SEQ ID NO: 1110432 - RNA, 22 nt, Human
aggaaucccgcaccagcugcug

SEQ ID NO: 1110433 - RNA, 22 nt, Human
aucuggcuugacuuugcgacuu

SEQ ID NO: 1110434 - RNA, 22 nt, Human
ugcucuguaaggucagaaaagg

SEQ ID NO: 1110435 - RNA, 22 nt, Human
agucccagcucugccacuuacu

SEQ ID NO: 1110436 - RNA, 22 nt, Human
ugcaguggcgccaucucagcuc

SEQ ID NO: 1110437 - RNA, 22 nt, Human
cugccuugaggagguuguggga

SEQ ID NO: 1110438 - RNA, 20 nt, Human
gagccugggaagucuaaggu

SEQ ID NO: 1110439 - RNA, 22 nt, Human
acauuucuauagugcaucuguu

SEQ ID NO: 1110440 - RNA, 22 nt, Human
cugggaguguucuaggucacau

SEQ ID NO: 1110441 - RNA, 22 nt, Human
uucaagaugacccagucacacg

SEQ ID NO: 1110442 - RNA, 22 nt, Human
gccaccucggcuuucucugcuc

SEQ ID NO: 1110443 - RNA, 22 nt, Human
ggaggccaaagugugggcggcu

SEQ ID NO: 1110444 - RNA, 22 nt, Human
cugccagcucucuggaggcucu

SEQ ID NO: 1110445 - RNA, 22 nt, Human
gcaggaugggagcuucacuuug

SEQ ID NO: 1110446 - RNA, 22 nt, Human
caagggaguuacugagggcggg

SEQ ID NO: 1110447 - RNA, 21 nt, Human
ucccagagugcuugggacugc

SEQ ID NO: 1110448 - RNA, 23 nt, Human
ucugagagaacaaugccuccuau

SEQ ID NO: 1110449 - RNA, 22 nt, Human
aggagcugaagucucugcacuc

SEQ ID NO: 1110450 - RNA, 22 nt, Human
ucagugucuugaccugggugug

SEQ ID NO: 1110451 - RNA, 22 nt, Human
cagacagcugcuuucuugcugu

SEQ ID NO: 1110452 - RNA, 22 nt, Human
guucucucugcuuccaagaugg

SEQ ID NO: 1110453 - RNA, 22 nt, Human
cagccaggcccccgagucguug

SEQ ID NO: 1110454 - RNA, 22 nt, Human
ccaggccauucccagaguugcu

SEQ ID NO: 1110455 - RNA, 22 nt, Human
ucagaggucccuagcaggagug

SEQ ID NO: 1110456 - RNA, 22 nt, Human
aagaaauuaaugugccauuacu

SEQ ID NO: 1110457 - RNA, 22 nt, Human
cuuucacagcugugcuuaugau

SEQ ID NO: 1110458 - RNA, 22 nt, Human
aggaaagcucccaguagggcuc

SEQ ID NO: 1110459 - RNA, 22 nt, Human
cuccucacacccacugcaacca

SEQ ID NO: 1110460 - RNA, 22 nt, Human
gcugucugagaacaugguggaa

SEQ ID NO: 1110461 - RNA, 22 nt, Human
ccugcagguaaggcuaacugcc

SEQ ID NO: 1110462 - RNA, 22 nt, Human
aaugaugguuaaacacuggagg

SEQ ID NO: 1110463 - RNA, 21 nt, Human
gagacagcccagugccagggc

SEQ ID NO: 1110464 - RNA, 22 nt, Human
aaaucugggucaagguggagug

SEQ ID NO: 1110465 - RNA, 15 nt, Human
aaucuggcggcaagu

SEQ ID NO: 1110466 - RNA, 22 nt, Human
aaauugcaaaaguacuuuuagg

SEQ ID NO: 1110467 - RNA, 22 nt, Human
ugccacccagccaggaguggga

SEQ ID NO: 1110468 - RNA, 22 nt, Human
cagaagcauugacuccuugcuc

SEQ ID NO: 1110469 - RNA, 22 nt, Human
uuguuaaaaugcauauucuggu

SEQ ID NO: 1110470 - RNA, 22 nt, Human
ucauugaauuucacagcuuuau

SEQ ID NO: 1110471 - RNA, 22 nt, Human
agagaugaaaaguggagacugg

SEQ ID NO: 1110472 - RNA, 22 nt, Human
uuuuuccuagcgauuugucagc

SEQ ID NO: 1110473 - RNA, 22 nt, Human
uaauacuuuugccuuguauuca

SEQ ID NO: 1110474 - RNA, 22 nt, Human
guuauaaaggugauaaugguca

SEQ ID NO: 1110475 - RNA, 21 nt, Human
gagcauggcuuacaucagcag

SEQ ID NO: 1110476 - RNA, 22 nt, Human
ggggacaguuaaagaccaagac

SEQ ID NO: 1110477 - RNA, 22 nt, Human
uaaagcaggccacauaugugau

SEQ ID NO: 1110478 - RNA, 22 nt, Human
gccagguggcugagugacugag

SEQ ID NO: 1110479 - RNA, 22 nt, Human
uaugcauaauuggauaaguaga

SEQ ID NO: 1110480 - RNA, 22 nt, Human
gcucagccgaacuucagagcag

SEQ ID NO: 1110481 - RNA, 22 nt, Human
agauguaguagugggucuuuua

SEQ ID NO: 1110482 - RNA, 19 nt, Human
ugccuggcaccagcuccac

SEQ ID NO: 1110483 - RNA, 22 nt, Human
cugggccuuggauugacacugu

SEQ ID NO: 1110484 - RNA, 22 nt, Human
uggcccugccacucacugcuga

SEQ ID NO: 1110485 - RNA, 21 nt, Human
uaucuacuggugucuuucaga

SEQ ID NO: 1110486 - RNA, 22 nt, Human
uccaguggcacuggagacuaga

SEQ ID NO: 1110487 - RNA, 22 nt, Human
ugcaccccauuuuacauuuaca

SEQ ID NO: 1110488 - RNA, 22 nt, Human
gugcucacugugagacguccug

SEQ ID NO: 1110489 - RNA, 19 nt, Human
ugaaggagggggauggcca

SEQ ID NO: 1110490 - RNA, 22 nt, Human
ugggcacuggaagccugcugug

SEQ ID NO: 1110491 - RNA, 22 nt, Human
gaagcccauuuguacagcacau

SEQ ID NO: 1110492 - RNA, 22 nt, Human
ggcuuccuggagaaggucugag

SEQ ID NO: 1110493 - RNA, 22 nt, Human
gcacacagauuaggaaacagaa

SEQ ID NO: 1110494 - RNA, 22 nt, Human
ugagguguguccccagggaggu

SEQ ID NO: 1110495 - RNA, 22 nt, Human
ccaggguguagggauuccagau

SEQ ID NO: 1110496 - RNA, 22 nt, Human
ugcauuguugaugaguugaaua

SEQ ID NO: 1110497 - RNA, 22 nt, Human
cugaggccagcugcagagcucu

SEQ ID NO: 1110498 - RNA, 22 nt, Human
acauuucucagggaguuuugcu

SEQ ID NO: 1110499 - RNA, 22 nt, Human
ugacuucaaaggcucuacuccu

SEQ ID NO: 1110500 - RNA, 22 nt, Human
guuauguaucuugauugggugg

SEQ ID NO: 1110501 - RNA, 22 nt, Human
accacugggcgggcagccugcu

SEQ ID NO: 1110502 - RNA, 22 nt, Human
aaauguauccuacuuccugagu

SEQ ID NO: 1110503 - RNA, 22 nt, Human
ucccagaguuuccuguguccca

SEQ ID NO: 1110504 - RNA, 22 nt, Human
ucagaagcaaacaucacucuag

SEQ ID NO: 1110505 - RNA, 22 nt, Human
cacuguaucuuuuccaaagucu

SEQ ID NO: 1110506 - RNA, 22 nt, Human
aguuaaagucugaaauagagaa

SEQ ID NO: 1110507 - RNA, 23 nt, Human
ggaguuggauuguacuugcugcu

SEQ ID NO: 1110508 - RNA, 22 nt, Human
cauuaagauuuuuuucuacugg

SEQ ID NO: 1110509 - RNA, 22 nt, Human
caaaugaagaaccuucucaccu

SEQ ID NO: 1110510 - RNA, 22 nt, Human
uguuacuuaucucacgugaugc

SEQ ID NO: 1110511 - RNA, 22 nt, Human
uauguacagggauagaacuuga

SEQ ID NO: 1110512 - RNA, 22 nt, Human
uaagaacauuuucggaaagaua

SEQ ID NO: 1110513 - RNA, 22 nt, Human
gggaguggagagcaauggauga

SEQ ID NO: 1110514 - RNA, 22 nt, Human
ugccucugugggccuuccuggc

SEQ ID NO: 1110515 - RNA, 22 nt, Human
ugucaugcuuauguuacauacu

SEQ ID NO: 1110516 - RNA, 22 nt, Human
agcaggguauguuagagcugua

SEQ ID NO: 1110517 - RNA, 22 nt, Human
cagccagagaaagggcacugcc

SEQ ID NO: 1110518 - RNA, 17 nt, Human
aauagcugcucagagag

SEQ ID NO: 1110519 - RNA, 22 nt, Human
guacauuggcaacucucuuaga

SEQ ID NO: 1110520 - RNA, 19 nt, Human
gugauuucuuuccacaagc

SEQ ID NO: 1110521 - RNA, 22 nt, Human
uaaagguagcaugaaacugcaa

SEQ ID NO: 1110522 - RNA, 19 nt, Human
auaaggcagugacuuuuuu

SEQ ID NO: 1110523 - RNA, 22 nt, Human
acucuugucucaacuuuuguau

SEQ ID NO: 1110524 - RNA, 22 nt, Human
augcacccagugucuggacuau

SEQ ID NO: 1110525 - RNA, 22 nt, Human
guucauuuuacuguaaauagca

SEQ ID NO: 1110526 - RNA, 22 nt, Human
augucuuucucacagccaguuc

SEQ ID NO: 1110527 - RNA, 22 nt, Human
uuuccucuucgauuaaguuugg

SEQ ID NO: 1110528 - RNA, 22 nt, Human
aaaugucuuucaauagagaaau

SEQ ID NO: 1110529 - RNA, 22 nt, Human
gagcacagccaaaguaagaagg

SEQ ID NO: 1110530 - RNA, 22 nt, Human
ucccugggccacagcugugagc

SEQ ID NO: 1110531 - RNA, 22 nt, Human
ccaggcaucacgggcauguggc

SEQ ID NO: 1110532 - RNA, 22 nt, Human
acacacagguaaaggagccugg

SEQ ID NO: 1110533 - RNA, 22 nt, Human
aaguuugagaagcuuauagaua

SEQ ID NO: 1110534 - RNA, 22 nt, Human
gacucugcuacaggccgagguu

SEQ ID NO: 1110535 - RNA, 22 nt, Human
ggucagccuuggauuugguagc

SEQ ID NO: 1110536 - RNA, 22 nt, Human
gcccucugcacagcucugagca

SEQ ID NO: 1110537 - RNA, 22 nt, Human
gggcccuggacguggcggcaga

SEQ ID NO: 1110538 - RNA, 22 nt, Human
ucugccuuuucacugccacuaa

SEQ ID NO: 1110539 - RNA, 22 nt, Human
cugagguguugaugaccuaugc

SEQ ID NO: 1110540 - RNA, 22 nt, Human
ccaggcugagcaugauuggagc

SEQ ID NO: 1110541 - RNA, 22 nt, Human
acucugaggagugacuagaggu

SEQ ID NO: 1110542 - RNA, 22 nt, Human
acaggugauucaggcucuggga

SEQ ID NO: 1110543 - RNA, 22 nt, Human
cauggccucaaaggacugcaga

SEQ ID NO: 1110544 - RNA, 22 nt, Human
gaggggcuggguagggcaaccc

SEQ ID NO: 1110545 - RNA, 22 nt, Human
gucaggggccaugggccaagga

SEQ ID NO: 1110546 - RNA, 22 nt, Human
auuuugaaaagcauuugaguaa

SEQ ID NO: 1110547 - RNA, 22 nt, Human
agggaauguagcaagaugccaa

SEQ ID NO: 1110548 - RNA, 22 nt, Human
cuccugaguaguagcauuguca

SEQ ID NO: 1110549 - RNA, 22 nt, Human
aggagccccucuucaguccugg

SEQ ID NO: 1110550 - RNA, 22 nt, Human
acuucauuguaauauuauagca

SEQ ID NO: 1110551 - RNA, 22 nt, Human
acagagcaauucuuggguguuu

SEQ ID NO: 1110552 - RNA, 22 nt, Human
cugugccuaagaugcaugucuc

SEQ ID NO: 1110553 - RNA, 22 nt, Human
ugagccagccuugcagcugugc

SEQ ID NO: 1110554 - RNA, 22 nt, Human
acaaagugcacaagaugagaac

SEQ ID NO: 1110555 - RNA, 22 nt, Human
ucagggcaagucucagaagguu

SEQ ID NO: 1110556 - RNA, 22 nt, Human
cuggagaggcugggaacagguu

SEQ ID NO: 1110557 - RNA, 16 nt, Human
gagccaggugccuuga

SEQ ID NO: 1110558 - RNA, 19 nt, Human
gaagaagcuugagaaguag

SEQ ID NO: 1110559 - RNA, 21 nt, Human
ucacuuauaauguauuugcug

SEQ ID NO: 1110560 - RNA, 22 nt, Human
cugcccugggaguaccuguccu

SEQ ID NO: 1110561 - RNA, 22 nt, Human
uucacauugugcagauuauggu

SEQ ID NO: 1110562 - RNA, 19 nt, Human
uucacauuggaagaaguag

SEQ ID NO: 1110563 - RNA, 22 nt, Human
aggcuucuacguggucccaggg

SEQ ID NO: 1110564 - RNA, 22 nt, Human
agagaaaacucauugagguguc

SEQ ID NO: 1110565 - RNA, 22 nt, Human
ccugggcauaaaucacuccaag

SEQ ID NO: 1110566 - RNA, 22 nt, Human
acagaacugcaggaggaaaagc

SEQ ID NO: 1110567 - RNA, 22 nt, Human
gagagcuggauucuggauaggu

SEQ ID NO: 1110568 - RNA, 22 nt, Human
aaguauauuuuuugaagcauau

SEQ ID NO: 1110569 - RNA, 22 nt, Human
uuuucuuacugucugugauccu

SEQ ID NO: 1110570 - RNA, 22 nt, Human
cgggcagaucacacagggcuug

SEQ ID NO: 1110571 - RNA, 22 nt, Human
cagcuggcaaguggagcagggu

SEQ ID NO: 1110572 - RNA, 22 nt, Human
ucagaagagcuggugcugccug

SEQ ID NO: 1110573 - RNA, 22 nt, Human
ggugggcaggucacucugccuc

SEQ ID NO: 1110574 - RNA, 22 nt, Human
guaggcagucucucaggugauc

SEQ ID NO: 1110575 - RNA, 22 nt, Human
cccagggacagcuagguggggc

SEQ ID NO: 1110576 - RNA, 22 nt, Human
uagaaaugcccagauucugcua

SEQ ID NO: 1110577 - RNA, 22 nt, Human
auaaggcagaaaugauucuagu

SEQ ID NO: 1110578 - RNA, 22 nt, Human
ugauuuccuagcugacaugaaa

SEQ ID NO: 1110579 - RNA, 18 nt, Human
cagagcagagguggagcg

SEQ ID NO: 1110580 - RNA, 22 nt, Human
uggggugccgacagggagggca

SEQ ID NO: 1110581 - RNA, 22 nt, Human
agaggugacauaggagaggcuc

SEQ ID NO: 1110582 - RNA, 22 nt, Human
ucccagccuuccagucugguuu

SEQ ID NO: 1110583 - RNA, 22 nt, Human
uagaaagugaagguuaauuaau

SEQ ID NO: 1110584 - RNA, 22 nt, Human
aggcuuccucgugccuuagaua

SEQ ID NO: 1110585 - RNA, 20 nt, Human
cagagccaagagcagcaucu

SEQ ID NO: 1110586 - RNA, 22 nt, Human
gccaggggacgcggagcgacga

SEQ ID NO: 1110587 - RNA, 22 nt, Human
ugcucuguauucuauggcaguu

SEQ ID NO: 1110588 - RNA, 22 nt, Human
auggggugagacuaggauuaaa

SEQ ID NO: 1110589 - RNA, 20 nt, Human
gggugagauguaggagaggg

SEQ ID NO: 1110590 - RNA, 22 nt, Human
cagccaucaguaaagacagcuu

SEQ ID NO: 1110591 - RNA, 22 nt, Human
gagugcagaugaacagaagauu

SEQ ID NO: 1110592 - RNA, 22 nt, Human
uccagcagcccgaaggcccauc

SEQ ID NO: 1110593 - RNA, 22 nt, Human
gcuggcagaagagcugguucaa

SEQ ID NO: 1110594 - RNA, 22 nt, Human
gcugucugcaagccaggaaaug

SEQ ID NO: 1110595 - RNA, 22 nt, Human
cacagcuuccauuagaaugaga

SEQ ID NO: 1110596 - RNA, 22 nt, Human
ccuuucucuuggauaccgauug

SEQ ID NO: 1110597 - RNA, 23 nt, Human
ugcuguccaacagacuggccaug

SEQ ID NO: 1110598 - RNA, 21 nt, Human
agaugaggauacugaggccua

SEQ ID NO: 1110599 - RNA, 22 nt, Human
uugccaggagcucaucugaggg

SEQ ID NO: 1110600 - RNA, 22 nt, Human
guggcagcggcccaggccgucu

SEQ ID NO: 1110601 - RNA, 22 nt, Human
gcucugcugucuucuugcaggc

SEQ ID NO: 1110602 - RNA, 22 nt, Human
acacaguauuacaauaggugcu

SEQ ID NO: 1110603 - RNA, 22 nt, Human
ucaggcugcccguucagggcuc

SEQ ID NO: 1110604 - RNA, 22 nt, Human
uauuugaaaguguacaaaaacu

SEQ ID NO: 1110605 - RNA, 22 nt, Human
ucuucuuccuccacagggccca

SEQ ID NO: 1110606 - RNA, 22 nt, Human
aggcaucugaguuugcaagcuu

SEQ ID NO: 1110607 - RNA, 20 nt, Human
accucugcaucaauccuuug

SEQ ID NO: 1110608 - RNA, 22 nt, Human
uaaaugcagcaguuucuguucu

SEQ ID NO: 1110609 - RNA, 22 nt, Human
gcuuccuaaaugcacagggcag

SEQ ID NO: 1110610 - RNA, 23 nt, Human
augcucugggcugugggaccugc

SEQ ID NO: 1110611 - RNA, 22 nt, Human
uaaugcaguacugauauaaaca

SEQ ID NO: 1110612 - RNA, 22 nt, Human
ccucuugccaaucagcuacaga

SEQ ID NO: 1110613 - RNA, 22 nt, Human
ugguggccaauucacagggcuc

SEQ ID NO: 1110614 - RNA, 22 nt, Human
aguuucauauuaccaugucacc

SEQ ID NO: 1110615 - RNA, 22 nt, Human
ccugcagguugcagaggcggaa

SEQ ID NO: 1110616 - RNA, 22 nt, Human
gagucaguaauggauaugucau

SEQ ID NO: 1110617 - RNA, 22 nt, Human
cuggcuuccucaggagcagugg

SEQ ID NO: 1110618 - RNA, 22 nt, Human
ugucaccaguuccaggaaauaa

SEQ ID NO: 1110619 - RNA, 22 nt, Human
agguacaguagacagacaguua

SEQ ID NO: 1110620 - RNA, 22 nt, Human
gaggccuggaauuccagccugg

SEQ ID NO: 1110621 - RNA, 19 nt, Human
cuggcucuuggguggagga

SEQ ID NO: 1110622 - RNA, 22 nt, Human
cugggcucagcccaugcugucc

SEQ ID NO: 1110623 - RNA, 22 nt, Human
ugggggugacuaucucgggaau

SEQ ID NO: 1110624 - RNA, 22 nt, Human
gccaagagaaugugagagaaau

SEQ ID NO: 1110625 - RNA, 22 nt, Human
gagaaggggugauguggguaau

SEQ ID NO: 1110626 - RNA, 22 nt, Human
ucaacagaagugauagcuauua

SEQ ID NO: 1110627 - RNA, 22 nt, Human
agaagaaacugucggggauauu

SEQ ID NO: 1110628 - RNA, 19 nt, Human
gccaggagggcucuggcug

SEQ ID NO: 1110629 - RNA, 22 nt, Human
ugggccugggucuuugcugcca

SEQ ID NO: 1110630 - RNA, 21 nt, Human
uggcugccuacaugcugcagg

SEQ ID NO: 1110631 - RNA, 22 nt, Human
agcacagguacggagaugcuac

SEQ ID NO: 1110632 - RNA, 22 nt, Human
gcucccagacugaccagaggug

SEQ ID NO: 1110633 - RNA, 22 nt, Human
cuggcucacaggugagaugcau

SEQ ID NO: 1110634 - RNA, 22 nt, Human
gcuguccaugucuggccucagu

SEQ ID NO: 1110635 - RNA, 22 nt, Human
ccaggcuggauuuugcaguuca

SEQ ID NO: 1110636 - RNA, 22 nt, Human
ccuggcugugcauugccggccc

SEQ ID NO: 1110637 - RNA, 22 nt, Human
cccaccaguacagaugguagau

SEQ ID NO: 1110638 - RNA, 22 nt, Human
ugaguagcggcuauguguaacu

SEQ ID NO: 1110639 - RNA, 22 nt, Human
agccucugcuuaugcaaaggua

SEQ ID NO: 1110640 - RNA, 22 nt, Human
agccuucaguaaauccacugug

SEQ ID NO: 1110641 - RNA, 20 nt, Human
gcccuggagccuuguccugg

SEQ ID NO: 1110642 - RNA, 22 nt, Human
aaaaacugcaauuacuuuuguc

SEQ ID NO: 1110643 - RNA, 22 nt, Human
uuguuuuuaugaacauccagga

SEQ ID NO: 1110644 - RNA, 20 nt, Human
ugcugcaguuucaugggacu

SEQ ID NO: 1110645 - RNA, 22 nt, Human
aucagcaagauugugucuugua

SEQ ID NO: 1110646 - RNA, 22 nt, Human
caagacaagaucuaagcaugcu

SEQ ID NO: 1110647 - RNA, 22 nt, Human
gagagaagggggauaugagccu

SEQ ID NO: 1110648 - RNA, 23 nt, Human
aagcugccuucgcaguuggucug

SEQ ID NO: 1110649 - RNA, 22 nt, Human
ugcugucuuccaggauggugaa

SEQ ID NO: 1110650 - RNA, 22 nt, Human
acaggcucucagccaguuggca

SEQ ID NO: 1110651 - RNA, 21 nt, Human
uaaagaagaugaaugugauca

SEQ ID NO: 1110652 - RNA, 21 nt, Human
agcugcuccagggagcucagg

SEQ ID NO: 1110653 - RNA, 22 nt, Human
uugcauugggagugaggagacc

SEQ ID NO: 1110654 - RNA, 22 nt, Human
ggcagcugugaagugccucaca

SEQ ID NO: 1110655 - RNA, 23 nt, Human
aggagccaggugcagcccuugug

SEQ ID NO: 1110656 - RNA, 19 nt, Human
agucccaggcccgaaagag

SEQ ID NO: 1110657 - RNA, 22 nt, Human
cauggcagaaaccugagcugcu

SEQ ID NO: 1110658 - RNA, 22 nt, Human
cucagggcuugaguguccagga

SEQ ID NO: 1110659 - RNA, 22 nt, Human
cagcuggcagcccuggcccugc

SEQ ID NO: 1110660 - RNA, 22 nt, Human
cuucuugcaauuuucaucuuau

SEQ ID NO: 1110661 - RNA, 22 nt, Human
ugagagugaaaugucacauguc

SEQ ID NO: 1110662 - RNA, 22 nt, Human
cuggcagcauggagccugugcu

SEQ ID NO: 1110663 - RNA, 22 nt, Human
aggcuuccgaguagcugggacu

SEQ ID NO: 1110664 - RNA, 22 nt, Human
gcugggcuucucaaugcugccu

SEQ ID NO: 1110665 - RNA, 22 nt, Human
uugcauugaaaauauauuuuaa

SEQ ID NO: 1110666 - RNA, 22 nt, Human
uuuccucugggcccugccaccc

SEQ ID NO: 1110667 - RNA, 22 nt, Human
agcagagucugugugcacuuua

SEQ ID NO: 1110668 - RNA, 22 nt, Human
cccagccugucuuucccaauga

SEQ ID NO: 1110669 - RNA, 22 nt, Human
cacagcagaaaguguaggagga

SEQ ID NO: 1110670 - RNA, 22 nt, Human
agcuggccuguuagagcugagu

SEQ ID NO: 1110671 - RNA, 22 nt, Human
aggagcagcccacuccuguccu

SEQ ID NO: 1110672 - RNA, 22 nt, Human
ggcugcaggcagaggcugucug

SEQ ID NO: 1110673 - RNA, 22 nt, Human
ucggagcuguagaugaaacccu

SEQ ID NO: 1110674 - RNA, 22 nt, Human
ugaaagguuauuuaggucugcu

SEQ ID NO: 1110675 - RNA, 22 nt, Human
uuccugaugcacacagucauuu

SEQ ID NO: 1110676 - RNA, 22 nt, Human
uuggccuucccuaccugggcca

SEQ ID NO: 1110677 - RNA, 22 nt, Human
aagagcuggauugugcugcaga

SEQ ID NO: 1110678 - RNA, 22 nt, Human
cugagggcccugaagcuuggca

SEQ ID NO: 1110679 - RNA, 22 nt, Human
cucucugggcccaguuggcacc

SEQ ID NO: 1110680 - RNA, 22 nt, Human
uucaaugagcccggggccauag

SEQ ID NO: 1110681 - RNA, 22 nt, Human
ucagcaggcgguuccuuguggg

SEQ ID NO: 1110682 - RNA, 18 nt, Human
uggcagggaggaaauaua

SEQ ID NO: 1110683 - RNA, 21 nt, Human
gggugcuguggucaugcagga

SEQ ID NO: 1110684 - RNA, 22 nt, Human
acuggcucagaguuccuagaga

SEQ ID NO: 1110685 - RNA, 22 nt, Human
ccggggacuuaaagugaaggaa

SEQ ID NO: 1110686 - RNA, 22 nt, Human
cugccucuauucacugaggcag

SEQ ID NO: 1110687 - RNA, 22 nt, Human
cucuuuccaggguaccccaggu

SEQ ID NO: 1110688 - RNA, 22 nt, Human
agcuucuugaccaagccuguaa

SEQ ID NO: 1110689 - RNA, 22 nt, Human
aaaaacuguaauuacuuuugca

SEQ ID NO: 1110690 - RNA, 22 nt, Human
aggcugaggcagguggaucacu

SEQ ID NO: 1110691 - RNA, 22 nt, Human
gcuggagcugcagccugggccu

SEQ ID NO: 1110692 - RNA, 22 nt, Human
ugagaggccccagcucuuggcc

SEQ ID NO: 1110693 - RNA, 22 nt, Human
ugcagggccuucuagaccaugg

SEQ ID NO: 1110694 - RNA, 22 nt, Human
gcauuucugugcauacacauga

SEQ ID NO: 1110695 - RNA, 22 nt, Human
aucugacaaccuauugacuuga

SEQ ID NO: 1110696 - RNA, 22 nt, Human
cuguauuuucaugccuacguac

SEQ ID NO: 1110697 - RNA, 22 nt, Human
gcugagucuugagcacugagca

SEQ ID NO: 1110698 - RNA, 22 nt, Human
acagggucauuuuaugaucugu

SEQ ID NO: 1110699 - RNA, 22 nt, Human
uguagcucuccagccagcaagg

SEQ ID NO: 1110700 - RNA, 22 nt, Human
ccucuggguaucuguggaagua

SEQ ID NO: 1110701 - RNA, 22 nt, Human
ugggaggagcccucugggaagg

SEQ ID NO: 1110702 - RNA, 22 nt, Human
ugggagcucagaaagggagguc

SEQ ID NO: 1110703 - RNA, 22 nt, Human
aaauuuaagaagugugugcgug

SEQ ID NO: 1110704 - RNA, 22 nt, Human
agcucucaagauaagaaagaac

SEQ ID NO: 1110705 - RNA, 22 nt, Human
uuuaucuuuaggacuuugcaga

SEQ ID NO: 1110706 - RNA, 22 nt, Human
ucucagagaaaugugucaccau

SEQ ID NO: 1110707 - RNA, 22 nt, Human
agccucuggcccuagacugcuu

SEQ ID NO: 1110708 - RNA, 22 nt, Human
aggugaaguugaggaggcagaa

SEQ ID NO: 1110709 - RNA, 22 nt, Human
aggacaggauugagcugaacug

SEQ ID NO: 1110710 - RNA, 20 nt, Human
cugagcgucuaagaggugag

SEQ ID NO: 1110711 - RNA, 22 nt, Human
cagagcagcagagcuuccaugg

SEQ ID NO: 1110712 - RNA, 22 nt, Human
uucaagauggcugcaaauacuu

SEQ ID NO: 1110713 - RNA, 22 nt, Human
cuggagccugcaguuuucacuu

SEQ ID NO: 1110714 - RNA, 22 nt, Human
gucccagaggcuuuggccacag

SEQ ID NO: 1110715 - RNA, 22 nt, Human
uccagugguacauggagacacu

SEQ ID NO: 1110716 - RNA, 22 nt, Human
caggcagcauuuacucugauga

SEQ ID NO: 1110717 - RNA, 22 nt, Human
uagauuucaggcuggcuugcgg

SEQ ID NO: 1110718 - RNA, 22 nt, Human
agugauggugagugagaagcuc

SEQ ID NO: 1110719 - RNA, 22 nt, Human
cuccugggcucaagugauccuc

SEQ ID NO: 1110720 - RNA, 22 nt, Human
agagugggugaucucuguuguc

SEQ ID NO: 1110721 - RNA, 22 nt, Human
gggcccagcgugguuccaucug

SEQ ID NO: 1110722 - RNA, 22 nt, Human
ggagccaguuuagaccucaguu

SEQ ID NO: 1110723 - RNA, 18 nt, Human
ugagagugugugcucuug

SEQ ID NO: 1110724 - RNA, 22 nt, Human
agcuccugcacccagccuugag

SEQ ID NO: 1110725 - RNA, 22 nt, Human
ugggccuggguuccuccugggc

SEQ ID NO: 1110726 - RNA, 22 nt, Human
ggagcuggucagccuugagcau

SEQ ID NO: 1110727 - RNA, 22 nt, Human
uuugcauuguuucaaaagugaa

SEQ ID NO: 1110728 - RNA, 22 nt, Human
augugucaauuuucaaaugcuu

SEQ ID NO: 1110729 - RNA, 23 nt, Human
ucuuuacauacugaugaguucuc

SEQ ID NO: 1110730 - RNA, 22 nt, Human
ucucagagauuuuguuucccuu

SEQ ID NO: 1110731 - RNA, 22 nt, Human
gccucugcaggugcgguuaucc

SEQ ID NO: 1110732 - RNA, 22 nt, Human
agagauucauguuuacuguagg

SEQ ID NO: 1110733 - RNA, 22 nt, Human
cagacagaccugcaagggcaca

SEQ ID NO: 1110734 - RNA, 22 nt, Human
gagucccaugaugauagccaca

SEQ ID NO: 1110735 - RNA, 22 nt, Human
uagaaacauauaggauggcagg

SEQ ID NO: 1110736 - RNA, 18 nt, Human
gggaagaggaucuggccc

SEQ ID NO: 1110737 - RNA, 22 nt, Human
ccagagcuccagggcuacagaa

SEQ ID NO: 1110738 - RNA, 22 nt, Human
gccagcagguugucaaggagcu

SEQ ID NO: 1110739 - RNA, 22 nt, Human
ccuccagguguuacauaugacu

SEQ ID NO: 1110740 - RNA, 21 nt, Human
agcagagugcuuugacuuugu

SEQ ID NO: 1110741 - RNA, 22 nt, Human
uggccugaggcucggcaugggu

SEQ ID NO: 1110742 - RNA, 22 nt, Human
ucuuagaaaugaaguucuuucu

SEQ ID NO: 1110743 - RNA, 22 nt, Human
ccuggcugcuuucacuauggag

SEQ ID NO: 1110744 - RNA, 19 nt, Human
cucuggagcagacacugga

SEQ ID NO: 1110745 - RNA, 21 nt, Human
ugagagccuccaaccggcuac

SEQ ID NO: 1110746 - RNA, 23 nt, Human
aguuuguaaagaaauauuugcac

SEQ ID NO: 1110747 - RNA, 22 nt, Human
aaaaaugcuuggacuuaauaaa

SEQ ID NO: 1110748 - RNA, 21 nt, Human
auccuugaucagaagagugcu

SEQ ID NO: 1110749 - RNA, 22 nt, Human
aggagucacucagggcuucauc

SEQ ID NO: 1110750 - RNA, 22 nt, Human
cucagagcccaggguacacccg

SEQ ID NO: 1110751 - RNA, 22 nt, Human
cacugcuuuuuuggcuauguac

SEQ ID NO: 1110752 - RNA, 22 nt, Human
cgcagaagagguugucuagucc

SEQ ID NO: 1110753 - RNA, 18 nt, Human
uccauuguucuacuguga

SEQ ID NO: 1110754 - RNA, 22 nt, Human
gcacagggcccugugcguaggu

SEQ ID NO: 1110755 - RNA, 22 nt, Human
gugucauuaaccaccaugcaaa

SEQ ID NO: 1110756 - RNA, 22 nt, Human
gaggccagcgcgcagcacuuuu

SEQ ID NO: 1110757 - RNA, 22 nt, Human
agucucugagguucagaugccu

SEQ ID NO: 1110758 - RNA, 22 nt, Human
gaggucagucagaccaggguuu

SEQ ID NO: 1110759 - RNA, 22 nt, Human
uggaggcaccacuggcugcccg

SEQ ID NO: 1110760 - RNA, 22 nt, Human
ucaagagacaggacguguuuca

SEQ ID NO: 1110761 - RNA, 22 nt, Human
agaaacuucagcuauucuuuug

SEQ ID NO: 1110762 - RNA, 22 nt, Human
caggagacaaguuagcagcuga

SEQ ID NO: 1110763 - RNA, 22 nt, Human
cugccacuuucacccagugcuc

SEQ ID NO: 1110764 - RNA, 22 nt, Human
uggccacagccucugccaguuc

SEQ ID NO: 1110765 - RNA, 22 nt, Human
ccugugugcugaugacgacaga

SEQ ID NO: 1110766 - RNA, 22 nt, Human
uccucagggcggccuccgucuu

SEQ ID NO: 1110767 - RNA, 22 nt, Human
aagguacaccaaaguucaaguu

SEQ ID NO: 1110768 - RNA, 22 nt, Human
ucuggcaggcaaucggcucugg

SEQ ID NO: 1110769 - RNA, 18 nt, Human
gggcauggaugcagcauc

SEQ ID NO: 1110770 - RNA, 17 nt, Human
gccaaaggguuccaauc

SEQ ID NO: 1110771 - RNA, 22 nt, Human
aaguucuacuguggguaaaaug

SEQ ID NO: 1110772 - RNA, 22 nt, Human
uggcugggggugcuauagcugc

SEQ ID NO: 1110773 - RNA, 22 nt, Human
cuggcagcgugagcagcaucca

SEQ ID NO: 1110774 - RNA, 22 nt, Human
ccuggccucagacagagggugg

SEQ ID NO: 1110775 - RNA, 20 nt, Human
uggagcugugguaaggagca

SEQ ID NO: 1110776 - RNA, 22 nt, Human
uguauuuucuucuggaagcuua

SEQ ID NO: 1110777 - RNA, 22 nt, Human
gcacugaaugccaaaguguagg

SEQ ID NO: 1110778 - RNA, 22 nt, Human
uuuucauuguaaaucaggaaac

SEQ ID NO: 1110779 - RNA, 19 nt, Human
gcagcugugggaagagcca

SEQ ID NO: 1110780 - RNA, 22 nt, Human
aggugcagcugacaccaugugg

SEQ ID NO: 1110781 - RNA, 22 nt, Human
uuggcuuccaggaucucagcag

SEQ ID NO: 1110782 - RNA, 22 nt, Human
ccccuuccgucucuugaguguc

SEQ ID NO: 1110783 - RNA, 22 nt, Human
aggagcugagggagcgcccuug

SEQ ID NO: 1110784 - RNA, 22 nt, Human
gcuguccagagcaugggagcaa

SEQ ID NO: 1110785 - RNA, 22 nt, Human
aaaaaugcugugguagcugugu

SEQ ID NO: 1110786 - RNA, 22 nt, Human
uggcaggguuggccaccuuacc

SEQ ID NO: 1110787 - RNA, 22 nt, Human
ccuggccucuccgaguaaccug

SEQ ID NO: 1110788 - RNA, 22 nt, Human
guggcccucugauagggucagg

SEQ ID NO: 1110789 - RNA, 22 nt, Human
cccccuggcaggcuggccucuc

SEQ ID NO: 1110790 - RNA, 22 nt, Human
auaaggcagaaauagggaaagu

SEQ ID NO: 1110791 - RNA, 22 nt, Human
ccucccuggccagagcagcagc

SEQ ID NO: 1110792 - RNA, 22 nt, Human
aagcagaaguugaucuaccaua

SEQ ID NO: 1110793 - RNA, 22 nt, Human
acccugccgugggcugcuugug

SEQ ID NO: 1110794 - RNA, 22 nt, Human
gggacagacccaugggccaggu

SEQ ID NO: 1110795 - RNA, 22 nt, Human
ugcagcugauuaaagggcagac

SEQ ID NO: 1110796 - RNA, 17 nt, Human
ccucacagggaccagac

SEQ ID NO: 1110797 - RNA, 22 nt, Human
ugaaaaggaguccuuguuuuca

SEQ ID NO: 1110798 - RNA, 22 nt, Human
cagcugccacaccucuuucucu

SEQ ID NO: 1110799 - RNA, 22 nt, Human
agccuggagaagauguguauug

SEQ ID NO: 1110800 - RNA, 22 nt, Human
gcagccccaggagacgcccagg

SEQ ID NO: 1110801 - RNA, 18 nt, Human
ccagcaugccagaggcug

SEQ ID NO: 1110802 - RNA, 22 nt, Human
gccuggagacaaggacaaaggg

SEQ ID NO: 1110803 - RNA, 22 nt, Human
augaagucugcacaugcaugug

SEQ ID NO: 1110804 - RNA, 22 nt, Human
ugcagccaauucauucauucuu

SEQ ID NO: 1110805 - RNA, 22 nt, Human
caggucagaggcgcagccccca

SEQ ID NO: 1110806 - RNA, 21 nt, Human
gcagacugcccugcugucccc

SEQ ID NO: 1110807 - RNA, 22 nt, Human
ggcagcuccaaaaggaaacacu

SEQ ID NO: 1110808 - RNA, 22 nt, Human
ggccuggaaugcuuuccuacca

SEQ ID NO: 1110809 - RNA, 22 nt, Human
uucagagccacuucaagucuaa

SEQ ID NO: 1110810 - RNA, 22 nt, Human
cagagccaggucuaggagucuc

SEQ ID NO: 1110811 - RNA, 22 nt, Human
uggcucagcaagacauugaccu

SEQ ID NO: 1110812 - RNA, 22 nt, Human
uuugcagcaaggagagagcauu

SEQ ID NO: 1110813 - RNA, 22 nt, Human
gccagcagggcccaaaugcugg

SEQ ID NO: 1110814 - RNA, 22 nt, Human
cacaggcucuucucacuugauu

SEQ ID NO: 1110815 - RNA, 22 nt, Human
gcugccugauguccagcaggac

SEQ ID NO: 1110816 - RNA, 22 nt, Human
ccagggccaagagaccucgagg

SEQ ID NO: 1110817 - RNA, 22 nt, Human
acugccuuauaugcugugugug

SEQ ID NO: 1110818 - RNA, 22 nt, Human
cuccucacuuuccagacugggc

SEQ ID NO: 1110819 - RNA, 22 nt, Human
aaugcacauguuguaauaaaua

SEQ ID NO: 1110820 - RNA, 22 nt, Human
aagucacagcuaaauagcuaag

SEQ ID NO: 1110821 - RNA, 22 nt, Human
cuccugggaauuuaguugugag

SEQ ID NO: 1110822 - RNA, 23 nt, Human
ggguccagagacaggcaugggug

SEQ ID NO: 1110823 - RNA, 22 nt, Human
cccagcagaaucugaugagggc

SEQ ID NO: 1110824 - RNA, 23 nt, Human
cugaggccugcugcguucagguu

SEQ ID NO: 1110825 - RNA, 22 nt, Human
cagggagcuggcuggcgugagu

SEQ ID NO: 1110826 - RNA, 21 nt, Human
agcagccauuucacagagacu

SEQ ID NO: 1110827 - RNA, 19 nt, Human
uggcucugucgaaggcaca

SEQ ID NO: 1110828 - RNA, 22 nt, Human
ugggcuggagcuuguugcuucc

SEQ ID NO: 1110829 - RNA, 22 nt, Human
cacuggcaugugaggcgguggc

SEQ ID NO: 1110830 - RNA, 22 nt, Human
gcucaggacccaggugugaccu

SEQ ID NO: 1110831 - RNA, 22 nt, Human
gggcuggcaucgguugcugaga

SEQ ID NO: 1110832 - RNA, 22 nt, Human
ccaaaguccauaguuuacauua

SEQ ID NO: 1110833 - RNA, 22 nt, Human
ugaagccaucaggaagccagca

SEQ ID NO: 1110834 - RNA, 22 nt, Human
ggccucaguuucuccauggguu

SEQ ID NO: 1110835 - RNA, 22 nt, Human
gggcucugcgcucagcuccagc

SEQ ID NO: 1110836 - RNA, 22 nt, Human
uggcagagucucuccuuuccag

SEQ ID NO: 1110837 - RNA, 22 nt, Human
ccagguggugaaagugggcccu

SEQ ID NO: 1110838 - RNA, 22 nt, Human
ggcagcuccucucagcaaaaga

SEQ ID NO: 1110839 - RNA, 22 nt, Human
uggcugggugcuauccaguacu

SEQ ID NO: 1110840 - RNA, 22 nt, Human
agaggcugagaaacccucuucu

SEQ ID NO: 1110841 - RNA, 22 nt, Human
uggcucagagagggagugugga

SEQ ID NO: 1110842 - RNA, 22 nt, Human
aggggccucgcaggaccgcucc

SEQ ID NO: 1110843 - RNA, 18 nt, Human
ugcucuguuuaaugauuu

SEQ ID NO: 1110844 - RNA, 22 nt, Human
caggaaugacugcagauggggc

SEQ ID NO: 1110845 - RNA, 22 nt, Human
aagauuuacuagcauaauagcu

SEQ ID NO: 1110846 - RNA, 22 nt, Human
gaacaauagugguaacaaagcc

SEQ ID NO: 1110847 - RNA, 22 nt, Human
cagcaagauuuuuaaagcaagg

SEQ ID NO: 1110848 - RNA, 22 nt, Human
aggccucuucagggagcaugga

SEQ ID NO: 1110849 - RNA, 22 nt, Human
ugaaaucuuagccauucugccu

SEQ ID NO: 1110850 - RNA, 22 nt, Human
cugcccugucugcagccuggcu

SEQ ID NO: 1110851 - RNA, 22 nt, Human
ggcuucuguccucuggaucugu

SEQ ID NO: 1110852 - RNA, 22 nt, Human
agccuggccacucagggccuga

SEQ ID NO: 1110853 - RNA, 22 nt, Human
caggugcugcguggcggagcug

SEQ ID NO: 1110854 - RNA, 22 nt, Human
ccagggucucugcugccugaga

SEQ ID NO: 1110855 - RNA, 22 nt, Human
agcucccugagaugccacagca

SEQ ID NO: 1110856 - RNA, 22 nt, Human
gcauaauauacaugcuugaucc

SEQ ID NO: 1110857 - RNA, 22 nt, Human
uccugccucaggcucuggagua

SEQ ID NO: 1110858 - RNA, 22 nt, Human
auucuucauguugaagcuguca

SEQ ID NO: 1110859 - RNA, 22 nt, Human
cauucacucagcgaugccagua

SEQ ID NO: 1110860 - RNA, 22 nt, Human
ucccagaggucucugcugguuc

SEQ ID NO: 1110861 - RNA, 19 nt, Human
ugaagcaauaccauuuuug

SEQ ID NO: 1110862 - RNA, 18 nt, Human
ccugcagcccaggaggcc

SEQ ID NO: 1110863 - RNA, 22 nt, Human
uauaaaguuucgaaagauguau

SEQ ID NO: 1110864 - RNA, 22 nt, Human
ccacacugaaccucagugucuu

SEQ ID NO: 1110865 - RNA, 22 nt, Human
agaaaagggcaggagggauaca

SEQ ID NO: 1110866 - RNA, 20 nt, Human
uugcauuggaugugcaggug

SEQ ID NO: 1110867 - RNA, 22 nt, Human
uggcuaggcuccaagagcugga

SEQ ID NO: 1110868 - RNA, 21 nt, Human
uggcucaguugcugggcacag

SEQ ID NO: 1110869 - RNA, 22 nt, Human
uuugcauuacuugacuuuaguu

SEQ ID NO: 1110870 - RNA, 21 nt, Human
ccagccucagaucagggagcu

SEQ ID NO: 1110871 - RNA, 22 nt, Human
uccugggcugugugccacucug

SEQ ID NO: 1110872 - RNA, 22 nt, Human
agcugucugucuccugaggaga

SEQ ID NO: 1110873 - RNA, 22 nt, Human
uguguacuugaaagggcagguc

SEQ ID NO: 1110874 - RNA, 18 nt, Human
uggagccauugccaccau

SEQ ID NO: 1110875 - RNA, 22 nt, Human
ccagccuggagggcaguggugg

SEQ ID NO: 1110876 - RNA, 22 nt, Human
gcagugcuaaguagcuggccca

SEQ ID NO: 1110877 - RNA, 22 nt, Human
caggaggcccaaagggcgcaga

SEQ ID NO: 1110878 - RNA, 22 nt, Human
acuuugcaauacuuaauacaaa

SEQ ID NO: 1110879 - RNA, 22 nt, Human
gugcugcucacaucuggaggua

SEQ ID NO: 1110880 - RNA, 22 nt, Human
ggguggaguagaaagaugaauu

SEQ ID NO: 1110881 - RNA, 22 nt, Human
gccugccugcugucaucugccu

SEQ ID NO: 1110882 - RNA, 22 nt, Human
gcucccugacucaguuccugag

SEQ ID NO: 1110883 - RNA, 22 nt, Human
uuaggaaauuaugguuucagau

SEQ ID NO: 1110884 - RNA, 22 nt, Human
ucuucagagacucugagccccu

SEQ ID NO: 1110885 - RNA, 22 nt, Human
acagcagcgucaacuuaaaauu

SEQ ID NO: 1110886 - RNA, 20 nt, Human
aucagcaacugccacucagu

SEQ ID NO: 1110887 - RNA, 20 nt, Human
aggaacuggaagggaggaaa

SEQ ID NO: 1110888 - RNA, 22 nt, Human
uggcuggggccacaguuuuccu

SEQ ID NO: 1110889 - RNA, 22 nt, Human
ggccucuguucugcauuccucc

SEQ ID NO: 1110890 - RNA, 22 nt, Human
ccagcuccccucagcagguaau

SEQ ID NO: 1110891 - RNA, 22 nt, Human
ugauuuccaaaaggcuucuaag

SEQ ID NO: 1110892 - RNA, 20 nt, Human
aaggcacuaugucugcuagc

SEQ ID NO: 1110893 - RNA, 22 nt, Human
ucccagagacagagccuccucc

SEQ ID NO: 1110894 - RNA, 22 nt, Human
ucagcagucacauguuguccca

SEQ ID NO: 1110895 - RNA, 22 nt, Human
agugugaccuuauuuggaaaca

SEQ ID NO: 1110896 - RNA, 22 nt, Human
uggcagggaauacagauguuua

SEQ ID NO: 1110897 - RNA, 22 nt, Human
ggugauuuucgaguuucauguu

SEQ ID NO: 1110898 - RNA, 22 nt, Human
gggacuggaguagaggccggug

SEQ ID NO: 1110899 - RNA, 20 nt, Human
acugccuugguucaguaggu

SEQ ID NO: 1110900 - RNA, 22 nt, Human
ucucagaguuuuuuuccaggac

SEQ ID NO: 1110901 - RNA, 22 nt, Human
gugcccaggcccaaggcaccac

SEQ ID NO: 1110902 - RNA, 22 nt, Human
ugugugacccccagugaagccu

SEQ ID NO: 1110903 - RNA, 22 nt, Human
augagcugugggauuccagagg

SEQ ID NO: 1110904 - RNA, 23 nt, Human
gggaccagcuagggcugugaccu

SEQ ID NO: 1110905 - RNA, 22 nt, Human
aggagcugcagauucugccuug

SEQ ID NO: 1110906 - RNA, 22 nt, Human
accuggagucauuugaggagua

SEQ ID NO: 1110907 - RNA, 22 nt, Human
gcagagccaggagagacccuug

SEQ ID NO: 1110908 - RNA, 22 nt, Human
ggccucucucccuggcuugcag

SEQ ID NO: 1110909 - RNA, 22 nt, Human
agccaucauuucugucacuggc

SEQ ID NO: 1110910 - RNA, 22 nt, Human
acauuugagaugccuuuuaggu

SEQ ID NO: 1110911 - RNA, 22 nt, Human
caaggagaguaauugaaugaga

SEQ ID NO: 1110912 - RNA, 22 nt, Human
agccacagcauguguguaugua

SEQ ID NO: 1110913 - RNA, 22 nt, Human
accucuggccuucaggcaucau

SEQ ID NO: 1110914 - RNA, 23 nt, Human
agcacagacuagaaaggucuuuc

SEQ ID NO: 1110915 - RNA, 22 nt, Human
ucaggggacuuaggagagaagu

SEQ ID NO: 1110916 - RNA, 17 nt, Human
aagacagaagccaugag

SEQ ID NO: 1110917 - RNA, 22 nt, Human
ggucauugaaaucagaaggguu

SEQ ID NO: 1110918 - RNA, 22 nt, Human
cagcagcuggugagacacagcc

SEQ ID NO: 1110919 - RNA, 22 nt, Human
cuuccugcaggacagccaucug

SEQ ID NO: 1110920 - RNA, 22 nt, Human
uccaggcugggcugaagggugc

SEQ ID NO: 1110921 - RNA, 22 nt, Human
ccagcugcugugaggaccacag

SEQ ID NO: 1110922 - RNA, 22 nt, Human
ccagggcaauuauuuggagggu

SEQ ID NO: 1110923 - RNA, 22 nt, Human
cagaggcagaggucaucucugg

SEQ ID NO: 1110924 - RNA, 22 nt, Human
ggcugcaguuugucuuuugcuu

SEQ ID NO: 1110925 - RNA, 22 nt, Human
gcagccacagaggagggaugca

SEQ ID NO: 1110926 - RNA, 22 nt, Human
agacagaacagaauaauuguug

SEQ ID NO: 1110927 - RNA, 22 nt, Human
agaaaugcucuuccugaccaga

SEQ ID NO: 1110928 - RNA, 22 nt, Human
uggagcccagacacuggcauug

SEQ ID NO: 1110929 - RNA, 22 nt, Human
gcugcccucccagggcaagcuu

SEQ ID NO: 1110930 - RNA, 19 nt, Human
aucagcaagguaggaugug

SEQ ID NO: 1110931 - RNA, 22 nt, Human
ccugggaggcggagguugcagu

SEQ ID NO: 1110932 - RNA, 22 nt, Human
gaggcccuccagcugucagcug

SEQ ID NO: 1110933 - RNA, 21 nt, Human
uuuauguacuucauagaguag

SEQ ID NO: 1110934 - RNA, 22 nt, Human
agccacagagguugaugugguu

SEQ ID NO: 1110935 - RNA, 22 nt, Human
cuggucugagggcucuugaggc

SEQ ID NO: 1110936 - RNA, 22 nt, Human
agccuggaggaggaguugagca

SEQ ID NO: 1110937 - RNA, 20 nt, Human
ucucccaggcucagggaaga

SEQ ID NO: 1110938 - RNA, 22 nt, Human
cagccagaaccuaggaugagcu

SEQ ID NO: 1110939 - RNA, 22 nt, Human
ugccaaggguaugggcaagaua

SEQ ID NO: 1110940 - RNA, 22 nt, Human
aaauacagaguugcuuaaaagc

SEQ ID NO: 1110941 - RNA, 22 nt, Human
caggagccccaggcugacaaua

SEQ ID NO: 1110942 - RNA, 22 nt, Human
aucaguuuggugcuuucaguga

SEQ ID NO: 1110943 - RNA, 22 nt, Human
gagcagugaagacagaaguaca

SEQ ID NO: 1110944 - RNA, 22 nt, Human
acaaaugcagcauaaagugaac

SEQ ID NO: 1110945 - RNA, 17 nt, Human
gugcagggaugaaggau

SEQ ID NO: 1110946 - RNA, 22 nt, Human
gcugugcuggaaggggaccugc

SEQ ID NO: 1110947 - RNA, 23 nt, Human
cccuggagcuagucugagcagag

SEQ ID NO: 1110948 - RNA, 20 nt, Human
uacuugaauguugcagcagu

SEQ ID NO: 1110949 - RNA, 22 nt, Human
ccugccugucaucgccugcgcc

SEQ ID NO: 1110950 - RNA, 22 nt, Human
aacagcaugcuggguaacauug

SEQ ID NO: 1110951 - RNA, 22 nt, Human
cagggagggacaauugucaccu

SEQ ID NO: 1110952 - RNA, 22 nt, Human
ccagcuggucugugcucauguu

SEQ ID NO: 1110953 - RNA, 22 nt, Human
ccagagucuuuauauuccugaa

SEQ ID NO: 1110954 - RNA, 22 nt, Human
ucucuggaguauaaccagggau

SEQ ID NO: 1110955 - RNA, 22 nt, Human
cucaggguaaugaaagacgaau

SEQ ID NO: 1110956 - RNA, 22 nt, Human
cucugaagggagggccaagccc

SEQ ID NO: 1110957 - RNA, 22 nt, Human
gcaaggcugugcacuuugcauu

SEQ ID NO: 1110958 - RNA, 22 nt, Human
gcauuucuuccuggugugagcc

SEQ ID NO: 1110959 - RNA, 22 nt, Human
aaggucauuuuuuccucuguug

SEQ ID NO: 1110960 - RNA, 22 nt, Human
cuggcucaggaaaguugcugcu

SEQ ID NO: 1110961 - RNA, 22 nt, Human
gagagggccgggggccagcucc

SEQ ID NO: 1110962 - RNA, 22 nt, Human
aggaccagaggccagagucagc

SEQ ID NO: 1110963 - RNA, 22 nt, Human
cugccucugguuuuggucccug

SEQ ID NO: 1110964 - RNA, 22 nt, Human
uccucaggagagcuccuaugcc

SEQ ID NO: 1110965 - RNA, 23 nt, Human
ucccagccucuucucuugcauac

SEQ ID NO: 1110966 - RNA, 22 nt, Human
uauguacacauacacuuguaau

SEQ ID NO: 1110967 - RNA, 22 nt, Human
accugaggcuguuagucuaggu

SEQ ID NO: 1110968 - RNA, 22 nt, Human
gcugaagagagaugcguccagc

SEQ ID NO: 1110969 - RNA, 22 nt, Human
gcagggacaccuuugugaagcu

SEQ ID NO: 1110970 - RNA, 22 nt, Human
ucuugccucuuccccuuuccau

SEQ ID NO: 1110971 - RNA, 22 nt, Human
aggcagugcagaguccucuucu

SEQ ID NO: 1110972 - RNA, 22 nt, Human
ucagaacauugacauucuuauu

SEQ ID NO: 1110973 - RNA, 22 nt, Human
uacauagcaaggaaaugacaga

SEQ ID NO: 1110974 - RNA, 22 nt, Human
gaagccaguacugugcucugca

SEQ ID NO: 1110975 - RNA, 22 nt, Human
aaaauaucagcaaagggugaca

SEQ ID NO: 1110976 - RNA, 22 nt, Human
acuguacuguguauuguagaau

SEQ ID NO: 1110977 - RNA, 22 nt, Human
cucuuaguuuaucuuugacaaa

SEQ ID NO: 1110978 - RNA, 22 nt, Human
cuccagaagacccauccucaug

SEQ ID NO: 1110979 - RNA, 22 nt, Human
gucuugaucuccugaccuugug

SEQ ID NO: 1110980 - RNA, 22 nt, Human
ggaugcugacuuuggagcaugg

SEQ ID NO: 1110981 - RNA, 22 nt, Human
ggccugcacagagguggcucua

SEQ ID NO: 1110982 - RNA, 22 nt, Human
agaagccaacagggcaggagag

SEQ ID NO: 1110983 - RNA, 22 nt, Human
agcugagagguggcaagcugua

SEQ ID NO: 1110984 - RNA, 22 nt, Human
gaggggcuggcacgauggcugc

SEQ ID NO: 1110985 - RNA, 22 nt, Human
cugugcuucgcaacuccaaggu

SEQ ID NO: 1110986 - RNA, 22 nt, Human
accucugccaagaugugcuccc

SEQ ID NO: 1110987 - RNA, 22 nt, Human
agagcuuagaauuucagaugau

SEQ ID NO: 1110988 - RNA, 22 nt, Human
cagccuguagaauacaguaaau

SEQ ID NO: 1110989 - RNA, 22 nt, Human
ugggcagacuaaggucaaagcu

SEQ ID NO: 1110990 - RNA, 22 nt, Human
ugaaggaaaugacggcagaaga

SEQ ID NO: 1110991 - RNA, 22 nt, Human
aggccuggugaaugaaguaucu

SEQ ID NO: 1110992 - RNA, 22 nt, Human
aacuagaaaacaagaugcugau

SEQ ID NO: 1110993 - RNA, 22 nt, Human
ccugagaggcccucucacuguc

SEQ ID NO: 1110994 - RNA, 22 nt, Human
uuugucagucaugucugcuuuu

SEQ ID NO: 1110995 - RNA, 22 nt, Human
cauuaucucuucuauaugcuag

SEQ ID NO: 1110996 - RNA, 19 nt, Human
aggucauugauagugcagg

SEQ ID NO: 1110997 - RNA, 22 nt, Human
uuugugaaaugaagucacaacu

SEQ ID NO: 1110998 - RNA, 22 nt, Human
aacagcuuugcuucuggagaca

SEQ ID NO: 1110999 - RNA, 21 nt, Human
ucuccaguauccuucucugag

SEQ ID NO: 1111000 - RNA, 22 nt, Human
cacagggcuaaaugaaggguug

SEQ ID NO: 1111001 - RNA, 22 nt, Human
ugccagcacuucuggcugucug

SEQ ID NO: 1111002 - RNA, 22 nt, Human
cugcugggucuaugcaagugga

SEQ ID NO: 1111003 - RNA, 22 nt, Human
cccagcccagcguucgaggggu

SEQ ID NO: 1111004 - RNA, 22 nt, Human
uuucaagcauaacugggaagag

SEQ ID NO: 1111005 - RNA, 22 nt, Human
agcuuccuuggcgcugaggccu

SEQ ID NO: 1111006 - RNA, 17 nt, Human
gucugggcuuuagagac

SEQ ID NO: 1111007 - RNA, 22 nt, Human
cacaggagagcugggaggugcc

SEQ ID NO: 1111008 - RNA, 22 nt, Human
agggucccgaaggagacagcaa

SEQ ID NO: 1111009 - RNA, 22 nt, Human
cuggggugucucgucugccauu

SEQ ID NO: 1111010 - RNA, 20 nt, Human
aguagcagugugacauugac

SEQ ID NO: 1111011 - RNA, 20 nt, Human
aggcacuggauuucuuauau

SEQ ID NO: 1111012 - RNA, 22 nt, Human
caaauaucuuuggcaaagagaa

SEQ ID NO: 1111013 - RNA, 22 nt, Human
gggcagagagcuggaacuccuu

SEQ ID NO: 1111014 - RNA, 21 nt, Human
ccuggcuucagggugcacugg

SEQ ID NO: 1111015 - RNA, 22 nt, Human
aaugaacaaaauaugcuuugca

SEQ ID NO: 1111016 - RNA, 22 nt, Human
gacauucacagguaaacauucc

SEQ ID NO: 1111017 - RNA, 22 nt, Human
uucagcagucguccaggaaaag

SEQ ID NO: 1111018 - RNA, 22 nt, Human
acucugccccgaguucugggaa

SEQ ID NO: 1111019 - RNA, 22 nt, Human
agagccaggugcugcuguuuga

SEQ ID NO: 1111020 - RNA, 23 nt, Human
gagcugggauacaggcuuacugc

SEQ ID NO: 1111021 - RNA, 22 nt, Human
gggucccaggaaggagcagugu

SEQ ID NO: 1111022 - RNA, 22 nt, Human
aggcacugugcugaugucuuau

SEQ ID NO: 1111023 - RNA, 19 nt, Human
gcuggggccugaccagaca

SEQ ID NO: 1111024 - RNA, 21 nt, Human
aaaguucaugcuuuaauauuc

SEQ ID NO: 1111025 - RNA, 22 nt, Human
acaggcugacuuccugccaugu

SEQ ID NO: 1111026 - RNA, 22 nt, Human
uuauuuauuguguaccuacugu

SEQ ID NO: 1111027 - RNA, 22 nt, Human
ugucaugccaccguuucccaga

SEQ ID NO: 1111028 - RNA, 22 nt, Human
uuaagaauggaaugaggaauuu

SEQ ID NO: 1111029 - RNA, 22 nt, Human
cucagcagcagggaagagguca

SEQ ID NO: 1111030 - RNA, 22 nt, Human
uucuggaguauuccuggcaccu

SEQ ID NO: 1111031 - RNA, 22 nt, Human
gaggcucugugaugugccaggc

SEQ ID NO: 1111032 - RNA, 20 nt, Human
acugcuucuuucucugaccu

SEQ ID NO: 1111033 - RNA, 17 nt, Human
uccuucagggccucaca

SEQ ID NO: 1111034 - RNA, 22 nt, Human
caagcagagacuagauagcugu

SEQ ID NO: 1111035 - RNA, 22 nt, Human
acagugucuccugguacccagu

SEQ ID NO: 1111036 - RNA, 22 nt, Human
ugcagccaccaccucugcugaa

SEQ ID NO: 1111037 - RNA, 22 nt, Human
ugaggaugacgauggcaauggc

SEQ ID NO: 1111038 - RNA, 23 nt, Human
aacaccaaggcucagagagauaa

SEQ ID NO: 1111039 - RNA, 22 nt, Human
cuggcuucugggccagggcaga

SEQ ID NO: 1111040 - RNA, 22 nt, Human
agcaccaucagaugcaauaucu

SEQ ID NO: 1111041 - RNA, 22 nt, Human
cucugggcaccaaagagcagcu

SEQ ID NO: 1111042 - RNA, 22 nt, Human
uuguuacacauaauaacauuuu

SEQ ID NO: 1111043 - RNA, 22 nt, Human
ggcagcucugugucugggaagc

SEQ ID NO: 1111044 - RNA, 22 nt, Human
acauuucugcauguaggguaau

SEQ ID NO: 1111045 - RNA, 22 nt, Human
gaggaggcuggcgccgccugcc

SEQ ID NO: 1111046 - RNA, 20 nt, Human
gaggcugcggacugcuggac

SEQ ID NO: 1111047 - RNA, 22 nt, Human
ccuggcuguggcggugcucuca

SEQ ID NO: 1111048 - RNA, 22 nt, Human
uggcacuggcgcaggauggcgg

SEQ ID NO: 1111049 - RNA, 22 nt, Human
cauuucugauuacagaauacua

SEQ ID NO: 1111050 - RNA, 22 nt, Human
guguccagggccguguugucuu

SEQ ID NO: 1111051 - RNA, 22 nt, Human
ugccugucuuuccucccucgua

SEQ ID NO: 1111052 - RNA, 22 nt, Human
ccugagagcagcuuccugcuua

SEQ ID NO: 1111053 - RNA, 22 nt, Human
ucugucacaauuugcuuacucu

SEQ ID NO: 1111054 - RNA, 20 nt, Human
gacauucauaguuauuacca

SEQ ID NO: 1111055 - RNA, 22 nt, Human
cucacagaugcugugggucagg

SEQ ID NO: 1111056 - RNA, 23 nt, Human
uccagggauuaaugaagucaguc

SEQ ID NO: 1111057 - RNA, 22 nt, Human
ggcagugguuagaaacaugagc

SEQ ID NO: 1111058 - RNA, 22 nt, Human
ugggcucucuggcaggaaggcu

SEQ ID NO: 1111059 - RNA, 22 nt, Human
gaagccaagugcaaaugccuua

SEQ ID NO: 1111060 - RNA, 22 nt, Human
aggcagaggaaggguggauuug

SEQ ID NO: 1111061 - RNA, 22 nt, Human
gucagcagugucagcucugggg

SEQ ID NO: 1111062 - RNA, 22 nt, Human
gcuggugcauuagcugcaguuc

SEQ ID NO: 1111063 - RNA, 22 nt, Human
uuuuagaaauacugauuuagug

SEQ ID NO: 1111064 - RNA, 22 nt, Human
cucuggaguuagugaucugggc

SEQ ID NO: 1111065 - RNA, 22 nt, Human
ccaggacuucgaggcuacagug

SEQ ID NO: 1111066 - RNA, 22 nt, Human
gucucagagagcuacucucuua

SEQ ID NO: 1111067 - RNA, 23 nt, Human
ucacacagcuggucagguacaga

SEQ ID NO: 1111068 - RNA, 22 nt, Human
ugaaaaggagccuuagguaggu

SEQ ID NO: 1111069 - RNA, 22 nt, Human
gggcucucaugaguguguggua

SEQ ID NO: 1111070 - RNA, 18 nt, Human
ucuggcucaggacugaac

SEQ ID NO: 1111071 - RNA, 20 nt, Human
ucacauccucucccaacaug

SEQ ID NO: 1111072 - RNA, 22 nt, Human
cagacacaccaggcccauucug

SEQ ID NO: 1111073 - RNA, 22 nt, Human
ccugccaggacauugcuugaag

SEQ ID NO: 1111074 - RNA, 19 nt, Human
cagaguccuugaccagucc

SEQ ID NO: 1111075 - RNA, 22 nt, Human
aaggguggauuucugagcucua

SEQ ID NO: 1111076 - RNA, 22 nt, Human
acagguggcauaggcaguuuga

SEQ ID NO: 1111077 - RNA, 17 nt, Human
uugggagagaaagguau

SEQ ID NO: 1111078 - RNA, 22 nt, Human
aggcaugugacccuggacucag

SEQ ID NO: 1111079 - RNA, 22 nt, Human
gggacagcuguagugcuuggcu

SEQ ID NO: 1111080 - RNA, 22 nt, Human
uugauaaaaugauaucuucuuu

SEQ ID NO: 1111081 - RNA, 22 nt, Human
uauugaaaugaaugacagugau

SEQ ID NO: 1111082 - RNA, 22 nt, Human
ccucacuggccagccaggggug

SEQ ID NO: 1111083 - RNA, 22 nt, Human
cagcucugugcaggccugggga

SEQ ID NO: 1111084 - RNA, 22 nt, Human
ccagggcauguccaagacuuag

SEQ ID NO: 1111085 - RNA, 22 nt, Human
aggagucaggaccaaauggaaa

SEQ ID NO: 1111086 - RNA, 22 nt, Human
guauuugauacaugaaauggug

SEQ ID NO: 1111087 - RNA, 22 nt, Human
cuggcagcucuacucagagccu

SEQ ID NO: 1111088 - RNA, 22 nt, Human
acauagcuuaaaugagaagaua

SEQ ID NO: 1111089 - RNA, 20 nt, Human
caccaggcgcucugagaaca

SEQ ID NO: 1111090 - RNA, 22 nt, Human
agcugccaucagccuuuggaug

SEQ ID NO: 1111091 - RNA, 22 nt, Human
ccagggugcucuguggcgucgc

SEQ ID NO: 1111092 - RNA, 22 nt, Human
acagaauuaaugaaaauuacaa

SEQ ID NO: 1111093 - RNA, 22 nt, Human
auaaauuuauaauuguuuccug

SEQ ID NO: 1111094 - RNA, 22 nt, Human
aagcacuuagaagagugccugc

SEQ ID NO: 1111095 - RNA, 22 nt, Human
cuguucucuggcgguggcuguu

SEQ ID NO: 1111096 - RNA, 22 nt, Human
uccuuccuggggucucugcugc

SEQ ID NO: 1111097 - RNA, 22 nt, Human
agccucugauggcucccaagga

SEQ ID NO: 1111098 - RNA, 20 nt, Human
ucagugauuaucucugagug

SEQ ID NO: 1111099 - RNA, 22 nt, Human
ggaggccaggguggguggaucg

SEQ ID NO: 1111100 - RNA, 22 nt, Human
agaugcugcuccacaggccagg

SEQ ID NO: 1111101 - RNA, 22 nt, Human
auguaaggcugccuaugacacu

SEQ ID NO: 1111102 - RNA, 22 nt, Human
ugaaauauuuagagaguaaguu

SEQ ID NO: 1111103 - RNA, 22 nt, Human
ucaggggaaaucucucagcgaa

SEQ ID NO: 1111104 - RNA, 19 nt, Human
uggcagggagugauauuag

SEQ ID NO: 1111105 - RNA, 22 nt, Human
uggugugggcguggcaggcaag

SEQ ID NO: 1111106 - RNA, 18 nt, Human
gcuggcugcacuucugcu

SEQ ID NO: 1111107 - RNA, 22 nt, Human
caaggagauaaaauguugagcu

SEQ ID NO: 1111108 - RNA, 22 nt, Human
ugaugcuucacgcugaauaugc

SEQ ID NO: 1111109 - RNA, 22 nt, Human
agcaggaguguccccuggcugu

SEQ ID NO: 1111110 - RNA, 21 nt, Human
gcugagagguugggaaguuca

SEQ ID NO: 1111111 - RNA, 22 nt, Human
uuucagaugcaauuaauuuuca

SEQ ID NO: 1111112 - RNA, 22 nt, Human
aagugacacauggcacuucuau

SEQ ID NO: 1111113 - RNA, 22 nt, Human
ugucucaguauacgaaacacuu

SEQ ID NO: 1111114 - RNA, 22 nt, Human
uguacaguauauuucaaagcca

SEQ ID NO: 1111115 - RNA, 22 nt, Human
ccuuugggugaauuccucucuu

SEQ ID NO: 1111116 - RNA, 22 nt, Human
gggugaggagcugccagucaug

SEQ ID NO: 1111117 - RNA, 19 nt, Human
ucaaggcucccugagggau

SEQ ID NO: 1111118 - RNA, 19 nt, Human
agacagagcucaguggguu

SEQ ID NO: 1111119 - RNA, 22 nt, Human
uggcacuggaaucguagccuug

SEQ ID NO: 1111120 - RNA, 22 nt, Human
caccagggacaaugcuaggggu

SEQ ID NO: 1111121 - RNA, 22 nt, Human
uggcccuguggaggucagugag

SEQ ID NO: 1111122 - RNA, 22 nt, Human
gccugagauucccggagccgug

SEQ ID NO: 1111123 - RNA, 21 nt, Human
uggcccuggccacggcugcca

SEQ ID NO: 1111124 - RNA, 22 nt, Human
aaggcucucugauggcagcagu

SEQ ID NO: 1111125 - RNA, 22 nt, Human
cugagcugggaguagagacucu

SEQ ID NO: 1111126 - RNA, 22 nt, Human
ucuuguccuaagagcuggauuc

SEQ ID NO: 1111127 - RNA, 22 nt, Human
cagcagaggaaagcaaaucuaa

SEQ ID NO: 1111128 - RNA, 22 nt, Human
agguggggugagcugcagacua

SEQ ID NO: 1111129 - RNA, 22 nt, Human
ucuggccugaaaguccaugcuu

SEQ ID NO: 1111130 - RNA, 23 nt, Human
uccagcagagccuuccaggaggg

SEQ ID NO: 1111131 - RNA, 22 nt, Human
uggcuucaucugcagcacugcc

SEQ ID NO: 1111132 - RNA, 22 nt, Human
acuucucuucauagguggcaau

SEQ ID NO: 1111133 - RNA, 22 nt, Human
ccaaagucuggagcagcagagc

SEQ ID NO: 1111134 - RNA, 22 nt, Human
ucauccaguaccauggaaggca

SEQ ID NO: 1111135 - RNA, 22 nt, Human
cuggccuggcaggggaccucua

SEQ ID NO: 1111136 - RNA, 22 nt, Human
aaggcgacacaggcagcaggcc

SEQ ID NO: 1111137 - RNA, 22 nt, Human
uggcagcauguuauguaaggaa

SEQ ID NO: 1111138 - RNA, 22 nt, Human
gggcuccaacggugagcaugga

SEQ ID NO: 1111139 - RNA, 22 nt, Human
caagagcugcaaauagcgugac

SEQ ID NO: 1111140 - RNA, 22 nt, Human
acagaggccccgugggagagcc

SEQ ID NO: 1111141 - RNA, 22 nt, Human
uuauccaaacuggugaaucauu

SEQ ID NO: 1111142 - RNA, 22 nt, Human
ccaggagucaauaaaggaagcu

SEQ ID NO: 1111143 - RNA, 22 nt, Human
aacagaacccgagugugaaucu

SEQ ID NO: 1111144 - RNA, 22 nt, Human
cuggcccauggugagcucuggg

SEQ ID NO: 1111145 - RNA, 22 nt, Human
ucaaguguaguggugucagguc

SEQ ID NO: 1111146 - RNA, 22 nt, Human
aaugcacauaaauauggucuua

SEQ ID NO: 1111147 - RNA, 22 nt, Human
cugaggugagcuucccugggcu

SEQ ID NO: 1111148 - RNA, 22 nt, Human
uucuucaaaauccagcaugauu

SEQ ID NO: 1111149 - RNA, 22 nt, Human
gcuguauuuaacaacuggcuca

SEQ ID NO: 1111150 - RNA, 20 nt, Human
uucuggaggcuacaagucug

SEQ ID NO: 1111151 - RNA, 22 nt, Human
uugugugguagcuucauugaac

SEQ ID NO: 1111152 - RNA, 22 nt, Human
uuuaaucaggcaaagcauaaua

SEQ ID NO: 1111153 - RNA, 23 nt, Human
agacccagagacuggcucugcuc

SEQ ID NO: 1111154 - RNA, 22 nt, Human
agggcugagacuaaggccagau

SEQ ID NO: 1111155 - RNA, 22 nt, Human
cucucugaggaaggagcaucug

SEQ ID NO: 1111156 - RNA, 22 nt, Human
caaaguuaugaaugauaagauu

SEQ ID NO: 1111157 - RNA, 22 nt, Human
cagacagaaggcuccuugaggu

SEQ ID NO: 1111158 - RNA, 22 nt, Human
agauuuagacugccuuaaucau

SEQ ID NO: 1111159 - RNA, 20 nt, Human
gaaaugugaccucuucugug

SEQ ID NO: 1111160 - RNA, 22 nt, Human
aagcugcagacccccugucuca

SEQ ID NO: 1111161 - RNA, 22 nt, Human
acugucugcuggccccugguua

SEQ ID NO: 1111162 - RNA, 22 nt, Human
auugaaagauauacuguucuca

SEQ ID NO: 1111163 - RNA, 22 nt, Human
agcaugaaagcauaggacaguc

SEQ ID NO: 1111164 - RNA, 22 nt, Human
uggcucagugaagagauaacuu

SEQ ID NO: 1111165 - RNA, 22 nt, Human
augggaggcaggcucagaaccg

SEQ ID NO: 1111166 - RNA, 22 nt, Human
uccucaggugacuagguaucuu

SEQ ID NO: 1111167 - RNA, 22 nt, Human
gaaagaggaaggagauguauua

SEQ ID NO: 1111168 - RNA, 22 nt, Human
ugggagcugggguuggacgucu

SEQ ID NO: 1111169 - RNA, 23 nt, Human
ugcuucucugcuugacaguucug

SEQ ID NO: 1111170 - RNA, 22 nt, Human
uggucucugacucugaagaccc

SEQ ID NO: 1111171 - RNA, 22 nt, Human
auggacagugugaagcagauag

SEQ ID NO: 1111172 - RNA, 22 nt, Human
acauguuagaaaugcagaaucu

SEQ ID NO: 1111173 - RNA, 21 nt, Human
gagugcagcaagguagagucu

SEQ ID NO: 1111174 - RNA, 22 nt, Human
uagagcugcuggacuguaacag

SEQ ID NO: 1111175 - RNA, 22 nt, Human
ucccagagaagagcuggaugga

SEQ ID NO: 1111176 - RNA, 22 nt, Human
cuggcucagacagcugugcagu

SEQ ID NO: 1111177 - RNA, 22 nt, Human
uggcuuccaaaggaaugggccu

SEQ ID NO: 1111178 - RNA, 22 nt, Human
auucuccagcucacuguccaua

SEQ ID NO: 1111179 - RNA, 22 nt, Human
ucaaaguuuguggcaauuuauu

SEQ ID NO: 1111180 - RNA, 22 nt, Human
ucugucacuuuuauuuacugaa

SEQ ID NO: 1111181 - RNA, 22 nt, Human
gcucucugaggugcuggcagag

SEQ ID NO: 1111182 - RNA, 22 nt, Human
ccagucugaggccuggugaggg

SEQ ID NO: 1111183 - RNA, 23 nt, Human
ucccuggaggcagguccagggcc

SEQ ID NO: 1111184 - RNA, 22 nt, Human
uagcagggaagaugaucagaau

SEQ ID NO: 1111185 - RNA, 22 nt, Human
auacaucuuccuuuuaaaaugc

SEQ ID NO: 1111186 - RNA, 22 nt, Human
agccucucuccagcuuggcaga

SEQ ID NO: 1111187 - RNA, 22 nt, Human
gcccagcagcugguggagaagg

SEQ ID NO: 1111188 - RNA, 22 nt, Human
ggcagaagaaaggcuaagucuc

SEQ ID NO: 1111189 - RNA, 22 nt, Human
cuggcucagugccuucagaagu

SEQ ID NO: 1111190 - RNA, 22 nt, Human
acugcuuuuagaaaucuauaga

SEQ ID NO: 1111191 - RNA, 22 nt, Human
guuagaaagugucugcuugggu

SEQ ID NO: 1111192 - RNA, 22 nt, Human
ccaggccuuccaguacgcagaa

SEQ ID NO: 1111193 - RNA, 22 nt, Human
acucugccuuucagcagaugaa

SEQ ID NO: 1111194 - RNA, 22 nt, Human
uucacauugguucuugauagcu

SEQ ID NO: 1111195 - RNA, 22 nt, Human
cucagcagugacaagagaguau

SEQ ID NO: 1111196 - RNA, 22 nt, Human
agugaaauagcauuuaugaagc

SEQ ID NO: 1111197 - RNA, 23 nt, Human
cagaccuggcagucauccucaac

SEQ ID NO: 1111198 - RNA, 22 nt, Human
uuguaacagcuguuuauauagu

SEQ ID NO: 1111199 - RNA, 22 nt, Human
acuguguguuugucuagcacag

SEQ ID NO: 1111200 - RNA, 22 nt, Human
uucucuuauucuggauaugcag

SEQ ID NO: 1111201 - RNA, 22 nt, Human
ccacaaguuucagcacccagag

SEQ ID NO: 1111202 - RNA, 22 nt, Human
caaggaaaaagcgagcucgggg

SEQ ID NO: 1111203 - RNA, 22 nt, Human
acuuucuaggucucaguccuuu

SEQ ID NO: 1111204 - RNA, 23 nt, Human
uggcucugagcuuccugguggcc

SEQ ID NO: 1111205 - RNA, 19 nt, Human
cagcugccuuuucuuugca

SEQ ID NO: 1111206 - RNA, 22 nt, Human
ugggcugcagggguugagagcu

SEQ ID NO: 1111207 - RNA, 22 nt, Human
auccaaaccuggacaugagugg

SEQ ID NO: 1111208 - RNA, 22 nt, Human
cuggcagcagcuucuggaucga

SEQ ID NO: 1111209 - RNA, 22 nt, Human
ggcuuccuaauacucccuacac

SEQ ID NO: 1111210 - RNA, 22 nt, Human
uggcagaguuauggguauuuau

SEQ ID NO: 1111211 - RNA, 22 nt, Human
ucauucagguugggcaaguguc

SEQ ID NO: 1111212 - RNA, 22 nt, Human
acugucacuccaacugagucgu

SEQ ID NO: 1111213 - RNA, 22 nt, Human
ggcaguggguuccccaaggcac

SEQ ID NO: 1111214 - RNA, 22 nt, Human
acagaguacauucagagacuau

SEQ ID NO: 1111215 - RNA, 22 nt, Human
gguggcagaggugcaucagccc

SEQ ID NO: 1111216 - RNA, 22 nt, Human
agcuggccuccgggugccuggg

SEQ ID NO: 1111217 - RNA, 22 nt, Human
acagccagaggugguccugggu

SEQ ID NO: 1111218 - RNA, 22 nt, Human
uuugaacaugcugcaugauaau

SEQ ID NO: 1111219 - RNA, 22 nt, Human
gagcuggugugugcccgagcac

SEQ ID NO: 1111220 - RNA, 22 nt, Human
cuggccugaggccgccuucaga

SEQ ID NO: 1111221 - RNA, 22 nt, Human
ggucucagacuggcaggcagug

SEQ ID NO: 1111222 - RNA, 22 nt, Human
ucucccaggugggugccuggag

SEQ ID NO: 1111223 - RNA, 22 nt, Human
ugauuuccuggcuuuggaguuc

SEQ ID NO: 1111224 - RNA, 22 nt, Human
ggagccaguauuuaguggucuu

SEQ ID NO: 1111225 - RNA, 22 nt, Human
ugucucaggggcauugaaauaa

SEQ ID NO: 1111226 - RNA, 23 nt, Human
caugggagugagaaugccagcuc

SEQ ID NO: 1111227 - RNA, 22 nt, Human
cagcagagguuggaacaguucu

SEQ ID NO: 1111228 - RNA, 22 nt, Human
gcugggagcccuggucugcucc

SEQ ID NO: 1111229 - RNA, 22 nt, Human
auaauaacaccugaauaggaaa

SEQ ID NO: 1111230 - RNA, 22 nt, Human
uagauuucgcugcaucucaauc

SEQ ID NO: 1111231 - RNA, 22 nt, Human
uugcuuccaguccaagucuguu

SEQ ID NO: 1111232 - RNA, 22 nt, Human
accaggggugucaacagcauuu

SEQ ID NO: 1111233 - RNA, 22 nt, Human
agcugccacaugcccaagggca

SEQ ID NO: 1111234 - RNA, 22 nt, Human
ccuuccaggugcaggcaagccu

SEQ ID NO: 1111235 - RNA, 22 nt, Human
cccagguggguuggccucuguc

SEQ ID NO: 1111236 - RNA, 22 nt, Human
gagcugagccuggguggaccgc

SEQ ID NO: 1111237 - RNA, 22 nt, Human
aagaacauuuuguagaaugaca

SEQ ID NO: 1111238 - RNA, 19 nt, Human
gcuccugggccucacucau

SEQ ID NO: 1111239 - RNA, 22 nt, Human
cagggcaguuugugccuaugag

SEQ ID NO: 1111240 - RNA, 22 nt, Human
ucauugcaguugaguuguguua

SEQ ID NO: 1111241 - RNA, 20 nt, Human
uuucagugguuugugccuag

SEQ ID NO: 1111242 - RNA, 22 nt, Human
guaaaucccauccuuucucugg

SEQ ID NO: 1111243 - RNA, 22 nt, Human
ggaaaguggugguggaaagagg

SEQ ID NO: 1111244 - RNA, 22 nt, Human
ccugggcaucucaugcaccugc

SEQ ID NO: 1111245 - RNA, 22 nt, Human
aguuauauaacuaucuagaugc

SEQ ID NO: 1111246 - RNA, 22 nt, Human
augugacaauauuuggucuuau

SEQ ID NO: 1111247 - RNA, 18 nt, Human
gguggcaggucagaugcc

SEQ ID NO: 1111248 - RNA, 22 nt, Human
aggcacugcuucuaaguaggaa

SEQ ID NO: 1111249 - RNA, 22 nt, Human
ggugccaggcucccagcucagg

SEQ ID NO: 1111250 - RNA, 19 nt, Human
acaagggcaggcaagguga

SEQ ID NO: 1111251 - RNA, 22 nt, Human
ugggccuguugggguugaguua

SEQ ID NO: 1111252 - RNA, 22 nt, Human
cuggccagcauuuuugcuuuag

SEQ ID NO: 1111253 - RNA, 22 nt, Human
agaaaguucacugguauauuuu

SEQ ID NO: 1111254 - RNA, 22 nt, Human
uggcagggccugaaucuuauac

SEQ ID NO: 1111255 - RNA, 22 nt, Human
cagggcugagaauuuagagaca

SEQ ID NO: 1111256 - RNA, 22 nt, Human
agcagcucacaggauuccugaa

SEQ ID NO: 1111257 - RNA, 22 nt, Human
aaacuguaagagaauaaacuac

SEQ ID NO: 1111258 - RNA, 22 nt, Human
cugggccagucucggccgcucu

SEQ ID NO: 1111259 - RNA, 22 nt, Human
acaggggcuccgaaggugaggg

SEQ ID NO: 1111260 - RNA, 21 nt, Human
ccuucuccacagggucuccgg

SEQ ID NO: 1111261 - RNA, 22 nt, Human
gagagugaggcaucaggggcag

SEQ ID NO: 1111262 - RNA, 22 nt, Human
gggccuggggugacguaccccu

SEQ ID NO: 1111263 - RNA, 22 nt, Human
cagucccaugagcccagaacau

SEQ ID NO: 1111264 - RNA, 22 nt, Human
agcagggggaguuagacuagau

SEQ ID NO: 1111265 - RNA, 22 nt, Human
auauuucuccaaauguuuucaa

SEQ ID NO: 1111266 - RNA, 22 nt, Human
aucuggcucgcuaggcucuggg

SEQ ID NO: 1111267 - RNA, 22 nt, Human
accacuguaucuccagcacauu

SEQ ID NO: 1111268 - RNA, 22 nt, Human
cugaagccaugugcucacuggu

SEQ ID NO: 1111269 - RNA, 22 nt, Human
gcacagccacugagugagaacc

SEQ ID NO: 1111270 - RNA, 23 nt, Human
cuuuuaacuugaucugagaccag

SEQ ID NO: 1111271 - RNA, 22 nt, Human
cagggcugcuggccgugcccuc

SEQ ID NO: 1111272 - RNA, 22 nt, Human
agccucugguccucccucagcu

SEQ ID NO: 1111273 - RNA, 22 nt, Human
aaaugcauguagaauaauagag

SEQ ID NO: 1111274 - RNA, 22 nt, Human
uugaaaggugcugugugcugau

SEQ ID NO: 1111275 - RNA, 22 nt, Human
ccuguggcucucuuuggagguc

SEQ ID NO: 1111276 - RNA, 20 nt, Human
acuuucucgguuucucaccu

SEQ ID NO: 1111277 - RNA, 22 nt, Human
uuagauauguuuuugcuaaugc

SEQ ID NO: 1111278 - RNA, 22 nt, Human
uggcuagcccuuguggggagag

SEQ ID NO: 1111279 - RNA, 22 nt, Human
uugcauugcuuggucuucaaga

SEQ ID NO: 1111280 - RNA, 22 nt, Human
cagcauugaucccaggcugugg

SEQ ID NO: 1111281 - RNA, 22 nt, Human
accucugccacuuucuaacucu

SEQ ID NO: 1111282 - RNA, 22 nt, Human
gccugccuuugugaggaagcgg

SEQ ID NO: 1111283 - RNA, 22 nt, Human
ggcuccagggaguggagagaag

SEQ ID NO: 1111284 - RNA, 22 nt, Human
gggcagcagagcccugccgagu

SEQ ID NO: 1111285 - RNA, 19 nt, Human
auacacauacguaaacuga

SEQ ID NO: 1111286 - RNA, 22 nt, Human
gaagagcuuagacagaaucaaa

SEQ ID NO: 1111287 - RNA, 22 nt, Human
uaaggcacccuucugaguagag

SEQ ID NO: 1111288 - RNA, 20 nt, Human
uaacagaaguagaagugggu

SEQ ID NO: 1111289 - RNA, 22 nt, Human
ugcugcuccccagcacacagca

SEQ ID NO: 1111290 - RNA, 22 nt, Human
cgcugggggaacagcgagggug

SEQ ID NO: 1111291 - RNA, 22 nt, Human
augggugugaaaauggucaucu

SEQ ID NO: 1111292 - RNA, 22 nt, Human
caggaacauuuaaccacagggu

SEQ ID NO: 1111293 - RNA, 19 nt, Human
acccagagcccuuugcagg

SEQ ID NO: 1111294 - RNA, 22 nt, Human
aguuuuucugggaggcacugcu

SEQ ID NO: 1111295 - RNA, 22 nt, Human
uggagcagcuaagccucugaga

SEQ ID NO: 1111296 - RNA, 22 nt, Human
cugaggcuuggaggggucuggu

SEQ ID NO: 1111297 - RNA, 19 nt, Human
agggcugcucuggccuggg

SEQ ID NO: 1111298 - RNA, 22 nt, Human
acauuucucagguaagucauuu

SEQ ID NO: 1111299 - RNA, 21 nt, Human
cccuguguuccacagcagaca

SEQ ID NO: 1111300 - RNA, 19 nt, Human
caagugaagccugggaugg

SEQ ID NO: 1111301 - RNA, 22 nt, Human
ugucuuuucuacuguaagcaua

SEQ ID NO: 1111302 - RNA, 22 nt, Human
cuauugaauuaacuauuaaagu

SEQ ID NO: 1111303 - RNA, 22 nt, Human
cagguacacucccuugugcuga

SEQ ID NO: 1111304 - RNA, 16 nt, Human
gggagggaguuggugg

SEQ ID NO: 1111305 - RNA, 22 nt, Human
ugggcucugugccagguuggug

SEQ ID NO: 1111306 - RNA, 22 nt, Human
agcugccauccuguucagcacc

SEQ ID NO: 1111307 - RNA, 22 nt, Human
cuggcuggucaucagcaguacg

SEQ ID NO: 1111308 - RNA, 22 nt, Human
agcagaaccugcagaccugucu

SEQ ID NO: 1111309 - RNA, 22 nt, Human
uugccuugauucuucucaugug

SEQ ID NO: 1111310 - RNA, 22 nt, Human
aggcccuguccauggugcugaa

SEQ ID NO: 1111311 - RNA, 22 nt, Human
gcugccucaggcaccuccuggc

SEQ ID NO: 1111312 - RNA, 22 nt, Human
agcagggguaacagaaggaaag

SEQ ID NO: 1111313 - RNA, 22 nt, Human
uauagagguggaaacugagguu

SEQ ID NO: 1111314 - RNA, 22 nt, Human
aucagcaagauguaauuucuau

SEQ ID NO: 1111315 - RNA, 22 nt, Human
ccucuguccuggggaguggagc

SEQ ID NO: 1111316 - RNA, 22 nt, Human
aacaugaaguuuucuauaguga

SEQ ID NO: 1111317 - RNA, 22 nt, Human
gauuuauuggucuuucauuggu

SEQ ID NO: 1111318 - RNA, 19 nt, Human
cuguccuuggcugcacugu

SEQ ID NO: 1111319 - RNA, 22 nt, Human
agugucauuccagggacccucg

SEQ ID NO: 1111320 - RNA, 22 nt, Human
ucagcugcucuguugagcugaa

SEQ ID NO: 1111321 - RNA, 22 nt, Human
ccugccaggcuuugggcuucug

SEQ ID NO: 1111322 - RNA, 22 nt, Human
ugaaaucuucacuaagucucuu

SEQ ID NO: 1111323 - RNA, 22 nt, Human
gccugguggugugcucaagugg

SEQ ID NO: 1111324 - RNA, 21 nt, Human
aaggaaaagcuuggucucuga

SEQ ID NO: 1111325 - RNA, 22 nt, Human
uggcagaguucgcugugccuuu

SEQ ID NO: 1111326 - RNA, 22 nt, Human
uauucacaggcuggagugaugu

SEQ ID NO: 1111327 - RNA, 22 nt, Human
ugggccaggauuucaagacccu

SEQ ID NO: 1111328 - RNA, 22 nt, Human
ucauaauacaaagaguucugca

SEQ ID NO: 1111329 - RNA, 22 nt, Human
uuccagaaaucuuucagcucaa

SEQ ID NO: 1111330 - RNA, 22 nt, Human
gaggccacgguuuuccuugggg

SEQ ID NO: 1111331 - RNA, 22 nt, Human
agcaucuggugagggccuaguu

SEQ ID NO: 1111332 - RNA, 22 nt, Human
ccacagggucagccacucugca

SEQ ID NO: 1111333 - RNA, 22 nt, Human
uuucaauguaacauuuccaggc

SEQ ID NO: 1111334 - RNA, 22 nt, Human
cugccuuugcccuugacacugu

SEQ ID NO: 1111335 - RNA, 22 nt, Human
cagagcugguguuacaagucca

SEQ ID NO: 1111336 - RNA, 22 nt, Human
augccuggacugacaugcacug

SEQ ID NO: 1111337 - RNA, 22 nt, Human
gcugccuguccugaggaguccg

SEQ ID NO: 1111338 - RNA, 22 nt, Human
gaggcaggguguugauuacaga

SEQ ID NO: 1111339 - RNA, 20 nt, Human
ggcagcucacuacuuucugu

SEQ ID NO: 1111340 - RNA, 22 nt, Human
ugcugggggugucucaccaggc

SEQ ID NO: 1111341 - RNA, 22 nt, Human
uggccuguggcuuaaggucugu

SEQ ID NO: 1111342 - RNA, 22 nt, Human
gcagggugccgacuucagggau

SEQ ID NO: 1111343 - RNA, 22 nt, Human
aacauuuaugguagucauugca

SEQ ID NO: 1111344 - RNA, 22 nt, Human
cccagcccugaccuauuggaaa

SEQ ID NO: 1111345 - RNA, 22 nt, Human
ggccugagcagacagcaugaug

SEQ ID NO: 1111346 - RNA, 22 nt, Human
uggcagaaguacacaagcaugc

SEQ ID NO: 1111347 - RNA, 22 nt, Human
guuccaggcaagugggauagga

SEQ ID NO: 1111348 - RNA, 22 nt, Human
gugccugguuuggggaauguuc

SEQ ID NO: 1111349 - RNA, 22 nt, Human
cagggagaggcaucauagggaa

SEQ ID NO: 1111350 - RNA, 20 nt, Human
acugagcugcauggagagga

SEQ ID NO: 1111351 - RNA, 22 nt, Human
ucuagaaauuuugccuuguauu

SEQ ID NO: 1111352 - RNA, 22 nt, Human
gccuggcuccuaaggacuggcu

SEQ ID NO: 1111353 - RNA, 22 nt, Human
cuggcucccagcuuucagggag

SEQ ID NO: 1111354 - RNA, 22 nt, Human
ccugugcccucagccuggcucu

SEQ ID NO: 1111355 - RNA, 21 nt, Human
uugaaggaucacuucuguacc

SEQ ID NO: 1111356 - RNA, 22 nt, Human
aggucaccauggcaugcuccac

SEQ ID NO: 1111357 - RNA, 19 nt, Human
cugaagucuuuucagcugg

SEQ ID NO: 1111358 - RNA, 22 nt, Human
ggcugcaggcaggguauccacu

SEQ ID NO: 1111359 - RNA, 22 nt, Human
gggaaauugugugagaucuuug

SEQ ID NO: 1111360 - RNA, 22 nt, Human
agagaacaaauuaaaggugguu

SEQ ID NO: 1111361 - RNA, 22 nt, Human
agcugcaggccucuccugggga

SEQ ID NO: 1111362 - RNA, 22 nt, Human
cuguggagcuuguggcaguggg

SEQ ID NO: 1111363 - RNA, 22 nt, Human
cugggaggcccacguugggaag

SEQ ID NO: 1111364 - RNA, 22 nt, Human
aaaugcacaauaaaguaaaggc

SEQ ID NO: 1111365 - RNA, 22 nt, Human
ucuuugcaugugcuucuuggcc

SEQ ID NO: 1111366 - RNA, 22 nt, Human
agugauggagcuuccucugcua

SEQ ID NO: 1111367 - RNA, 22 nt, Human
aggucacccguuugacuaucca

SEQ ID NO: 1111368 - RNA, 22 nt, Human
aaaugcacacaccaggaaacua

SEQ ID NO: 1111369 - RNA, 22 nt, Human
uacauuugcuuugauuuucagc

SEQ ID NO: 1111370 - RNA, 22 nt, Human
uuggcugagagaggaaaagggc

SEQ ID NO: 1111371 - RNA, 20 nt, Human
acaauagauuugagcaaagu

SEQ ID NO: 1111372 - RNA, 22 nt, Human
uccuugaacagagggccugggu

SEQ ID NO: 1111373 - RNA, 22 nt, Human
uggcagcacuugaacuugagcc

SEQ ID NO: 1111374 - RNA, 22 nt, Human
ccacaggggcccacgagccgcu

SEQ ID NO: 1111375 - RNA, 22 nt, Human
ccugggaagagcugacaggagg

SEQ ID NO: 1111376 - RNA, 22 nt, Human
aggagccaagcagaacuaagga

SEQ ID NO: 1111377 - RNA, 22 nt, Human
guccucaguaagagggccucug

SEQ ID NO: 1111378 - RNA, 22 nt, Human
cuggggccacaacggcgcacgc

SEQ ID NO: 1111379 - RNA, 22 nt, Human
cccaggaguuugaguucagcau

SEQ ID NO: 1111380 - RNA, 22 nt, Human
gcaggaagaugagcucagguaa

SEQ ID NO: 1111381 - RNA, 22 nt, Human
uuguaacagcugcuuaauagag

SEQ ID NO: 1111382 - RNA, 23 nt, Human
gcugcagcuguggauguucucag

SEQ ID NO: 1111383 - RNA, 22 nt, Human
auaauguagguauguguauuua

SEQ ID NO: 1111384 - RNA, 21 nt, Human
ugcagagauaucugaagcaga

SEQ ID NO: 1111385 - RNA, 22 nt, Human
aagccagccagugccagucuua

SEQ ID NO: 1111386 - RNA, 22 nt, Human
cuuugaaagcucccaggacuua

SEQ ID NO: 1111387 - RNA, 22 nt, Human
aaagacugguguguuacauaua

SEQ ID NO: 1111388 - RNA, 22 nt, Human
ccagaaaaugcagaacauagaa

SEQ ID NO: 1111389 - RNA, 22 nt, Human
cugcuuugauuagaagaguaca

SEQ ID NO: 1111390 - RNA, 22 nt, Human
aucagcugaaaaacaggcagca

SEQ ID NO: 1111391 - RNA, 22 nt, Human
uggcuggcgccgggcuagccac

SEQ ID NO: 1111392 - RNA, 22 nt, Human
gccuggucucuuucaugucagu

SEQ ID NO: 1111393 - RNA, 22 nt, Human
cuggguggcgucuggggccagu

SEQ ID NO: 1111394 - RNA, 22 nt, Human
ucuggcucuguguccccaccca

SEQ ID NO: 1111395 - RNA, 21 nt, Human
aggucccagguuugggcagca

SEQ ID NO: 1111396 - RNA, 22 nt, Human
ucucauucauacccuacaugcu

SEQ ID NO: 1111397 - RNA, 22 nt, Human
cuggcagcugugugaagaacug

SEQ ID NO: 1111398 - RNA, 20 nt, Human
cccuccagcaaccaggacuu

SEQ ID NO: 1111399 - RNA, 22 nt, Human
uccucagaugcucuuggacgcc

SEQ ID NO: 1111400 - RNA, 22 nt, Human
ccugucugaaggcagggggaug

SEQ ID NO: 1111401 - RNA, 22 nt, Human
agggcacaucugcugggaaugg

SEQ ID NO: 1111402 - RNA, 22 nt, Human
cugccuuggcccuaguucaugg

SEQ ID NO: 1111403 - RNA, 22 nt, Human
ugggauaguggccaggaccccc

SEQ ID NO: 1111404 - RNA, 22 nt, Human
uaggcaggugugcacugcccac

SEQ ID NO: 1111405 - RNA, 22 nt, Human
ucugccuggauuuuggaaagcu

SEQ ID NO: 1111406 - RNA, 22 nt, Human
aagcacaaugaacaucuuagau

SEQ ID NO: 1111407 - RNA, 22 nt, Human
agccacagagagggagcugcaa

SEQ ID NO: 1111408 - RNA, 22 nt, Human
ucagagcugcccaugcaagggg

SEQ ID NO: 1111409 - RNA, 22 nt, Human
cuggaagguuccucccagcucc

SEQ ID NO: 1111410 - RNA, 22 nt, Human
agcuuccuguugagagagggag

SEQ ID NO: 1111411 - RNA, 22 nt, Human
ccaggggaaacagggagcacuc

SEQ ID NO: 1111412 - RNA, 22 nt, Human
ucaguguccggagccugagugc

SEQ ID NO: 1111413 - RNA, 22 nt, Human
uguggccaccagagcugcuauu

SEQ ID NO: 1111414 - RNA, 22 nt, Human
gcaggcucuucuuucugcccag

SEQ ID NO: 1111415 - RNA, 22 nt, Human
uuucucuaaauagggaggcuua

SEQ ID NO: 1111416 - RNA, 22 nt, Human
gcugcccuaauaucacauguua

SEQ ID NO: 1111417 - RNA, 22 nt, Human
cacauguaguaagcaggcaaug

SEQ ID NO: 1111418 - RNA, 22 nt, Human
auggggcucugcggcugcuccc

SEQ ID NO: 1111419 - RNA, 22 nt, Human
agaaacauuuagauuauauguc

SEQ ID NO: 1111420 - RNA, 22 nt, Human
gagggugguggcuuaaggugcu

SEQ ID NO: 1111421 - RNA, 17 nt, Human
ugaaggaaggaugaugu

SEQ ID NO: 1111422 - RNA, 22 nt, Human
cccuggaguagcacugggucgc

SEQ ID NO: 1111423 - RNA, 22 nt, Human
agagcuggcugguagcccugau

SEQ ID NO: 1111424 - RNA, 21 nt, Human
gcaggcuggucaaaccucagu

SEQ ID NO: 1111425 - RNA, 22 nt, Human
aaaguguagagacuuuggaacc

SEQ ID NO: 1111426 - RNA, 22 nt, Human
ucugggcucuuaguguacccuc

SEQ ID NO: 1111427 - RNA, 22 nt, Human
cugcagaguggagccucggcug

SEQ ID NO: 1111428 - RNA, 22 nt, Human
agucauauguggcauuuucuaa

SEQ ID NO: 1111429 - RNA, 22 nt, Human
cucacugcccugaaguuggguu

SEQ ID NO: 1111430 - RNA, 22 nt, Human
caugggagcuaucuccaucacu

SEQ ID NO: 1111431 - RNA, 22 nt, Human
aaguuaugaaauuuggacagcu

SEQ ID NO: 1111432 - RNA, 22 nt, Human
agcugcugcgccucacccuggc

SEQ ID NO: 1111433 - RNA, 23 nt, Human
cccagcuuucccacugccgagag

SEQ ID NO: 1111434 - RNA, 22 nt, Human
uuggaaggcccugccuagcagg

SEQ ID NO: 1111435 - RNA, 22 nt, Human
augcaguaaauguucuaguuug

SEQ ID NO: 1111436 - RNA, 22 nt, Human
acagaccaaguuuccagcaggu

SEQ ID NO: 1111437 - RNA, 22 nt, Human
ucccagagucagagguggggcc

SEQ ID NO: 1111438 - RNA, 19 nt, Human
ccuggguccacucagacua

SEQ ID NO: 1111439 - RNA, 22 nt, Human
ugaagcaaacgcuucuguuccu

SEQ ID NO: 1111440 - RNA, 22 nt, Human
auaugccauuagcuagaaauaa

SEQ ID NO: 1111441 - RNA, 22 nt, Human
uuugcauugcauacaaggaacu

SEQ ID NO: 1111442 - RNA, 22 nt, Human
caggcugcagugcaguggcuau

SEQ ID NO: 1111443 - RNA, 22 nt, Human
ucacuugccuagcccaguucag

SEQ ID NO: 1111444 - RNA, 19 nt, Human
ugcuuccucaccaucuccc

SEQ ID NO: 1111445 - RNA, 22 nt, Human
uuacaaagagugccagagugug

SEQ ID NO: 1111446 - RNA, 22 nt, Human
cacacaugucucuccaugcucu

SEQ ID NO: 1111447 - RNA, 22 nt, Human
ucuagaaaaaaacugcugugga

SEQ ID NO: 1111448 - RNA, 22 nt, Human
caggaaccuaaugaaggcucac

SEQ ID NO: 1111449 - RNA, 22 nt, Human
ucacauacacuaggauauuuuu

SEQ ID NO: 1111450 - RNA, 22 nt, Human
agcuggagaugcccagcaccgg

SEQ ID NO: 1111451 - RNA, 22 nt, Human
aggaguggaauuacuggguucu

SEQ ID NO: 1111452 - RNA, 22 nt, Human
uccugccuucauacugcuguau

SEQ ID NO: 1111453 - RNA, 22 nt, Human
uagcagcuuccagagagggcag

SEQ ID NO: 1111454 - RNA, 22 nt, Human
auggggcugggauucuccucgg

SEQ ID NO: 1111455 - RNA, 22 nt, Human
caggcugaucagggcugggaug

SEQ ID NO: 1111456 - RNA, 22 nt, Human
gaggcaggcagauugcuugagg

SEQ ID NO: 1111457 - RNA, 22 nt, Human
ggcucuggugggaagguuagau

SEQ ID NO: 1111458 - RNA, 18 nt, Human
ugaacagaugaguugaag

SEQ ID NO: 1111459 - RNA, 22 nt, Human
gaugaagccugacuucucggug

SEQ ID NO: 1111460 - RNA, 22 nt, Human
uaagaaauuuaguuauagaaug

SEQ ID NO: 1111461 - RNA, 22 nt, Human
gcugucugucuucacaucucgc

SEQ ID NO: 1111462 - RNA, 22 nt, Human
uccugagagcagaguccaggug

SEQ ID NO: 1111463 - RNA, 22 nt, Human
cugccucuggccucaggcccag

SEQ ID NO: 1111464 - RNA, 22 nt, Human
ucugcucuaguugcuuccugcc

SEQ ID NO: 1111465 - RNA, 22 nt, Human
gugcuuccccaagccacagccu

SEQ ID NO: 1111466 - RNA, 20 nt, Human
uccagccacuuccgcugguc

SEQ ID NO: 1111467 - RNA, 22 nt, Human
ugucauaaaacacaagcuguug

SEQ ID NO: 1111468 - RNA, 22 nt, Human
cccauuuaucccaagguuacuc

SEQ ID NO: 1111469 - RNA, 22 nt, Human
uaagaacagugucugucucaca

SEQ ID NO: 1111470 - RNA, 22 nt, Human
ucaguuuuuaagaguuaugcga

SEQ ID NO: 1111471 - RNA, 22 nt, Human
ggcacugaucugauuucccucc

SEQ ID NO: 1111472 - RNA, 20 nt, Human
uacugggcaagcccacagac

SEQ ID NO: 1111473 - RNA, 22 nt, Human
aggacuucuccgauaagucaga

SEQ ID NO: 1111474 - RNA, 22 nt, Human
ccagucugugugccagccugcg

SEQ ID NO: 1111475 - RNA, 22 nt, Human
gacagaagaggaacuuggacag

SEQ ID NO: 1111476 - RNA, 22 nt, Human
cugaggcucccucgggucugcu

SEQ ID NO: 1111477 - RNA, 20 nt, Human
ccagcauguacacaugugga

SEQ ID NO: 1111478 - RNA, 22 nt, Human
aguguuccacacaucuggggaa

SEQ ID NO: 1111479 - RNA, 22 nt, Human
agggugggcuagacucuucccc

SEQ ID NO: 1111480 - RNA, 20 nt, Human
ccugucuccucuuaccuggc

SEQ ID NO: 1111481 - RNA, 22 nt, Human
aggguauaaagagcaagcagaa

SEQ ID NO: 1111482 - RNA, 22 nt, Human
gaaggcaggcuucugauuaggu

SEQ ID NO: 1111483 - RNA, 22 nt, Human
gugaaaucugaggcccaugaug

SEQ ID NO: 1111484 - RNA, 22 nt, Human
guccucugggcagcugccccac

SEQ ID NO: 1111485 - RNA, 22 nt, Human
cuggcuggcaaguagaacacaa

SEQ ID NO: 1111486 - RNA, 22 nt, Human
aguuauucauuuauucuguaca

SEQ ID NO: 1111487 - RNA, 22 nt, Human
ccugggaggcagagguugcagu

SEQ ID NO: 1111488 - RNA, 22 nt, Human
cacugaaggcuaggauuagaug

SEQ ID NO: 1111489 - RNA, 22 nt, Human
ccagcugcgggcaucgagaguu

SEQ ID NO: 1111490 - RNA, 22 nt, Human
gccuggagcagacgugucccgg

SEQ ID NO: 1111491 - RNA, 22 nt, Human
uauguguaggaggaggacaggg

SEQ ID NO: 1111492 - RNA, 23 nt, Human
acagagaucuugacuuguaugga

SEQ ID NO: 1111493 - RNA, 22 nt, Human
ggugcagaggagccagcugggg

SEQ ID NO: 1111494 - RNA, 22 nt, Human
ugcagcuccucuggcugccuga

SEQ ID NO: 1111495 - RNA, 22 nt, Human
cgugucaucugagccuugggcg

SEQ ID NO: 1111496 - RNA, 22 nt, Human
uugugaaacauucauggauuug

SEQ ID NO: 1111497 - RNA, 22 nt, Human
ugcagcucugaacagucaugaa

SEQ ID NO: 1111498 - RNA, 22 nt, Human
gcagcccagagcgcaggacccc

SEQ ID NO: 1111499 - RNA, 22 nt, Human
gcagaagggaauaaggagcuuu

SEQ ID NO: 1111500 - RNA, 22 nt, Human
augcacuugcguguuugcaaau

SEQ ID NO: 1111501 - RNA, 22 nt, Human
ucaugcacaugugucaccauca

SEQ ID NO: 1111502 - RNA, 22 nt, Human
ccagggcaauaggaacacuuuu

SEQ ID NO: 1111503 - RNA, 22 nt, Human
agugacagcugggaaggugaaa

SEQ ID NO: 1111504 - RNA, 22 nt, Human
uuucuagaggcuccaggggagu

SEQ ID NO: 1111505 - RNA, 22 nt, Human
auucaguaggucuagaauaaga

SEQ ID NO: 1111506 - RNA, 22 nt, Human
ucagcagggccuccuugugcag

SEQ ID NO: 1111507 - RNA, 22 nt, Human
gcugagaggcacuaucuccgga

SEQ ID NO: 1111508 - RNA, 22 nt, Human
cugcugggcuccucaugugacu

SEQ ID NO: 1111509 - RNA, 22 nt, Human
ggcugcucuucuuggcgaccuc

SEQ ID NO: 1111510 - RNA, 22 nt, Human
agggcagagaucugagugggca

SEQ ID NO: 1111511 - RNA, 22 nt, Human
gcagccacugggagugcuuaua

SEQ ID NO: 1111512 - RNA, 22 nt, Human
aacaaaugauaccaguucucaa

SEQ ID NO: 1111513 - RNA, 23 nt, Human
agccacuucuaucuugcuccugg

SEQ ID NO: 1111514 - RNA, 18 nt, Human
agaaggagcuaugggcag

SEQ ID NO: 1111515 - RNA, 22 nt, Human
ucagggacauuuagacacugau

SEQ ID NO: 1111516 - RNA, 22 nt, Human
ggcauguuucaucacaucaaga

SEQ ID NO: 1111517 - RNA, 19 nt, Human
cagcugcaccgugaccauc

SEQ ID NO: 1111518 - RNA, 22 nt, Human
gucucagaguccuacuuauucc

SEQ ID NO: 1111519 - RNA, 22 nt, Human
uucaaucauuuuuacauagucc

SEQ ID NO: 1111520 - RNA, 22 nt, Human
ggugaggcuaagugacacaggg

SEQ ID NO: 1111521 - RNA, 22 nt, Human
cccagcauggagugaggacuca

SEQ ID NO: 1111522 - RNA, 22 nt, Human
gcaaagguagccaaggagcuca

SEQ ID NO: 1111523 - RNA, 22 nt, Human
ucagaaauuuucucaguaguuc

SEQ ID NO: 1111524 - RNA, 22 nt, Human
gcugucugcugggucgcucagg

SEQ ID NO: 1111525 - RNA, 22 nt, Human
cagucccagacccagaaggugg

SEQ ID NO: 1111526 - RNA, 22 nt, Human
ucccagagccaagcuauggaug

SEQ ID NO: 1111527 - RNA, 20 nt, Human
gcccacucuaauccacuguc

SEQ ID NO: 1111528 - RNA, 22 nt, Human
ggaagagagggcugggccucaa

SEQ ID NO: 1111529 - RNA, 19 nt, Human
ucuggcuccugccaggcug

SEQ ID NO: 1111530 - RNA, 20 nt, Human
ugcagcugcaggaggguggg

SEQ ID NO: 1111531 - RNA, 22 nt, Human
gcucucugggugugucuagaua

SEQ ID NO: 1111532 - RNA, 22 nt, Human
ccauuuguucgcccagcuccaa

SEQ ID NO: 1111533 - RNA, 21 nt, Human
cccuugccugcacuccucggc

SEQ ID NO: 1111534 - RNA, 22 nt, Human
caguuuuugccauuaagaguaa

SEQ ID NO: 1111535 - RNA, 22 nt, Human
gaugagggccugguggcugugc

SEQ ID NO: 1111536 - RNA, 23 nt, Human
gaagcagaugucugaguaggcag

SEQ ID NO: 1111537 - RNA, 22 nt, Human
cugggccagcaacugcaaugga

SEQ ID NO: 1111538 - RNA, 22 nt, Human
uccuucagucuucugagccaua

SEQ ID NO: 1111539 - RNA, 22 nt, Human
cugccugugccaaugcuccuuu

SEQ ID NO: 1111540 - RNA, 22 nt, Human
ucaagagauugaauaauaacug

SEQ ID NO: 1111541 - RNA, 22 nt, Human
acagcagcaauagcagugacau

SEQ ID NO: 1111542 - RNA, 22 nt, Human
ucuggcuccacaccucacugca

SEQ ID NO: 1111543 - RNA, 19 nt, Human
uguagcaguuuaaaacaac

SEQ ID NO: 1111544 - RNA, 17 nt, Human
gcuuccugugcugggga

SEQ ID NO: 1111545 - RNA, 22 nt, Human
aauguguacuuuuucaugcuca

SEQ ID NO: 1111546 - RNA, 19 nt, Human
aacuagaaagguuuugaga

SEQ ID NO: 1111547 - RNA, 20 nt, Human
accuugaacccgccagccau

SEQ ID NO: 1111548 - RNA, 21 nt, Human
ccagcagcucaaggaucucuu

SEQ ID NO: 1111549 - RNA, 22 nt, Human
ggaccugccagaacucaggcua

SEQ ID NO: 1111550 - RNA, 22 nt, Human
uaugaagacaaugauagcauga

SEQ ID NO: 1111551 - RNA, 22 nt, Human
ccugccugcagaaaguaucucc

SEQ ID NO: 1111552 - RNA, 21 nt, Human
ucaaagcacauauuugcacau

SEQ ID NO: 1111553 - RNA, 22 nt, Human
uuccauaaucaccuuauucuuu

SEQ ID NO: 1111554 - RNA, 22 nt, Human
cuaaaugcccuacaaugacugg

SEQ ID NO: 1111555 - RNA, 22 nt, Human
ggcucuggaaaguguccuugau

SEQ ID NO: 1111556 - RNA, 23 nt, Human
ccugucugugcuggguggacaca

SEQ ID NO: 1111557 - RNA, 22 nt, Human
gagcugccugaacaagcagcag

SEQ ID NO: 1111558 - RNA, 22 nt, Human
cucuggagugcagccugguggc

SEQ ID NO: 1111559 - RNA, 22 nt, Human
augugcauuaaaugucaauguu

SEQ ID NO: 1111560 - RNA, 18 nt, Human
gcucugcccaggcugccc

SEQ ID NO: 1111561 - RNA, 22 nt, Human
acugugcaaugaguaauaaacu

SEQ ID NO: 1111562 - RNA, 22 nt, Human
uggccugccucccggcuucuuu

SEQ ID NO: 1111563 - RNA, 22 nt, Human
ucuggcucuaacuaggcaucag

SEQ ID NO: 1111564 - RNA, 22 nt, Human
aaaugccucugcuguacacaau

SEQ ID NO: 1111565 - RNA, 22 nt, Human
gcagcuggagcaucuucucauc

SEQ ID NO: 1111566 - RNA, 20 nt, Human
gcaaauggaucccacaagcc

SEQ ID NO: 1111567 - RNA, 19 nt, Human
gcuguauuaaagauacaug

SEQ ID NO: 1111568 - RNA, 22 nt, Human
ccuugcaggggaacaggcagug

SEQ ID NO: 1111569 - RNA, 22 nt, Human
agccaggauuggcugagccuua

SEQ ID NO: 1111570 - RNA, 22 nt, Human
ucucccagaggaucccagugga

SEQ ID NO: 1111571 - RNA, 22 nt, Human
gaagcccagggcguggccgggc

SEQ ID NO: 1111572 - RNA, 22 nt, Human
ggugcuggacacguggcacucc

SEQ ID NO: 1111573 - RNA, 22 nt, Human
guauacauagaugaugaacaag

SEQ ID NO: 1111574 - RNA, 22 nt, Human
agcugccugcuuaugagcucca

SEQ ID NO: 1111575 - RNA, 22 nt, Human
uauagaaguaagcauugugaug

SEQ ID NO: 1111576 - RNA, 22 nt, Human
gauuucaaagguucugcaugcc

SEQ ID NO: 1111577 - RNA, 22 nt, Human
uccaggacuagcauuucugaua

SEQ ID NO: 1111578 - RNA, 22 nt, Human
gagcacaggcuuugguggacac

SEQ ID NO: 1111579 - RNA, 22 nt, Human
uccagggaucuuuagagucuuu

SEQ ID NO: 1111580 - RNA, 22 nt, Human
cucaaguaagaaacagaauugg

SEQ ID NO: 1111581 - RNA, 22 nt, Human
gaaacccaaacuaagacaguag

SEQ ID NO: 1111582 - RNA, 22 nt, Human
uaagaagcuucugcuaaugccu

SEQ ID NO: 1111583 - RNA, 22 nt, Human
uccagggagagccgcugcucca

SEQ ID NO: 1111584 - RNA, 19 nt, Human
ggcucagggcgcugccgcc

SEQ ID NO: 1111585 - RNA, 19 nt, Human
agcagccaucgaccaugga

SEQ ID NO: 1111586 - RNA, 22 nt, Human
uccugccugcaaucccagcacu

SEQ ID NO: 1111587 - RNA, 22 nt, Human
ggccuagggaguggccaugccu

SEQ ID NO: 1111588 - RNA, 22 nt, Human
ucaggaucaggggccuuuccuu

SEQ ID NO: 1111589 - RNA, 22 nt, Human
ugaggccaaugacccugggcag

SEQ ID NO: 1111590 - RNA, 22 nt, Human
ucaggcacugcuuucugauaug

SEQ ID NO: 1111591 - RNA, 21 nt, Human
gccaccucgucucggagcagc

SEQ ID NO: 1111592 - RNA, 23 nt, Human
ucagagaaguuguaggcugggga

SEQ ID NO: 1111593 - RNA, 22 nt, Human
agaauucuguucuucgggugug

SEQ ID NO: 1111594 - RNA, 22 nt, Human
aagaauucacugguagagucaa

SEQ ID NO: 1111595 - RNA, 21 nt, Human
cuccugggcuaagauauagug

SEQ ID NO: 1111596 - RNA, 22 nt, Human
gaaaauguuuccuguuauuugc

SEQ ID NO: 1111597 - RNA, 22 nt, Human
uccuucagccaugggcucucca

SEQ ID NO: 1111598 - RNA, 17 nt, Human
cuggagccuccaacucc

SEQ ID NO: 1111599 - RNA, 22 nt, Human
cuggccuuggugcuugcagaca

SEQ ID NO: 1111600 - RNA, 22 nt, Human
aaagaaauagauggcauuuaaa

SEQ ID NO: 1111601 - RNA, 22 nt, Human
gccucugcaccaguacugugcc

SEQ ID NO: 1111602 - RNA, 22 nt, Human
uucacaggugacuggggauaac

SEQ ID NO: 1111603 - RNA, 22 nt, Human
acacaggggcucggcugggugc

SEQ ID NO: 1111604 - RNA, 22 nt, Human
ucuuuccuagaggcugaugagu

SEQ ID NO: 1111605 - RNA, 17 nt, Human
acagggcagaaacagcu

SEQ ID NO: 1111606 - RNA, 22 nt, Human
ucaagagaaggggaaauagacu

SEQ ID NO: 1111607 - RNA, 22 nt, Human
ccucugagaccagcucugcacc

SEQ ID NO: 1111608 - RNA, 22 nt, Human
cucccagggccaucgagucacu

SEQ ID NO: 1111609 - RNA, 18 nt, Human
aaaugcuaggcuacauga

SEQ ID NO: 1111610 - RNA, 22 nt, Human
aaaucaguuagugguaggauug

SEQ ID NO: 1111611 - RNA, 22 nt, Human
uaugcacauuaucuaauccauu

SEQ ID NO: 1111612 - RNA, 23 nt, Human
ccuggcuggauucucugcauuca

SEQ ID NO: 1111613 - RNA, 22 nt, Human
cacugcagaucagaggcugaga

SEQ ID NO: 1111614 - RNA, 22 nt, Human
acaaagucuuuuacaacaguca

SEQ ID NO: 1111615 - RNA, 22 nt, Human
ucccagagauuuccucuccuuc

SEQ ID NO: 1111616 - RNA, 18 nt, Human
agggaucaucacugcagc

SEQ ID NO: 1111617 - RNA, 22 nt, Human
gcagcccagguguagcucuuug

SEQ ID NO: 1111618 - RNA, 22 nt, Human
auccugggaagcugacauugaa

SEQ ID NO: 1111619 - RNA, 22 nt, Human
gcacagggccuggcacauaaga

SEQ ID NO: 1111620 - RNA, 22 nt, Human
ggugccagccuagugcaguggu

SEQ ID NO: 1111621 - RNA, 21 nt, Human
gggugggaggacacagcaggc

SEQ ID NO: 1111622 - RNA, 22 nt, Human
ugaagccacagagcaucugccu

SEQ ID NO: 1111623 - RNA, 22 nt, Human
cagggcuggcuguggcaaucuc

SEQ ID NO: 1111624 - RNA, 22 nt, Human
auggaaagggaagcaaggaaca

SEQ ID NO: 1111625 - RNA, 22 nt, Human
aagccagauagaagaacucauu

SEQ ID NO: 1111626 - RNA, 18 nt, Human
gcagcugcaguuguagcu

SEQ ID NO: 1111627 - RNA, 22 nt, Human
ugcagucuggauguccucagau

SEQ ID NO: 1111628 - RNA, 22 nt, Human
gucccugcccuccugggacuca

SEQ ID NO: 1111629 - RNA, 22 nt, Human
gcucugggaacugacugccuuc

SEQ ID NO: 1111630 - RNA, 22 nt, Human
agggcagagcugucuaaauggc

SEQ ID NO: 1111631 - RNA, 22 nt, Human
cagcauggcuugaguguuuccu

SEQ ID NO: 1111632 - RNA, 22 nt, Human
aggggugaaagagggcccucaa

SEQ ID NO: 1111633 - RNA, 22 nt, Human
caggaagagaacauggaggcug

SEQ ID NO: 1111634 - RNA, 22 nt, Human
uguggccuugcagccuggaggu

SEQ ID NO: 1111635 - RNA, 22 nt, Human
uccaggaggguuuucugccuuc

SEQ ID NO: 1111636 - RNA, 22 nt, Human
ggccucugaggacagccuuggc

SEQ ID NO: 1111637 - RNA, 22 nt, Human
cacagaggcaaccuucuggggu

SEQ ID NO: 1111638 - RNA, 22 nt, Human
ucugcucagugcuuaucucuaa

SEQ ID NO: 1111639 - RNA, 22 nt, Human
cagaaauucccauuucagauuc

SEQ ID NO: 1111640 - RNA, 22 nt, Human
ugcagugggccggaggccaggg

SEQ ID NO: 1111641 - RNA, 20 nt, Human
uguuucuuuuaaugagcggc

SEQ ID NO: 1111642 - RNA, 22 nt, Human
uccuggcccacuaugccagcau

SEQ ID NO: 1111643 - RNA, 22 nt, Human
ugggccuggcccuguggaggag

SEQ ID NO: 1111644 - RNA, 22 nt, Human
cacagaauuaagggagaaauau

SEQ ID NO: 1111645 - RNA, 22 nt, Human
ccaggcccugcuccucacacca

SEQ ID NO: 1111646 - RNA, 22 nt, Human
uuccucaugggguuccuucaga

SEQ ID NO: 1111647 - RNA, 22 nt, Human
ccuuaaaagaacuaucucuucu

SEQ ID NO: 1111648 - RNA, 22 nt, Human
cagcuuugauucuuucugccau

SEQ ID NO: 1111649 - RNA, 21 nt, Human
uccauaagagaccaucuccua

SEQ ID NO: 1111650 - RNA, 19 nt, Human
ccugugugggguagagauc

SEQ ID NO: 1111651 - RNA, 22 nt, Human
agaggccacuuugccugugaug

SEQ ID NO: 1111652 - RNA, 22 nt, Human
cagggccagcgcccaggcccag

SEQ ID NO: 1111653 - RNA, 21 nt, Human
cagagcagcguucugcugugg

SEQ ID NO: 1111654 - RNA, 22 nt, Human
cccagcaggucggugcugccug

SEQ ID NO: 1111655 - RNA, 22 nt, Human
gcagugaaucuggcaagaauuu

SEQ ID NO: 1111656 - RNA, 22 nt, Human
guccacauaggaacccagcuuc

SEQ ID NO: 1111657 - RNA, 22 nt, Human
cugagauggaguuucgcucuuc

SEQ ID NO: 1111658 - RNA, 22 nt, Human
uggccuggggaccugugagacc

SEQ ID NO: 1111659 - RNA, 22 nt, Human
gcagugcuuuagucuguccuuu

SEQ ID NO: 1111660 - RNA, 22 nt, Human
uggcagagaugaagaguuguuu

SEQ ID NO: 1111661 - RNA, 22 nt, Human
uugcagagaucagcagguuuga

SEQ ID NO: 1111662 - RNA, 22 nt, Human
ugaugguuuuauuaauaggacc

SEQ ID NO: 1111663 - RNA, 22 nt, Human
uucuuaaagaggcaaaacacag

SEQ ID NO: 1111664 - RNA, 22 nt, Human
aggccuguuccaggccccuuuu

SEQ ID NO: 1111665 - RNA, 22 nt, Human
agccuguccagaggacagggcu

SEQ ID NO: 1111666 - RNA, 22 nt, Human
caauagcagcuucugaaugcaa

SEQ ID NO: 1111667 - RNA, 22 nt, Human
aucccugcccucauggagcuua

SEQ ID NO: 1111668 - RNA, 22 nt, Human
agcugccuguccuaggccauca

SEQ ID NO: 1111669 - RNA, 22 nt, Human
ccaagggcucugacuugccugc

SEQ ID NO: 1111670 - RNA, 22 nt, Human
ucccugggcaucacguugcuuc

SEQ ID NO: 1111671 - RNA, 22 nt, Human
agagccugggaauuugcauguu

SEQ ID NO: 1111672 - RNA, 22 nt, Human
aaggcccuaauagagcacauau

SEQ ID NO: 1111673 - RNA, 22 nt, Human
gauuucaaggauguuagaggug

SEQ ID NO: 1111674 - RNA, 22 nt, Human
acacagggcaaugcuuugaccu

SEQ ID NO: 1111675 - RNA, 22 nt, Human
cugucuccuccacugcauggga

SEQ ID NO: 1111676 - RNA, 22 nt, Human
gaggaguggaguugcuggguug

SEQ ID NO: 1111677 - RNA, 22 nt, Human
caggcagcucgaugccuuguug

SEQ ID NO: 1111678 - RNA, 22 nt, Human
ccuggagcacagcccaguccca

SEQ ID NO: 1111679 - RNA, 22 nt, Human
cuggugccuccucccugugcuu

SEQ ID NO: 1111680 - RNA, 22 nt, Human
caauaugcaagcuauuaaguau

SEQ ID NO: 1111681 - RNA, 22 nt, Human
auugcacaaacacagucagacu

SEQ ID NO: 1111682 - RNA, 22 nt, Human
ccagaggucuccugcacgggau

SEQ ID NO: 1111683 - RNA, 22 nt, Human
gcaggggcugagcaccagcggg

SEQ ID NO: 1111684 - RNA, 22 nt, Human
uccuggagcuuccuucauggua

SEQ ID NO: 1111685 - RNA, 22 nt, Human
gagagcugcagccgagaggggg

SEQ ID NO: 1111686 - RNA, 22 nt, Human
gugugcagaagacacaagacau

SEQ ID NO: 1111687 - RNA, 17 nt, Human
guccugggaggagagag

SEQ ID NO: 1111688 - RNA, 22 nt, Human
guucauauuacuuugagugcag

SEQ ID NO: 1111689 - RNA, 22 nt, Human
acuccuggggauccauuccuuu

SEQ ID NO: 1111690 - RNA, 18 nt, Human
acagaggcagacauguau

SEQ ID NO: 1111691 - RNA, 22 nt, Human
aggcacugaaggaagcuugcgc

SEQ ID NO: 1111692 - RNA, 22 nt, Human
cagaggccucacuuccagccag

SEQ ID NO: 1111693 - RNA, 22 nt, Human
ugagggaggcccuuugagcaga

SEQ ID NO: 1111694 - RNA, 20 nt, Human
cagcucugggaaagaggcca

SEQ ID NO: 1111695 - RNA, 22 nt, Human
cuguuuauuacacuggauagca

SEQ ID NO: 1111696 - RNA, 22 nt, Human
auuauguagguuaggugguugu

SEQ ID NO: 1111697 - RNA, 22 nt, Human
uggccugggccggcagauauac

SEQ ID NO: 1111698 - RNA, 22 nt, Human
auuucacucuuaauugcuuccu

SEQ ID NO: 1111699 - RNA, 22 nt, Human
cugcuuuguguggucccuccag

SEQ ID NO: 1111700 - RNA, 22 nt, Human
caguguccucagccagcagcua

SEQ ID NO: 1111701 - RNA, 22 nt, Human
ggaggaugccaagcugugcaca

SEQ ID NO: 1111702 - RNA, 22 nt, Human
caggcacuguguuaggcacugu

SEQ ID NO: 1111703 - RNA, 22 nt, Human
uuacaaagcguugagacaagua

SEQ ID NO: 1111704 - RNA, 22 nt, Human
aaggccagcuuguagggcuggu

SEQ ID NO: 1111705 - RNA, 18 nt, Human
gccugccuagagcuugcc

SEQ ID NO: 1111706 - RNA, 22 nt, Human
cccaaggccucuccuuggcuug

SEQ ID NO: 1111707 - RNA, 20 nt, Human
uguauauuuucugguguaaa

SEQ ID NO: 1111708 - RNA, 22 nt, Human
aggccugaaguguggagugggg

SEQ ID NO: 1111709 - RNA, 22 nt, Human
ucuggagauaagacagacagau

SEQ ID NO: 1111710 - RNA, 22 nt, Human
gucccaggcagagucaggaggg

SEQ ID NO: 1111711 - RNA, 22 nt, Human
auacauguuguaccauauguuu

SEQ ID NO: 1111712 - RNA, 22 nt, Human
caggccugggcuucggggcuga

SEQ ID NO: 1111713 - RNA, 22 nt, Human
uuaaacagguuuuugaauggcc

SEQ ID NO: 1111714 - RNA, 22 nt, Human
uguguacauaucuauccuagau

SEQ ID NO: 1111715 - RNA, 22 nt, Human
ccaccaggacagcccugagggg

SEQ ID NO: 1111716 - RNA, 22 nt, Human
ggcaggagaaaggucucuucuu

SEQ ID NO: 1111717 - RNA, 22 nt, Human
accagcagaguugaggaggaca

SEQ ID NO: 1111718 - RNA, 22 nt, Human
gaaaggagggaaacagagcggu

SEQ ID NO: 1111719 - RNA, 22 nt, Human
ucucaccauggugcuugcuuau

SEQ ID NO: 1111720 - RNA, 22 nt, Human
agugagggaugaagaacugcgg

SEQ ID NO: 1111721 - RNA, 22 nt, Human
aaguuacuggcaagggcugcag

SEQ ID NO: 1111722 - RNA, 22 nt, Human
agcaguggagcgagauguuuaa

SEQ ID NO: 1111723 - RNA, 20 nt, Human
aguguuccggaagacuggca

SEQ ID NO: 1111724 - RNA, 19 nt, Human
agccagggugagaaggagc

SEQ ID NO: 1111725 - RNA, 22 nt, Human
ucacaugcccuguauuuaccag

SEQ ID NO: 1111726 - RNA, 22 nt, Human
cagucacacaaguggacuuggg

SEQ ID NO: 1111727 - RNA, 22 nt, Human
uggcuggacagugggcagugga

SEQ ID NO: 1111728 - RNA, 22 nt, Human
cucccuggcacagcgagagguu

SEQ ID NO: 1111729 - RNA, 22 nt, Human
aagagcugcccaaggugaacag

SEQ ID NO: 1111730 - RNA, 22 nt, Human
ucugccagugguuuggcccuga

SEQ ID NO: 1111731 - RNA, 22 nt, Human
acagagcauuugggacagagag

SEQ ID NO: 1111732 - RNA, 22 nt, Human
uggaggagggcuggugucugua

SEQ ID NO: 1111733 - RNA, 22 nt, Human
acaugcaugucuaugggcaggu

SEQ ID NO: 1111734 - RNA, 22 nt, Human
cccucccagaugggcuugaggu

SEQ ID NO: 1111735 - RNA, 20 nt, Human
cucaggauugucuagccccu

SEQ ID NO: 1111736 - RNA, 22 nt, Human
agagcugagaauguggcuuccu

SEQ ID NO: 1111737 - RNA, 22 nt, Human
gcacacccucucaccagcacug

SEQ ID NO: 1111738 - RNA, 22 nt, Human
ggaccagagcucgggcuucuca

SEQ ID NO: 1111739 - RNA, 22 nt, Human
aucuggcucuuccuggaguucc

SEQ ID NO: 1111740 - RNA, 22 nt, Human
ucaaaguaaaaguauagaguuu

SEQ ID NO: 1111741 - RNA, 22 nt, Human
agaaauuccuaagguacacaag

SEQ ID NO: 1111742 - RNA, 22 nt, Human
ucauucuccucuggaaaaggca

SEQ ID NO: 1111743 - RNA, 22 nt, Human
agggacacugaugagaaauucu

SEQ ID NO: 1111744 - RNA, 19 nt, Human
ggcagaagguguaggggga

SEQ ID NO: 1111745 - RNA, 22 nt, Human
gcacagaacagagaaauagcca

SEQ ID NO: 1111746 - RNA, 22 nt, Human
gcagaggcuccauuuuacagau

SEQ ID NO: 1111747 - RNA, 22 nt, Human
gaaaugcaaauucucucucgcu

SEQ ID NO: 1111748 - RNA, 22 nt, Human
gggcuaggcuuggccagcacug

SEQ ID NO: 1111749 - RNA, 22 nt, Human
ccaggcagcucugauuuauguc

SEQ ID NO: 1111750 - RNA, 22 nt, Human
cagugcaugaaacaauaugcag

SEQ ID NO: 1111751 - RNA, 22 nt, Human
augcaguaaaauaggagguaau

SEQ ID NO: 1111752 - RNA, 22 nt, Human
agggggcaggagagaccugcug

SEQ ID NO: 1111753 - RNA, 22 nt, Human
aggggcugcuggguccgccccu

SEQ ID NO: 1111754 - RNA, 22 nt, Human
uggacagguugaguaggaggag

SEQ ID NO: 1111755 - RNA, 22 nt, Human
aagcgccacgagaagcuggacc

SEQ ID NO: 1111756 - RNA, 22 nt, Human
cucugagaggugagaagcagca

SEQ ID NO: 1111757 - RNA, 22 nt, Human
ugggcagauuaaugcaguggcu

SEQ ID NO: 1111758 - RNA, 22 nt, Human
ugugucagagguagagauggca

SEQ ID NO: 1111759 - RNA, 19 nt, Human
ggcccaaguacugagugcc

SEQ ID NO: 1111760 - RNA, 20 nt, Human
cuguccccgaggucaccagg

SEQ ID NO: 1111761 - RNA, 22 nt, Human
gcccuuccaacccagagggcaa

SEQ ID NO: 1111762 - RNA, 22 nt, Human
uugaaagggauauaucuuucug

SEQ ID NO: 1111763 - RNA, 22 nt, Human
augauugaccaucugcugggcu

SEQ ID NO: 1111764 - RNA, 21 nt, Human
aacaaagggaugcucaucuuu

SEQ ID NO: 1111765 - RNA, 22 nt, Human
ggcugcugcccaccccugcaug

SEQ ID NO: 1111766 - RNA, 22 nt, Human
guggaggagaggcgccuugcgg

SEQ ID NO: 1111767 - RNA, 22 nt, Human
cuuccaaacccaggguaugggc

SEQ ID NO: 1111768 - RNA, 17 nt, Human
ugguggcuggagucagg

SEQ ID NO: 1111769 - RNA, 22 nt, Human
ccugagugaauucccucacugu

SEQ ID NO: 1111770 - RNA, 22 nt, Human
ucacauuuuaucuauuuuaagu

SEQ ID NO: 1111771 - RNA, 22 nt, Human
aaggcccuggcaggaagcagga

SEQ ID NO: 1111772 - RNA, 20 nt, Human
gucagugucuucaguaguga

SEQ ID NO: 1111773 - RNA, 22 nt, Human
acaagagacaagagguucuucu

SEQ ID NO: 1111774 - RNA, 22 nt, Human
ccagcagaggggcggagugcag

SEQ ID NO: 1111775 - RNA, 22 nt, Human
agguggguaucaugagagauua

SEQ ID NO: 1111776 - RNA, 22 nt, Human
ucuuugcaggagcccuuugaac

SEQ ID NO: 1111777 - RNA, 22 nt, Human
gaggacagugugaucugccagc

SEQ ID NO: 1111778 - RNA, 22 nt, Human
cccucaggagaugucagcugga

SEQ ID NO: 1111779 - RNA, 22 nt, Human
ccuggaggagcgcugaccagcu

SEQ ID NO: 1111780 - RNA, 22 nt, Human
gaugguuugguaaaaguauguu

SEQ ID NO: 1111781 - RNA, 22 nt, Human
gcucaagagagaugcaguucuu

SEQ ID NO: 1111782 - RNA, 22 nt, Human
agugggcagugcgcucggaugc

SEQ ID NO: 1111783 - RNA, 18 nt, Human
caggucagccuggccuca

SEQ ID NO: 1111784 - RNA, 21 nt, Human
aaggagccuaggaggcucagg

SEQ ID NO: 1111785 - RNA, 22 nt, Human
cagaagcacuaggaggaaacgu

SEQ ID NO: 1111786 - RNA, 22 nt, Human
cccugggcaagcccuauuuucc

SEQ ID NO: 1111787 - RNA, 22 nt, Human
agaggaugauuuuaaggacacu

SEQ ID NO: 1111788 - RNA, 22 nt, Human
uaggcagggauuaggguugauu

SEQ ID NO: 1111789 - RNA, 22 nt, Human
cucuccuggggagcacacacac

SEQ ID NO: 1111790 - RNA, 22 nt, Human
agcagggcuuugcagacuuggg

SEQ ID NO: 1111791 - RNA, 22 nt, Human
agaaugcaguuugaaauaaggu

SEQ ID NO: 1111792 - RNA, 22 nt, Human
ugagcuuccucccugcauccau

SEQ ID NO: 1111793 - RNA, 22 nt, Human
agggaaaguaagcauuucauua

SEQ ID NO: 1111794 - RNA, 21 nt, Human
agcugggccucagccugcagu

SEQ ID NO: 1111795 - RNA, 22 nt, Human
uggcucagugacauuccuccca

SEQ ID NO: 1111796 - RNA, 22 nt, Human
ggcagcuguaagaugagugaau

SEQ ID NO: 1111797 - RNA, 19 nt, Human
ugggccugcaucugggucu

SEQ ID NO: 1111798 - RNA, 22 nt, Human
ggaggaccccagcagcucccca

SEQ ID NO: 1111799 - RNA, 22 nt, Human
ugggcagaucuuugguggcuag

SEQ ID NO: 1111800 - RNA, 22 nt, Human
uuaaguccuugguaauuuucuu

SEQ ID NO: 1111801 - RNA, 22 nt, Human
gcauggcagugaggauggugcu

SEQ ID NO: 1111802 - RNA, 22 nt, Human
ucacaggguaucugggauggau

SEQ ID NO: 1111803 - RNA, 18 nt, Human
ccuggcagccaugcgcgc

SEQ ID NO: 1111804 - RNA, 22 nt, Human
uacuuucuagcucuccccaguu

SEQ ID NO: 1111805 - RNA, 22 nt, Human
ggguggaggagaacaggcccca

SEQ ID NO: 1111806 - RNA, 19 nt, Human
ccucccacggauuccuucc

SEQ ID NO: 1111807 - RNA, 22 nt, Human
auaguaacuggcauguuuauga

SEQ ID NO: 1111808 - RNA, 22 nt, Human
gauggcacacagacauccccgc

SEQ ID NO: 1111809 - RNA, 22 nt, Human
gugagcaggauuucauggugua

SEQ ID NO: 1111810 - RNA, 22 nt, Human
aucaguuugauaauaaggcuug

SEQ ID NO: 1111811 - RNA, 22 nt, Human
ggcaggcuggcuuuguuccagg

SEQ ID NO: 1111812 - RNA, 22 nt, Human
uggcucuguuuuaugaguacca

SEQ ID NO: 1111813 - RNA, 22 nt, Human
ccacugucagaggggcugugcc

SEQ ID NO: 1111814 - RNA, 22 nt, Human
uacaaaguauauuucuagcugu

SEQ ID NO: 1111815 - RNA, 22 nt, Human
auagaaauggcagcuggugcua

SEQ ID NO: 1111816 - RNA, 22 nt, Human
cagaggccuuucuacagugaua

SEQ ID NO: 1111817 - RNA, 22 nt, Human
ucuggcucacuucaggcuucac

SEQ ID NO: 1111818 - RNA, 22 nt, Human
ugcaauaaggaguaauaguaaa

SEQ ID NO: 1111819 - RNA, 22 nt, Human
gcagugccuugcuucucugucu

SEQ ID NO: 1111820 - RNA, 22 nt, Human
aagauacauaaagguagagucu

SEQ ID NO: 1111821 - RNA, 21 nt, Human
ucacaugcccauuacuggagc

SEQ ID NO: 1111822 - RNA, 22 nt, Human
ggaggcaggaaagacagguuca

SEQ ID NO: 1111823 - RNA, 22 nt, Human
cugucaccuguucacugcagca

SEQ ID NO: 1111824 - RNA, 22 nt, Human
ccugaggcuuaaucugucccaa

SEQ ID NO: 1111825 - RNA, 22 nt, Human
uugaagcauuguggcuuguauu

SEQ ID NO: 1111826 - RNA, 19 nt, Human
ugucuuaauuaacucagag

SEQ ID NO: 1111827 - RNA, 22 nt, Human
ugagccuggcggaagcagcgug

SEQ ID NO: 1111828 - RNA, 22 nt, Human
cagcugcccauccugggaaaug

SEQ ID NO: 1111829 - RNA, 22 nt, Human
uaaggcauucucaugcugugaa

SEQ ID NO: 1111830 - RNA, 22 nt, Human
uagggcuauaagagaauaagac

SEQ ID NO: 1111831 - RNA, 22 nt, Human
ggcagccauggacacuggcuag

SEQ ID NO: 1111832 - RNA, 22 nt, Human
ggcagcaguccauggcccaagg

SEQ ID NO: 1111833 - RNA, 20 nt, Human
ccagagcagccacugaaguu

SEQ ID NO: 1111834 - RNA, 22 nt, Human
cugcagcugucucuacugggca

SEQ ID NO: 1111835 - RNA, 22 nt, Human
gaggcagcaugguaccuuggag

SEQ ID NO: 1111836 - RNA, 22 nt, Human
agccuggagcuugaguuaugag

SEQ ID NO: 1111837 - RNA, 19 nt, Human
caaggguugggucugucau

SEQ ID NO: 1111838 - RNA, 22 nt, Human
ggguggggcccaggaaaucuau

SEQ ID NO: 1111839 - RNA, 22 nt, Human
ggagaguggauuccagcuguau

SEQ ID NO: 1111840 - RNA, 22 nt, Human
ucuuugcagaauuuaacuuugc

SEQ ID NO: 1111841 - RNA, 22 nt, Human
cagucacauugcccugcauuua

SEQ ID NO: 1111842 - RNA, 22 nt, Human
caggcugcagcagcaguggccc

SEQ ID NO: 1111843 - RNA, 22 nt, Human
gcuggccacauugugccguccu

SEQ ID NO: 1111844 - RNA, 21 nt, Human
gcagcagaggcuugacagaca

SEQ ID NO: 1111845 - RNA, 22 nt, Human
auuucacucucccugccacuua

SEQ ID NO: 1111846 - RNA, 22 nt, Human
gggcucuguccauuccuucaua

SEQ ID NO: 1111847 - RNA, 22 nt, Human
cagagcugcucaugguggccag

SEQ ID NO: 1111848 - RNA, 22 nt, Human
ggcugccuugacccuggcuccg

SEQ ID NO: 1111849 - RNA, 22 nt, Human
uccugccucuuuucuuauucca

SEQ ID NO: 1111850 - RNA, 22 nt, Human
agugucauaugccacugcaucc

SEQ ID NO: 1111851 - RNA, 22 nt, Human
cccuggcaaaacacucucuuga

SEQ ID NO: 1111852 - RNA, 22 nt, Human
gcugaagcugcagcaggaggaa

SEQ ID NO: 1111853 - RNA, 22 nt, Human
caugcacaaagguaagaugcgu

SEQ ID NO: 1111854 - RNA, 22 nt, Human
agggcugccugacuccagagcc

SEQ ID NO: 1111855 - RNA, 22 nt, Human
aaauguguguauguacauauau

SEQ ID NO: 1111856 - RNA, 22 nt, Human
ucugcaggccucgacaaggcca

SEQ ID NO: 1111857 - RNA, 22 nt, Human
augauuuccaguuguugcuaag

SEQ ID NO: 1111858 - RNA, 22 nt, Human
gagggcugauaaaugcgcaugg

SEQ ID NO: 1111859 - RNA, 22 nt, Human
gccugucugcgucacgcuuauu

SEQ ID NO: 1111860 - RNA, 22 nt, Human
auucuccacacauccagaccuu

SEQ ID NO: 1111861 - RNA, 22 nt, Human
cugagcuuccaguuccuccagg

SEQ ID NO: 1111862 - RNA, 21 nt, Human
agcugcuuucagcuccuagag

SEQ ID NO: 1111863 - RNA, 22 nt, Human
caaaggcaguuacugaaugaag

SEQ ID NO: 1111864 - RNA, 22 nt, Human
cccagguggcagaagcugcagu

SEQ ID NO: 1111865 - RNA, 22 nt, Human
ccagcaccuugaucuuggaguu

SEQ ID NO: 1111866 - RNA, 22 nt, Human
ugagguaggugguaagagauac

SEQ ID NO: 1111867 - RNA, 23 nt, Human
aguacauucgaaaaauucuguga

SEQ ID NO: 1111868 - RNA, 22 nt, Human
uggcucagaaggcugccuucac

SEQ ID NO: 1111869 - RNA, 22 nt, Human
gguggccucugcaggccucgac

SEQ ID NO: 1111870 - RNA, 22 nt, Human
gccugcaguucugugcuaggca

SEQ ID NO: 1111871 - RNA, 22 nt, Human
uguguacucaauugagccauuu

SEQ ID NO: 1111872 - RNA, 22 nt, Human
gcugccucccccauggcuggaa

SEQ ID NO: 1111873 - RNA, 22 nt, Human
cauuucugggagacaugcuaga

SEQ ID NO: 1111874 - RNA, 22 nt, Human
gggggcuggaauauccaucaac

SEQ ID NO: 1111875 - RNA, 19 nt, Human
ucaaagcaagcauguucug

SEQ ID NO: 1111876 - RNA, 22 nt, Human
cagacagacagccguggccacc

SEQ ID NO: 1111877 - RNA, 22 nt, Human
ccucugggugggaggccgggcg

SEQ ID NO: 1111878 - RNA, 22 nt, Human
cccugccuuguuggagccuaug

SEQ ID NO: 1111879 - RNA, 22 nt, Human
acagagguguuccagaccuagg

SEQ ID NO: 1111880 - RNA, 22 nt, Human
aagugacaccucuucccuuucc

SEQ ID NO: 1111881 - RNA, 22 nt, Human
gaggggcagaaugugaucaggg

SEQ ID NO: 1111882 - RNA, 22 nt, Human
ugacagaaugugacucucagau

SEQ ID NO: 1111883 - RNA, 22 nt, Human
ggccuuggggaggauggugucc

SEQ ID NO: 1111884 - RNA, 22 nt, Human
auuaaaagcuucccaagaguua

SEQ ID NO: 1111885 - RNA, 22 nt, Human
aaagaacaauguggaaucuccu

SEQ ID NO: 1111886 - RNA, 22 nt, Human
uuacauuuggcuauguccucua

SEQ ID NO: 1111887 - RNA, 22 nt, Human
auuugucucugcacuuuacuca

SEQ ID NO: 1111888 - RNA, 22 nt, Human
augcaguacugauacaugccac

SEQ ID NO: 1111889 - RNA, 22 nt, Human
auugucuucuggucuuaucuuu

SEQ ID NO: 1111890 - RNA, 22 nt, Human
agggaggagaauggacuccuuc

SEQ ID NO: 1111891 - RNA, 22 nt, Human
ugggcagaggcucugaagucca

SEQ ID NO: 1111892 - RNA, 22 nt, Human
aaggcacucagccuugggacag

SEQ ID NO: 1111893 - RNA, 18 nt, Human
uuaagagcugaaagggga

SEQ ID NO: 1111894 - RNA, 22 nt, Human
ugucacagggauaccauggggc

SEQ ID NO: 1111895 - RNA, 22 nt, Human
caggcagcgcucguggccuggc

SEQ ID NO: 1111896 - RNA, 21 nt, Human
uuagcaaagcaaacacaugcu

SEQ ID NO: 1111897 - RNA, 22 nt, Human
ggccuggcauggggacuaaggg

SEQ ID NO: 1111898 - RNA, 22 nt, Human
uggcucagaguucaucuuuuag

SEQ ID NO: 1111899 - RNA, 21 nt, Human
uuacuuuugcaccaaccuaau

SEQ ID NO: 1111900 - RNA, 22 nt, Human
uuguuucauggggauguuuauu

SEQ ID NO: 1111901 - RNA, 22 nt, Human
gaaaugugugacaaguuucaau

SEQ ID NO: 1111902 - RNA, 22 nt, Human
gacagcauggugucuguucagg

SEQ ID NO: 1111903 - RNA, 22 nt, Human
agcagaacauuuucagggcugu

SEQ ID NO: 1111904 - RNA, 22 nt, Human
gacuguguccaugugcuggauu

SEQ ID NO: 1111905 - RNA, 22 nt, Human
ggcucaggaccugggauugcca

SEQ ID NO: 1111906 - RNA, 22 nt, Human
ucaguguagcagacuuguagcc

SEQ ID NO: 1111907 - RNA, 22 nt, Human
cugucagguuggucucagagcu

SEQ ID NO: 1111908 - RNA, 17 nt, Human
ucagcaaagacaaagga

SEQ ID NO: 1111909 - RNA, 22 nt, Human
caggcacagaguuauucauuua

SEQ ID NO: 1111910 - RNA, 22 nt, Human
cucuggaauuaaggaagccugu

SEQ ID NO: 1111911 - RNA, 22 nt, Human
acuccugguuuguguccuggcu

SEQ ID NO: 1111912 - RNA, 22 nt, Human
ggugaggcccagugaucugugu

SEQ ID NO: 1111913 - RNA, 22 nt, Human
caggggcucugagauugucuaa

SEQ ID NO: 1111914 - RNA, 22 nt, Human
uccagggagauacuggcugcca

SEQ ID NO: 1111915 - RNA, 21 nt, Human
ugcugccauagaccugaggga

SEQ ID NO: 1111916 - RNA, 22 nt, Human
cacagggcaggccccaggccuc

SEQ ID NO: 1111917 - RNA, 18 nt, Human
ucucagaggccauccuag

SEQ ID NO: 1111918 - RNA, 22 nt, Human
ccuucagaccuagacaggaauc

SEQ ID NO: 1111919 - RNA, 21 nt, Human
ggcuccugcuuugugaggggc

SEQ ID NO: 1111920 - RNA, 22 nt, Human
ggccuuggugccauggccaguu

SEQ ID NO: 1111921 - RNA, 22 nt, Human
gagguagccacagauagagacu

SEQ ID NO: 1111922 - RNA, 21 nt, Human
agaaauguaucauucuuuucc

SEQ ID NO: 1111923 - RNA, 22 nt, Human
caggcuggagugaguguagugg

SEQ ID NO: 1111924 - RNA, 22 nt, Human
gcuuccugagaaacaaucugau

SEQ ID NO: 1111925 - RNA, 22 nt, Human
cuggccaacuugcuuguuggca

SEQ ID NO: 1111926 - RNA, 21 nt, Human
ggagucagggucuggcugggg

SEQ ID NO: 1111927 - RNA, 22 nt, Human
ggagccagaggcugcugcugug

SEQ ID NO: 1111928 - RNA, 22 nt, Human
agcauuuauuucuuagaaauug

SEQ ID NO: 1111929 - RNA, 18 nt, Human
acauacauucugucugca

SEQ ID NO: 1111930 - RNA, 22 nt, Human
acugcagcaaagcccgugucuu

SEQ ID NO: 1111931 - RNA, 22 nt, Human
aagcagcauaauugcuauuuua

SEQ ID NO: 1111932 - RNA, 22 nt, Human
aggagccaugagugacaucaca

SEQ ID NO: 1111933 - RNA, 23 nt, Human
cuccucguaacucuguggugggu

SEQ ID NO: 1111934 - RNA, 22 nt, Human
ugcagaagcagagaguugccaa

SEQ ID NO: 1111935 - RNA, 22 nt, Human
acagccauagaugcuuauguaa

SEQ ID NO: 1111936 - RNA, 22 nt, Human
gaaaguuuauagguuauauaau

SEQ ID NO: 1111937 - RNA, 22 nt, Human
acuggcaguuugagaaugcauu

SEQ ID NO: 1111938 - RNA, 22 nt, Human
gugugccaccagucaaggugaa

SEQ ID NO: 1111939 - RNA, 22 nt, Human
aagacccacaaggcugaauguu

SEQ ID NO: 1111940 - RNA, 22 nt, Human
cauugacaucaggcuuggccaa

SEQ ID NO: 1111941 - RNA, 22 nt, Human
gccuaauaacuagcuguguaac

SEQ ID NO: 1111942 - RNA, 22 nt, Human
cucugcugcccaggccugcuag

SEQ ID NO: 1111943 - RNA, 22 nt, Human
gacaggaggcagagcucaggug

SEQ ID NO: 1111944 - RNA, 22 nt, Human
aggcucagcaucugauucauau

SEQ ID NO: 1111945 - RNA, 22 nt, Human
uggacaggugagugacucaggg

SEQ ID NO: 1111946 - RNA, 22 nt, Human
aggcuggcuggcaggggacaca

SEQ ID NO: 1111947 - RNA, 22 nt, Human
ugccugaggagucagggcaggu

SEQ ID NO: 1111948 - RNA, 22 nt, Human
agagugauggguugugcugacc

SEQ ID NO: 1111949 - RNA, 23 nt, Human
aggcuuccuaucuuagagcuggg

SEQ ID NO: 1111950 - RNA, 22 nt, Human
caaaugcuaacuucuuuccaaa

SEQ ID NO: 1111951 - RNA, 22 nt, Human
acuacuuugggccauuuguuua

SEQ ID NO: 1111952 - RNA, 22 nt, Human
uggcucaguuucaguccugguu

SEQ ID NO: 1111953 - RNA, 22 nt, Human
ccaggcugcucacaagcugccc

SEQ ID NO: 1111954 - RNA, 22 nt, Human
aaggucauuuaacaauuuauga

SEQ ID NO: 1111955 - RNA, 22 nt, Human
uuguguccugauuugacacaau

SEQ ID NO: 1111956 - RNA, 22 nt, Human
uccugccuagcaggugaccuau

SEQ ID NO: 1111957 - RNA, 22 nt, Human
uuucauaugggcauuggcaaua

SEQ ID NO: 1111958 - RNA, 21 nt, Human
ccaggcagagcugugaguucu

SEQ ID NO: 1111959 - RNA, 22 nt, Human
aagucacacuagacaacugagg

SEQ ID NO: 1111960 - RNA, 22 nt, Human
aaaaucaguacacuuuauuuug

SEQ ID NO: 1111961 - RNA, 22 nt, Human
aauuugcaugaugagaacaaua

SEQ ID NO: 1111962 - RNA, 22 nt, Human
ccacaggggucucuguagcuga

SEQ ID NO: 1111963 - RNA, 22 nt, Human
ugccucagcugaggccgcucca

SEQ ID NO: 1111964 - RNA, 22 nt, Human
uugaaggacaucuuguuucuag

SEQ ID NO: 1111965 - RNA, 17 nt, Human
auuuccucagggcugag

SEQ ID NO: 1111966 - RNA, 22 nt, Human
ccacagggaacaugacagccuu

SEQ ID NO: 1111967 - RNA, 22 nt, Human
gccacugcacuccagcccaggc

SEQ ID NO: 1111968 - RNA, 22 nt, Human
acacugaagagcacuuucaaag

SEQ ID NO: 1111969 - RNA, 22 nt, Human
ugccaggagagugcaugcaggg

SEQ ID NO: 1111970 - RNA, 22 nt, Human
acaaagucugaaaccugaggca

SEQ ID NO: 1111971 - RNA, 22 nt, Human
ggagagaaauugagguagcaag

SEQ ID NO: 1111972 - RNA, 22 nt, Human
uuuggaaaguugucacuuuaga

SEQ ID NO: 1111973 - RNA, 22 nt, Human
cacagcugccauggcugcacuu

SEQ ID NO: 1111974 - RNA, 22 nt, Human
uggaccugcuggaugggcaggu

SEQ ID NO: 1111975 - RNA, 22 nt, Human
ucugucacccagagugcagugg

SEQ ID NO: 1111976 - RNA, 19 nt, Human
uguuuuguuaaagcagucc

SEQ ID NO: 1111977 - RNA, 22 nt, Human
aaauuguugaucuacaguaagg

SEQ ID NO: 1111978 - RNA, 22 nt, Human
auguaacaggugaagcucugag

SEQ ID NO: 1111979 - RNA, 22 nt, Human
gccaggcuggugucacaacucu

SEQ ID NO: 1111980 - RNA, 22 nt, Human
uggaagcagugauucuugucug

SEQ ID NO: 1111981 - RNA, 22 nt, Human
auugaaagagaauguagcucuu

SEQ ID NO: 1111982 - RNA, 22 nt, Human
gaggagcuggcagcgucuccgc

SEQ ID NO: 1111983 - RNA, 22 nt, Human
augugugccccuuuuacucuuu

SEQ ID NO: 1111984 - RNA, 22 nt, Human
uggccuggcagagcaaggccug

SEQ ID NO: 1111985 - RNA, 22 nt, Human
agcugccaccucugccuuuggg

SEQ ID NO: 1111986 - RNA, 20 nt, Human
gcugccuguuucuguaagua

SEQ ID NO: 1111987 - RNA, 22 nt, Human
ucucacugggucacagcagagg

SEQ ID NO: 1111988 - RNA, 22 nt, Human
acauuuaaauaccuauguuucu

SEQ ID NO: 1111989 - RNA, 22 nt, Human
ccucucauagucuguauccuuu

SEQ ID NO: 1111990 - RNA, 22 nt, Human
agcugucuaccugcagaguccu

SEQ ID NO: 1111991 - RNA, 22 nt, Human
gagccugaauuugaccugcuua

SEQ ID NO: 1111992 - RNA, 22 nt, Human
ccuuuggguucaaucucggucu

SEQ ID NO: 1111993 - RNA, 22 nt, Human
uguguuccuucgucuucccuuc

SEQ ID NO: 1111994 - RNA, 22 nt, Human
ggucucuguugccuccaucaag

SEQ ID NO: 1111995 - RNA, 22 nt, Human
aagccaggaagagagccuucac

SEQ ID NO: 1111996 - RNA, 22 nt, Human
ucugaggcauaaccuguucugc

SEQ ID NO: 1111997 - RNA, 22 nt, Human
gcagugguggagcuuacauauc

SEQ ID NO: 1111998 - RNA, 22 nt, Human
cagggcagggauguugcggcag

SEQ ID NO: 1111999 - RNA, 22 nt, Human
accagagaaaacacagcaggcu

SEQ ID NO: 1112000 - RNA, 22 nt, Human
uaaauucugaucaaguuccuuc

SEQ ID NO: 1112001 - RNA, 20 nt, Human
cugggcagguguuugaucuc

SEQ ID NO: 1112002 - RNA, 22 nt, Human
guggccuggaugagcuucgaca

SEQ ID NO: 1112003 - RNA, 22 nt, Human
uaacagaaauauuuccagguga

SEQ ID NO: 1112004 - RNA, 22 nt, Human
ugucucugagaugacucccacc

SEQ ID NO: 1112005 - RNA, 22 nt, Human
cuagaaaaauacuuuauuguga

SEQ ID NO: 1112006 - RNA, 22 nt, Human
agauuucccacuccauguauug

SEQ ID NO: 1112007 - RNA, 22 nt, Human
agcagggcugcagugugucuuu

SEQ ID NO: 1112008 - RNA, 22 nt, Human
gguuugcacgauauuuccaugg

SEQ ID NO: 1112009 - RNA, 22 nt, Human
cagcagcucccauccgcugagc

SEQ ID NO: 1112010 - RNA, 22 nt, Human
agcucacaguguccuuccucaa

SEQ ID NO: 1112011 - RNA, 22 nt, Human
aaucaguuagaaggaagagaau

SEQ ID NO: 1112012 - RNA, 18 nt, Human
acauuucucucugcguga

SEQ ID NO: 1112013 - RNA, 22 nt, Human
cagcagcuucuguugaucagaa

SEQ ID NO: 1112014 - RNA, 22 nt, Human
caggugcccagcuccugcugug

SEQ ID NO: 1112015 - RNA, 22 nt, Human
cugcuuugaaaauaaacuuguc

SEQ ID NO: 1112016 - RNA, 22 nt, Human
aacaggagaguaaauauaugau

SEQ ID NO: 1112017 - RNA, 22 nt, Human
uggaaagaugaagauguuuaag

SEQ ID NO: 1112018 - RNA, 22 nt, Human
uggccaggggaguuccccucca

SEQ ID NO: 1112019 - RNA, 22 nt, Human
cuggccugggagcugcuagcgu

SEQ ID NO: 1112020 - RNA, 22 nt, Human
aaaugcacugaacacauguugu

SEQ ID NO: 1112021 - RNA, 22 nt, Human
aggcugggcuccgcccaacucc

SEQ ID NO: 1112022 - RNA, 22 nt, Human
ucagcugccucucccuggaaga

SEQ ID NO: 1112023 - RNA, 22 nt, Human
cccugaggggaguggugaggug

SEQ ID NO: 1112024 - RNA, 22 nt, Human
uggcugaauaaaauaugguguu

SEQ ID NO: 1112025 - RNA, 22 nt, Human
caagggccuccaccuugcucgu

SEQ ID NO: 1112026 - RNA, 22 nt, Human
agcuccugaaaagcgcuugcuu

SEQ ID NO: 1112027 - RNA, 19 nt, Human
ucccgcccacugagcgugc

SEQ ID NO: 1112028 - RNA, 22 nt, Human
cugcaggauucucccaguugga

SEQ ID NO: 1112029 - RNA, 22 nt, Human
ggccugcuuuccgagccugcag

SEQ ID NO: 1112030 - RNA, 22 nt, Human
ggagagugggagcaacuguugc

SEQ ID NO: 1112031 - RNA, 22 nt, Human
cugggacagcugagacaggaga

SEQ ID NO: 1112032 - RNA, 22 nt, Human
ucucagagagaugaaacuucca

SEQ ID NO: 1112033 - RNA, 22 nt, Human
cuggagagaccgaaagaggcug

SEQ ID NO: 1112034 - RNA, 22 nt, Human
gcagagccgugaauggauuuca

SEQ ID NO: 1112035 - RNA, 22 nt, Human
agagugaaguucaucgugcagc

SEQ ID NO: 1112036 - RNA, 22 nt, Human
ccucaggguggcaucagaucuu

SEQ ID NO: 1112037 - RNA, 22 nt, Human
gcacacaggcaguuuccagcca

SEQ ID NO: 1112038 - RNA, 22 nt, Human
aggggacacggcuucuccaggg

SEQ ID NO: 1112039 - RNA, 22 nt, Human
aaugcacagcuaaagugguucc

SEQ ID NO: 1112040 - RNA, 22 nt, Human
cuggcugguuacuauuucuggu

SEQ ID NO: 1112041 - RNA, 22 nt, Human
gaagagcugcucagaacaugau

SEQ ID NO: 1112042 - RNA, 22 nt, Human
cugcccugggauggucugugcg

SEQ ID NO: 1112043 - RNA, 22 nt, Human
aaguucaaggcagguccugagg

SEQ ID NO: 1112044 - RNA, 22 nt, Human
gcccaucaucacuguggaggcu

SEQ ID NO: 1112045 - RNA, 21 nt, Human
ccugcagcaccagaaggagau

SEQ ID NO: 1112046 - RNA, 17 nt, Human
ucuguccagggagugug

SEQ ID NO: 1112047 - RNA, 22 nt, Human
gccagccccuuagggcucuccc

SEQ ID NO: 1112048 - RNA, 22 nt, Human
uucuuuccucccagccuuugga

SEQ ID NO: 1112049 - RNA, 22 nt, Human
ugccugccaugcagaaagcuga

SEQ ID NO: 1112050 - RNA, 22 nt, Human
agguaggguuaauggagauaua

SEQ ID NO: 1112051 - RNA, 22 nt, Human
ugccuggguucccaccccaaag

SEQ ID NO: 1112052 - RNA, 22 nt, Human
ucuuuacaguccucugucaauc

SEQ ID NO: 1112053 - RNA, 22 nt, Human
auucaguucuaaggucagugcc

SEQ ID NO: 1112054 - RNA, 22 nt, Human
ucagagaaguaagguggggugc

SEQ ID NO: 1112055 - RNA, 21 nt, Human
ccaggguccagcugccauggu

SEQ ID NO: 1112056 - RNA, 22 nt, Human
aaaugugugcacaaagacagcu

SEQ ID NO: 1112057 - RNA, 22 nt, Human
ucccaaggcacagggcagggac

SEQ ID NO: 1112058 - RNA, 22 nt, Human
cugggagucuggccucuggucc

SEQ ID NO: 1112059 - RNA, 22 nt, Human
cagcauggagacaaagugggca

SEQ ID NO: 1112060 - RNA, 16 nt, Human
ugggcagaugagaaga

SEQ ID NO: 1112061 - RNA, 20 nt, Human
ugcuggggacauacagggug

SEQ ID NO: 1112062 - RNA, 22 nt, Human
uccaucagauucccuccugaga

SEQ ID NO: 1112063 - RNA, 22 nt, Human
agaaauguacgauguuaugcag

SEQ ID NO: 1112064 - RNA, 22 nt, Human
aaaugugcuugugaucagcugu

SEQ ID NO: 1112065 - RNA, 21 nt, Human
gggccacaccuucugcagacc

SEQ ID NO: 1112066 - RNA, 22 nt, Human
ugaugcugagccugggacugac

SEQ ID NO: 1112067 - RNA, 17 nt, Human
aggcagcucagaacauc

SEQ ID NO: 1112068 - RNA, 22 nt, Human
uccaggcuagguuuacaggaca

SEQ ID NO: 1112069 - RNA, 22 nt, Human
aaauguguuugauaggaauauu

SEQ ID NO: 1112070 - RNA, 22 nt, Human
cagggguguuuuuggccaggag

SEQ ID NO: 1112071 - RNA, 22 nt, Human
cauuugaugacucaacucauaa

SEQ ID NO: 1112072 - RNA, 22 nt, Human
gugcagugacccuggagagcug

SEQ ID NO: 1112073 - RNA, 22 nt, Human
uuuuccucuguuauuaguguga

SEQ ID NO: 1112074 - RNA, 22 nt, Human
cugcugagguccuugcucagac

SEQ ID NO: 1112075 - RNA, 21 nt, Human
uguucacauggagcagaaugu

SEQ ID NO: 1112076 - RNA, 22 nt, Human
gcugagagugagcacuggauau

SEQ ID NO: 1112077 - RNA, 22 nt, Human
uccagggagauggcagaggcug

SEQ ID NO: 1112078 - RNA, 22 nt, Human
cugcaguguucuggaaugcauu

SEQ ID NO: 1112079 - RNA, 22 nt, Human
aaauguguauaugaaacaugau

SEQ ID NO: 1112080 - RNA, 22 nt, Human
uagccucucuccuccacaaccu

SEQ ID NO: 1112081 - RNA, 22 nt, Human
aguggcagagcugugucuugaa

SEQ ID NO: 1112082 - RNA, 22 nt, Human
aagaauguucuuguagucauga

SEQ ID NO: 1112083 - RNA, 22 nt, Human
cagaguguuucuuugggugggu

SEQ ID NO: 1112084 - RNA, 22 nt, Human
cuuacauuaaguaagagauuga

SEQ ID NO: 1112085 - RNA, 23 nt, Human
agaugaggcuucuccauguuggu

SEQ ID NO: 1112086 - RNA, 22 nt, Human
uugcauaaaugcuuaaaauuug

SEQ ID NO: 1112087 - RNA, 22 nt, Human
ucaguuuuuacggucacaggga

SEQ ID NO: 1112088 - RNA, 22 nt, Human
cagagguagccgagugcaaucg

SEQ ID NO: 1112089 - RNA, 22 nt, Human
augggaggaagagaagaugucu

SEQ ID NO: 1112090 - RNA, 22 nt, Human
uuacaguauuguuaaacucuuu

SEQ ID NO: 1112091 - RNA, 22 nt, Human
uagagcuguaucaaagagccuu

SEQ ID NO: 1112092 - RNA, 22 nt, Human
ucuggcuccguguccgcuccca

SEQ ID NO: 1112093 - RNA, 22 nt, Human
cucccucugucuuguccagaaa

SEQ ID NO: 1112094 - RNA, 22 nt, Human
accagagcuggcucugagcacc

SEQ ID NO: 1112095 - RNA, 22 nt, Human
ucucugggaaugggccugggua

SEQ ID NO: 1112096 - RNA, 22 nt, Human
ucagcaauaugauaggcuuugu

SEQ ID NO: 1112097 - RNA, 22 nt, Human
ggucccaggaagugcggcggcg

SEQ ID NO: 1112098 - RNA, 22 nt, Human
agcugcaggcccaugcucaguc

SEQ ID NO: 1112099 - RNA, 22 nt, Human
gggcaugguggcaggcaccugu

SEQ ID NO: 1112100 - RNA, 18 nt, Human
acaaaggucugcaagacc

SEQ ID NO: 1112101 - RNA, 22 nt, Human
aaguucaagucugcaucuuuuu

SEQ ID NO: 1112102 - RNA, 19 nt, Human
uguggccaugguucagcug

SEQ ID NO: 1112103 - RNA, 22 nt, Human
agcucccauuaucuucugaaac

SEQ ID NO: 1112104 - RNA, 22 nt, Human
ggcaugggagugagcaaccuua

SEQ ID NO: 1112105 - RNA, 22 nt, Human
agaacagaagggaggaaggccu

SEQ ID NO: 1112106 - RNA, 22 nt, Human
aaagcucacaguaauacaaggc

SEQ ID NO: 1112107 - RNA, 22 nt, Human
uggagcaggugccaggugugug

SEQ ID NO: 1112108 - RNA, 22 nt, Human
caggcugcggucggcucugguc

SEQ ID NO: 1112109 - RNA, 22 nt, Human
acagugucaugucguguucccc

SEQ ID NO: 1112110 - RNA, 22 nt, Human
uuagcucagaaaauuuaaacuu

SEQ ID NO: 1112111 - RNA, 22 nt, Human
gguggguauaguuagggccucu

SEQ ID NO: 1112112 - RNA, 22 nt, Human
agcagccaguucucugugguag

SEQ ID NO: 1112113 - RNA, 22 nt, Human
aaagauuuaugaaguucaauua

SEQ ID NO: 1112114 - RNA, 22 nt, Human
uaauguguugaauauuuguaca

SEQ ID NO: 1112115 - RNA, 22 nt, Human
agcccuucaaccugccuacucc

SEQ ID NO: 1112116 - RNA, 22 nt, Human
uccucuggcucuuucccuagga

SEQ ID NO: 1112117 - RNA, 22 nt, Human
uagagaaaagcagggaucagga

SEQ ID NO: 1112118 - RNA, 21 nt, Human
ugagccaggcugacggcugug

SEQ ID NO: 1112119 - RNA, 22 nt, Human
ucagagugguagccuauuuucu

SEQ ID NO: 1112120 - RNA, 22 nt, Human
gaaggccuagggaugcucugcg

SEQ ID NO: 1112121 - RNA, 22 nt, Human
ucagaaaugaucguuauucauu

SEQ ID NO: 1112122 - RNA, 22 nt, Human
gucucccaucguuugugaggaa

SEQ ID NO: 1112123 - RNA, 22 nt, Human
gagugguaggcaguguuaggaa

SEQ ID NO: 1112124 - RNA, 17 nt, Human
ggccuuggggccucagu

SEQ ID NO: 1112125 - RNA, 19 nt, Human
ugucccagacuccgugucu

SEQ ID NO: 1112126 - RNA, 22 nt, Human
gagguagcaugcuggaagggac

SEQ ID NO: 1112127 - RNA, 22 nt, Human
gccuucagcccugacuggccag

SEQ ID NO: 1112128 - RNA, 21 nt, Human
uucaaugaaaacaaagugagg

SEQ ID NO: 1112129 - RNA, 22 nt, Human
agcuggagcuucaagcagguaa

SEQ ID NO: 1112130 - RNA, 22 nt, Human
cagagcaguaaaucuggggcac

SEQ ID NO: 1112131 - RNA, 22 nt, Human
uccuucagauuccugcuucugg

SEQ ID NO: 1112132 - RNA, 22 nt, Human
aacuucuugguccugagcuguu

SEQ ID NO: 1112133 - RNA, 22 nt, Human
aggagguggccugagcgugccc

SEQ ID NO: 1112134 - RNA, 22 nt, Human
gguggagcuggaccaggagagg

SEQ ID NO: 1112135 - RNA, 22 nt, Human
aagauuucugcuccugagagaa

SEQ ID NO: 1112136 - RNA, 22 nt, Human
aagggcugccagggggugccag

SEQ ID NO: 1112137 - RNA, 22 nt, Human
ugcucagggacaauggagaggg

SEQ ID NO: 1112138 - RNA, 21 nt, Human
accucaagcaacaaccaaggu

SEQ ID NO: 1112139 - RNA, 22 nt, Human
aagggaaaucauauggugcagu

SEQ ID NO: 1112140 - RNA, 22 nt, Human
ccagagccuggcaucugcauaa

SEQ ID NO: 1112141 - RNA, 22 nt, Human
ucucagaggugcccuggcaucu

SEQ ID NO: 1112142 - RNA, 22 nt, Human
agccacagcccacaggacucuu

SEQ ID NO: 1112143 - RNA, 22 nt, Human
cugugucccccucagccaggug

SEQ ID NO: 1112144 - RNA, 22 nt, Human
cuuccagagauagggccucaag

SEQ ID NO: 1112145 - RNA, 22 nt, Human
uggcagggccuaccccaauauc

SEQ ID NO: 1112146 - RNA, 22 nt, Human
agggccagaaucccucagucua

SEQ ID NO: 1112147 - RNA, 22 nt, Human
acagcagagacacucaggaggc

SEQ ID NO: 1112148 - RNA, 21 nt, Human
uccuuccuugagguccuuucc

SEQ ID NO: 1112149 - RNA, 22 nt, Human
gugccugugcggacucagggaa

SEQ ID NO: 1112150 - RNA, 23 nt, Human
ccugaagggucaggguccucagc

SEQ ID NO: 1112151 - RNA, 22 nt, Human
aggguagggcccggagacagac

SEQ ID NO: 1112152 - RNA, 22 nt, Human
agaccagcugccucccagggcc

SEQ ID NO: 1112153 - RNA, 22 nt, Human
ggccucgcggcuucugguggcu

SEQ ID NO: 1112154 - RNA, 22 nt, Human
gagagugagauccuccugggga

SEQ ID NO: 1112155 - RNA, 21 nt, Human
ugucagaaauaagcaugugau

SEQ ID NO: 1112156 - RNA, 22 nt, Human
uggacucagaaguguucuuuua

SEQ ID NO: 1112157 - RNA, 22 nt, Human
acauguggucaaucuguguagg

SEQ ID NO: 1112158 - RNA, 22 nt, Human
guaagcaucugucucuucugca

SEQ ID NO: 1112159 - RNA, 22 nt, Human
caggggcuuuuccucuauaagg

SEQ ID NO: 1112160 - RNA, 22 nt, Human
cugcccugaccugccucagagu

SEQ ID NO: 1112161 - RNA, 22 nt, Human
ucuucacaccgggcagcaggaa

SEQ ID NO: 1112162 - RNA, 22 nt, Human
aggguccaucaaggacugcaca

SEQ ID NO: 1112163 - RNA, 20 nt, Human
auugucagccuucagaggag

SEQ ID NO: 1112164 - RNA, 22 nt, Human
ugggugggagcacccugucugg

SEQ ID NO: 1112165 - RNA, 22 nt, Human
cagcugccccuccagggcuggg

SEQ ID NO: 1112166 - RNA, 22 nt, Human
cacagggcuucucauggggugc

SEQ ID NO: 1112167 - RNA, 17 nt, Human
aagauuucauuagcuga

SEQ ID NO: 1112168 - RNA, 19 nt, Human
ccaguagagacagcugcag

SEQ ID NO: 1112169 - RNA, 22 nt, Human
ucccagaggaaauggcagcuga

SEQ ID NO: 1112170 - RNA, 22 nt, Human
ggcucaagcagucugccugccu

SEQ ID NO: 1112171 - RNA, 22 nt, Human
gcccagcugucuggcagggaug

SEQ ID NO: 1112172 - RNA, 22 nt, Human
ugaaaggugacauuucuuggau

SEQ ID NO: 1112173 - RNA, 22 nt, Human
ugggcugcagagcccggccuuc

SEQ ID NO: 1112174 - RNA, 22 nt, Human
auugacaauuagcccuuaggug

SEQ ID NO: 1112175 - RNA, 22 nt, Human
gcagcguggggcugagucagcu

SEQ ID NO: 1112176 - RNA, 22 nt, Human
agcccuccucacaucagcgucc

SEQ ID NO: 1112177 - RNA, 22 nt, Human
aggagccaggaaaccugcucug

SEQ ID NO: 1112178 - RNA, 22 nt, Human
gguggccaggccagcucuggcc

SEQ ID NO: 1112179 - RNA, 22 nt, Human
auguagcagaagauguuuuccu

SEQ ID NO: 1112180 - RNA, 20 nt, Human
cagaccugcacccacuucga

SEQ ID NO: 1112181 - RNA, 22 nt, Human
cacugccuccccaggcuccaca

SEQ ID NO: 1112182 - RNA, 22 nt, Human
agucccagacuccaguuuucug

SEQ ID NO: 1112183 - RNA, 22 nt, Human
gggggcucugacucccucagcu

SEQ ID NO: 1112184 - RNA, 22 nt, Human
gggauggggggaagcguccaug

SEQ ID NO: 1112185 - RNA, 22 nt, Human
gaggccugcuuuggcacucugg

SEQ ID NO: 1112186 - RNA, 22 nt, Human
agccagcaugaagacagaggcc

SEQ ID NO: 1112187 - RNA, 22 nt, Human
uccaagaucuacagcaguuuag

SEQ ID NO: 1112188 - RNA, 22 nt, Human
ucauggcacuuagcacaguccu

SEQ ID NO: 1112189 - RNA, 22 nt, Human
agaaaucugacugcugugcaca

SEQ ID NO: 1112190 - RNA, 19 nt, Human
ucucaauguucagaaagcu

SEQ ID NO: 1112191 - RNA, 20 nt, Human
uaucaaucagaaagaagacu

SEQ ID NO: 1112192 - RNA, 22 nt, Human
ccuccuggugggcgcuucuggc

SEQ ID NO: 1112193 - RNA, 22 nt, Human
ucccagagucuucuccuguaau

SEQ ID NO: 1112194 - RNA, 22 nt, Human
ccugagacaugaaccaggcucc

SEQ ID NO: 1112195 - RNA, 22 nt, Human
aauuucaaacuaauaggaacca

SEQ ID NO: 1112196 - RNA, 22 nt, Human
auaucuuuuagagcaagcuugu

SEQ ID NO: 1112197 - RNA, 22 nt, Human
ucugggcccuaaaccagcucua

SEQ ID NO: 1112198 - RNA, 22 nt, Human
ccugucuggaacauggccuguu

SEQ ID NO: 1112199 - RNA, 22 nt, Human
cugggaggauacacaagaucag

SEQ ID NO: 1112200 - RNA, 22 nt, Human
ucaucaaagucaaagaaugacu

SEQ ID NO: 1112201 - RNA, 22 nt, Human
uaacagaaaggggacagaaaua

SEQ ID NO: 1112202 - RNA, 22 nt, Human
caucugccuaaguggcccuguu

SEQ ID NO: 1112203 - RNA, 20 nt, Human
cugugccuaaaccuccgggu

SEQ ID NO: 1112204 - RNA, 22 nt, Human
uagcagggccaggcugggaacc

SEQ ID NO: 1112205 - RNA, 22 nt, Human
uccucagacacccugcuggcuu

SEQ ID NO: 1112206 - RNA, 22 nt, Human
acucugugugaguagagccugu

SEQ ID NO: 1112207 - RNA, 22 nt, Human
uuuguaaagucuguucugaguu

SEQ ID NO: 1112208 - RNA, 22 nt, Human
uugucugaaagaucauuacauu

SEQ ID NO: 1112209 - RNA, 22 nt, Human
agacaaagaaaccguagaagca

SEQ ID NO: 1112210 - RNA, 23 nt, Human
ccucagcauggcaggagcccagc

SEQ ID NO: 1112211 - RNA, 19 nt, Human
ggucacagggguuacaagg

SEQ ID NO: 1112212 - RNA, 22 nt, Human
gcucugagcacugugcggcugg

SEQ ID NO: 1112213 - RNA, 22 nt, Human
cugagcuuggccaggaaugaau

SEQ ID NO: 1112214 - RNA, 22 nt, Human
caguggaggcucaagugugcuu

SEQ ID NO: 1112215 - RNA, 22 nt, Human
ggaggugguggcagugacaauu

SEQ ID NO: 1112216 - RNA, 22 nt, Human
cacacuagucuauccauuagcu

SEQ ID NO: 1112217 - RNA, 22 nt, Human
uaugcacaauaugaucuauuug

SEQ ID NO: 1112218 - RNA, 22 nt, Human
uccucugcuccaucuuuacugu

SEQ ID NO: 1112219 - RNA, 22 nt, Human
ugcauauuuuauaaagauggaa

SEQ ID NO: 1112220 - RNA, 22 nt, Human
cagaggcugcucuggguggcau

SEQ ID NO: 1112221 - RNA, 22 nt, Human
acaguuucuccauuuacaccuu

SEQ ID NO: 1112222 - RNA, 19 nt, Human
cgcaggagccgaggugacc

SEQ ID NO: 1112223 - RNA, 22 nt, Human
ccucagggucugaggagaccgu

SEQ ID NO: 1112224 - RNA, 22 nt, Human
ugccaggcccagcuccagagcu

SEQ ID NO: 1112225 - RNA, 22 nt, Human
cagcucugaggaacacuccuuu

SEQ ID NO: 1112226 - RNA, 22 nt, Human
cugaagccacgauagcuuccua

SEQ ID NO: 1112227 - RNA, 22 nt, Human
gugucaugggguuuguuauaca

SEQ ID NO: 1112228 - RNA, 22 nt, Human
gugcaugugucuuuauaguagc

SEQ ID NO: 1112229 - RNA, 23 nt, Human
aaagacugcugagaauuuuagga

SEQ ID NO: 1112230 - RNA, 22 nt, Human
ggccagaggccacagcuguguc

SEQ ID NO: 1112231 - RNA, 22 nt, Human
gugggacucuucuuuggcagug

SEQ ID NO: 1112232 - RNA, 20 nt, Human
uguucacaguaguugcugcu

SEQ ID NO: 1112233 - RNA, 21 nt, Human
aggugcagagccagggaccag

SEQ ID NO: 1112234 - RNA, 22 nt, Human
ggguccagacacuccagaggaa

SEQ ID NO: 1112235 - RNA, 22 nt, Human
cagaccuggaaaacaggcuugc

SEQ ID NO: 1112236 - RNA, 22 nt, Human
cuucucucugcauaggcauggg

SEQ ID NO: 1112237 - RNA, 22 nt, Human
uuccauaauaaccugagagaaa

SEQ ID NO: 1112238 - RNA, 22 nt, Human
acuccuggggcugccaucacag

SEQ ID NO: 1112239 - RNA, 22 nt, Human
gaaggaaaaauacucuguaagg

SEQ ID NO: 1112240 - RNA, 22 nt, Human
uucagagaugacaccugguguu

SEQ ID NO: 1112241 - RNA, 22 nt, Human
ucaguuuucauuucaugagcag

SEQ ID NO: 1112242 - RNA, 22 nt, Human
augcugaggacaaagagaucaa

SEQ ID NO: 1112243 - RNA, 22 nt, Human
ccuggagcaggagcugcagagg

SEQ ID NO: 1112244 - RNA, 22 nt, Human
uccagaggcuccaaagggagau

SEQ ID NO: 1112245 - RNA, 22 nt, Human
cccugcaggggaccugcagccu

SEQ ID NO: 1112246 - RNA, 22 nt, Human
agcaccugcacaguggaggaaa

SEQ ID NO: 1112247 - RNA, 22 nt, Human
ggaggaugagcuacgaggagcu

SEQ ID NO: 1112248 - RNA, 22 nt, Human
gugccugcugcagagucgcugu

SEQ ID NO: 1112249 - RNA, 22 nt, Human
aagaacaacugcuuuaaaagca

SEQ ID NO: 1112250 - RNA, 22 nt, Human
cauugcuguuaauugucucuag

SEQ ID NO: 1112251 - RNA, 22 nt, Human
cagggcaggaauuugacauugc

SEQ ID NO: 1112252 - RNA, 22 nt, Human
ggcagaggaagcuggaaguggg

SEQ ID NO: 1112253 - RNA, 22 nt, Human
ggcaaaguuuucaucucauaac

SEQ ID NO: 1112254 - RNA, 22 nt, Human
acauuucuaguuguucaucucc

SEQ ID NO: 1112255 - RNA, 22 nt, Human
cacagggcuuugauggcugagu

SEQ ID NO: 1112256 - RNA, 22 nt, Human
acaugucaauuuaguacucuua

SEQ ID NO: 1112257 - RNA, 22 nt, Human
cugcuggagguuggagcaugca

SEQ ID NO: 1112258 - RNA, 22 nt, Human
ccaggccuguguuguguggagg

SEQ ID NO: 1112259 - RNA, 22 nt, Human
aaugauggucauggcaacuuuu

SEQ ID NO: 1112260 - RNA, 22 nt, Human
ucugccuggguguggagcagag

SEQ ID NO: 1112261 - RNA, 22 nt, Human
cagugcuccugauguacccuug

SEQ ID NO: 1112262 - RNA, 22 nt, Human
gguuugcaugugauguugggca

SEQ ID NO: 1112263 - RNA, 22 nt, Human
ucaggugggaccugcuaggaca

SEQ ID NO: 1112264 - RNA, 22 nt, Human
ucuuucucucuaaucaagcaca

SEQ ID NO: 1112265 - RNA, 17 nt, Human
aggccucccuccaggcc

SEQ ID NO: 1112266 - RNA, 22 nt, Human
auugacaauguauuuguaucug

SEQ ID NO: 1112267 - RNA, 22 nt, Human
aaggccugggaggccucucuuc

SEQ ID NO: 1112268 - RNA, 22 nt, Human
uacagaguggugagaucuuuug

SEQ ID NO: 1112269 - RNA, 22 nt, Human
gcucucuggaggccauggacag

SEQ ID NO: 1112270 - RNA, 23 nt, Human
cauggcagcaagagcucauggcc

SEQ ID NO: 1112271 - RNA, 22 nt, Human
cucaguuucugacauuaaaauc

SEQ ID NO: 1112272 - RNA, 21 nt, Human
agggaaagaaaaugagcuaau

SEQ ID NO: 1112273 - RNA, 22 nt, Human
ggguaauuggggccuugcagug

SEQ ID NO: 1112274 - RNA, 22 nt, Human
acaggcuuacaggcugcaagua

SEQ ID NO: 1112275 - RNA, 22 nt, Human
ggcugcuuuaucggcugcugaa

SEQ ID NO: 1112276 - RNA, 22 nt, Human
ggcucaggacacagugguuuag

SEQ ID NO: 1112277 - RNA, 22 nt, Human
uggaugcuguaggacacgcucu

SEQ ID NO: 1112278 - RNA, 22 nt, Human
agaaaugugaauuucauuuccu

SEQ ID NO: 1112279 - RNA, 22 nt, Human
cccuggagggcagacagaugcc

SEQ ID NO: 1112280 - RNA, 22 nt, Human
uccucacagucaacacuuugag

SEQ ID NO: 1112281 - RNA, 22 nt, Human
aaaguucaugguguuauagaaa

SEQ ID NO: 1112282 - RNA, 22 nt, Human
auaugucgcuacaucauuagau

SEQ ID NO: 1112283 - RNA, 22 nt, Human
ugacagcugagccccaggcaag

SEQ ID NO: 1112284 - RNA, 22 nt, Human
aaugagcuagaccugcuuccuc

SEQ ID NO: 1112285 - RNA, 22 nt, Human
ucucagagauuuauggaaaacu

SEQ ID NO: 1112286 - RNA, 22 nt, Human
acagggccucagccagggcaga

SEQ ID NO: 1112287 - RNA, 22 nt, Human
uucaaagugcauguuccucaga

SEQ ID NO: 1112288 - RNA, 22 nt, Human
ugcguugcgcuccugcagcagg

SEQ ID NO: 1112289 - RNA, 22 nt, Human
ggcagggguccugguguugacu

SEQ ID NO: 1112290 - RNA, 22 nt, Human
cuggagccgcauggagcaggga

SEQ ID NO: 1112291 - RNA, 22 nt, Human
ccucagggacuccaugcugcag

SEQ ID NO: 1112292 - RNA, 22 nt, Human
aaaugaacaguugcauucucug

SEQ ID NO: 1112293 - RNA, 22 nt, Human
caguggucugugcuucuguaca

SEQ ID NO: 1112294 - RNA, 22 nt, Human
agaggagcugggaggcccucgu

SEQ ID NO: 1112295 - RNA, 22 nt, Human
uagaaaauagggccuguggagc

SEQ ID NO: 1112296 - RNA, 22 nt, Human
uccauaagcagguucuuccuga

SEQ ID NO: 1112297 - RNA, 22 nt, Human
agggaaggaaaagcugucgcuu

SEQ ID NO: 1112298 - RNA, 22 nt, Human
gaggcugcaggcaaugcugccc

SEQ ID NO: 1112299 - RNA, 19 nt, Human
gcacacccugcaccaccau

SEQ ID NO: 1112300 - RNA, 22 nt, Human
aaaugucuguuagucauaucau

SEQ ID NO: 1112301 - RNA, 22 nt, Human
gccucugcucucagguagccuc

SEQ ID NO: 1112302 - RNA, 22 nt, Human
uagcagugccaggauuuugcug

SEQ ID NO: 1112303 - RNA, 20 nt, Human
aggcagacaaggagucuguu

SEQ ID NO: 1112304 - RNA, 19 nt, Human
gaaggagagcugaguuagg

SEQ ID NO: 1112305 - RNA, 22 nt, Human
cacagggccacuuucccaguaa

SEQ ID NO: 1112306 - RNA, 22 nt, Human
cccagacauaacagcagagagg

SEQ ID NO: 1112307 - RNA, 22 nt, Human
agaauucuggaguugggaggaa

SEQ ID NO: 1112308 - RNA, 22 nt, Human
uggaggaaguggcuggccagaa

SEQ ID NO: 1112309 - RNA, 22 nt, Human
uuucaaugacacaaaagagaaa

SEQ ID NO: 1112310 - RNA, 22 nt, Human
aaggacuccaauucuuucaucu

SEQ ID NO: 1112311 - RNA, 22 nt, Human
gagaugaauguaaacaaaggca

SEQ ID NO: 1112312 - RNA, 17 nt, Human
agcagcuggcacaggag

SEQ ID NO: 1112313 - RNA, 22 nt, Human
augaugugugcugaucaagcuu

SEQ ID NO: 1112314 - RNA, 22 nt, Human
cagagggagcccuccaggagca

SEQ ID NO: 1112315 - RNA, 22 nt, Human
gcagcuuggugaaaggugaugg

SEQ ID NO: 1112316 - RNA, 22 nt, Human
uccaggagagguguggggacug

SEQ ID NO: 1112317 - RNA, 22 nt, Human
auugagaauccauuugagauga

SEQ ID NO: 1112318 - RNA, 22 nt, Human
aggcacugacaauucuggacug

SEQ ID NO: 1112319 - RNA, 22 nt, Human
accucugcaguagggcugugcc

SEQ ID NO: 1112320 - RNA, 22 nt, Human
aagccaggcaugcuuggacagu

SEQ ID NO: 1112321 - RNA, 22 nt, Human
guggagaccuccuaggaugugu

SEQ ID NO: 1112322 - RNA, 22 nt, Human
uuucagauggagguuuaggaca

SEQ ID NO: 1112323 - RNA, 22 nt, Human
ucacguuuuacugagugagaua

SEQ ID NO: 1112324 - RNA, 22 nt, Human
agcagccauagauagcaugcaa

SEQ ID NO: 1112325 - RNA, 22 nt, Human
ccugucugagccagggugggca

SEQ ID NO: 1112326 - RNA, 22 nt, Human
gaguccaguuguucacagaggc

SEQ ID NO: 1112327 - RNA, 22 nt, Human
cccagggagguagcaggagaaa

SEQ ID NO: 1112328 - RNA, 22 nt, Human
ugcugccuugaccuccugggcu

SEQ ID NO: 1112329 - RNA, 21 nt, Human
ucugggcccaugcugccucac

SEQ ID NO: 1112330 - RNA, 22 nt, Human
gcagcugggccccagccucucc

SEQ ID NO: 1112331 - RNA, 22 nt, Human
caggggacaguaugguggauga

SEQ ID NO: 1112332 - RNA, 22 nt, Human
cagagcuguugcggggcuuggc

SEQ ID NO: 1112333 - RNA, 22 nt, Human
ugcaagcacucaaugcaaacag

SEQ ID NO: 1112334 - RNA, 22 nt, Human
uacaaacuuguuuuaaguaagu

SEQ ID NO: 1112335 - RNA, 22 nt, Human
caaaugugacuuuugggcuucu

SEQ ID NO: 1112336 - RNA, 22 nt, Human
ggccugagcuugggcagcguau

SEQ ID NO: 1112337 - RNA, 22 nt, Human
uaguaucuuucuauauuuccca

SEQ ID NO: 1112338 - RNA, 22 nt, Human
augggagugacagggccacugg

SEQ ID NO: 1112339 - RNA, 22 nt, Human
gcagggcuauuggaaggagaug

SEQ ID NO: 1112340 - RNA, 22 nt, Human
uuauuuuuaaaaguucacacag

SEQ ID NO: 1112341 - RNA, 22 nt, Human
ugggcuguggagcaccuuugca

SEQ ID NO: 1112342 - RNA, 22 nt, Human
aggugaguuacaggaggagguc

SEQ ID NO: 1112343 - RNA, 22 nt, Human
ugcuggcugggcugcuggagac

SEQ ID NO: 1112344 - RNA, 22 nt, Human
acauuucugagcagggagcugu

SEQ ID NO: 1112345 - RNA, 22 nt, Human
ucugcuguaaagaauuucugcc

SEQ ID NO: 1112346 - RNA, 22 nt, Human
aaugggagguaguaugggaggu

SEQ ID NO: 1112347 - RNA, 22 nt, Human
acagggccauuaucuguucuag

SEQ ID NO: 1112348 - RNA, 22 nt, Human
cucaggauucucgacacucaca

SEQ ID NO: 1112349 - RNA, 22 nt, Human
gaauuguagagggaacagaagc

SEQ ID NO: 1112350 - RNA, 22 nt, Human
ucacaggguuuggaagccuccu

SEQ ID NO: 1112351 - RNA, 22 nt, Human
uccuuuuugguccaaggugacc

SEQ ID NO: 1112352 - RNA, 22 nt, Human
acaaaguccugguguauggcca

SEQ ID NO: 1112353 - RNA, 22 nt, Human
ggcaggugugagaucgaggcca

SEQ ID NO: 1112354 - RNA, 20 nt, Human
acuggagccaucucagccua

SEQ ID NO: 1112355 - RNA, 21 nt, Human
ggagcugcaggagccgaaggc

SEQ ID NO: 1112356 - RNA, 22 nt, Human
acaggcagcacuaaucucuggu

SEQ ID NO: 1112357 - RNA, 22 nt, Human
ugcccacauucaaaaggugaug

SEQ ID NO: 1112358 - RNA, 22 nt, Human
ucaggggcccuucccucagcag

SEQ ID NO: 1112359 - RNA, 22 nt, Human
aucaguuuuguucacuacuaua

SEQ ID NO: 1112360 - RNA, 22 nt, Human
aacaguaucuuuuaucagaaau

SEQ ID NO: 1112361 - RNA, 22 nt, Human
cccuggaggcggauguugcagu

SEQ ID NO: 1112362 - RNA, 22 nt, Human
cccugccugugggcaucaacau

SEQ ID NO: 1112363 - RNA, 21 nt, Human
uauacaugugugcauacgugu

SEQ ID NO: 1112364 - RNA, 22 nt, Human
gggucuggacggcugcaggaag

SEQ ID NO: 1112365 - RNA, 22 nt, Human
ggcugccucugaugugcagacg

SEQ ID NO: 1112366 - RNA, 21 nt, Human
uccacaaguuagaaggaaauu

SEQ ID NO: 1112367 - RNA, 22 nt, Human
cuggccagacuacacaugugug

SEQ ID NO: 1112368 - RNA, 22 nt, Human
uggucucuucuuccaagauggc

SEQ ID NO: 1112369 - RNA, 22 nt, Human
caggagcaaggagcagugggau

SEQ ID NO: 1112370 - RNA, 22 nt, Human
gaggccacagcuaucagggaca

SEQ ID NO: 1112371 - RNA, 22 nt, Human
ugcagccauuuucugccaaugc

SEQ ID NO: 1112372 - RNA, 20 nt, Human
agcugaggcaccugagguua

SEQ ID NO: 1112373 - RNA, 19 nt, Human
uggcagaggcaguuuguac

SEQ ID NO: 1112374 - RNA, 22 nt, Human
aguacauuuauuaaugguaaaa

SEQ ID NO: 1112375 - RNA, 22 nt, Human
ucugcugcacaaauucaucucu

SEQ ID NO: 1112376 - RNA, 22 nt, Human
ggccugagucacaucaggagag

SEQ ID NO: 1112377 - RNA, 22 nt, Human
agcagccagugggagugauaca

SEQ ID NO: 1112378 - RNA, 22 nt, Human
caagaauuguacaaacugggug

SEQ ID NO: 1112379 - RNA, 20 nt, Human
acagaaagagagaaugucag

SEQ ID NO: 1112380 - RNA, 22 nt, Human
ugcucuggagggugaagcuuuu

SEQ ID NO: 1112381 - RNA, 22 nt, Human
cacauguuuggcaugucaccaa

SEQ ID NO: 1112382 - RNA, 22 nt, Human
cugggcacuugcucacagcucu

SEQ ID NO: 1112383 - RNA, 23 nt, Human
cauguacagaguuugauaaagug

SEQ ID NO: 1112384 - RNA, 22 nt, Human
aaggagagagcuuugcuggaac

SEQ ID NO: 1112385 - RNA, 22 nt, Human
ggcuggcacugaggagagcucu

SEQ ID NO: 1112386 - RNA, 22 nt, Human
ucucuggagggcuccaggcggg

SEQ ID NO: 1112387 - RNA, 22 nt, Human
gagagcuggguucaaguagcug

SEQ ID NO: 1112388 - RNA, 22 nt, Human
agugaaauaugcccauugcugu

SEQ ID NO: 1112389 - RNA, 22 nt, Human
auacaagacucagcacagacgg

SEQ ID NO: 1112390 - RNA, 22 nt, Human
uuaugcuaguauaguccuuaga

SEQ ID NO: 1112391 - RNA, 22 nt, Human
ucugcgcugccuugauccuugg

SEQ ID NO: 1112392 - RNA, 23 nt, Human
agaugaaagcuucccaucacagu

SEQ ID NO: 1112393 - RNA, 22 nt, Human
cucuggagcaccgggcuaucca

SEQ ID NO: 1112394 - RNA, 22 nt, Human
agcucccagggcugggcaaguu

SEQ ID NO: 1112395 - RNA, 22 nt, Human
uauguacaucguugaauucaaa

SEQ ID NO: 1112396 - RNA, 21 nt, Human
acaugcauagagagauuucug

SEQ ID NO: 1112397 - RNA, 22 nt, Human
cugccugugugugccugcagaa

SEQ ID NO: 1112398 - RNA, 22 nt, Human
aaaggcuccuucucccaugacc

SEQ ID NO: 1112399 - RNA, 22 nt, Human
cagggccuucguaaguguccgg

SEQ ID NO: 1112400 - RNA, 22 nt, Human
uggcuggcuuguucacugacug

SEQ ID NO: 1112401 - RNA, 23 nt, Human
acucacaaagcaggaucauguug

SEQ ID NO: 1112402 - RNA, 22 nt, Human
gagcaggcucugccuguguguc

SEQ ID NO: 1112403 - RNA, 22 nt, Human
aaaguuuccugcuaagugcuau

SEQ ID NO: 1112404 - RNA, 22 nt, Human
ccaggagcuggagggugcagug

SEQ ID NO: 1112405 - RNA, 17 nt, Human
aggcuggcucacaggga

SEQ ID NO: 1112406 - RNA, 22 nt, Human
ugcccugugugugcaagcacug

SEQ ID NO: 1112407 - RNA, 22 nt, Human
ggcacugggcaccggcugaggg

SEQ ID NO: 1112408 - RNA, 22 nt, Human
gcugccuugaacuuggccuggg

SEQ ID NO: 1112409 - RNA, 22 nt, Human
uaguuacagcaggcaggauaua

SEQ ID NO: 1112410 - RNA, 22 nt, Human
ggcugccugcucaggugcggcg

SEQ ID NO: 1112411 - RNA, 22 nt, Human
cccugccuugggguccacaccg

SEQ ID NO: 1112412 - RNA, 22 nt, Human
cucuggacagcaggugcugugg

SEQ ID NO: 1112413 - RNA, 22 nt, Human
ucaugccacuuacaaaauaaug

SEQ ID NO: 1112414 - RNA, 22 nt, Human
aggcacugugcagucccaagca

SEQ ID NO: 1112415 - RNA, 22 nt, Human
acuuuguauaagacaauaaaga

SEQ ID NO: 1112416 - RNA, 19 nt, Human
ccugggagucagcugaagg

SEQ ID NO: 1112417 - RNA, 21 nt, Human
gcagagccggggcgagaaggc

SEQ ID NO: 1112418 - RNA, 22 nt, Human
ucacagacaauuguuuuggugu

SEQ ID NO: 1112419 - RNA, 22 nt, Human
ccagagcuucggggcggcugua

SEQ ID NO: 1112420 - RNA, 20 nt, Human
gucagaggacccuagagcga

SEQ ID NO: 1112421 - RNA, 22 nt, Human
caggugggaccaugauagggca

SEQ ID NO: 1112422 - RNA, 22 nt, Human
uggcagagucugggcuugggca

SEQ ID NO: 1112423 - RNA, 22 nt, Human
ccagcagagucuaggaaggagg

SEQ ID NO: 1112424 - RNA, 22 nt, Human
acacagaaccucauagccucuc

SEQ ID NO: 1112425 - RNA, 22 nt, Human
ugugacaucgcugugucuguuu

SEQ ID NO: 1112426 - RNA, 18 nt, Human
gagcugccauauuuaguu

SEQ ID NO: 1112427 - RNA, 22 nt, Human
cucugggcaaguaugauagaaa

SEQ ID NO: 1112428 - RNA, 22 nt, Human
uaaagguagugugacauauugu

SEQ ID NO: 1112429 - RNA, 22 nt, Human
acagcagagugugagauagcca

SEQ ID NO: 1112430 - RNA, 22 nt, Human
cagcuucccuuggcugagcaga

SEQ ID NO: 1112431 - RNA, 22 nt, Human
aacagaaaagguagguggcuuu

SEQ ID NO: 1112432 - RNA, 22 nt, Human
ccuccugguccagcaucucuuu

SEQ ID NO: 1112433 - RNA, 20 nt, Human
gcagcugcccccagucccug

SEQ ID NO: 1112434 - RNA, 17 nt, Human
uuuucucucuuggauuc

SEQ ID NO: 1112435 - RNA, 22 nt, Human
acaaagucacaauaauuaaccu

SEQ ID NO: 1112436 - RNA, 22 nt, Human
aagcuuccugaaugcucauuua

SEQ ID NO: 1112437 - RNA, 22 nt, Human
ccuccagcugccucagucucuu

SEQ ID NO: 1112438 - RNA, 22 nt, Human
gagugaaaaaggaagggccaua

SEQ ID NO: 1112439 - RNA, 22 nt, Human
agaaaugacacacaugagacau

SEQ ID NO: 1112440 - RNA, 22 nt, Human
uaaaucaguuucucuuauuggu

SEQ ID NO: 1112441 - RNA, 22 nt, Human
ggcugccugaggcugaggcccg

SEQ ID NO: 1112442 - RNA, 18 nt, Human
cucagggcaucagucugg

SEQ ID NO: 1112443 - RNA, 22 nt, Human
cagaguguugaccauaagccca

SEQ ID NO: 1112444 - RNA, 22 nt, Human
gccuggguuccaugaucuccag

SEQ ID NO: 1112445 - RNA, 22 nt, Human
ccagcucucagcgggagacuca

SEQ ID NO: 1112446 - RNA, 22 nt, Human
cucuggaguucuucaagcuacu

SEQ ID NO: 1112447 - RNA, 22 nt, Human
cagggccauaucuugugcacca

SEQ ID NO: 1112448 - RNA, 22 nt, Human
gcucucagguacaaagcugugu

SEQ ID NO: 1112449 - RNA, 22 nt, Human
cagaguggcagucccaggccca

SEQ ID NO: 1112450 - RNA, 22 nt, Human
aggagagucuugagucacuggu

SEQ ID NO: 1112451 - RNA, 22 nt, Human
gggcugggauggcuugaagauu

SEQ ID NO: 1112452 - RNA, 22 nt, Human
augggaugcauggcuguggcca

SEQ ID NO: 1112453 - RNA, 22 nt, Human
ccuccagggcagacggggagca

SEQ ID NO: 1112454 - RNA, 22 nt, Human
caggagugucuccacacagcaa

SEQ ID NO: 1112455 - RNA, 20 nt, Human
cuaucuccuggcgugccuuc

SEQ ID NO: 1112456 - RNA, 22 nt, Human
agaaauguauagugaauuuuuc

SEQ ID NO: 1112457 - RNA, 22 nt, Human
aaagucauguaaugauaugauu

SEQ ID NO: 1112458 - RNA, 22 nt, Human
cuggccaguuguccuggcuugg

SEQ ID NO: 1112459 - RNA, 22 nt, Human
gccugagacagugugguccaau

SEQ ID NO: 1112460 - RNA, 22 nt, Human
cagagcagggugcaccuugggc

SEQ ID NO: 1112461 - RNA, 22 nt, Human
cacuggugacuucugagcugga

SEQ ID NO: 1112462 - RNA, 17 nt, Human
uguuccauuugaccacc

SEQ ID NO: 1112463 - RNA, 22 nt, Human
uugcauaaaagaguauaucuua

SEQ ID NO: 1112464 - RNA, 22 nt, Human
cggggacacacuggcagcuccu

SEQ ID NO: 1112465 - RNA, 22 nt, Human
ugacacaggcagcucccagcac

SEQ ID NO: 1112466 - RNA, 22 nt, Human
uuuccauauuuggucuuuggga

SEQ ID NO: 1112467 - RNA, 22 nt, Human
aguacuuugcacuuugcucaga

SEQ ID NO: 1112468 - RNA, 22 nt, Human
gggcccuggauuuaagcaugga

SEQ ID NO: 1112469 - RNA, 22 nt, Human
agagugauucuaguuagggaau

SEQ ID NO: 1112470 - RNA, 22 nt, Human
uacauuccauguguguguauuc

SEQ ID NO: 1112471 - RNA, 17 nt, Human
agaggcagauacuugga

SEQ ID NO: 1112472 - RNA, 23 nt, Human
cagggcugguagggaagagcgug

SEQ ID NO: 1112473 - RNA, 22 nt, Human
uaugcacaccuggguccuuguc

SEQ ID NO: 1112474 - RNA, 22 nt, Human
ccucccacauugaggacaugcu

SEQ ID NO: 1112475 - RNA, 20 nt, Human
gccuggaggcagagauaaag

SEQ ID NO: 1112476 - RNA, 22 nt, Human
cagaguacugggagaacagaag

SEQ ID NO: 1112477 - RNA, 22 nt, Human
ugaggcaguucuuacuuguauu

SEQ ID NO: 1112478 - RNA, 22 nt, Human
uggaggugagugugguacagca

SEQ ID NO: 1112479 - RNA, 22 nt, Human
gcaaggcagcgcggaguagcua

SEQ ID NO: 1112480 - RNA, 22 nt, Human
gcagcuggugcaaaugucacuc

SEQ ID NO: 1112481 - RNA, 22 nt, Human
ugguccaggguguaguacagag

SEQ ID NO: 1112482 - RNA, 22 nt, Human
ccagcugcuugggaaaaugucu

SEQ ID NO: 1112483 - RNA, 22 nt, Human
agcucccagcuccuuugagaga

SEQ ID NO: 1112484 - RNA, 19 nt, Human
agugaaauggaguauucaa

SEQ ID NO: 1112485 - RNA, 22 nt, Human
cccaugccuucugacucacagg

SEQ ID NO: 1112486 - RNA, 22 nt, Human
agaagugccauacuguggucca

SEQ ID NO: 1112487 - RNA, 22 nt, Human
auuuguacaaauuuauguuagu

SEQ ID NO: 1112488 - RNA, 22 nt, Human
auucacagggacaaugggagag

SEQ ID NO: 1112489 - RNA, 20 nt, Human
agaguaacuggcacauaggg

SEQ ID NO: 1112490 - RNA, 22 nt, Human
auggaagguccuacagagcgca

SEQ ID NO: 1112491 - RNA, 22 nt, Human
agcugcucuuugaaggacacuu

SEQ ID NO: 1112492 - RNA, 22 nt, Human
ggcugccaggagggaggccagu

SEQ ID NO: 1112493 - RNA, 19 nt, Human
caugagcugcucacuuccc

SEQ ID NO: 1112494 - RNA, 22 nt, Human
gcugccugccuaguuccacagu

SEQ ID NO: 1112495 - RNA, 22 nt, Human
cagaaugcaaauuuuauaauau

SEQ ID NO: 1112496 - RNA, 22 nt, Human
agcugcagagguuugugcaaca

SEQ ID NO: 1112497 - RNA, 22 nt, Human
auguuacauaguccuuauuugu

SEQ ID NO: 1112498 - RNA, 22 nt, Human
aagggcagaauagagaagaugg

SEQ ID NO: 1112499 - RNA, 22 nt, Human
cugccuugaaaaugaagcuuua

SEQ ID NO: 1112500 - RNA, 22 nt, Human
ugggacacccucacgccugcac

SEQ ID NO: 1112501 - RNA, 22 nt, Human
aagaaaagaaaccugaggcuuu

SEQ ID NO: 1112502 - RNA, 22 nt, Human
ccacagcaugcaggccugacac

SEQ ID NO: 1112503 - RNA, 22 nt, Human
augaugguggguaauguguaaa

SEQ ID NO: 1112504 - RNA, 22 nt, Human
ccaggccuggccaggggaugcc

SEQ ID NO: 1112505 - RNA, 22 nt, Human
gcccagcuggcuuccagcacau

SEQ ID NO: 1112506 - RNA, 22 nt, Human
agagcuggccagggaucacucu

SEQ ID NO: 1112507 - RNA, 22 nt, Human
acacugaauauacaaugaauau

SEQ ID NO: 1112508 - RNA, 22 nt, Human
uuaagucauuucugauuauaga

SEQ ID NO: 1112509 - RNA, 22 nt, Human
ccucucucuccugcacacacac

SEQ ID NO: 1112510 - RNA, 22 nt, Human
aaaaaugucauuauggaacuga

SEQ ID NO: 1112511 - RNA, 22 nt, Human
gcuggggaggcagcagagaaca

SEQ ID NO: 1112512 - RNA, 22 nt, Human
uggcugcucaagggaggaggcu

SEQ ID NO: 1112513 - RNA, 22 nt, Human
ugagugaggaagcgguggagga

SEQ ID NO: 1112514 - RNA, 22 nt, Human
ugacuuccugcacucaggugau

SEQ ID NO: 1112515 - RNA, 22 nt, Human
uagagcuggaaaacugcaggua

SEQ ID NO: 1112516 - RNA, 19 nt, Human
ugcucauggggacuucucc

SEQ ID NO: 1112517 - RNA, 22 nt, Human
agccaaagaucagugugcaagu

SEQ ID NO: 1112518 - RNA, 22 nt, Human
cucaggacccgguccagguggg

SEQ ID NO: 1112519 - RNA, 22 nt, Human
uucaaugaggauagaacuggau

SEQ ID NO: 1112520 - RNA, 22 nt, Human
ugcagcugcuugauucaucuug

SEQ ID NO: 1112521 - RNA, 22 nt, Human
caggugcucccagagaagugcu

SEQ ID NO: 1112522 - RNA, 22 nt, Human
gccaccagccccaugcgcugug

SEQ ID NO: 1112523 - RNA, 22 nt, Human
uucucuggaacugaaacaagau

SEQ ID NO: 1112524 - RNA, 22 nt, Human
gacagccaugcacuucugcugu

SEQ ID NO: 1112525 - RNA, 22 nt, Human
ugcuggggguucagaugaguaa

SEQ ID NO: 1112526 - RNA, 22 nt, Human
uggccuuggacagagcgcuccu

SEQ ID NO: 1112527 - RNA, 21 nt, Human
uccuccuucaaguccuggccu

SEQ ID NO: 1112528 - RNA, 22 nt, Human
gaugcugagagguggagggaac

SEQ ID NO: 1112529 - RNA, 22 nt, Human
aggggcuggaguucgagguuac

SEQ ID NO: 1112530 - RNA, 22 nt, Human
gcccagcacauugcugaggacc

SEQ ID NO: 1112531 - RNA, 22 nt, Human
ucagaagcugguguccuuugaa

SEQ ID NO: 1112532 - RNA, 21 nt, Human
ugcucaugcaaugcaugucca

SEQ ID NO: 1112533 - RNA, 22 nt, Human
ucagagugaccuuacauggucu

SEQ ID NO: 1112534 - RNA, 22 nt, Human
guuugcauuucuugaacuauau

SEQ ID NO: 1112535 - RNA, 22 nt, Human
acauuugucuucuuucagauua

SEQ ID NO: 1112536 - RNA, 22 nt, Human
ugauuucaaguagugacaugcu

SEQ ID NO: 1112537 - RNA, 22 nt, Human
gggcacugcuggaggcucccug

SEQ ID NO: 1112538 - RNA, 22 nt, Human
ccaggaggcagagguuacagug

SEQ ID NO: 1112539 - RNA, 19 nt, Human
uggcugggcgugccuccgu

SEQ ID NO: 1112540 - RNA, 22 nt, Human
augaagcugguuuuggcuuggg

SEQ ID NO: 1112541 - RNA, 22 nt, Human
gagccuucaucgcagccuuguu

SEQ ID NO: 1112542 - RNA, 22 nt, Human
cuguccauuuucgugccuccuu

SEQ ID NO: 1112543 - RNA, 22 nt, Human
ucccagaggcuccagucucuau

SEQ ID NO: 1112544 - RNA, 22 nt, Human
uauaacaguuuaggugguguca

SEQ ID NO: 1112545 - RNA, 22 nt, Human
acagaaauuagcagugaguuua

SEQ ID NO: 1112546 - RNA, 22 nt, Human
cucugggcaaguuucuucauga

SEQ ID NO: 1112547 - RNA, 22 nt, Human
uguggugagaaacugguagauu

SEQ ID NO: 1112548 - RNA, 22 nt, Human
agccaggggauucaucagggac

SEQ ID NO: 1112549 - RNA, 22 nt, Human
ucucagggugaggaaagaauuu

SEQ ID NO: 1112550 - RNA, 22 nt, Human
cagacuugacggcagcugcuuu

SEQ ID NO: 1112551 - RNA, 22 nt, Human
aaaugcuguaacugauauucug

SEQ ID NO: 1112552 - RNA, 21 nt, Human
cugccuugaaugguacuggga

SEQ ID NO: 1112553 - RNA, 20 nt, Human
ugcuuccuggccacugcggg

SEQ ID NO: 1112554 - RNA, 22 nt, Human
cagagugaaaacugagcucaaa

SEQ ID NO: 1112555 - RNA, 22 nt, Human
cccucugccugggaccaagucc

SEQ ID NO: 1112556 - RNA, 22 nt, Human
cagugcaguugguggcaggggu

SEQ ID NO: 1112557 - RNA, 22 nt, Human
cacaggagguuaggaagugguc

SEQ ID NO: 1112558 - RNA, 22 nt, Human
agguaacacuacuuaguauacu

SEQ ID NO: 1112559 - RNA, 22 nt, Human
agagcuguggauaguccuggau

SEQ ID NO: 1112560 - RNA, 22 nt, Human
caggauccccaggucgccgucc

SEQ ID NO: 1112561 - RNA, 22 nt, Human
ggacucagcagccaggaguggc

SEQ ID NO: 1112562 - RNA, 21 nt, Human
gcugcugccccuagugaggcc

SEQ ID NO: 1112563 - RNA, 22 nt, Human
cucaggauuuaaaggggcacuc

SEQ ID NO: 1112564 - RNA, 22 nt, Human
acaguaauauugaugcucguca

SEQ ID NO: 1112565 - RNA, 22 nt, Human
cacugcauggaugauggcugua

SEQ ID NO: 1112566 - RNA, 22 nt, Human
agcuuuauucaugauuucaggg

SEQ ID NO: 1112567 - RNA, 22 nt, Human
cugccuggggaaugugaggauu

SEQ ID NO: 1112568 - RNA, 22 nt, Human
cugcucuguuaauuaaacuuug

SEQ ID NO: 1112569 - RNA, 22 nt, Human
gccuggagcucaugugggcauu

SEQ ID NO: 1112570 - RNA, 21 nt, Human
guauucuuuaugaagugaaaa

SEQ ID NO: 1112571 - RNA, 22 nt, Human
cccuggaggucagaggccuggg

SEQ ID NO: 1112572 - RNA, 22 nt, Human
aaggagaguacaggaguuggua

SEQ ID NO: 1112573 - RNA, 22 nt, Human
agggccuggugaccuggguccu

SEQ ID NO: 1112574 - RNA, 22 nt, Human
agauggggcagaauggagccau

SEQ ID NO: 1112575 - RNA, 22 nt, Human
ccagcuccuucugucuguggag

SEQ ID NO: 1112576 - RNA, 22 nt, Human
gcugggcagccccuacagagag

SEQ ID NO: 1112577 - RNA, 22 nt, Human
ggccuuggugcucuguguugca

SEQ ID NO: 1112578 - RNA, 22 nt, Human
cgcuggggcuuuuugcuugaga

SEQ ID NO: 1112579 - RNA, 22 nt, Human
agcccuggcccggcugugcuuu

SEQ ID NO: 1112580 - RNA, 22 nt, Human
ugcauuaugcuugugcuguaua

SEQ ID NO: 1112581 - RNA, 22 nt, Human
ccacagggcacagacaggaagc

SEQ ID NO: 1112582 - RNA, 22 nt, Human
agcaggagcccuuaucaccagg

SEQ ID NO: 1112583 - RNA, 22 nt, Human
ggccucggcccacugcugcggu

SEQ ID NO: 1112584 - RNA, 22 nt, Human
agggccagggaagcuguauuuu

SEQ ID NO: 1112585 - RNA, 22 nt, Human
cagguggcuucucccuaggcca

SEQ ID NO: 1112586 - RNA, 22 nt, Human
gggcauggugaugugcaccugu

SEQ ID NO: 1112587 - RNA, 22 nt, Human
aucuggcugagcgaggcccaca

SEQ ID NO: 1112588 - RNA, 22 nt, Human
cacugcuuauaaauucuaggca

SEQ ID NO: 1112589 - RNA, 18 nt, Human
ccuggaccugucuccuuu

SEQ ID NO: 1112590 - RNA, 22 nt, Human
cagcugccuucugcgggaaguc

SEQ ID NO: 1112591 - RNA, 22 nt, Human
ggcaugggguguauguggcacg

SEQ ID NO: 1112592 - RNA, 22 nt, Human
ugccagggugucaggagagcua

SEQ ID NO: 1112593 - RNA, 22 nt, Human
cucccaggcacagggaggagcc

SEQ ID NO: 1112594 - RNA, 22 nt, Human
cuccaggggccagaagccuggc

SEQ ID NO: 1112595 - RNA, 22 nt, Human
acguuuucagugacugugcuuc

SEQ ID NO: 1112596 - RNA, 22 nt, Human
gggagagaugcugauugccaau

SEQ ID NO: 1112597 - RNA, 22 nt, Human
ucucagagaugucaagagucua

SEQ ID NO: 1112598 - RNA, 22 nt, Human
uuuccucugagugagcugggag

SEQ ID NO: 1112599 - RNA, 22 nt, Human
uccugucugucuuuggucccuu

SEQ ID NO: 1112600 - RNA, 17 nt, Human
ucaugcccaacuauuac

SEQ ID NO: 1112601 - RNA, 22 nt, Human
uggcucugggaaucuguugcuu

SEQ ID NO: 1112602 - RNA, 22 nt, Human
uuagaaacccagacucuuaggu

SEQ ID NO: 1112603 - RNA, 22 nt, Human
aagucauuaucucuucuaaucu

SEQ ID NO: 1112604 - RNA, 22 nt, Human
uuauguaauuuguuugcucuuc

SEQ ID NO: 1112605 - RNA, 18 nt, Human
uggcucuggacuugcucc

SEQ ID NO: 1112606 - RNA, 22 nt, Human
aaacuguaaacacagcaguaca

SEQ ID NO: 1112607 - RNA, 22 nt, Human
cagaguguauucugcaguugca

SEQ ID NO: 1112608 - RNA, 23 nt, Human
uccuucagagccucccuccaagc

SEQ ID NO: 1112609 - RNA, 22 nt, Human
gccggggcuggggagagacaug

SEQ ID NO: 1112610 - RNA, 17 nt, Human
uucucuuccuggauagu

SEQ ID NO: 1112611 - RNA, 22 nt, Human
agggcucugagugggaaagagg

SEQ ID NO: 1112612 - RNA, 22 nt, Human
uauuucugaggcccaggaagug

SEQ ID NO: 1112613 - RNA, 22 nt, Human
acuugauuuugaaccuuucuac

SEQ ID NO: 1112614 - RNA, 22 nt, Human
gccuggugaaaggcagagagcg

SEQ ID NO: 1112615 - RNA, 18 nt, Human
ccugagcccugcuuacuu

SEQ ID NO: 1112616 - RNA, 22 nt, Human
uaagaacagauaaaguuucccc

SEQ ID NO: 1112617 - RNA, 22 nt, Human
cccaggcuggagugcaauggca

SEQ ID NO: 1112618 - RNA, 23 nt, Human
ggucccaguggagaggccucacc

SEQ ID NO: 1112619 - RNA, 22 nt, Human
guuuuuaucuaauagcaguuau

SEQ ID NO: 1112620 - RNA, 22 nt, Human
ccugucuggccuuccacggggg

SEQ ID NO: 1112621 - RNA, 22 nt, Human
cccucugcucaggugcauaggc

SEQ ID NO: 1112622 - RNA, 22 nt, Human
ccuccugggacaggcuggcaca

SEQ ID NO: 1112623 - RNA, 22 nt, Human
uaaggcacccauguucauacag

SEQ ID NO: 1112624 - RNA, 22 nt, Human
uaacacugauuuguucucaggg

SEQ ID NO: 1112625 - RNA, 22 nt, Human
agcaggaggguuuuguagaguc

SEQ ID NO: 1112626 - RNA, 22 nt, Human
agggacagaugaaugacugagu

SEQ ID NO: 1112627 - RNA, 22 nt, Human
gaugaggggucauuggcuggga

SEQ ID NO: 1112628 - RNA, 22 nt, Human
agcccuagagcuggaggucagu

SEQ ID NO: 1112629 - RNA, 22 nt, Human
ucuggccagugaaaugcagaau

SEQ ID NO: 1112630 - RNA, 22 nt, Human
uguuccauaaguggugcuuugu

SEQ ID NO: 1112631 - RNA, 22 nt, Human
gccagagccacuuuugggugau

SEQ ID NO: 1112632 - RNA, 22 nt, Human
agugcugaagacuggcuaggga

SEQ ID NO: 1112633 - RNA, 20 nt, Human
ucagaggcugccagcugggg

SEQ ID NO: 1112634 - RNA, 22 nt, Human
caggguggcacucagcgcaucu

SEQ ID NO: 1112635 - RNA, 22 nt, Human
acuuugcaaugggcagaaccca

SEQ ID NO: 1112636 - RNA, 22 nt, Human
auugucuguacuuuaaaaaugu

SEQ ID NO: 1112637 - RNA, 22 nt, Human
aauucauccaugaacaauucca

SEQ ID NO: 1112638 - RNA, 19 nt, Human
auuuacugccuaaaaucuc

SEQ ID NO: 1112639 - RNA, 22 nt, Human
uauagaagagacaugugcauag

SEQ ID NO: 1112640 - RNA, 22 nt, Human
uugcucagcacuggagccagcu

SEQ ID NO: 1112641 - RNA, 22 nt, Human
agauuucaaugugagcauuagu

SEQ ID NO: 1112642 - RNA, 22 nt, Human
cugaaugucgaucagcuugggu

SEQ ID NO: 1112643 - RNA, 22 nt, Human
acagccuguguaccagcuggga

SEQ ID NO: 1112644 - RNA, 22 nt, Human
uccucuggauauaagccucacc

SEQ ID NO: 1112645 - RNA, 22 nt, Human
cagagcagagugauuguucugg

SEQ ID NO: 1112646 - RNA, 22 nt, Human
cgcaccacugaauuccagccug

SEQ ID NO: 1112647 - RNA, 22 nt, Human
uuagaaaggagcuuauuucuuu

SEQ ID NO: 1112648 - RNA, 22 nt, Human
ugggggacugcacuggcgucag

SEQ ID NO: 1112649 - RNA, 22 nt, Human
aagguacaaaguauuauuuaaa

SEQ ID NO: 1112650 - RNA, 22 nt, Human
gcacagagggcagugagccucu

SEQ ID NO: 1112651 - RNA, 22 nt, Human
cauggcagagaaggggaacugg

SEQ ID NO: 1112652 - RNA, 22 nt, Human
caggguacagaguuuucuaaac

SEQ ID NO: 1112653 - RNA, 22 nt, Human
ugagccuguggggugacaacca

SEQ ID NO: 1112654 - RNA, 22 nt, Human
ccagggcauguaacuaauggug

SEQ ID NO: 1112655 - RNA, 22 nt, Human
gacagcagacagaacuaccugc

SEQ ID NO: 1112656 - RNA, 22 nt, Human
caggguagacaguaggugucug

SEQ ID NO: 1112657 - RNA, 22 nt, Human
auguaguauuuggaaauguaaa

SEQ ID NO: 1112658 - RNA, 22 nt, Human
ucuucucccaucuccaggcagg

SEQ ID NO: 1112659 - RNA, 22 nt, Human
ucuccuggauggaccuucucuu

SEQ ID NO: 1112660 - RNA, 22 nt, Human
ucugucugagggagugacauuu

SEQ ID NO: 1112661 - RNA, 21 nt, Human
ggcagaaguagcauggacggg

SEQ ID NO: 1112662 - RNA, 22 nt, Human
aucuaagaguuaacaucaagaa

SEQ ID NO: 1112663 - RNA, 22 nt, Human
aaggcagauauaaagacuagag

SEQ ID NO: 1112664 - RNA, 22 nt, Human
ucuggcucccuggagcuccaca

SEQ ID NO: 1112665 - RNA, 22 nt, Human
cucaggauugugccuagggaga

SEQ ID NO: 1112666 - RNA, 22 nt, Human
cagagccauccaggugccuguu

SEQ ID NO: 1112667 - RNA, 22 nt, Human
cugggccugucagggcuuuuug

SEQ ID NO: 1112668 - RNA, 22 nt, Human
ucugcaggacugaggccuguuu

SEQ ID NO: 1112669 - RNA, 22 nt, Human
ggucaugcugugaaucagugcu

SEQ ID NO: 1112670 - RNA, 22 nt, Human
ugggaggcuuccagaccuugcu

SEQ ID NO: 1112671 - RNA, 22 nt, Human
guggcaggucccauuggagcag

SEQ ID NO: 1112672 - RNA, 22 nt, Human
aagugguaggaagagagcacug

SEQ ID NO: 1112673 - RNA, 22 nt, Human
gugcauauaugcacauaugugu

SEQ ID NO: 1112674 - RNA, 22 nt, Human
gucccugcaucaccacgggacu

SEQ ID NO: 1112675 - RNA, 22 nt, Human
agagccaggcggcugggcaccu

SEQ ID NO: 1112676 - RNA, 22 nt, Human
ggcuucugagugcucugcuguu

SEQ ID NO: 1112677 - RNA, 22 nt, Human
ugccugggccuucccaccucug

SEQ ID NO: 1112678 - RNA, 22 nt, Human
gccugccuggagcuugagguga

SEQ ID NO: 1112679 - RNA, 22 nt, Human
uggccuuccuggugacucauga

SEQ ID NO: 1112680 - RNA, 22 nt, Human
gaggcugcggggaggagccugc

SEQ ID NO: 1112681 - RNA, 22 nt, Human
cacagggcagugcugcccacuc

SEQ ID NO: 1112682 - RNA, 23 nt, Human
agcccagcagagaaccuaggucc

SEQ ID NO: 1112683 - RNA, 22 nt, Human
uaauuuaauuucaugccagccu

SEQ ID NO: 1112684 - RNA, 22 nt, Human
acauuucucauaggagagccac

SEQ ID NO: 1112685 - RNA, 22 nt, Human
gagcagugguugaacagaggca

SEQ ID NO: 1112686 - RNA, 22 nt, Human
uggcucaguggcagccgcagcu

SEQ ID NO: 1112687 - RNA, 22 nt, Human
agcaggcuaagggaccuguuua

SEQ ID NO: 1112688 - RNA, 21 nt, Human
gcugccaccgcgugcuccagg

SEQ ID NO: 1112689 - RNA, 22 nt, Human
gcugagcugcuguucauccugc

SEQ ID NO: 1112690 - RNA, 22 nt, Human
gacccugccaugagugacaggg

SEQ ID NO: 1112691 - RNA, 22 nt, Human
ugucaguguauacauacaguau

SEQ ID NO: 1112692 - RNA, 22 nt, Human
gcugcugguccucagagcucau

SEQ ID NO: 1112693 - RNA, 22 nt, Human
caggcaccccaggugagcacug

SEQ ID NO: 1112694 - RNA, 22 nt, Human
uguguccauucaggcacugacc

SEQ ID NO: 1112695 - RNA, 22 nt, Human
aauccagguggcggagguugug

SEQ ID NO: 1112696 - RNA, 22 nt, Human
caggaaccuaaagagacauuac

SEQ ID NO: 1112697 - RNA, 22 nt, Human
ggccugcuccgggggcugagcu

SEQ ID NO: 1112698 - RNA, 22 nt, Human
aggucauuccagccauuccccu

SEQ ID NO: 1112699 - RNA, 22 nt, Human
acuguguggaaauuugugaggg

SEQ ID NO: 1112700 - RNA, 22 nt, Human
gcuguucccauguggggcucag

SEQ ID NO: 1112701 - RNA, 20 nt, Human
cccucugcacauggcugugg

SEQ ID NO: 1112702 - RNA, 22 nt, Human
ggaugcuggggaccaaucucug

SEQ ID NO: 1112703 - RNA, 21 nt, Human
uucaaagagugggcauuguca

SEQ ID NO: 1112704 - RNA, 22 nt, Human
acauugaucagccucccaugca

SEQ ID NO: 1112705 - RNA, 22 nt, Human
cuggccacaugugugcugagca

SEQ ID NO: 1112706 - RNA, 22 nt, Human
ggccugaggcgucccagcugug

SEQ ID NO: 1112707 - RNA, 22 nt, Human
guuauguaugggggccuuauga

SEQ ID NO: 1112708 - RNA, 22 nt, Human
ggcugcuggaagacugaacaag

SEQ ID NO: 1112709 - RNA, 19 nt, Human
ggcugcugguuacagaggc

SEQ ID NO: 1112710 - RNA, 22 nt, Human
gcagggcugcagagggcacugu

SEQ ID NO: 1112711 - RNA, 21 nt, Human
uccucagggccccagagcacu

SEQ ID NO: 1112712 - RNA, 22 nt, Human
aggagcugcauggauaccuggu

SEQ ID NO: 1112713 - RNA, 22 nt, Human
guaggaagcucugaggcuaguu

SEQ ID NO: 1112714 - RNA, 22 nt, Human
ugugaaaggggucacagggaaa

SEQ ID NO: 1112715 - RNA, 22 nt, Human
uagaaacauguucuguucuguu

SEQ ID NO: 1112716 - RNA, 22 nt, Human
ucaucuucuauuaauagggaga

SEQ ID NO: 1112717 - RNA, 22 nt, Human
ccuaugccugucacucugcgcu

SEQ ID NO: 1112718 - RNA, 22 nt, Human
agcagcugggcucagagcuggg

SEQ ID NO: 1112719 - RNA, 22 nt, Human
guaucuuuugguggaaaaauaa

SEQ ID NO: 1112720 - RNA, 22 nt, Human
gcaguggggaaugcuggggaga

SEQ ID NO: 1112721 - RNA, 22 nt, Human
gcccagcacagcuggaagaguc

SEQ ID NO: 1112722 - RNA, 19 nt, Human
ugucucugaaagaugagcu

SEQ ID NO: 1112723 - RNA, 22 nt, Human
agagguagagguugcagugagc

SEQ ID NO: 1112724 - RNA, 22 nt, Human
ucugccugaaauucacauguaa

SEQ ID NO: 1112725 - RNA, 22 nt, Human
aagcaagacagaaguuacugcc

SEQ ID NO: 1112726 - RNA, 22 nt, Human
cggcagagacggcgcuuugaac

SEQ ID NO: 1112727 - RNA, 18 nt, Human
uacaugcauaaaugaagc

SEQ ID NO: 1112728 - RNA, 22 nt, Human
uggagggaacccaggcugcucu

SEQ ID NO: 1112729 - RNA, 22 nt, Human
ccuuuuucccuggagggacagc

SEQ ID NO: 1112730 - RNA, 22 nt, Human
cagggccuuauccugccauuga

SEQ ID NO: 1112731 - RNA, 22 nt, Human
aaaggucaaaaucgugacauug

SEQ ID NO: 1112732 - RNA, 22 nt, Human
agucccuguacuuuccacugcc

SEQ ID NO: 1112733 - RNA, 22 nt, Human
ggggugggcgugcagggacacc

SEQ ID NO: 1112734 - RNA, 22 nt, Human
uaguuuuuucaacaaauggugc

SEQ ID NO: 1112735 - RNA, 22 nt, Human
ccugugaggucaucugugguaa

SEQ ID NO: 1112736 - RNA, 22 nt, Human
ucucugcucugugccucaguuu

SEQ ID NO: 1112737 - RNA, 22 nt, Human
auguguacaaccaagcacuaaa

SEQ ID NO: 1112738 - RNA, 22 nt, Human
agaauuguaagcaauuugauua

SEQ ID NO: 1112739 - RNA, 22 nt, Human
cacagguguucuugcagugaaa

SEQ ID NO: 1112740 - RNA, 22 nt, Human
gacauucacaguuuccgauggu

SEQ ID NO: 1112741 - RNA, 22 nt, Human
uaagaacauaaauucauacggg

SEQ ID NO: 1112742 - RNA, 22 nt, Human
aggcucagcugguggugaucgc

SEQ ID NO: 1112743 - RNA, 22 nt, Human
ugaagcaggcauugacugauga

SEQ ID NO: 1112744 - RNA, 22 nt, Human
acagagcugggugcccccugga

SEQ ID NO: 1112745 - RNA, 19 nt, Human
gcaggcacagcccugggug

SEQ ID NO: 1112746 - RNA, 22 nt, Human
ggcagcagcaagguuggagcug

SEQ ID NO: 1112747 - RNA, 22 nt, Human
ggcuucucucuucacauggcuu

SEQ ID NO: 1112748 - RNA, 22 nt, Human
aagggcagccugacucacgguc

SEQ ID NO: 1112749 - RNA, 20 nt, Human
ggccuuggguuucgccuguu

SEQ ID NO: 1112750 - RNA, 22 nt, Human
auauacuuggagacuaucauug

SEQ ID NO: 1112751 - RNA, 22 nt, Human
agcugcucccuauccuuuccuu

SEQ ID NO: 1112752 - RNA, 22 nt, Human
aacuuuauuguuaggggcuaaa

SEQ ID NO: 1112753 - RNA, 22 nt, Human
aaagcccauguggaaguacagg

SEQ ID NO: 1112754 - RNA, 22 nt, Human
uggcugcuagccagagcuucag

SEQ ID NO: 1112755 - RNA, 22 nt, Human
agggcagaaguacagacacuua

SEQ ID NO: 1112756 - RNA, 22 nt, Human
agaauuagucacaauuauagga

SEQ ID NO: 1112757 - RNA, 22 nt, Human
ucuggcuccuggcuccacugcc

SEQ ID NO: 1112758 - RNA, 22 nt, Human
cacugugucaguuugguuagac

SEQ ID NO: 1112759 - RNA, 22 nt, Human
gauuuccuaauguggaucucug

SEQ ID NO: 1112760 - RNA, 22 nt, Human
gccuucugauugcuggacugac

SEQ ID NO: 1112761 - RNA, 22 nt, Human
cucucaggcuugggucguggca

SEQ ID NO: 1112762 - RNA, 22 nt, Human
caggggcuuaagugacagaagg

SEQ ID NO: 1112763 - RNA, 21 nt, Human
ucccagggccaggugccauca

SEQ ID NO: 1112764 - RNA, 22 nt, Human
cagaacauuccaugugcccugc

SEQ ID NO: 1112765 - RNA, 22 nt, Human
uggacagcgaaagugccuggga

SEQ ID NO: 1112766 - RNA, 22 nt, Human
caguacuugggggguucuaagu

SEQ ID NO: 1112767 - RNA, 22 nt, Human
cugaggaugguguggucuucuc

SEQ ID NO: 1112768 - RNA, 20 nt, Human
ccuggaagagcuccccaggc

SEQ ID NO: 1112769 - RNA, 22 nt, Human
cucaccacagagccuguccagc

SEQ ID NO: 1112770 - RNA, 22 nt, Human
augaagucuagcaagcauugaa

SEQ ID NO: 1112771 - RNA, 21 nt, Human
ugguggagugugcugagcaug

SEQ ID NO: 1112772 - RNA, 22 nt, Human
ucaaugauuagaguuuagugug

SEQ ID NO: 1112773 - RNA, 22 nt, Human
agaaaguucugugaguuguuca

SEQ ID NO: 1112774 - RNA, 22 nt, Human
uuguccuuaccucaaucuggaa

SEQ ID NO: 1112775 - RNA, 22 nt, Human
ucccaguguggcaggccaugga

SEQ ID NO: 1112776 - RNA, 22 nt, Human
accacugcccauggugaaaacu

SEQ ID NO: 1112777 - RNA, 22 nt, Human
gggcuggaggaccggccucgga

SEQ ID NO: 1112778 - RNA, 22 nt, Human
auuuaucaccaguuagcugacu

SEQ ID NO: 1112779 - RNA, 22 nt, Human
ggagugggcagcacugcccugu

SEQ ID NO: 1112780 - RNA, 22 nt, Human
acuggcagagguuggacaccau

SEQ ID NO: 1112781 - RNA, 22 nt, Human
guacuuccguggacuaauuguu

SEQ ID NO: 1112782 - RNA, 22 nt, Human
uuugcauugccucugacuuaug

SEQ ID NO: 1112783 - RNA, 22 nt, Human
uaaugcacagaauugacauggg

SEQ ID NO: 1112784 - RNA, 22 nt, Human
cccugagaugccucacccuagu

SEQ ID NO: 1112785 - RNA, 20 nt, Human
agugcaagaaagcacagcug

SEQ ID NO: 1112786 - RNA, 22 nt, Human
gcccagcaccucucucaggguu

SEQ ID NO: 1112787 - RNA, 22 nt, Human
gugcuuccaucuagagggucac

SEQ ID NO: 1112788 - RNA, 22 nt, Human
cucaggaugcaauuccaucaag

SEQ ID NO: 1112789 - RNA, 22 nt, Human
gcagauggugggggaggaguac

SEQ ID NO: 1112790 - RNA, 22 nt, Human
ccagggucuuggagaggagugc

SEQ ID NO: 1112791 - RNA, 22 nt, Human
ggaggccaugaggcucuaggug

SEQ ID NO: 1112792 - RNA, 22 nt, Human
aggccucacucucagagcuucu

SEQ ID NO: 1112793 - RNA, 22 nt, Human
cauuucuguucucuuccuguac

SEQ ID NO: 1112794 - RNA, 22 nt, Human
cagagcugcaaaugccccuccg

SEQ ID NO: 1112795 - RNA, 22 nt, Human
cugucaucacaguugagcagcc

SEQ ID NO: 1112796 - RNA, 19 nt, Human
aggugaugugacucuagaa

SEQ ID NO: 1112797 - RNA, 22 nt, Human
caggagcccguugcuccggcgg

SEQ ID NO: 1112798 - RNA, 22 nt, Human
uggaaagaauuccuaugguuca

SEQ ID NO: 1112799 - RNA, 22 nt, Human
ccacagggcacaagggagguug

SEQ ID NO: 1112800 - RNA, 22 nt, Human
uauauguaagcuauguaagagu

SEQ ID NO: 1112801 - RNA, 22 nt, Human
cccagcuccagagccagaaaca

SEQ ID NO: 1112802 - RNA, 19 nt, Human
uagcugccuguuaccucca

SEQ ID NO: 1112803 - RNA, 22 nt, Human
ccuggaaguuggagguugcagu

SEQ ID NO: 1112804 - RNA, 18 nt, Human
gggcccuggcguccgccc

SEQ ID NO: 1112805 - RNA, 22 nt, Human
aggcugucugaccccagagccc

SEQ ID NO: 1112806 - RNA, 22 nt, Human
uggccucuuacgacauagccuu

SEQ ID NO: 1112807 - RNA, 22 nt, Human
cugagaggcacaaggcauuucg

SEQ ID NO: 1112808 - RNA, 22 nt, Human
guggcugcuaagucuccuuccu

SEQ ID NO: 1112809 - RNA, 22 nt, Human
aggcuccaugcaaaggcuguuu

SEQ ID NO: 1112810 - RNA, 22 nt, Human
gccagggaggcuguaggguccu

SEQ ID NO: 1112811 - RNA, 22 nt, Human
gcuggccuugugucugaggaag

SEQ ID NO: 1112812 - RNA, 22 nt, Human
uugcaggggaaggagcagagcu

SEQ ID NO: 1112813 - RNA, 22 nt, Human
caggccugugaguugaggcccc

SEQ ID NO: 1112814 - RNA, 22 nt, Human
gccugguggacacugggcauca

SEQ ID NO: 1112815 - RNA, 22 nt, Human
gaaaugcauaaucuuaguagau

SEQ ID NO: 1112816 - RNA, 22 nt, Human
ugucucagauacgccaucaagg

SEQ ID NO: 1112817 - RNA, 22 nt, Human
cccuggagucagguuggccugg

SEQ ID NO: 1112818 - RNA, 22 nt, Human
uacauguauugauuucucuucu

SEQ ID NO: 1112819 - RNA, 22 nt, Human
uggcagagcaaaaagauagaau

SEQ ID NO: 1112820 - RNA, 22 nt, Human
ucaguuuugaaaacauugaaug

SEQ ID NO: 1112821 - RNA, 22 nt, Human
gaugcugaagugaagugaucuu

SEQ ID NO: 1112822 - RNA, 22 nt, Human
acagggcagaaauguugcaucu

SEQ ID NO: 1112823 - RNA, 22 nt, Human
ccugccuguacuagagacccag

SEQ ID NO: 1112824 - RNA, 22 nt, Human
cccccaggcucugacacaggag

SEQ ID NO: 1112825 - RNA, 22 nt, Human
gcuggccaguguggugaccacc

SEQ ID NO: 1112826 - RNA, 23 nt, Human
gcugagguacauuuacaggaaga

SEQ ID NO: 1112827 - RNA, 22 nt, Human
agcagcuggggccugugacgau

SEQ ID NO: 1112828 - RNA, 22 nt, Human
guggagacuucuacuagagacc

SEQ ID NO: 1112829 - RNA, 22 nt, Human
aaaagagucuuaggcagucaua

SEQ ID NO: 1112830 - RNA, 22 nt, Human
uggcucuguugugcugagccag

SEQ ID NO: 1112831 - RNA, 22 nt, Human
cugucagcacucuacuacagau

SEQ ID NO: 1112832 - RNA, 22 nt, Human
agggcugcugcuccgggcccag

SEQ ID NO: 1112833 - RNA, 21 nt, Human
cacucaggguaugugccaggc

SEQ ID NO: 1112834 - RNA, 22 nt, Human
auccuugaacuuagacacuagg

SEQ ID NO: 1112835 - RNA, 22 nt, Human
uacauuaucuuguuaucuuuca

SEQ ID NO: 1112836 - RNA, 20 nt, Human
aaaguguaagcauauaauua

SEQ ID NO: 1112837 - RNA, 22 nt, Human
augaugguaaauucaguauccg

SEQ ID NO: 1112838 - RNA, 22 nt, Human
aaaucagugcucauuugaaagg

SEQ ID NO: 1112839 - RNA, 18 nt, Human
aggccagcccugcuacug

SEQ ID NO: 1112840 - RNA, 22 nt, Human
ccugggagugucagacuugcuu

SEQ ID NO: 1112841 - RNA, 22 nt, Human
ucccagaggacuguuggugcua

SEQ ID NO: 1112842 - RNA, 22 nt, Human
uggcucagaacuacuucuaguu

SEQ ID NO: 1112843 - RNA, 22 nt, Human
ucccacugcuuugcucugcuca

SEQ ID NO: 1112844 - RNA, 22 nt, Human
aagauacugaugauguaggcua

SEQ ID NO: 1112845 - RNA, 22 nt, Human
gcucuggacuggggccugagaa

SEQ ID NO: 1112846 - RNA, 22 nt, Human
gauucugagcugguguuuuacg

SEQ ID NO: 1112847 - RNA, 22 nt, Human
uuagaaaaaggcuguggucuua

SEQ ID NO: 1112848 - RNA, 19 nt, Human
ugggcuuccccagggcaga

SEQ ID NO: 1112849 - RNA, 22 nt, Human
aagaacaguugggaggugagcc

SEQ ID NO: 1112850 - RNA, 22 nt, Human
cugccuggcuaaacucaagucg

SEQ ID NO: 1112851 - RNA, 22 nt, Human
ugggcugccagcucuccagaug

SEQ ID NO: 1112852 - RNA, 22 nt, Human
gaaaugcaggcuuggauucagc

SEQ ID NO: 1112853 - RNA, 22 nt, Human
ggccuugggcuggcugcaguau

SEQ ID NO: 1112854 - RNA, 22 nt, Human
aggacagaccuaggacuggagc

SEQ ID NO: 1112855 - RNA, 22 nt, Human
gugugccaacaaaagacagugc

SEQ ID NO: 1112856 - RNA, 22 nt, Human
ugcuguagcccugcacagugca

SEQ ID NO: 1112857 - RNA, 22 nt, Human
uagaaaagaauuuuauuugaua

SEQ ID NO: 1112858 - RNA, 22 nt, Human
agcucugggccaggaacccuaa

SEQ ID NO: 1112859 - RNA, 22 nt, Human
ucugucaccgagggcauccaaa

SEQ ID NO: 1112860 - RNA, 22 nt, Human
cugggcagagcuaacaccugag

SEQ ID NO: 1112861 - RNA, 22 nt, Human
uucaaugagcccaagaacguga

SEQ ID NO: 1112862 - RNA, 21 nt, Human
agcugagcccagaagacuggu

SEQ ID NO: 1112863 - RNA, 22 nt, Human
gguggccucgguggugcacagg

SEQ ID NO: 1112864 - RNA, 22 nt, Human
ggcagcacugcagcuuguuggg

SEQ ID NO: 1112865 - RNA, 22 nt, Human
cuggcccuucucuugcuuccug

SEQ ID NO: 1112866 - RNA, 22 nt, Human
ccagguggcuucugcccgaugu

SEQ ID NO: 1112867 - RNA, 22 nt, Human
gagcccucucuguaggcaagua

SEQ ID NO: 1112868 - RNA, 22 nt, Human
ugucaugcccaggagcaaggua

SEQ ID NO: 1112869 - RNA, 22 nt, Human
ccagcuggugacauccccaacc

SEQ ID NO: 1112870 - RNA, 22 nt, Human
agcacuuuccuggcaaaugugg

SEQ ID NO: 1112871 - RNA, 22 nt, Human
acugugcaugaaccgaaacaaa

SEQ ID NO: 1112872 - RNA, 21 nt, Human
gcacagggacagaucaucaca

SEQ ID NO: 1112873 - RNA, 22 nt, Human
aggcaggcucaggcccaugcuu

SEQ ID NO: 1112874 - RNA, 22 nt, Human
auguaacuucugugaaucugac

SEQ ID NO: 1112875 - RNA, 22 nt, Human
ugugccuucucaguccugcuca

SEQ ID NO: 1112876 - RNA, 22 nt, Human
gcugagugagguccagagcuug

SEQ ID NO: 1112877 - RNA, 22 nt, Human
auacauuagaaucugguacuca

SEQ ID NO: 1112878 - RNA, 22 nt, Human
agccccuuccaguucucagauc

SEQ ID NO: 1112879 - RNA, 22 nt, Human
uuuccaauaaagugucauuguu

SEQ ID NO: 1112880 - RNA, 22 nt, Human
agcucccagagcucgagaguaa

SEQ ID NO: 1112881 - RNA, 22 nt, Human
aagcagcagaccugauuuugaa

SEQ ID NO: 1112882 - RNA, 22 nt, Human
cuggcugcgucugcucugacag

SEQ ID NO: 1112883 - RNA, 22 nt, Human
cagcucccuauggugaggcgac

SEQ ID NO: 1112884 - RNA, 22 nt, Human
acugaaauacugcucuuggauu

SEQ ID NO: 1112885 - RNA, 22 nt, Human
ugugcaguuucuauguugucca

SEQ ID NO: 1112886 - RNA, 22 nt, Human
ggcugcagcagagggacucacg

SEQ ID NO: 1112887 - RNA, 17 nt, Human
uggacccuugggccucc

SEQ ID NO: 1112888 - RNA, 22 nt, Human
gccugccuucggugcgcagcgg

SEQ ID NO: 1112889 - RNA, 22 nt, Human
ccagcccuucccaacuggccag

SEQ ID NO: 1112890 - RNA, 22 nt, Human
acugcuuuucuaagauucugug

SEQ ID NO: 1112891 - RNA, 22 nt, Human
ccagggcagugggagaaggugc

SEQ ID NO: 1112892 - RNA, 22 nt, Human
caggugggccgggguuuguucu

SEQ ID NO: 1112893 - RNA, 22 nt, Human
uucaaugauuuuuagggaucau

SEQ ID NO: 1112894 - RNA, 22 nt, Human
uguguuuuacaaauucucuuaa

SEQ ID NO: 1112895 - RNA, 22 nt, Human
uggcucagaagaaaagguaaac

SEQ ID NO: 1112896 - RNA, 22 nt, Human
aauguacaauaagacaaagagg

SEQ ID NO: 1112897 - RNA, 22 nt, Human
aggcuggggaauugaauuugcu

SEQ ID NO: 1112898 - RNA, 22 nt, Human
gcacagaagagcuuuggaauga

SEQ ID NO: 1112899 - RNA, 22 nt, Human
ugguggcuguugcagaacugag

SEQ ID NO: 1112900 - RNA, 22 nt, Human
uccucaggucaaagcaggagaa

SEQ ID NO: 1112901 - RNA, 22 nt, Human
agauacauugaguuuccuccug

SEQ ID NO: 1112902 - RNA, 22 nt, Human
aguggcagaagucacuggguag

SEQ ID NO: 1112903 - RNA, 22 nt, Human
gcugagaguguaggauguuuac

SEQ ID NO: 1112904 - RNA, 22 nt, Human
ggccagaaguuggaaaagagcc

SEQ ID NO: 1112905 - RNA, 22 nt, Human
caguuucuuaucuucaaaauug

SEQ ID NO: 1112906 - RNA, 22 nt, Human
auaauuuacuaagcucuaccuu

SEQ ID NO: 1112907 - RNA, 22 nt, Human
ugugcuucagguugucgccacg

SEQ ID NO: 1112908 - RNA, 22 nt, Human
augucuaaaagauaaaguuuaa

SEQ ID NO: 1112909 - RNA, 20 nt, Human
gccuguccugagugucaugg

SEQ ID NO: 1112910 - RNA, 22 nt, Human
gagagaagaaagccaugguccu

SEQ ID NO: 1112911 - RNA, 20 nt, Human
acauugauuauguuuguaga

SEQ ID NO: 1112912 - RNA, 22 nt, Human
ugucaccucuuuggcugcagcu

SEQ ID NO: 1112913 - RNA, 18 nt, Human
cuucagugacagucuggc

SEQ ID NO: 1112914 - RNA, 22 nt, Human
agcaggaguuugaugcuuuuau

SEQ ID NO: 1112915 - RNA, 22 nt, Human
cagcuggcuccaccucugggcu

SEQ ID NO: 1112916 - RNA, 21 nt, Human
gggaaauuaggauugcucauc

SEQ ID NO: 1112917 - RNA, 23 nt, Human
auucuucauuaucuucuagaaaa

SEQ ID NO: 1112918 - RNA, 22 nt, Human
gugucaugggagucagaaguga

SEQ ID NO: 1112919 - RNA, 22 nt, Human
ucugagagguuaagcaauuuga

SEQ ID NO: 1112920 - RNA, 19 nt, Human
cugugcuuuaaacuccuau

SEQ ID NO: 1112921 - RNA, 22 nt, Human
uggcucagcgcggccuggucuu

SEQ ID NO: 1112922 - RNA, 22 nt, Human
agccacagggggugagggacaa

SEQ ID NO: 1112923 - RNA, 22 nt, Human
cugggcucagaugagaggaagg

SEQ ID NO: 1112924 - RNA, 22 nt, Human
uaaauucccaacucugcucuuc

SEQ ID NO: 1112925 - RNA, 22 nt, Human
ucugggcucugucagcaccucu

SEQ ID NO: 1112926 - RNA, 22 nt, Human
ucuggaaguuagaggaggaaag

SEQ ID NO: 1112927 - RNA, 22 nt, Human
aaugauguauuaguacaacaca

SEQ ID NO: 1112928 - RNA, 22 nt, Human
gcaguccucucauuggccuccu

SEQ ID NO: 1112929 - RNA, 22 nt, Human
gagccuggccuccugccucagc

SEQ ID NO: 1112930 - RNA, 22 nt, Human
agguggggaaaccagcgauccc

SEQ ID NO: 1112931 - RNA, 20 nt, Human
acccagcucugugcccuggg

SEQ ID NO: 1112932 - RNA, 22 nt, Human
cuggcaggcggcagagcccagg

SEQ ID NO: 1112933 - RNA, 22 nt, Human
cuguauuuaguuaaaaugcuaa

SEQ ID NO: 1112934 - RNA, 17 nt, Human
auuucacuuagcaugag

SEQ ID NO: 1112935 - RNA, 22 nt, Human
gcauugucaaaagugguaugac

SEQ ID NO: 1112936 - RNA, 22 nt, Human
ucaaugauagacaagaucuaag

SEQ ID NO: 1112937 - RNA, 22 nt, Human
agucccagugagaugaaccagg

SEQ ID NO: 1112938 - RNA, 22 nt, Human
caugucuguguacacaugcaca

SEQ ID NO: 1112939 - RNA, 22 nt, Human
cugcucuggggaagccagaugu

SEQ ID NO: 1112940 - RNA, 22 nt, Human
aggucauuacaauuaucauuuu

SEQ ID NO: 1112941 - RNA, 22 nt, Human
accugggagucacaccugagaa

SEQ ID NO: 1112942 - RNA, 22 nt, Human
uguuaacaucuuggacucguga

SEQ ID NO: 1112943 - RNA, 22 nt, Human
cagugcagccaaggacaggcac

SEQ ID NO: 1112944 - RNA, 22 nt, Human
cugugucucuccuuacaagacu

SEQ ID NO: 1112945 - RNA, 22 nt, Human
ucccagagccucugccacucug

SEQ ID NO: 1112946 - RNA, 22 nt, Human
ucucuccuuaucauuguguuua

SEQ ID NO: 1112947 - RNA, 22 nt, Human
uggcuccuaggauggugccugg

SEQ ID NO: 1112948 - RNA, 22 nt, Human
uaauguguccugaaagcuucug

SEQ ID NO: 1112949 - RNA, 22 nt, Human
ucacuguaucauguugcacuua

SEQ ID NO: 1112950 - RNA, 22 nt, Human
cuguccuccggccaccuacagu

SEQ ID NO: 1112951 - RNA, 22 nt, Human
agccucugacugucagcaaggu

SEQ ID NO: 1112952 - RNA, 22 nt, Human
agggacagucuacuguucacug

SEQ ID NO: 1112953 - RNA, 22 nt, Human
gugcugucguggaacugggcug

SEQ ID NO: 1112954 - RNA, 22 nt, Human
ugaaaguugcacauaagagaau

SEQ ID NO: 1112955 - RNA, 22 nt, Human
cccagagcugagucugauauau

SEQ ID NO: 1112956 - RNA, 17 nt, Human
gaaagguccuagaaauc

SEQ ID NO: 1112957 - RNA, 22 nt, Human
ccucagaguaggucucagcugu

SEQ ID NO: 1112958 - RNA, 22 nt, Human
cucugagcugaaacaugagcau

SEQ ID NO: 1112959 - RNA, 22 nt, Human
uggagcugggguuugaaucugg

SEQ ID NO: 1112960 - RNA, 22 nt, Human
guccucuggaagaugaguucuu

SEQ ID NO: 1112961 - RNA, 22 nt, Human
ugucccauggauaccaggcuau

SEQ ID NO: 1112962 - RNA, 22 nt, Human
uccacuuuagcaaugauugaau

SEQ ID NO: 1112963 - RNA, 22 nt, Human
acagaaauauucguggugcuug

SEQ ID NO: 1112964 - RNA, 22 nt, Human
ggcugcucugccuuccagcugg

SEQ ID NO: 1112965 - RNA, 22 nt, Human
ccugagaccaaguugcagccau

SEQ ID NO: 1112966 - RNA, 22 nt, Human
gggagggaaggaggcgccgugu

SEQ ID NO: 1112967 - RNA, 22 nt, Human
ugucucagggcagcagcagggg

SEQ ID NO: 1112968 - RNA, 22 nt, Human
ggugccaggcuguagucagggu

SEQ ID NO: 1112969 - RNA, 22 nt, Human
uaaccauauuuuccauuaaguu

SEQ ID NO: 1112970 - RNA, 22 nt, Human
ccaggccuccugugaguggacc

SEQ ID NO: 1112971 - RNA, 22 nt, Human
aggcagaaaauagucauccaaa

SEQ ID NO: 1112972 - RNA, 22 nt, Human
gccucugcaucuucgccgcacu

SEQ ID NO: 1112973 - RNA, 22 nt, Human
gggcuggcgggaaaggcaauuc

SEQ ID NO: 1112974 - RNA, 22 nt, Human
agauacauauagaaaacaucaa

SEQ ID NO: 1112975 - RNA, 21 nt, Human
guuugcaugaacaagucagcc

SEQ ID NO: 1112976 - RNA, 22 nt, Human
ugucuguacaaauuuucugugu

SEQ ID NO: 1112977 - RNA, 22 nt, Human
aagaggaacugggggcugaguc

SEQ ID NO: 1112978 - RNA, 22 nt, Human
uuuuucaugagacuagaaguca

SEQ ID NO: 1112979 - RNA, 22 nt, Human
gcaggcagagaaggaacauuua

SEQ ID NO: 1112980 - RNA, 22 nt, Human
acugugcuuucucuggaggcau

SEQ ID NO: 1112981 - RNA, 22 nt, Human
uggcucaggccuacgacgccuu

SEQ ID NO: 1112982 - RNA, 22 nt, Human
agcugccagggacugggcaugg

SEQ ID NO: 1112983 - RNA, 22 nt, Human
uucuuuccccauggaguucgga

SEQ ID NO: 1112984 - RNA, 22 nt, Human
agggccugucagcgguguccug

SEQ ID NO: 1112985 - RNA, 22 nt, Human
acagggcagugucuugaaaaau

SEQ ID NO: 1112986 - RNA, 22 nt, Human
cugacccauauaagaguggagg

SEQ ID NO: 1112987 - RNA, 22 nt, Human
gggacuggaacuacuggugcag

SEQ ID NO: 1112988 - RNA, 22 nt, Human
gccugggugucgaucacuagug

SEQ ID NO: 1112989 - RNA, 22 nt, Human
cccaggucugugccagcucuga

SEQ ID NO: 1112990 - RNA, 22 nt, Human
cugaaggagcauagucaguuuu

SEQ ID NO: 1112991 - RNA, 22 nt, Human
cagcugccacuugcucucggcu

SEQ ID NO: 1112992 - RNA, 22 nt, Human
ucccacacagcccgcucaccgg

SEQ ID NO: 1112993 - RNA, 15 nt, Human
cagucccagggaccc

SEQ ID NO: 1112994 - RNA, 22 nt, Human
ugcuauaagaauuauauuacuc

SEQ ID NO: 1112995 - RNA, 22 nt, Human
cuuugcauacaauuuuuagaaa

SEQ ID NO: 1112996 - RNA, 21 nt, Human
ggagucauuagucauuuccuu

SEQ ID NO: 1112997 - RNA, 22 nt, Human
acagagcauauaaagugcuuug

SEQ ID NO: 1112998 - RNA, 22 nt, Human
uggagggcaucuguggucaggc

SEQ ID NO: 1112999 - RNA, 22 nt, Human
gcugucuuccuugcuccaaggg

SEQ ID NO: 1113000 - RNA, 22 nt, Human
gcagcaggagaguuuguccugc

SEQ ID NO: 1113001 - RNA, 22 nt, Human
ucuggcucucaacaaauauuua

SEQ ID NO: 1113002 - RNA, 22 nt, Human
cuucagaacuauaaaaaguacu

SEQ ID NO: 1113003 - RNA, 22 nt, Human
uagaaaucauuuagaaguauug

SEQ ID NO: 1113004 - RNA, 22 nt, Human
ggauggagaugaccauggugac

SEQ ID NO: 1113005 - RNA, 22 nt, Human
uaacagaaauagaaaugagagu

SEQ ID NO: 1113006 - RNA, 22 nt, Human
gcaggcaguugcaguuuucuag

SEQ ID NO: 1113007 - RNA, 22 nt, Human
cuggccagaguuggagggugug

SEQ ID NO: 1113008 - RNA, 22 nt, Human
uggcucuggugcgggcuccugc

SEQ ID NO: 1113009 - RNA, 22 nt, Human
cuucuggaggacacuggcccca

SEQ ID NO: 1113010 - RNA, 22 nt, Human
ucucagagugguggucccucug

SEQ ID NO: 1113011 - RNA, 22 nt, Human
cugucugcuagaacaucuauac

SEQ ID NO: 1113012 - RNA, 20 nt, Human
ugcucaggauggagaggugu

SEQ ID NO: 1113013 - RNA, 22 nt, Human
agggcagagggugccucaccug

SEQ ID NO: 1113014 - RNA, 22 nt, Human
ugaacagauggcccagcagagg

SEQ ID NO: 1113015 - RNA, 22 nt, Human
uuuuaaucaugcuucuaugucc

SEQ ID NO: 1113016 - RNA, 22 nt, Human
agaggcugaaugaugucaucau

SEQ ID NO: 1113017 - RNA, 22 nt, Human
gggcauggaggucugucugcag

SEQ ID NO: 1113018 - RNA, 22 nt, Human
aguggcagagguugacugcagu

SEQ ID NO: 1113019 - RNA, 22 nt, Human
uggcagaaguucacuaguagcu

SEQ ID NO: 1113020 - RNA, 22 nt, Human
ggcacucagagauucaggcugu

SEQ ID NO: 1113021 - RNA, 22 nt, Human
gcaggggaguggcaggcccgga

SEQ ID NO: 1113022 - RNA, 22 nt, Human
uccuugaauggacauuacacug

SEQ ID NO: 1113023 - RNA, 20 nt, Human
ccucucugaagaggucaucu

SEQ ID NO: 1113024 - RNA, 22 nt, Human
ucccugcucagcucaccuggca

SEQ ID NO: 1113025 - RNA, 22 nt, Human
ggguuggggcccagcagucugc

SEQ ID NO: 1113026 - RNA, 22 nt, Human
aagaugcuuauugcuccugcag

SEQ ID NO: 1113027 - RNA, 22 nt, Human
uguguauuucuggaacagacua

SEQ ID NO: 1113028 - RNA, 22 nt, Human
augacagaaggccucccugaca

SEQ ID NO: 1113029 - RNA, 22 nt, Human
cucagaguucuccugggaggug

SEQ ID NO: 1113030 - RNA, 21 nt, Human
ugcaggaaagugcugcgaccc

SEQ ID NO: 1113031 - RNA, 22 nt, Human
ucuggcuccaggaccgggcaca

SEQ ID NO: 1113032 - RNA, 22 nt, Human
gcaaggcugcugccacccaucu

SEQ ID NO: 1113033 - RNA, 22 nt, Human
cacugcaguaacucuaggacug

SEQ ID NO: 1113034 - RNA, 20 nt, Human
ugcuccaucuaaagugauua

SEQ ID NO: 1113035 - RNA, 22 nt, Human
cagggcacaguuauggaggugg

SEQ ID NO: 1113036 - RNA, 17 nt, Human
agaaagaggauccacag

SEQ ID NO: 1113037 - RNA, 21 nt, Human
gcagagccugagguucuugag

SEQ ID NO: 1113038 - RNA, 22 nt, Human
uaggccaggacagagcuuccag

SEQ ID NO: 1113039 - RNA, 22 nt, Human
aggcacuguggaagacaugguu

SEQ ID NO: 1113040 - RNA, 22 nt, Human
agcuguccuggcucaggcugug

SEQ ID NO: 1113041 - RNA, 22 nt, Human
ccccaccugugcgucugccgca

SEQ ID NO: 1113042 - RNA, 22 nt, Human
cucaggagaugacagaagguau

SEQ ID NO: 1113043 - RNA, 19 nt, Human
gugaggauacugcucagag

SEQ ID NO: 1113044 - RNA, 22 nt, Human
gcucacugccauucucuagaug

SEQ ID NO: 1113045 - RNA, 22 nt, Human
ucacagugaugacgugggagca

SEQ ID NO: 1113046 - RNA, 22 nt, Human
gcccucucggcauagcaggggc

SEQ ID NO: 1113047 - RNA, 22 nt, Human
cuggugcuggagccuagucccu

SEQ ID NO: 1113048 - RNA, 22 nt, Human
gggccacacagaaccuccuggu

SEQ ID NO: 1113049 - RNA, 22 nt, Human
ccuccaggaacuugagagacac

SEQ ID NO: 1113050 - RNA, 22 nt, Human
ggggcuggcucacuaagagacu

SEQ ID NO: 1113051 - RNA, 22 nt, Human
cagaguguggcaucuuccaacu

SEQ ID NO: 1113052 - RNA, 19 nt, Human
agcaccugugagagccugg

SEQ ID NO: 1113053 - RNA, 22 nt, Human
aaaucaguuguuauauuaaaga

SEQ ID NO: 1113054 - RNA, 22 nt, Human
cugugcuugacagugggaagca

SEQ ID NO: 1113055 - RNA, 22 nt, Human
uccuuggcagcagggagcauga

SEQ ID NO: 1113056 - RNA, 22 nt, Human
ugcagggcuacaggacuacaac

SEQ ID NO: 1113057 - RNA, 22 nt, Human
uuggagcccugaggaucuggau

SEQ ID NO: 1113058 - RNA, 22 nt, Human
caguauguacucuuaucaugua

SEQ ID NO: 1113059 - RNA, 22 nt, Human
gcccaggccggagagcagugcu

SEQ ID NO: 1113060 - RNA, 22 nt, Human
ccagccagcugcccuuggggcc

SEQ ID NO: 1113061 - RNA, 22 nt, Human
ugcaauaaguuguguuaucacu

SEQ ID NO: 1113062 - RNA, 19 nt, Human
ggcugggucuggcagguuc

SEQ ID NO: 1113063 - RNA, 22 nt, Human
cccucugcugccuggcuggguc

SEQ ID NO: 1113064 - RNA, 22 nt, Human
gcaguggcuaggagucuggcgu

SEQ ID NO: 1113065 - RNA, 23 nt, Human
gggagccauggguggucauggag

SEQ ID NO: 1113066 - RNA, 22 nt, Human
gggcccuggggccugauuugca

SEQ ID NO: 1113067 - RNA, 22 nt, Human
cuguuuucaaagagagagaaug

SEQ ID NO: 1113068 - RNA, 22 nt, Human
auaaggcagucacuggaauguu

SEQ ID NO: 1113069 - RNA, 22 nt, Human
agcaauauaaauguuggguaga

SEQ ID NO: 1113070 - RNA, 20 nt, Human
ucucaggccccaguuuucuu

SEQ ID NO: 1113071 - RNA, 18 nt, Human
auccuugaugagaggucu

SEQ ID NO: 1113072 - RNA, 22 nt, Human
uuccauauuuguguggcaaaag

SEQ ID NO: 1113073 - RNA, 22 nt, Human
aucuuugaagaggacuugaagu

SEQ ID NO: 1113074 - RNA, 19 nt, Human
gggcucuggccucaguggg

SEQ ID NO: 1113075 - RNA, 22 nt, Human
gcucaggacuggaggagcgggg

SEQ ID NO: 1113076 - RNA, 22 nt, Human
caaugugugcuuacaggccagu

SEQ ID NO: 1113077 - RNA, 22 nt, Human
uuuuccucugcaauaaaagcag

SEQ ID NO: 1113078 - RNA, 22 nt, Human
aagccagguguugugguaagag

SEQ ID NO: 1113079 - RNA, 21 nt, Human
uagcacuucgcuguaauuggg

SEQ ID NO: 1113080 - RNA, 22 nt, Human
auggcccaggccuccuguggcu

SEQ ID NO: 1113081 - RNA, 22 nt, Human
ucugccuuccccauaaucugau

SEQ ID NO: 1113082 - RNA, 19 nt, Human
cugguccugacugaggggu

SEQ ID NO: 1113083 - RNA, 22 nt, Human
gcagcuggggaggucgugggga

SEQ ID NO: 1113084 - RNA, 22 nt, Human
ugaugcugcugggaguggugcu

SEQ ID NO: 1113085 - RNA, 22 nt, Human
acuguguccuauuuccuugaca

SEQ ID NO: 1113086 - RNA, 22 nt, Human
ucucucagaggccaggguccug

SEQ ID NO: 1113087 - RNA, 22 nt, Human
ucaaaaguuucacauagagaua

SEQ ID NO: 1113088 - RNA, 22 nt, Human
guggauggauugaggcaguggg

SEQ ID NO: 1113089 - RNA, 22 nt, Human
cugcccuggucccauggcugau

SEQ ID NO: 1113090 - RNA, 22 nt, Human
gccucucucuacccaguaugau

SEQ ID NO: 1113091 - RNA, 22 nt, Human
ucuggccuauuucugucagauc

SEQ ID NO: 1113092 - RNA, 22 nt, Human
ugggaguguucuuggcuugcuu

SEQ ID NO: 1113093 - RNA, 22 nt, Human
aguggcaggcggagauguagga

SEQ ID NO: 1113094 - RNA, 22 nt, Human
acagagccaaaaggacauagua

SEQ ID NO: 1113095 - RNA, 22 nt, Human
agcucccagucuccucuccaug

SEQ ID NO: 1113096 - RNA, 23 nt, Human
gggauauggaccuuggaggaguc

SEQ ID NO: 1113097 - RNA, 22 nt, Human
caggguggcaggcaccauggcc

SEQ ID NO: 1113098 - RNA, 17 nt, Human
acacagggagagggagc

SEQ ID NO: 1113099 - RNA, 22 nt, Human
uccauugucuuugguccuagcc

SEQ ID NO: 1113100 - RNA, 22 nt, Human
ucagggcaggacaguguaggcc

SEQ ID NO: 1113101 - RNA, 22 nt, Human
gcugccuggagcucagccugcc

SEQ ID NO: 1113102 - RNA, 22 nt, Human
gugcugucaauugcuuucagua

SEQ ID NO: 1113103 - RNA, 22 nt, Human
uccaugugccaaggggcagagg

SEQ ID NO: 1113104 - RNA, 22 nt, Human
uuuccucuccaccaggaggucu

SEQ ID NO: 1113105 - RNA, 22 nt, Human
ccuggagcacauggcaggaggc

SEQ ID NO: 1113106 - RNA, 22 nt, Human
gagaggcugacuggcuguccug

SEQ ID NO: 1113107 - RNA, 22 nt, Human
caggggcugugggcggagccuc

SEQ ID NO: 1113108 - RNA, 22 nt, Human
aucuggguucaccaugcuccug

SEQ ID NO: 1113109 - RNA, 22 nt, Human
agcuaggaaauugaggcugaga

SEQ ID NO: 1113110 - RNA, 22 nt, Human
gcaaagucugcaucuggaucag

SEQ ID NO: 1113111 - RNA, 22 nt, Human
gagcugugagggacacauugcu

SEQ ID NO: 1113112 - RNA, 22 nt, Human
cuucugugcuucacaguugcca

SEQ ID NO: 1113113 - RNA, 22 nt, Human
ucugcagcuucuugccagagag

SEQ ID NO: 1113114 - RNA, 21 nt, Human
uguaugcacgcacaugcacac

SEQ ID NO: 1113115 - RNA, 22 nt, Human
ugggcagagucguggggaauag

SEQ ID NO: 1113116 - RNA, 22 nt, Human
cucucugagugagggacaagcu

SEQ ID NO: 1113117 - RNA, 22 nt, Human
gccaggcagcugggagggugcc

SEQ ID NO: 1113118 - RNA, 22 nt, Human
uccuggagaauccugccaccug

SEQ ID NO: 1113119 - RNA, 22 nt, Human
auacuuacuuuucuucagacua

SEQ ID NO: 1113120 - RNA, 22 nt, Human
ggcucugcagugacuugagggg

SEQ ID NO: 1113121 - RNA, 22 nt, Human
cagcuggcauaccugggcccgg

SEQ ID NO: 1113122 - RNA, 22 nt, Human
uugauacaggcucuauuucauc

SEQ ID NO: 1113123 - RNA, 22 nt, Human
uugcucaggcuuagagcuacua

SEQ ID NO: 1113124 - RNA, 22 nt, Human
uguaugcuuguguauaauauaa

SEQ ID NO: 1113125 - RNA, 22 nt, Human
uguaugcaaauuuauuagcaca

SEQ ID NO: 1113126 - RNA, 22 nt, Human
uuugcauuaucucacuuauaua

SEQ ID NO: 1113127 - RNA, 22 nt, Human
agggcagcacagcugugcuccu

SEQ ID NO: 1113128 - RNA, 22 nt, Human
caggguggaauggaaugcuggc

SEQ ID NO: 1113129 - RNA, 22 nt, Human
uaagauaugguaggaaguuugg

SEQ ID NO: 1113130 - RNA, 22 nt, Human
acauacuaugaauacauguguc

SEQ ID NO: 1113131 - RNA, 20 nt, Human
uaaggcuguuuuguauuccu

SEQ ID NO: 1113132 - RNA, 22 nt, Human
gcuggccugaccugaggcuggg

SEQ ID NO: 1113133 - RNA, 21 nt, Human
cugcaucucauagaacauguc

SEQ ID NO: 1113134 - RNA, 18 nt, Human
aaggcuucaaagaguaga

SEQ ID NO: 1113135 - RNA, 22 nt, Human
cacauacaaugguguuauuugg

SEQ ID NO: 1113136 - RNA, 22 nt, Human
aggccagcucacccuggcuccu

SEQ ID NO: 1113137 - RNA, 20 nt, Human
gcacugaagguuccagggga

SEQ ID NO: 1113138 - RNA, 22 nt, Human
uuguaacagguacuaaauaacu

SEQ ID NO: 1113139 - RNA, 22 nt, Human
agcacaggaccaaggaagcugu

SEQ ID NO: 1113140 - RNA, 22 nt, Human
aaucuggcauguaagcuuagag

SEQ ID NO: 1113141 - RNA, 23 nt, Human
aaggucacagaacuuagcaagcc

SEQ ID NO: 1113142 - RNA, 22 nt, Human
cugaaggagaaggccacuguuc

SEQ ID NO: 1113143 - RNA, 20 nt, Human
gacaggagaguuagguaggu

SEQ ID NO: 1113144 - RNA, 19 nt, Human
uugaggggccaggggagau

SEQ ID NO: 1113145 - RNA, 22 nt, Human
gagcugccagacaugggaauga

SEQ ID NO: 1113146 - RNA, 22 nt, Human
ugaaggaaugaguauacuguuu

SEQ ID NO: 1113147 - RNA, 22 nt, Human
uggccaggcagguagaacggcc

SEQ ID NO: 1113148 - RNA, 22 nt, Human
gcucuccaaacccuguggcuuu

SEQ ID NO: 1113149 - RNA, 22 nt, Human
ggaggccaaggcagguggauca

SEQ ID NO: 1113150 - RNA, 22 nt, Human
acauugaugaaaagguaucauu

SEQ ID NO: 1113151 - RNA, 21 nt, Human
ccugagggugguugugaagau

SEQ ID NO: 1113152 - RNA, 22 nt, Human
ugcaccauguaaguggccacgu

SEQ ID NO: 1113153 - RNA, 22 nt, Human
uggagaagucaaagugaacagg

SEQ ID NO: 1113154 - RNA, 22 nt, Human
gcugagagaaaagugagguucu

SEQ ID NO: 1113155 - RNA, 22 nt, Human
aggcugaggcagguggaucauu

SEQ ID NO: 1113156 - RNA, 22 nt, Human
gcugucugucucugugacuuaa

SEQ ID NO: 1113157 - RNA, 17 nt, Human
aggcauggucuggggug

SEQ ID NO: 1113158 - RNA, 22 nt, Human
ccagggugaggaggcucccacg

SEQ ID NO: 1113159 - RNA, 22 nt, Human
aaggccauuauucugauauauu

SEQ ID NO: 1113160 - RNA, 19 nt, Human
aggacucuggaggcaugag

SEQ ID NO: 1113161 - RNA, 21 nt, Human
ccugccaggaaacugaguguc

SEQ ID NO: 1113162 - RNA, 22 nt, Human
agcagggcuugccgcuuguccu

SEQ ID NO: 1113163 - RNA, 22 nt, Human
augugaaagagguguucagugg

SEQ ID NO: 1113164 - RNA, 22 nt, Human
agagcccuuucuccaggcaccu

SEQ ID NO: 1113165 - RNA, 22 nt, Human
ccaggacuuauuacaguauaac

SEQ ID NO: 1113166 - RNA, 22 nt, Human
cugugcuuccaggauggcagcu

SEQ ID NO: 1113167 - RNA, 22 nt, Human
gugucccagcagcacauuggcu

SEQ ID NO: 1113168 - RNA, 22 nt, Human
uugcauuguugcaaugaaguau

SEQ ID NO: 1113169 - RNA, 22 nt, Human
ugggacagagugagcuuuggcc

SEQ ID NO: 1113170 - RNA, 22 nt, Human
gcagagguggcaucugggcucu

SEQ ID NO: 1113171 - RNA, 22 nt, Human
gccuggaggggccaggguggua

SEQ ID NO: 1113172 - RNA, 22 nt, Human
ugggcagauguccucugaagug

SEQ ID NO: 1113173 - RNA, 22 nt, Human
ugucucaggcccaagccaguaa

SEQ ID NO: 1113174 - RNA, 22 nt, Human
agccugagccccauccagcuga

SEQ ID NO: 1113175 - RNA, 22 nt, Human
ugagcccaggaguuggaggcug

SEQ ID NO: 1113176 - RNA, 22 nt, Human
ucaagauaccaccauuauaugu

SEQ ID NO: 1113177 - RNA, 22 nt, Human
auccaaagcccuaaguuaacug

SEQ ID NO: 1113178 - RNA, 22 nt, Human
aggucaaguuuagauagaguua

SEQ ID NO: 1113179 - RNA, 22 nt, Human
cuggagaggccccaagauauuu

SEQ ID NO: 1113180 - RNA, 22 nt, Human
agcagccauuuaaaaugaauug

SEQ ID NO: 1113181 - RNA, 22 nt, Human
uuuccucuucuggcaggcaggg

SEQ ID NO: 1113182 - RNA, 22 nt, Human
ugggcaggaugcguugauucuu

SEQ ID NO: 1113183 - RNA, 22 nt, Human
auacaugucaucauauguuugu

SEQ ID NO: 1113184 - RNA, 22 nt, Human
cugagccagagggagucggguc

SEQ ID NO: 1113185 - RNA, 22 nt, Human
ccugccagugaagcugacgggc

SEQ ID NO: 1113186 - RNA, 22 nt, Human
agcaguggcugaagauguuccu

SEQ ID NO: 1113187 - RNA, 22 nt, Human
ggcuggcaagugucugcucaug

SEQ ID NO: 1113188 - RNA, 19 nt, Human
caguggagauuggaggagg

SEQ ID NO: 1113189 - RNA, 20 nt, Human
ggguggaguugcggucugug

SEQ ID NO: 1113190 - RNA, 22 nt, Human
acuccagggcuccaucccuugu

SEQ ID NO: 1113191 - RNA, 22 nt, Human
gcucucuggguggugggcaaca

SEQ ID NO: 1113192 - RNA, 22 nt, Human
uaacagaagaaaacauauugga

SEQ ID NO: 1113193 - RNA, 22 nt, Human
cuggagccauguauagccuaug

SEQ ID NO: 1113194 - RNA, 22 nt, Human
ucugccugagggagcugaggaa

SEQ ID NO: 1113195 - RNA, 23 nt, Human
caguacuuaguguagcguuaauu

SEQ ID NO: 1113196 - RNA, 22 nt, Human
aagagggaggugcgggugcaga

SEQ ID NO: 1113197 - RNA, 22 nt, Human
uggguggcacuucuggggucca

SEQ ID NO: 1113198 - RNA, 22 nt, Human
gcagagcuguuaauggagcuga

SEQ ID NO: 1113199 - RNA, 22 nt, Human
uaguaaaaguuuaguugaaagu

SEQ ID NO: 1113200 - RNA, 22 nt, Human
caagggugguauugggagcaua

SEQ ID NO: 1113201 - RNA, 22 nt, Human
gcagcagaguuugggagauggu

SEQ ID NO: 1113202 - RNA, 22 nt, Human
ccucagggaggccucuguggcu

SEQ ID NO: 1113203 - RNA, 22 nt, Human
cacaggagcuguggggcagugu

SEQ ID NO: 1113204 - RNA, 22 nt, Human
uggcagggaguugcaggauuuc

SEQ ID NO: 1113205 - RNA, 22 nt, Human
aggccugagccccagguuuguu

SEQ ID NO: 1113206 - RNA, 22 nt, Human
cugggagcugucaggagcgugu

SEQ ID NO: 1113207 - RNA, 22 nt, Human
uuuguaaaaggaggaagcaugg

SEQ ID NO: 1113208 - RNA, 22 nt, Human
ugucacuucaggaaugcaggga

SEQ ID NO: 1113209 - RNA, 17 nt, Human
gagagcugcugcuuccg

SEQ ID NO: 1113210 - RNA, 22 nt, Human
ucuggcucuuugggugauugua

SEQ ID NO: 1113211 - RNA, 22 nt, Human
ugaaaucugcaugcaaaguccu

SEQ ID NO: 1113212 - RNA, 22 nt, Human
acacugaauguuuaagaacuug

SEQ ID NO: 1113213 - RNA, 22 nt, Human
cugcagaggucuugcugauggu

SEQ ID NO: 1113214 - RNA, 22 nt, Human
ggaggccaccugaccugcuguu

SEQ ID NO: 1113215 - RNA, 22 nt, Human
ggagucaggagcaggcugggcu

SEQ ID NO: 1113216 - RNA, 23 nt, Human
aggcagagccaaggucaaaaccc

SEQ ID NO: 1113217 - RNA, 22 nt, Human
gaggcagagucacaaagagucu

SEQ ID NO: 1113218 - RNA, 22 nt, Human
cagcuuccaucuccacugcccu

SEQ ID NO: 1113219 - RNA, 22 nt, Human
gcuggcaggguucucacugaaa

SEQ ID NO: 1113220 - RNA, 22 nt, Human
gucaugccagcggagcucggga

SEQ ID NO: 1113221 - RNA, 22 nt, Human
gcuggugagcaaaggagaagga

SEQ ID NO: 1113222 - RNA, 17 nt, Human
cugaggcccagggccca

SEQ ID NO: 1113223 - RNA, 22 nt, Human
agcagccacacgccuccuucuc

SEQ ID NO: 1113224 - RNA, 22 nt, Human
cuucaagauauuucuagaauca

SEQ ID NO: 1113225 - RNA, 22 nt, Human
ucagugucuugggcuugaaugc

SEQ ID NO: 1113226 - RNA, 22 nt, Human
aggcccugcccagagcuccucg

SEQ ID NO: 1113227 - RNA, 22 nt, Human
ucacugcagagaccucuaguca

SEQ ID NO: 1113228 - RNA, 22 nt, Human
caacagaagguguacuacugaa

SEQ ID NO: 1113229 - RNA, 22 nt, Human
acaggcuuuuuuagaaugacau

SEQ ID NO: 1113230 - RNA, 19 nt, Human
gagaggccugugcuugaag

SEQ ID NO: 1113231 - RNA, 22 nt, Human
ugggcagagaguagaggcaacg

SEQ ID NO: 1113232 - RNA, 22 nt, Human
gaggucaggggagaggcugaug

SEQ ID NO: 1113233 - RNA, 22 nt, Human
aguauuuccuggcuuaucugcu

SEQ ID NO: 1113234 - RNA, 22 nt, Human
gagggaaagguuaauacaugau

SEQ ID NO: 1113235 - RNA, 22 nt, Human
agcaggaaguagucuguaagca

SEQ ID NO: 1113236 - RNA, 22 nt, Human
uauguacaugauuucauuugcu

SEQ ID NO: 1113237 - RNA, 22 nt, Human
aggcugcuggcaggcguggacg

SEQ ID NO: 1113238 - RNA, 22 nt, Human
cuggccacuggagguggcaccc

SEQ ID NO: 1113239 - RNA, 22 nt, Human
ugggcagacgggagcuugccuu

SEQ ID NO: 1113240 - RNA, 19 nt, Human
ucacaggcaucuccccaga

SEQ ID NO: 1113241 - RNA, 22 nt, Human
ugagggcugcuuccagagcuag

SEQ ID NO: 1113242 - RNA, 22 nt, Human
ccccuuccaggaagcagaaucg

SEQ ID NO: 1113243 - RNA, 23 nt, Human
uggcucugagagguucagaugcu

SEQ ID NO: 1113244 - RNA, 22 nt, Human
ucagagaaaugaaguagggauu

SEQ ID NO: 1113245 - RNA, 22 nt, Human
gaagcagcaaaucugcaguauc

SEQ ID NO: 1113246 - RNA, 22 nt, Human
uuacaaaguucugaguucaaac

SEQ ID NO: 1113247 - RNA, 22 nt, Human
agccagagagccccagguucua

SEQ ID NO: 1113248 - RNA, 22 nt, Human
cugccucuugacagaucguggc

SEQ ID NO: 1113249 - RNA, 17 nt, Human
gccuggcccagccuggc

SEQ ID NO: 1113250 - RNA, 22 nt, Human
ucauccaguucacauggugagu

SEQ ID NO: 1113251 - RNA, 22 nt, Human
aagugaaacauguaucucuuua

SEQ ID NO: 1113252 - RNA, 22 nt, Human
ggucacugcucuaaacaaaagu

SEQ ID NO: 1113253 - RNA, 22 nt, Human
aaguuauugcagcaauccaagu

SEQ ID NO: 1113254 - RNA, 22 nt, Human
aguaaaaucuuaagcacagugg

SEQ ID NO: 1113255 - RNA, 22 nt, Human
ccucuuccacugggccccaucc

SEQ ID NO: 1113256 - RNA, 22 nt, Human
cagcugagcaucacuagucugg

SEQ ID NO: 1113257 - RNA, 22 nt, Human
uggcucagcugucacagccugg

SEQ ID NO: 1113258 - RNA, 22 nt, Human
agcuucuggaaggcaaggcuug

SEQ ID NO: 1113259 - RNA, 22 nt, Human
aaaugcaggaaauuaugcuuuu

SEQ ID NO: 1113260 - RNA, 22 nt, Human
ccaggagcaaagaucacuggga

SEQ ID NO: 1113261 - RNA, 22 nt, Human
ugggcagacugagcccuguccc

SEQ ID NO: 1113262 - RNA, 17 nt, Human
uucaaugauuaaugcau

SEQ ID NO: 1113263 - RNA, 22 nt, Human
aaaugucuuugaguauuucugc

SEQ ID NO: 1113264 - RNA, 22 nt, Human
cguguacagucuaucuuuuuuc

SEQ ID NO: 1113265 - RNA, 22 nt, Human
ugcccaggaucuggcgaugcuc

SEQ ID NO: 1113266 - RNA, 22 nt, Human
ucccuggccauuccucuaggcc

SEQ ID NO: 1113267 - RNA, 22 nt, Human
uggccucaagucugagggccuu

SEQ ID NO: 1113268 - RNA, 21 nt, Human
aaauguguuccauaaugcuuu

SEQ ID NO: 1113269 - RNA, 22 nt, Human
gugggugauguacuggaggcca

SEQ ID NO: 1113270 - RNA, 19 nt, Human
uggaggagaggaaaaguca

SEQ ID NO: 1113271 - RNA, 22 nt, Human
cagagaaacucagauagcugau

SEQ ID NO: 1113272 - RNA, 22 nt, Human
ggcucuggucagugaggggccu

SEQ ID NO: 1113273 - RNA, 22 nt, Human
uggcucaggugugagcugaaga

SEQ ID NO: 1113274 - RNA, 20 nt, Human
uggagcuguaaucuugucug

SEQ ID NO: 1113275 - RNA, 22 nt, Human
uguggcucucagauccuccaau

SEQ ID NO: 1113276 - RNA, 22 nt, Human
ugcauugcaguuaacucaguau

SEQ ID NO: 1113277 - RNA, 22 nt, Human
ccacagccauuccagggaggcu

SEQ ID NO: 1113278 - RNA, 22 nt, Human
ggcucuggugugaagcagccuc

SEQ ID NO: 1113279 - RNA, 22 nt, Human
ucaguuuuuaaaugauauaauu

SEQ ID NO: 1113280 - RNA, 22 nt, Human
agcuggguggagggcccacggu

SEQ ID NO: 1113281 - RNA, 22 nt, Human
cagcccuguccagcagagggug

SEQ ID NO: 1113282 - RNA, 22 nt, Human
ucuuucagccacuuaccugucu

SEQ ID NO: 1113283 - RNA, 22 nt, Human
ggcaggcugcuugggucauguc

SEQ ID NO: 1113284 - RNA, 22 nt, Human
gcucccuccaugaggcagaccg

SEQ ID NO: 1113285 - RNA, 22 nt, Human
uucugucacuuaggaggucaua

SEQ ID NO: 1113286 - RNA, 22 nt, Human
gggugggguucaggaaucuuca

SEQ ID NO: 1113287 - RNA, 22 nt, Human
ugagccagaggaggcugugugg

SEQ ID NO: 1113288 - RNA, 22 nt, Human
acaggcuucucacagaaaaggg

SEQ ID NO: 1113289 - RNA, 20 nt, Human
ggccugagcauggcuggcag

SEQ ID NO: 1113290 - RNA, 19 nt, Human
cugcucaggucagucuguc

SEQ ID NO: 1113291 - RNA, 22 nt, Human
cugcagcuauauuuucccacag

SEQ ID NO: 1113292 - RNA, 22 nt, Human
uuccuuccgggcaccaggcacu

SEQ ID NO: 1113293 - RNA, 22 nt, Human
agagcccucucauuggcuuauu

SEQ ID NO: 1113294 - RNA, 22 nt, Human
cagccagguaugggcgugcggg

SEQ ID NO: 1113295 - RNA, 22 nt, Human
gccuggagggcucuagagaggc

SEQ ID NO: 1113296 - RNA, 22 nt, Human
aagauucuacaguagguacauu

SEQ ID NO: 1113297 - RNA, 22 nt, Human
aaguucaaguguaaucuuuauu

SEQ ID NO: 1113298 - RNA, 22 nt, Human
acugggaggcaaagagcaagga

SEQ ID NO: 1113299 - RNA, 22 nt, Human
uaguccagccuuggguguagcc

SEQ ID NO: 1113300 - RNA, 22 nt, Human
ccuggccugugaaucugagagc

SEQ ID NO: 1113301 - RNA, 22 nt, Human
acugagcucuugacugggaguu

SEQ ID NO: 1113302 - RNA, 22 nt, Human
uauguacaccggggaagguggg

SEQ ID NO: 1113303 - RNA, 22 nt, Human
gucccuggaauggacucugcgc

SEQ ID NO: 1113304 - RNA, 22 nt, Human
gggccuggcaugcagccccguu

SEQ ID NO: 1113305 - RNA, 22 nt, Human
cagcuggcuggucagugcacaa

SEQ ID NO: 1113306 - RNA, 22 nt, Human
cugcugggcagaggcugcauga

SEQ ID NO: 1113307 - RNA, 22 nt, Human
ggcccagccggcgagucucgcg

SEQ ID NO: 1113308 - RNA, 18 nt, Human
aggcacuggaauuaaggg

SEQ ID NO: 1113309 - RNA, 22 nt, Human
ggcugcuggcauugagguaggu

SEQ ID NO: 1113310 - RNA, 22 nt, Human
aggacuccauguguccuggaga

SEQ ID NO: 1113311 - RNA, 22 nt, Human
agacuucucaguuuuauuagua

SEQ ID NO: 1113312 - RNA, 22 nt, Human
gcuggcuccucuguccucacgg

SEQ ID NO: 1113313 - RNA, 22 nt, Human
aucuggcuuuuaccccacggcc

SEQ ID NO: 1113314 - RNA, 22 nt, Human
ugcucuucggggccacugcuug

SEQ ID NO: 1113315 - RNA, 22 nt, Human
uccuugaagcaacgugcagaca

SEQ ID NO: 1113316 - RNA, 22 nt, Human
aaggccugcucagcugucugug

SEQ ID NO: 1113317 - RNA, 23 nt, Human
uggggccaagugaggaagggucu

SEQ ID NO: 1113318 - RNA, 22 nt, Human
gggagggaggugcugguucacg

SEQ ID NO: 1113319 - RNA, 22 nt, Human
agauuucaauggauauugcaag

SEQ ID NO: 1113320 - RNA, 22 nt, Human
ugcccacauggugccauggcca

SEQ ID NO: 1113321 - RNA, 22 nt, Human
auauguguacgugcaguauaua

SEQ ID NO: 1113322 - RNA, 22 nt, Human
cagggcuguggcuuugugcugu

SEQ ID NO: 1113323 - RNA, 22 nt, Human
uuaacagagugccuggcaugua

SEQ ID NO: 1113324 - RNA, 22 nt, Human
cagggccuuuuagcaucuucuc

SEQ ID NO: 1113325 - RNA, 22 nt, Human
cugggaggauucauugagguga

SEQ ID NO: 1113326 - RNA, 22 nt, Human
ucugagagcuguagaagccuau

SEQ ID NO: 1113327 - RNA, 22 nt, Human
accugccuucucaaggacauga

SEQ ID NO: 1113328 - RNA, 22 nt, Human
cauugcccaguaggaucaccag

SEQ ID NO: 1113329 - RNA, 22 nt, Human
gggacuguaaauucauauggcc

SEQ ID NO: 1113330 - RNA, 22 nt, Human
ccugucuguauugguuugcuau

SEQ ID NO: 1113331 - RNA, 22 nt, Human
ggcugccuucagacuccagcuu

SEQ ID NO: 1113332 - RNA, 22 nt, Human
uaguacuuaucucugucauugu

SEQ ID NO: 1113333 - RNA, 22 nt, Human
aaaacucugcaguuaguuucua

SEQ ID NO: 1113334 - RNA, 21 nt, Human
ugaaaguuggagucaaaugua

SEQ ID NO: 1113335 - RNA, 22 nt, Human
cuccagggaugagacagaguag

SEQ ID NO: 1113336 - RNA, 22 nt, Human
guuugcauguauuaagucaaua

SEQ ID NO: 1113337 - RNA, 20 nt, Human
ccugaggguuuguguucuuu

SEQ ID NO: 1113338 - RNA, 23 nt, Human
acaguuauagcugugaauaacau

SEQ ID NO: 1113339 - RNA, 22 nt, Human
acccaggagguggaggcugcag

SEQ ID NO: 1113340 - RNA, 22 nt, Human
ccuggggcucaagauggcgccg

SEQ ID NO: 1113341 - RNA, 22 nt, Human
cccugcagaaccacagacaaac

SEQ ID NO: 1113342 - RNA, 21 nt, Human
uggcugcuggcccucucucca

SEQ ID NO: 1113343 - RNA, 22 nt, Human
ugagcccaggaguuggagaccg

SEQ ID NO: 1113344 - RNA, 22 nt, Human
uggagcugagaaguggagcucu

SEQ ID NO: 1113345 - RNA, 20 nt, Human
ccugccugccucggcucauu

SEQ ID NO: 1113346 - RNA, 22 nt, Human
ucagaguguuuuacuaaacaag

SEQ ID NO: 1113347 - RNA, 22 nt, Human
aaguucaaucagaugaaaaagc

SEQ ID NO: 1113348 - RNA, 22 nt, Human
gcucuguguugucagaggcacc

SEQ ID NO: 1113349 - RNA, 22 nt, Human
acccagaggugucuagcaagcu

SEQ ID NO: 1113350 - RNA, 23 nt, Human
agagcuuagggaauucacaugag

SEQ ID NO: 1113351 - RNA, 22 nt, Human
uagggcaguuauaacauuagug

SEQ ID NO: 1113352 - RNA, 22 nt, Human
agugucauuuuguccaucuucu

SEQ ID NO: 1113353 - RNA, 22 nt, Human
gagagugauucccucccauaga

SEQ ID NO: 1113354 - RNA, 22 nt, Human
cuuugaaaacuuaaauaacagc

SEQ ID NO: 1113355 - RNA, 22 nt, Human
caguguguggauccucccagga

SEQ ID NO: 1113356 - RNA, 22 nt, Human
augaaacaugagaaauggagag

SEQ ID NO: 1113357 - RNA, 22 nt, Human
cuguggcuaggaagcuguggga

SEQ ID NO: 1113358 - RNA, 22 nt, Human
ccuggcagcaggugggcccgug

SEQ ID NO: 1113359 - RNA, 22 nt, Human
ccugcuucagggaugauggcac

SEQ ID NO: 1113360 - RNA, 22 nt, Human
acacacaacucauuguguaaua

SEQ ID NO: 1113361 - RNA, 22 nt, Human
uggcagcaaguucuugggaggu

SEQ ID NO: 1113362 - RNA, 22 nt, Human
ucagguguuagaagaaauuuca

SEQ ID NO: 1113363 - RNA, 22 nt, Human
accagagcgcucaagccuuccc

SEQ ID NO: 1113364 - RNA, 22 nt, Human
gugaccaucagagaauaacaaa

SEQ ID NO: 1113365 - RNA, 22 nt, Human
ucugagcuacgaugccugucac

SEQ ID NO: 1113366 - RNA, 22 nt, Human
ggaggagacaguaaaaagcacg

SEQ ID NO: 1113367 - RNA, 22 nt, Human
ugggggagauuagagcuucuua

SEQ ID NO: 1113368 - RNA, 22 nt, Human
caagagcugugaccucauucac

SEQ ID NO: 1113369 - RNA, 22 nt, Human
gaugugggguugagggaccagc

SEQ ID NO: 1113370 - RNA, 19 nt, Human
uggcugggugccaauggcc

SEQ ID NO: 1113371 - RNA, 22 nt, Human
gagcagugggaaggaacagggu

SEQ ID NO: 1113372 - RNA, 19 nt, Human
ugaggccaaggucacagau

SEQ ID NO: 1113373 - RNA, 22 nt, Human
ugggcagauguggcucuccuug

SEQ ID NO: 1113374 - RNA, 20 nt, Human
ugggcagcacugcuggcugg

SEQ ID NO: 1113375 - RNA, 22 nt, Human
ugaaggaauggaggaucagagc

SEQ ID NO: 1113376 - RNA, 22 nt, Human
ccucccucuuucagucccacag

SEQ ID NO: 1113377 - RNA, 20 nt, Human
ugggccugagccugugggcu

SEQ ID NO: 1113378 - RNA, 22 nt, Human
gacagagugcagggcuagaaga

SEQ ID NO: 1113379 - RNA, 22 nt, Human
ugcugccacaaauucagcugcc

SEQ ID NO: 1113380 - RNA, 20 nt, Human
gcugucuggauuagaagccu

SEQ ID NO: 1113381 - RNA, 22 nt, Human
guaaaugugcuucuuuuaacuu

SEQ ID NO: 1113382 - RNA, 23 nt, Human
agggguggucaguacccgcagug

SEQ ID NO: 1113383 - RNA, 22 nt, Human
uauaguaaaauuuucauuuaug

SEQ ID NO: 1113384 - RNA, 22 nt, Human
ccagagccagagaggugccugc

SEQ ID NO: 1113385 - RNA, 23 nt, Human
uggagcugacagucagagggagg

SEQ ID NO: 1113386 - RNA, 22 nt, Human
ccaaaauguuugaaugcaugug

SEQ ID NO: 1113387 - RNA, 22 nt, Human
ggggagaguccuuuccaguucc

SEQ ID NO: 1113388 - RNA, 22 nt, Human
gucuuucuuaauucaagugcuu

SEQ ID NO: 1113389 - RNA, 17 nt, Human
guuugcaugguguuaac

SEQ ID NO: 1113390 - RNA, 22 nt, Human
aagaugcagcuuccacuuuugc

SEQ ID NO: 1113391 - RNA, 22 nt, Human
cagaggcugaugugggaugggc

SEQ ID NO: 1113392 - RNA, 22 nt, Human
cccuggcaugcaugucccuggc

SEQ ID NO: 1113393 - RNA, 22 nt, Human
aagggcaggcagagaucauaua

SEQ ID NO: 1113394 - RNA, 22 nt, Human
uccuucaggguugaggccgacu

SEQ ID NO: 1113395 - RNA, 22 nt, Human
uagugauuaaaggcagaauguu

SEQ ID NO: 1113396 - RNA, 20 nt, Human
cuuugccuauucucugccug

SEQ ID NO: 1113397 - RNA, 17 nt, Human
aaaauucuguaaagagg

SEQ ID NO: 1113398 - RNA, 19 nt, Human
gcaggcaguggcauucgga

SEQ ID NO: 1113399 - RNA, 22 nt, Human
ucaagagaagugcuccacagua

SEQ ID NO: 1113400 - RNA, 22 nt, Human
ggagacagugacuuagagacug

SEQ ID NO: 1113401 - RNA, 22 nt, Human
augggaggaaggaggcccuuga

SEQ ID NO: 1113402 - RNA, 21 nt, Human
ggccugagcaccuguccaccu

SEQ ID NO: 1113403 - RNA, 22 nt, Human
guggccuggauagacuccaucu

SEQ ID NO: 1113404 - RNA, 22 nt, Human
gcucccacgcaauucuuuucag

SEQ ID NO: 1113405 - RNA, 20 nt, Human
uccaggagaacugggagccg

SEQ ID NO: 1113406 - RNA, 22 nt, Human
ggcuucugguaaagaccacacc

SEQ ID NO: 1113407 - RNA, 23 nt, Human
gagagcugacugucaagacuguu

SEQ ID NO: 1113408 - RNA, 22 nt, Human
ucaggagcagcaugggugagag

SEQ ID NO: 1113409 - RNA, 20 nt, Human
acagaauaugcugguugugg

SEQ ID NO: 1113410 - RNA, 22 nt, Human
uggccuggccacauccagcagg

SEQ ID NO: 1113411 - RNA, 22 nt, Human
acuuucucccacccacccgucu

SEQ ID NO: 1113412 - RNA, 22 nt, Human
acauuguauaaugauuaucaca

SEQ ID NO: 1113413 - RNA, 22 nt, Human
ggcacugaauuucuuggcaucu

SEQ ID NO: 1113414 - RNA, 22 nt, Human
gcucuguguccacagcuggaaa

SEQ ID NO: 1113415 - RNA, 20 nt, Human
agcugguuaucuuaauucuu

SEQ ID NO: 1113416 - RNA, 22 nt, Human
gaggggcucuuuaauaguaaca

SEQ ID NO: 1113417 - RNA, 22 nt, Human
gaggcagcaucuauggugggaa

SEQ ID NO: 1113418 - RNA, 22 nt, Human
aagcccagcaucccugcaccag

SEQ ID NO: 1113419 - RNA, 22 nt, Human
ccacagggcucuaggcgcuucc

SEQ ID NO: 1113420 - RNA, 22 nt, Human
cagcucugugggagcguaugug

SEQ ID NO: 1113421 - RNA, 22 nt, Human
agguaaggcuguaagcuaagcc

SEQ ID NO: 1113422 - RNA, 22 nt, Human
caaagaugcugauguuggauca

SEQ ID NO: 1113423 - RNA, 22 nt, Human
cuguccucuguccucagcagga

SEQ ID NO: 1113424 - RNA, 22 nt, Human
ugcccagcacugugccagucac

SEQ ID NO: 1113425 - RNA, 22 nt, Human
gaguggggcccacugcugggug

SEQ ID NO: 1113426 - RNA, 22 nt, Human
ccacagagagugucagccuuug

SEQ ID NO: 1113427 - RNA, 22 nt, Human
gugcauuugugcaugcacaugu

SEQ ID NO: 1113428 - RNA, 21 nt, Human
ucaggcaggcgcagagggaag

SEQ ID NO: 1113429 - RNA, 22 nt, Human
ucucaagagggaggcaaucaug

SEQ ID NO: 1113430 - RNA, 22 nt, Human
gccagggcucgcggucccucgu

SEQ ID NO: 1113431 - RNA, 22 nt, Human
uagagcuauuuagagcauuuua

SEQ ID NO: 1113432 - RNA, 17 nt, Human
cccagcuggcagugccg

SEQ ID NO: 1113433 - RNA, 22 nt, Human
aggugaguugguaggaaguuug

SEQ ID NO: 1113434 - RNA, 22 nt, Human
cucuccagaauaugccgccgug

SEQ ID NO: 1113435 - RNA, 22 nt, Human
gggcccacuggcugucugaccc

SEQ ID NO: 1113436 - RNA, 22 nt, Human
gaguuauucuagguccuuugua

SEQ ID NO: 1113437 - RNA, 22 nt, Human
uccucugcucagcauuccucac

SEQ ID NO: 1113438 - RNA, 22 nt, Human
aaucaguucuacaucuuaucca

SEQ ID NO: 1113439 - RNA, 22 nt, Human
gcagagccugugucugagcaaa

SEQ ID NO: 1113440 - RNA, 22 nt, Human
cugagcugggacucaguagcaa

SEQ ID NO: 1113441 - RNA, 22 nt, Human
uugcuauuuugagagucauagu

SEQ ID NO: 1113442 - RNA, 22 nt, Human
gggcuggaggugagcaggacag

SEQ ID NO: 1113443 - RNA, 22 nt, Human
gaggcagcuuggggcugugggu

SEQ ID NO: 1113444 - RNA, 23 nt, Human
agcuggaggcugucuacucccaa

SEQ ID NO: 1113445 - RNA, 22 nt, Human
uccacagaauguaagauccaca

SEQ ID NO: 1113446 - RNA, 22 nt, Human
gguaacaguauguagaguaaga

SEQ ID NO: 1113447 - RNA, 22 nt, Human
aagauuucucuccuggaaagca

SEQ ID NO: 1113448 - RNA, 22 nt, Human
aagagcauauuaauaguggaga

SEQ ID NO: 1113449 - RNA, 22 nt, Human
ggcugccugaacuuuggggaaa

SEQ ID NO: 1113450 - RNA, 22 nt, Human
uucuaacucuguuauguguuuc

SEQ ID NO: 1113451 - RNA, 21 nt, Human
uccauuguuuucccaggguuu

SEQ ID NO: 1113452 - RNA, 22 nt, Human
cuuauuauaaaauccuguuuga

SEQ ID NO: 1113453 - RNA, 22 nt, Human
agcuggaggauaacucacuucu

SEQ ID NO: 1113454 - RNA, 22 nt, Human
agccuggauccuaggcucagcu

SEQ ID NO: 1113455 - RNA, 22 nt, Human
gagcugccaagauuacaaucag

SEQ ID NO: 1113456 - RNA, 22 nt, Human
cauuagaagaacaguuauauua

SEQ ID NO: 1113457 - RNA, 22 nt, Human
aggaaaaagaguugcugccuuc

SEQ ID NO: 1113458 - RNA, 22 nt, Human
cagagccugccucuggcugugg

SEQ ID NO: 1113459 - RNA, 22 nt, Human
acaguggagaaggcaugaggcu

SEQ ID NO: 1113460 - RNA, 22 nt, Human
gagacauggcaaaagcacuggu

SEQ ID NO: 1113461 - RNA, 22 nt, Human
ucugccugccagucugguccuc

SEQ ID NO: 1113462 - RNA, 19 nt, Human
agaggcugucaccuguagc

SEQ ID NO: 1113463 - RNA, 22 nt, Human
ggcacugagaacaggcugacuu

SEQ ID NO: 1113464 - RNA, 19 nt, Human
caggagagcaugcacuuug

SEQ ID NO: 1113465 - RNA, 23 nt, Human
ucagcugcuuccuccugccugcc

SEQ ID NO: 1113466 - RNA, 22 nt, Human
uaaaugugcacagguuagaagg

SEQ ID NO: 1113467 - RNA, 19 nt, Human
ucugucacuggggguauuc

SEQ ID NO: 1113468 - RNA, 17 nt, Human
cuggagccaagagggcc

SEQ ID NO: 1113469 - RNA, 22 nt, Human
ggcugccacgucgaggguccaa

SEQ ID NO: 1113470 - RNA, 22 nt, Human
gagucacauuaauuuaauuuua

SEQ ID NO: 1113471 - RNA, 22 nt, Human
aaggcacuguacuaguuaguua

SEQ ID NO: 1113472 - RNA, 22 nt, Human
ggcugcugaguuggccaggaga

SEQ ID NO: 1113473 - RNA, 22 nt, Human
ucugucuccucugaggugccag

SEQ ID NO: 1113474 - RNA, 22 nt, Human
aggggagaguuaaugugaaugu

SEQ ID NO: 1113475 - RNA, 22 nt, Human
ccagagccucgcccggagccuc

SEQ ID NO: 1113476 - RNA, 22 nt, Human
uuguuuguaugcugagaagaau

SEQ ID NO: 1113477 - RNA, 20 nt, Human
accuuucaaaugauucagca

SEQ ID NO: 1113478 - RNA, 22 nt, Human
gcucccacaaccuucuugcucc

SEQ ID NO: 1113479 - RNA, 22 nt, Human
gagggucccgagcccugucaga

SEQ ID NO: 1113480 - RNA, 22 nt, Human
uggaagggggaagacagcucug

SEQ ID NO: 1113481 - RNA, 22 nt, Human
ugagagagccugaaucucuuac

SEQ ID NO: 1113482 - RNA, 22 nt, Human
acaaggcugaacagugaagccg

SEQ ID NO: 1113483 - RNA, 22 nt, Human
cagcuccugccugggcagcugu

SEQ ID NO: 1113484 - RNA, 22 nt, Human
cucagaaguucagccuagagua

SEQ ID NO: 1113485 - RNA, 22 nt, Human
ugcauuauaacugaauguuguu

SEQ ID NO: 1113486 - RNA, 22 nt, Human
aagaaauuaaggaaugcaacga

SEQ ID NO: 1113487 - RNA, 22 nt, Human
uggagcugagagccaggcuggc

SEQ ID NO: 1113488 - RNA, 22 nt, Human
augcugcacaagccacauguag

SEQ ID NO: 1113489 - RNA, 22 nt, Human
acucucucacagcuuggcugau

SEQ ID NO: 1113490 - RNA, 22 nt, Human
ggaguucacugugcaggcucug

SEQ ID NO: 1113491 - RNA, 22 nt, Human
ccacccugagccgcaagagcag

SEQ ID NO: 1113492 - RNA, 22 nt, Human
ugucucugaacagcuuacuaaa

SEQ ID NO: 1113493 - RNA, 22 nt, Human
gcucugaggcugugaggugcug

SEQ ID NO: 1113494 - RNA, 22 nt, Human
acuuuggaucugauguaaucag

SEQ ID NO: 1113495 - RNA, 22 nt, Human
agaauccugaugaaaaggagag

SEQ ID NO: 1113496 - RNA, 22 nt, Human
gggcugugagaguggggcugcu

SEQ ID NO: 1113497 - RNA, 22 nt, Human
gaaaagagaacaucugaggauc

SEQ ID NO: 1113498 - RNA, 21 nt, Human
gugucaugguugacuuuggca

SEQ ID NO: 1113499 - RNA, 18 nt, Human
gccugcaggcacgggggu

SEQ ID NO: 1113500 - RNA, 22 nt, Human
accugagaaugggggcaugugu

SEQ ID NO: 1113501 - RNA, 21 nt, Human
acagaacuguauagugauaaa

SEQ ID NO: 1113502 - RNA, 22 nt, Human
auaugcacauacauacauaggu

SEQ ID NO: 1113503 - RNA, 22 nt, Human
uggagcugggaguccugggcug

SEQ ID NO: 1113504 - RNA, 22 nt, Human
cacagugcaugaugggcagaag

SEQ ID NO: 1113505 - RNA, 22 nt, Human
cuggcagcuuccuuugcaucug

SEQ ID NO: 1113506 - RNA, 22 nt, Human
uguuaaauguuccuuuacugga

SEQ ID NO: 1113507 - RNA, 22 nt, Human
cuggagcucuguguguuccuga

SEQ ID NO: 1113508 - RNA, 19 nt, Human
uagaaugcccacuuaaaaa

SEQ ID NO: 1113509 - RNA, 22 nt, Human
cuggcuuccaugcuguaguggc

SEQ ID NO: 1113510 - RNA, 22 nt, Human
aacagaauugcugcugccaaug

SEQ ID NO: 1113511 - RNA, 23 nt, Human
uugucugugcuuuuccaguugcu

SEQ ID NO: 1113512 - RNA, 22 nt, Human
ucagcuccucaugcaggggaua

SEQ ID NO: 1113513 - RNA, 22 nt, Human
ucuacuuuucccuauacaguuu

SEQ ID NO: 1113514 - RNA, 18 nt, Human
cugcugcaggcacucagg

SEQ ID NO: 1113515 - RNA, 22 nt, Human
agggacuggcucucugagcagg

SEQ ID NO: 1113516 - RNA, 22 nt, Human
ccagggccucguguucugagug

SEQ ID NO: 1113517 - RNA, 22 nt, Human
gggcugugggacccggcacuuu

SEQ ID NO: 1113518 - RNA, 22 nt, Human
uucuuuaaaauagugagaaaga

SEQ ID NO: 1113519 - RNA, 22 nt, Human
ugcugccuuugggaccuggccu

SEQ ID NO: 1113520 - RNA, 17 nt, Human
ugccagccugucccagg

SEQ ID NO: 1113521 - RNA, 22 nt, Human
ugcucuggguccugggccuccu

SEQ ID NO: 1113522 - RNA, 22 nt, Human
auuugcagagcucugaauuuug

SEQ ID NO: 1113523 - RNA, 22 nt, Human
gagccuccuccuggugugccga

SEQ ID NO: 1113524 - RNA, 22 nt, Human
aagcagccagccaucaugcccg

SEQ ID NO: 1113525 - RNA, 22 nt, Human
ccagugggugcugggcucugcc

SEQ ID NO: 1113526 - RNA, 22 nt, Human
guacuucccugggaggcaagca

SEQ ID NO: 1113527 - RNA, 22 nt, Human
uggcagcagggaggccaguguu

SEQ ID NO: 1113528 - RNA, 22 nt, Human
auccaaagauggaaagaacuuu

SEQ ID NO: 1113529 - RNA, 22 nt, Human
cuggcuggccggaggcaucccu

SEQ ID NO: 1113530 - RNA, 22 nt, Human
uuccuccacgugacaggagcca

SEQ ID NO: 1113531 - RNA, 22 nt, Human
ucagccugcgucauggugacac

SEQ ID NO: 1113532 - RNA, 22 nt, Human
ggacucuguuuuccugaucacu

SEQ ID NO: 1113533 - RNA, 21 nt, Human
uaaauaauaaguugcugagau

SEQ ID NO: 1113534 - RNA, 22 nt, Human
gcagagcauguccucaggacag

SEQ ID NO: 1113535 - RNA, 22 nt, Human
cucccaagggguaagggagcug

SEQ ID NO: 1113536 - RNA, 22 nt, Human
aaaaguaauugaugcaaucgua

SEQ ID NO: 1113537 - RNA, 22 nt, Human
uuucaaagguggaagagugaau

SEQ ID NO: 1113538 - RNA, 22 nt, Human
gggccugacugagagcuccuca

SEQ ID NO: 1113539 - RNA, 22 nt, Human
ccugucugaggaggugcucuuu

SEQ ID NO: 1113540 - RNA, 22 nt, Human
aaucagaaaauucaguggaauu

SEQ ID NO: 1113541 - RNA, 22 nt, Human
aggccucacauugggcuucaag

SEQ ID NO: 1113542 - RNA, 22 nt, Human
acucucagaggguggcagcaau

SEQ ID NO: 1113543 - RNA, 17 nt, Human
cugagcauccgugcucu

SEQ ID NO: 1113544 - RNA, 22 nt, Human
ggguguccugugccaagcuggg

SEQ ID NO: 1113545 - RNA, 22 nt, Human
aaaucuguaagcaauugcucag

SEQ ID NO: 1113546 - RNA, 22 nt, Human
agucagugaaaacuagaauguu

SEQ ID NO: 1113547 - RNA, 19 nt, Human
agucucaguguacagaggc

SEQ ID NO: 1113548 - RNA, 22 nt, Human
aagauuuccauuucuagcucau

SEQ ID NO: 1113549 - RNA, 22 nt, Human
guuuacaaauauuuuaaauggu

SEQ ID NO: 1113550 - RNA, 22 nt, Human
gccuggagaggaagccggugga

SEQ ID NO: 1113551 - RNA, 20 nt, Human
gcugggggugugcugaguga

SEQ ID NO: 1113552 - RNA, 22 nt, Human
uauugacagagggucagaagag

SEQ ID NO: 1113553 - RNA, 22 nt, Human
cccagcuccuuggaugggcagg

SEQ ID NO: 1113554 - RNA, 21 nt, Human
aaaaugugagcgugaugcuua

SEQ ID NO: 1113555 - RNA, 22 nt, Human
aauauuucuccuucguuauagc

SEQ ID NO: 1113556 - RNA, 23 nt, Human
aagaauaaaugacauuaaaggug

SEQ ID NO: 1113557 - RNA, 22 nt, Human
ucaggaguccugccugcagccu

SEQ ID NO: 1113558 - RNA, 22 nt, Human
gcugcaggggggucuggacuug

SEQ ID NO: 1113559 - RNA, 22 nt, Human
aaggccugaacaugaggagaug

SEQ ID NO: 1113560 - RNA, 22 nt, Human
ggcagcuguggacgucgucauu

SEQ ID NO: 1113561 - RNA, 22 nt, Human
aaggcacugaaaaauugugugu

SEQ ID NO: 1113562 - RNA, 22 nt, Human
uguaugcagcaaaacaauuagu

SEQ ID NO: 1113563 - RNA, 22 nt, Human
cccuggcauaaaacuucuccag

SEQ ID NO: 1113564 - RNA, 22 nt, Human
gaaaugugcagaauguguuaga

SEQ ID NO: 1113565 - RNA, 22 nt, Human
caguaugagaguugaaucaagg

SEQ ID NO: 1113566 - RNA, 19 nt, Human
uggcuucuguuuucauguu

SEQ ID NO: 1113567 - RNA, 23 nt, Human
uggggagaguuacccuggaagcg

SEQ ID NO: 1113568 - RNA, 22 nt, Human
auguguagaacuguaaugccca

SEQ ID NO: 1113569 - RNA, 22 nt, Human
gugccaggugcuaagcugugcu

SEQ ID NO: 1113570 - RNA, 22 nt, Human
uagcagggaaggugugcugagc

SEQ ID NO: 1113571 - RNA, 22 nt, Human
gcaggcugauagaggauuccau

SEQ ID NO: 1113572 - RNA, 22 nt, Human
cuggcuccuccaaggccuggag

SEQ ID NO: 1113573 - RNA, 22 nt, Human
uuuaccaagcuuuaauuacaua

SEQ ID NO: 1113574 - RNA, 22 nt, Human
uggcacugccaaccugcuaggu

SEQ ID NO: 1113575 - RNA, 22 nt, Human
gagaagguggaccugaaggagc

SEQ ID NO: 1113576 - RNA, 22 nt, Human
cuacauuucccagcugccuucc

SEQ ID NO: 1113577 - RNA, 22 nt, Human
gcugcagcagaaguucucagag

SEQ ID NO: 1113578 - RNA, 20 nt, Human
auacaaagagauugauguau

SEQ ID NO: 1113579 - RNA, 22 nt, Human
aggcccuguuaugagccacugu

SEQ ID NO: 1113580 - RNA, 22 nt, Human
uguuccaucaguuuuugguuga

SEQ ID NO: 1113581 - RNA, 22 nt, Human
accugccucagugcagcuggau

SEQ ID NO: 1113582 - RNA, 22 nt, Human
agucccagcuucccccaugcag

SEQ ID NO: 1113583 - RNA, 22 nt, Human
aaaauguguuuaugcauuucgu

SEQ ID NO: 1113584 - RNA, 22 nt, Human
aagccaagaguuaacuauuugu

SEQ ID NO: 1113585 - RNA, 22 nt, Human
ugagcuucuuuauuuggccaga

SEQ ID NO: 1113586 - RNA, 22 nt, Human
aaaagggacuacucucagcucc

SEQ ID NO: 1113587 - RNA, 22 nt, Human
ggccugagucccaccuggcugu

SEQ ID NO: 1113588 - RNA, 23 nt, Human
ugcucccaggugacgcugcuguu

SEQ ID NO: 1113589 - RNA, 21 nt, Human
ggggcagagcuaggcccugca

SEQ ID NO: 1113590 - RNA, 22 nt, Human
ccugggaguggcacucacagca

SEQ ID NO: 1113591 - RNA, 22 nt, Human
ccugggugucaugggcagcugg

SEQ ID NO: 1113592 - RNA, 22 nt, Human
acauuucucaucuaguagagua

SEQ ID NO: 1113593 - RNA, 22 nt, Human
cugggggcaagcagacagcugu

SEQ ID NO: 1113594 - RNA, 22 nt, Human
gccugagccgccugagcggcgg

SEQ ID NO: 1113595 - RNA, 22 nt, Human
gcauuuagcuuuaaaauauuuc

SEQ ID NO: 1113596 - RNA, 22 nt, Human
uggcagggccugcucaucaucc

SEQ ID NO: 1113597 - RNA, 22 nt, Human
uuucuguauuuaaaagaucugg

SEQ ID NO: 1113598 - RNA, 22 nt, Human
cagggcuggauccuccagacuc

SEQ ID NO: 1113599 - RNA, 22 nt, Human
ugugugccugagccgugccugg

SEQ ID NO: 1113600 - RNA, 22 nt, Human
cucaggauccaucuccugcccu

SEQ ID NO: 1113601 - RNA, 22 nt, Human
uagugaaacaguuaucaaucug

SEQ ID NO: 1113602 - RNA, 22 nt, Human
ggagccugugcccaagcccaga

SEQ ID NO: 1113603 - RNA, 22 nt, Human
agcugcugaaugacacugcaag

SEQ ID NO: 1113604 - RNA, 22 nt, Human
caaggaaaacagaugaucaaca

SEQ ID NO: 1113605 - RNA, 18 nt, Human
gaugggagcaagagaaga

SEQ ID NO: 1113606 - RNA, 22 nt, Human
ugucauguguucuuaaauacau

SEQ ID NO: 1113607 - RNA, 22 nt, Human
guggcugcagcccagcggcacg

SEQ ID NO: 1113608 - RNA, 22 nt, Human
agggugccuggaagccacucac

SEQ ID NO: 1113609 - RNA, 22 nt, Human
ucccagggucaguggugaggcc

SEQ ID NO: 1113610 - RNA, 22 nt, Human
acaaaguuauucuuucagagga

SEQ ID NO: 1113611 - RNA, 22 nt, Human
uagagaaauaagcuuugccuug

SEQ ID NO: 1113612 - RNA, 22 nt, Human
uucauauauaugcacuacguac

SEQ ID NO: 1113613 - RNA, 22 nt, Human
acagguggagugguuagcaggc

SEQ ID NO: 1113614 - RNA, 22 nt, Human
gaggcaggcccugaaugaguca

SEQ ID NO: 1113615 - RNA, 22 nt, Human
ucuuccaguguagacaucugcc

SEQ ID NO: 1113616 - RNA, 22 nt, Human
gugcaugugucuuuauaguaga

SEQ ID NO: 1113617 - RNA, 22 nt, Human
ugguccagacauuucugaggua

SEQ ID NO: 1113618 - RNA, 22 nt, Human
uagagcugauaaugaggccaag

SEQ ID NO: 1113619 - RNA, 23 nt, Human
agggcccaagccuggacagcagg

SEQ ID NO: 1113620 - RNA, 22 nt, Human
cuggaagguucuuugugugccu

SEQ ID NO: 1113621 - RNA, 22 nt, Human
ucaugcccagagcaguaaauua

SEQ ID NO: 1113622 - RNA, 22 nt, Human
aaaguguugggaagaaagugca

SEQ ID NO: 1113623 - RNA, 20 nt, Human
ugggagcuggugaggucuca

SEQ ID NO: 1113624 - RNA, 20 nt, Human
cuggguggcaagcaaggggg

SEQ ID NO: 1113625 - RNA, 20 nt, Human
ugcagggcugccucccagcu

SEQ ID NO: 1113626 - RNA, 22 nt, Human
caguacuugggaaugcugggga

SEQ ID NO: 1113627 - RNA, 22 nt, Human
uuaaaaccaucagcuguaagau

SEQ ID NO: 1113628 - RNA, 20 nt, Human
gaggccucagccucagcucc

SEQ ID NO: 1113629 - RNA, 22 nt, Human
cugggcacuuuggggagccuac

SEQ ID NO: 1113630 - RNA, 22 nt, Human
aagaaucauccugcaagagucu

SEQ ID NO: 1113631 - RNA, 22 nt, Human
gugcagguguuuuggcugccag

SEQ ID NO: 1113632 - RNA, 22 nt, Human
gcauuccuacaggcugcuauga

SEQ ID NO: 1113633 - RNA, 22 nt, Human
ucucagagugacaaugagaauu

SEQ ID NO: 1113634 - RNA, 22 nt, Human
caggccucccggugcacacuga

SEQ ID NO: 1113635 - RNA, 22 nt, Human
gcagagugagccgaggcugcuc

SEQ ID NO: 1113636 - RNA, 19 nt, Human
uccugggcugggccagguc

SEQ ID NO: 1113637 - RNA, 22 nt, Human
ccaggaguuugaggcugcagug

SEQ ID NO: 1113638 - RNA, 22 nt, Human
gaaaucugaacucuguauccuu

SEQ ID NO: 1113639 - RNA, 22 nt, Human
agagccagagaccuggguucac

SEQ ID NO: 1113640 - RNA, 22 nt, Human
gggggcuguccugugcauugua

SEQ ID NO: 1113641 - RNA, 22 nt, Human
cagaguccuggacacagagaca

SEQ ID NO: 1113642 - RNA, 22 nt, Human
gaggcugcuguuagcccugggc

SEQ ID NO: 1113643 - RNA, 22 nt, Human
gccuggagugguccugcugccc

SEQ ID NO: 1113644 - RNA, 22 nt, Human
aaguucuaauuuugcauucagg

SEQ ID NO: 1113645 - RNA, 22 nt, Human
uaugagaaaauaaauaucuguu

SEQ ID NO: 1113646 - RNA, 22 nt, Human
ggcacugagaggcucuuccuaa

SEQ ID NO: 1113647 - RNA, 22 nt, Human
aaaaauaggucaaccguguaug

SEQ ID NO: 1113648 - RNA, 22 nt, Human
cagcuggcgggcagagccgcca

SEQ ID NO: 1113649 - RNA, 22 nt, Human
ugauuuccugugcgcccuuagg

SEQ ID NO: 1113650 - RNA, 22 nt, Human
uagcugugagcacccaggcugu

SEQ ID NO: 1113651 - RNA, 22 nt, Human
gcugggagcaaagccaugcaua

SEQ ID NO: 1113652 - RNA, 17 nt, Human
gcuuccucaugcaguuc

SEQ ID NO: 1113653 - RNA, 22 nt, Human
cugaaauuccauuucagccaca

SEQ ID NO: 1113654 - RNA, 22 nt, Human
uccagccuaauguucuucccac

SEQ ID NO: 1113655 - RNA, 21 nt, Human
uagaaaucagcuggugccucu

SEQ ID NO: 1113656 - RNA, 22 nt, Human
aaaucaguuggaacacaagcag

SEQ ID NO: 1113657 - RNA, 22 nt, Human
uguaggauuuucaccagaccuu

SEQ ID NO: 1113658 - RNA, 21 nt, Human
cacugcagccuugaccugggc

SEQ ID NO: 1113659 - RNA, 22 nt, Human
ccagcuccgggaguugcugcug

SEQ ID NO: 1113660 - RNA, 22 nt, Human
gccaccagugggggccugggca

SEQ ID NO: 1113661 - RNA, 22 nt, Human
agguacagcaauauaagagguc

SEQ ID NO: 1113662 - RNA, 22 nt, Human
ggaugcaggggcagcagagccu

SEQ ID NO: 1113663 - RNA, 22 nt, Human
cagagcugauuggauccagaga

SEQ ID NO: 1113664 - RNA, 22 nt, Human
ugaacccaggagguugcaguga

SEQ ID NO: 1113665 - RNA, 22 nt, Human
agggcccauagaucgucagcuu

SEQ ID NO: 1113666 - RNA, 22 nt, Human
gcaggugguccccguggagugg

SEQ ID NO: 1113667 - RNA, 22 nt, Human
gccagcucagaugcaggaagga

SEQ ID NO: 1113668 - RNA, 22 nt, Human
acagagccacuuuggugccuac

SEQ ID NO: 1113669 - RNA, 20 nt, Human
gcagagcuguucugugggga

SEQ ID NO: 1113670 - RNA, 22 nt, Human
uuuauugcauacacaaauguca

SEQ ID NO: 1113671 - RNA, 22 nt, Human
aggccagagaggggaccagccu

SEQ ID NO: 1113672 - RNA, 23 nt, Human
aaucuggcugauguuuuuucucu

SEQ ID NO: 1113673 - RNA, 22 nt, Human
uuugcauuuccagaguagcaga

SEQ ID NO: 1113674 - RNA, 22 nt, Human
ucacugcaaggaggcuucucaa

SEQ ID NO: 1113675 - RNA, 19 nt, Human
ugaagcagcaaacucucag

SEQ ID NO: 1113676 - RNA, 22 nt, Human
cccaggcugaugggaugggcca

SEQ ID NO: 1113677 - RNA, 22 nt, Human
gguggccucucaugcaagguag

SEQ ID NO: 1113678 - RNA, 22 nt, Human
ugcccugcagugagugcgucug

SEQ ID NO: 1113679 - RNA, 22 nt, Human
cagcaauaagccagguuagaca

SEQ ID NO: 1113680 - RNA, 21 nt, Human
agggcagauuagcuguaagag

SEQ ID NO: 1113681 - RNA, 22 nt, Human
ugaagcagagugaaggugaauu

SEQ ID NO: 1113682 - RNA, 22 nt, Human
aagcagccucauuugugguaag

SEQ ID NO: 1113683 - RNA, 22 nt, Human
cacaggaggaggugcccgggcc

SEQ ID NO: 1113684 - RNA, 22 nt, Human
agagcuguagcuuccuagagcc

SEQ ID NO: 1113685 - RNA, 22 nt, Human
ugcugggcuagaagcugaggcc

SEQ ID NO: 1113686 - RNA, 22 nt, Human
ggccugugucugugccuguccu

SEQ ID NO: 1113687 - RNA, 21 nt, Human
gagcugggcgaggcuccgggg

SEQ ID NO: 1113688 - RNA, 22 nt, Human
ccugucaggguuugccucagaa

SEQ ID NO: 1113689 - RNA, 22 nt, Human
gcagcccaaaaaagagguagau

SEQ ID NO: 1113690 - RNA, 22 nt, Human
auauguguauuugguuagccua

SEQ ID NO: 1113691 - RNA, 22 nt, Human
ggugaaggaggaagcugaugga

SEQ ID NO: 1113692 - RNA, 22 nt, Human
gcagggcucaacaggacacccc

SEQ ID NO: 1113693 - RNA, 23 nt, Human
ucuggcuccauccuuggggaucc

SEQ ID NO: 1113694 - RNA, 22 nt, Human
ggagcuguugcgcaugcgcucg

SEQ ID NO: 1113695 - RNA, 22 nt, Human
caggagaagguuuggagugcag

SEQ ID NO: 1113696 - RNA, 22 nt, Human
uauaguacauggaaucuucaua

SEQ ID NO: 1113697 - RNA, 22 nt, Human
uacuuagagcgauaauuuauac

SEQ ID NO: 1113698 - RNA, 19 nt, Human
gccugcagaaaaggcaggg

SEQ ID NO: 1113699 - RNA, 22 nt, Human
gccugagcuacuagggagucug

SEQ ID NO: 1113700 - RNA, 22 nt, Human
ucccaagugucuuggaccaggg

SEQ ID NO: 1113701 - RNA, 22 nt, Human
gugucacaagagcccaggaaac

SEQ ID NO: 1113702 - RNA, 22 nt, Human
agcugccagcaucccggaaggg

SEQ ID NO: 1113703 - RNA, 19 nt, Human
uggcauugguccagauaaa

SEQ ID NO: 1113704 - RNA, 22 nt, Human
cugcccugcccaggccuugggc

SEQ ID NO: 1113705 - RNA, 22 nt, Human
ucagaacagaagcuggcuauaa

SEQ ID NO: 1113706 - RNA, 22 nt, Human
ggcugagcaauuuugaugacau

SEQ ID NO: 1113707 - RNA, 22 nt, Human
cugggcugucaauggcccucug

SEQ ID NO: 1113708 - RNA, 22 nt, Human
uaccuugggguuuuguugcucu

SEQ ID NO: 1113709 - RNA, 22 nt, Human
agccucucuuucugguggcuaa

SEQ ID NO: 1113710 - RNA, 22 nt, Human
ccugagagcgaguggccucaug

SEQ ID NO: 1113711 - RNA, 22 nt, Human
agagccuggacuuuucugagcc

SEQ ID NO: 1113712 - RNA, 22 nt, Human
ucacugggagaugugggaaggg

SEQ ID NO: 1113713 - RNA, 22 nt, Human
acugugugaaacaucaaugugu

SEQ ID NO: 1113714 - RNA, 22 nt, Human
gggcugcugcugccagcgacac

SEQ ID NO: 1113715 - RNA, 23 nt, Human
ucuccagugucucuucauugagu

SEQ ID NO: 1113716 - RNA, 21 nt, Human
aucagcaaaugccugucuccc

SEQ ID NO: 1113717 - RNA, 22 nt, Human
caguuucuacgacuuaagcaca

SEQ ID NO: 1113718 - RNA, 22 nt, Human
uccuugaaaaucuugguuuaga

SEQ ID NO: 1113719 - RNA, 22 nt, Human
uccagcucuaacaugcugggcc

SEQ ID NO: 1113720 - RNA, 22 nt, Human
acagccagggcauugucgccga

SEQ ID NO: 1113721 - RNA, 22 nt, Human
ggcccugugguuuugcaaaguc

SEQ ID NO: 1113722 - RNA, 22 nt, Human
agaggcuccaccuucucugucc

SEQ ID NO: 1113723 - RNA, 22 nt, Human
caguuucugggcguucacaggu

SEQ ID NO: 1113724 - RNA, 22 nt, Human
gugcaugugcauccauguguac

SEQ ID NO: 1113725 - RNA, 22 nt, Human
gcucuggcuacuguggcuaccg

SEQ ID NO: 1113726 - RNA, 22 nt, Human
ccuccugggccuugcucuguga

SEQ ID NO: 1113727 - RNA, 22 nt, Human
ucucuggccgagagucccuggg

SEQ ID NO: 1113728 - RNA, 22 nt, Human
aaugggagagaacacaaagucc

SEQ ID NO: 1113729 - RNA, 22 nt, Human
accuggcacuacaggcaccugu

SEQ ID NO: 1113730 - RNA, 22 nt, Human
cggcagcuccgcgccguaggac

SEQ ID NO: 1113731 - RNA, 20 nt, Human
gggguuggcuggcacaggga

SEQ ID NO: 1113732 - RNA, 22 nt, Human
cacauuuaauccuuuauaagua

SEQ ID NO: 1113733 - RNA, 15 nt, Human
aggcacugugggacc

SEQ ID NO: 1113734 - RNA, 22 nt, Human
ccaccagcagugugcaaggauu

SEQ ID NO: 1113735 - RNA, 22 nt, Human
gaggccugguagccgagcccca

SEQ ID NO: 1113736 - RNA, 22 nt, Human
ccagcucccugaagccuggucu

SEQ ID NO: 1113737 - RNA, 22 nt, Human
accugagcaugccaggagagug

SEQ ID NO: 1113738 - RNA, 22 nt, Human
aaggccaugcacauccuaggca

SEQ ID NO: 1113739 - RNA, 22 nt, Human
cacagaaaaaggcuugaaaauc

SEQ ID NO: 1113740 - RNA, 22 nt, Human
cccagcacuuugaauaugucac

SEQ ID NO: 1113741 - RNA, 22 nt, Human
augucuuucgcaucaguagcua

SEQ ID NO: 1113742 - RNA, 22 nt, Human
ggguccagcgacagcaggcuca

SEQ ID NO: 1113743 - RNA, 22 nt, Human
cugggcaguuuuacaucauugc

SEQ ID NO: 1113744 - RNA, 22 nt, Human
ucacaugcucaccuaagccaca

SEQ ID NO: 1113745 - RNA, 22 nt, Human
caggggcucuaaugcaugauca

SEQ ID NO: 1113746 - RNA, 22 nt, Human
gcagacagccagacugcacugg

SEQ ID NO: 1113747 - RNA, 22 nt, Human
guuugcauggaagacagugagu

SEQ ID NO: 1113748 - RNA, 22 nt, Human
ggucucagcuggaguccuuggu

SEQ ID NO: 1113749 - RNA, 22 nt, Human
cagagcaguccuugucaaucag

SEQ ID NO: 1113750 - RNA, 22 nt, Human
uagucuuuuuaauaaauaaugc

SEQ ID NO: 1113751 - RNA, 23 nt, Human
uugaaggagaaagcuuucuuggu

SEQ ID NO: 1113752 - RNA, 19 nt, Human
gcacugaagaguuggucac

SEQ ID NO: 1113753 - RNA, 22 nt, Human
agcuggugcugaagcucuugag

SEQ ID NO: 1113754 - RNA, 22 nt, Human
aaucaguuucuuggcaaguuua

SEQ ID NO: 1113755 - RNA, 22 nt, Human
cagcuugcaguacuuguuuuug

SEQ ID NO: 1113756 - RNA, 22 nt, Human
cugccuguuuucugauagauuu

SEQ ID NO: 1113757 - RNA, 18 nt, Human
gcagagugcgucucugug

SEQ ID NO: 1113758 - RNA, 22 nt, Human
gcccagcuccucugcagacccu

SEQ ID NO: 1113759 - RNA, 22 nt, Human
agugaccaaucaugguuagauu

SEQ ID NO: 1113760 - RNA, 19 nt, Human
augagcuggcauuucaggu

SEQ ID NO: 1113761 - RNA, 22 nt, Human
uuguggaaauacagacuccaag

SEQ ID NO: 1113762 - RNA, 22 nt, Human
ugcaccauacccauuccccucu

SEQ ID NO: 1113763 - RNA, 22 nt, Human
uauccaauucaccauugauggg

SEQ ID NO: 1113764 - RNA, 22 nt, Human
uggugccuugggccuacagcgc

SEQ ID NO: 1113765 - RNA, 22 nt, Human
uccuucagggcugaccacaggc

SEQ ID NO: 1113766 - RNA, 23 nt, Human
agccuucaggcaaugucaguaga

SEQ ID NO: 1113767 - RNA, 22 nt, Human
ugaaccagagucuccagugguu

SEQ ID NO: 1113768 - RNA, 22 nt, Human
uccagggacacagaguccuucu

SEQ ID NO: 1113769 - RNA, 22 nt, Human
gucuggagccacccuaagcauu

SEQ ID NO: 1113770 - RNA, 20 nt, Human
gcacugaaauucaauguuug

SEQ ID NO: 1113771 - RNA, 22 nt, Human
ugucccagacauaaguggacau

SEQ ID NO: 1113772 - RNA, 22 nt, Human
ccuccaggauaagucagggccu

SEQ ID NO: 1113773 - RNA, 22 nt, Human
uaauuuacuugcaaauaacaau

SEQ ID NO: 1113774 - RNA, 22 nt, Human
cagauaaaggcuuacuaguagu

SEQ ID NO: 1113775 - RNA, 22 nt, Human
agcuucuguucaucuuccaggc

SEQ ID NO: 1113776 - RNA, 22 nt, Human
ccagguggacggcgaguacagg

SEQ ID NO: 1113777 - RNA, 22 nt, Human
uagacacaucaaguauaguuaa

SEQ ID NO: 1113778 - RNA, 22 nt, Human
uuuccuaugauauucuaugugu

SEQ ID NO: 1113779 - RNA, 19 nt, Human
ugcucaggccaaggagccc

SEQ ID NO: 1113780 - RNA, 21 nt, Human
ugugucacuaacuagaggcua

SEQ ID NO: 1113781 - RNA, 22 nt, Human
cuguagcaaguuauucaauaaa

SEQ ID NO: 1113782 - RNA, 22 nt, Human
uggcuggggccugaauccugca

SEQ ID NO: 1113783 - RNA, 22 nt, Human
ugggcagacgcuguuggaaggc

SEQ ID NO: 1113784 - RNA, 22 nt, Human
ccugggucuugguucaugcucu

SEQ ID NO: 1113785 - RNA, 22 nt, Human
uauuucuguaugcauaaaagga

SEQ ID NO: 1113786 - RNA, 22 nt, Human
aaucacaauuacuuuugcacca

SEQ ID NO: 1113787 - RNA, 22 nt, Human
gauaugaaguggcauugugaag

SEQ ID NO: 1113788 - RNA, 22 nt, Human
aggcccuggcacugccugggag

SEQ ID NO: 1113789 - RNA, 22 nt, Human
ucagaggacgcacuaggguugu

SEQ ID NO: 1113790 - RNA, 22 nt, Human
gccagaaacauacacaucacuu

SEQ ID NO: 1113791 - RNA, 22 nt, Human
cuccccagguucaggagguggg

SEQ ID NO: 1113792 - RNA, 22 nt, Human
ccugggcuuucaaaaccagccu

SEQ ID NO: 1113793 - RNA, 22 nt, Human
gucugcccucacgccagcuggg

SEQ ID NO: 1113794 - RNA, 22 nt, Human
caggaggaacaagagguucugg

SEQ ID NO: 1113795 - RNA, 22 nt, Human
uggcagcuguguccagguagaa

SEQ ID NO: 1113796 - RNA, 22 nt, Human
aguuuuaugcaguguucugaua

SEQ ID NO: 1113797 - RNA, 22 nt, Human
ccucugggagacugcuacugag

SEQ ID NO: 1113798 - RNA, 22 nt, Human
cagagcuggagaaguggauuua

SEQ ID NO: 1113799 - RNA, 22 nt, Human
agucucugcaugaugcagcaca

SEQ ID NO: 1113800 - RNA, 22 nt, Human
uugaaaggguuaaagugguaaa

SEQ ID NO: 1113801 - RNA, 22 nt, Human
ggcugucugugguggagcguug

SEQ ID NO: 1113802 - RNA, 22 nt, Human
uagcccagagucccaauuccag

SEQ ID NO: 1113803 - RNA, 22 nt, Human
aaaaagauguccugaaguuuag

SEQ ID NO: 1113804 - RNA, 22 nt, Human
ggagcauguggggugagcaggg

SEQ ID NO: 1113805 - RNA, 22 nt, Human
ccucagggccaucucugucccu

SEQ ID NO: 1113806 - RNA, 22 nt, Human
ucugcagcuuuuugguggggug

SEQ ID NO: 1113807 - RNA, 22 nt, Human
aagccgggccugagaaaugaca

SEQ ID NO: 1113808 - RNA, 18 nt, Human
cagcagagacauucaaaa

SEQ ID NO: 1113809 - RNA, 22 nt, Human
uggcccugacugauguggaggg

SEQ ID NO: 1113810 - RNA, 22 nt, Human
ugcagaagaccuuccagggcug

SEQ ID NO: 1113811 - RNA, 22 nt, Human
guaucuuuuacaccaggaaauu

SEQ ID NO: 1113812 - RNA, 22 nt, Human
ccaggagcauuaagagaacaua

SEQ ID NO: 1113813 - RNA, 22 nt, Human
ucaggccacuucacaggugauu

SEQ ID NO: 1113814 - RNA, 18 nt, Human
gggcacuggggacuggag

SEQ ID NO: 1113815 - RNA, 22 nt, Human
uaaaaguggauaagcuguagga

SEQ ID NO: 1113816 - RNA, 22 nt, Human
cugcugcucagugucaucaugu

SEQ ID NO: 1113817 - RNA, 22 nt, Human
acacaguaccccaaggcugggc

SEQ ID NO: 1113818 - RNA, 22 nt, Human
gugccuggcaugcgccggugcu

SEQ ID NO: 1113819 - RNA, 22 nt, Human
uaaagguaacaugaacugcuuu

SEQ ID NO: 1113820 - RNA, 22 nt, Human
cccucagcuccacccucagcag

SEQ ID NO: 1113821 - RNA, 22 nt, Human
caggcugccgugaagcaggccu

SEQ ID NO: 1113822 - RNA, 22 nt, Human
agcucccagcagagcuggccac

SEQ ID NO: 1113823 - RNA, 22 nt, Human
uagggcagauucgguggaguuu

SEQ ID NO: 1113824 - RNA, 22 nt, Human
cugcagugcaagcccagaugga

SEQ ID NO: 1113825 - RNA, 22 nt, Human
agucccagccuguaggauuggg

SEQ ID NO: 1113826 - RNA, 22 nt, Human
uacagaaaucacaucgcuuuga

SEQ ID NO: 1113827 - RNA, 22 nt, Human
uaaaugugcacuuuacuuuuca

SEQ ID NO: 1113828 - RNA, 22 nt, Human
ugaagcaggaaacuucuuguuu

SEQ ID NO: 1113829 - RNA, 22 nt, Human
agcagccagaaagggcagucga

SEQ ID NO: 1113830 - RNA, 22 nt, Human
aucaaaguccaucagaagguag

SEQ ID NO: 1113831 - RNA, 22 nt, Human
acuuagaacaggcagaauucca

SEQ ID NO: 1113832 - RNA, 22 nt, Human
gcagcuggucuggccuagagua

SEQ ID NO: 1113833 - RNA, 22 nt, Human
ucacaacuugaagcugauuuaa

SEQ ID NO: 1113834 - RNA, 22 nt, Human
aggcacugagaggcuguguugc

SEQ ID NO: 1113835 - RNA, 22 nt, Human
agaggcaguauacaauccgagc

SEQ ID NO: 1113836 - RNA, 22 nt, Human
acauuuaaugauccuacuguga

SEQ ID NO: 1113837 - RNA, 22 nt, Human
ucugagggugggagaaggagcu

SEQ ID NO: 1113838 - RNA, 22 nt, Human
aauaguguuguucacucaggag

SEQ ID NO: 1113839 - RNA, 22 nt, Human
ggagcuggcuacagagaacucc

SEQ ID NO: 1113840 - RNA, 22 nt, Human
agugaaauuuguuuagauaggu

SEQ ID NO: 1113841 - RNA, 21 nt, Human
gugcucugggcagcagagggc

SEQ ID NO: 1113842 - RNA, 22 nt, Human
gagaggaguaggcugauggugc

SEQ ID NO: 1113843 - RNA, 22 nt, Human
cugggagauugcuagagaugca

SEQ ID NO: 1113844 - RNA, 22 nt, Human
agaaaaggcuugaagagguuuu

SEQ ID NO: 1113845 - RNA, 22 nt, Human
cugucaguaggcucccaucauu

SEQ ID NO: 1113846 - RNA, 22 nt, Human
aggugcuggagucugggcagga

SEQ ID NO: 1113847 - RNA, 22 nt, Human
aaguguuaaaagauuaaaugcu

SEQ ID NO: 1113848 - RNA, 22 nt, Human
acuccuggguugcaguccucaa

SEQ ID NO: 1113849 - RNA, 22 nt, Human
agaggucauaucucagaagaga

SEQ ID NO: 1113850 - RNA, 22 nt, Human
uccagggaugccagccauguug

SEQ ID NO: 1113851 - RNA, 21 nt, Human
uccugccuuaguccagagcag

SEQ ID NO: 1113852 - RNA, 19 nt, Human
accucugcagagauguuua

SEQ ID NO: 1113853 - RNA, 19 nt, Human
uggcuuccaucucucucau

SEQ ID NO: 1113854 - RNA, 22 nt, Human
aaaaaaucagaucuuugguuaa

SEQ ID NO: 1113855 - RNA, 22 nt, Human
ucucagggccccaaaggcuagu

SEQ ID NO: 1113856 - RNA, 22 nt, Human
uuuucuaacaucuaguaauuug

SEQ ID NO: 1113857 - RNA, 22 nt, Human
ucugugacuugcgggaggagaa

SEQ ID NO: 1113858 - RNA, 22 nt, Human
cugggcuacguguugacagcau

SEQ ID NO: 1113859 - RNA, 22 nt, Human
ggcccucccugagccagguggg

SEQ ID NO: 1113860 - RNA, 22 nt, Human
cacaagagagugcgcguugcaa

SEQ ID NO: 1113861 - RNA, 22 nt, Human
acagcuggcaggggggcaugaa

SEQ ID NO: 1113862 - RNA, 22 nt, Human
gaaggagagggucaaggauaau

SEQ ID NO: 1113863 - RNA, 22 nt, Human
cuccucuggcuuccuggaggca

SEQ ID NO: 1113864 - RNA, 22 nt, Human
gcucugcucuaacauuccugac

SEQ ID NO: 1113865 - RNA, 22 nt, Human
uggccugggcaugaagcaucgu

SEQ ID NO: 1113866 - RNA, 20 nt, Human
aagagaagaagucuuugaaa

SEQ ID NO: 1113867 - RNA, 22 nt, Human
uaucuuugcaaauaucucuaag

SEQ ID NO: 1113868 - RNA, 19 nt, Human
agggaaggauucugucauu

SEQ ID NO: 1113869 - RNA, 22 nt, Human
cccugagcccauaguugacauu

SEQ ID NO: 1113870 - RNA, 22 nt, Human
gccaggcugaggcucuggaaga

SEQ ID NO: 1113871 - RNA, 22 nt, Human
cacaggcuugucagcaugaggc

SEQ ID NO: 1113872 - RNA, 22 nt, Human
agagcugcaccuaugcagaccu

SEQ ID NO: 1113873 - RNA, 22 nt, Human
ggcacugagcgggcucugagcg

SEQ ID NO: 1113874 - RNA, 22 nt, Human
aggcagagagcaguggccgucu

SEQ ID NO: 1113875 - RNA, 22 nt, Human
uugucccaggacuugcauagau

SEQ ID NO: 1113876 - RNA, 18 nt, Human
ugucucaggcugaaacag

SEQ ID NO: 1113877 - RNA, 20 nt, Human
agaauucuuacccuuugaug

SEQ ID NO: 1113878 - RNA, 21 nt, Human
ugccagggauuuacagagccu

SEQ ID NO: 1113879 - RNA, 22 nt, Human
cagcucccgccaucgggaggca

SEQ ID NO: 1113880 - RNA, 22 nt, Human
uggggcugucccgguuuggcga

SEQ ID NO: 1113881 - RNA, 18 nt, Human
gucaccuggaucagauua

SEQ ID NO: 1113882 - RNA, 22 nt, Human
cagagggcucaguccugcugga

SEQ ID NO: 1113883 - RNA, 22 nt, Human
gagaaagauguaggcugggagg

SEQ ID NO: 1113884 - RNA, 19 nt, Human
cagucccaaauucuuguca

SEQ ID NO: 1113885 - RNA, 17 nt, Human
agcagaagucagaggga

SEQ ID NO: 1113886 - RNA, 22 nt, Human
uccugccuguuuaccuguacuu

SEQ ID NO: 1113887 - RNA, 19 nt, Human
ggacacagaaagcugcauu

SEQ ID NO: 1113888 - RNA, 22 nt, Human
acagaaauugggcaaauggaag

SEQ ID NO: 1113889 - RNA, 22 nt, Human
guggcugcucgggcuccggccc

SEQ ID NO: 1113890 - RNA, 22 nt, Human
ugcaagggcuuagggggcugug

SEQ ID NO: 1113891 - RNA, 22 nt, Human
acacaggggaaaguggagcuga

SEQ ID NO: 1113892 - RNA, 22 nt, Human
agcaguggaccucagugcuauu

SEQ ID NO: 1113893 - RNA, 23 nt, Human
gccuucagcucgggaaggcuccc

SEQ ID NO: 1113894 - RNA, 22 nt, Human
ggcuggagugggcuccagaguu

SEQ ID NO: 1113895 - RNA, 22 nt, Human
uuagcuaaacuguaacuagaau

SEQ ID NO: 1113896 - RNA, 22 nt, Human
agaaagaacguugguuaucuua

SEQ ID NO: 1113897 - RNA, 22 nt, Human
acucacuuuccauucaagcacc

SEQ ID NO: 1113898 - RNA, 22 nt, Human
ucccccacucuaaaggagccuu

SEQ ID NO: 1113899 - RNA, 22 nt, Human
cuucucuucccagggacacagg

SEQ ID NO: 1113900 - RNA, 22 nt, Human
uuagaaauacaagugagguuga

SEQ ID NO: 1113901 - RNA, 22 nt, Human
ggaggcuccacugcucuuccug

SEQ ID NO: 1113902 - RNA, 22 nt, Human
cugagauggccacugggucuca

SEQ ID NO: 1113903 - RNA, 21 nt, Human
ugcugccaucaugcagagaug

SEQ ID NO: 1113904 - RNA, 22 nt, Human
ugugcugguacaugugaggaug

SEQ ID NO: 1113905 - RNA, 22 nt, Human
uggcucugccacuaacuuggua

SEQ ID NO: 1113906 - RNA, 22 nt, Human
cguggccuuugagugagcuccc

SEQ ID NO: 1113907 - RNA, 22 nt, Human
ccacccuuggguucggaggccg

SEQ ID NO: 1113908 - RNA, 22 nt, Human
uuucucaucuggaaacagugcu

SEQ ID NO: 1113909 - RNA, 19 nt, Human
gagcacagcggcauuuggu

SEQ ID NO: 1113910 - RNA, 22 nt, Human
aucagcaaucucguguauuagg

SEQ ID NO: 1113911 - RNA, 22 nt, Human
ucugucacccaggcuggagugc

SEQ ID NO: 1113912 - RNA, 22 nt, Human
cagaguguuagcgcugguuggg

SEQ ID NO: 1113913 - RNA, 22 nt, Human
uccugucagugaggcagaugaa

SEQ ID NO: 1113914 - RNA, 22 nt, Human
cuucuugcugggggccucagug

SEQ ID NO: 1113915 - RNA, 22 nt, Human
ucccagccugacagugcaucaa

SEQ ID NO: 1113916 - RNA, 22 nt, Human
gguagcacauugcauuaggaga

SEQ ID NO: 1113917 - RNA, 22 nt, Human
cagcccaaagccccaggcuaga

SEQ ID NO: 1113918 - RNA, 22 nt, Human
cuggagggugagccucaucucu

SEQ ID NO: 1113919 - RNA, 22 nt, Human
uuugcauugcauuaaguauucu

SEQ ID NO: 1113920 - RNA, 22 nt, Human
uacaugcuccacuuucuccugu

SEQ ID NO: 1113921 - RNA, 22 nt, Human
cagggagaaaucuccaggaggu

SEQ ID NO: 1113922 - RNA, 22 nt, Human
ggaggggccggcugccugccac

SEQ ID NO: 1113923 - RNA, 22 nt, Human
gcccucagaugggaaaggaggg

SEQ ID NO: 1113924 - RNA, 22 nt, Human
cugggccauggaagucucugcc

SEQ ID NO: 1113925 - RNA, 22 nt, Human
uccugggcugcagggaagagca

SEQ ID NO: 1113926 - RNA, 22 nt, Human
gguagcagggcugugagucaga

SEQ ID NO: 1113927 - RNA, 22 nt, Human
cagcagagcauuugguaggagg

SEQ ID NO: 1113928 - RNA, 22 nt, Human
accccagaggcggaggcugcag

SEQ ID NO: 1113929 - RNA, 22 nt, Human
uacauuguuuuuucuugccauc

SEQ ID NO: 1113930 - RNA, 17 nt, Human
uucaagauauugaaaug

SEQ ID NO: 1113931 - RNA, 22 nt, Human
cuuggcagauccaaaaaugaca

SEQ ID NO: 1113932 - RNA, 22 nt, Human
aaugcuagugugauauguaagg

SEQ ID NO: 1113933 - RNA, 17 nt, Human
gcuggcugacccaugcc

SEQ ID NO: 1113934 - RNA, 22 nt, Human
guggcucuccauugacauggaa

SEQ ID NO: 1113935 - RNA, 22 nt, Human
uccuggaguugugcagugcaca

SEQ ID NO: 1113936 - RNA, 23 nt, Human
aguuccagaaaaaugcucaagca

SEQ ID NO: 1113937 - RNA, 22 nt, Human
cucucugcuguauccuuaggcu

SEQ ID NO: 1113938 - RNA, 19 nt, Human
ggcugccuggagcgagggc

SEQ ID NO: 1113939 - RNA, 22 nt, Human
ucugcagaaguggcugggccac

SEQ ID NO: 1113940 - RNA, 22 nt, Human
ugguuuugcuccaguauaaaua

SEQ ID NO: 1113941 - RNA, 22 nt, Human
gucuggaggaggaagaaggcac

SEQ ID NO: 1113942 - RNA, 22 nt, Human
caacagaaggaagcagggucag

SEQ ID NO: 1113943 - RNA, 22 nt, Human
cagagccagcuguccuuggcau

SEQ ID NO: 1113944 - RNA, 22 nt, Human
uagcugccuagacagcuauagc

SEQ ID NO: 1113945 - RNA, 22 nt, Human
gugucauguagaaauugaugaa

SEQ ID NO: 1113946 - RNA, 22 nt, Human
cagaaaaccugacucuagaacu

SEQ ID NO: 1113947 - RNA, 22 nt, Human
ggggcagagagaaggaagcuug

SEQ ID NO: 1113948 - RNA, 22 nt, Human
ccaccagcuuugccacccugcu

SEQ ID NO: 1113949 - RNA, 22 nt, Human
ucagagugggagaaugugccaa

SEQ ID NO: 1113950 - RNA, 21 nt, Human
gagugcaggucugaugccauc

SEQ ID NO: 1113951 - RNA, 22 nt, Human
ggccucucauguccugggcuuc

SEQ ID NO: 1113952 - RNA, 22 nt, Human
gugucauggaaaauugcaaugg

SEQ ID NO: 1113953 - RNA, 22 nt, Human
ucacuuuugaucccuaugcagu

SEQ ID NO: 1113954 - RNA, 22 nt, Human
agagacaggguuuugccauguu

SEQ ID NO: 1113955 - RNA, 22 nt, Human
gaggccuguagucauggaugua

SEQ ID NO: 1113956 - RNA, 22 nt, Human
gccucugcggagcuguacauca

SEQ ID NO: 1113957 - RNA, 22 nt, Human
gcuggccuccugcuagauggaa

SEQ ID NO: 1113958 - RNA, 22 nt, Human
uugugucccccuuugagagcca

SEQ ID NO: 1113959 - RNA, 22 nt, Human
ugcagagggacagccacagcuc

SEQ ID NO: 1113960 - RNA, 22 nt, Human
auuugucuucaguagguucuuc

SEQ ID NO: 1113961 - RNA, 22 nt, Human
uaaauguggagacucaggaguc

SEQ ID NO: 1113962 - RNA, 22 nt, Human
uggcagagaacacggcugaucu

SEQ ID NO: 1113963 - RNA, 22 nt, Human
uggcagagagagugcagucgac

SEQ ID NO: 1113964 - RNA, 22 nt, Human
ucuagaaacaugacauugaucu

SEQ ID NO: 1113965 - RNA, 22 nt, Human
uuugcaauuugugcugcaaaug

SEQ ID NO: 1113966 - RNA, 22 nt, Human
cugaggccuaagacaugaauga

SEQ ID NO: 1113967 - RNA, 22 nt, Human
guggcugcuacagagcuggagg

SEQ ID NO: 1113968 - RNA, 22 nt, Human
aaaugaccagaauacaggcuuc

SEQ ID NO: 1113969 - RNA, 22 nt, Human
cugaggcugcccagggccaggu

SEQ ID NO: 1113970 - RNA, 22 nt, Human
ugcuggggauccguaccaaccc

SEQ ID NO: 1113971 - RNA, 22 nt, Human
gcucuggacccuggaguggcug

SEQ ID NO: 1113972 - RNA, 22 nt, Human
uucacaggauauaugugcaggg

SEQ ID NO: 1113973 - RNA, 22 nt, Human
uagaaacucaggauacucuucc

SEQ ID NO: 1113974 - RNA, 22 nt, Human
acauuucuuccacaugcugcug

SEQ ID NO: 1113975 - RNA, 22 nt, Human
gcaugguggccuuaggguagcc

SEQ ID NO: 1113976 - RNA, 22 nt, Human
caaagggcucuagacucagcag

SEQ ID NO: 1113977 - RNA, 22 nt, Human
ccagcuccaaguuugggcauca

SEQ ID NO: 1113978 - RNA, 19 nt, Human
gccugccuggguuucugag

SEQ ID NO: 1113979 - RNA, 22 nt, Human
cagaggcugggaccucaggcau

SEQ ID NO: 1113980 - RNA, 22 nt, Human
cagcagugcuucagugugagau

SEQ ID NO: 1113981 - RNA, 22 nt, Human
uuugacagauccuuaacucagc

SEQ ID NO: 1113982 - RNA, 22 nt, Human
cugccagcucgccacaaugaca

SEQ ID NO: 1113983 - RNA, 20 nt, Human
agaaucugacccagagagac

SEQ ID NO: 1113984 - RNA, 22 nt, Human
cccuucccuucugggagaucca

SEQ ID NO: 1113985 - RNA, 22 nt, Human
uuccuguaguugugcaauguac

SEQ ID NO: 1113986 - RNA, 22 nt, Human
aggcaguguguagcuggaagag

SEQ ID NO: 1113987 - RNA, 22 nt, Human
gugucccagccccacaggccug

SEQ ID NO: 1113988 - RNA, 22 nt, Human
gcagacagacugcagugauuuu

SEQ ID NO: 1113989 - RNA, 22 nt, Human
ggugcagaaggaagggagcugg

SEQ ID NO: 1113990 - RNA, 22 nt, Human
gcagagcugggucuguauccaa

SEQ ID NO: 1113991 - RNA, 22 nt, Human
caggccagguggcaggcaaaac

SEQ ID NO: 1113992 - RNA, 22 nt, Human
cuuccucccccacacacucacu

SEQ ID NO: 1113993 - RNA, 22 nt, Human
uucaacacaggaacaugauaua

SEQ ID NO: 1113994 - RNA, 22 nt, Human
uuuccuuccuugcuagccugag

SEQ ID NO: 1113995 - RNA, 22 nt, Human
uggcugcugagaaggcagcugu

SEQ ID NO: 1113996 - RNA, 22 nt, Human
auaacagaugugaagugcuaau

SEQ ID NO: 1113997 - RNA, 22 nt, Human
cagaagcauuccagcaaauagu

SEQ ID NO: 1113998 - RNA, 22 nt, Human
cagcagugaugugugaggguuc

SEQ ID NO: 1113999 - RNA, 22 nt, Human
cuguguccugcgucaagccaau

SEQ ID NO: 1114000 - RNA, 22 nt, Human
ugcagaagcagagccgguggcc

SEQ ID NO: 1114001 - RNA, 21 nt, Human
gcccucaggggaggauggccu

SEQ ID NO: 1114002 - RNA, 22 nt, Human
cacaguggauugggugaugccc

SEQ ID NO: 1114003 - RNA, 20 nt, Human
caggccagagguuugauggc

SEQ ID NO: 1114004 - RNA, 22 nt, Human
ccuccugggcuccugucugcac

SEQ ID NO: 1114005 - RNA, 20 nt, Human
gcugccagugccugaugcuu

SEQ ID NO: 1114006 - RNA, 21 nt, Human
cgggcuggccgggcccucacc

SEQ ID NO: 1114007 - RNA, 22 nt, Human
agggcacagccuaaagccuaug

SEQ ID NO: 1114008 - RNA, 22 nt, Human
agggagcaugggugaagcaggc

SEQ ID NO: 1114009 - RNA, 22 nt, Human
uggccugccccgagauccuggc

SEQ ID NO: 1114010 - RNA, 22 nt, Human
caggggcaagaaugcugucagc

SEQ ID NO: 1114011 - RNA, 22 nt, Human
aaugccaguguguugauuccag

SEQ ID NO: 1114012 - RNA, 22 nt, Human
ucaucacucauuggacaacaga

SEQ ID NO: 1114013 - RNA, 22 nt, Human
acagaauugauggaaaucucag

SEQ ID NO: 1114014 - RNA, 22 nt, Human
uuaucauugucgcagucuaauu

SEQ ID NO: 1114015 - RNA, 22 nt, Human
uuuuccuaguaggccuauuaga

SEQ ID NO: 1114016 - RNA, 22 nt, Human
agccugguguggggcugcagag

SEQ ID NO: 1114017 - RNA, 22 nt, Human
ggucagggggaucugugaggua

SEQ ID NO: 1114018 - RNA, 20 nt, Human
uauuuagauucaaguaugga

SEQ ID NO: 1114019 - RNA, 21 nt, Human
uucuuuccccagaggacuaaa

SEQ ID NO: 1114020 - RNA, 22 nt, Human
ugggccugugaugcugggcuau

SEQ ID NO: 1114021 - RNA, 22 nt, Human
auguagcaucuauccugauaaa

SEQ ID NO: 1114022 - RNA, 22 nt, Human
aucuacagcugucugcacagua

SEQ ID NO: 1114023 - RNA, 22 nt, Human
gccuccugguugcuucuccaac

SEQ ID NO: 1114024 - RNA, 22 nt, Human
ggcagcucaccucugguccagg

SEQ ID NO: 1114025 - RNA, 22 nt, Human
uucuuacagcccuauuacuaaa

SEQ ID NO: 1114026 - RNA, 22 nt, Human
ucucuucuugauuuucacugga

SEQ ID NO: 1114027 - RNA, 22 nt, Human
gucauugcaguggcaaaucaca

SEQ ID NO: 1114028 - RNA, 22 nt, Human
ccugacgaaaggcgugcuggag

SEQ ID NO: 1114029 - RNA, 23 nt, Human
acagcugcaccuggccgccuggc

SEQ ID NO: 1114030 - RNA, 22 nt, Human
uggcucaggaucuaagcagaau

SEQ ID NO: 1114031 - RNA, 22 nt, Human
aaagccuucaaguagauguaag

SEQ ID NO: 1114032 - RNA, 22 nt, Human
cuccaggagcugugucuuucuu

SEQ ID NO: 1114033 - RNA, 22 nt, Human
ugauuuccuaggucuggagaag

SEQ ID NO: 1114034 - RNA, 22 nt, Human
ugagcccaggaguaugaggcug

SEQ ID NO: 1114035 - RNA, 22 nt, Human
caggaggcaucauggagcggac

SEQ ID NO: 1114036 - RNA, 22 nt, Human
aucaguuugagugcugugucaa

SEQ ID NO: 1114037 - RNA, 22 nt, Human
cagcaggcucugaguggcugcc

SEQ ID NO: 1114038 - RNA, 22 nt, Human
uaaggcacccgugagcugccag

SEQ ID NO: 1114039 - RNA, 22 nt, Human
uccaagggcagccauagaacuu

SEQ ID NO: 1114040 - RNA, 22 nt, Human
uugaagauggaucgccacucuc

SEQ ID NO: 1114041 - RNA, 22 nt, Human
acugucuccucaucaugccugg

SEQ ID NO: 1114042 - RNA, 22 nt, Human
guggcucucgccagccugcggg

SEQ ID NO: 1114043 - RNA, 23 nt, Human
gcagacagagcagacuaagacaa

SEQ ID NO: 1114044 - RNA, 22 nt, Human
aaaguguaaaagcauguuaggg

SEQ ID NO: 1114045 - RNA, 22 nt, Human
guggggggacguuggucacuuu

SEQ ID NO: 1114046 - RNA, 22 nt, Human
cuccagggagcuguggagguuu

SEQ ID NO: 1114047 - RNA, 22 nt, Human
uuuuggucagguuggucucgaa

SEQ ID NO: 1114048 - RNA, 22 nt, Human
ucagaggugguaaaggacagca

SEQ ID NO: 1114049 - RNA, 22 nt, Human
aggagcuggguuccuuuggugg

SEQ ID NO: 1114050 - RNA, 22 nt, Human
gcugagagcggccagcugggaa

SEQ ID NO: 1114051 - RNA, 22 nt, Human
agucuccuuggccucaaugccu

SEQ ID NO: 1114052 - RNA, 22 nt, Human
ccagucccaucucugucgcuua

SEQ ID NO: 1114053 - RNA, 22 nt, Human
agggccuggcuucacuuucuca

SEQ ID NO: 1114054 - RNA, 22 nt, Human
ucccuggggauguuggccugcc

SEQ ID NO: 1114055 - RNA, 22 nt, Human
uuccuucucagcccucgaggau

SEQ ID NO: 1114056 - RNA, 22 nt, Human
aggaagcccuugucauuucugu

SEQ ID NO: 1114057 - RNA, 22 nt, Human
guuuuauaggugaaauauuacu

SEQ ID NO: 1114058 - RNA, 22 nt, Human
guggcccugucccaggccuccu

SEQ ID NO: 1114059 - RNA, 22 nt, Human
cagagagagucaaaucuuugcu

SEQ ID NO: 1114060 - RNA, 20 nt, Human
cucugcagcaaggccugggu

SEQ ID NO: 1114061 - RNA, 23 nt, Human
ugcucugugaauaguuggugacu

SEQ ID NO: 1114062 - RNA, 22 nt, Human
acagcacaaucugagucccaga

SEQ ID NO: 1114063 - RNA, 22 nt, Human
aguauuucuaguugguucuacu

SEQ ID NO: 1114064 - RNA, 22 nt, Human
ucugaaaguaucuggaucuuuu

SEQ ID NO: 1114065 - RNA, 19 nt, Human
ggcugucucggcccagcca

SEQ ID NO: 1114066 - RNA, 22 nt, Human
uucauuacugcgguagucacac

SEQ ID NO: 1114067 - RNA, 22 nt, Human
ugcagcugaggccagcuaugcc

SEQ ID NO: 1114068 - RNA, 22 nt, Human
cauugcacuccaucuugggcaa

SEQ ID NO: 1114069 - RNA, 22 nt, Human
ccugccaggagcuggugcugca

SEQ ID NO: 1114070 - RNA, 22 nt, Human
ggcugccugggagcccuccucu

SEQ ID NO: 1114071 - RNA, 22 nt, Human
agccagagcugaugucauucuc

SEQ ID NO: 1114072 - RNA, 22 nt, Human
uguccucacaggaaugaacuuu

SEQ ID NO: 1114073 - RNA, 22 nt, Human
ccuggcagcuaagugcuuugag

SEQ ID NO: 1114074 - RNA, 22 nt, Human
uuuccucuccggggccuccagg

SEQ ID NO: 1114075 - RNA, 22 nt, Human
cauugaaaccuaacauaggcug

SEQ ID NO: 1114076 - RNA, 22 nt, Human
uccuggagauaauugcagugaa

SEQ ID NO: 1114077 - RNA, 22 nt, Human
gauggcagguaguggucucauc

SEQ ID NO: 1114078 - RNA, 22 nt, Human
cccagcaucccagugggcagca

SEQ ID NO: 1114079 - RNA, 20 nt, Human
uaugaguauuacuuucagga

SEQ ID NO: 1114080 - RNA, 22 nt, Human
cagaccugagguugaguaccag

SEQ ID NO: 1114081 - RNA, 22 nt, Human
ugcugcucaaugagaugccauc

SEQ ID NO: 1114082 - RNA, 22 nt, Human
uggcagggugccaguugcgagu

SEQ ID NO: 1114083 - RNA, 22 nt, Human
ggagccagagggaugcaguuga

SEQ ID NO: 1114084 - RNA, 22 nt, Human
uggagcaggccggaaguggcuu

SEQ ID NO: 1114085 - RNA, 22 nt, Human
caguguggagggagagagccug

SEQ ID NO: 1114086 - RNA, 21 nt, Human
ggccugaguauaggacaggcc

SEQ ID NO: 1114087 - RNA, 22 nt, Human
gaggcugguaggaaaggaaaca

SEQ ID NO: 1114088 - RNA, 22 nt, Human
agaaaugugagccccuuaucaa

SEQ ID NO: 1114089 - RNA, 22 nt, Human
uggaggaaaauuacuggggucu

SEQ ID NO: 1114090 - RNA, 22 nt, Human
cagggugcgccacucagaugua

SEQ ID NO: 1114091 - RNA, 22 nt, Human
ucugccuggauuccauucucca

SEQ ID NO: 1114092 - RNA, 20 nt, Human
ugcucugucuaaaacuuccc

SEQ ID NO: 1114093 - RNA, 22 nt, Human
cugagccauaagggaggcuggg

SEQ ID NO: 1114094 - RNA, 22 nt, Human
agugucugccagcugccaggug

SEQ ID NO: 1114095 - RNA, 22 nt, Human
aguauacauauauuagccuucg

SEQ ID NO: 1114096 - RNA, 22 nt, Human
uacuuugucauucuaaccuucc

SEQ ID NO: 1114097 - RNA, 22 nt, Human
cuccuuccugguuagcaccuua

SEQ ID NO: 1114098 - RNA, 22 nt, Human
aauagguagccagauauauaaa

SEQ ID NO: 1114099 - RNA, 22 nt, Human
aauggcugggaguguauuuugg

SEQ ID NO: 1114100 - RNA, 22 nt, Human
cagggcagagccaggauuucaa

SEQ ID NO: 1114101 - RNA, 22 nt, Human
uagcacauaacuuagaauaguu

SEQ ID NO: 1114102 - RNA, 22 nt, Human
uguggcucucaugcacucccag

SEQ ID NO: 1114103 - RNA, 22 nt, Human
gucuggaguggggccugagaau

SEQ ID NO: 1114104 - RNA, 23 nt, Human
gcagaggagcaagcuggacacca

SEQ ID NO: 1114105 - RNA, 22 nt, Human
cacaggguuguucugaggauuc

SEQ ID NO: 1114106 - RNA, 22 nt, Human
gccaguuccuguggagucagag

SEQ ID NO: 1114107 - RNA, 22 nt, Human
ggagaggugaauggcugcucua

SEQ ID NO: 1114108 - RNA, 22 nt, Human
agcuguguagggaaucagagaa

SEQ ID NO: 1114109 - RNA, 22 nt, Human
gaggugggagggcagucccuaa

SEQ ID NO: 1114110 - RNA, 22 nt, Human
aaggccaugaccacuugcugug

SEQ ID NO: 1114111 - RNA, 22 nt, Human
uuaauaaacaggugcagcugaa

SEQ ID NO: 1114112 - RNA, 20 nt, Human
ucagccagcuaacaugggga

SEQ ID NO: 1114113 - RNA, 22 nt, Human
cagcugccaagaaucuuuucua

SEQ ID NO: 1114114 - RNA, 22 nt, Human
auucccaucgucaacuucacug

SEQ ID NO: 1114115 - RNA, 22 nt, Human
ucugcuggccuuagcaggucua

SEQ ID NO: 1114116 - RNA, 23 nt, Human
agggaaaguaguaauggccuuug

SEQ ID NO: 1114117 - RNA, 22 nt, Human
gugggggcaggcagugcuagga

SEQ ID NO: 1114118 - RNA, 23 nt, Human
ugcagcugccucuggcgggccgg

SEQ ID NO: 1114119 - RNA, 22 nt, Human
uuaugacaggaaaaucacagaa

SEQ ID NO: 1114120 - RNA, 22 nt, Human
aaaucaguucacguucugaggu

SEQ ID NO: 1114121 - RNA, 22 nt, Human
cacccagcagcacuuaagacua

SEQ ID NO: 1114122 - RNA, 22 nt, Human
cuggcuccaucacugggugaug

SEQ ID NO: 1114123 - RNA, 22 nt, Human
gcucuggguagccacugccugg

SEQ ID NO: 1114124 - RNA, 21 nt, Human
agcagccauggaugguaugua

SEQ ID NO: 1114125 - RNA, 22 nt, Human
ucagagccccuccgcuguccca

SEQ ID NO: 1114126 - RNA, 22 nt, Human
cagagagcuuagugugcugcau

SEQ ID NO: 1114127 - RNA, 22 nt, Human
gcaggaugagugaguacauuua

SEQ ID NO: 1114128 - RNA, 22 nt, Human
uccuccaggucuaggguggcuu

SEQ ID NO: 1114129 - RNA, 22 nt, Human
gagcccaggcagagguugcagu

SEQ ID NO: 1114130 - RNA, 22 nt, Human
aaauguaguauguugcauguau

SEQ ID NO: 1114131 - RNA, 22 nt, Human
uauuucaugugcaccauaauuc

SEQ ID NO: 1114132 - RNA, 22 nt, Human
uugcaccaaaugaguuaaaauu

SEQ ID NO: 1114133 - RNA, 22 nt, Human
auggcagcaaaugucuggcugg

SEQ ID NO: 1114134 - RNA, 21 nt, Human
agacagagugcagucuacaua

SEQ ID NO: 1114135 - RNA, 22 nt, Human
cugcagggcccgccugagcccu

SEQ ID NO: 1114136 - RNA, 22 nt, Human
agggccuggaacuggagaccac

SEQ ID NO: 1114137 - RNA, 22 nt, Human
ccauggccgccgcugcucagga

SEQ ID NO: 1114138 - RNA, 22 nt, Human
uguggccuggaaggggcugcuc

SEQ ID NO: 1114139 - RNA, 22 nt, Human
uaucuacuccucuuucagaugc

SEQ ID NO: 1114140 - RNA, 22 nt, Human
acacagggcugcgccugacccc

SEQ ID NO: 1114141 - RNA, 22 nt, Human
gagaggccaaaaucccugcccc

SEQ ID NO: 1114142 - RNA, 22 nt, Human
agagccugaggccaggaaaaug

SEQ ID NO: 1114143 - RNA, 22 nt, Human
uccagccaacugccuagggagc

SEQ ID NO: 1114144 - RNA, 22 nt, Human
ugucucaguucccuucucugga

SEQ ID NO: 1114145 - RNA, 22 nt, Human
gagcuguccuaccaggaguccu

SEQ ID NO: 1114146 - RNA, 22 nt, Human
cugaggucaauuaaucaacaac

SEQ ID NO: 1114147 - RNA, 22 nt, Human
agccucucuguuagucacuggg

SEQ ID NO: 1114148 - RNA, 22 nt, Human
uucaagaucuuccaaaggauac

SEQ ID NO: 1114149 - RNA, 22 nt, Human
uagaaaagauaacauucugugc

SEQ ID NO: 1114150 - RNA, 22 nt, Human
ggccucugggguccugagccca

SEQ ID NO: 1114151 - RNA, 22 nt, Human
auuguauuagcacaauacaauu

SEQ ID NO: 1114152 - RNA, 22 nt, Human
aaagaaggaccuggaggaggau

SEQ ID NO: 1114153 - RNA, 19 nt, Human
gcaggguguugacuguccc

SEQ ID NO: 1114154 - RNA, 22 nt, Human
caaagugcuaggauuacaggcc

SEQ ID NO: 1114155 - RNA, 22 nt, Human
gcaccugggacccagaggcacc

SEQ ID NO: 1114156 - RNA, 22 nt, Human
ugcaaucucggcacuuugggag

SEQ ID NO: 1114157 - RNA, 19 nt, Human
cugaggugcaguaagaggc

SEQ ID NO: 1114158 - RNA, 22 nt, Human
auauuucuugagcaccugguau

SEQ ID NO: 1114159 - RNA, 22 nt, Human
aaaugucuuuaucucauguaac

SEQ ID NO: 1114160 - RNA, 22 nt, Human
gucccaggugggcuccaccucu

SEQ ID NO: 1114161 - RNA, 22 nt, Human
aggagcccugcgggaggcagag

SEQ ID NO: 1114162 - RNA, 22 nt, Human
uacaaagugagcaaccucuuuu

SEQ ID NO: 1114163 - RNA, 22 nt, Human
cuuguacaggaauccaugguau

SEQ ID NO: 1114164 - RNA, 22 nt, Human
aacaugaaaguugcuaagugca

SEQ ID NO: 1114165 - RNA, 23 nt, Human
uggcuucugccccauucucucca

SEQ ID NO: 1114166 - RNA, 22 nt, Human
agugcugucccgacaacugagg

SEQ ID NO: 1114167 - RNA, 22 nt, Human
ccagucagccaagcugcagcgg

SEQ ID NO: 1114168 - RNA, 22 nt, Human
gcucucugucguuaugcuucau

SEQ ID NO: 1114169 - RNA, 22 nt, Human
ccuguguguaggccaggggagu

SEQ ID NO: 1114170 - RNA, 19 nt, Human
gccucugcuggggacaggc

SEQ ID NO: 1114171 - RNA, 22 nt, Human
gucaaguuaagauaaggucaug

SEQ ID NO: 1114172 - RNA, 22 nt, Human
gaggcaggcacuguuaucagca

SEQ ID NO: 1114173 - RNA, 22 nt, Human
ccacugucuuuuccaggcugaa

SEQ ID NO: 1114174 - RNA, 22 nt, Human
agcugcucugauaaaccuacuu

SEQ ID NO: 1114175 - RNA, 22 nt, Human
gaaggaaaggucucaugccuuu

SEQ ID NO: 1114176 - RNA, 22 nt, Human
ugcacacaaaugugaacgugcc

SEQ ID NO: 1114177 - RNA, 22 nt, Human
ggcucugcugguaagaugccuc

SEQ ID NO: 1114178 - RNA, 21 nt, Human
agcucagccgggcacaguggc

SEQ ID NO: 1114179 - RNA, 22 nt, Human
guaagagcacugucuccugcug

SEQ ID NO: 1114180 - RNA, 22 nt, Human
cugggagagaagcgaagcuggg

SEQ ID NO: 1114181 - RNA, 22 nt, Human
cagaaagaccugggcucaagag

SEQ ID NO: 1114182 - RNA, 21 nt, Human
aggcugcuggcucaggguccu

SEQ ID NO: 1114183 - RNA, 22 nt, Human
cagcacuggggggauucggagc

SEQ ID NO: 1114184 - RNA, 22 nt, Human
agcagccacagcagaucugagu

SEQ ID NO: 1114185 - RNA, 22 nt, Human
augccagucaaagaagaugaca

SEQ ID NO: 1114186 - RNA, 22 nt, Human
agggcagaaaccaccuugaugg

SEQ ID NO: 1114187 - RNA, 22 nt, Human
cuggagcuaggaaguccaagau

SEQ ID NO: 1114188 - RNA, 22 nt, Human
aucccuggacggcgccucccca

SEQ ID NO: 1114189 - RNA, 22 nt, Human
acccagagcugggcuuggcaaa

SEQ ID NO: 1114190 - RNA, 22 nt, Human
aaaguguugggauuacaggugu

SEQ ID NO: 1114191 - RNA, 22 nt, Human
aggucacacaacugucagaggc

SEQ ID NO: 1114192 - RNA, 22 nt, Human
aaaugcauuuuuaauuagaccc

SEQ ID NO: 1114193 - RNA, 22 nt, Human
uuugaguugcuuauuuaauagg

SEQ ID NO: 1114194 - RNA, 22 nt, Human
ggccccaggaccuccacggucc

SEQ ID NO: 1114195 - RNA, 22 nt, Human
uuuccucuuauacaguguuuau

SEQ ID NO: 1114196 - RNA, 22 nt, Human
ucagcagggaggcucugugccc

SEQ ID NO: 1114197 - RNA, 22 nt, Human
uugaacagcuguuacauuguua

SEQ ID NO: 1114198 - RNA, 22 nt, Human
uggcucucagcucccagcagcc

SEQ ID NO: 1114199 - RNA, 23 nt, Human
ccugcagcugcuggggcuccacc

SEQ ID NO: 1114200 - RNA, 22 nt, Human
gggcuggcaucaguugccgaga

SEQ ID NO: 1114201 - RNA, 22 nt, Human
caggcaggagccagggauucca

SEQ ID NO: 1114202 - RNA, 22 nt, Human
acugaaggguaaugugggagcc

SEQ ID NO: 1114203 - RNA, 18 nt, Human
accugccuguucuucucu

SEQ ID NO: 1114204 - RNA, 22 nt, Human
cuguuuaucuaggaguugcagg

SEQ ID NO: 1114205 - RNA, 22 nt, Human
agcuucuggaagccuggcagca

SEQ ID NO: 1114206 - RNA, 19 nt, Human
uacauuuguguacacuugu

SEQ ID NO: 1114207 - RNA, 22 nt, Human
ugggcucugcaucagugcccau

SEQ ID NO: 1114208 - RNA, 22 nt, Human
caggaaaaaugccaggagucag

SEQ ID NO: 1114209 - RNA, 22 nt, Human
agaaguaggcagggcuguauca

SEQ ID NO: 1114210 - RNA, 22 nt, Human
cuggagcugcuguccuugggug

SEQ ID NO: 1114211 - RNA, 22 nt, Human
gggcuccagcccgggaccaggu

SEQ ID NO: 1114212 - RNA, 22 nt, Human
ggggcagaguagcuggggugug

SEQ ID NO: 1114213 - RNA, 22 nt, Human
guccucagucaguuuggugggg

SEQ ID NO: 1114214 - RNA, 22 nt, Human
caguggccugagccaggcuucc

SEQ ID NO: 1114215 - RNA, 22 nt, Human
ugcagucuuccagcugcacaaa

SEQ ID NO: 1114216 - RNA, 22 nt, Human
cagugccucuuaagugucaccc

SEQ ID NO: 1114217 - RNA, 22 nt, Human
ucacaugcuugaggaaagaaaa

SEQ ID NO: 1114218 - RNA, 22 nt, Human
cagaggaggccaccgcauaggc

SEQ ID NO: 1114219 - RNA, 22 nt, Human
gccuuggccaacaccuugcaaa

SEQ ID NO: 1114220 - RNA, 22 nt, Human
uucuaguguccuuggacuugcu

SEQ ID NO: 1114221 - RNA, 22 nt, Human
aaaauacacauacuaggggaaa

SEQ ID NO: 1114222 - RNA, 22 nt, Human
guggagacgggacagaagcuaa

SEQ ID NO: 1114223 - RNA, 22 nt, Human
uggagcagagaugguggccuuc

SEQ ID NO: 1114224 - RNA, 22 nt, Human
ugcaggagcagagauggcugga

SEQ ID NO: 1114225 - RNA, 22 nt, Human
ucuggcagggguucugcacuug

SEQ ID NO: 1114226 - RNA, 22 nt, Human
ugagccugcugucgcuggaccc

SEQ ID NO: 1114227 - RNA, 22 nt, Human
gagggcugcaaugagacagaga

SEQ ID NO: 1114228 - RNA, 22 nt, Human
uggcucaggccacuucuuuuau

SEQ ID NO: 1114229 - RNA, 18 nt, Human
acauuucuccuucugacc

SEQ ID NO: 1114230 - RNA, 22 nt, Human
acauuucugcaucucagagcua

SEQ ID NO: 1114231 - RNA, 22 nt, Human
uccugcagccacugcaggcaga

SEQ ID NO: 1114232 - RNA, 22 nt, Human
caccaucagcagcaggugucaa

SEQ ID NO: 1114233 - RNA, 22 nt, Human
uggagccaaggccaguucucag

SEQ ID NO: 1114234 - RNA, 22 nt, Human
uccuguaguugcuaaguuuguu

SEQ ID NO: 1114235 - RNA, 22 nt, Human
cugcccuguuuggacagcccgg

SEQ ID NO: 1114236 - RNA, 22 nt, Human
aucagcaagcauuuauugagug

SEQ ID NO: 1114237 - RNA, 22 nt, Human
auuauguagcuaaaaauugugu

SEQ ID NO: 1114238 - RNA, 22 nt, Human
gccuggagccucagcaaggagg

SEQ ID NO: 1114239 - RNA, 22 nt, Human
uucagaaagugaaucuuguuau

SEQ ID NO: 1114240 - RNA, 23 nt, Human
uugcuucugugcaauucaguacu

SEQ ID NO: 1114241 - RNA, 22 nt, Human
ccugucugcaugaucccugcca

SEQ ID NO: 1114242 - RNA, 22 nt, Human
uggcagcagacaaaaggccauu

SEQ ID NO: 1114243 - RNA, 22 nt, Human
ugccagugggugugcagagacu

SEQ ID NO: 1114244 - RNA, 17 nt, Human
ucaggauccaggguucu

SEQ ID NO: 1114245 - RNA, 22 nt, Human
aggaguguggccagggcucugg

SEQ ID NO: 1114246 - RNA, 22 nt, Human
uuucagugcuucuguuuaccgg

SEQ ID NO: 1114247 - RNA, 19 nt, Human
uccucaggggcucacagac

SEQ ID NO: 1114248 - RNA, 19 nt, Human
auuccucaaggacagaaau

SEQ ID NO: 1114249 - RNA, 22 nt, Human
gcaggagcucguuuccaggcug

SEQ ID NO: 1114250 - RNA, 22 nt, Human
uguaugcaccauuguauuaccu

SEQ ID NO: 1114251 - RNA, 22 nt, Human
uuauuuaauuuucucacucaga

SEQ ID NO: 1114252 - RNA, 20 nt, Human
aagcagaagcugcucucagc

SEQ ID NO: 1114253 - RNA, 22 nt, Human
cccagagccucauucuguuggg

SEQ ID NO: 1114254 - RNA, 22 nt, Human
gucaaacaaauuaacauaucca

SEQ ID NO: 1114255 - RNA, 22 nt, Human
ccagcagcuguggcuuugccuc

SEQ ID NO: 1114256 - RNA, 22 nt, Human
cacagaguggaggcuuggccug

SEQ ID NO: 1114257 - RNA, 22 nt, Human
aggccuguuccuuccugggcac

SEQ ID NO: 1114258 - RNA, 22 nt, Human
agcagggccucuggcacugguc

SEQ ID NO: 1114259 - RNA, 22 nt, Human
cugggguggugcaggccucaug

SEQ ID NO: 1114260 - RNA, 22 nt, Human
gagagcugggggacuguggaug

SEQ ID NO: 1114261 - RNA, 22 nt, Human
aaguguguauuguuuaugcugc

SEQ ID NO: 1114262 - RNA, 22 nt, Human
guguggcugccagccaagaggc

SEQ ID NO: 1114263 - RNA, 22 nt, Human
caggguuucaccauguuagcag

SEQ ID NO: 1114264 - RNA, 22 nt, Human
ccaggaggcggaagguacagug

SEQ ID NO: 1114265 - RNA, 19 nt, Human
cccucaggucugagcaguc

SEQ ID NO: 1114266 - RNA, 22 nt, Human
ccaaaguccauaguuuacauaa

SEQ ID NO: 1114267 - RNA, 22 nt, Human
gaaaagcuaggccaguucagcu

SEQ ID NO: 1114268 - RNA, 22 nt, Human
aggcuccuuguucaucauccau

SEQ ID NO: 1114269 - RNA, 22 nt, Human
ggcagcugggucacaccgaucu

SEQ ID NO: 1114270 - RNA, 22 nt, Human
cuccuggacauggagcggagga

SEQ ID NO: 1114271 - RNA, 22 nt, Human
cuggcaggagcauucacagagg

SEQ ID NO: 1114272 - RNA, 22 nt, Human
ugcaggggcuugucugggccug

SEQ ID NO: 1114273 - RNA, 22 nt, Human
aagaaaugcagaaaugugcugg

SEQ ID NO: 1114274 - RNA, 22 nt, Human
gaaggaagugcucauacuaguu

SEQ ID NO: 1114275 - RNA, 17 nt, Human
cccugccaccaggaagc

SEQ ID NO: 1114276 - RNA, 20 nt, Human
ccagucccugagcaccaggg

SEQ ID NO: 1114277 - RNA, 22 nt, Human
gcugucucauacaaggcccugc

SEQ ID NO: 1114278 - RNA, 22 nt, Human
agaaauguuguggguuuuguua

SEQ ID NO: 1114279 - RNA, 22 nt, Human
ucucuggaagcgcagaucuguu

SEQ ID NO: 1114280 - RNA, 22 nt, Human
ggagucagccugucagagugua

SEQ ID NO: 1114281 - RNA, 22 nt, Human
cuccuuccugccccagugauaa

SEQ ID NO: 1114282 - RNA, 22 nt, Human
uggcuggcuagugggcaggauu

SEQ ID NO: 1114283 - RNA, 22 nt, Human
gggcugcugcccaggaggcacc

SEQ ID NO: 1114284 - RNA, 22 nt, Human
auuguaucuugucauuaugcau

SEQ ID NO: 1114285 - RNA, 22 nt, Human
cugccuggucucaggcaugggg

SEQ ID NO: 1114286 - RNA, 22 nt, Human
caggccuggcccccggcacacc

SEQ ID NO: 1114287 - RNA, 22 nt, Human
acauuucuuagccuaguuccag

SEQ ID NO: 1114288 - RNA, 22 nt, Human
gcuggccaggugcuuugguucu

SEQ ID NO: 1114289 - RNA, 22 nt, Human
agacaacaccaaaugcuagugu

SEQ ID NO: 1114290 - RNA, 23 nt, Human
aggagccaggaaccagcuucccc

SEQ ID NO: 1114291 - RNA, 22 nt, Human
cugggaggcggagguuguagug

SEQ ID NO: 1114292 - RNA, 22 nt, Human
cuucagaggggacucaaaguca

SEQ ID NO: 1114293 - RNA, 22 nt, Human
guccucuguagggcugggccac

SEQ ID NO: 1114294 - RNA, 19 nt, Human
auaaggcaauuggauuugg

SEQ ID NO: 1114295 - RNA, 22 nt, Human
cacuguguaagaagaugggcuu

SEQ ID NO: 1114296 - RNA, 23 nt, Human
gccucagagaaacagcugcacac

SEQ ID NO: 1114297 - RNA, 21 nt, Human
aggagggcacaaggccaggaa

SEQ ID NO: 1114298 - RNA, 22 nt, Human
ccauggcauuuuaugugucuua

SEQ ID NO: 1114299 - RNA, 22 nt, Human
caggggcaggugugagaucauc

SEQ ID NO: 1114300 - RNA, 22 nt, Human
cuaucuuucgauucuagcuuaa

SEQ ID NO: 1114301 - RNA, 22 nt, Human
ucuuugcaaauguuauuaucuu

SEQ ID NO: 1114302 - RNA, 22 nt, Human
cgcugccaggucaccaggggua

SEQ ID NO: 1114303 - RNA, 22 nt, Human
ugcagggccgcuggaggucaug

SEQ ID NO: 1114304 - RNA, 22 nt, Human
agcaaaguagcugcuguucuua

SEQ ID NO: 1114305 - RNA, 22 nt, Human
cuggagcccaggccuggugucu

SEQ ID NO: 1114306 - RNA, 22 nt, Human
gaggcaugucuggccuguccca

SEQ ID NO: 1114307 - RNA, 22 nt, Human
cuuaacagagagaaguguugcu

SEQ ID NO: 1114308 - RNA, 22 nt, Human
aggaccugacuggcuccugcuu

SEQ ID NO: 1114309 - RNA, 22 nt, Human
ccauaagguugaaaacuguaca

SEQ ID NO: 1114310 - RNA, 22 nt, Human
caagugucuauaucagugcuug

SEQ ID NO: 1114311 - RNA, 23 nt, Human
ggccucuguguucugcccacaug

SEQ ID NO: 1114312 - RNA, 22 nt, Human
auugacaaggaaacuauaccag

SEQ ID NO: 1114313 - RNA, 22 nt, Human
acucugccaucccaggugcugu

SEQ ID NO: 1114314 - RNA, 22 nt, Human
uggggguguccuggugcacaca

SEQ ID NO: 1114315 - RNA, 22 nt, Human
aaggcccuggccccagcuucuu

SEQ ID NO: 1114316 - RNA, 22 nt, Human
cuuacauuuaaucaugugucau

SEQ ID NO: 1114317 - RNA, 22 nt, Human
agggugcagaaggagccuagga

SEQ ID NO: 1114318 - RNA, 22 nt, Human
acuggacagaggaaauauggag

SEQ ID NO: 1114319 - RNA, 22 nt, Human
uggaggaaucagggcuuaggcu

SEQ ID NO: 1114320 - RNA, 22 nt, Human
aggcucugugacaaucaagcug

SEQ ID NO: 1114321 - RNA, 22 nt, Human
aaaguucugggggagaagaacg

SEQ ID NO: 1114322 - RNA, 22 nt, Human
cuuguggcccauggcuuccugc

SEQ ID NO: 1114323 - RNA, 18 nt, Human
gcugagguggugucagag

SEQ ID NO: 1114324 - RNA, 21 nt, Human
ucauuuuuauugcuaccuugc

SEQ ID NO: 1114325 - RNA, 22 nt, Human
cacugaaucucaaggggagggu

SEQ ID NO: 1114326 - RNA, 22 nt, Human
gggcucuggaaggugcaccaug

SEQ ID NO: 1114327 - RNA, 23 nt, Human
ugggggugcacgggccacaucuu

SEQ ID NO: 1114328 - RNA, 22 nt, Human
ugccucugcugcuguggcauca

SEQ ID NO: 1114329 - RNA, 22 nt, Human
cugugggcugaaagugcucccg

SEQ ID NO: 1114330 - RNA, 22 nt, Human
gccagguggcugagcagcugca

SEQ ID NO: 1114331 - RNA, 22 nt, Human
agcccagcagaaaguccagccu

SEQ ID NO: 1114332 - RNA, 22 nt, Human
ugcagggcacacgcacgggugu

SEQ ID NO: 1114333 - RNA, 22 nt, Human
uaaaugugucuauggacccgcc

SEQ ID NO: 1114334 - RNA, 22 nt, Human
uggagcaggugcucaggguaau

SEQ ID NO: 1114335 - RNA, 22 nt, Human
ccaguuuuuccagugcuuucug

SEQ ID NO: 1114336 - RNA, 22 nt, Human
aggugagguuugggagguguca

SEQ ID NO: 1114337 - RNA, 18 nt, Human
uccuccuuuggccuuuuc

SEQ ID NO: 1114338 - RNA, 22 nt, Human
ucagagucauugcaaguagaag

SEQ ID NO: 1114339 - RNA, 22 nt, Human
acccucccauuuccauguagca

SEQ ID NO: 1114340 - RNA, 22 nt, Human
agagaagagcaaugauaaauuu

SEQ ID NO: 1114341 - RNA, 22 nt, Human
ggcugccuacuuucccagaguu

SEQ ID NO: 1114342 - RNA, 22 nt, Human
ugaggaggucagagucuggcug

SEQ ID NO: 1114343 - RNA, 22 nt, Human
agugacugggcagggcagggcc

SEQ ID NO: 1114344 - RNA, 22 nt, Human
ggccugagcucuggggaggcaa

SEQ ID NO: 1114345 - RNA, 22 nt, Human
uaagacaugguugaucuagugu

SEQ ID NO: 1114346 - RNA, 21 nt, Human
gcucucugcaugguggcucag

SEQ ID NO: 1114347 - RNA, 22 nt, Human
ugcagaagaaaacagcugugug

SEQ ID NO: 1114348 - RNA, 22 nt, Human
ccugugcauccgguggucauug

SEQ ID NO: 1114349 - RNA, 22 nt, Human
ugauuaacugucuauuaaucau

SEQ ID NO: 1114350 - RNA, 22 nt, Human
cugagggcaugaacauuccaua

SEQ ID NO: 1114351 - RNA, 22 nt, Human
gagcagcuagauaaagcccuuc

SEQ ID NO: 1114352 - RNA, 22 nt, Human
aaaauguaaagcuugaguguag

SEQ ID NO: 1114353 - RNA, 22 nt, Human
caugcuuucuguccaaauguua

SEQ ID NO: 1114354 - RNA, 22 nt, Human
aaaugcaauuguauguacucca

SEQ ID NO: 1114355 - RNA, 22 nt, Human
augguuuguaacccaauacucc

SEQ ID NO: 1114356 - RNA, 21 nt, Human
uggagcugccacuuguccucc

SEQ ID NO: 1114357 - RNA, 22 nt, Human
agucccagcuacucaagaggcu

SEQ ID NO: 1114358 - RNA, 22 nt, Human
ugucucugcuuuccuugcaggg

SEQ ID NO: 1114359 - RNA, 22 nt, Human
uuuguuuucaaugugucauuca

SEQ ID NO: 1114360 - RNA, 22 nt, Human
cauguacaguuuuucuguccug

SEQ ID NO: 1114361 - RNA, 22 nt, Human
ugaggcaggagguugagaacug

SEQ ID NO: 1114362 - RNA, 22 nt, Human
gccuggaggaauguagcugagg

SEQ ID NO: 1114363 - RNA, 23 nt, Human
gcauugucuccccacuucugggc

SEQ ID NO: 1114364 - RNA, 22 nt, Human
gcucugggugaacuuggagcaa

SEQ ID NO: 1114365 - RNA, 22 nt, Human
ucugccuugagguccucagcuc

SEQ ID NO: 1114366 - RNA, 22 nt, Human
aggcagagaaaaaccagauaug

SEQ ID NO: 1114367 - RNA, 22 nt, Human
ugcagccaucuuucuuggagga

SEQ ID NO: 1114368 - RNA, 22 nt, Human
gccugcagaggugcugcuagcu

SEQ ID NO: 1114369 - RNA, 22 nt, Human
cacagggccuggggcagcugcu

SEQ ID NO: 1114370 - RNA, 22 nt, Human
ugucacauaauuuaucuguagg

SEQ ID NO: 1114371 - RNA, 22 nt, Human
guggguggaggcgucgagggca

SEQ ID NO: 1114372 - RNA, 22 nt, Human
aagggcagagggaaucccacau

SEQ ID NO: 1114373 - RNA, 22 nt, Human
cagguggggcgcccucaggcag

SEQ ID NO: 1114374 - RNA, 22 nt, Human
ucucaccaaagccuugaccaua

SEQ ID NO: 1114375 - RNA, 22 nt, Human
ugcuuaauauugugauguaaua

SEQ ID NO: 1114376 - RNA, 22 nt, Human
ggcugccauaacagaguaccac

SEQ ID NO: 1114377 - RNA, 19 nt, Human
gccugggaugggcagaacu

SEQ ID NO: 1114378 - RNA, 22 nt, Human
ccaguugguuucaaugggacag

SEQ ID NO: 1114379 - RNA, 22 nt, Human
uugggcugaaguagagggcaga

SEQ ID NO: 1114380 - RNA, 22 nt, Human
ugugaaagucaaauuaauugaa

SEQ ID NO: 1114381 - RNA, 22 nt, Human
aaguucaagucuccugaguaua

SEQ ID NO: 1114382 - RNA, 22 nt, Human
ugggcagacauugaguuuguuc

SEQ ID NO: 1114383 - RNA, 22 nt, Human
ggcagaggaaggaugaauucac

SEQ ID NO: 1114384 - RNA, 22 nt, Human
gccaggcuggugcaaggauauu

SEQ ID NO: 1114385 - RNA, 22 nt, Human
aagagagagcauucuucuguua

SEQ ID NO: 1114386 - RNA, 22 nt, Human
cagaauuugaaguaauauucca

SEQ ID NO: 1114387 - RNA, 22 nt, Human
augcuauacucaaagaaauuca

SEQ ID NO: 1114388 - RNA, 22 nt, Human
gaaaucugcuucuugcauagua

SEQ ID NO: 1114389 - RNA, 22 nt, Human
acugcaggagacacagcugcug

SEQ ID NO: 1114390 - RNA, 22 nt, Human
uggagcaggacugcugcccuca

SEQ ID NO: 1114391 - RNA, 22 nt, Human
gccccucccagucaggagcacu

SEQ ID NO: 1114392 - RNA, 23 nt, Human
ucagaaugcacugaauuuacccu

SEQ ID NO: 1114393 - RNA, 22 nt, Human
ucaguuuucucauuuaugagau

SEQ ID NO: 1114394 - RNA, 22 nt, Human
acaaagcuagagaagagaauug

SEQ ID NO: 1114395 - RNA, 22 nt, Human
ugagcuucaaaauaugugaauc

SEQ ID NO: 1114396 - RNA, 22 nt, Human
acauuucuugaugccucuguga

SEQ ID NO: 1114397 - RNA, 22 nt, Human
ggucccaggcugcgggcuggug

SEQ ID NO: 1114398 - RNA, 17 nt, Human
cucuccuuccucugagg

SEQ ID NO: 1114399 - RNA, 22 nt, Human
cagggugccaaagaacaaauau

SEQ ID NO: 1114400 - RNA, 20 nt, Human
uggagccacagucagguucc

SEQ ID NO: 1114401 - RNA, 22 nt, Human
gggugacauuucccaaugagcc

SEQ ID NO: 1114402 - RNA, 22 nt, Human
acaggcugccuaccaaguauca

SEQ ID NO: 1114403 - RNA, 22 nt, Human
caccagggcucugagcucugaa

SEQ ID NO: 1114404 - RNA, 22 nt, Human
uuaugacauaugaguacaagua

SEQ ID NO: 1114405 - RNA, 22 nt, Human
gcagcugccccgacugugaguc

SEQ ID NO: 1114406 - RNA, 22 nt, Human
uccugagaugagacagugcugc

SEQ ID NO: 1114407 - RNA, 22 nt, Human
gcacccagccagcaucucagag

SEQ ID NO: 1114408 - RNA, 22 nt, Human
agccugagugcuuaggacuguu

SEQ ID NO: 1114409 - RNA, 22 nt, Human
gguggcaggcccugagcauccc

SEQ ID NO: 1114410 - RNA, 22 nt, Human
ugugacaugugucaucuuuucu

SEQ ID NO: 1114411 - RNA, 22 nt, Human
cagggacauugguggccagguu

SEQ ID NO: 1114412 - RNA, 22 nt, Human
uuugcauuuugauaagaucacu

SEQ ID NO: 1114413 - RNA, 22 nt, Human
uccauguggccagacacuggca

SEQ ID NO: 1114414 - RNA, 19 nt, Human
gaguuauugccagggcaug

SEQ ID NO: 1114415 - RNA, 22 nt, Human
cccuguccuggaugggagcacu

SEQ ID NO: 1114416 - RNA, 22 nt, Human
agaacagaugugggcagaccug

SEQ ID NO: 1114417 - RNA, 22 nt, Human
gagcagcugguaggugaaccca

SEQ ID NO: 1114418 - RNA, 22 nt, Human
gcucagagcuugaaguuccacu

SEQ ID NO: 1114419 - RNA, 22 nt, Human
ggucagguuuuuaggagugacc

SEQ ID NO: 1114420 - RNA, 22 nt, Human
ggaagaagggucauuggcagcc

SEQ ID NO: 1114421 - RNA, 22 nt, Human
cugggccucauccucagaguuu

SEQ ID NO: 1114422 - RNA, 22 nt, Human
ugcucugcaagcaggagcaaga

SEQ ID NO: 1114423 - RNA, 22 nt, Human
acaugcauacaagcacauguag

SEQ ID NO: 1114424 - RNA, 22 nt, Human
acauuucucauucuccccuaac

SEQ ID NO: 1114425 - RNA, 22 nt, Human
gagcugccuguugcauagcaac

SEQ ID NO: 1114426 - RNA, 22 nt, Human
ugucccuggaacuauggcucca

SEQ ID NO: 1114427 - RNA, 22 nt, Human
ccagucacuggaaaaugggaau

SEQ ID NO: 1114428 - RNA, 20 nt, Human
uggggccuguuucugugguu

SEQ ID NO: 1114429 - RNA, 22 nt, Human
aaaugguguuucuaaugcuaga

SEQ ID NO: 1114430 - RNA, 22 nt, Human
cugccagcucaaagcgcagcua

SEQ ID NO: 1114431 - RNA, 22 nt, Human
gagagcugggcuuugggugaag

SEQ ID NO: 1114432 - RNA, 22 nt, Human
gggccucucccuucucacgcau

SEQ ID NO: 1114433 - RNA, 22 nt, Human
aucuggcuauuucuggucgggg

SEQ ID NO: 1114434 - RNA, 22 nt, Human
agggcuggcaagggauugaaau

SEQ ID NO: 1114435 - RNA, 22 nt, Human
aagggcaggugggcauuucugg

SEQ ID NO: 1114436 - RNA, 22 nt, Human
ucagggcagaauccaaagaauu

SEQ ID NO: 1114437 - RNA, 22 nt, Human
uuccauaacugaccgaaugcau

SEQ ID NO: 1114438 - RNA, 22 nt, Human
aucuacaggcugaggugggagg

SEQ ID NO: 1114439 - RNA, 22 nt, Human
aagaguuaagcaacagauacca

SEQ ID NO: 1114440 - RNA, 22 nt, Human
acagggucaagggugcuacaag

SEQ ID NO: 1114441 - RNA, 22 nt, Human
aguuuuucugcuggucucacua

SEQ ID NO: 1114442 - RNA, 22 nt, Human
gaaggagagagacaucgucccu

SEQ ID NO: 1114443 - RNA, 22 nt, Human
cauguaaaacacucagaacagu

SEQ ID NO: 1114444 - RNA, 22 nt, Human
aaauucuuucauggcuaauaag

SEQ ID NO: 1114445 - RNA, 22 nt, Human
ugcuauugugaacagugccaca

SEQ ID NO: 1114446 - RNA, 22 nt, Human
caggguggggcuggcuaucaaa

SEQ ID NO: 1114447 - RNA, 22 nt, Human
uccugcagagccgcccucaggu

SEQ ID NO: 1114448 - RNA, 22 nt, Human
uuauugccugauugaggucauu

SEQ ID NO: 1114449 - RNA, 22 nt, Human
gcugcagcuuuaggauccagug

SEQ ID NO: 1114450 - RNA, 22 nt, Human
ccugggaggcggagguugcagg

SEQ ID NO: 1114451 - RNA, 22 nt, Human
uggguggaauaaaucaguucug

SEQ ID NO: 1114452 - RNA, 22 nt, Human
gcccauggcagaacugugagca

SEQ ID NO: 1114453 - RNA, 22 nt, Human
gugggcuucuguuagggaggcu

SEQ ID NO: 1114454 - RNA, 22 nt, Human
ccugggaggcuguuuccagccu

SEQ ID NO: 1114455 - RNA, 22 nt, Human
ccaucuccacugucccugucaa

SEQ ID NO: 1114456 - RNA, 22 nt, Human
auguacaaaaugccacugaauu

SEQ ID NO: 1114457 - RNA, 22 nt, Human
ucuuccucucuaauugaucaga

SEQ ID NO: 1114458 - RNA, 22 nt, Human
gucacuggggccacaugcagaa

SEQ ID NO: 1114459 - RNA, 22 nt, Human
ggccugagaaccauggggccaa

SEQ ID NO: 1114460 - RNA, 22 nt, Human
gcugccugggcaggaggcgcug

SEQ ID NO: 1114461 - RNA, 22 nt, Human
ugcaggugccucuugagcuugu

SEQ ID NO: 1114462 - RNA, 22 nt, Human
uuggaggcaaugggaaggaggc

SEQ ID NO: 1114463 - RNA, 22 nt, Human
guggcucuaggugagcauggag

SEQ ID NO: 1114464 - RNA, 22 nt, Human
agagcugggacuuggacucaau

SEQ ID NO: 1114465 - RNA, 22 nt, Human
caagccucagaaucuucuccau

SEQ ID NO: 1114466 - RNA, 21 nt, Human
ccucugcucgggcaugcguuu

SEQ ID NO: 1114467 - RNA, 22 nt, Human
auccuugagccuuaucuuuugu

SEQ ID NO: 1114468 - RNA, 22 nt, Human
gccuugcuuugcuucuggacag

SEQ ID NO: 1114469 - RNA, 22 nt, Human
ugcaugcauaaauguacacaca

SEQ ID NO: 1114470 - RNA, 22 nt, Human
cagagccacugucugccaggca

SEQ ID NO: 1114471 - RNA, 22 nt, Human
auuucuuuucaagagggugcuu

SEQ ID NO: 1114472 - RNA, 22 nt, Human
uccaggagaggccugaccaggu

SEQ ID NO: 1114473 - RNA, 22 nt, Human
ugucucugauaaguaguucagu

SEQ ID NO: 1114474 - RNA, 20 nt, Human
aaagucuuaugguuaauuuu

SEQ ID NO: 1114475 - RNA, 22 nt, Human
aagggacuuugucagcuuucca

SEQ ID NO: 1114476 - RNA, 22 nt, Human
cugagccuuauucaccagcccu

SEQ ID NO: 1114477 - RNA, 22 nt, Human
gccagcaguccugcugugugcc

SEQ ID NO: 1114478 - RNA, 22 nt, Human
ggcugcagcggauuggggauug

SEQ ID NO: 1114479 - RNA, 22 nt, Human
cauggcaggaggcugcuggcag

SEQ ID NO: 1114480 - RNA, 22 nt, Human
uuucuucugagaucagggagaa

SEQ ID NO: 1114481 - RNA, 22 nt, Human
gcaucuuucuguccauucagca

SEQ ID NO: 1114482 - RNA, 22 nt, Human
agaauuguugggguaauaaaag

SEQ ID NO: 1114483 - RNA, 22 nt, Human
ccuuccuggcuguccgccugau

SEQ ID NO: 1114484 - RNA, 22 nt, Human
ccugcagguccccggaugcgca

SEQ ID NO: 1114485 - RNA, 22 nt, Human
cccagcucaucaggagccgccc

SEQ ID NO: 1114486 - RNA, 22 nt, Human
cccaggcucccaggugggacaa

SEQ ID NO: 1114487 - RNA, 22 nt, Human
ucucagaggcccgacguucucc

SEQ ID NO: 1114488 - RNA, 22 nt, Human
cacugaagccugggaguaagac

SEQ ID NO: 1114489 - RNA, 22 nt, Human
acauuucuccuugcaggaguca

SEQ ID NO: 1114490 - RNA, 22 nt, Human
agcagcaggcuguguggacuga

SEQ ID NO: 1114491 - RNA, 22 nt, Human
cuuagaaaucgaacucagguua

SEQ ID NO: 1114492 - RNA, 21 nt, Human
uggcucugcucagagcagucc

SEQ ID NO: 1114493 - RNA, 20 nt, Human
uugcagcagugaggugaagg

SEQ ID NO: 1114494 - RNA, 22 nt, Human
gagcuuggugaugccuccuggu

SEQ ID NO: 1114495 - RNA, 22 nt, Human
cuggccuucagacucggacuga

SEQ ID NO: 1114496 - RNA, 19 nt, Human
ggaagagaggaaaggugga

SEQ ID NO: 1114497 - RNA, 22 nt, Human
ccagcucugcagggccuggggu

SEQ ID NO: 1114498 - RNA, 22 nt, Human
accaggcuggagugcaguggcg

SEQ ID NO: 1114499 - RNA, 22 nt, Human
cacugccugugagcugugugcc

SEQ ID NO: 1114500 - RNA, 19 nt, Human
aggcagcacccaguccuug

SEQ ID NO: 1114501 - RNA, 22 nt, Human
aguaggaggcgggagcaugaag

SEQ ID NO: 1114502 - RNA, 22 nt, Human
uguggccuccuguuccugggua

SEQ ID NO: 1114503 - RNA, 22 nt, Human
uccugcaggccuguucccagua

SEQ ID NO: 1114504 - RNA, 23 nt, Human
gagguacagcaccagugaauagg

SEQ ID NO: 1114505 - RNA, 22 nt, Human
uagcugucagcaaucaaguggu

SEQ ID NO: 1114506 - RNA, 22 nt, Human
aucuggcucaccuggguaaaua

SEQ ID NO: 1114507 - RNA, 18 nt, Human
cccagcuccacuucccuc

SEQ ID NO: 1114508 - RNA, 22 nt, Human
uccagggaaggugugaggcugg

SEQ ID NO: 1114509 - RNA, 22 nt, Human
agaugcugucacacacacuguu

SEQ ID NO: 1114510 - RNA, 22 nt, Human
caaugugucaggaaaagggcca

SEQ ID NO: 1114511 - RNA, 23 nt, Human
cucccuggaguuucuggaagaug

SEQ ID NO: 1114512 - RNA, 22 nt, Human
uguuuaagcugaugagguaucg

SEQ ID NO: 1114513 - RNA, 22 nt, Human
ggggcugggauuugaacccagg

SEQ ID NO: 1114514 - RNA, 22 nt, Human
uucauuccuucccuaagcaacu

SEQ ID NO: 1114515 - RNA, 22 nt, Human
cccagcuccaagggacagcgaa

SEQ ID NO: 1114516 - RNA, 22 nt, Human
ccuggcacgaagggcugagguu

SEQ ID NO: 1114517 - RNA, 22 nt, Human
gccaccagggggcuccagugag

SEQ ID NO: 1114518 - RNA, 22 nt, Human
auacauuagcucauaugauuaa

SEQ ID NO: 1114519 - RNA, 20 nt, Human
cuuuggcaaugagaacaggg

SEQ ID NO: 1114520 - RNA, 22 nt, Human
ccagcagacacacaggcguggg

SEQ ID NO: 1114521 - RNA, 22 nt, Human
agccagggagguggagguugca

SEQ ID NO: 1114522 - RNA, 22 nt, Human
uggcuggcaguaggcuaguggc

SEQ ID NO: 1114523 - RNA, 22 nt, Human
acagggcccuugccagcacaag

SEQ ID NO: 1114524 - RNA, 22 nt, Human
ugcugucccuaagucucuucaa

SEQ ID NO: 1114525 - RNA, 22 nt, Human
ugaggccagucucaucacaggc

SEQ ID NO: 1114526 - RNA, 22 nt, Human
acugcuuacaaaaggaaagaau

SEQ ID NO: 1114527 - RNA, 22 nt, Human
ccuggcaggcuggggacagugc

SEQ ID NO: 1114528 - RNA, 23 nt, Human
ucacagggcacuggcugggguug

SEQ ID NO: 1114529 - RNA, 22 nt, Human
aagccuuccugagugcaaggcc

SEQ ID NO: 1114530 - RNA, 22 nt, Human
uugucuuaaauggauggacaau

SEQ ID NO: 1114531 - RNA, 22 nt, Human
auaugcacacucugcccacaga

SEQ ID NO: 1114532 - RNA, 22 nt, Human
aagggcugaaagaccuugggca

SEQ ID NO: 1114533 - RNA, 22 nt, Human
cagagguagaaggcaugcagug

SEQ ID NO: 1114534 - RNA, 22 nt, Human
ccaggccuuucuucuuggucug

SEQ ID NO: 1114535 - RNA, 22 nt, Human
caggcccugggcaggaucagcc

SEQ ID NO: 1114536 - RNA, 22 nt, Human
cagcugccacaggacuuucuga

SEQ ID NO: 1114537 - RNA, 22 nt, Human
aaaucaguucucccuuucuuca

SEQ ID NO: 1114538 - RNA, 22 nt, Human
ugcagcuguaacagaggccuca

SEQ ID NO: 1114539 - RNA, 22 nt, Human
gucagugucuuaacagagauua

SEQ ID NO: 1114540 - RNA, 22 nt, Human
aucagcaagcaugguuaggugu

SEQ ID NO: 1114541 - RNA, 22 nt, Human
uccugccuaccuugcggaggug

SEQ ID NO: 1114542 - RNA, 22 nt, Human
ugcacacaguucucaggaaaga

SEQ ID NO: 1114543 - RNA, 22 nt, Human
cagguccccuccccuaccaggc

SEQ ID NO: 1114544 - RNA, 22 nt, Human
augucuuuauaaauguauaaug

SEQ ID NO: 1114545 - RNA, 22 nt, Human
ggaggccacgguuuagcaccga

SEQ ID NO: 1114546 - RNA, 22 nt, Human
uaaguucaaugaacucaguucu

SEQ ID NO: 1114547 - RNA, 22 nt, Human
ucugguaaccuuuaucccuccu

SEQ ID NO: 1114548 - RNA, 22 nt, Human
ugcccaaguguuuggcugaguc

SEQ ID NO: 1114549 - RNA, 22 nt, Human
ggcccaucucuugcucuggguu

SEQ ID NO: 1114550 - RNA, 22 nt, Human
cacugcuuucacaguuuguucc

SEQ ID NO: 1114551 - RNA, 22 nt, Human
uagcugcccaucuuuccuuuag

SEQ ID NO: 1114552 - RNA, 22 nt, Human
cauugcacuucugcuuuuccuc

SEQ ID NO: 1114553 - RNA, 22 nt, Human
ucuguggcacgauugcacugca

SEQ ID NO: 1114554 - RNA, 22 nt, Human
ugcagaagcugcaggucagugg

SEQ ID NO: 1114555 - RNA, 21 nt, Human
uuacuuuugcagcaaccuaau

SEQ ID NO: 1114556 - RNA, 22 nt, Human
ugucuagggagcugcucaggcu

SEQ ID NO: 1114557 - RNA, 22 nt, Human
agugcuguccaguuucacaggu

SEQ ID NO: 1114558 - RNA, 22 nt, Human
uugugaaauguuucaaaauagu

SEQ ID NO: 1114559 - RNA, 22 nt, Human
cuggugggagcagcaggcagcu

SEQ ID NO: 1114560 - RNA, 22 nt, Human
ugcagagguguugcugagauaa

SEQ ID NO: 1114561 - RNA, 22 nt, Human
aucuggcuauugacauguuaua

SEQ ID NO: 1114562 - RNA, 22 nt, Human
acagcagcuaaaggugucuccu

SEQ ID NO: 1114563 - RNA, 22 nt, Human
ggagaaggaagaaagcuacuau

SEQ ID NO: 1114564 - RNA, 22 nt, Human
ucagggcauguauguuucuuua

SEQ ID NO: 1114565 - RNA, 22 nt, Human
auuguaaguagaaauguuaugg

SEQ ID NO: 1114566 - RNA, 22 nt, Human
ucagagaacacagaggugaugu

SEQ ID NO: 1114567 - RNA, 22 nt, Human
ugcugccucagcuuccugggcu

SEQ ID NO: 1114568 - RNA, 22 nt, Human
ggcuggagauaugucuggaaca

SEQ ID NO: 1114569 - RNA, 16 nt, Human
ccaccugcagcucuca

SEQ ID NO: 1114570 - RNA, 21 nt, Human
agccuggcccagggggaggcu

SEQ ID NO: 1114571 - RNA, 21 nt, Human
ccugggccaaauucccuggac

SEQ ID NO: 1114572 - RNA, 22 nt, Human
cucagggucugguccuuagauu

SEQ ID NO: 1114573 - RNA, 22 nt, Human
uacauucuggaaaggcacagac

SEQ ID NO: 1114574 - RNA, 20 nt, Human
ccacaggaguccagucgacc

SEQ ID NO: 1114575 - RNA, 22 nt, Human
ucuccucugcgcggcagugccc

SEQ ID NO: 1114576 - RNA, 22 nt, Human
ccugccagcauggcuuaucucc

SEQ ID NO: 1114577 - RNA, 22 nt, Human
ugcugccaaaugcgagcucugu

SEQ ID NO: 1114578 - RNA, 22 nt, Human
caugaagcacagcucucuuuuu

SEQ ID NO: 1114579 - RNA, 22 nt, Human
ggagagagaugccgccuugcuc

SEQ ID NO: 1114580 - RNA, 22 nt, Human
uggcucaggggucuggcucugu

SEQ ID NO: 1114581 - RNA, 18 nt, Human
aagccagagaccacugcc

SEQ ID NO: 1114582 - RNA, 22 nt, Human
gcagagcucaagguguucagcu

SEQ ID NO: 1114583 - RNA, 22 nt, Human
gcucccagcaauugaggcagcc

SEQ ID NO: 1114584 - RNA, 22 nt, Human
ucauugcaccccagucccagcu

SEQ ID NO: 1114585 - RNA, 17 nt, Human
cucugcagugcauggcu

SEQ ID NO: 1114586 - RNA, 22 nt, Human
ugauuucauaguauauacauga

SEQ ID NO: 1114587 - RNA, 22 nt, Human
gucagcugucuccccagagugg

SEQ ID NO: 1114588 - RNA, 22 nt, Human
aaguaugacauuuaagacaauu

SEQ ID NO: 1114589 - RNA, 22 nt, Human
agguagagcuccaguagaaaau

SEQ ID NO: 1114590 - RNA, 22 nt, Human
cagcucuguaaauuccuucauc

SEQ ID NO: 1114591 - RNA, 22 nt, Human
uugaggaguguuuagggugagg

SEQ ID NO: 1114592 - RNA, 22 nt, Human
gacccuguuucuacaaauaauu

SEQ ID NO: 1114593 - RNA, 22 nt, Human
agggcagaccacgugcaaggau

SEQ ID NO: 1114594 - RNA, 22 nt, Human
cagcccagcagggucuggcccu

SEQ ID NO: 1114595 - RNA, 22 nt, Human
uuuauguaguuacggacuauca

SEQ ID NO: 1114596 - RNA, 22 nt, Human
gccagagcacaggcugguagua

SEQ ID NO: 1114597 - RNA, 22 nt, Human
agccagaggccagccugccuca

SEQ ID NO: 1114598 - RNA, 22 nt, Human
gauuucaauccagcuuucuucu

SEQ ID NO: 1114599 - RNA, 22 nt, Human
ucagggacuuacaaaccagaag

SEQ ID NO: 1114600 - RNA, 21 nt, Human
uucagcaguccucuagagaua

SEQ ID NO: 1114601 - RNA, 17 nt, Human
gcugcagcgguaggcag

SEQ ID NO: 1114602 - RNA, 22 nt, Human
acagagcuucccagccugagca

SEQ ID NO: 1114603 - RNA, 22 nt, Human
ccugccugucccucaguccaca

SEQ ID NO: 1114604 - RNA, 22 nt, Human
agugacugacaccuguaauccc

SEQ ID NO: 1114605 - RNA, 22 nt, Human
gcucugugccacaugcaguguu

SEQ ID NO: 1114606 - RNA, 20 nt, Human
ggggcccaagcccucuugcc

SEQ ID NO: 1114607 - RNA, 17 nt, Human
cacaggugugguuugag

SEQ ID NO: 1114608 - RNA, 22 nt, Human
uggucaguugcaucagagaagu

SEQ ID NO: 1114609 - RNA, 22 nt, Human
agugccaggagcaaggagcucc

SEQ ID NO: 1114610 - RNA, 22 nt, Human
ugugccugaguuggcugaguac

SEQ ID NO: 1114611 - RNA, 22 nt, Human
ggcucugcccagguggacagca

SEQ ID NO: 1114612 - RNA, 22 nt, Human
cugggccuagaggaagcugaca

SEQ ID NO: 1114613 - RNA, 22 nt, Human
cagagggcucuuggcugccugc

SEQ ID NO: 1114614 - RNA, 22 nt, Human
acuuugcagagccagaagagaa

SEQ ID NO: 1114615 - RNA, 22 nt, Human
ugggagagugcucaaugugcaa

SEQ ID NO: 1114616 - RNA, 22 nt, Human
uagcugccauugcuccaggaag

SEQ ID NO: 1114617 - RNA, 22 nt, Human
gccugccugcugugugcaaguu

SEQ ID NO: 1114618 - RNA, 22 nt, Human
aagaaauauugggccuuauaaa

SEQ ID NO: 1114619 - RNA, 22 nt, Human
agccucuguagaaagcagugug

SEQ ID NO: 1114620 - RNA, 22 nt, Human
uggcucugaucagauguccagu

SEQ ID NO: 1114621 - RNA, 22 nt, Human
cagugguggaaugaggaauugu

SEQ ID NO: 1114622 - RNA, 22 nt, Human
uccagucauuuccauuguuccc

SEQ ID NO: 1114623 - RNA, 22 nt, Human
ccuuucucuggcagcaggacag

SEQ ID NO: 1114624 - RNA, 22 nt, Human
ugggcugccggcaggcucugcc

SEQ ID NO: 1114625 - RNA, 22 nt, Human
caggccugaguguggaagucuu

SEQ ID NO: 1114626 - RNA, 23 nt, Human
ugagcugguauuguccaucucca

SEQ ID NO: 1114627 - RNA, 22 nt, Human
gcugucaggccaugugggccuu

SEQ ID NO: 1114628 - RNA, 22 nt, Human
agcagcucuggcacuguagcau

SEQ ID NO: 1114629 - RNA, 22 nt, Human
gcugcuuccuuuccugcugacc

SEQ ID NO: 1114630 - RNA, 20 nt, Human
aggagcugaauuagaggguu

SEQ ID NO: 1114631 - RNA, 22 nt, Human
ucuucagauugcacugagcaag

SEQ ID NO: 1114632 - RNA, 22 nt, Human
ggcuucagugacuggugcccuc

SEQ ID NO: 1114633 - RNA, 22 nt, Human
ucauggagacuuugagccuguu

SEQ ID NO: 1114634 - RNA, 22 nt, Human
uggcucagccuggcccuuucau

SEQ ID NO: 1114635 - RNA, 23 nt, Human
uggcagcuguguaagagaaagca

SEQ ID NO: 1114636 - RNA, 22 nt, Human
agaaaucucaguaucucaggga

SEQ ID NO: 1114637 - RNA, 22 nt, Human
cacagggcagugauuguccaca

SEQ ID NO: 1114638 - RNA, 22 nt, Human
agccaagcacucaacuccugga

SEQ ID NO: 1114639 - RNA, 22 nt, Human
aguaaacauaauuuaccuguag

SEQ ID NO: 1114640 - RNA, 22 nt, Human
cagcuggaugggagaccauguu

SEQ ID NO: 1114641 - RNA, 22 nt, Human
ggaaagagcccagcagugcuug

SEQ ID NO: 1114642 - RNA, 22 nt, Human
ugcuggcccaugaagacgcagu

SEQ ID NO: 1114643 - RNA, 22 nt, Human
uugacagcaaagauugugccua

SEQ ID NO: 1114644 - RNA, 22 nt, Human
gugucaugcacacucaguguug

SEQ ID NO: 1114645 - RNA, 22 nt, Human
ucagcaguuuuauaugcagcuu

SEQ ID NO: 1114646 - RNA, 23 nt, Human
agaauuguaaauagaauauaccu

SEQ ID NO: 1114647 - RNA, 22 nt, Human
ucagggcaaagggcagaguuug

SEQ ID NO: 1114648 - RNA, 22 nt, Human
ucagccuggcaggauggccugg

SEQ ID NO: 1114649 - RNA, 22 nt, Human
uggcuggcaaggcuggagucag

SEQ ID NO: 1114650 - RNA, 22 nt, Human
uagacagauuuaaaggaaugga

SEQ ID NO: 1114651 - RNA, 22 nt, Human
gagagucacugucugcauuucc

SEQ ID NO: 1114652 - RNA, 22 nt, Human
cccauuuaaacacaagcuuuca

SEQ ID NO: 1114653 - RNA, 22 nt, Human
agcuuccugaugcaagagggcu

SEQ ID NO: 1114654 - RNA, 22 nt, Human
gagaccaggaaguacagcagcc

SEQ ID NO: 1114655 - RNA, 18 nt, Human
ggaaaaggagugucuagc

SEQ ID NO: 1114656 - RNA, 22 nt, Human
gacaucauagggugggaggaaa

SEQ ID NO: 1114657 - RNA, 20 nt, Human
uacauucaaaacaaacucug

SEQ ID NO: 1114658 - RNA, 22 nt, Human
cugccuuggaaaaugugguaau

SEQ ID NO: 1114659 - RNA, 22 nt, Human
cuggcagcucugagucccuucu

SEQ ID NO: 1114660 - RNA, 22 nt, Human
ccugggcuucugucuagauguu

SEQ ID NO: 1114661 - RNA, 22 nt, Human
gcauguguggaggagaugugcu

SEQ ID NO: 1114662 - RNA, 22 nt, Human
cuggggggagcugcguccagca

SEQ ID NO: 1114663 - RNA, 22 nt, Human
agcccaagcuaugaggugaccu

SEQ ID NO: 1114664 - RNA, 22 nt, Human
gaggugaguggaucacgagguc

SEQ ID NO: 1114665 - RNA, 22 nt, Human
cacagcuuaugccacugauugg

SEQ ID NO: 1114666 - RNA, 22 nt, Human
ugcugccacauuuaaagagggg

SEQ ID NO: 1114667 - RNA, 22 nt, Human
uacaguaucuucuggcaagcau

SEQ ID NO: 1114668 - RNA, 22 nt, Human
gaagcagcuuucuggugaggag

SEQ ID NO: 1114669 - RNA, 22 nt, Human
ucugccagaaguucugagagua

SEQ ID NO: 1114670 - RNA, 22 nt, Human
caggagacaauggcuguggggc

SEQ ID NO: 1114671 - RNA, 22 nt, Human
uccuucaguuaucacaguacug

SEQ ID NO: 1114672 - RNA, 22 nt, Human
ucaggaucggccuuuuuuuaag

SEQ ID NO: 1114673 - RNA, 22 nt, Human
gguggguuuggaagagcaggcu

SEQ ID NO: 1114674 - RNA, 22 nt, Human
agcaauauuucagcuagcaggu

SEQ ID NO: 1114675 - RNA, 22 nt, Human
ugggcuggcccaccacaccucg

SEQ ID NO: 1114676 - RNA, 22 nt, Human
aaaagacauaugugggcauucu

SEQ ID NO: 1114677 - RNA, 22 nt, Human
cuuccucacggugcaacaggaa

SEQ ID NO: 1114678 - RNA, 22 nt, Human
uucaagauggcaccagugagug

SEQ ID NO: 1114679 - RNA, 22 nt, Human
ggcaggugcucugugggccugg

SEQ ID NO: 1114680 - RNA, 22 nt, Human
ggguccagcuacaucagggugg

SEQ ID NO: 1114681 - RNA, 20 nt, Human
cagagacccaggcuucagcu

SEQ ID NO: 1114682 - RNA, 22 nt, Human
agcugagcugcagaugacugua

SEQ ID NO: 1114683 - RNA, 22 nt, Human
agggccugggauguccuccuag

SEQ ID NO: 1114684 - RNA, 22 nt, Human
ccagcuggagcucgcagauagg

SEQ ID NO: 1114685 - RNA, 22 nt, Human
gcugcucugugacagccuccgg

SEQ ID NO: 1114686 - RNA, 22 nt, Human
accuuuuuucagaacucuaaag

SEQ ID NO: 1114687 - RNA, 22 nt, Human
ugccuggguccaggccaagccu

SEQ ID NO: 1114688 - RNA, 22 nt, Human
gcucccagggcagcgcagaaga

SEQ ID NO: 1114689 - RNA, 22 nt, Human
gccucugcaucaucacuccagc

SEQ ID NO: 1114690 - RNA, 22 nt, Human
agaagccagcuucagcugcccg

SEQ ID NO: 1114691 - RNA, 22 nt, Human
uuuuccucugagcuuugaauaa

SEQ ID NO: 1114692 - RNA, 22 nt, Human
cauuauguucaguagcuuaaaa

SEQ ID NO: 1114693 - RNA, 22 nt, Human
gcccagaaguugaggcugcagu

SEQ ID NO: 1114694 - RNA, 22 nt, Human
agcagaugagccucaugacugg

SEQ ID NO: 1114695 - RNA, 22 nt, Human
uauauuaacacccacuugccuc

SEQ ID NO: 1114696 - RNA, 22 nt, Human
guggccuggaguuugauguagg

SEQ ID NO: 1114697 - RNA, 22 nt, Human
ccagcuggugggucuuucucug

SEQ ID NO: 1114698 - RNA, 22 nt, Human
ccauuugucaccucugcacucc

SEQ ID NO: 1114699 - RNA, 22 nt, Human
uggggcuggcuauugucucccu

SEQ ID NO: 1114700 - RNA, 18 nt, Human
ccgggcuuuggugacaca

SEQ ID NO: 1114701 - RNA, 22 nt, Human
gcagcagaugcuuucauggaca

SEQ ID NO: 1114702 - RNA, 22 nt, Human
accaaggagacaaagguguauu

SEQ ID NO: 1114703 - RNA, 22 nt, Human
gugaggugguacaauauuaacu

SEQ ID NO: 1114704 - RNA, 22 nt, Human
gaagcagccacggggagacaga

SEQ ID NO: 1114705 - RNA, 22 nt, Human
agcagccacagucugggacagg

SEQ ID NO: 1114706 - RNA, 18 nt, Human
caggaugagugaugggga

SEQ ID NO: 1114707 - RNA, 20 nt, Human
ugagugauggaggcggguca

SEQ ID NO: 1114708 - RNA, 22 nt, Human
ggcucaggaugagccuucucau

SEQ ID NO: 1114709 - RNA, 22 nt, Human
ugauuuccaguugcugggugcu

SEQ ID NO: 1114710 - RNA, 22 nt, Human
gcagagugauggaaugugggug

SEQ ID NO: 1114711 - RNA, 22 nt, Human
auaauuaauuucaguaaucucc

SEQ ID NO: 1114712 - RNA, 20 nt, Human
ggcugccuccuuccuuuccu

SEQ ID NO: 1114713 - RNA, 22 nt, Human
ugugccagaaaauaugcugagg

SEQ ID NO: 1114714 - RNA, 22 nt, Human
uuaaaaugcagauucugauuca

SEQ ID NO: 1114715 - RNA, 22 nt, Human
gaaaugugggucaugacccauu

SEQ ID NO: 1114716 - RNA, 21 nt, Human
uaaaugugagcagggcugggc

SEQ ID NO: 1114717 - RNA, 22 nt, Human
uugaagcauuucuuugagcuuc

SEQ ID NO: 1114718 - RNA, 22 nt, Human
gcaggcagagguggaggagaca

SEQ ID NO: 1114719 - RNA, 20 nt, Human
cagaaggucuaagcuuuaga

SEQ ID NO: 1114720 - RNA, 22 nt, Human
gcagcugaagcugcaguuccag

SEQ ID NO: 1114721 - RNA, 22 nt, Human
ccucaggcuuacgggcaaugga

SEQ ID NO: 1114722 - RNA, 22 nt, Human
uuagugucuucuucauccucug

SEQ ID NO: 1114723 - RNA, 22 nt, Human
agcugccacugagggugcacag

SEQ ID NO: 1114724 - RNA, 22 nt, Human
gcugccuucaguucugauucau

SEQ ID NO: 1114725 - RNA, 20 nt, Human
gucucagaauggauuugcau

SEQ ID NO: 1114726 - RNA, 22 nt, Human
gaagaagcaggaguguguagca

SEQ ID NO: 1114727 - RNA, 22 nt, Human
gagguacaugaggauacacagg

SEQ ID NO: 1114728 - RNA, 22 nt, Human
cauggccuugagugacugcacu

SEQ ID NO: 1114729 - RNA, 22 nt, Human
ugcagcucauugguguccuggu

SEQ ID NO: 1114730 - RNA, 22 nt, Human
agagccugaggaugucccagcu

SEQ ID NO: 1114731 - RNA, 22 nt, Human
agagcagagggcucugggacaa

SEQ ID NO: 1114732 - RNA, 22 nt, Human
gagcaggccagcaauggaaggg

SEQ ID NO: 1114733 - RNA, 22 nt, Human
aggagaaagacuggacagccaa

SEQ ID NO: 1114734 - RNA, 18 nt, Human
cucucugggugaggacaa

SEQ ID NO: 1114735 - RNA, 22 nt, Human
gcagggcuaauggggcaaguag

SEQ ID NO: 1114736 - RNA, 22 nt, Human
ggcugcagauagccagccacca

SEQ ID NO: 1114737 - RNA, 18 nt, Human
ggagagugagaucaaaca

SEQ ID NO: 1114738 - RNA, 22 nt, Human
acuguacacgugucauuuacag

SEQ ID NO: 1114739 - RNA, 20 nt, Human
gcaggcagggaaugggggug

SEQ ID NO: 1114740 - RNA, 22 nt, Human
uccugggccuguacuccauccg

SEQ ID NO: 1114741 - RNA, 22 nt, Human
caggaaggcccaccuguccugu

SEQ ID NO: 1114742 - RNA, 22 nt, Human
accucaggauguggacacagaa

SEQ ID NO: 1114743 - RNA, 21 nt, Human
ggcagccugacccccagagag

SEQ ID NO: 1114744 - RNA, 22 nt, Human
cccuggaggcggagcuugcagu

SEQ ID NO: 1114745 - RNA, 22 nt, Human
caggugggagcggagacugauu

SEQ ID NO: 1114746 - RNA, 22 nt, Human
uccagagccuauauguucaacu

SEQ ID NO: 1114747 - RNA, 22 nt, Human
acugggccggugcagaguaguu

SEQ ID NO: 1114748 - RNA, 22 nt, Human
ugcuccuuccucauccugugca

SEQ ID NO: 1114749 - RNA, 22 nt, Human
acagaauugaaaguauaaucug

SEQ ID NO: 1114750 - RNA, 22 nt, Human
cuggcucaauaaauauuagcug

SEQ ID NO: 1114751 - RNA, 22 nt, Human
ugagccuguccugugcauguga

SEQ ID NO: 1114752 - RNA, 22 nt, Human
cauugcacgggcgucugucugu

SEQ ID NO: 1114753 - RNA, 22 nt, Human
cucacugucuguacuagcugau

SEQ ID NO: 1114754 - RNA, 22 nt, Human
uaaagguaguuuuaaaggugcu

SEQ ID NO: 1114755 - RNA, 22 nt, Human
guggccuggcgagcuggcgcgg

SEQ ID NO: 1114756 - RNA, 21 nt, Human
acagcagggcuggcaugacag

SEQ ID NO: 1114757 - RNA, 22 nt, Human
gggaguggguuuggccuaggcc

SEQ ID NO: 1114758 - RNA, 22 nt, Human
ggcagagcuugcagugagccga

SEQ ID NO: 1114759 - RNA, 22 nt, Human
ccuggagauuauuugguccaau

SEQ ID NO: 1114760 - RNA, 22 nt, Human
augggaggguggaaaggcucug

SEQ ID NO: 1114761 - RNA, 22 nt, Human
ugaggcuguucuaccagggcca

SEQ ID NO: 1114762 - RNA, 22 nt, Human
gcugucugcaucucuagagcuu

SEQ ID NO: 1114763 - RNA, 22 nt, Human
uucuuucccagaagauauguuu

SEQ ID NO: 1114764 - RNA, 22 nt, Human
auagaaaacagauguccuuaaa

SEQ ID NO: 1114765 - RNA, 22 nt, Human
cucagggcaguauggcugagag

SEQ ID NO: 1114766 - RNA, 20 nt, Human
uguugauuggugucaucuca

SEQ ID NO: 1114767 - RNA, 22 nt, Human
agcgggugcugugucagcccuc

SEQ ID NO: 1114768 - RNA, 22 nt, Human
ucucagagggaaacaugaguga

SEQ ID NO: 1114769 - RNA, 22 nt, Human
uacccaggagaaacagcagggc

SEQ ID NO: 1114770 - RNA, 22 nt, Human
cagagccugccaccuuucuccc

SEQ ID NO: 1114771 - RNA, 22 nt, Human
agcugucagugcugugccugua

SEQ ID NO: 1114772 - RNA, 22 nt, Human
ggcuucccaaggagccaggaug

SEQ ID NO: 1114773 - RNA, 22 nt, Human
acuuguguaacacagaaagaac

SEQ ID NO: 1114774 - RNA, 22 nt, Human
cugccucucaggucccugagau

SEQ ID NO: 1114775 - RNA, 19 nt, Human
gagcccucuccauggccac

SEQ ID NO: 1114776 - RNA, 22 nt, Human
ucaguuuuaagguuugagaauu

SEQ ID NO: 1114777 - RNA, 22 nt, Human
acuuccuggcugggugaccugg

SEQ ID NO: 1114778 - RNA, 22 nt, Human
cugagccaaggggacagugaca

SEQ ID NO: 1114779 - RNA, 22 nt, Human
ccaggagucuggaugagguguc

SEQ ID NO: 1114780 - RNA, 22 nt, Human
ucucagagggaggauuacugcc

SEQ ID NO: 1114781 - RNA, 20 nt, Human
gccugcagagaaggucagag

SEQ ID NO: 1114782 - RNA, 22 nt, Human
gugcccugguccccagcauaua

SEQ ID NO: 1114783 - RNA, 22 nt, Human
cuuccuggccauugccauggca

SEQ ID NO: 1114784 - RNA, 20 nt, Human
aggcucagagcaguaguaca

SEQ ID NO: 1114785 - RNA, 22 nt, Human
cacagcuuguuuagugacucac

SEQ ID NO: 1114786 - RNA, 22 nt, Human
ucaaggcuaaacuuucagagua

SEQ ID NO: 1114787 - RNA, 23 nt, Human
ccaggcaguagcuauugaaguga

SEQ ID NO: 1114788 - RNA, 22 nt, Human
ggcagcucugaugaugcucugg

SEQ ID NO: 1114789 - RNA, 22 nt, Human
uagugcacacgcauguagcagu

SEQ ID NO: 1114790 - RNA, 22 nt, Human
ugcauauuuguaugauguuuag

SEQ ID NO: 1114791 - RNA, 22 nt, Human
guguuuccaguucagaaagcaa

SEQ ID NO: 1114792 - RNA, 18 nt, Human
aggccugggaagcugagg

SEQ ID NO: 1114793 - RNA, 22 nt, Human
gaaaaaugagcugaugucaggg

SEQ ID NO: 1114794 - RNA, 22 nt, Human
uccagcagaaaagagguaggga

SEQ ID NO: 1114795 - RNA, 22 nt, Human
ccuggagcuuuuccauccugga

SEQ ID NO: 1114796 - RNA, 22 nt, Human
aauaugugagguauguucagug

SEQ ID NO: 1114797 - RNA, 22 nt, Human
uggggccuggucagagcugcac

SEQ ID NO: 1114798 - RNA, 22 nt, Human
ccaaagagcuagaauuauaggc

SEQ ID NO: 1114799 - RNA, 22 nt, Human
gcuggccauggggagugaggag

SEQ ID NO: 1114800 - RNA, 22 nt, Human
gcugucuucacuuccugguuuc

SEQ ID NO: 1114801 - RNA, 22 nt, Human
agggcagcacaaggcauggacu

SEQ ID NO: 1114802 - RNA, 17 nt, Human
aggaaacauuuucuuuc

SEQ ID NO: 1114803 - RNA, 22 nt, Human
ucagaacauuuaaaaagugguu

SEQ ID NO: 1114804 - RNA, 22 nt, Human
cucugcagaggcccaaggcuga

SEQ ID NO: 1114805 - RNA, 22 nt, Human
accucugcucaagaccccuccg

SEQ ID NO: 1114806 - RNA, 22 nt, Human
gcugagcugaggcagggcuggg

SEQ ID NO: 1114807 - RNA, 22 nt, Human
ggcagggagagcaugcugauaa

SEQ ID NO: 1114808 - RNA, 22 nt, Human
uagccaggcgaggucagugucg

SEQ ID NO: 1114809 - RNA, 22 nt, Human
ccaggacuuuaaguccagcacu

SEQ ID NO: 1114810 - RNA, 22 nt, Human
gcacccaggccggcgacugcag

SEQ ID NO: 1114811 - RNA, 22 nt, Human
ggccugcuauuggugggcagac

SEQ ID NO: 1114812 - RNA, 22 nt, Human
aauaauuuugagagccuggaaa

SEQ ID NO: 1114813 - RNA, 22 nt, Human
uccagccaugcaugacaaucac

SEQ ID NO: 1114814 - RNA, 22 nt, Human
aggcacugaagaacucuuuuug

SEQ ID NO: 1114815 - RNA, 19 nt, Human
agcaaauauaauaguguuc

SEQ ID NO: 1114816 - RNA, 23 nt, Human
uuugcaaauuggacacaaccaca

SEQ ID NO: 1114817 - RNA, 22 nt, Human
uagcugccaaaagggugggcua

SEQ ID NO: 1114818 - RNA, 22 nt, Human
cuugcaggauuuugcugcugua

SEQ ID NO: 1114819 - RNA, 19 nt, Human
gccugagccagccaugcaa

SEQ ID NO: 1114820 - RNA, 22 nt, Human
caguguacuuggaauguaacag

SEQ ID NO: 1114821 - RNA, 22 nt, Human
gcaggggaguggaugauggauu

SEQ ID NO: 1114822 - RNA, 22 nt, Human
uacauauacugagugauuugcu

SEQ ID NO: 1114823 - RNA, 22 nt, Human
gagcccagguucugcuuccagc

SEQ ID NO: 1114824 - RNA, 22 nt, Human
aggcccuggguuagggcccacu

SEQ ID NO: 1114825 - RNA, 22 nt, Human
ucugucacucuagagauggcag

SEQ ID NO: 1114826 - RNA, 22 nt, Human
cugcccagaaucacucacucga

SEQ ID NO: 1114827 - RNA, 22 nt, Human
augcaguaaauguuaagaaaaa

SEQ ID NO: 1114828 - RNA, 22 nt, Human
gcccuuccuuagacagcaggau

SEQ ID NO: 1114829 - RNA, 22 nt, Human
ucacaugcuacugagccagacc

SEQ ID NO: 1114830 - RNA, 22 nt, Human
ccuggagcgcgggucaagcugg

SEQ ID NO: 1114831 - RNA, 22 nt, Human
ggcaaaaaccacaauuacuuuu

SEQ ID NO: 1114832 - RNA, 22 nt, Human
cugggcagaauuuuaggauggc

SEQ ID NO: 1114833 - RNA, 22 nt, Human
aaguguguugacugaauugggg

SEQ ID NO: 1114834 - RNA, 22 nt, Human
gacagaguuguugauguaugcu

SEQ ID NO: 1114835 - RNA, 22 nt, Human
acugaaggaaacuuuuguguuu

SEQ ID NO: 1114836 - RNA, 22 nt, Human
accccaagacaguagaagagaa

SEQ ID NO: 1114837 - RNA, 22 nt, Human
uacaaagucaccagcuucuugc

SEQ ID NO: 1114838 - RNA, 22 nt, Human
gcccacagcucguuccucuccu

SEQ ID NO: 1114839 - RNA, 20 nt, Human
agccagaagaaggcuggaga

SEQ ID NO: 1114840 - RNA, 22 nt, Human
gcacagguugcaaaaguucaca

SEQ ID NO: 1114841 - RNA, 19 nt, Human
cugcugggugcugagggag

SEQ ID NO: 1114842 - RNA, 18 nt, Human
cucugcuaaugggcagcu

SEQ ID NO: 1114843 - RNA, 20 nt, Human
gcagagccucacugcaaggg

SEQ ID NO: 1114844 - RNA, 18 nt, Human
cggcagagugcuucuagc

SEQ ID NO: 1114845 - RNA, 22 nt, Human
gcagccugaugaucuggguugu

SEQ ID NO: 1114846 - RNA, 22 nt, Human
guuuuguugcugcagagcucaa

SEQ ID NO: 1114847 - RNA, 22 nt, Human
gcugccaugccacagcacucac

SEQ ID NO: 1114848 - RNA, 22 nt, Human
uccugagggcgauucagcaggu

SEQ ID NO: 1114849 - RNA, 22 nt, Human
uugcauugaucccagcuugggc

SEQ ID NO: 1114850 - RNA, 22 nt, Human
caguacuuaguucucaugguuu

SEQ ID NO: 1114851 - RNA, 22 nt, Human
ugcagcuguuacggacccuguc

SEQ ID NO: 1114852 - RNA, 22 nt, Human
guuauguaugagggaaugauua

SEQ ID NO: 1114853 - RNA, 22 nt, Human
aggacugggugcagagggcauc

SEQ ID NO: 1114854 - RNA, 22 nt, Human
cagagccaggguugcaccccug

SEQ ID NO: 1114855 - RNA, 22 nt, Human
gccccagccaaggugacacgaa

SEQ ID NO: 1114856 - RNA, 22 nt, Human
augaacacauguacacauuucu

SEQ ID NO: 1114857 - RNA, 18 nt, Human
acagacaaaauggaaaug

SEQ ID NO: 1114858 - RNA, 22 nt, Human
ugugcuucugcagagacuauuu

SEQ ID NO: 1114859 - RNA, 21 nt, Human
agucccaggggugagugaugu

SEQ ID NO: 1114860 - RNA, 23 nt, Human
gugugccaagcacugugccagga

SEQ ID NO: 1114861 - RNA, 22 nt, Human
caagcccaggauuccccaguua

SEQ ID NO: 1114862 - RNA, 22 nt, Human
agagcccugaagcagagcuaaa

SEQ ID NO: 1114863 - RNA, 22 nt, Human
gagccagccgcaagagcuguga

SEQ ID NO: 1114864 - RNA, 22 nt, Human
cuguggugagcaacugacugaa

SEQ ID NO: 1114865 - RNA, 22 nt, Human
ucugucucaaguucuugcacuc

SEQ ID NO: 1114866 - RNA, 22 nt, Human
caggagugagaugcgaucacuu

SEQ ID NO: 1114867 - RNA, 22 nt, Human
ugaaccaggaggcagccagcac

SEQ ID NO: 1114868 - RNA, 22 nt, Human
cuggccgguauuugccucuggg

SEQ ID NO: 1114869 - RNA, 21 nt, Human
gcaggaugcaucuuggugucu

SEQ ID NO: 1114870 - RNA, 22 nt, Human
gccaggcauucuagaaguagug

SEQ ID NO: 1114871 - RNA, 22 nt, Human
aagagagaacucccuucgccag

SEQ ID NO: 1114872 - RNA, 22 nt, Human
ugaggcucaaggucugguggag

SEQ ID NO: 1114873 - RNA, 22 nt, Human
agcagcucaaagccugcaagga

SEQ ID NO: 1114874 - RNA, 22 nt, Human
cagcccagcagucuuagccugc

SEQ ID NO: 1114875 - RNA, 22 nt, Human
uuaaacagagucugaaauguaa

SEQ ID NO: 1114876 - RNA, 22 nt, Human
agcagccaagguaaccugugcu

SEQ ID NO: 1114877 - RNA, 22 nt, Human
gugccucagcaccgccugcagc

SEQ ID NO: 1114878 - RNA, 22 nt, Human
agauuuccugcacugccuuuga

SEQ ID NO: 1114879 - RNA, 18 nt, Human
aguaguggguuuagcuuc

SEQ ID NO: 1114880 - RNA, 20 nt, Human
accauaauguuaauuacaaa

SEQ ID NO: 1114881 - RNA, 22 nt, Human
ugaagcugugggcaguggagcc

SEQ ID NO: 1114882 - RNA, 22 nt, Human
cagcugccuguauuguccucau

SEQ ID NO: 1114883 - RNA, 22 nt, Human
uuccucucucuugccagaaugu

SEQ ID NO: 1114884 - RNA, 22 nt, Human
uccugggcuguggccccgggca

SEQ ID NO: 1114885 - RNA, 22 nt, Human
cagcuggaucccugcagaacuu

SEQ ID NO: 1114886 - RNA, 22 nt, Human
ucacuggggccuuuggucagga

SEQ ID NO: 1114887 - RNA, 20 nt, Human
cugcugugugugccucagcc

SEQ ID NO: 1114888 - RNA, 22 nt, Human
caguagcaggcaggugcuuuug

SEQ ID NO: 1114889 - RNA, 22 nt, Human
ugucccagacacaguaugcgcu

SEQ ID NO: 1114890 - RNA, 22 nt, Human
ugagcuggucacuccuucugaa

SEQ ID NO: 1114891 - RNA, 23 nt, Human
agucucagcuggaaacauguguc

SEQ ID NO: 1114892 - RNA, 22 nt, Human
gggagguucuguucgcacuuga

SEQ ID NO: 1114893 - RNA, 22 nt, Human
cagagcugcagauugaaggcau

SEQ ID NO: 1114894 - RNA, 22 nt, Human
ucugggcagcagcagcuaguag

SEQ ID NO: 1114895 - RNA, 22 nt, Human
gcacagggagcaggucucuggu

SEQ ID NO: 1114896 - RNA, 23 nt, Human
uaagaacagacaagcauuuacau

SEQ ID NO: 1114897 - RNA, 22 nt, Human
uccugugccuccaccugcuccg

SEQ ID NO: 1114898 - RNA, 22 nt, Human
aggccagguuccucaaucuuga

SEQ ID NO: 1114899 - RNA, 22 nt, Human
ugcuuuuaagaacaaugcugcu

SEQ ID NO: 1114900 - RNA, 18 nt, Human
gcugccugcauuccucac

SEQ ID NO: 1114901 - RNA, 22 nt, Human
cugggagggguagccaauccua

SEQ ID NO: 1114902 - RNA, 22 nt, Human
aagaaugucguugguauuuuaa

SEQ ID NO: 1114903 - RNA, 22 nt, Human
cauaagaaauaaugaugaugac

SEQ ID NO: 1114904 - RNA, 22 nt, Human
ucuguccucuuugaagcugcuc

SEQ ID NO: 1114905 - RNA, 22 nt, Human
ugagaauuacaaaugagucaca

SEQ ID NO: 1114906 - RNA, 17 nt, Human
ugcugccaagucccaac

SEQ ID NO: 1114907 - RNA, 22 nt, Human
cuugaaagcuuugcgucuucua

SEQ ID NO: 1114908 - RNA, 22 nt, Human
uuccauaaugagauucccagcc

SEQ ID NO: 1114909 - RNA, 22 nt, Human
aagcagccaccucaucuccacu

SEQ ID NO: 1114910 - RNA, 22 nt, Human
gcuggucacucugggagcugcu

SEQ ID NO: 1114911 - RNA, 22 nt, Human
ccagcuggaagagugcagaacu

SEQ ID NO: 1114912 - RNA, 22 nt, Human
gcagcuggacccacacggcuua

SEQ ID NO: 1114913 - RNA, 22 nt, Human
agggaguguaaauggugcucag

SEQ ID NO: 1114914 - RNA, 22 nt, Human
ucccagcagggccgaccagccu

SEQ ID NO: 1114915 - RNA, 23 nt, Human
ugggccuggccucccaguccagc

SEQ ID NO: 1114916 - RNA, 22 nt, Human
aaagaauuuguacacccuacua

SEQ ID NO: 1114917 - RNA, 22 nt, Human
uugacaauugggagauauaaag

SEQ ID NO: 1114918 - RNA, 22 nt, Human
cuugggagacacaagaagacau

SEQ ID NO: 1114919 - RNA, 22 nt, Human
aaagauuuaagaauaauuugug

SEQ ID NO: 1114920 - RNA, 22 nt, Human
ugcagggccagacuggguugga

SEQ ID NO: 1114921 - RNA, 21 nt, Human
guggccugauuaugaaugggu

SEQ ID NO: 1114922 - RNA, 21 nt, Human
gcagccacagccaccaagcua

SEQ ID NO: 1114923 - RNA, 22 nt, Human
cccagccuggugcacugugggg

SEQ ID NO: 1114924 - RNA, 22 nt, Human
ucuggauggucagcucuuccug

SEQ ID NO: 1114925 - RNA, 22 nt, Human
cucagagcaaugaacaugcaaa

SEQ ID NO: 1114926 - RNA, 22 nt, Human
aucuagaaguggcaugaauuac

SEQ ID NO: 1114927 - RNA, 22 nt, Human
aggcugcuucagcugcagggag

SEQ ID NO: 1114928 - RNA, 22 nt, Human
uauuucuggcuuugagggugau

SEQ ID NO: 1114929 - RNA, 22 nt, Human
aguaaaaauugaggugcaaaau

SEQ ID NO: 1114930 - RNA, 22 nt, Human
ugcuagaaaucugaaacuagca

SEQ ID NO: 1114931 - RNA, 22 nt, Human
ucuggagcuuccucauuuacag

SEQ ID NO: 1114932 - RNA, 22 nt, Human
caaaugcauagaaagaugaaac

SEQ ID NO: 1114933 - RNA, 18 nt, Human
ugcucuggucucacuugg

SEQ ID NO: 1114934 - RNA, 22 nt, Human
ucccagggcagcuguccagaag

SEQ ID NO: 1114935 - RNA, 22 nt, Human
ugggcagagucauacaggagac

SEQ ID NO: 1114936 - RNA, 22 nt, Human
cccaaggcauggcaugguggca

SEQ ID NO: 1114937 - RNA, 23 nt, Human
uccuccuuuugcuugugcuuccc

SEQ ID NO: 1114938 - RNA, 22 nt, Human
cuggugagacgguugacaggag

SEQ ID NO: 1114939 - RNA, 22 nt, Human
uacauucaacaugucacuaugu

SEQ ID NO: 1114940 - RNA, 22 nt, Human
augaaggauggcuggcugcccu

SEQ ID NO: 1114941 - RNA, 22 nt, Human
cucucuucccgugaguguugca

SEQ ID NO: 1114942 - RNA, 18 nt, Human
uggguggcuagggaguuu

SEQ ID NO: 1114943 - RNA, 22 nt, Human
cuguccuuacugcuucuggcuu

SEQ ID NO: 1114944 - RNA, 22 nt, Human
gcugccaauccagcugugggag

SEQ ID NO: 1114945 - RNA, 22 nt, Human
ccuggcagaauauuaaagugca

SEQ ID NO: 1114946 - RNA, 18 nt, Human
uccugccugcgggcuccc

SEQ ID NO: 1114947 - RNA, 22 nt, Human
uuggcagggccaggcucucucu

SEQ ID NO: 1114948 - RNA, 22 nt, Human
ugcuucaggaagaaacgccagg

SEQ ID NO: 1114949 - RNA, 22 nt, Human
cccaggcagggacgugcucugg

SEQ ID NO: 1114950 - RNA, 22 nt, Human
uuaucguacgcuucagaaauuu

SEQ ID NO: 1114951 - RNA, 22 nt, Human
gcuucccacagcuggacugggg

SEQ ID NO: 1114952 - RNA, 21 nt, Human
gccauuguuuucuaccuggag

SEQ ID NO: 1114953 - RNA, 22 nt, Human
aggcagcagccacaaggccuga

SEQ ID NO: 1114954 - RNA, 22 nt, Human
ggagccaggcaaucuguacuuu

SEQ ID NO: 1114955 - RNA, 22 nt, Human
gcugggaggaucucucccuguc

SEQ ID NO: 1114956 - RNA, 19 nt, Human
uccauaagcuuguguucau

SEQ ID NO: 1114957 - RNA, 22 nt, Human
cacaggcuccggccuugcagcc

SEQ ID NO: 1114958 - RNA, 22 nt, Human
cccagcagaccgcugugauggc

SEQ ID NO: 1114959 - RNA, 22 nt, Human
gagaggucaucucccaucagca

SEQ ID NO: 1114960 - RNA, 22 nt, Human
aaaaaguuucaacugccaacuc

SEQ ID NO: 1114961 - RNA, 21 nt, Human
ugauuuccaucuuaaaauaaa

SEQ ID NO: 1114962 - RNA, 22 nt, Human
cccaagcagggugcagaggcau

SEQ ID NO: 1114963 - RNA, 22 nt, Human
uuaguaaauaaagucuacuuuc

SEQ ID NO: 1114964 - RNA, 22 nt, Human
guggccucuguuggcuccuagg

SEQ ID NO: 1114965 - RNA, 22 nt, Human
cccagccaaggugcugguguug

SEQ ID NO: 1114966 - RNA, 22 nt, Human
agacagcaggggagucugguuu

SEQ ID NO: 1114967 - RNA, 22 nt, Human
uccagcagaccaucaaggcuca

SEQ ID NO: 1114968 - RNA, 22 nt, Human
aaugcacaugucuuggccucac

SEQ ID NO: 1114969 - RNA, 22 nt, Human
uagcacaucuggcgcuuauagg

SEQ ID NO: 1114970 - RNA, 22 nt, Human
uaaguucaguuggucgaaguag

SEQ ID NO: 1114971 - RNA, 22 nt, Human
acaguaccugcucucaagcaaa

SEQ ID NO: 1114972 - RNA, 22 nt, Human
ugcagugguugagagcccagac

SEQ ID NO: 1114973 - RNA, 22 nt, Human
ccugcccagcuucaccucaggc

SEQ ID NO: 1114974 - RNA, 22 nt, Human
acugggaggcaucuggagcuga

SEQ ID NO: 1114975 - RNA, 22 nt, Human
agaguggggaagguguugagaa

SEQ ID NO: 1114976 - RNA, 22 nt, Human
acugccuugaaagauuguugag

SEQ ID NO: 1114977 - RNA, 22 nt, Human
agugacucacuagcucucagug

SEQ ID NO: 1114978 - RNA, 22 nt, Human
uggcucuguuuguuaacuagac

SEQ ID NO: 1114979 - RNA, 22 nt, Human
cccuggagcaucucugcugucu

SEQ ID NO: 1114980 - RNA, 22 nt, Human
agaugguguuuccccaggugga

SEQ ID NO: 1114981 - RNA, 22 nt, Human
gcagugggagcuuaggcagugc

SEQ ID NO: 1114982 - RNA, 22 nt, Human
aagcugccauagaacgagaggu

SEQ ID NO: 1114983 - RNA, 22 nt, Human
aucuggcuuuuacugaauugcu

SEQ ID NO: 1114984 - RNA, 22 nt, Human
gucccuggucuaccguggcuuc

SEQ ID NO: 1114985 - RNA, 22 nt, Human
uccuuuccagccucaccucagc

SEQ ID NO: 1114986 - RNA, 22 nt, Human
gagcagcugagcuggaaugaga

SEQ ID NO: 1114987 - RNA, 22 nt, Human
cugggcacacagugacucugca

SEQ ID NO: 1114988 - RNA, 22 nt, Human
gccaggcagccacccucugcga

SEQ ID NO: 1114989 - RNA, 22 nt, Human
uuuccucuuugugacacagcug

SEQ ID NO: 1114990 - RNA, 19 nt, Human
agcuggggcgguguguguu

SEQ ID NO: 1114991 - RNA, 22 nt, Human
cugcuuuggcucagugacauca

SEQ ID NO: 1114992 - RNA, 22 nt, Human
gcuggcaucacuggcuucggug

SEQ ID NO: 1114993 - RNA, 22 nt, Human
gagcagaugugugccaggaugc

SEQ ID NO: 1114994 - RNA, 22 nt, Human
agagugaaguaauuguuaggau

SEQ ID NO: 1114995 - RNA, 22 nt, Human
gccaggcugcuccagggaggcc

SEQ ID NO: 1114996 - RNA, 22 nt, Human
guguaauuauauaaagaucuac

SEQ ID NO: 1114997 - RNA, 22 nt, Human
ggcugccugugcccaggcacac

SEQ ID NO: 1114998 - RNA, 22 nt, Human
cauugaaaaacguugacugagu

SEQ ID NO: 1114999 - RNA, 21 nt, Human
acagggcaugcagcuggcugu

SEQ ID NO: 1115000 - RNA, 22 nt, Human
cuccucugucuggcccugagcc

SEQ ID NO: 1115001 - RNA, 22 nt, Human
cuggcagcguguuuaugaacau

SEQ ID NO: 1115002 - RNA, 20 nt, Human
ggccuuggccucuuugcagc

SEQ ID NO: 1115003 - RNA, 22 nt, Human
agccauggcgccacuagaggga

SEQ ID NO: 1115004 - RNA, 22 nt, Human
ucagagucucccccaguuuggg

SEQ ID NO: 1115005 - RNA, 22 nt, Human
ccaggcugccgaggaaagaaag

SEQ ID NO: 1115006 - RNA, 22 nt, Human
ggcagcagaacuggcccuguau

SEQ ID NO: 1115007 - RNA, 20 nt, Human
ugcagagcuggcuggcuccu

SEQ ID NO: 1115008 - RNA, 22 nt, Human
aagggaggggauguaagccugg

SEQ ID NO: 1115009 - RNA, 22 nt, Human
caggcuggagugcaguugugca

SEQ ID NO: 1115010 - RNA, 22 nt, Human
aggccagcuguuacuagagcca

SEQ ID NO: 1115011 - RNA, 22 nt, Human
gcagcuggagccagccagacac

SEQ ID NO: 1115012 - RNA, 22 nt, Human
uccagagcagguggucagaagg

SEQ ID NO: 1115013 - RNA, 22 nt, Human
uugacaagaaucguugccuugg

SEQ ID NO: 1115014 - RNA, 22 nt, Human
ggcgugggaaguggggcuucug

SEQ ID NO: 1115015 - RNA, 23 nt, Human
acugagccagggccugggucagc

SEQ ID NO: 1115016 - RNA, 22 nt, Human
gccugaaguuucaugccucuau

SEQ ID NO: 1115017 - RNA, 22 nt, Human
uacauaguuccauuuacaggaa

SEQ ID NO: 1115018 - RNA, 22 nt, Human
ucaccagucuuucuuaccauug

SEQ ID NO: 1115019 - RNA, 22 nt, Human
ucacuuaaaaauucuaguuaug

SEQ ID NO: 1115020 - RNA, 20 nt, Human
uucaggauucuagaccacac

SEQ ID NO: 1115021 - RNA, 22 nt, Human
agacccugcaccucucgugggc

SEQ ID NO: 1115022 - RNA, 22 nt, Human
uguguguauaugcauuuaucua

SEQ ID NO: 1115023 - RNA, 22 nt, Human
uagagcuagcuucaaaaugcga

SEQ ID NO: 1115024 - RNA, 22 nt, Human
cagggcccaagacacaaugagg

SEQ ID NO: 1115025 - RNA, 22 nt, Human
guccucuguguaggcugcagac

SEQ ID NO: 1115026 - RNA, 22 nt, Human
cccagggucccugcucucugug

SEQ ID NO: 1115027 - RNA, 22 nt, Human
gaacagcugcuagagaucugug

SEQ ID NO: 1115028 - RNA, 22 nt, Human
uguauacauuuaacuagauaga

SEQ ID NO: 1115029 - RNA, 22 nt, Human
cuggcagcccaaccuagagucu

SEQ ID NO: 1115030 - RNA, 22 nt, Human
uggagcaagcuggagagaacau

SEQ ID NO: 1115031 - RNA, 22 nt, Human
gcucugagaggugcagcaguaa

SEQ ID NO: 1115032 - RNA, 18 nt, Human
cguuuuuccgggauugca

SEQ ID NO: 1115033 - RNA, 21 nt, Human
cugcucuggggaccggcugug

SEQ ID NO: 1115034 - RNA, 22 nt, Human
cacuacuugaaagaauuacaga

SEQ ID NO: 1115035 - RNA, 22 nt, Human
gagcucuguguagccugagggu

SEQ ID NO: 1115036 - RNA, 22 nt, Human
auaguacacauccuacaauguu

SEQ ID NO: 1115037 - RNA, 22 nt, Human
agcaggcuccuuccuucucugg

SEQ ID NO: 1115038 - RNA, 22 nt, Human
cuuccugcauugugccagaguu

SEQ ID NO: 1115039 - RNA, 22 nt, Human
ggacuggacucucaggcucaca

SEQ ID NO: 1115040 - RNA, 22 nt, Human
aggggagccccugguccuggug

SEQ ID NO: 1115041 - RNA, 22 nt, Human
guacaguuuucaguguucacug

SEQ ID NO: 1115042 - RNA, 22 nt, Human
uguccacaucacucacuuguca

SEQ ID NO: 1115043 - RNA, 22 nt, Human
agcaggagcugugggaagaugg

SEQ ID NO: 1115044 - RNA, 22 nt, Human
ggcaggcaggagcgugcuuggg

SEQ ID NO: 1115045 - RNA, 17 nt, Human
aggcugcugggccaggg

SEQ ID NO: 1115046 - RNA, 22 nt, Human
acagcaagccagcuugucacug

SEQ ID NO: 1115047 - RNA, 22 nt, Human
ggcugccagugagugcagaccg

SEQ ID NO: 1115048 - RNA, 22 nt, Human
gggcucugggauucagagcaag

SEQ ID NO: 1115049 - RNA, 18 nt, Human
cugaggcuggcaggagcc

SEQ ID NO: 1115050 - RNA, 22 nt, Human
uggcacugggaugcuacuguua

SEQ ID NO: 1115051 - RNA, 22 nt, Human
cugggcugagccugggcugugu

SEQ ID NO: 1115052 - RNA, 22 nt, Human
gccuccccugcaauuguccuug

SEQ ID NO: 1115053 - RNA, 22 nt, Human
ucugaagaacugaguaaacaug

SEQ ID NO: 1115054 - RNA, 22 nt, Human
ggcuucuccagguacugagcau

SEQ ID NO: 1115055 - RNA, 22 nt, Human
uuagaaaucugcugccaugcaa

SEQ ID NO: 1115056 - RNA, 22 nt, Human
ccagagccuaagaucugauccu

SEQ ID NO: 1115057 - RNA, 22 nt, Human
ucauugucuugauaugauuguc

SEQ ID NO: 1115058 - RNA, 23 nt, Human
cugucuccugggcuagguggaau

SEQ ID NO: 1115059 - RNA, 22 nt, Human
cugcagagcuaggcugagugaa

SEQ ID NO: 1115060 - RNA, 22 nt, Human
gggaguguugagcgcccugcca

SEQ ID NO: 1115061 - RNA, 22 nt, Human
uuccucagaaaauacuguccaa

SEQ ID NO: 1115062 - RNA, 22 nt, Human
uggcacugaccccaggccugug

SEQ ID NO: 1115063 - RNA, 22 nt, Human
gccuucugcgcucgugucuccg

SEQ ID NO: 1115064 - RNA, 22 nt, Human
aggcucagauccuuguguccug

SEQ ID NO: 1115065 - RNA, 22 nt, Human
cacaggaggaggccagagcgua

SEQ ID NO: 1115066 - RNA, 22 nt, Human
aggaaaaaccuguuaaugguag

SEQ ID NO: 1115067 - RNA, 22 nt, Human
guguuccauguuugagguaguu

SEQ ID NO: 1115068 - RNA, 21 nt, Human
aggcacuguuugugguuuggg

SEQ ID NO: 1115069 - RNA, 22 nt, Human
uuucaguggguuuauuucaugu

SEQ ID NO: 1115070 - RNA, 22 nt, Human
uggcugggccgggccuugugcc

SEQ ID NO: 1115071 - RNA, 22 nt, Human
ggccgggcaggucucagccagc

SEQ ID NO: 1115072 - RNA, 22 nt, Human
cccagcucucucaguucugcuu

SEQ ID NO: 1115073 - RNA, 22 nt, Human
aagcccagaugugagaacugag

SEQ ID NO: 1115074 - RNA, 22 nt, Human
gcaaggaccuuugagcgugcca

SEQ ID NO: 1115075 - RNA, 22 nt, Human
uccucaggauguggaguagaau

SEQ ID NO: 1115076 - RNA, 22 nt, Human
gaugggaggaaccugggucccu

SEQ ID NO: 1115077 - RNA, 22 nt, Human
ucccaggaucugagggcagaga

SEQ ID NO: 1115078 - RNA, 22 nt, Human
gcccucagaggacagcugacuu

SEQ ID NO: 1115079 - RNA, 22 nt, Human
cucugugccucaguuuucuucu

SEQ ID NO: 1115080 - RNA, 22 nt, Human
gcugccaguaguuggagcucca

SEQ ID NO: 1115081 - RNA, 19 nt, Human
uguuggugcggauguggag

SEQ ID NO: 1115082 - RNA, 22 nt, Human
cugcucugcaaggcacagugau

SEQ ID NO: 1115083 - RNA, 22 nt, Human
uggcucagcauucacuggucuu

SEQ ID NO: 1115084 - RNA, 22 nt, Human
gcauuguccugcuucugagugu

SEQ ID NO: 1115085 - RNA, 22 nt, Human
uugaaaggugacauuguuagag

SEQ ID NO: 1115086 - RNA, 22 nt, Human
aucaauucuuaggaaaauagcu

SEQ ID NO: 1115087 - RNA, 22 nt, Human
ccuggguggcagagguugcagu

SEQ ID NO: 1115088 - RNA, 20 nt, Human
ugcagggcucugcuucucuc

SEQ ID NO: 1115089 - RNA, 22 nt, Human
uguggccuccccacuucugggg

SEQ ID NO: 1115090 - RNA, 22 nt, Human
agcccaugcaacaggccuagcg

SEQ ID NO: 1115091 - RNA, 21 nt, Human
agcaggaggcagucacagcuc

SEQ ID NO: 1115092 - RNA, 18 nt, Human
cacaggcucccagugagg

SEQ ID NO: 1115093 - RNA, 22 nt, Human
ugcucagacaagcugaacagua

SEQ ID NO: 1115094 - RNA, 22 nt, Human
uuucacauacaguguauaguag

SEQ ID NO: 1115095 - RNA, 22 nt, Human
auugucgcuuauuuaggugcuu

SEQ ID NO: 1115096 - RNA, 23 nt, Human
cagcugaagcagccugggcugga

SEQ ID NO: 1115097 - RNA, 22 nt, Human
acagcugggugcugcucagagc

SEQ ID NO: 1115098 - RNA, 22 nt, Human
ccagggcaugggaagaacugaa

SEQ ID NO: 1115099 - RNA, 22 nt, Human
gggagagagagcucauguugaa

SEQ ID NO: 1115100 - RNA, 23 nt, Human
cuggccuccgacacuggccaaga

SEQ ID NO: 1115101 - RNA, 22 nt, Human
gcacugaaaauguuggauucca

SEQ ID NO: 1115102 - RNA, 22 nt, Human
ucucccacagccgugcuucaag

SEQ ID NO: 1115103 - RNA, 22 nt, Human
ccuggccuccuggccuucucau

SEQ ID NO: 1115104 - RNA, 22 nt, Human
ugcacccucaucagucaaaugg

SEQ ID NO: 1115105 - RNA, 22 nt, Human
gccacaugcaauugcagcacgu

SEQ ID NO: 1115106 - RNA, 22 nt, Human
cagcccuggaacagcugacuca

SEQ ID NO: 1115107 - RNA, 22 nt, Human
ugagcccuaagggucaagcagg

SEQ ID NO: 1115108 - RNA, 18 nt, Human
ugacucacccugucagug

SEQ ID NO: 1115109 - RNA, 22 nt, Human
cugggcagugguggcaucuuug

SEQ ID NO: 1115110 - RNA, 22 nt, Human
cagugcaguuucccagaugcug

SEQ ID NO: 1115111 - RNA, 22 nt, Human
ucgugucagaucagagguuccu

SEQ ID NO: 1115112 - RNA, 22 nt, Human
uccagcagggaauuaguagucu

SEQ ID NO: 1115113 - RNA, 21 nt, Human
ccuccaggagcagagcccuga

SEQ ID NO: 1115114 - RNA, 22 nt, Human
gugggaugcaguggugaguggc

SEQ ID NO: 1115115 - RNA, 21 nt, Human
ggucuuccaaauaaggagaaa

SEQ ID NO: 1115116 - RNA, 22 nt, Human
gaagcagcucagauugacugaa

SEQ ID NO: 1115117 - RNA, 22 nt, Human
agguuauaugucauacugaagu

SEQ ID NO: 1115118 - RNA, 22 nt, Human
ucuguaucacccguucccagaa

SEQ ID NO: 1115119 - RNA, 22 nt, Human
agagaugucgccuugcccaggg

SEQ ID NO: 1115120 - RNA, 22 nt, Human
uagaaaucuacuuagacuuucu

SEQ ID NO: 1115121 - RNA, 22 nt, Human
uccucacaagcaagcacaggua

SEQ ID NO: 1115122 - RNA, 22 nt, Human
ugcuggggucauggggcgcccg

SEQ ID NO: 1115123 - RNA, 22 nt, Human
ccaggccugcaucugcugcgca

SEQ ID NO: 1115124 - RNA, 22 nt, Human
aaaaguauuggccaccauuucu

SEQ ID NO: 1115125 - RNA, 22 nt, Human
ugcucuggaguggcuugugcac

SEQ ID NO: 1115126 - RNA, 22 nt, Human
cuuaacagcaagaucuguguca

SEQ ID NO: 1115127 - RNA, 22 nt, Human
gcugcucuccauggccgugagu

SEQ ID NO: 1115128 - RNA, 20 nt, Human
gugcauuucaccuguacugu

SEQ ID NO: 1115129 - RNA, 22 nt, Human
ggaucauuaacacauccaucac

SEQ ID NO: 1115130 - RNA, 22 nt, Human
gaguuguucaacgugugugaaa

SEQ ID NO: 1115131 - RNA, 22 nt, Human
agccuccaucccaugcacaaag

SEQ ID NO: 1115132 - RNA, 22 nt, Human
cugaaggauuagagagcacuua

SEQ ID NO: 1115133 - RNA, 22 nt, Human
uuagaaaugauuucaccucuuu

SEQ ID NO: 1115134 - RNA, 22 nt, Human
ucagaggaauaaugcugcauuu

SEQ ID NO: 1115135 - RNA, 21 nt, Human
ucagggcagugggagguuccu

SEQ ID NO: 1115136 - RNA, 22 nt, Human
gagggcagugaauuuugaagcu

SEQ ID NO: 1115137 - RNA, 22 nt, Human
uccugucugcucacagagcugg

SEQ ID NO: 1115138 - RNA, 22 nt, Human
agccuucauaaucuugggcuuu

SEQ ID NO: 1115139 - RNA, 22 nt, Human
ccuggcagacagcacugaagcu

SEQ ID NO: 1115140 - RNA, 21 nt, Human
uuugcauuuuacaugugggga

SEQ ID NO: 1115141 - RNA, 21 nt, Human
gacaggggaagaagcaaggag

SEQ ID NO: 1115142 - RNA, 22 nt, Human
ucucagagagcuguguuuuccu

SEQ ID NO: 1115143 - RNA, 22 nt, Human
ccuccaaguuugacucaggaca

SEQ ID NO: 1115144 - RNA, 22 nt, Human
aucaguuuggaacauucaggcc

SEQ ID NO: 1115145 - RNA, 22 nt, Human
auccuugagccaaugacugauu

SEQ ID NO: 1115146 - RNA, 22 nt, Human
ugaggcaggaguucaggcugcg

SEQ ID NO: 1115147 - RNA, 22 nt, Human
agccaagcaccacuggcacucg

SEQ ID NO: 1115148 - RNA, 22 nt, Human
ggcucaggccagaccacgacuc

SEQ ID NO: 1115149 - RNA, 22 nt, Human
gaagcccaggcuuccuuggcuu

SEQ ID NO: 1115150 - RNA, 21 nt, Human
ugggcacugagggugcugcuc

SEQ ID NO: 1115151 - RNA, 22 nt, Human
ugcugccaugcagagcaacaga

SEQ ID NO: 1115152 - RNA, 22 nt, Human
ucaccuuagcuagaggaagaga

SEQ ID NO: 1115153 - RNA, 23 nt, Human
aggagaagagauuuccacaugca

SEQ ID NO: 1115154 - RNA, 22 nt, Human
guuggccugaauggucaagagg

SEQ ID NO: 1115155 - RNA, 22 nt, Human
ggacaggguaaguacuagugug

SEQ ID NO: 1115156 - RNA, 22 nt, Human
gggagcugagggaccucugugg

SEQ ID NO: 1115157 - RNA, 22 nt, Human
uggggaggacgggcgccuuccu

SEQ ID NO: 1115158 - RNA, 22 nt, Human
gcagccuguuguaccagccugu

SEQ ID NO: 1115159 - RNA, 20 nt, Human
gccagcacagggagcaguuc

SEQ ID NO: 1115160 - RNA, 22 nt, Human
gcucagagaugucugcugccuu

SEQ ID NO: 1115161 - RNA, 22 nt, Human
cagugucuuauuuguagcucag

SEQ ID NO: 1115162 - RNA, 22 nt, Human
cacagaauaaauugguaucaga

SEQ ID NO: 1115163 - RNA, 22 nt, Human
agucccagcucagaaccacuag

SEQ ID NO: 1115164 - RNA, 22 nt, Human
agccacaggaaacagagacagc

SEQ ID NO: 1115165 - RNA, 22 nt, Human
gaggcagagugcaccccaggag

SEQ ID NO: 1115166 - RNA, 22 nt, Human
uaaaugugucuuuuuaaggccu

SEQ ID NO: 1115167 - RNA, 22 nt, Human
guagaagugaugucauguuaua

SEQ ID NO: 1115168 - RNA, 22 nt, Human
aaaguuuuagaacuaggaagca

SEQ ID NO: 1115169 - RNA, 22 nt, Human
guccucuggccuuucccaggac

SEQ ID NO: 1115170 - RNA, 22 nt, Human
gcucaggaaaacagucuaguaa

SEQ ID NO: 1115171 - RNA, 22 nt, Human
ggcagcuuuuaucccugacaga

SEQ ID NO: 1115172 - RNA, 22 nt, Human
ggcagccaugucccagggcuuc

SEQ ID NO: 1115173 - RNA, 22 nt, Human
uggcuuccacugugugcccccu

SEQ ID NO: 1115174 - RNA, 21 nt, Human
guuuuaagggagaaaaccuag

SEQ ID NO: 1115175 - RNA, 22 nt, Human
uauucacaguugauuuacaguu

SEQ ID NO: 1115176 - RNA, 22 nt, Human
ucaggcagaugcagggauggau

SEQ ID NO: 1115177 - RNA, 22 nt, Human
ccucugcagcagagagccagag

SEQ ID NO: 1115178 - RNA, 22 nt, Human
agccuggaggccaggagacagu

SEQ ID NO: 1115179 - RNA, 21 nt, Human
guggcccugccgcagugucca

SEQ ID NO: 1115180 - RNA, 22 nt, Human
gucccagaugucuggaacuccc

SEQ ID NO: 1115181 - RNA, 22 nt, Human
ggaaccaggaguuacacgaguu

SEQ ID NO: 1115182 - RNA, 22 nt, Human
gcuugcuggugccugcaggcuc

SEQ ID NO: 1115183 - RNA, 22 nt, Human
ccagagccugcugagccccauu

SEQ ID NO: 1115184 - RNA, 22 nt, Human
gcaugcugcaccagagccucuc

SEQ ID NO: 1115185 - RNA, 23 nt, Human
acagggcauugcuggccucgagg

SEQ ID NO: 1115186 - RNA, 19 nt, Human
aggcugcaagguggugggc

SEQ ID NO: 1115187 - RNA, 22 nt, Human
cagggccaccguguuugcugcu

SEQ ID NO: 1115188 - RNA, 22 nt, Human
ccaggcauccauugcuuccucu

SEQ ID NO: 1115189 - RNA, 22 nt, Human
agcugguuagcaaucuaaguga

SEQ ID NO: 1115190 - RNA, 22 nt, Human
ccaguccagugccaugcauggc

SEQ ID NO: 1115191 - RNA, 22 nt, Human
cugcucugaagccaggauucug

SEQ ID NO: 1115192 - RNA, 22 nt, Human
cacaagacuuauuuguguagaa

SEQ ID NO: 1115193 - RNA, 22 nt, Human
ggccucuggucaagacaagcau

SEQ ID NO: 1115194 - RNA, 22 nt, Human
gcagcugccuauucagggcuug

SEQ ID NO: 1115195 - RNA, 22 nt, Human
gcugcccaggguggagccggcu

SEQ ID NO: 1115196 - RNA, 22 nt, Human
acagcugugaaaauccacagga

SEQ ID NO: 1115197 - RNA, 22 nt, Human
uuugcauugcagugguuuacag

SEQ ID NO: 1115198 - RNA, 22 nt, Human
ccugggucacucaggcaggcgg

SEQ ID NO: 1115199 - RNA, 22 nt, Human
ccagagucuaugaguccucauu

SEQ ID NO: 1115200 - RNA, 21 nt, Human
gccagggaagagaguuggcug

SEQ ID NO: 1115201 - RNA, 22 nt, Human
uggcucugcugaaccuagugca

SEQ ID NO: 1115202 - RNA, 22 nt, Human
uggcccugacacgugguacugg

SEQ ID NO: 1115203 - RNA, 22 nt, Human
gagagcugucagcguagcaccg

SEQ ID NO: 1115204 - RNA, 22 nt, Human
ugugcccauuccacuugaguac

SEQ ID NO: 1115205 - RNA, 22 nt, Human
ucaguuuucucaucugugaaau

SEQ ID NO: 1115206 - RNA, 22 nt, Human
cacaccuguaauaccagcuacu

SEQ ID NO: 1115207 - RNA, 22 nt, Human
ucugccugcuaacuccugcacc

SEQ ID NO: 1115208 - RNA, 22 nt, Human
ccagccuggacugggucuugug

SEQ ID NO: 1115209 - RNA, 22 nt, Human
cuggcucuaucuccaaggcugg

SEQ ID NO: 1115210 - RNA, 22 nt, Human
acaggggauugauuggaagucu

SEQ ID NO: 1115211 - RNA, 22 nt, Human
agucuucagagaaauuaacucu

SEQ ID NO: 1115212 - RNA, 22 nt, Human
uaugcacacauuagcacagggu

SEQ ID NO: 1115213 - RNA, 22 nt, Human
uuacugaaaauucuucaggauu

SEQ ID NO: 1115214 - RNA, 22 nt, Human
aaguuugagagccuuuaguaua

SEQ ID NO: 1115215 - RNA, 22 nt, Human
cucugagcagaggccguggcua

SEQ ID NO: 1115216 - RNA, 22 nt, Human
gcaggaugccagggcagcagcg

SEQ ID NO: 1115217 - RNA, 22 nt, Human
ccgggcgggggcucucgucacc

SEQ ID NO: 1115218 - RNA, 22 nt, Human
agcccagcaaagggagguucag

SEQ ID NO: 1115219 - RNA, 22 nt, Human
ugucacaaacauacauuauaga

SEQ ID NO: 1115220 - RNA, 22 nt, Human
gaaagagaaccugggccuagau

SEQ ID NO: 1115221 - RNA, 22 nt, Human
aggguauguuuuuaucuacugu

SEQ ID NO: 1115222 - RNA, 22 nt, Human
cuuccucaugugcaaugcaagc

SEQ ID NO: 1115223 - RNA, 22 nt, Human
ucaaaguagggguaagccaggc

SEQ ID NO: 1115224 - RNA, 22 nt, Human
caugggaggucugcaaggugcu

SEQ ID NO: 1115225 - RNA, 22 nt, Human
acuggaagccaguugacaauca

SEQ ID NO: 1115226 - RNA, 22 nt, Human
ugggacugcucuugcugggguc

SEQ ID NO: 1115227 - RNA, 22 nt, Human
cagcaggguauacagggaauuu

SEQ ID NO: 1115228 - RNA, 22 nt, Human
agguggguccuggcucugccau

SEQ ID NO: 1115229 - RNA, 22 nt, Human
ccuguccuccaagagcacaucu

SEQ ID NO: 1115230 - RNA, 22 nt, Human
cuuggcagagggcugggcucag

SEQ ID NO: 1115231 - RNA, 22 nt, Human
auaauuuaauuuucacaguggu

SEQ ID NO: 1115232 - RNA, 20 nt, Human
cuucaggacccauccucccc

SEQ ID NO: 1115233 - RNA, 19 nt, Human
ucuggagcugaugcaggug

SEQ ID NO: 1115234 - RNA, 22 nt, Human
ccugccagucacuaugucaccu

SEQ ID NO: 1115235 - RNA, 22 nt, Human
aagggcaggcacccacccucac

SEQ ID NO: 1115236 - RNA, 18 nt, Human
cugagggcagccccuggg

SEQ ID NO: 1115237 - RNA, 22 nt, Human
accugccuaucagcugccugcu

SEQ ID NO: 1115238 - RNA, 22 nt, Human
gccagcaguauguccuggcagu

SEQ ID NO: 1115239 - RNA, 22 nt, Human
acugucaccaucagagcgggaa

SEQ ID NO: 1115240 - RNA, 22 nt, Human
ucucacucauuuccuaggucuu

SEQ ID NO: 1115241 - RNA, 22 nt, Human
gcugccugcacagagcugcuuu

SEQ ID NO: 1115242 - RNA, 22 nt, Human
ucucagagaucuuucugcaugu

SEQ ID NO: 1115243 - RNA, 20 nt, Human
gugugaagcccucaggagga

SEQ ID NO: 1115244 - RNA, 22 nt, Human
cccaggaggucgaagcugcagu

SEQ ID NO: 1115245 - RNA, 22 nt, Human
cccagaaggucgaggcugcagu

SEQ ID NO: 1115246 - RNA, 22 nt, Human
ucaaacuguuuacagugagaua

SEQ ID NO: 1115247 - RNA, 22 nt, Human
cuguacaucucugaggacagua

SEQ ID NO: 1115248 - RNA, 18 nt, Human
aggcccuggccucgaaca

SEQ ID NO: 1115249 - RNA, 22 nt, Human
ggagaagggacagacucagcuu

SEQ ID NO: 1115250 - RNA, 22 nt, Human
uccucugccccagaugaaauuu

SEQ ID NO: 1115251 - RNA, 22 nt, Human
guuguauucuucaauaucagag

SEQ ID NO: 1115252 - RNA, 22 nt, Human
uuuaucuuuggaucuucagaaa

SEQ ID NO: 1115253 - RNA, 22 nt, Human
agaaugcauuuuguguagcuau

SEQ ID NO: 1115254 - RNA, 22 nt, Human
agagcugcccacacagcagauu

SEQ ID NO: 1115255 - RNA, 22 nt, Human
uggaggcaucagagugcuuggc

SEQ ID NO: 1115256 - RNA, 22 nt, Human
uggagcuggaauuucugggccu

SEQ ID NO: 1115257 - RNA, 22 nt, Human
agcccucauggaacagcuccua

SEQ ID NO: 1115258 - RNA, 22 nt, Human
ucucuuuuauguacacccugac

SEQ ID NO: 1115259 - RNA, 22 nt, Human
ccuggccuggcacucccucugc

SEQ ID NO: 1115260 - RNA, 22 nt, Human
caggggccaggcugucugcugu

SEQ ID NO: 1115261 - RNA, 22 nt, Human
ggaggcucugcuccguguguuc

SEQ ID NO: 1115262 - RNA, 22 nt, Human
uuccugagggacuuuugagauu

SEQ ID NO: 1115263 - RNA, 22 nt, Human
aaggcugauuagacugauagcu

SEQ ID NO: 1115264 - RNA, 22 nt, Human
cauggccugccuccuccuggug

SEQ ID NO: 1115265 - RNA, 22 nt, Human
uggagcuggaauuugagcugga

SEQ ID NO: 1115266 - RNA, 20 nt, Human
cucuccuugccgacuuggca

SEQ ID NO: 1115267 - RNA, 22 nt, Human
uauaacacucagaaagaaucau

SEQ ID NO: 1115268 - RNA, 22 nt, Human
uagggcagccuuauagcuccca

SEQ ID NO: 1115269 - RNA, 22 nt, Human
uccucccacauaggacaauggg

SEQ ID NO: 1115270 - RNA, 22 nt, Human
gccagggagucugggccacaga

SEQ ID NO: 1115271 - RNA, 22 nt, Human
acaggagugaaucuggcacuua

SEQ ID NO: 1115272 - RNA, 22 nt, Human
agagugaagguugacacuucac

SEQ ID NO: 1115273 - RNA, 22 nt, Human
cuggagagggagcccuggcagu

SEQ ID NO: 1115274 - RNA, 23 nt, Human
gcugucugucaucucugcgggag

SEQ ID NO: 1115275 - RNA, 22 nt, Human
gcagguggcagaggugggaucu

SEQ ID NO: 1115276 - RNA, 22 nt, Human
ucccagagcugauaagccuuua

SEQ ID NO: 1115277 - RNA, 20 nt, Human
cuccagggaacagacuggag

SEQ ID NO: 1115278 - RNA, 22 nt, Human
accuuuuuguucuguucucagc

SEQ ID NO: 1115279 - RNA, 22 nt, Human
uccucuucugcccaucagaggc

SEQ ID NO: 1115280 - RNA, 22 nt, Human
ucucaagcuuguugguauguuu

SEQ ID NO: 1115281 - RNA, 22 nt, Human
gcacugaaugcuuuuacuguaa

SEQ ID NO: 1115282 - RNA, 22 nt, Human
gcugccuguguggccacucacu

SEQ ID NO: 1115283 - RNA, 22 nt, Human
agcagggcagugcuucagcucu

SEQ ID NO: 1115284 - RNA, 22 nt, Human
guuugcauaaaguggaugcagg

SEQ ID NO: 1115285 - RNA, 22 nt, Human
ggcuucccagcagagggcgcac

SEQ ID NO: 1115286 - RNA, 22 nt, Human
aggccugaaggaagaugagcug

SEQ ID NO: 1115287 - RNA, 22 nt, Human
acauuucuuugcuagacagcag

SEQ ID NO: 1115288 - RNA, 22 nt, Human
cuggaugcuuccucucugcuag

SEQ ID NO: 1115289 - RNA, 22 nt, Human
ucaccugggagggcugugguag

SEQ ID NO: 1115290 - RNA, 22 nt, Human
ugccaggcuaaguggaggacuu

SEQ ID NO: 1115291 - RNA, 22 nt, Human
acugaaggaagcgggcaggggu

SEQ ID NO: 1115292 - RNA, 22 nt, Human
cccuccagagcuugaccugcug

SEQ ID NO: 1115293 - RNA, 22 nt, Human
agaggaugguugaggaagaccu

SEQ ID NO: 1115294 - RNA, 22 nt, Human
ugggcuccagcaccugugcucu

SEQ ID NO: 1115295 - RNA, 22 nt, Human
cuucuaggcuucucagggggca

SEQ ID NO: 1115296 - RNA, 22 nt, Human
uggcagagagacucuccuugau

SEQ ID NO: 1115297 - RNA, 22 nt, Human
gccuucagcggccgcucgcugc

SEQ ID NO: 1115298 - RNA, 22 nt, Human
uugaagcauuugcuauagcauu

SEQ ID NO: 1115299 - RNA, 22 nt, Human
aaggacagaaacagauugcugg

SEQ ID NO: 1115300 - RNA, 22 nt, Human
cauauaaauacaacauguguua

SEQ ID NO: 1115301 - RNA, 22 nt, Human
gagggggcgugcaaggcuccgc

SEQ ID NO: 1115302 - RNA, 22 nt, Human
gccugagaaggauaggaagcga

SEQ ID NO: 1115303 - RNA, 22 nt, Human
caagagcuagacuuugucagga

SEQ ID NO: 1115304 - RNA, 22 nt, Human
aguuuagaguucaaauuaguuc

SEQ ID NO: 1115305 - RNA, 22 nt, Human
ccaggagcaggagcuggacaga

SEQ ID NO: 1115306 - RNA, 22 nt, Human
agggaugguggagguugcaagu

SEQ ID NO: 1115307 - RNA, 22 nt, Human
guuauaaauaccuaauaggauu

SEQ ID NO: 1115308 - RNA, 22 nt, Human
cagccccucccucaggcaggug

SEQ ID NO: 1115309 - RNA, 22 nt, Human
cugggaguugacgaggcuugua

SEQ ID NO: 1115310 - RNA, 20 nt, Human
ugcagcugguuucacaggga

SEQ ID NO: 1115311 - RNA, 22 nt, Human
guggccugaugccagcccugug

SEQ ID NO: 1115312 - RNA, 22 nt, Human
aaagauuucacaucccaagccu

SEQ ID NO: 1115313 - RNA, 22 nt, Human
ugucaugccaggaaauaguccc

SEQ ID NO: 1115314 - RNA, 21 nt, Human
acagacagggccagugucccc

SEQ ID NO: 1115315 - RNA, 22 nt, Human
caggaggaggugagguagaacu

SEQ ID NO: 1115316 - RNA, 22 nt, Human
acacaugcauaagccuucccuu

SEQ ID NO: 1115317 - RNA, 22 nt, Human
agauguuccagccaaugggaau

SEQ ID NO: 1115318 - RNA, 22 nt, Human
aggucauuuuugccuucuauuu

SEQ ID NO: 1115319 - RNA, 22 nt, Human
uguccucuuccagugcuccuuc

SEQ ID NO: 1115320 - RNA, 22 nt, Human
guccagggcuaaaucagguucc

SEQ ID NO: 1115321 - RNA, 22 nt, Human
ggcaguggugggaggcucgcuc

SEQ ID NO: 1115322 - RNA, 22 nt, Human
uguggccagcagguggcugugu

SEQ ID NO: 1115323 - RNA, 21 nt, Human
ccuauugaauauaggaagauu

SEQ ID NO: 1115324 - RNA, 22 nt, Human
gagaaagacguaggcugggagg

SEQ ID NO: 1115325 - RNA, 22 nt, Human
ccuggccacucagguguggggc

SEQ ID NO: 1115326 - RNA, 22 nt, Human
gccagcucagugccaggccccu

SEQ ID NO: 1115327 - RNA, 22 nt, Human
acagugucugacacauuguagc

SEQ ID NO: 1115328 - RNA, 22 nt, Human
caguggguaggaaaggcucuuc

SEQ ID NO: 1115329 - RNA, 22 nt, Human
cuguuuauaaauagaggggagu

SEQ ID NO: 1115330 - RNA, 22 nt, Human
acaggcugcugagccauuugcu

SEQ ID NO: 1115331 - RNA, 22 nt, Human
ccaaagucagugcucagucguc

SEQ ID NO: 1115332 - RNA, 22 nt, Human
ucccagcauaacaaacugcccg

SEQ ID NO: 1115333 - RNA, 22 nt, Human
cacugggcaauucugagccuaa

SEQ ID NO: 1115334 - RNA, 19 nt, Human
acuuucuccaggaccuguu

SEQ ID NO: 1115335 - RNA, 22 nt, Human
aggccugggacgggagccguga

SEQ ID NO: 1115336 - RNA, 22 nt, Human
uagggaggcuacuucuuguagg

SEQ ID NO: 1115337 - RNA, 22 nt, Human
uccuggaguauuucuguggugu

SEQ ID NO: 1115338 - RNA, 17 nt, Human
ucaggcugugccuggua

SEQ ID NO: 1115339 - RNA, 22 nt, Human
uccagcagguuggucaggugca

SEQ ID NO: 1115340 - RNA, 22 nt, Human
ucugguuagccaauaaugccaa

SEQ ID NO: 1115341 - RNA, 22 nt, Human
gucccuuggcucacaaacagcu

SEQ ID NO: 1115342 - RNA, 22 nt, Human
ugccagcacaaguuaagagauc

SEQ ID NO: 1115343 - RNA, 22 nt, Human
ugccaggccucaggagucucca

SEQ ID NO: 1115344 - RNA, 22 nt, Human
ugaagcagauggucuggucauu

SEQ ID NO: 1115345 - RNA, 22 nt, Human
gaguuauuuguagggauuauau

SEQ ID NO: 1115346 - RNA, 22 nt, Human
aggcagagcugauguucuguga

SEQ ID NO: 1115347 - RNA, 22 nt, Human
cagaaauggaauuuuccaucac

SEQ ID NO: 1115348 - RNA, 22 nt, Human
cagaggcuguguaggcagacug

SEQ ID NO: 1115349 - RNA, 22 nt, Human
aucuuccuucacuuucucccac

SEQ ID NO: 1115350 - RNA, 22 nt, Human
aaggcagccucugccagccggg

SEQ ID NO: 1115351 - RNA, 22 nt, Human
gggagggaaggaccuuaugaau

SEQ ID NO: 1115352 - RNA, 23 nt, Human
gccucuggagccccagugcucag

SEQ ID NO: 1115353 - RNA, 22 nt, Human
aggcugcaggucugggucaugu

SEQ ID NO: 1115354 - RNA, 19 nt, Human
ccuuccuccccagggccau

SEQ ID NO: 1115355 - RNA, 22 nt, Human
aggaggcccuagagcucuagag

SEQ ID NO: 1115356 - RNA, 22 nt, Human
uguggccucaaggcugcccuca

SEQ ID NO: 1115357 - RNA, 22 nt, Human
cuggcucauagagcagcuccaa

SEQ ID NO: 1115358 - RNA, 22 nt, Human
gaggaaugucagcacaggccuc

SEQ ID NO: 1115359 - RNA, 22 nt, Human
gaggccuggcugggaggaggug

SEQ ID NO: 1115360 - RNA, 22 nt, Human
aagaguuuucuauaaucuuggc

SEQ ID NO: 1115361 - RNA, 23 nt, Human
agccucuuuucuccugcccugca

SEQ ID NO: 1115362 - RNA, 22 nt, Human
aggccucagugaucaucaucag

SEQ ID NO: 1115363 - RNA, 20 nt, Human
gcucccagccugcagucccc

SEQ ID NO: 1115364 - RNA, 22 nt, Human
cacacaggagagugcuggaggu

SEQ ID NO: 1115365 - RNA, 22 nt, Human
uccuggagagugggcgagcaca

SEQ ID NO: 1115366 - RNA, 22 nt, Human
ucgagucauguucucccauuaa

SEQ ID NO: 1115367 - RNA, 22 nt, Human
cugcugcugagagcucagccug

SEQ ID NO: 1115368 - RNA, 22 nt, Human
gcugucugggaggccuccacuu

SEQ ID NO: 1115369 - RNA, 22 nt, Human
ccucugaggucauggacuuggc

SEQ ID NO: 1115370 - RNA, 22 nt, Human
agccccaggcccggacgccucu

SEQ ID NO: 1115371 - RNA, 22 nt, Human
gcugagagcaguguggccuuaa

SEQ ID NO: 1115372 - RNA, 23 nt, Human
acagcaagaggaccagaugugag

SEQ ID NO: 1115373 - RNA, 22 nt, Human
gaaaucugcggugaggccugag

SEQ ID NO: 1115374 - RNA, 18 nt, Human
uggcucugcagccagaug

SEQ ID NO: 1115375 - RNA, 22 nt, Human
uuucucugaggcuggccucccu

SEQ ID NO: 1115376 - RNA, 22 nt, Human
aaucagaauuuauugaaucuuu

SEQ ID NO: 1115377 - RNA, 19 nt, Human
cucugccucuggcuguggc

SEQ ID NO: 1115378 - RNA, 22 nt, Human
gccugcagaacugugaggcaau

SEQ ID NO: 1115379 - RNA, 22 nt, Human
cagggccucuccuccaggaacu

SEQ ID NO: 1115380 - RNA, 23 nt, Human
ugaugggaaggaacgacuaccac

SEQ ID NO: 1115381 - RNA, 22 nt, Human
uguccugcaacugaaggagaag

SEQ ID NO: 1115382 - RNA, 22 nt, Human
uuugcuauuuuucugugcagcu

SEQ ID NO: 1115383 - RNA, 22 nt, Human
ccaggaagcggugagggcugcc

SEQ ID NO: 1115384 - RNA, 22 nt, Human
guggccuuuccugaagaaauga

SEQ ID NO: 1115385 - RNA, 22 nt, Human
cucucccccacagcagccuucu

SEQ ID NO: 1115386 - RNA, 22 nt, Human
ucaggcaggcagagggcaaaug

SEQ ID NO: 1115387 - RNA, 22 nt, Human
ucuaggagcaugaagggaaggc

SEQ ID NO: 1115388 - RNA, 22 nt, Human
gugagcagaacagguggcuucu

SEQ ID NO: 1115389 - RNA, 22 nt, Human
cagccagccucucaaccaugca

SEQ ID NO: 1115390 - RNA, 22 nt, Human
ucugaggcuauguucaggcuaa

SEQ ID NO: 1115391 - RNA, 22 nt, Human
ugugaaggcagcagcucugucc

SEQ ID NO: 1115392 - RNA, 22 nt, Human
cccuggaagguucucuggcuca

SEQ ID NO: 1115393 - RNA, 22 nt, Human
cucucuggcuuggcacggagau

SEQ ID NO: 1115394 - RNA, 18 nt, Human
gccugggaggaggaaaug

SEQ ID NO: 1115395 - RNA, 22 nt, Human
uucaagauggccccagugagcc

SEQ ID NO: 1115396 - RNA, 21 nt, Human
ucaggggcuguguuuuccauc

SEQ ID NO: 1115397 - RNA, 22 nt, Human
ugucucaguacacuccgauguu

SEQ ID NO: 1115398 - RNA, 22 nt, Human
gcagggcagccacaggcccccu

SEQ ID NO: 1115399 - RNA, 22 nt, Human
guggcuucuggcugggccucag

SEQ ID NO: 1115400 - RNA, 21 nt, Human
ugcaggagucugugagucagg

SEQ ID NO: 1115401 - RNA, 19 nt, Human
acacagggcuagaguuaca

SEQ ID NO: 1115402 - RNA, 22 nt, Human
uacagucuuuggaaagagauag

SEQ ID NO: 1115403 - RNA, 22 nt, Human
cuggcagguccagcuggacuca

SEQ ID NO: 1115404 - RNA, 22 nt, Human
cuuuccuagauggccaucuuuc

SEQ ID NO: 1115405 - RNA, 22 nt, Human
ugaaguccuagaacuccuggua

SEQ ID NO: 1115406 - RNA, 22 nt, Human
gccuuccuuacaccugcucagc

SEQ ID NO: 1115407 - RNA, 22 nt, Human
caggagcagaggguggucagca

SEQ ID NO: 1115408 - RNA, 22 nt, Human
aucaguuuguauaugaaacacu

SEQ ID NO: 1115409 - RNA, 22 nt, Human
ucugucuccugccagugccucu

SEQ ID NO: 1115410 - RNA, 22 nt, Human
agggcagaaauauugauacugu

SEQ ID NO: 1115411 - RNA, 22 nt, Human
uaaguucauuagacuacagaua

SEQ ID NO: 1115412 - RNA, 22 nt, Human
cagcuugcuaauuuugacuuca

SEQ ID NO: 1115413 - RNA, 21 nt, Human
aagggagauaggaaucaggcc

SEQ ID NO: 1115414 - RNA, 22 nt, Human
guuugucuuaauuaggcaucga

SEQ ID NO: 1115415 - RNA, 22 nt, Human
gagcucaggagcaucagaagaa

SEQ ID NO: 1115416 - RNA, 22 nt, Human
aggugccagcucucaggcagga

SEQ ID NO: 1115417 - RNA, 22 nt, Human
ugaugauguuuaucuugguauu

SEQ ID NO: 1115418 - RNA, 19 nt, Human
augucccaccgccccugag

SEQ ID NO: 1115419 - RNA, 22 nt, Human
ccugagggcgccgagcucccag

SEQ ID NO: 1115420 - RNA, 22 nt, Human
ccagccagucccgcaugaccgc

SEQ ID NO: 1115421 - RNA, 22 nt, Human
agcugucuuucugccuccugau

SEQ ID NO: 1115422 - RNA, 23 nt, Human
gggagccaggaccucgcgcccca

SEQ ID NO: 1115423 - RNA, 22 nt, Human
caauguguuugcauauuaaaau

SEQ ID NO: 1115424 - RNA, 22 nt, Human
uuauuauuuuguguacagcaaa

SEQ ID NO: 1115425 - RNA, 22 nt, Human
acuuuuuacaggguguauacca

SEQ ID NO: 1115426 - RNA, 19 nt, Human
gggaugggcccucacccuc

SEQ ID NO: 1115427 - RNA, 19 nt, Human
aagcagcccuggcaagagc

SEQ ID NO: 1115428 - RNA, 22 nt, Human
aaaucaguuaagaugaggccau

SEQ ID NO: 1115429 - RNA, 22 nt, Human
aacccuggggcagcugcuaggg

SEQ ID NO: 1115430 - RNA, 19 nt, Human
ugcagccacgugagagacu

SEQ ID NO: 1115431 - RNA, 18 nt, Human
caugucugcgccacaagg

SEQ ID NO: 1115432 - RNA, 22 nt, Human
ggcugggcucgcugauuggcug

SEQ ID NO: 1115433 - RNA, 22 nt, Human
caggcacuagcagaaugaggcu

SEQ ID NO: 1115434 - RNA, 22 nt, Human
agcccaagcauaggagggaggc

SEQ ID NO: 1115435 - RNA, 20 nt, Human
gagggcaggcacccauuuca

SEQ ID NO: 1115436 - RNA, 22 nt, Human
cccagcacaggcaauuccauac

SEQ ID NO: 1115437 - RNA, 22 nt, Human
gcugucacacaugggaucucag

SEQ ID NO: 1115438 - RNA, 22 nt, Human
ucaggagaaucagggcuguccu

SEQ ID NO: 1115439 - RNA, 21 nt, Human
ccagagccugcugagcccccu

SEQ ID NO: 1115440 - RNA, 22 nt, Human
gccaggaguucagaugcauguu

SEQ ID NO: 1115441 - RNA, 22 nt, Human
aggaggccgggauucuggagau

SEQ ID NO: 1115442 - RNA, 20 nt, Human
agcccaggccugugugaguc

SEQ ID NO: 1115443 - RNA, 22 nt, Human
ucugcaggaaaaaagugccugg

SEQ ID NO: 1115444 - RNA, 22 nt, Human
gagggguguggagccaucaguu

SEQ ID NO: 1115445 - RNA, 22 nt, Human
cauuaugugggaaaauguucuu

SEQ ID NO: 1115446 - RNA, 22 nt, Human
aggagcugaaacuucucauaug

SEQ ID NO: 1115447 - RNA, 22 nt, Human
aguggcagccgagcaggagaug

SEQ ID NO: 1115448 - RNA, 22 nt, Human
uaaaugcaaugugcuuuaccag

SEQ ID NO: 1115449 - RNA, 22 nt, Human
ggcaguggguggaucucaggga

SEQ ID NO: 1115450 - RNA, 22 nt, Human
cagggcagccaggccccguggg

SEQ ID NO: 1115451 - RNA, 22 nt, Human
cuucuuuccuuccuccaguggc

SEQ ID NO: 1115452 - RNA, 22 nt, Human
cagcugccugucuggaggcaau

SEQ ID NO: 1115453 - RNA, 22 nt, Human
cccagacuccucuggcuggugg

SEQ ID NO: 1115454 - RNA, 22 nt, Human
cucacuggcaagacuacaggug

SEQ ID NO: 1115455 - RNA, 23 nt, Human
uggccucuccccaccuggcagaa

SEQ ID NO: 1115456 - RNA, 22 nt, Human
cugaaggauuuaguucuuugcu

SEQ ID NO: 1115457 - RNA, 22 nt, Human
uuuugaaagaguccugcuacag

SEQ ID NO: 1115458 - RNA, 22 nt, Human
gcccagaguucaaggcugcagu

SEQ ID NO: 1115459 - RNA, 22 nt, Human
ucacgagaggcacagaauagag

SEQ ID NO: 1115460 - RNA, 22 nt, Human
ccugugugcacacgaggccaug

SEQ ID NO: 1115461 - RNA, 22 nt, Human
ugggcucugaagucagucugcu

SEQ ID NO: 1115462 - RNA, 22 nt, Human
agccuggaccaggggccucaga

SEQ ID NO: 1115463 - RNA, 22 nt, Human
cugaggcucaagggcagguggg

SEQ ID NO: 1115464 - RNA, 22 nt, Human
auccuugacacacuccaguacu

SEQ ID NO: 1115465 - RNA, 22 nt, Human
aaaagucagucucuccuagcuc

SEQ ID NO: 1115466 - RNA, 19 nt, Human
ccuuugaaucaggacacuu

SEQ ID NO: 1115467 - RNA, 22 nt, Human
ccucugccaccucccacgaggc

SEQ ID NO: 1115468 - RNA, 22 nt, Human
uaccuuuugcuuauuaugacac

SEQ ID NO: 1115469 - RNA, 22 nt, Human
aucacaggugguaggaaaagaa

SEQ ID NO: 1115470 - RNA, 22 nt, Human
ccuggcugguggcagcgacaag

SEQ ID NO: 1115471 - RNA, 22 nt, Human
ucccagaggcaguugguaacuu

SEQ ID NO: 1115472 - RNA, 19 nt, Human
cagagcagugguuccugaa

SEQ ID NO: 1115473 - RNA, 22 nt, Human
cagggccacccucugcugggug

SEQ ID NO: 1115474 - RNA, 22 nt, Human
caaaggagguaaugggugugag

SEQ ID NO: 1115475 - RNA, 22 nt, Human
uuacuuugaugaucaaugagcg

SEQ ID NO: 1115476 - RNA, 22 nt, Human
ccaaggagaaugacaccaugga

SEQ ID NO: 1115477 - RNA, 22 nt, Human
cagccagcuggcacugugagua

SEQ ID NO: 1115478 - RNA, 19 nt, Human
gccacuccugaugcugccc

SEQ ID NO: 1115479 - RNA, 23 nt, Human
ggccauggagacuuagaaugggc

SEQ ID NO: 1115480 - RNA, 22 nt, Human
uguuccuaaauaugaauggaga

SEQ ID NO: 1115481 - RNA, 22 nt, Human
gcugguuaggugagggugcgcc

SEQ ID NO: 1115482 - RNA, 22 nt, Human
gauuucuucauucauuagaugg

SEQ ID NO: 1115483 - RNA, 18 nt, Human
ucuuggaguaaugaucaa

SEQ ID NO: 1115484 - RNA, 20 nt, Human
cagcaggaaaagugccucag

SEQ ID NO: 1115485 - RNA, 22 nt, Human
uagcagcucugauucugggccc

SEQ ID NO: 1115486 - RNA, 20 nt, Human
ggcucuggaaucuggugggc

SEQ ID NO: 1115487 - RNA, 22 nt, Human
uauugacaauuugugaaacuau

SEQ ID NO: 1115488 - RNA, 19 nt, Human
agagaggcugugugaggga

SEQ ID NO: 1115489 - RNA, 22 nt, Human
caugggcuuuggaggcuggagg

SEQ ID NO: 1115490 - RNA, 22 nt, Human
ggcaaaaacagcaaugacuuuu

SEQ ID NO: 1115491 - RNA, 23 nt, Human
ucacaggggccagcgcucugugg

SEQ ID NO: 1115492 - RNA, 19 nt, Human
guggccagggcaggggcug

SEQ ID NO: 1115493 - RNA, 22 nt, Human
uacuuuagaaggaaauaaguuc

SEQ ID NO: 1115494 - RNA, 23 nt, Human
uucuuucaagaaguucacagugc

SEQ ID NO: 1115495 - RNA, 22 nt, Human
cacucccuucaggagccuagga

SEQ ID NO: 1115496 - RNA, 22 nt, Human
ggugggcacauucagucucugu

SEQ ID NO: 1115497 - RNA, 22 nt, Human
cccuggguucuggcugggcugc

SEQ ID NO: 1115498 - RNA, 22 nt, Human
agccaggaaccagcuacagucu

SEQ ID NO: 1115499 - RNA, 22 nt, Human
cugaggccucucuccugggcuu

SEQ ID NO: 1115500 - RNA, 22 nt, Human
ugcugugcuggcggcagaggcc

SEQ ID NO: 1115501 - RNA, 22 nt, Human
cccuccccacaaagcuucacac

SEQ ID NO: 1115502 - RNA, 22 nt, Human
gcccugucggaacugcgaccuc

SEQ ID NO: 1115503 - RNA, 22 nt, Human
ucuggcuccaccuccuuuacua

SEQ ID NO: 1115504 - RNA, 22 nt, Human
ccucugcaccauagccuucagc

SEQ ID NO: 1115505 - RNA, 22 nt, Human
uucucuucuguucagugcccaa

SEQ ID NO: 1115506 - RNA, 22 nt, Human
cuggagcccugaaugggcagga

SEQ ID NO: 1115507 - RNA, 20 nt, Human
cuuccacacaagaagcacag

SEQ ID NO: 1115508 - RNA, 22 nt, Human
agaaagaacgcacuugugcugc

SEQ ID NO: 1115509 - RNA, 22 nt, Human
acccaggguagagugcaguggc

SEQ ID NO: 1115510 - RNA, 22 nt, Human
gucugcugcagagcauggcuuu

SEQ ID NO: 1115511 - RNA, 22 nt, Human
cugagaggugacagcgugcugg

SEQ ID NO: 1115512 - RNA, 22 nt, Human
gaugauuuuaugucuugucauu

SEQ ID NO: 1115513 - RNA, 22 nt, Human
ccagcucugccaagcgucagcu

SEQ ID NO: 1115514 - RNA, 22 nt, Human
uccuucagugucccgcucaggu

SEQ ID NO: 1115515 - RNA, 22 nt, Human
agaguguuuuucugucaaggac

SEQ ID NO: 1115516 - RNA, 22 nt, Human
ggcccaaggcccaggucgagcu

SEQ ID NO: 1115517 - RNA, 20 nt, Human
uggcuccugcgguggaacca

SEQ ID NO: 1115518 - RNA, 22 nt, Human
cuuccugaacaaugccaucaau

SEQ ID NO: 1115519 - RNA, 22 nt, Human
ucuggagcuggcagggcccugg

SEQ ID NO: 1115520 - RNA, 22 nt, Human
agaggccagcagugccuaucug

SEQ ID NO: 1115521 - RNA, 22 nt, Human
guuugauucaagaacaaagagu

SEQ ID NO: 1115522 - RNA, 22 nt, Human
aguguacauguuuacagcaucu

SEQ ID NO: 1115523 - RNA, 22 nt, Human
uauuacugagguuuuauggagu

SEQ ID NO: 1115524 - RNA, 22 nt, Human
gacagggcauggugcagaguuc

SEQ ID NO: 1115525 - RNA, 22 nt, Human
gcuggccugcgagggcaggcug

SEQ ID NO: 1115526 - RNA, 22 nt, Human
ugcugccaggucuugcugucca

SEQ ID NO: 1115527 - RNA, 22 nt, Human
gccucuggucccucaugcugug

SEQ ID NO: 1115528 - RNA, 22 nt, Human
guggagccaggaucuccgcaca

SEQ ID NO: 1115529 - RNA, 22 nt, Human
cccuguccuuggcugugaggcu

SEQ ID NO: 1115530 - RNA, 22 nt, Human
acuuucucaaaucagacuuuaa

SEQ ID NO: 1115531 - RNA, 22 nt, Human
aggccuggccuuuauguucaag

SEQ ID NO: 1115532 - RNA, 22 nt, Human
ggcuccugggaugggacugagc

SEQ ID NO: 1115533 - RNA, 22 nt, Human
gccagcagccacagaagucacu

SEQ ID NO: 1115534 - RNA, 22 nt, Human
gguacaaggagugaagguuugg

SEQ ID NO: 1115535 - RNA, 22 nt, Human
uuuccucuucuucccaugucau

SEQ ID NO: 1115536 - RNA, 22 nt, Human
cacaagucuguggucuccaaca

SEQ ID NO: 1115537 - RNA, 22 nt, Human
agaggcaggaagagcugauuuu

SEQ ID NO: 1115538 - RNA, 22 nt, Human
ugccaggcccugugcuggaugc

SEQ ID NO: 1115539 - RNA, 22 nt, Human
gagagcuguguucauucuacca

SEQ ID NO: 1115540 - RNA, 22 nt, Human
ggagccuuccagacugcccaca

SEQ ID NO: 1115541 - RNA, 22 nt, Human
gcauuccugagaaugcagagug

SEQ ID NO: 1115542 - RNA, 22 nt, Human
auucagcauaaucaguagcuug

SEQ ID NO: 1115543 - RNA, 22 nt, Human
uuccauaauuaaguggagagaa

SEQ ID NO: 1115544 - RNA, 17 nt, Human
ugcauuguaggcuagcc

SEQ ID NO: 1115545 - RNA, 22 nt, Human
ucacugaauacuugucucaucc

SEQ ID NO: 1115546 - RNA, 21 nt, Human
uggcucugagccucauggcug

SEQ ID NO: 1115547 - RNA, 22 nt, Human
ugggccacaagccaugggacca

SEQ ID NO: 1115548 - RNA, 22 nt, Human
cagggccucauccucagagauu

SEQ ID NO: 1115549 - RNA, 22 nt, Human
ucuguggccuguguccaagugc

SEQ ID NO: 1115550 - RNA, 22 nt, Human
ucagggcagguuaacuugggug

SEQ ID NO: 1115551 - RNA, 22 nt, Human
uuucuguagggauuucacaguu

SEQ ID NO: 1115552 - RNA, 22 nt, Human
gagagugagauaauuucacaua

SEQ ID NO: 1115553 - RNA, 22 nt, Human
gcccaggcuagcguagagugca

SEQ ID NO: 1115554 - RNA, 22 nt, Human
uguauuuucugaagauaaucaa

SEQ ID NO: 1115555 - RNA, 22 nt, Human
aggcucugguuggcaaguaaag

SEQ ID NO: 1115556 - RNA, 22 nt, Human
cugcccugacugaccuuuugaa

SEQ ID NO: 1115557 - RNA, 22 nt, Human
ucuggagagucacagugccaga

SEQ ID NO: 1115558 - RNA, 22 nt, Human
ggaggagacccugugucaguuu

SEQ ID NO: 1115559 - RNA, 20 nt, Human
cugccuggaggccucuaccu

SEQ ID NO: 1115560 - RNA, 19 nt, Human
ugacaggcuguugccuuga

SEQ ID NO: 1115561 - RNA, 22 nt, Human
ucaagagagugcugcuuggggu

SEQ ID NO: 1115562 - RNA, 19 nt, Human
augauggucccauucaccu

SEQ ID NO: 1115563 - RNA, 22 nt, Human
uuugcaaauaccaugaaacuug

SEQ ID NO: 1115564 - RNA, 22 nt, Human
gaugugagugguagcugggauu

SEQ ID NO: 1115565 - RNA, 22 nt, Human
gaccugccugagcugccucugc

SEQ ID NO: 1115566 - RNA, 22 nt, Human
acucugcuuauugcugcaggca

SEQ ID NO: 1115567 - RNA, 22 nt, Human
aaggcugagacagcacaggucc

SEQ ID NO: 1115568 - RNA, 22 nt, Human
ugcaguggaagagguggagauc

SEQ ID NO: 1115569 - RNA, 22 nt, Human
ugcucugguaacucacuuccau

SEQ ID NO: 1115570 - RNA, 22 nt, Human
caugcacuuaccugaaauucaa

SEQ ID NO: 1115571 - RNA, 22 nt, Human
agcuccuccugugccaggccag

SEQ ID NO: 1115572 - RNA, 23 nt, Human
gccaggcuccggucuguggccac

SEQ ID NO: 1115573 - RNA, 22 nt, Human
uggccuugggcagguggccugc

SEQ ID NO: 1115574 - RNA, 20 nt, Human
uccaagcccuccuuccauuc

SEQ ID NO: 1115575 - RNA, 22 nt, Human
cagcaguguacaaggugucaga

SEQ ID NO: 1115576 - RNA, 22 nt, Human
cagcugcccaggccaccuggag

SEQ ID NO: 1115577 - RNA, 22 nt, Human
uaagugcaauguuuuacuuaaa

SEQ ID NO: 1115578 - RNA, 22 nt, Human
auuguacaaugccuggaacauu

SEQ ID NO: 1115579 - RNA, 22 nt, Human
auacaaguugugauaauguaaa

SEQ ID NO: 1115580 - RNA, 22 nt, Human
ugggcacuguagcuggugcugg

SEQ ID NO: 1115581 - RNA, 22 nt, Human
aaaucugguucaguaaguccuc

SEQ ID NO: 1115582 - RNA, 22 nt, Human
gaggaagcagggcuuggcugag

SEQ ID NO: 1115583 - RNA, 22 nt, Human
cagggacaugacuggucucugu

SEQ ID NO: 1115584 - RNA, 22 nt, Human
agggaagaaaauccaucgcugc

SEQ ID NO: 1115585 - RNA, 22 nt, Human
agcugccugggcuuguacaccu

SEQ ID NO: 1115586 - RNA, 19 nt, Human
uggccagguacugucugcu

SEQ ID NO: 1115587 - RNA, 22 nt, Human
caggcuugcugcuagagcacuu

SEQ ID NO: 1115588 - RNA, 22 nt, Human
gcagccagaagacucagaacaa

SEQ ID NO: 1115589 - RNA, 22 nt, Human
ugccagaagugcuuuauaagug

SEQ ID NO: 1115590 - RNA, 22 nt, Human
ugaaagaacuagcaucuucaag

SEQ ID NO: 1115591 - RNA, 17 nt, Human
accagccucuccugggg

SEQ ID NO: 1115592 - RNA, 22 nt, Human
gcacagccagcaucugagggau

SEQ ID NO: 1115593 - RNA, 22 nt, Human
aguuuuauuccaaugugcagca

SEQ ID NO: 1115594 - RNA, 22 nt, Human
cugucucugucuuaacucccag

SEQ ID NO: 1115595 - RNA, 22 nt, Human
uggccgggccgggcgccuccac

SEQ ID NO: 1115596 - RNA, 22 nt, Human
auugaaagauaggcuacugugg

SEQ ID NO: 1115597 - RNA, 22 nt, Human
guggccugccgugugguauggg

SEQ ID NO: 1115598 - RNA, 22 nt, Human
aagcugccaaugguaagcugcu

SEQ ID NO: 1115599 - RNA, 22 nt, Human
ugauuuccacgugcacccaggu

SEQ ID NO: 1115600 - RNA, 22 nt, Human
aaggccuggauuuagguuguga

SEQ ID NO: 1115601 - RNA, 22 nt, Human
gcauuauuaauagcugcaugag

SEQ ID NO: 1115602 - RNA, 22 nt, Human
ggcucuggagacauguggagag

SEQ ID NO: 1115603 - RNA, 22 nt, Human
cucugcuuggaacuggacagaa

SEQ ID NO: 1115604 - RNA, 22 nt, Human
ccacagaaaguugucuagagua

SEQ ID NO: 1115605 - RNA, 22 nt, Human
ugccugggaaccaauccuggcu

SEQ ID NO: 1115606 - RNA, 22 nt, Human
auguagcaugaggcacugugcc

SEQ ID NO: 1115607 - RNA, 20 nt, Human
uacagaaacaggacuuuugg

SEQ ID NO: 1115608 - RNA, 22 nt, Human
ucugaggcauacccaggccccc

SEQ ID NO: 1115609 - RNA, 22 nt, Human
gggcacuguacacugugcaugg

SEQ ID NO: 1115610 - RNA, 22 nt, Human
uugacaauguccuuugaauuuc

SEQ ID NO: 1115611 - RNA, 22 nt, Human
ggcacagggagccgcaguugca

SEQ ID NO: 1115612 - RNA, 23 nt, Human
uugaaagguagcuggcagcuaga

SEQ ID NO: 1115613 - RNA, 22 nt, Human
agcucuccacacauaggacuag

SEQ ID NO: 1115614 - RNA, 22 nt, Human
ucacaccuguaaucccaggccu

SEQ ID NO: 1115615 - RNA, 22 nt, Human
gcacagaaguaaaauacaaguc

SEQ ID NO: 1115616 - RNA, 22 nt, Human
cuacauggagaagaaaauucuu

SEQ ID NO: 1115617 - RNA, 22 nt, Human
caaaguuaucaacugcaacauu

SEQ ID NO: 1115618 - RNA, 22 nt, Human
gcaggcaggagcccaacugccu

SEQ ID NO: 1115619 - RNA, 22 nt, Human
aaagauuucagaagccugugcc

SEQ ID NO: 1115620 - RNA, 22 nt, Human
aggaagccuggggcugcccucg

SEQ ID NO: 1115621 - RNA, 17 nt, Human
uuccucucacauuuuuu

SEQ ID NO: 1115622 - RNA, 22 nt, Human
agaaauguuuauggcugccuau

SEQ ID NO: 1115623 - RNA, 22 nt, Human
aagaauuauugcaauacuagau

SEQ ID NO: 1115624 - RNA, 22 nt, Human
aaauaauguuaggccuuugcuc

SEQ ID NO: 1115625 - RNA, 22 nt, Human
aagaauguggguggauaugaug

SEQ ID NO: 1115626 - RNA, 22 nt, Human
ucuggcucuauaacuccuagcu

SEQ ID NO: 1115627 - RNA, 22 nt, Human
cagacacagcaauucuguguug

SEQ ID NO: 1115628 - RNA, 22 nt, Human
agcugucuccagauacaggauu

SEQ ID NO: 1115629 - RNA, 22 nt, Human
agagcagccugugaugaugcac

SEQ ID NO: 1115630 - RNA, 22 nt, Human
ccugucuguccucucaugagcc

SEQ ID NO: 1115631 - RNA, 22 nt, Human
uuaacagagaacauagaaguag

SEQ ID NO: 1115632 - RNA, 23 nt, Human
uuuuaauuuggacauaagaagau

SEQ ID NO: 1115633 - RNA, 22 nt, Human
ugggccugacucaccugccucc

SEQ ID NO: 1115634 - RNA, 22 nt, Human
ccagagacgucggucagggcgc

SEQ ID NO: 1115635 - RNA, 22 nt, Human
auaagaaacauuauucuuucca

SEQ ID NO: 1115636 - RNA, 22 nt, Human
cuuggccucuucucaggguggg

SEQ ID NO: 1115637 - RNA, 20 nt, Human
ucaggcaguggggaaaggca

SEQ ID NO: 1115638 - RNA, 22 nt, Human
caggcacugugcaagggucucg

SEQ ID NO: 1115639 - RNA, 22 nt, Human
gcuguauuccugcacuguauag

SEQ ID NO: 1115640 - RNA, 22 nt, Human
auaaggcagugacuucaucuau

SEQ ID NO: 1115641 - RNA, 23 nt, Human
ggcuggcccggggcugcuccuga

SEQ ID NO: 1115642 - RNA, 20 nt, Human
uggagccaaggugugucugg

SEQ ID NO: 1115643 - RNA, 21 nt, Human
gcaggguccuuuccauuccua

SEQ ID NO: 1115644 - RNA, 17 nt, Human
gcugagugcagggaguc

SEQ ID NO: 1115645 - RNA, 22 nt, Human
agcugcucaggagagccagguc

SEQ ID NO: 1115646 - RNA, 22 nt, Human
ucaaaccaccuuguuacugggg

SEQ ID NO: 1115647 - RNA, 22 nt, Human
agucaguggcuccgagccuggu

SEQ ID NO: 1115648 - RNA, 22 nt, Human
ugcagcaggagccaggccuggu

SEQ ID NO: 1115649 - RNA, 22 nt, Human
acaguguccuuguggucccugu

SEQ ID NO: 1115650 - RNA, 22 nt, Human
caggggcuguggcacauggugu

SEQ ID NO: 1115651 - RNA, 22 nt, Human
ugaagccuuguguggccucucu

SEQ ID NO: 1115652 - RNA, 21 nt, Human
ccaggcuccugaggcugguca

SEQ ID NO: 1115653 - RNA, 22 nt, Human
gagauuggauuuaauggccaaa

SEQ ID NO: 1115654 - RNA, 22 nt, Human
cccagcauccucagggagcggg

SEQ ID NO: 1115655 - RNA, 22 nt, Human
gaaaaaugcuccaaaucugugg

SEQ ID NO: 1115656 - RNA, 22 nt, Human
uaaggcaccauaauauauuuaa

SEQ ID NO: 1115657 - RNA, 22 nt, Human
gggcacugugcuaggugcugag

SEQ ID NO: 1115658 - RNA, 20 nt, Human
cccuggccuguuucaugccc

SEQ ID NO: 1115659 - RNA, 22 nt, Human
augcugagacuggagcagcugg

SEQ ID NO: 1115660 - RNA, 22 nt, Human
ccagcagaagcucccgcugggu

SEQ ID NO: 1115661 - RNA, 22 nt, Human
aacaaauguguggcaguguggg

SEQ ID NO: 1115662 - RNA, 22 nt, Human
ucacaacucuuuccauuuaaua

SEQ ID NO: 1115663 - RNA, 22 nt, Human
auuauaaagaacaugugugugg

SEQ ID NO: 1115664 - RNA, 22 nt, Human
accaaggagaaggugcaagcuu

SEQ ID NO: 1115665 - RNA, 22 nt, Human
uuuccucuuccgagggggaggc

SEQ ID NO: 1115666 - RNA, 22 nt, Human
caaaguuuggcucucaugacau

SEQ ID NO: 1115667 - RNA, 22 nt, Human
ucauugcagugauguuguaugu

SEQ ID NO: 1115668 - RNA, 22 nt, Human
cuguacaucccgagagccagua

SEQ ID NO: 1115669 - RNA, 22 nt, Human
acugcaucugaaacauggguca

SEQ ID NO: 1115670 - RNA, 20 nt, Human
uccugagauuuaagggguuc

SEQ ID NO: 1115671 - RNA, 22 nt, Human
aaauugugcucacacugauauu

SEQ ID NO: 1115672 - RNA, 22 nt, Human
uagaaauguugguauuaacauu

SEQ ID NO: 1115673 - RNA, 21 nt, Human
gcagccagacgggauucaguu

SEQ ID NO: 1115674 - RNA, 22 nt, Human
uauuaguagcuugaaauuggug

SEQ ID NO: 1115675 - RNA, 22 nt, Human
cuggcagcuuagcacucugguu

SEQ ID NO: 1115676 - RNA, 22 nt, Human
ccugauggagcccugcugcaug

SEQ ID NO: 1115677 - RNA, 22 nt, Human
cugggcacaaguggcccuggau

SEQ ID NO: 1115678 - RNA, 22 nt, Human
ugcugccuucuaggcgugcccu

SEQ ID NO: 1115679 - RNA, 22 nt, Human
agccugccuugggcugcuugag

SEQ ID NO: 1115680 - RNA, 22 nt, Human
cagugcauaaucuaaauggggg

SEQ ID NO: 1115681 - RNA, 22 nt, Human
gcagggacaucuuugucuagua

SEQ ID NO: 1115682 - RNA, 22 nt, Human
ucaggacagccagggugcagac

SEQ ID NO: 1115683 - RNA, 22 nt, Human
gcucccuguucucagccaugau

SEQ ID NO: 1115684 - RNA, 22 nt, Human
aggcagagcuggguuuugaaau

SEQ ID NO: 1115685 - RNA, 22 nt, Human
aggagucauugagagggguccu

SEQ ID NO: 1115686 - RNA, 21 nt, Human
ucucuggaguuagcagagaga

SEQ ID NO: 1115687 - RNA, 22 nt, Human
auuuaugacuggugaauagaac

SEQ ID NO: 1115688 - RNA, 22 nt, Human
accagagcuggcagaguaucaa

SEQ ID NO: 1115689 - RNA, 22 nt, Human
uggagaugaauauguguaccug

SEQ ID NO: 1115690 - RNA, 22 nt, Human
uagaaagcuugggguguuuaaa

SEQ ID NO: 1115691 - RNA, 22 nt, Human
aauuuagaauucgcuagcuaau

SEQ ID NO: 1115692 - RNA, 22 nt, Human
ucccagccuuucuuuucugcug

SEQ ID NO: 1115693 - RNA, 22 nt, Human
aaaggugacugcagcagcuauu

SEQ ID NO: 1115694 - RNA, 23 nt, Human
uccucccaaauuucagccucauu

SEQ ID NO: 1115695 - RNA, 22 nt, Human
cugccgagugggucaugaggca

SEQ ID NO: 1115696 - RNA, 22 nt, Human
gcaguggauccaaugguaucuu

SEQ ID NO: 1115697 - RNA, 22 nt, Human
auggcucauuuaucuugcagcc

SEQ ID NO: 1115698 - RNA, 22 nt, Human
cagggcaguaccgcccucuggc

SEQ ID NO: 1115699 - RNA, 22 nt, Human
gggaaccagccgcuuccgccuc

SEQ ID NO: 1115700 - RNA, 22 nt, Human
gggcagggguagcauuccaagu

SEQ ID NO: 1115701 - RNA, 22 nt, Human
gcugccucugcgacucugggcg

SEQ ID NO: 1115702 - RNA, 22 nt, Human
cugccaaggcuggggaggacaa

SEQ ID NO: 1115703 - RNA, 22 nt, Human
agccagcugccuuucacaucug

SEQ ID NO: 1115704 - RNA, 22 nt, Human
aguuggagugaacaugagauug

SEQ ID NO: 1115705 - RNA, 22 nt, Human
aguucuuuugugaacauaugcu

SEQ ID NO: 1115706 - RNA, 20 nt, Human
cucugcugcccgccggcugc

SEQ ID NO: 1115707 - RNA, 22 nt, Human
ggcuccuggcaucuggugggua

SEQ ID NO: 1115708 - RNA, 22 nt, Human
ugggaugggaucucgcuguguc

SEQ ID NO: 1115709 - RNA, 22 nt, Human
agggagcucaguuggaagcggu

SEQ ID NO: 1115710 - RNA, 22 nt, Human
cccaggcuggauuucgguggca

SEQ ID NO: 1115711 - RNA, 22 nt, Human
aaguucaagcucugccuaaaau

SEQ ID NO: 1115712 - RNA, 22 nt, Human
cccagcccaucucaaaggucua

SEQ ID NO: 1115713 - RNA, 22 nt, Human
uccauuuuguagguaugcuaca

SEQ ID NO: 1115714 - RNA, 20 nt, Human
gucugaggagcagugggaaa

SEQ ID NO: 1115715 - RNA, 22 nt, Human
caggcagcugaggacuuugcua

SEQ ID NO: 1115716 - RNA, 22 nt, Human
agcugcucuugggugacuucaa

SEQ ID NO: 1115717 - RNA, 22 nt, Human
gagacaaaaguuggagugcaag

SEQ ID NO: 1115718 - RNA, 22 nt, Human
ggucccagcuggucacugucag

SEQ ID NO: 1115719 - RNA, 22 nt, Human
caggucccgccccgggcugacc

SEQ ID NO: 1115720 - RNA, 22 nt, Human
aagggccuccuggggagccugg

SEQ ID NO: 1115721 - RNA, 22 nt, Human
aauggacaggagagcauaguca

SEQ ID NO: 1115722 - RNA, 22 nt, Human
gcuguauuuauuuucuaggguu

SEQ ID NO: 1115723 - RNA, 22 nt, Human
cagucccaguuugagacucugg

SEQ ID NO: 1115724 - RNA, 22 nt, Human
aagacagaccacgugacagggc

SEQ ID NO: 1115725 - RNA, 22 nt, Human
ggagccugugggaugagaugug

SEQ ID NO: 1115726 - RNA, 22 nt, Human
aaugucugagucucuguauccc

SEQ ID NO: 1115727 - RNA, 22 nt, Human
uugaagcaggaaaauuucuauu

SEQ ID NO: 1115728 - RNA, 22 nt, Human
cuguagccagaagcagaaggcc

SEQ ID NO: 1115729 - RNA, 22 nt, Human
agugucugaaccaccggggcau

SEQ ID NO: 1115730 - RNA, 22 nt, Human
gaagaacaccugcugcccagug

SEQ ID NO: 1115731 - RNA, 22 nt, Human
gcugccagcucacucuccugag

SEQ ID NO: 1115732 - RNA, 22 nt, Human
ccugggagagucuguggucucc

SEQ ID NO: 1115733 - RNA, 22 nt, Human
gcacagcaauuucuauaagcuc

SEQ ID NO: 1115734 - RNA, 22 nt, Human
cuaaaugccuuuccuaccuaac

SEQ ID NO: 1115735 - RNA, 22 nt, Human
ccugcagagccacgugccagcg

SEQ ID NO: 1115736 - RNA, 23 nt, Human
ggcugagacuacaggcgcuugcc

SEQ ID NO: 1115737 - RNA, 22 nt, Human
cuguccugcaguugggggcagg

SEQ ID NO: 1115738 - RNA, 22 nt, Human
acugcagccuugaacucugggc

SEQ ID NO: 1115739 - RNA, 22 nt, Human
auggcagggcagccucucagag

SEQ ID NO: 1115740 - RNA, 22 nt, Human
ggagcugaugacgucaccaugg

SEQ ID NO: 1115741 - RNA, 22 nt, Human
uggucaggcugcucugcggcgu

SEQ ID NO: 1115742 - RNA, 22 nt, Human
ucugccugcaguguggcagggc

SEQ ID NO: 1115743 - RNA, 22 nt, Human
gccuggguccacugaucaugcu

SEQ ID NO: 1115744 - RNA, 22 nt, Human
agccucugcacgggcacgggug

SEQ ID NO: 1115745 - RNA, 22 nt, Human
ggucccugguucccucugagcu

SEQ ID NO: 1115746 - RNA, 22 nt, Human
gacagcagggacauguaggaag

SEQ ID NO: 1115747 - RNA, 22 nt, Human
aagagggcugcaaucuuauugc

SEQ ID NO: 1115748 - RNA, 22 nt, Human
uggccuggggaagaccaugggc

SEQ ID NO: 1115749 - RNA, 21 nt, Human
ugggcagauggcaguguggcu

SEQ ID NO: 1115750 - RNA, 22 nt, Human
uccuugaauccuagcauccuau

SEQ ID NO: 1115751 - RNA, 22 nt, Human
aguacuuuacuucuuacaguuu

SEQ ID NO: 1115752 - RNA, 22 nt, Human
agagcugcaauuucauguggug

SEQ ID NO: 1115753 - RNA, 22 nt, Human
ggagccuugggcgcucucccau

SEQ ID NO: 1115754 - RNA, 22 nt, Human
aagucagagcaacugagacauu

SEQ ID NO: 1115755 - RNA, 22 nt, Human
ggcuucugaaaucucugugcgu

SEQ ID NO: 1115756 - RNA, 22 nt, Human
ucccacucccaggcaggccucu

SEQ ID NO: 1115757 - RNA, 22 nt, Human
aggacucaucccugcuugucag

SEQ ID NO: 1115758 - RNA, 20 nt, Human
ucucugcuguccacauuugc

SEQ ID NO: 1115759 - RNA, 22 nt, Human
cccagggacagaugggcagcua

SEQ ID NO: 1115760 - RNA, 22 nt, Human
auguguauacuugugcuuacuc

SEQ ID NO: 1115761 - RNA, 22 nt, Human
aguacagaccugucucuuccug

SEQ ID NO: 1115762 - RNA, 22 nt, Human
uguggcuuaagaaugccuuuaa

SEQ ID NO: 1115763 - RNA, 22 nt, Human
uggcucagucauggaugaguaa

SEQ ID NO: 1115764 - RNA, 22 nt, Human
gaagcagcuagcccacuaguca

SEQ ID NO: 1115765 - RNA, 22 nt, Human
aggucauuuccuuagaggcaga

SEQ ID NO: 1115766 - RNA, 22 nt, Human
cccaguccuaaagcagacgcca

SEQ ID NO: 1115767 - RNA, 22 nt, Human
acagacauuuucuguauugccu

SEQ ID NO: 1115768 - RNA, 22 nt, Human
uuaaugcagaaaucaaacugac

SEQ ID NO: 1115769 - RNA, 22 nt, Human
aggcacugacucaagggagcca

SEQ ID NO: 1115770 - RNA, 22 nt, Human
agggccuggcgcguggccgccg

SEQ ID NO: 1115771 - RNA, 22 nt, Human
ugaaaucugucccacuuuagcu

SEQ ID NO: 1115772 - RNA, 22 nt, Human
acagccaggagccaugggcagg

SEQ ID NO: 1115773 - RNA, 22 nt, Human
ggcagccauacucagaccuggg

SEQ ID NO: 1115774 - RNA, 22 nt, Human
uuuccucugucaugacagcuga

SEQ ID NO: 1115775 - RNA, 22 nt, Human
cugucucucuaggacacugggg

SEQ ID NO: 1115776 - RNA, 22 nt, Human
ugguaaagaaggcuagaucuga

SEQ ID NO: 1115777 - RNA, 23 nt, Human
uggcuggcagaaacugaagcaug

SEQ ID NO: 1115778 - RNA, 22 nt, Human
ugacagggcuagaggcaaugca

SEQ ID NO: 1115779 - RNA, 22 nt, Human
acucccacuccagaguagaagc

SEQ ID NO: 1115780 - RNA, 22 nt, Human
ccaggcagagugcuccagaaag

SEQ ID NO: 1115781 - RNA, 22 nt, Human
ccagcagcgauagggugagugc

SEQ ID NO: 1115782 - RNA, 23 nt, Human
auaaggcauaaagguacauugga

SEQ ID NO: 1115783 - RNA, 22 nt, Human
gaguaagagcuggcuuuggugu

SEQ ID NO: 1115784 - RNA, 22 nt, Human
gucucagauaacauguauucua

SEQ ID NO: 1115785 - RNA, 22 nt, Human
aaugcacagcguuccaugcuug

SEQ ID NO: 1115786 - RNA, 22 nt, Human
gcucucugccauaugaggauac

SEQ ID NO: 1115787 - RNA, 22 nt, Human
uggaaagagguagaggaucugg

SEQ ID NO: 1115788 - RNA, 22 nt, Human
cucagagucugcauuucuguca

SEQ ID NO: 1115789 - RNA, 21 nt, Human
aaagaacaggcagauguucuu

SEQ ID NO: 1115790 - RNA, 22 nt, Human
gccucuggggcagcugagucau

SEQ ID NO: 1115791 - RNA, 21 nt, Human
ccucuggcuugugcugugccc

SEQ ID NO: 1115792 - RNA, 22 nt, Human
guuccuauauagccuuaaggau

SEQ ID NO: 1115793 - RNA, 22 nt, Human
ugaaaaggguagaucccuaagu

SEQ ID NO: 1115794 - RNA, 22 nt, Human
cucaccaggaacagcugcggag

SEQ ID NO: 1115795 - RNA, 22 nt, Human
ugccugucuccucugcagggug

SEQ ID NO: 1115796 - RNA, 22 nt, Human
gacagguggggaaacuaaggua

SEQ ID NO: 1115797 - RNA, 22 nt, Human
auugaaaggcaaaguaggaagc

SEQ ID NO: 1115798 - RNA, 22 nt, Human
uacaaaguuugggguccucaaa

SEQ ID NO: 1115799 - RNA, 22 nt, Human
guuauguaaucuaacacucagu

SEQ ID NO: 1115800 - RNA, 22 nt, Human
gccuaggaguacagaaugguuu

SEQ ID NO: 1115801 - RNA, 22 nt, Human
cagucccacaagaucuccacaa

SEQ ID NO: 1115802 - RNA, 22 nt, Human
caggcacuucugcugcuugucu

SEQ ID NO: 1115803 - RNA, 22 nt, Human
aguaacaagugccaacguuaga

SEQ ID NO: 1115804 - RNA, 22 nt, Human
aaggcugccucugccagaggag

SEQ ID NO: 1115805 - RNA, 22 nt, Human
gggccccaaaaugccaggcucu

SEQ ID NO: 1115806 - RNA, 18 nt, Human
gcccugguggagcuggug

SEQ ID NO: 1115807 - RNA, 22 nt, Human
augucacagucugacucaguga

SEQ ID NO: 1115808 - RNA, 22 nt, Human
cuggcagcuucaggacacucgg

SEQ ID NO: 1115809 - RNA, 22 nt, Human
uggcccgaccucugcucaugca

SEQ ID NO: 1115810 - RNA, 22 nt, Human
agguaagggucacaguucauau

SEQ ID NO: 1115811 - RNA, 22 nt, Human
caccagcagaagacugagggug

SEQ ID NO: 1115812 - RNA, 22 nt, Human
ggcacugggagaggugagacgg

SEQ ID NO: 1115813 - RNA, 22 nt, Human
acccaggccugagagacaggag

SEQ ID NO: 1115814 - RNA, 22 nt, Human
augggaggcagcagagcccagc

SEQ ID NO: 1115815 - RNA, 22 nt, Human
gggcagcugccaagugcaucgc

SEQ ID NO: 1115816 - RNA, 22 nt, Human
ugugaagcuggauccuggagcu

SEQ ID NO: 1115817 - RNA, 22 nt, Human
ucccuggguccugcuugcucuc

SEQ ID NO: 1115818 - RNA, 22 nt, Human
uuaauacagucuccagaaguaa

SEQ ID NO: 1115819 - RNA, 22 nt, Human
cccaggcuggagugcaauggug

SEQ ID NO: 1115820 - RNA, 22 nt, Human
gcagggcuguucaggagggugg

SEQ ID NO: 1115821 - RNA, 22 nt, Human
ggcaggguggcccuccagugag

SEQ ID NO: 1115822 - RNA, 21 nt, Human
aggaaguggccagauugggaa

SEQ ID NO: 1115823 - RNA, 22 nt, Human
cugagaggaugcugcaguggag

SEQ ID NO: 1115824 - RNA, 22 nt, Human
agugaggcuaauaggcaauggu

SEQ ID NO: 1115825 - RNA, 22 nt, Human
cucuggagggaggcugagcugg

SEQ ID NO: 1115826 - RNA, 22 nt, Human
ucagggcaucaucaugaauaua

SEQ ID NO: 1115827 - RNA, 22 nt, Human
gcccugagacugagcauggguu

SEQ ID NO: 1115828 - RNA, 22 nt, Human
aguauuucugcucaugaaagag

SEQ ID NO: 1115829 - RNA, 20 nt, Human
agugugcauuuagagucugc

SEQ ID NO: 1115830 - RNA, 16 nt, Human
ggagagugucugcaaa

SEQ ID NO: 1115831 - RNA, 23 nt, Human
gugauuucagggaacagaaucag

SEQ ID NO: 1115832 - RNA, 22 nt, Human
acugggccuugccauggcagcc

SEQ ID NO: 1115833 - RNA, 22 nt, Human
gccccagcucugccacaacuag

SEQ ID NO: 1115834 - RNA, 22 nt, Human
gcagaggcaaucagguaugugg

SEQ ID NO: 1115835 - RNA, 22 nt, Human
gugaggggaguaaagccauguu

SEQ ID NO: 1115836 - RNA, 22 nt, Human
acagguggaggcuuuaggaggu

SEQ ID NO: 1115837 - RNA, 22 nt, Human
uggcugcugcuuggucuucuuc

SEQ ID NO: 1115838 - RNA, 22 nt, Human
cugucacacugauaucaggcuu

SEQ ID NO: 1115839 - RNA, 19 nt, Human
cccagcuugaccaccugcu

SEQ ID NO: 1115840 - RNA, 22 nt, Human
ucucugcugagaagggcuggca

SEQ ID NO: 1115841 - RNA, 22 nt, Human
gaggccuggcugucagucccca

SEQ ID NO: 1115842 - RNA, 22 nt, Human
augcagcaguuuacaaagcaau

SEQ ID NO: 1115843 - RNA, 22 nt, Human
cagggccaaguuggugccuuuu

SEQ ID NO: 1115844 - RNA, 22 nt, Human
aaguucaaguaguguuacaugg

SEQ ID NO: 1115845 - RNA, 22 nt, Human
accagagcagacuacuggaggu

SEQ ID NO: 1115846 - RNA, 22 nt, Human
augaugguuguccuaggugcau

SEQ ID NO: 1115847 - RNA, 22 nt, Human
cugccaggacugacgucuucag

SEQ ID NO: 1115848 - RNA, 22 nt, Human
ccugccucaucaacuugucgug

SEQ ID NO: 1115849 - RNA, 22 nt, Human
gcuggaaggcuaggcucaguug

SEQ ID NO: 1115850 - RNA, 22 nt, Human
uacaugcucaguaacuuucagu

SEQ ID NO: 1115851 - RNA, 22 nt, Human
gugggaugguagguagguaaua

SEQ ID NO: 1115852 - RNA, 22 nt, Human
uggcucaguuugggggauugaa

SEQ ID NO: 1115853 - RNA, 22 nt, Human
cugggagaugacucagagcagg

SEQ ID NO: 1115854 - RNA, 22 nt, Human
ugcccuguuccugccuccagcu

SEQ ID NO: 1115855 - RNA, 22 nt, Human
aagcucugcucagcagacuagg

SEQ ID NO: 1115856 - RNA, 22 nt, Human
cacccagccuucacacaggagu

SEQ ID NO: 1115857 - RNA, 22 nt, Human
cugagguggaacagaggugaag

SEQ ID NO: 1115858 - RNA, 19 nt, Human
gggcuccuugggccucucu

SEQ ID NO: 1115859 - RNA, 19 nt, Human
gagguggguccccgcagcc

SEQ ID NO: 1115860 - RNA, 22 nt, Human
acauacauaugacaacuuuccu

SEQ ID NO: 1115861 - RNA, 22 nt, Human
acagcuguggggacucuugccc

SEQ ID NO: 1115862 - RNA, 22 nt, Human
augcaccugaacuccaucagcu

SEQ ID NO: 1115863 - RNA, 22 nt, Human
ucaaagcaucagucaauuuagg

SEQ ID NO: 1115864 - RNA, 22 nt, Human
agucccagagaggucggggcca

SEQ ID NO: 1115865 - RNA, 22 nt, Human
ucuucuccagugcuucugcaca

SEQ ID NO: 1115866 - RNA, 22 nt, Human
ccuggcaguuuugcccaggauu

SEQ ID NO: 1115867 - RNA, 22 nt, Human
ucacauuuuccuugguaucugu

SEQ ID NO: 1115868 - RNA, 22 nt, Human
uggccuggcucacagugagauu

SEQ ID NO: 1115869 - RNA, 22 nt, Human
gcagggugugucucauacaguu

SEQ ID NO: 1115870 - RNA, 22 nt, Human
uacagauacagaucuagauaca

SEQ ID NO: 1115871 - RNA, 22 nt, Human
ccuggcugcauuuugcuggaug

SEQ ID NO: 1115872 - RNA, 22 nt, Human
aagcugcccucauucccagugc

SEQ ID NO: 1115873 - RNA, 22 nt, Human
ucucagagaagugaugagcaau

SEQ ID NO: 1115874 - RNA, 22 nt, Human
uggcagaggcucugugauguug

SEQ ID NO: 1115875 - RNA, 22 nt, Human
caaauccagaucccagucguag

SEQ ID NO: 1115876 - RNA, 22 nt, Human
uaaaguuuggcagacaauaaca

SEQ ID NO: 1115877 - RNA, 19 nt, Human
cugagcagcggcagcacuu

SEQ ID NO: 1115878 - RNA, 22 nt, Human
auacauguucguguacauguuc

SEQ ID NO: 1115879 - RNA, 22 nt, Human
aaaggucagcugccaucguucu

SEQ ID NO: 1115880 - RNA, 22 nt, Human
aggaccuguagggccugcaucc

SEQ ID NO: 1115881 - RNA, 22 nt, Human
uuugcauuuuagauuuaggccu

SEQ ID NO: 1115882 - RNA, 22 nt, Human
cccuggagugccggaaucaaga

SEQ ID NO: 1115883 - RNA, 22 nt, Human
agcagagccagaauuggaccag

SEQ ID NO: 1115884 - RNA, 22 nt, Human
aacagcaauagcacuauucauu

SEQ ID NO: 1115885 - RNA, 22 nt, Human
gucagaggggcagcugccaggc

SEQ ID NO: 1115886 - RNA, 22 nt, Human
ugaagcagaggggucuugagcu

SEQ ID NO: 1115887 - RNA, 22 nt, Human
agcuugaguuuuggaugaagug

SEQ ID NO: 1115888 - RNA, 22 nt, Human
ucugagagagggucagaugcua

SEQ ID NO: 1115889 - RNA, 22 nt, Human
uggcaggggaggugcuugcuua

SEQ ID NO: 1115890 - RNA, 22 nt, Human
uauguacauggagagcaauuga

SEQ ID NO: 1115891 - RNA, 22 nt, Human
guggugcauccuugaguaagcu

SEQ ID NO: 1115892 - RNA, 22 nt, Human
aaggaaagacauauaaaugacu

SEQ ID NO: 1115893 - RNA, 22 nt, Human
ucugucugcaccuaagcacagu

SEQ ID NO: 1115894 - RNA, 22 nt, Human
uucaagaucgaguuuaaaguga

SEQ ID NO: 1115895 - RNA, 19 nt, Human
acauuuagaauguacuugc

SEQ ID NO: 1115896 - RNA, 22 nt, Human
acugcuuuagaccuagagcucu

SEQ ID NO: 1115897 - RNA, 18 nt, Human
aaguaacagaagagcaca

SEQ ID NO: 1115898 - RNA, 22 nt, Human
ugugaggagaggcccagcuccc

SEQ ID NO: 1115899 - RNA, 21 nt, Human
acaggcucuggggaugcuggg

SEQ ID NO: 1115900 - RNA, 20 nt, Human
gccugccucagcuagcugag

SEQ ID NO: 1115901 - RNA, 22 nt, Human
gcucagagaaucagcagacacc

SEQ ID NO: 1115902 - RNA, 22 nt, Human
aggauccuuuggccacuucuua

SEQ ID NO: 1115903 - RNA, 22 nt, Human
uugaaaggugaacaugaugcac

SEQ ID NO: 1115904 - RNA, 22 nt, Human
acaggugguaaaauggacuguc

SEQ ID NO: 1115905 - RNA, 22 nt, Human
ucaaacuagccugacugguauu

SEQ ID NO: 1115906 - RNA, 22 nt, Human
gggcugagggguaucucauggg

SEQ ID NO: 1115907 - RNA, 22 nt, Human
auuauguauuugguauaguuug

SEQ ID NO: 1115908 - RNA, 22 nt, Human
ugggcagagaucuggaucaaac

SEQ ID NO: 1115909 - RNA, 22 nt, Human
caggaaagggaugggcugccac

SEQ ID NO: 1115910 - RNA, 22 nt, Human
gggcuggucuggcuuagucagg

SEQ ID NO: 1115911 - RNA, 22 nt, Human
agauuucccucuuguauuugca

SEQ ID NO: 1115912 - RNA, 22 nt, Human
ccugggcuggaguacagcagug

SEQ ID NO: 1115913 - RNA, 22 nt, Human
auguaucagauaaagcaugugg

SEQ ID NO: 1115914 - RNA, 22 nt, Human
gcucccacugcagcccugagcc

SEQ ID NO: 1115915 - RNA, 22 nt, Human
auauucacugagcauaaagcca

SEQ ID NO: 1115916 - RNA, 22 nt, Human
uuccagaauuuuguucugcuug

SEQ ID NO: 1115917 - RNA, 22 nt, Human
auuguacuuuuauuacauguag

SEQ ID NO: 1115918 - RNA, 22 nt, Human
cagagccagcaguggggacagg

SEQ ID NO: 1115919 - RNA, 22 nt, Human
ugagccuggguggucgaggcug

SEQ ID NO: 1115920 - RNA, 22 nt, Human
gaaaucugcccagugcacuggu

SEQ ID NO: 1115921 - RNA, 22 nt, Human
uauuucugggaguucagaaauu

SEQ ID NO: 1115922 - RNA, 23 nt, Human
aggcacugaaugugucagugagu

SEQ ID NO: 1115923 - RNA, 22 nt, Human
uagagcaguuggcagcuguauu

SEQ ID NO: 1115924 - RNA, 22 nt, Human
uuguuuucuccacugcaucuua

SEQ ID NO: 1115925 - RNA, 22 nt, Human
ugccagggcugcuacuggcuga

SEQ ID NO: 1115926 - RNA, 22 nt, Human
ccugggagugugccaucucugu

SEQ ID NO: 1115927 - RNA, 22 nt, Human
ucccacugugaauccaaggccu

SEQ ID NO: 1115928 - RNA, 22 nt, Human
auaagagcuagucuuuuccuug

SEQ ID NO: 1115929 - RNA, 22 nt, Human
gccacccccaaguagguggucu

SEQ ID NO: 1115930 - RNA, 22 nt, Human
cagggugccuguccucagcaaa

SEQ ID NO: 1115931 - RNA, 22 nt, Human
ccuucucuacuccugaugcaug

SEQ ID NO: 1115932 - RNA, 22 nt, Human
uaucuauuccaaauaucagcgu

SEQ ID NO: 1115933 - RNA, 22 nt, Human
ucccagauuguugauggcuuaa

SEQ ID NO: 1115934 - RNA, 22 nt, Human
ugugcuucuugcagcuccugua

SEQ ID NO: 1115935 - RNA, 22 nt, Human
agcugccaaguuucucaguuua

SEQ ID NO: 1115936 - RNA, 22 nt, Human
agcagagcgccugcucagaggg

SEQ ID NO: 1115937 - RNA, 22 nt, Human
aggcacugauucucagaguuac

SEQ ID NO: 1115938 - RNA, 22 nt, Human
uaucuuuagaggaagagaaucu

SEQ ID NO: 1115939 - RNA, 18 nt, Human
gcagcugacacuggaguu

SEQ ID NO: 1115940 - RNA, 22 nt, Human
cauuucugcagaauugcucuuc

SEQ ID NO: 1115941 - RNA, 22 nt, Human
agcuggccuuagugagcaccug

SEQ ID NO: 1115942 - RNA, 22 nt, Human
gucauuguguggacauggagaa

SEQ ID NO: 1115943 - RNA, 22 nt, Human
acacagggauauuucagguggu

SEQ ID NO: 1115944 - RNA, 22 nt, Human
gaggccugguuugcaugagaau

SEQ ID NO: 1115945 - RNA, 22 nt, Human
cagggcagaaggcacucuacuc

SEQ ID NO: 1115946 - RNA, 22 nt, Human
ugccugucuuggaguccuggcc

SEQ ID NO: 1115947 - RNA, 22 nt, Human
ugcugccagccaggccauggag

SEQ ID NO: 1115948 - RNA, 22 nt, Human
gcauucaucuuccuccaugcag

SEQ ID NO: 1115949 - RNA, 22 nt, Human
uauccuuguacuauaguauuua

SEQ ID NO: 1115950 - RNA, 22 nt, Human
ucuggagccacaaaccucagcu

SEQ ID NO: 1115951 - RNA, 22 nt, Human
uaaaguucagugcaugaaugug

SEQ ID NO: 1115952 - RNA, 21 nt, Human
ugcagcugacacugguaugcc

SEQ ID NO: 1115953 - RNA, 22 nt, Human
gccuggcuccuaagagcacaac

SEQ ID NO: 1115954 - RNA, 23 nt, Human
ugcugggcagagcuggugcugag

SEQ ID NO: 1115955 - RNA, 22 nt, Human
ucugggagacguguguugucag

SEQ ID NO: 1115956 - RNA, 22 nt, Human
gagcagcuuaugucaagccaga

SEQ ID NO: 1115957 - RNA, 22 nt, Human
gagcuuccugaugccgaccagu

SEQ ID NO: 1115958 - RNA, 22 nt, Human
gcucugagccgggggccugucc

SEQ ID NO: 1115959 - RNA, 22 nt, Human
ugggcugcccaagguggccaug

SEQ ID NO: 1115960 - RNA, 22 nt, Human
aagcagcugauuucacagcuca

SEQ ID NO: 1115961 - RNA, 22 nt, Human
ccugugugucugucacugcaca

SEQ ID NO: 1115962 - RNA, 22 nt, Human
gaguguggugaacaggagcacc

SEQ ID NO: 1115963 - RNA, 22 nt, Human
aggagucauaaaugugaacaaa

SEQ ID NO: 1115964 - RNA, 21 nt, Human
ccuggcagaagccugauaugc

SEQ ID NO: 1115965 - RNA, 22 nt, Human
aaaugcaucagcucauaagaga

SEQ ID NO: 1115966 - RNA, 22 nt, Human
uggccucugcaauggauucacc

SEQ ID NO: 1115967 - RNA, 22 nt, Human
ggcucagguuaccagucccucc

SEQ ID NO: 1115968 - RNA, 22 nt, Human
ugguccugagcaccagccugac

SEQ ID NO: 1115969 - RNA, 22 nt, Human
uccagggacagcgcuggagcua

SEQ ID NO: 1115970 - RNA, 22 nt, Human
uuucuuauauucugucauuguu

SEQ ID NO: 1115971 - RNA, 22 nt, Human
ggugggcaggcgaggcccaggu

SEQ ID NO: 1115972 - RNA, 22 nt, Human
cccagccucagcuuuacuucca

SEQ ID NO: 1115973 - RNA, 21 nt, Human
gcuccuggugcugcguggcgc

SEQ ID NO: 1115974 - RNA, 22 nt, Human
ugaaaucuuuaguuucuguccc

SEQ ID NO: 1115975 - RNA, 22 nt, Human
ccacagggugucaucagcuuga

SEQ ID NO: 1115976 - RNA, 22 nt, Human
uuggccuuguuaaggaggcccu

SEQ ID NO: 1115977 - RNA, 22 nt, Human
agcagcuguggaaaaguaacua

SEQ ID NO: 1115978 - RNA, 22 nt, Human
gagccaggucgggccgcggcga

SEQ ID NO: 1115979 - RNA, 22 nt, Human
gugugcaugcauagacaccaca

SEQ ID NO: 1115980 - RNA, 22 nt, Human
aguuucuaccgguacauucagg

SEQ ID NO: 1115981 - RNA, 22 nt, Human
ggcucuggcguccaauggagcg

SEQ ID NO: 1115982 - RNA, 22 nt, Human
ucagggcagccuaaggcaccuc

SEQ ID NO: 1115983 - RNA, 22 nt, Human
gggcuugcugauuugggcagga

SEQ ID NO: 1115984 - RNA, 21 nt, Human
gggagcuggaaacugggugac

SEQ ID NO: 1115985 - RNA, 22 nt, Human
ccuggccuuaagggcagggagc

SEQ ID NO: 1115986 - RNA, 23 nt, Human
acacaauagaguacuauucagcc

SEQ ID NO: 1115987 - RNA, 22 nt, Human
caggaggcuccuagggcucugu

SEQ ID NO: 1115988 - RNA, 22 nt, Human
aagcugaggcccauggcaaggu

SEQ ID NO: 1115989 - RNA, 22 nt, Human
gccuggagcucggcugagggcg

SEQ ID NO: 1115990 - RNA, 22 nt, Human
agggcuggcaucucuaaugcug

SEQ ID NO: 1115991 - RNA, 22 nt, Human
agaggcuccuagccacuggcuu

SEQ ID NO: 1115992 - RNA, 22 nt, Human
ggcugccucaaagcucaagcuc

SEQ ID NO: 1115993 - RNA, 22 nt, Human
cucuggcuuugcucaugcaucc

SEQ ID NO: 1115994 - RNA, 22 nt, Human
agagccuggucugagauaggac

SEQ ID NO: 1115995 - RNA, 22 nt, Human
cugaggucucuuuccauaguga

SEQ ID NO: 1115996 - RNA, 22 nt, Human
ccagggugaccagcuggccuag

SEQ ID NO: 1115997 - RNA, 22 nt, Human
gccagagcaugcacugccugca

SEQ ID NO: 1115998 - RNA, 22 nt, Human
ugagccuggccugcagagacca

SEQ ID NO: 1115999 - RNA, 22 nt, Human
uucucuagguuuuagaugaaga

SEQ ID NO: 1116000 - RNA, 22 nt, Human
ucuuuccucugagcuccuguag

SEQ ID NO: 1116001 - RNA, 22 nt, Human
caugcuuugggucagaaaugcc

SEQ ID NO: 1116002 - RNA, 22 nt, Human
ccgggccucgggacaccgggua

SEQ ID NO: 1116003 - RNA, 22 nt, Human
ugaaagcuguccacuaggcugu

SEQ ID NO: 1116004 - RNA, 22 nt, Human
gaggccugucgcuaggccucug

SEQ ID NO: 1116005 - RNA, 22 nt, Human
ucuccugugcacccucccugug

SEQ ID NO: 1116006 - RNA, 22 nt, Human
cagcacugcugcuguacacaca

SEQ ID NO: 1116007 - RNA, 22 nt, Human
ucuuugcaacucccauuuccau

SEQ ID NO: 1116008 - RNA, 22 nt, Human
uuguuucugaguuuucauguau

SEQ ID NO: 1116009 - RNA, 22 nt, Human
cuuguauuccccuaucucuaaa

SEQ ID NO: 1116010 - RNA, 22 nt, Human
cuucacauguuggaguccuuug

SEQ ID NO: 1116011 - RNA, 22 nt, Human
aagcagccuggcaugaugcuuu

SEQ ID NO: 1116012 - RNA, 22 nt, Human
ccucgaccuccccaggcucagg

SEQ ID NO: 1116013 - RNA, 23 nt, Human
gccucugcagccuaguuaguguc

SEQ ID NO: 1116014 - RNA, 22 nt, Human
cugccagcaaugugaccaugcu

SEQ ID NO: 1116015 - RNA, 22 nt, Human
ugcuugagacacauaugaauuu

SEQ ID NO: 1116016 - RNA, 22 nt, Human
ucauugcagacuaacaaucuca

SEQ ID NO: 1116017 - RNA, 22 nt, Human
ucacaggacccugaggguggcg

SEQ ID NO: 1116018 - RNA, 22 nt, Human
gcugagcugggacaguccuggg

SEQ ID NO: 1116019 - RNA, 22 nt, Human
cuuauguaaaacggaaagggaa

SEQ ID NO: 1116020 - RNA, 22 nt, Human
gugcuuucugcaugguuccuac

SEQ ID NO: 1116021 - RNA, 20 nt, Human
ugcuugucaugcacucaggc

SEQ ID NO: 1116022 - RNA, 19 nt, Human
cagagcugcuggccucguc

SEQ ID NO: 1116023 - RNA, 22 nt, Human
gaggcagaggaagguggucucu

SEQ ID NO: 1116024 - RNA, 22 nt, Human
agaaaucacaggaggcagaagg

SEQ ID NO: 1116025 - RNA, 22 nt, Human
aagccucaccuuuuagaagcua

SEQ ID NO: 1116026 - RNA, 22 nt, Human
aagccaggcugcacuugcuggg

SEQ ID NO: 1116027 - RNA, 22 nt, Human
gcaguaaaaaaggauaugugca

SEQ ID NO: 1116028 - RNA, 22 nt, Human
uccuuuuuauaguuagagaaac

SEQ ID NO: 1116029 - RNA, 22 nt, Human
auuucugauaaacguaagcugc

SEQ ID NO: 1116030 - RNA, 22 nt, Human
acuuccugcagcuucucagccc

SEQ ID NO: 1116031 - RNA, 22 nt, Human
aggucauuggggacuaucuccg

SEQ ID NO: 1116032 - RNA, 22 nt, Human
accuggcaugaagcaugccuua

SEQ ID NO: 1116033 - RNA, 22 nt, Human
cuguccuggagggcauaggacg

SEQ ID NO: 1116034 - RNA, 22 nt, Human
uuuuugaaggcugaugugauua

SEQ ID NO: 1116035 - RNA, 22 nt, Human
gagccugaaauacaggucacug

SEQ ID NO: 1116036 - RNA, 22 nt, Human
uuucacaaugcaauccuacuuc

SEQ ID NO: 1116037 - RNA, 22 nt, Human
gcaggccagcugugcagauggg

SEQ ID NO: 1116038 - RNA, 22 nt, Human
cuggccuuuagccccagugucu

SEQ ID NO: 1116039 - RNA, 20 nt, Human
gggaguggugguagccugug

SEQ ID NO: 1116040 - RNA, 22 nt, Human
aaaguuagaaugauaucaacga

SEQ ID NO: 1116041 - RNA, 22 nt, Human
caggcuugggagcagagccacu

SEQ ID NO: 1116042 - RNA, 22 nt, Human
ucugggcuuuacacugugcuua

SEQ ID NO: 1116043 - RNA, 22 nt, Human
cugcugcaggaugggcacucug

SEQ ID NO: 1116044 - RNA, 22 nt, Human
uguacaauagcuauuaucucca

SEQ ID NO: 1116045 - RNA, 22 nt, Human
uccagucaucucccuucacauu

SEQ ID NO: 1116046 - RNA, 22 nt, Human
uggcucugugcuucuaguaucu

SEQ ID NO: 1116047 - RNA, 21 nt, Human
gaaaggucuuaacuuacagag

SEQ ID NO: 1116048 - RNA, 22 nt, Human
aaggcagcagugcacgacugau

SEQ ID NO: 1116049 - RNA, 22 nt, Human
ggcucugcccagaugaagagga

SEQ ID NO: 1116050 - RNA, 22 nt, Human
aaacucuggagauguuuaugca

SEQ ID NO: 1116051 - RNA, 22 nt, Human
uugcucugacuggagugcagug

SEQ ID NO: 1116052 - RNA, 22 nt, Human
ggagacagugguagggccuaag

SEQ ID NO: 1116053 - RNA, 22 nt, Human
agaaacugaauuauuucugagg

SEQ ID NO: 1116054 - RNA, 23 nt, Human
caggcaggaugaggacuacacuc

SEQ ID NO: 1116055 - RNA, 22 nt, Human
caggcacuggccagucagcaca

SEQ ID NO: 1116056 - RNA, 21 nt, Human
ucuguacaucauugagucccc

SEQ ID NO: 1116057 - RNA, 22 nt, Human
uugcacuccagcccgagcaaca

SEQ ID NO: 1116058 - RNA, 22 nt, Human
auaaacacuucuagggcacaca

SEQ ID NO: 1116059 - RNA, 22 nt, Human
cccucccaggaguggccagaga

SEQ ID NO: 1116060 - RNA, 22 nt, Human
cucccugguguccccuccagga

SEQ ID NO: 1116061 - RNA, 22 nt, Human
ugaggcagaaauuccuguuuuc

SEQ ID NO: 1116062 - RNA, 22 nt, Human
uagcagaaccagcagucaauuu

SEQ ID NO: 1116063 - RNA, 22 nt, Human
gggcuggagccagcuguggcug

SEQ ID NO: 1116064 - RNA, 22 nt, Human
gcucaggaucagccaccucuuu

SEQ ID NO: 1116065 - RNA, 22 nt, Human
uugggugcugucauggggcacg

SEQ ID NO: 1116066 - RNA, 22 nt, Human
aggcucaggcaggaauggcgga

SEQ ID NO: 1116067 - RNA, 22 nt, Human
uccugccuugccugggacauca

SEQ ID NO: 1116068 - RNA, 22 nt, Human
ccuggcagcagcacaugccuuc

SEQ ID NO: 1116069 - RNA, 22 nt, Human
acagaaauaacuuuuuauguuu

SEQ ID NO: 1116070 - RNA, 22 nt, Human
ugucccagcagcuggguucucu

SEQ ID NO: 1116071 - RNA, 22 nt, Human
aggaccaacauagcagcagugg

SEQ ID NO: 1116072 - RNA, 22 nt, Human
gcagcaugagcuauacaaagua

SEQ ID NO: 1116073 - RNA, 22 nt, Human
gaaggcuggcuuucugagagca

SEQ ID NO: 1116074 - RNA, 22 nt, Human
cccugggcagucugcacuucag

SEQ ID NO: 1116075 - RNA, 22 nt, Human
ucaucaaagcgcuuggaguagg

SEQ ID NO: 1116076 - RNA, 22 nt, Human
caauaauauccugugcuguuug

SEQ ID NO: 1116077 - RNA, 22 nt, Human
ugcacacacaugaaguagcaug

SEQ ID NO: 1116078 - RNA, 22 nt, Human
gcugcucucagagcucaugcug

SEQ ID NO: 1116079 - RNA, 22 nt, Human
aggccugaggaccagauaaaug

SEQ ID NO: 1116080 - RNA, 22 nt, Human
uccuucaguucaauuaguccgu

SEQ ID NO: 1116081 - RNA, 22 nt, Human
aaggcagccgugugacugcaug

SEQ ID NO: 1116082 - RNA, 22 nt, Human
ugcccaagcagaggagugauuc

SEQ ID NO: 1116083 - RNA, 22 nt, Human
cucugugggggagaggcagcug

SEQ ID NO: 1116084 - RNA, 22 nt, Human
uggaagccaggcccgcuccuaa

SEQ ID NO: 1116085 - RNA, 22 nt, Human
ggucucagcccucgccagcagc

SEQ ID NO: 1116086 - RNA, 22 nt, Human
aagggcuggccacauucugggu

SEQ ID NO: 1116087 - RNA, 22 nt, Human
ccugaagaugcuguggccuggu

SEQ ID NO: 1116088 - RNA, 22 nt, Human
ccacuugugaaauaaucaaaua

SEQ ID NO: 1116089 - RNA, 22 nt, Human
ccaaggagcaaggcucaacaag

SEQ ID NO: 1116090 - RNA, 22 nt, Human
ucaaaugcacguagagaaaaua

SEQ ID NO: 1116091 - RNA, 22 nt, Human
gggccuggggacaccaccauga

SEQ ID NO: 1116092 - RNA, 22 nt, Human
ggcugcuugcuguuucuuggau

SEQ ID NO: 1116093 - RNA, 21 nt, Human
ugcuccuuagcugccccugcc

SEQ ID NO: 1116094 - RNA, 22 nt, Human
ucaguuuucaauuucaucagag

SEQ ID NO: 1116095 - RNA, 22 nt, Human
gguuugcauucugaaaggcuca

SEQ ID NO: 1116096 - RNA, 22 nt, Human
agggcaaguugagugugcgugg

SEQ ID NO: 1116097 - RNA, 22 nt, Human
gccaggcagcaggaagccagug

SEQ ID NO: 1116098 - RNA, 22 nt, Human
uacaaaguuuucuuggauugag

SEQ ID NO: 1116099 - RNA, 22 nt, Human
gccaggcuggcaaaaggaaacc

SEQ ID NO: 1116100 - RNA, 23 nt, Human
gcagagcugcccuauugccuugg

SEQ ID NO: 1116101 - RNA, 22 nt, Human
cucuggagguugagcccagcaa

SEQ ID NO: 1116102 - RNA, 22 nt, Human
cuggguggaaagugcugagaau

SEQ ID NO: 1116103 - RNA, 22 nt, Human
ugggaccaagucauuucuuuag

SEQ ID NO: 1116104 - RNA, 22 nt, Human
aguagaaagaaggcacugggcc

SEQ ID NO: 1116105 - RNA, 22 nt, Human
gagauauguuagaaagcuauug

SEQ ID NO: 1116106 - RNA, 22 nt, Human
ccagggugagugucauggguua

SEQ ID NO: 1116107 - RNA, 23 nt, Human
ucucagaggauuccugggccuug

SEQ ID NO: 1116108 - RNA, 22 nt, Human
cugcuuugaggggcucuguaua

SEQ ID NO: 1116109 - RNA, 21 nt, Human
ugggagagggcucagcuaccc

SEQ ID NO: 1116110 - RNA, 22 nt, Human
guguacauagaauugugcuuug

SEQ ID NO: 1116111 - RNA, 22 nt, Human
cugugugcugaaaugcagugag

SEQ ID NO: 1116112 - RNA, 23 nt, Human
aucaagauaauccagaugaccua

SEQ ID NO: 1116113 - RNA, 23 nt, Human
uggcucagcuaguuuuccauuuc

SEQ ID NO: 1116114 - RNA, 22 nt, Human
aaucaguuaaauauugaguaca

SEQ ID NO: 1116115 - RNA, 22 nt, Human
cugucuguucagauucauuacu

SEQ ID NO: 1116116 - RNA, 22 nt, Human
cagcagagcugugugggaaggg

SEQ ID NO: 1116117 - RNA, 22 nt, Human
ucagagugaggcgucaacauga

SEQ ID NO: 1116118 - RNA, 22 nt, Human
agaugauggccauguccucucc

SEQ ID NO: 1116119 - RNA, 23 nt, Human
cuggcuccgaagacuccaggauc

SEQ ID NO: 1116120 - RNA, 22 nt, Human
gcugccugauuuacauagugaa

SEQ ID NO: 1116121 - RNA, 22 nt, Human
gccucccuggcccacagcagcg

SEQ ID NO: 1116122 - RNA, 22 nt, Human
gaugguuuaugauagaugggaa

SEQ ID NO: 1116123 - RNA, 21 nt, Human
gggccuggcugcgcaggacgg

SEQ ID NO: 1116124 - RNA, 22 nt, Human
agcuggaggggccagcaggugu

SEQ ID NO: 1116125 - RNA, 18 nt, Human
gucuggaggucaggagcu

SEQ ID NO: 1116126 - RNA, 22 nt, Human
caaaugugguuucucagcauuc

SEQ ID NO: 1116127 - RNA, 22 nt, Human
aggagcugcuuaaaugguuggu

SEQ ID NO: 1116128 - RNA, 22 nt, Human
ugggcagaauugugguaguuaa

SEQ ID NO: 1116129 - RNA, 22 nt, Human
ugaagcagagaauuugacaguc

SEQ ID NO: 1116130 - RNA, 22 nt, Human
ggaggccaaggcaggcggauca

SEQ ID NO: 1116131 - RNA, 22 nt, Human
aggcugcuuucauggccgcccc

SEQ ID NO: 1116132 - RNA, 22 nt, Human
gccagcagcccagaaggacuuu

SEQ ID NO: 1116133 - RNA, 19 nt, Human
ccugcagggaugagagguu

SEQ ID NO: 1116134 - RNA, 22 nt, Human
uaacagaagaugaaacuucuuu

SEQ ID NO: 1116135 - RNA, 22 nt, Human
cugaggagagaucacguggugu

SEQ ID NO: 1116136 - RNA, 22 nt, Human
acagaaggcggggacaaggcgg

SEQ ID NO: 1116137 - RNA, 22 nt, Human
ucugggagauccaagcagaacu

SEQ ID NO: 1116138 - RNA, 22 nt, Human
gcagggcucauucuaguacaau

SEQ ID NO: 1116139 - RNA, 22 nt, Human
ugcccaggguggagugcagcgg

SEQ ID NO: 1116140 - RNA, 22 nt, Human
uguucuugggaaucuuacaguu

SEQ ID NO: 1116141 - RNA, 22 nt, Human
gcaaagucucaagacccaagug

SEQ ID NO: 1116142 - RNA, 22 nt, Human
uuccauuguuucugucuucacu

SEQ ID NO: 1116143 - RNA, 22 nt, Human
caugggcuacagaagcaugcug

SEQ ID NO: 1116144 - RNA, 22 nt, Human
ugcugcauuuaucuucucaaac

SEQ ID NO: 1116145 - RNA, 22 nt, Human
gggcugcugccaccagguggau

SEQ ID NO: 1116146 - RNA, 22 nt, Human
gaagcucucaaacucuccccuu

SEQ ID NO: 1116147 - RNA, 19 nt, Human
gagcagcugcacccauuga

SEQ ID NO: 1116148 - RNA, 22 nt, Human
uggggcuguggauucucacgaa

SEQ ID NO: 1116149 - RNA, 22 nt, Human
uaccaggcagcugcacagaggc

SEQ ID NO: 1116150 - RNA, 22 nt, Human
gcagggcugcugaaacuuguuu

SEQ ID NO: 1116151 - RNA, 22 nt, Human
gcaggccuuggcaaugagccug

SEQ ID NO: 1116152 - RNA, 18 nt, Human
ucugucuguacaaguauc

SEQ ID NO: 1116153 - RNA, 22 nt, Human
cccaggagauggagguugcagu

SEQ ID NO: 1116154 - RNA, 22 nt, Human
cagccagggagcaaagaguuga

SEQ ID NO: 1116155 - RNA, 21 nt, Human
agggccugugcucuccagguc

SEQ ID NO: 1116156 - RNA, 22 nt, Human
uggggugguaauacaccguucu

SEQ ID NO: 1116157 - RNA, 22 nt, Human
augugcaugcacuuacaugugu

SEQ ID NO: 1116158 - RNA, 22 nt, Human
gaggcagcaaaauauaucauaa

SEQ ID NO: 1116159 - RNA, 22 nt, Human
cuggccacaacuagcccaggac

SEQ ID NO: 1116160 - RNA, 22 nt, Human
uacaguuuguuacauuguuagu

SEQ ID NO: 1116161 - RNA, 22 nt, Human
acaggccugacacacagagggc

SEQ ID NO: 1116162 - RNA, 22 nt, Human
gcagggccagugcagagaggaa

SEQ ID NO: 1116163 - RNA, 22 nt, Human
gccaggugcuaucccugcgcug

SEQ ID NO: 1116164 - RNA, 22 nt, Human
uccugaggaaaguucaugaaug

SEQ ID NO: 1116165 - RNA, 22 nt, Human
agcucagggcgaucugucucgg

SEQ ID NO: 1116166 - RNA, 22 nt, Human
gaaggaaaacagaucugccuga

SEQ ID NO: 1116167 - RNA, 22 nt, Human
cacagguguaugaauaugucca

SEQ ID NO: 1116168 - RNA, 22 nt, Human
cagucccaucucccagguggcu

SEQ ID NO: 1116169 - RNA, 22 nt, Human
acuguguccucauguggcagaa

SEQ ID NO: 1116170 - RNA, 22 nt, Human
uggccugcagaggcuguggggc

SEQ ID NO: 1116171 - RNA, 22 nt, Human
uggcccugugugcaggcugcac

SEQ ID NO: 1116172 - RNA, 22 nt, Human
acugcuuuucagagucugccug

SEQ ID NO: 1116173 - RNA, 22 nt, Human
ugcugggcuaggguggagcucu

SEQ ID NO: 1116174 - RNA, 22 nt, Human
ggaggccaucagggagggcauu

SEQ ID NO: 1116175 - RNA, 22 nt, Human
uggcccugcagaacuagccugg

SEQ ID NO: 1116176 - RNA, 22 nt, Human
aaacugaauucccaagggcaug

SEQ ID NO: 1116177 - RNA, 20 nt, Human
ccugccuguguuugugauga

SEQ ID NO: 1116178 - RNA, 22 nt, Human
cauacuuuugcccugacauucu

SEQ ID NO: 1116179 - RNA, 22 nt, Human
cucaggcccacagcagacccac

SEQ ID NO: 1116180 - RNA, 22 nt, Human
agggcagauggaacuuccccga

SEQ ID NO: 1116181 - RNA, 22 nt, Human
cagcagguauguuuguucagca

SEQ ID NO: 1116182 - RNA, 22 nt, Human
aagggcaggaaaagauggaugu

SEQ ID NO: 1116183 - RNA, 22 nt, Human
agggcugguauguccaugaaag

SEQ ID NO: 1116184 - RNA, 22 nt, Human
gcuccagguauuugcccuuuua

SEQ ID NO: 1116185 - RNA, 22 nt, Human
ccacagaguuacaaaacaguca

SEQ ID NO: 1116186 - RNA, 22 nt, Human
ccaggccaaauucagucagcag

SEQ ID NO: 1116187 - RNA, 22 nt, Human
aucaguuuuuauuaauguagcu

SEQ ID NO: 1116188 - RNA, 22 nt, Human
uguaacaguaagccugugagcu

SEQ ID NO: 1116189 - RNA, 22 nt, Human
agucucugcaugccugcugugc

SEQ ID NO: 1116190 - RNA, 22 nt, Human
uccugggaagagaccugagcau

SEQ ID NO: 1116191 - RNA, 22 nt, Human
uauaagaaacaaggcaaauuuu

SEQ ID NO: 1116192 - RNA, 22 nt, Human
auucaguuaaaaacuguacuuc

SEQ ID NO: 1116193 - RNA, 22 nt, Human
ugcccuguuaucuuggaagagu

SEQ ID NO: 1116194 - RNA, 22 nt, Human
uauucacagcugccgcacucag

SEQ ID NO: 1116195 - RNA, 22 nt, Human
aggcugaggcagguggaucacc

SEQ ID NO: 1116196 - RNA, 22 nt, Human
cagguggggagaguguggagca

SEQ ID NO: 1116197 - RNA, 19 nt, Human
accaggcuuauggucagug

SEQ ID NO: 1116198 - RNA, 22 nt, Human
aucuaggauuugaaugcacagu

SEQ ID NO: 1116199 - RNA, 22 nt, Human
cccagggcuuuucucacuagac

SEQ ID NO: 1116200 - RNA, 22 nt, Human
gcccucucuucugcagccucca

SEQ ID NO: 1116201 - RNA, 22 nt, Human
gggugcugacuggggccugaaa

SEQ ID NO: 1116202 - RNA, 22 nt, Human
cagcaguguggaagcugagggg

SEQ ID NO: 1116203 - RNA, 21 nt, Human
aggugccaaggagaagcaggc

SEQ ID NO: 1116204 - RNA, 22 nt, Human
ggugcugguucaggguggcugu

SEQ ID NO: 1116205 - RNA, 22 nt, Human
gagauguacaauguguauuaau

SEQ ID NO: 1116206 - RNA, 22 nt, Human
ccagggcagaaaaagagggaau

SEQ ID NO: 1116207 - RNA, 22 nt, Human
aagcccagaugggagcauuuca

SEQ ID NO: 1116208 - RNA, 22 nt, Human
uccugccucacaguugaaguuu

SEQ ID NO: 1116209 - RNA, 22 nt, Human
ccucccaccguaucucaguggc

SEQ ID NO: 1116210 - RNA, 20 nt, Human
gucaucgccggcagcaaaga

SEQ ID NO: 1116211 - RNA, 22 nt, Human
aguugcagacgcagagauguug

SEQ ID NO: 1116212 - RNA, 19 nt, Human
cugggagguguucagagaa

SEQ ID NO: 1116213 - RNA, 22 nt, Human
ggccuguccagccugccuggcu

SEQ ID NO: 1116214 - RNA, 22 nt, Human
gagccucguggcggccacugcg

SEQ ID NO: 1116215 - RNA, 22 nt, Human
aaagagcuucauuuccauuuau

SEQ ID NO: 1116216 - RNA, 19 nt, Human
ggccccucucacaggaguu

SEQ ID NO: 1116217 - RNA, 22 nt, Human
aucaguuuaaaugggcuguugg

SEQ ID NO: 1116218 - RNA, 22 nt, Human
gcugucacaaauauuucucagc

SEQ ID NO: 1116219 - RNA, 22 nt, Human
gagcucuggcagggcaggucug

SEQ ID NO: 1116220 - RNA, 22 nt, Human
ggccugucucacccccgggugc

SEQ ID NO: 1116221 - RNA, 22 nt, Human
ugccuuggugcuucuucaugug

SEQ ID NO: 1116222 - RNA, 22 nt, Human
cucucugguuucagcgaagggg

SEQ ID NO: 1116223 - RNA, 22 nt, Human
caggggcuagcacuuaauguuu

SEQ ID NO: 1116224 - RNA, 22 nt, Human
caaaugcauaguuuauaagaag

SEQ ID NO: 1116225 - RNA, 22 nt, Human
gagggcaguagccucguacccu

SEQ ID NO: 1116226 - RNA, 22 nt, Human
gcagcuuuuuggaugucaguua

SEQ ID NO: 1116227 - RNA, 22 nt, Human
cuguacauauacauuuuuuucc

SEQ ID NO: 1116228 - RNA, 22 nt, Human
aggugcugccccgagaaggaug

SEQ ID NO: 1116229 - RNA, 22 nt, Human
cugagccagcgggcucacuuuu

SEQ ID NO: 1116230 - RNA, 22 nt, Human
guuuucuuugaaugcuucuaga

SEQ ID NO: 1116231 - RNA, 22 nt, Human
gggacagaaggaagugagcaca

SEQ ID NO: 1116232 - RNA, 22 nt, Human
agaaauguauucuguauguuuu

SEQ ID NO: 1116233 - RNA, 22 nt, Human
cuggccuuggaagggagcccgu

SEQ ID NO: 1116234 - RNA, 22 nt, Human
ccagcuccaggacugggagcug

SEQ ID NO: 1116235 - RNA, 22 nt, Human
cugcccuggcagccuaccaugg

SEQ ID NO: 1116236 - RNA, 22 nt, Human
ccugacucuggccaggccagcu

SEQ ID NO: 1116237 - RNA, 22 nt, Human
ugauggcuaucccuggaagggc

SEQ ID NO: 1116238 - RNA, 22 nt, Human
agaaggccuaacuugggggcaa

SEQ ID NO: 1116239 - RNA, 22 nt, Human
acagaguaucuaucaggaguau

SEQ ID NO: 1116240 - RNA, 22 nt, Human
cagaggccuauccaguguccau

SEQ ID NO: 1116241 - RNA, 22 nt, Human
cugggcacauuuugacuagugu

SEQ ID NO: 1116242 - RNA, 22 nt, Human
cagugcagaacacauggaaaau

SEQ ID NO: 1116243 - RNA, 22 nt, Human
ccugagcugaacuaagcaguuu

SEQ ID NO: 1116244 - RNA, 23 nt, Human
ucugggcaccuuguugacaugau

SEQ ID NO: 1116245 - RNA, 22 nt, Human
gggcugcacagaucuucaaggg

SEQ ID NO: 1116246 - RNA, 20 nt, Human
agugucugggccucaggccc

SEQ ID NO: 1116247 - RNA, 23 nt, Human
agucaguguaaguuuggaaugca

SEQ ID NO: 1116248 - RNA, 22 nt, Human
gcagccacuuugcaaccaagag

SEQ ID NO: 1116249 - RNA, 19 nt, Human
gcugugugaccuugggcaa

SEQ ID NO: 1116250 - RNA, 22 nt, Human
gaggaugugucuggucugggca

SEQ ID NO: 1116251 - RNA, 17 nt, Human
agcugagcuggccaggg

SEQ ID NO: 1116252 - RNA, 22 nt, Human
gcucugcucuugacuuaccagg

SEQ ID NO: 1116253 - RNA, 21 nt, Human
ggcccugguuacgccuccucu

SEQ ID NO: 1116254 - RNA, 22 nt, Human
ccuaagaauuaaugaauacacc

SEQ ID NO: 1116255 - RNA, 22 nt, Human
cugcagccuccugggguacaug

SEQ ID NO: 1116256 - RNA, 22 nt, Human
aggagaaggaagugcaucacua

SEQ ID NO: 1116257 - RNA, 22 nt, Human
cagagcugggaucccaugggcg

SEQ ID NO: 1116258 - RNA, 22 nt, Human
cuuauguaugcuacuuuguggu

SEQ ID NO: 1116259 - RNA, 22 nt, Human
ucugucaggagauuggcagcug

SEQ ID NO: 1116260 - RNA, 23 nt, Human
agcagccagagauccucggcccu

SEQ ID NO: 1116261 - RNA, 22 nt, Human
caagaacauugugaucacuuca

SEQ ID NO: 1116262 - RNA, 22 nt, Human
uccugccucuugccuucuucac

SEQ ID NO: 1116263 - RNA, 22 nt, Human
acaaaaauuagcugggcauggu

SEQ ID NO: 1116264 - RNA, 22 nt, Human
agucccagugagaugagccacg

SEQ ID NO: 1116265 - RNA, 22 nt, Human
ugaagcaguucucagaaguggg

SEQ ID NO: 1116266 - RNA, 22 nt, Human
gaggucaauaauaugugcuuua

SEQ ID NO: 1116267 - RNA, 22 nt, Human
gcccagagagaugcuguagacc

SEQ ID NO: 1116268 - RNA, 22 nt, Human
ccuccuggcccugggccuggaa

SEQ ID NO: 1116269 - RNA, 22 nt, Human
ugaagacacauacaagggaaug

SEQ ID NO: 1116270 - RNA, 22 nt, Human
caaauguguaaggaaguguuag

SEQ ID NO: 1116271 - RNA, 22 nt, Human
uggccugguccuugucaaggca

SEQ ID NO: 1116272 - RNA, 22 nt, Human
ccagcagccaccuucucgaaau

SEQ ID NO: 1116273 - RNA, 22 nt, Human
caggccugauacacugaacucu

SEQ ID NO: 1116274 - RNA, 22 nt, Human
ggggggugcugaucaguggagc

SEQ ID NO: 1116275 - RNA, 22 nt, Human
ccaggcugcuguugguguccgc

SEQ ID NO: 1116276 - RNA, 22 nt, Human
aaugcugcaagaggugaaaaga

SEQ ID NO: 1116277 - RNA, 22 nt, Human
uuccaguugguagaauguaagg

SEQ ID NO: 1116278 - RNA, 22 nt, Human
agcauuuaguuaguaaauguuu

SEQ ID NO: 1116279 - RNA, 22 nt, Human
uauugucuguccgggucaaagc

SEQ ID NO: 1116280 - RNA, 22 nt, Human
ugucaccaugccagcuucugcc

SEQ ID NO: 1116281 - RNA, 22 nt, Human
ccagcucuggcuucuugcuggg

SEQ ID NO: 1116282 - RNA, 22 nt, Human
aagagcuggcucuugcagcagc

SEQ ID NO: 1116283 - RNA, 22 nt, Human
ucuggccacccgaggccccugc

SEQ ID NO: 1116284 - RNA, 22 nt, Human
ggccuguguccuccuugcccug

SEQ ID NO: 1116285 - RNA, 22 nt, Human
cccagccuuugcuuccugguuc

SEQ ID NO: 1116286 - RNA, 22 nt, Human
gccugagcccaggugugcagag

SEQ ID NO: 1116287 - RNA, 22 nt, Human
uacauuccacuagugacuggcg

SEQ ID NO: 1116288 - RNA, 20 nt, Human
gccagcccugacacaggagc

SEQ ID NO: 1116289 - RNA, 22 nt, Human
cucuggaguggguggccgggag

SEQ ID NO: 1116290 - RNA, 22 nt, Human
gcugcagcagcugcaggguugu

SEQ ID NO: 1116291 - RNA, 22 nt, Human
ggcagcagggucuagauugaug

SEQ ID NO: 1116292 - RNA, 22 nt, Human
ugcugucugcaacaguacuaca

SEQ ID NO: 1116293 - RNA, 22 nt, Human
uccuggauucugcccugaaggc

SEQ ID NO: 1116294 - RNA, 17 nt, Human
uuccccugaccaagccu

SEQ ID NO: 1116295 - RNA, 22 nt, Human
guuuuccuucucagccauugcc

SEQ ID NO: 1116296 - RNA, 22 nt, Human
cagcugccagcuucucuccauc

SEQ ID NO: 1116297 - RNA, 22 nt, Human
gcaagcuggcuguuagaggaug

SEQ ID NO: 1116298 - RNA, 22 nt, Human
cuggagcugucuucacaggccu

SEQ ID NO: 1116299 - RNA, 22 nt, Human
ggaggccaguccuggccgggcu

SEQ ID NO: 1116300 - RNA, 22 nt, Human
cagguggggcagcugugggagc

SEQ ID NO: 1116301 - RNA, 22 nt, Human
gcagacuggucuucagccuugg

SEQ ID NO: 1116302 - RNA, 22 nt, Human
cuggccaggcuugggacagaca

SEQ ID NO: 1116303 - RNA, 22 nt, Human
ccagggcaacgcugucucagag

SEQ ID NO: 1116304 - RNA, 22 nt, Human
uuccucagagggcgcuggggaa

SEQ ID NO: 1116305 - RNA, 22 nt, Human
ucugccuuggcaaccacagcuu

SEQ ID NO: 1116306 - RNA, 22 nt, Human
gccuuugcaccaucagugcaau

SEQ ID NO: 1116307 - RNA, 22 nt, Human
gcuggagcuugagaggacaggg

SEQ ID NO: 1116308 - RNA, 20 nt, Human
ccagacagcaccugccuggu

SEQ ID NO: 1116309 - RNA, 22 nt, Human
cccagaggugcuucagaggugc

SEQ ID NO: 1116310 - RNA, 22 nt, Human
uccugcugagcgucugucauuu

SEQ ID NO: 1116311 - RNA, 19 nt, Human
cucuggccucuggaugcug

SEQ ID NO: 1116312 - RNA, 22 nt, Human
uuguaacaggcacucugugcca

SEQ ID NO: 1116313 - RNA, 22 nt, Human
agauacauuaguaguuacuugu

SEQ ID NO: 1116314 - RNA, 22 nt, Human
acagagcaguucuggagcuggc

SEQ ID NO: 1116315 - RNA, 22 nt, Human
gcuccugggcucuaccuugcua

SEQ ID NO: 1116316 - RNA, 22 nt, Human
cuucuggggauggagcccagaa

SEQ ID NO: 1116317 - RNA, 22 nt, Human
gcacaugagcugcugggauggg

SEQ ID NO: 1116318 - RNA, 22 nt, Human
uuuauuugucuugccauuuagu

SEQ ID NO: 1116319 - RNA, 22 nt, Human
aucuggcucucucauuuacaaa

SEQ ID NO: 1116320 - RNA, 22 nt, Human
ggcuugcuucuuguccaggaau

SEQ ID NO: 1116321 - RNA, 22 nt, Human
ggcugugccucaaggcuacuca

SEQ ID NO: 1116322 - RNA, 22 nt, Human
cugagcugaaacuugagaggcu

SEQ ID NO: 1116323 - RNA, 22 nt, Human
ugaaagguagcuggccucauag

SEQ ID NO: 1116324 - RNA, 22 nt, Human
cugaugcuauaagccacagugg

SEQ ID NO: 1116325 - RNA, 18 nt, Human
agccuggaggguugaagu

SEQ ID NO: 1116326 - RNA, 22 nt, Human
gaaggccauugcguccugggau

SEQ ID NO: 1116327 - RNA, 22 nt, Human
ucuggagaacuugcaagaggau

SEQ ID NO: 1116328 - RNA, 22 nt, Human
cugguccuccuugccuucagau

SEQ ID NO: 1116329 - RNA, 22 nt, Human
gccuggagggucccucucugga

SEQ ID NO: 1116330 - RNA, 22 nt, Human
caguacuucuuggaaacuggau

SEQ ID NO: 1116331 - RNA, 22 nt, Human
acucagaguuugcguuccauac

SEQ ID NO: 1116332 - RNA, 22 nt, Human
auacuuuggggguuaguguaga

SEQ ID NO: 1116333 - RNA, 22 nt, Human
uuauguacucugcaauguuuga

SEQ ID NO: 1116334 - RNA, 22 nt, Human
ucauccuuuugcaugggaaggc

SEQ ID NO: 1116335 - RNA, 22 nt, Human
gcagcugguuaaugggagaauu

SEQ ID NO: 1116336 - RNA, 22 nt, Human
cacagaagaaucaugcuguguu

SEQ ID NO: 1116337 - RNA, 19 nt, Human
ccucugccagcccgccucu

SEQ ID NO: 1116338 - RNA, 22 nt, Human
gccugggaacucugaucuccug

SEQ ID NO: 1116339 - RNA, 18 nt, Human
cagaaaucacaccagcac

SEQ ID NO: 1116340 - RNA, 22 nt, Human
cucagagaaaaggagcaagggu

SEQ ID NO: 1116341 - RNA, 22 nt, Human
gcagcuuuguggagaggcccau

SEQ ID NO: 1116342 - RNA, 22 nt, Human
guuuuuccugcugacuuggguc

SEQ ID NO: 1116343 - RNA, 22 nt, Human
uaauaucuacuucauagaguuu

SEQ ID NO: 1116344 - RNA, 22 nt, Human
ugagaaagugggugccuagcaa

SEQ ID NO: 1116345 - RNA, 22 nt, Human
ccugguguugugaaguagccgu

SEQ ID NO: 1116346 - RNA, 22 nt, Human
acagguggggaggcugagguuc

SEQ ID NO: 1116347 - RNA, 22 nt, Human
uccucagggggccaacccagcc

SEQ ID NO: 1116348 - RNA, 22 nt, Human
gggagccaugcuggucuucuuu

SEQ ID NO: 1116349 - RNA, 22 nt, Human
gucccuggggaaucagcuggag

SEQ ID NO: 1116350 - RNA, 18 nt, Human
gaggccugagaaccaggu

SEQ ID NO: 1116351 - RNA, 22 nt, Human
ggagccugggcauuaguaauuu

SEQ ID NO: 1116352 - RNA, 22 nt, Human
uuuauucuugagagugagaaga

SEQ ID NO: 1116353 - RNA, 23 nt, Human
gguggcaggaguggaugcugagc

SEQ ID NO: 1116354 - RNA, 22 nt, Human
ucuguagcaagugagaggcauu

SEQ ID NO: 1116355 - RNA, 22 nt, Human
aggacuucaucaccuguauaaa

SEQ ID NO: 1116356 - RNA, 22 nt, Human
cuccagggaaaggggcguccgc

SEQ ID NO: 1116357 - RNA, 20 nt, Human
aguaggggaaugcaagagca

SEQ ID NO: 1116358 - RNA, 22 nt, Human
uuucuuccuuaccuuacuagag

SEQ ID NO: 1116359 - RNA, 22 nt, Human
gccugagagacccauggggcaa

SEQ ID NO: 1116360 - RNA, 22 nt, Human
acuucuggugucauacugcauu

SEQ ID NO: 1116361 - RNA, 22 nt, Human
gcucugucuucagcacacagua

SEQ ID NO: 1116362 - RNA, 22 nt, Human
cugggcugcagcgggagcgacg

SEQ ID NO: 1116363 - RNA, 22 nt, Human
uucucuucaucucaguaaaugu

SEQ ID NO: 1116364 - RNA, 22 nt, Human
ugcagcuucuuguccugugauu

SEQ ID NO: 1116365 - RNA, 22 nt, Human
aagcaauauacugauaugauua

SEQ ID NO: 1116366 - RNA, 22 nt, Human
ggcagcugagcauggcuaccuu

SEQ ID NO: 1116367 - RNA, 22 nt, Human
ucagccagugccuugaucuugc

SEQ ID NO: 1116368 - RNA, 20 nt, Human
uccugggguaagccaugguc

SEQ ID NO: 1116369 - RNA, 22 nt, Human
aaugcacaaaaauuguauguaa

SEQ ID NO: 1116370 - RNA, 22 nt, Human
ggugcccaccugucuuccugga

SEQ ID NO: 1116371 - RNA, 22 nt, Human
cuacauuuugugauuaugaaau

SEQ ID NO: 1116372 - RNA, 22 nt, Human
uccuucagcucucuauuuagau

SEQ ID NO: 1116373 - RNA, 22 nt, Human
ugggccuguggcuuggcucuag

SEQ ID NO: 1116374 - RNA, 22 nt, Human
agaaaacauuacauaggugugu

SEQ ID NO: 1116375 - RNA, 22 nt, Human
cacaggcugcccgcagcuggga

SEQ ID NO: 1116376 - RNA, 17 nt, Human
gggcagggacuccuggg

SEQ ID NO: 1116377 - RNA, 22 nt, Human
ccuggcagcuguuuggcuuggc

SEQ ID NO: 1116378 - RNA, 22 nt, Human
cagcaauaacucaaagccauuu

SEQ ID NO: 1116379 - RNA, 18 nt, Human
agcuggggccucuggucc

SEQ ID NO: 1116380 - RNA, 19 nt, Human
gcucagagggcccugugcu

SEQ ID NO: 1116381 - RNA, 22 nt, Human
caagaaauguuuacugagcauc

SEQ ID NO: 1116382 - RNA, 22 nt, Human
acauuucucccugcaugccugc

SEQ ID NO: 1116383 - RNA, 22 nt, Human
ugucccaggcugaaguacagug

SEQ ID NO: 1116384 - RNA, 23 nt, Human
ugacacauuuccuuuccacugca

SEQ ID NO: 1116385 - RNA, 22 nt, Human
aggcacugggaauaugcugagg

SEQ ID NO: 1116386 - RNA, 18 nt, Human
ccuggagcuccacagcaa

SEQ ID NO: 1116387 - RNA, 22 nt, Human
agcagcauucucugguaugggg

SEQ ID NO: 1116388 - RNA, 22 nt, Human
uccuucagcuacucaguuucca

SEQ ID NO: 1116389 - RNA, 22 nt, Human
ggcagcaggagccaucugguag

SEQ ID NO: 1116390 - RNA, 22 nt, Human
augggaggaucacuugaggcca

SEQ ID NO: 1116391 - RNA, 18 nt, Human
caaagcucacguuccauc

SEQ ID NO: 1116392 - RNA, 22 nt, Human
aauacaaucaaauucacuagca

SEQ ID NO: 1116393 - RNA, 22 nt, Human
aguggggacuuaugccagcauu

SEQ ID NO: 1116394 - RNA, 22 nt, Human
ugcauugcauuugucaugaaga

SEQ ID NO: 1116395 - RNA, 22 nt, Human
ccugcugggccugagcaaugag

SEQ ID NO: 1116396 - RNA, 22 nt, Human
ccacugucugcaggccucagca

SEQ ID NO: 1116397 - RNA, 21 nt, Human
agagaagggacucuuccaguc

SEQ ID NO: 1116398 - RNA, 22 nt, Human
agacaaagacagcaucucaggu

SEQ ID NO: 1116399 - RNA, 22 nt, Human
cagggccaguucucgcagcagu

SEQ ID NO: 1116400 - RNA, 22 nt, Human
ggccagaggccauccuccugcu

SEQ ID NO: 1116401 - RNA, 22 nt, Human
cuggagccggcgagccccagcc

SEQ ID NO: 1116402 - RNA, 22 nt, Human
uugcauugaugucuauacgcug

SEQ ID NO: 1116403 - RNA, 22 nt, Human
ugauuuccaugaagcugaaggc

SEQ ID NO: 1116404 - RNA, 22 nt, Human
agucccagccuaggcugugcug

SEQ ID NO: 1116405 - RNA, 22 nt, Human
agagacaggauaucugcucaug

SEQ ID NO: 1116406 - RNA, 22 nt, Human
cagccagguucaaguccuuaua

SEQ ID NO: 1116407 - RNA, 22 nt, Human
agggacacaugugauuauuuau

SEQ ID NO: 1116408 - RNA, 22 nt, Human
agcuggcuccagaaggagucgu

SEQ ID NO: 1116409 - RNA, 22 nt, Human
ccagggugggaggcugaaggcg

SEQ ID NO: 1116410 - RNA, 22 nt, Human
aaucaguuaggguguuaaugag

SEQ ID NO: 1116411 - RNA, 22 nt, Human
ggaggguuagcaaaggcacaga

SEQ ID NO: 1116412 - RNA, 22 nt, Human
aggaggugacagccugcaucug

SEQ ID NO: 1116413 - RNA, 22 nt, Human
cucccuggaggugagcuggcac

SEQ ID NO: 1116414 - RNA, 22 nt, Human
ccacugaaggucaacauagagc

SEQ ID NO: 1116415 - RNA, 22 nt, Human
ggccucugguucacagggagga

SEQ ID NO: 1116416 - RNA, 22 nt, Human
ccauuguaaagaguauacuuug

SEQ ID NO: 1116417 - RNA, 22 nt, Human
ccugagggaggguauaggcugu

SEQ ID NO: 1116418 - RNA, 22 nt, Human
auguaacuguuauauuuuguug

SEQ ID NO: 1116419 - RNA, 22 nt, Human
ucaggcugugggcacuggccau

SEQ ID NO: 1116420 - RNA, 22 nt, Human
caaauguguuuuuucuucuaca

SEQ ID NO: 1116421 - RNA, 22 nt, Human
agggcccuccccgcucagggca

SEQ ID NO: 1116422 - RNA, 22 nt, Human
ugcucacugaacucuugcuguc

SEQ ID NO: 1116423 - RNA, 22 nt, Human
aggugcagcugguggagucugg

SEQ ID NO: 1116424 - RNA, 22 nt, Human
gagugcaucguggccauuuuaa

SEQ ID NO: 1116425 - RNA, 22 nt, Human
cugagcucuaaugucagccuug

SEQ ID NO: 1116426 - RNA, 17 nt, Human
ggccuugggcugcucuu

SEQ ID NO: 1116427 - RNA, 22 nt, Human
uuaagucacuuaucuaaagaca

SEQ ID NO: 1116428 - RNA, 22 nt, Human
ucuggagccuuggaugggaaag

SEQ ID NO: 1116429 - RNA, 22 nt, Human
gucuuuauuugagauugucauu

SEQ ID NO: 1116430 - RNA, 22 nt, Human
cagggugcagugucgcugcuag

SEQ ID NO: 1116431 - RNA, 22 nt, Human
uagugaaauuuaugcacagcua

SEQ ID NO: 1116432 - RNA, 22 nt, Human
auugacaaucuacuauguucug

SEQ ID NO: 1116433 - RNA, 22 nt, Human
aucagcaaggcaaucacugcag

SEQ ID NO: 1116434 - RNA, 22 nt, Human
uacaguauuaugagugauugaa

SEQ ID NO: 1116435 - RNA, 22 nt, Human
cugcccugccuggccagugugg

SEQ ID NO: 1116436 - RNA, 22 nt, Human
agcagugggggaguguuaguuu

SEQ ID NO: 1116437 - RNA, 22 nt, Human
gcuccacuugcagcuaggcuug

SEQ ID NO: 1116438 - RNA, 22 nt, Human
cucugggcaaagaugccucauc

SEQ ID NO: 1116439 - RNA, 22 nt, Human
gccucugcaacuccgccuuggu

SEQ ID NO: 1116440 - RNA, 22 nt, Human
cuugugcauuucauuccucagg

SEQ ID NO: 1116441 - RNA, 22 nt, Human
aggccuagaggaauggccaggg

SEQ ID NO: 1116442 - RNA, 22 nt, Human
auguaucagaaauagcauuggc

SEQ ID NO: 1116443 - RNA, 22 nt, Human
cuagagggauguuaggauagca

SEQ ID NO: 1116444 - RNA, 22 nt, Human
aggagagagcugagcuuugcug

SEQ ID NO: 1116445 - RNA, 22 nt, Human
uccucugcuggaagggcaagag

SEQ ID NO: 1116446 - RNA, 22 nt, Human
ggcagaguggagugcggccucc

SEQ ID NO: 1116447 - RNA, 22 nt, Human
cagcuuggaggaggaucuaaga

SEQ ID NO: 1116448 - RNA, 22 nt, Human
gauggcagucaaccaggugagg

SEQ ID NO: 1116449 - RNA, 22 nt, Human
gaaugcacucacccaucacuca

SEQ ID NO: 1116450 - RNA, 22 nt, Human
cucaggauuuacuaauuucaag

SEQ ID NO: 1116451 - RNA, 22 nt, Human
ggcugcuguacugaugucaguu

SEQ ID NO: 1116452 - RNA, 22 nt, Human
ggcagcuccucaaaaaauuaaa

SEQ ID NO: 1116453 - RNA, 22 nt, Human
cccaagggagugccuggucaac

SEQ ID NO: 1116454 - RNA, 22 nt, Human
agaagccauguuuaguaggaug

SEQ ID NO: 1116455 - RNA, 22 nt, Human
ucuuaaaaguaugccaauugga

SEQ ID NO: 1116456 - RNA, 22 nt, Human
gucaugccuggcuucuuagaca

SEQ ID NO: 1116457 - RNA, 22 nt, Human
ucccagggacaccaagcuguuu

SEQ ID NO: 1116458 - RNA, 21 nt, Human
aggccucuucauggccaugau

SEQ ID NO: 1116459 - RNA, 22 nt, Human
cagagguacaagcuaaguuggg

SEQ ID NO: 1116460 - RNA, 22 nt, Human
gcagagcuaucuucuggauuug

SEQ ID NO: 1116461 - RNA, 22 nt, Human
ccuggagcccaaggcagugaga

SEQ ID NO: 1116462 - RNA, 21 nt, Human
ucagaguguguuacagcaagc

SEQ ID NO: 1116463 - RNA, 22 nt, Human
aaacauugcuaaauaaugcugc

SEQ ID NO: 1116464 - RNA, 22 nt, Human
uaugcacacaucgcagcaggaa

SEQ ID NO: 1116465 - RNA, 20 nt, Human
ugccagggccagcagaggcu

SEQ ID NO: 1116466 - RNA, 17 nt, Human
cucagaguugcuuuguc

SEQ ID NO: 1116467 - RNA, 19 nt, Human
aggaaagguggccuuagca

SEQ ID NO: 1116468 - RNA, 22 nt, Human
gguuggggcgagcuggaggccc

SEQ ID NO: 1116469 - RNA, 22 nt, Human
cuuucaaugugccugccuuggg

SEQ ID NO: 1116470 - RNA, 22 nt, Human
ucaggagucugugcaguuccac

SEQ ID NO: 1116471 - RNA, 22 nt, Human
uaaaauguguuucuguaugguu

SEQ ID NO: 1116472 - RNA, 22 nt, Human
aagacauuuauuugaaucaauu

SEQ ID NO: 1116473 - RNA, 22 nt, Human
aaagaacaaaugauauaugguu

SEQ ID NO: 1116474 - RNA, 22 nt, Human
agucagcagccuggccaggaga

SEQ ID NO: 1116475 - RNA, 22 nt, Human
gcuuucucuucacugauguuca

SEQ ID NO: 1116476 - RNA, 22 nt, Human
gauuucaaccuaacaguaugac

SEQ ID NO: 1116477 - RNA, 20 nt, Human
aacagggggcugcagagggc

SEQ ID NO: 1116478 - RNA, 22 nt, Human
ucaguuuuucuauacuuuguag

SEQ ID NO: 1116479 - RNA, 22 nt, Human
cccacagguccccaugaacucg

SEQ ID NO: 1116480 - RNA, 22 nt, Human
ucagcugagcuccagcucauag

SEQ ID NO: 1116481 - RNA, 22 nt, Human
uggcuuccgccgcgggccucgg

SEQ ID NO: 1116482 - RNA, 22 nt, Human
gcuugcucaacccccgucucuc

SEQ ID NO: 1116483 - RNA, 21 nt, Human
uggcucugaaagagugcugca

SEQ ID NO: 1116484 - RNA, 22 nt, Human
cagagcugucauuugccaguga

SEQ ID NO: 1116485 - RNA, 22 nt, Human
ugcugccagagagacagggacu

SEQ ID NO: 1116486 - RNA, 21 nt, Human
cacaggugggucagugaggcc

SEQ ID NO: 1116487 - RNA, 22 nt, Human
cuuccugguuugaagcucgccg

SEQ ID NO: 1116488 - RNA, 22 nt, Human
ggcugcuggggacgugggagag

SEQ ID NO: 1116489 - RNA, 22 nt, Human
aguggugcugcgcgcggagcuc

SEQ ID NO: 1116490 - RNA, 22 nt, Human
gcucugugcaguucagggacac

SEQ ID NO: 1116491 - RNA, 22 nt, Human
gaugguuuggaaugaaguagcu

SEQ ID NO: 1116492 - RNA, 22 nt, Human
gccuuggcugaugugcgaauga

SEQ ID NO: 1116493 - RNA, 22 nt, Human
ucagaagaagagacuccacagc

SEQ ID NO: 1116494 - RNA, 22 nt, Human
auucuagaugcuguaaguagca

SEQ ID NO: 1116495 - RNA, 22 nt, Human
caagaaauuucuuaagaacuaa

SEQ ID NO: 1116496 - RNA, 22 nt, Human
aggcccugcuuuccagagcuca

SEQ ID NO: 1116497 - RNA, 20 nt, Human
ccucaagcagacugacagcu

SEQ ID NO: 1116498 - RNA, 22 nt, Human
agcugagccagcagcaacagga

SEQ ID NO: 1116499 - RNA, 22 nt, Human
uggugcugacaguucugagugc

SEQ ID NO: 1116500 - RNA, 22 nt, Human
auguccuuugcuucucuggucc

SEQ ID NO: 1116501 - RNA, 21 nt, Human
gggcuggacaugguggcucau

SEQ ID NO: 1116502 - RNA, 22 nt, Human
uccaggaggaggaaggcugcca

SEQ ID NO: 1116503 - RNA, 19 nt, Human
cagaccuguccagccugug

SEQ ID NO: 1116504 - RNA, 22 nt, Human
uccaguggagugugggggugaa

SEQ ID NO: 1116505 - RNA, 22 nt, Human
ucaaaguccuugcuuuuucugu

SEQ ID NO: 1116506 - RNA, 22 nt, Human
agugaaaucagguuuugacugc

SEQ ID NO: 1116507 - RNA, 22 nt, Human
uagggcaggugaagaaaagcua

SEQ ID NO: 1116508 - RNA, 22 nt, Human
ucucaggguuuguacaagugua

SEQ ID NO: 1116509 - RNA, 22 nt, Human
aggcucagagagcuguguccau

SEQ ID NO: 1116510 - RNA, 22 nt, Human
cugcucucuguuccccuggauc

SEQ ID NO: 1116511 - RNA, 22 nt, Human
cuggcugcuuguagacucgacu

SEQ ID NO: 1116512 - RNA, 22 nt, Human
cuguacaggugaggagggggcu

SEQ ID NO: 1116513 - RNA, 22 nt, Human
ugcuccagugagcuggccaucc

SEQ ID NO: 1116514 - RNA, 22 nt, Human
gauuucaaaaguagauccauca

SEQ ID NO: 1116515 - RNA, 22 nt, Human
gccucugccaagggggcugcgg

SEQ ID NO: 1116516 - RNA, 22 nt, Human
ccaaggaggccccaggucagcu

SEQ ID NO: 1116517 - RNA, 22 nt, Human
aagauuucuuacuuauugaugc

SEQ ID NO: 1116518 - RNA, 22 nt, Human
cugcagagaauuguggggcuuc

SEQ ID NO: 1116519 - RNA, 22 nt, Human
agguggggccaaaugcuacagu

SEQ ID NO: 1116520 - RNA, 22 nt, Human
agucucagggccacccggggaa

SEQ ID NO: 1116521 - RNA, 22 nt, Human
caaagugcugagauuacaggua

SEQ ID NO: 1116522 - RNA, 22 nt, Human
ucucagagauguuagggaagag

SEQ ID NO: 1116523 - RNA, 22 nt, Human
cuuagaaauuguuacucauuca

SEQ ID NO: 1116524 - RNA, 22 nt, Human
ucccagagcucugacaccagcu

SEQ ID NO: 1116525 - RNA, 21 nt, Human
gccuggcagguggaagggcuc

SEQ ID NO: 1116526 - RNA, 22 nt, Human
aaaugcacaaaguaaguguaau

SEQ ID NO: 1116527 - RNA, 22 nt, Human
uggccuggcugcccugucugga

SEQ ID NO: 1116528 - RNA, 22 nt, Human
agccaaggagugcagguggcuu

SEQ ID NO: 1116529 - RNA, 22 nt, Human
ucucucagggggaaggcugaag

SEQ ID NO: 1116530 - RNA, 22 nt, Human
ccuuuugcucucccauccagaa

SEQ ID NO: 1116531 - RNA, 22 nt, Human
ugcugcucucagccaccaggaa

SEQ ID NO: 1116532 - RNA, 22 nt, Human
ccucuuugugccugcaggcugc

SEQ ID NO: 1116533 - RNA, 22 nt, Human
ucugagagucucugaggcagau

SEQ ID NO: 1116534 - RNA, 22 nt, Human
cagagcuguuacuauucaugaa

SEQ ID NO: 1116535 - RNA, 22 nt, Human
uaggggugaggccaggcaucag

SEQ ID NO: 1116536 - RNA, 22 nt, Human
gccugguguccagaggcgagug

SEQ ID NO: 1116537 - RNA, 22 nt, Human
gcagcugcagguggucccaugc

SEQ ID NO: 1116538 - RNA, 22 nt, Human
gacacagagauaggccuguguu

SEQ ID NO: 1116539 - RNA, 22 nt, Human
accaggcugugaagugagacua

SEQ ID NO: 1116540 - RNA, 22 nt, Human
uggccuggugucugcgaggccu

SEQ ID NO: 1116541 - RNA, 22 nt, Human
ucacagggauggaauagaaaua

SEQ ID NO: 1116542 - RNA, 22 nt, Human
cuggguggcagagccugcagug

SEQ ID NO: 1116543 - RNA, 22 nt, Human
aggcacugugcuucuuauaugu

SEQ ID NO: 1116544 - RNA, 22 nt, Human
gaaaugugaccuacuuccuugu

SEQ ID NO: 1116545 - RNA, 22 nt, Human
uuccucugaaauggcuuggaaa

SEQ ID NO: 1116546 - RNA, 22 nt, Human
cagcagggggcagcgcagauca

SEQ ID NO: 1116547 - RNA, 22 nt, Human
uggcucaguuuagcagcucagu

SEQ ID NO: 1116548 - RNA, 22 nt, Human
cagugggcugugauggauucac

SEQ ID NO: 1116549 - RNA, 22 nt, Human
aauaauguugacgauagucuua

SEQ ID NO: 1116550 - RNA, 22 nt, Human
acaaaggugcgucccuucagcu

SEQ ID NO: 1116551 - RNA, 22 nt, Human
agggagccagaguugggagcuc

SEQ ID NO: 1116552 - RNA, 22 nt, Human
cggagccugcuuguugcagcug

SEQ ID NO: 1116553 - RNA, 18 nt, Human
uccagagcuacuguggug

SEQ ID NO: 1116554 - RNA, 22 nt, Human
gagcucagauucuggugucaga

SEQ ID NO: 1116555 - RNA, 22 nt, Human
caggugggcguggcgagaaggc

SEQ ID NO: 1116556 - RNA, 22 nt, Human
agguggaacguucaggugcuag

SEQ ID NO: 1116557 - RNA, 22 nt, Human
caggaccccauauucacugaac

SEQ ID NO: 1116558 - RNA, 22 nt, Human
gccucugcccauccaccaucag

SEQ ID NO: 1116559 - RNA, 23 nt, Human
ggacagggcccugcccuauggcc

SEQ ID NO: 1116560 - RNA, 22 nt, Human
ucagggcauggcugcacuuggc

SEQ ID NO: 1116561 - RNA, 22 nt, Human
aauaugcauguauacaugugua

SEQ ID NO: 1116562 - RNA, 22 nt, Human
guaacagaaagucaugcucauu

SEQ ID NO: 1116563 - RNA, 22 nt, Human
cugcuuugcauagcugccagag

SEQ ID NO: 1116564 - RNA, 22 nt, Human
cugucccaggagcuguaagaca

SEQ ID NO: 1116565 - RNA, 22 nt, Human
cagaaauguucuaaugauucag

SEQ ID NO: 1116566 - RNA, 22 nt, Human
guacuuccagccaagugagaca

SEQ ID NO: 1116567 - RNA, 22 nt, Human
gcaaaugcuaaaguguagagac

SEQ ID NO: 1116568 - RNA, 22 nt, Human
ggcaguggaggacccugugucu

SEQ ID NO: 1116569 - RNA, 20 nt, Human
gccugagcuauugccaggau

SEQ ID NO: 1116570 - RNA, 22 nt, Human
ccuggcucucugcagauccugg

SEQ ID NO: 1116571 - RNA, 22 nt, Human
acauuucuccuacuuguuauuu

SEQ ID NO: 1116572 - RNA, 22 nt, Human
aagcagcuuaaauuagagccug

SEQ ID NO: 1116573 - RNA, 22 nt, Human
acacagccgugaaucugcuucu

SEQ ID NO: 1116574 - RNA, 22 nt, Human
aagaacauguuaaaagauucac

SEQ ID NO: 1116575 - RNA, 22 nt, Human
uggccugaauuauggcagaucu

SEQ ID NO: 1116576 - RNA, 22 nt, Human
ccugggagcuguggaaaggcug

SEQ ID NO: 1116577 - RNA, 22 nt, Human
gcugugcagguccccacugccu

SEQ ID NO: 1116578 - RNA, 22 nt, Human
ucuggcuccugaguccaugcuc

SEQ ID NO: 1116579 - RNA, 22 nt, Human
uggagccauaacccuuucguac

SEQ ID NO: 1116580 - RNA, 18 nt, Human
uucaccagugugaugggu

SEQ ID NO: 1116581 - RNA, 20 nt, Human
gugggcagaugugugcaugg

SEQ ID NO: 1116582 - RNA, 22 nt, Human
caauguguguguuuuucucaac

SEQ ID NO: 1116583 - RNA, 22 nt, Human
ugcugucaguuggcaggaugag

SEQ ID NO: 1116584 - RNA, 22 nt, Human
ugcuuuauguuaucagaagggu

SEQ ID NO: 1116585 - RNA, 22 nt, Human
ccaggggcuggugcugagcugg

SEQ ID NO: 1116586 - RNA, 22 nt, Human
acugcagccuuugggcucauaa

SEQ ID NO: 1116587 - RNA, 22 nt, Human
uggcucaguaaucgagucuccu

SEQ ID NO: 1116588 - RNA, 22 nt, Human
aagcugcccaagacugaagcau

SEQ ID NO: 1116589 - RNA, 22 nt, Human
gucccagagagcacuaguccau

SEQ ID NO: 1116590 - RNA, 22 nt, Human
uggcucugggcaccguguccac

SEQ ID NO: 1116591 - RNA, 22 nt, Human
aggcacugaagugguaaaugua

SEQ ID NO: 1116592 - RNA, 22 nt, Human
gagccuggggacccuccugagu

SEQ ID NO: 1116593 - RNA, 19 nt, Human
ccuggaggugaagguucuc

SEQ ID NO: 1116594 - RNA, 22 nt, Human
caggcagcagaggaguguggga

SEQ ID NO: 1116595 - RNA, 22 nt, Human
ucccuggcuguguucaggugcg

SEQ ID NO: 1116596 - RNA, 22 nt, Human
cuggcagguuuggugucuggug

SEQ ID NO: 1116597 - RNA, 22 nt, Human
gcuggcccagggucaccuagga

SEQ ID NO: 1116598 - RNA, 22 nt, Human
agaagcugccuacaugaccagc

SEQ ID NO: 1116599 - RNA, 22 nt, Human
uggccucugggaaagcagauuc

SEQ ID NO: 1116600 - RNA, 22 nt, Human
caggugccgggaaugcagcaau

SEQ ID NO: 1116601 - RNA, 19 nt, Human
cugccuguuauggagagaa

SEQ ID NO: 1116602 - RNA, 22 nt, Human
caggugggcuugggagaacacu

SEQ ID NO: 1116603 - RNA, 22 nt, Human
ucagggcaaugucccucagaag

SEQ ID NO: 1116604 - RNA, 22 nt, Human
ugcauuguuugauaggugaauu

SEQ ID NO: 1116605 - RNA, 22 nt, Human
agcugcccuucucuugcccuug

SEQ ID NO: 1116606 - RNA, 22 nt, Human
cugcucugcagcuuggacuccc

SEQ ID NO: 1116607 - RNA, 22 nt, Human
ugcacagagagaugagacacgu

SEQ ID NO: 1116608 - RNA, 22 nt, Human
ucugucacuuauuaagauggau

SEQ ID NO: 1116609 - RNA, 20 nt, Human
ggaccagguggggcgguggc

SEQ ID NO: 1116610 - RNA, 22 nt, Human
ggcuagaauaauugacuucauu

SEQ ID NO: 1116611 - RNA, 22 nt, Human
uaaguuuaaauguacaugaagc

SEQ ID NO: 1116612 - RNA, 22 nt, Human
ggugggcagcucuuggcaggca

SEQ ID NO: 1116613 - RNA, 22 nt, Human
guggcugcuguccucucugguu

SEQ ID NO: 1116614 - RNA, 22 nt, Human
cugaagagcucuccuguccccu

SEQ ID NO: 1116615 - RNA, 22 nt, Human
ucauuuccucaaauucaagguu

SEQ ID NO: 1116616 - RNA, 22 nt, Human
acagacagauuuugucugaugu

SEQ ID NO: 1116617 - RNA, 22 nt, Human
aggccuguuggcgugggcucua

SEQ ID NO: 1116618 - RNA, 22 nt, Human
guggccugccagcagauggcgc

SEQ ID NO: 1116619 - RNA, 17 nt, Human
agccccucagcgucacc

SEQ ID NO: 1116620 - RNA, 22 nt, Human
gucaccagugcuaagaggugga

SEQ ID NO: 1116621 - RNA, 20 nt, Human
ucacaucuggcagcugauga

SEQ ID NO: 1116622 - RNA, 22 nt, Human
aagccucuggggccucaucugu

SEQ ID NO: 1116623 - RNA, 22 nt, Human
gcuggagccauuggcuuggccu

SEQ ID NO: 1116624 - RNA, 22 nt, Human
uggcugaaucugcagcaggaag

SEQ ID NO: 1116625 - RNA, 22 nt, Human
gagccugaugaaacaggcagac

SEQ ID NO: 1116626 - RNA, 19 nt, Human
cacagggcaggucucaugu

SEQ ID NO: 1116627 - RNA, 22 nt, Human
caagaaaugggauuugacugcc

SEQ ID NO: 1116628 - RNA, 22 nt, Human
uucuucaauuauuggaaagaaa

SEQ ID NO: 1116629 - RNA, 22 nt, Human
ugcugccaccccucaccagagc

SEQ ID NO: 1116630 - RNA, 22 nt, Human
acagugaaugcccaagaaaagu

SEQ ID NO: 1116631 - RNA, 22 nt, Human
ugccaggcgugguggugcgcac

SEQ ID NO: 1116632 - RNA, 22 nt, Human
uagcugccuuugggcuccugcu

SEQ ID NO: 1116633 - RNA, 22 nt, Human
cgccugggaguccacaccugcu

SEQ ID NO: 1116634 - RNA, 22 nt, Human
cagaaguaagauuacugugaga

SEQ ID NO: 1116635 - RNA, 22 nt, Human
gauuuagagaauguuuuguaag

SEQ ID NO: 1116636 - RNA, 22 nt, Human
ugccuggcaacuguggugggcu

SEQ ID NO: 1116637 - RNA, 22 nt, Human
uugcauugaaugcacauuuuua

SEQ ID NO: 1116638 - RNA, 22 nt, Human
gcugggaggaauuuggggaaua

SEQ ID NO: 1116639 - RNA, 22 nt, Human
auucuccaucaccacuggcacu

SEQ ID NO: 1116640 - RNA, 21 nt, Human
aggcucagcagguguauaaag

SEQ ID NO: 1116641 - RNA, 22 nt, Human
ggcagagguagcuggaaccagg

SEQ ID NO: 1116642 - RNA, 22 nt, Human
cacagcugaaguagccaugugg

SEQ ID NO: 1116643 - RNA, 22 nt, Human
ggcugagcacuuuaggcaggag

SEQ ID NO: 1116644 - RNA, 22 nt, Human
ucaaaguuuuugagaauuacau

SEQ ID NO: 1116645 - RNA, 22 nt, Human
ggauggagguucucagaugcuc

SEQ ID NO: 1116646 - RNA, 19 nt, Human
ccucuccgcccaccagccc

SEQ ID NO: 1116647 - RNA, 21 nt, Human
acagcaagccuuccuuucagg

SEQ ID NO: 1116648 - RNA, 22 nt, Human
ugacagaaauaguucuuaauuu

SEQ ID NO: 1116649 - RNA, 22 nt, Human
gggguugguuuaaaugcuugag

SEQ ID NO: 1116650 - RNA, 19 nt, Human
gguaaaagugagcuucagg

SEQ ID NO: 1116651 - RNA, 22 nt, Human
uucuuuggggaauauucugguu

SEQ ID NO: 1116652 - RNA, 22 nt, Human
ugggacagggaaucugaucccc

SEQ ID NO: 1116653 - RNA, 22 nt, Human
gagcucccuggagguucagaua

SEQ ID NO: 1116654 - RNA, 22 nt, Human
gauaccagacagggagggagaa

SEQ ID NO: 1116655 - RNA, 22 nt, Human
ucuuggagacucuuguauauuu

SEQ ID NO: 1116656 - RNA, 22 nt, Human
uugaaggaggcuccuuuuuaaa

SEQ ID NO: 1116657 - RNA, 22 nt, Human
gaggggcuggcuguggucccau

SEQ ID NO: 1116658 - RNA, 19 nt, Human
ggaugagggucaggcauag

SEQ ID NO: 1116659 - RNA, 22 nt, Human
ccagggcagcgccccuccacgc

SEQ ID NO: 1116660 - RNA, 22 nt, Human
gaggggcuugaggcccugaugg

SEQ ID NO: 1116661 - RNA, 22 nt, Human
gcucugcuugcaucaugacugc

SEQ ID NO: 1116662 - RNA, 18 nt, Human
uucagcagcagacacacu

SEQ ID NO: 1116663 - RNA, 22 nt, Human
caaaaugugagucccaccucaa

SEQ ID NO: 1116664 - RNA, 22 nt, Human
ugagcccagagaucugagcuau

SEQ ID NO: 1116665 - RNA, 22 nt, Human
agaaauaugcugauuagaugaa

SEQ ID NO: 1116666 - RNA, 22 nt, Human
ugggccugaaggagcugcgccc

SEQ ID NO: 1116667 - RNA, 22 nt, Human
aucucagggcuggagcccugga

SEQ ID NO: 1116668 - RNA, 22 nt, Human
ccagcccuugcugaaggguggc

SEQ ID NO: 1116669 - RNA, 22 nt, Human
aggcaggggagcuggaagggua

SEQ ID NO: 1116670 - RNA, 22 nt, Human
ggcugccauaacugauaccaua

SEQ ID NO: 1116671 - RNA, 22 nt, Human
cccuuccucccaggcuucugug

SEQ ID NO: 1116672 - RNA, 22 nt, Human
ggccucacccaucggugccuuu

SEQ ID NO: 1116673 - RNA, 22 nt, Human
uggagcauauucuggagcuugg

SEQ ID NO: 1116674 - RNA, 22 nt, Human
acagcagcacuauugacauuuu

SEQ ID NO: 1116675 - RNA, 22 nt, Human
uggcugccuagucccucagccu

SEQ ID NO: 1116676 - RNA, 22 nt, Human
cugcugcauuccucuuuaugag

SEQ ID NO: 1116677 - RNA, 22 nt, Human
uguauuuuuaggaaugcgcuau

SEQ ID NO: 1116678 - RNA, 22 nt, Human
uccauuggucucugugcccagg

SEQ ID NO: 1116679 - RNA, 22 nt, Human
acacaguaugaaaagucuaguu

SEQ ID NO: 1116680 - RNA, 22 nt, Human
ugucccaguucccaggguugcu

SEQ ID NO: 1116681 - RNA, 22 nt, Human
gcccugggauuggguggaggcu

SEQ ID NO: 1116682 - RNA, 22 nt, Human
cugccuggccugaucuccacgc

SEQ ID NO: 1116683 - RNA, 22 nt, Human
gccaggcuggaaagaacagaca

SEQ ID NO: 1116684 - RNA, 22 nt, Human
gcucuuccauuucucuugaacu

SEQ ID NO: 1116685 - RNA, 22 nt, Human
gaagagcuauguccagggagca

SEQ ID NO: 1116686 - RNA, 22 nt, Human
auccugggcagugugucacucu

SEQ ID NO: 1116687 - RNA, 22 nt, Human
gucccugggaugcccuucuggg

SEQ ID NO: 1116688 - RNA, 22 nt, Human
aggguggggugcuacaucuuua

SEQ ID NO: 1116689 - RNA, 22 nt, Human
ucauccaguuguggagagggaa

SEQ ID NO: 1116690 - RNA, 22 nt, Human
ugaagcagcuucuuucugucaa

SEQ ID NO: 1116691 - RNA, 19 nt, Human
cagaacagaggucauggcc

SEQ ID NO: 1116692 - RNA, 22 nt, Human
caagggcucuuuugaggaaugu

SEQ ID NO: 1116693 - RNA, 22 nt, Human
gggcuggcucccagguguugaa

SEQ ID NO: 1116694 - RNA, 22 nt, Human
agacagggucuugaucagagcu

SEQ ID NO: 1116695 - RNA, 19 nt, Human
aggcagaggcuuggcuagc

SEQ ID NO: 1116696 - RNA, 22 nt, Human
acccagagccagggucaggagc

SEQ ID NO: 1116697 - RNA, 18 nt, Human
agagcagcggcaucacac

SEQ ID NO: 1116698 - RNA, 22 nt, Human
uccugggcccaggcugccaggg

SEQ ID NO: 1116699 - RNA, 22 nt, Human
gcuggccugcugggcaccaccg

SEQ ID NO: 1116700 - RNA, 22 nt, Human
gcagagcagugcuugcccagcg

SEQ ID NO: 1116701 - RNA, 22 nt, Human
cucuccagccacagaagcugcu

SEQ ID NO: 1116702 - RNA, 22 nt, Human
cugcuucuaagaaccugcagcu

SEQ ID NO: 1116703 - RNA, 20 nt, Human
ccuccuggucaggugugcag

SEQ ID NO: 1116704 - RNA, 21 nt, Human
ggccucugucauccugggaag

SEQ ID NO: 1116705 - RNA, 22 nt, Human
gcagagcugucuaagucacuuc

SEQ ID NO: 1116706 - RNA, 19 nt, Human
ucaaugcaugaaaucagcc

SEQ ID NO: 1116707 - RNA, 20 nt, Human
cacguuuuuccacuagcaaa

SEQ ID NO: 1116708 - RNA, 22 nt, Human
uccugagauucugcauuucuaa

SEQ ID NO: 1116709 - RNA, 22 nt, Human
gccugagagucugcauuucuaa

SEQ ID NO: 1116710 - RNA, 22 nt, Human
aauuccugucuuaacaguucug

SEQ ID NO: 1116711 - RNA, 18 nt, Human
cccacggugcuguagggc

SEQ ID NO: 1116712 - RNA, 22 nt, Human
ccagcugggauuaagggaaaau

SEQ ID NO: 1116713 - RNA, 22 nt, Human
ucugucacugagcucaggauuc

SEQ ID NO: 1116714 - RNA, 22 nt, Human
cccugccucugaagcugcucag

SEQ ID NO: 1116715 - RNA, 23 nt, Human
ugcugguguuuuugggaccaggg

SEQ ID NO: 1116716 - RNA, 22 nt, Human
gcaggcagagagggguuuccag

SEQ ID NO: 1116717 - RNA, 22 nt, Human
ucaguauccacaaaugcucaaa

SEQ ID NO: 1116718 - RNA, 22 nt, Human
aaaguggucaccuucucauuuc

SEQ ID NO: 1116719 - RNA, 22 nt, Human
gcaggagucacugacuuggucc

SEQ ID NO: 1116720 - RNA, 22 nt, Human
cagagccaggccugcccucuuu

SEQ ID NO: 1116721 - RNA, 22 nt, Human
ggccucugcaacuggcuguggc

SEQ ID NO: 1116722 - RNA, 22 nt, Human
gcuggcucagggacuagaguuu

SEQ ID NO: 1116723 - RNA, 22 nt, Human
ccugggugaugugcugcccucg

SEQ ID NO: 1116724 - RNA, 22 nt, Human
guucaaagcuccugguacagua

SEQ ID NO: 1116725 - RNA, 22 nt, Human
ggccaggaagggaagaucagca

SEQ ID NO: 1116726 - RNA, 22 nt, Human
gaggcugccccuuccucagcug

SEQ ID NO: 1116727 - RNA, 22 nt, Human
aguggggaagagcaugggcccu

SEQ ID NO: 1116728 - RNA, 22 nt, Human
gagaaagcuucuuucccacagg

SEQ ID NO: 1116729 - RNA, 22 nt, Human
uggaaagacauucagccgcugg

SEQ ID NO: 1116730 - RNA, 22 nt, Human
acacuuuguuguggcauauacg

SEQ ID NO: 1116731 - RNA, 22 nt, Human
ccuauugacaauucucuucucc

SEQ ID NO: 1116732 - RNA, 22 nt, Human
guggguggaucaccugagguca

SEQ ID NO: 1116733 - RNA, 22 nt, Human
gcugccuggaauaacggcuggc

SEQ ID NO: 1116734 - RNA, 22 nt, Human
guuagaaacacauucuuauuga

SEQ ID NO: 1116735 - RNA, 22 nt, Human
ggucucaggagacuggagagca

SEQ ID NO: 1116736 - RNA, 22 nt, Human
accugccuaguugguucugccc

SEQ ID NO: 1116737 - RNA, 22 nt, Human
gcuggccugcaaagcccggcug

SEQ ID NO: 1116738 - RNA, 22 nt, Human
agugcagccgagaucaggugcu

SEQ ID NO: 1116739 - RNA, 22 nt, Human
acaaaguuugugguauuccaag

SEQ ID NO: 1116740 - RNA, 21 nt, Human
ugaggcuguuguaccagggag

SEQ ID NO: 1116741 - RNA, 22 nt, Human
agugaaauaaagcugccuaugg

SEQ ID NO: 1116742 - RNA, 22 nt, Human
gaagagcuaaaggcacaggcuu

SEQ ID NO: 1116743 - RNA, 22 nt, Human
ugagguggcuagggaggcacuc

SEQ ID NO: 1116744 - RNA, 22 nt, Human
cuguaauucacuagggucagcg

SEQ ID NO: 1116745 - RNA, 22 nt, Human
uggguagagcaggcuggggcuu

SEQ ID NO: 1116746 - RNA, 22 nt, Human
uguagcacagagcuuugacacu

SEQ ID NO: 1116747 - RNA, 22 nt, Human
agaugcugccucuccucacaag

SEQ ID NO: 1116748 - RNA, 21 nt, Human
gcccagcaaggugagaaggcc

SEQ ID NO: 1116749 - RNA, 22 nt, Human
gccaggcauuuguuaggugcug

SEQ ID NO: 1116750 - RNA, 21 nt, Human
agagaagaggacuuucucaca

SEQ ID NO: 1116751 - RNA, 22 nt, Human
ugcaagaggaauucuagaagca

SEQ ID NO: 1116752 - RNA, 22 nt, Human
ggcagcaggcgacuucccuauu

SEQ ID NO: 1116753 - RNA, 22 nt, Human
agguggggaggagugucucuuu

SEQ ID NO: 1116754 - RNA, 22 nt, Human
agcaggugaauuccuggaugug

SEQ ID NO: 1116755 - RNA, 22 nt, Human
gcaccugcaggaugagccaggg

SEQ ID NO: 1116756 - RNA, 22 nt, Human
augugaaacugaagcauccaua

SEQ ID NO: 1116757 - RNA, 22 nt, Human
ggcugcagagcugggugggccu

SEQ ID NO: 1116758 - RNA, 22 nt, Human
uugaagcaaauucugugcagua

SEQ ID NO: 1116759 - RNA, 22 nt, Human
uaaacaugugagugugcauaua

SEQ ID NO: 1116760 - RNA, 22 nt, Human
aguguggguuuuauggagcccu

SEQ ID NO: 1116761 - RNA, 22 nt, Human
gccagguggucuggcuccagag

SEQ ID NO: 1116762 - RNA, 22 nt, Human
aagcacagaaaaggagcaugga

SEQ ID NO: 1116763 - RNA, 19 nt, Human
ccugggaggcggagguugc

SEQ ID NO: 1116764 - RNA, 22 nt, Human
aucuuucagagcuccaucaggg

SEQ ID NO: 1116765 - RNA, 22 nt, Human
uggcagcugaggggaggcuuug

SEQ ID NO: 1116766 - RNA, 22 nt, Human
ucccagcgcggggggaggaucc

SEQ ID NO: 1116767 - RNA, 22 nt, Human
cugagagccuccuguuggcuag

SEQ ID NO: 1116768 - RNA, 22 nt, Human
aguguccaacucagcuugucaa

SEQ ID NO: 1116769 - RNA, 22 nt, Human
ucucuuucuauugcaccaugcu

SEQ ID NO: 1116770 - RNA, 18 nt, Human
uaaaugcauguuaauaac

SEQ ID NO: 1116771 - RNA, 22 nt, Human
cuggccugugggcugucuccgg

SEQ ID NO: 1116772 - RNA, 22 nt, Human
gcucagagcacucagacucagc

SEQ ID NO: 1116773 - RNA, 22 nt, Human
uggcagcuccuggggccagcac

SEQ ID NO: 1116774 - RNA, 22 nt, Human
ggaggccaaggcgggcggauca

SEQ ID NO: 1116775 - RNA, 22 nt, Human
gcucugcuggagggaaagagaa

SEQ ID NO: 1116776 - RNA, 22 nt, Human
cucaggauagauuguccucuca

SEQ ID NO: 1116777 - RNA, 22 nt, Human
gcccucagcuccuggacacaug

SEQ ID NO: 1116778 - RNA, 18 nt, Human
caguuuuuauaucuggca

SEQ ID NO: 1116779 - RNA, 22 nt, Human
auguaguguagagauuagucuc

SEQ ID NO: 1116780 - RNA, 22 nt, Human
agcucuggaauaaugaugugau

SEQ ID NO: 1116781 - RNA, 20 nt, Human
aauaaaagaagccuucaccc

SEQ ID NO: 1116782 - RNA, 22 nt, Human
gggaaauugucaacacucucaa

SEQ ID NO: 1116783 - RNA, 22 nt, Human
ugaagcaggugaauggaugucg

SEQ ID NO: 1116784 - RNA, 22 nt, Human
aaugcuguauaucuuagcuaau

SEQ ID NO: 1116785 - RNA, 22 nt, Human
ccaggagguggagauugcagug

SEQ ID NO: 1116786 - RNA, 22 nt, Human
ucccaggcuaggccucugcguu

SEQ ID NO: 1116787 - RNA, 23 nt, Human
acacaaggguaacugccagccau

SEQ ID NO: 1116788 - RNA, 22 nt, Human
uggcagagaaccugggcuuugu

SEQ ID NO: 1116789 - RNA, 22 nt, Human
cccagccucugggcucacccaa

SEQ ID NO: 1116790 - RNA, 22 nt, Human
gaggcugcuuugaugacaggag

SEQ ID NO: 1116791 - RNA, 22 nt, Human
gcugucacaagcaucuggggca

SEQ ID NO: 1116792 - RNA, 22 nt, Human
augcaguauaaaucauuucugg

SEQ ID NO: 1116793 - RNA, 22 nt, Human
auguuuuauauuuugcagcagu

SEQ ID NO: 1116794 - RNA, 22 nt, Human
uguauuagagcaguagaauuau

SEQ ID NO: 1116795 - RNA, 18 nt, Human
agcagcugucagaaugcc

SEQ ID NO: 1116796 - RNA, 22 nt, Human
gcucccugaaaagaacaaaguc

SEQ ID NO: 1116797 - RNA, 19 nt, Human
ggcugccuuuccuuaccag

SEQ ID NO: 1116798 - RNA, 22 nt, Human
gcucugcugagauaucugggag

SEQ ID NO: 1116799 - RNA, 22 nt, Human
uuucuggcagcgggacaggggu

SEQ ID NO: 1116800 - RNA, 22 nt, Human
cagcuuggcuuccgcuuuacug

SEQ ID NO: 1116801 - RNA, 17 nt, Human
aggugcuggagcaucag

SEQ ID NO: 1116802 - RNA, 22 nt, Human
agcugguggauuaugcuguaca

SEQ ID NO: 1116803 - RNA, 22 nt, Human
ggagggugcauuuuacccugug

SEQ ID NO: 1116804 - RNA, 20 nt, Human
ccugucugcaauggagguca

SEQ ID NO: 1116805 - RNA, 22 nt, Human
uuucacaaguuucaggauucug

SEQ ID NO: 1116806 - RNA, 22 nt, Human
aauguacaaggguuccaguuuu

SEQ ID NO: 1116807 - RNA, 22 nt, Human
ugccaggaggaggugggacaga

SEQ ID NO: 1116808 - RNA, 22 nt, Human
guuauguauugggaaauccaag

SEQ ID NO: 1116809 - RNA, 21 nt, Human
ccuggcugcacaguugcuggu

SEQ ID NO: 1116810 - RNA, 22 nt, Human
ggugaaggucuacugugugcca

SEQ ID NO: 1116811 - RNA, 22 nt, Human
gugugcaguagagaaagagcag

SEQ ID NO: 1116812 - RNA, 22 nt, Human
caucacagauguuguguggagu

SEQ ID NO: 1116813 - RNA, 22 nt, Human
ugagccugaguucaaggcugca

SEQ ID NO: 1116814 - RNA, 22 nt, Human
agagcuggggccagagucaagg

SEQ ID NO: 1116815 - RNA, 19 nt, Human
gcagccaccgcggcggccg

SEQ ID NO: 1116816 - RNA, 21 nt, Human
ggcagcugaccgcgcggugca

SEQ ID NO: 1116817 - RNA, 22 nt, Human
ucagaguggugguuuugccuuc

SEQ ID NO: 1116818 - RNA, 22 nt, Human
auggacaggcugagcuuccuca

SEQ ID NO: 1116819 - RNA, 22 nt, Human
gagccaggcccguacuugcugu

SEQ ID NO: 1116820 - RNA, 22 nt, Human
gagguacagaguguuccaaugu

SEQ ID NO: 1116821 - RNA, 19 nt, Human
ucagaggauuuggcuauga

SEQ ID NO: 1116822 - RNA, 22 nt, Human
ugaggcagcuuuuucugugugu

SEQ ID NO: 1116823 - RNA, 22 nt, Human
cuguguggacugguugaggccc

SEQ ID NO: 1116824 - RNA, 22 nt, Human
gcugccugaucauacaccaggg

SEQ ID NO: 1116825 - RNA, 22 nt, Human
cugagccagggccacacaugga

SEQ ID NO: 1116826 - RNA, 22 nt, Human
ccugggcagguguggcuucccc

SEQ ID NO: 1116827 - RNA, 22 nt, Human
agucaaagcuacaggcauuuga

SEQ ID NO: 1116828 - RNA, 22 nt, Human
agcugccaucugaagaacugca

SEQ ID NO: 1116829 - RNA, 22 nt, Human
aagcaggcauuccagagacaau

SEQ ID NO: 1116830 - RNA, 22 nt, Human
uaugagcuuccaguguugcaug

SEQ ID NO: 1116831 - RNA, 22 nt, Human
aguggggagguccaggccaccc

SEQ ID NO: 1116832 - RNA, 22 nt, Human
cgccaggcuugguagcucaugc

SEQ ID NO: 1116833 - RNA, 22 nt, Human
agucaguguucuccggagaggc

SEQ ID NO: 1116834 - RNA, 22 nt, Human
gcaaaugaguuguaacauaaaa

SEQ ID NO: 1116835 - RNA, 22 nt, Human
ugaugggaaaaugaggccuggg

SEQ ID NO: 1116836 - RNA, 22 nt, Human
gucucagauucagacaucuaca

SEQ ID NO: 1116837 - RNA, 22 nt, Human
caggugggccaugaaaaaugac

SEQ ID NO: 1116838 - RNA, 21 nt, Human
gcagccacugccuucaacaau

SEQ ID NO: 1116839 - RNA, 22 nt, Human
cagcaguggccaucuguguggu

SEQ ID NO: 1116840 - RNA, 22 nt, Human
ggcuucagugagcugagcucac

SEQ ID NO: 1116841 - RNA, 22 nt, Human
uuucuguaauuaaaagggcagg

SEQ ID NO: 1116842 - RNA, 22 nt, Human
ugccugggccucugaggaaggc

SEQ ID NO: 1116843 - RNA, 22 nt, Human
uugauacaggccuucuagauga

SEQ ID NO: 1116844 - RNA, 19 nt, Human
ggccaggcugacugugguc

SEQ ID NO: 1116845 - RNA, 22 nt, Human
uguuaucugagcaacgucgacg

SEQ ID NO: 1116846 - RNA, 22 nt, Human
aagcagaaaaacugagcuccaa

SEQ ID NO: 1116847 - RNA, 22 nt, Human
agggggaggcugugcugcgucu

SEQ ID NO: 1116848 - RNA, 22 nt, Human
aaucgguugaacccaggaagug

SEQ ID NO: 1116849 - RNA, 22 nt, Human
cacagggcagguacucucagag

SEQ ID NO: 1116850 - RNA, 22 nt, Human
cugaaggacuuggugauaguug

SEQ ID NO: 1116851 - RNA, 22 nt, Human
gcuggcaccugcaccaagcagg

SEQ ID NO: 1116852 - RNA, 22 nt, Human
gccuggaggggacagucucugg

SEQ ID NO: 1116853 - RNA, 22 nt, Human
agaaagcacucugucuuuuacc

SEQ ID NO: 1116854 - RNA, 22 nt, Human
ugcaauaaagugcuauaaaucc

SEQ ID NO: 1116855 - RNA, 22 nt, Human
guuuggggucugcagagcggcg

SEQ ID NO: 1116856 - RNA, 22 nt, Human
cacagcuucuccuugauaucgc

SEQ ID NO: 1116857 - RNA, 22 nt, Human
ugcucugucaagaaaagaugcc

SEQ ID NO: 1116858 - RNA, 22 nt, Human
cagaggcuaagaugagugggug

SEQ ID NO: 1116859 - RNA, 20 nt, Human
agucccuuuggucagguauu

SEQ ID NO: 1116860 - RNA, 22 nt, Human
cuggccugaucucaugcugucc

SEQ ID NO: 1116861 - RNA, 22 nt, Human
aagagcuggaagugaagauaac

SEQ ID NO: 1116862 - RNA, 16 nt, Human
ccacagggcaaggggc

SEQ ID NO: 1116863 - RNA, 20 nt, Human
auaauuuacccugcaccacu

SEQ ID NO: 1116864 - RNA, 22 nt, Human
ucccucuguguugggcaugccu

SEQ ID NO: 1116865 - RNA, 22 nt, Human
gcccugugccagucacgcugug

SEQ ID NO: 1116866 - RNA, 22 nt, Human
cggggcugcucguccuccugug

SEQ ID NO: 1116867 - RNA, 22 nt, Human
uccugggcuugcuccuccagcu

SEQ ID NO: 1116868 - RNA, 22 nt, Human
cccagggcccuggacagcuaca

SEQ ID NO: 1116869 - RNA, 22 nt, Human
gcugccacuuggucaugucaug

SEQ ID NO: 1116870 - RNA, 22 nt, Human
agaaaaaucuuggcgcuugucu

SEQ ID NO: 1116871 - RNA, 22 nt, Human
agaauucuuggugguuagaaua

SEQ ID NO: 1116872 - RNA, 22 nt, Human
caugagcugcugggagccuguc

SEQ ID NO: 1116873 - RNA, 22 nt, Human
ccagagccccugagcuucccug

SEQ ID NO: 1116874 - RNA, 22 nt, Human
aggcccaguagugcugccuuua

SEQ ID NO: 1116875 - RNA, 22 nt, Human
ggccuggaagaggacagagaaa

SEQ ID NO: 1116876 - RNA, 22 nt, Human
cacagcuggugcacuagcucug

SEQ ID NO: 1116877 - RNA, 22 nt, Human
uccuugaauugugccacuuacc

SEQ ID NO: 1116878 - RNA, 22 nt, Human
cuggcagguggauggggacucc

SEQ ID NO: 1116879 - RNA, 22 nt, Human
agacccugucaguguuaggaaa

SEQ ID NO: 1116880 - RNA, 19 nt, Human
agugucaucagcuacucag

SEQ ID NO: 1116881 - RNA, 22 nt, Human
aagcaucucuauguggagagug

SEQ ID NO: 1116882 - RNA, 22 nt, Human
agagauaugaguaguugugaca

SEQ ID NO: 1116883 - RNA, 22 nt, Human
aaguugaagcaugaaccaaggu

SEQ ID NO: 1116884 - RNA, 22 nt, Human
aacagaaugcaggggaugcugc

SEQ ID NO: 1116885 - RNA, 22 nt, Human
ugggccacuugaaaguggaugu

SEQ ID NO: 1116886 - RNA, 22 nt, Human
auuugucugcuugcugccuucc

SEQ ID NO: 1116887 - RNA, 22 nt, Human
ugcuggcuggccuggccuggac

SEQ ID NO: 1116888 - RNA, 20 nt, Human
aaaaacaguaaugcugaaga

SEQ ID NO: 1116889 - RNA, 22 nt, Human
ucuguaucuaauuuuacaguag

SEQ ID NO: 1116890 - RNA, 22 nt, Human
uucucucauucaaauuaaagug

SEQ ID NO: 1116891 - RNA, 22 nt, Human
uaaauuguuuucuagaaguugu

SEQ ID NO: 1116892 - RNA, 22 nt, Human
cagcuggccugaucccuguggc

SEQ ID NO: 1116893 - RNA, 22 nt, Human
gcuguggccaacaaaccacuuu

SEQ ID NO: 1116894 - RNA, 22 nt, Human
ucuggcucccagccugcucuca

SEQ ID NO: 1116895 - RNA, 22 nt, Human
aaagguaguacuucuagaaggg

SEQ ID NO: 1116896 - RNA, 22 nt, Human
uuauguaccugaauuaguaaag

SEQ ID NO: 1116897 - RNA, 22 nt, Human
ggcugaaacagauuucaagaca

SEQ ID NO: 1116898 - RNA, 22 nt, Human
agagggcauuaacucugucuug

SEQ ID NO: 1116899 - RNA, 22 nt, Human
gucagcaggguccccuugagug

SEQ ID NO: 1116900 - RNA, 22 nt, Human
caggcagccuucucgucucaca

SEQ ID NO: 1116901 - RNA, 23 nt, Human
ccuccugggcacaggccugaugg

SEQ ID NO: 1116902 - RNA, 22 nt, Human
auggauaagaacaaauaucuga

SEQ ID NO: 1116903 - RNA, 22 nt, Human
agcaugcugguguucauggcag

SEQ ID NO: 1116904 - RNA, 22 nt, Human
ccugcagaccacacucaguccu

SEQ ID NO: 1116905 - RNA, 22 nt, Human
gagcagaacaggccggguggga

SEQ ID NO: 1116906 - RNA, 22 nt, Human
cccugccuucuuggccuuuaaa

SEQ ID NO: 1116907 - RNA, 22 nt, Human
agccacagcuccuugguggaga

SEQ ID NO: 1116908 - RNA, 22 nt, Human
gcugcccugugguccagcaggu

SEQ ID NO: 1116909 - RNA, 21 nt, Human
ggacuuacauagguaaggggu

SEQ ID NO: 1116910 - RNA, 22 nt, Human
ccuggggagaagagcuuccccc

SEQ ID NO: 1116911 - RNA, 22 nt, Human
ucuggcucugacacuacuguua

SEQ ID NO: 1116912 - RNA, 22 nt, Human
cuuccuguugucacagucugcg

SEQ ID NO: 1116913 - RNA, 22 nt, Human
uaugcauauagaugcacacaca

SEQ ID NO: 1116914 - RNA, 19 nt, Human
ucucagagcccuagaggcc

SEQ ID NO: 1116915 - RNA, 22 nt, Human
uguaugcuuuccaaaaaugcug

SEQ ID NO: 1116916 - RNA, 22 nt, Human
gugucccaaucuacuuuucccu

SEQ ID NO: 1116917 - RNA, 22 nt, Human
ugccugggggacuaaggccaaa

SEQ ID NO: 1116918 - RNA, 22 nt, Human
uuuuaucaaucauuaagacauu

SEQ ID NO: 1116919 - RNA, 18 nt, Human
ccucaggggaccuggcag

SEQ ID NO: 1116920 - RNA, 23 nt, Human
aggaggaaaaguuaucugcugag

SEQ ID NO: 1116921 - RNA, 22 nt, Human
cacugaagcuuucauucucuug

SEQ ID NO: 1116922 - RNA, 22 nt, Human
uauguacaguccuuaacuuaaa

SEQ ID NO: 1116923 - RNA, 22 nt, Human
uggacucaaguccaaguucacg

SEQ ID NO: 1116924 - RNA, 22 nt, Human
aacauacagugagcaguggacu

SEQ ID NO: 1116925 - RNA, 21 nt, Human
ccugagccuguuuauccagaa

SEQ ID NO: 1116926 - RNA, 22 nt, Human
gccaggugggagacagacagca

SEQ ID NO: 1116927 - RNA, 22 nt, Human
agggagcuguggucagcucagu

SEQ ID NO: 1116928 - RNA, 22 nt, Human
acauuucuuucuauucaguagc

SEQ ID NO: 1116929 - RNA, 22 nt, Human
aucaaaguucguaacugauaac

SEQ ID NO: 1116930 - RNA, 22 nt, Human
cuugccuucuguuccuauagaa

SEQ ID NO: 1116931 - RNA, 22 nt, Human
ugcacacacgcggcacaucugu

SEQ ID NO: 1116932 - RNA, 22 nt, Human
ucccagccacagguguagcccu

SEQ ID NO: 1116933 - RNA, 22 nt, Human
agauuucccaaauacuuguuau

SEQ ID NO: 1116934 - RNA, 22 nt, Human
aguccaggaguugggugacauu

SEQ ID NO: 1116935 - RNA, 22 nt, Human
ucccagagugagccaggggcag

SEQ ID NO: 1116936 - RNA, 22 nt, Human
ucagagccaaucauggugcauu

SEQ ID NO: 1116937 - RNA, 22 nt, Human
ccugaggcccuggcugugcuga

SEQ ID NO: 1116938 - RNA, 22 nt, Human
cagggccuccccggcagucuuu

SEQ ID NO: 1116939 - RNA, 22 nt, Human
cauuucugugacacuuccaucu

SEQ ID NO: 1116940 - RNA, 22 nt, Human
aggcugccucgugagcucgcug

SEQ ID NO: 1116941 - RNA, 22 nt, Human
acagggcagagaggcaggcuug

SEQ ID NO: 1116942 - RNA, 22 nt, Human
ggcucugcgcgguaaagugacu

SEQ ID NO: 1116943 - RNA, 22 nt, Human
gagcagugagugaauguugccu

SEQ ID NO: 1116944 - RNA, 23 nt, Human
agagcuuucuaaaauguaaaucu

SEQ ID NO: 1116945 - RNA, 22 nt, Human
gcagacaggcccaguggaggga

SEQ ID NO: 1116946 - RNA, 21 nt, Human
ugaaaucugaugggacaaaug

SEQ ID NO: 1116947 - RNA, 20 nt, Human
uuccuguauacaaagaguuc

SEQ ID NO: 1116948 - RNA, 23 nt, Human
cagagcuggcucagagcugccug

SEQ ID NO: 1116949 - RNA, 22 nt, Human
augcauaauguauguauugacu

SEQ ID NO: 1116950 - RNA, 22 nt, Human
ggcugccugcuccuccugcacg

SEQ ID NO: 1116951 - RNA, 22 nt, Human
gcugucaccaaagcaggcacug

SEQ ID NO: 1116952 - RNA, 22 nt, Human
ucugggugcccuuugcucuguu

SEQ ID NO: 1116953 - RNA, 22 nt, Human
cuuggggcugucacucuggcau

SEQ ID NO: 1116954 - RNA, 22 nt, Human
cagucccagaagagccugggag

SEQ ID NO: 1116955 - RNA, 22 nt, Human
ugcagaagauggucugagcacc

SEQ ID NO: 1116956 - RNA, 22 nt, Human
caggggccggcuguccgugccc

SEQ ID NO: 1116957 - RNA, 22 nt, Human
gccaggcuguuuuuauuacugu

SEQ ID NO: 1116958 - RNA, 22 nt, Human
ucccagggugcgccugcccucg

SEQ ID NO: 1116959 - RNA, 22 nt, Human
aaaugguaagacaacacauuau

SEQ ID NO: 1116960 - RNA, 22 nt, Human
uugaaaggcacaggcaccuggg

SEQ ID NO: 1116961 - RNA, 22 nt, Human
cuguccuguagcuccaucaguc

SEQ ID NO: 1116962 - RNA, 17 nt, Human
gagauggguggaucacc

SEQ ID NO: 1116963 - RNA, 22 nt, Human
cuggggcucacuuuggucaggc

SEQ ID NO: 1116964 - RNA, 22 nt, Human
ugacaugcuuguuuuccuugaa

SEQ ID NO: 1116965 - RNA, 23 nt, Human
aggaggccugaaacugaggcuga

SEQ ID NO: 1116966 - RNA, 22 nt, Human
cugggccucaaucucagaguuu

SEQ ID NO: 1116967 - RNA, 21 nt, Human
agugaaaugaaguguaugcuc

SEQ ID NO: 1116968 - RNA, 22 nt, Human
uccaaacacccuccaugcugca

SEQ ID NO: 1116969 - RNA, 22 nt, Human
ucaauuaugccauugcaauauu

SEQ ID NO: 1116970 - RNA, 22 nt, Human
ucagagugcagcgggaggcugg

SEQ ID NO: 1116971 - RNA, 22 nt, Human
gaggccagaaugagcugaaugc

SEQ ID NO: 1116972 - RNA, 15 nt, Human
ugggcagaucacuug

SEQ ID NO: 1116973 - RNA, 19 nt, Human
cagaguacaccagauagga

SEQ ID NO: 1116974 - RNA, 22 nt, Human
cuuuuuccagcuucaggguggg

SEQ ID NO: 1116975 - RNA, 22 nt, Human
gcccugucccuuggcuucuagg

SEQ ID NO: 1116976 - RNA, 22 nt, Human
uggagggcaugcuguccauggg

SEQ ID NO: 1116977 - RNA, 22 nt, Human
uuuuuccaccguacuuccugag

SEQ ID NO: 1116978 - RNA, 22 nt, Human
gcugucuggaggcucugaggga

SEQ ID NO: 1116979 - RNA, 22 nt, Human
ucaucuaagagucuuacauuua

SEQ ID NO: 1116980 - RNA, 22 nt, Human
ccaaaguccauaguuuacuuua

SEQ ID NO: 1116981 - RNA, 22 nt, Human
cauucauuuacuuucaacagcu

SEQ ID NO: 1116982 - RNA, 22 nt, Human
ugucucagaguaucccugaacu

SEQ ID NO: 1116983 - RNA, 22 nt, Human
agcagcugagaugguaagauuc

SEQ ID NO: 1116984 - RNA, 22 nt, Human
ugcuaucucuauauccauuuau

SEQ ID NO: 1116985 - RNA, 22 nt, Human
agcugccaaguuggaguagcaa

SEQ ID NO: 1116986 - RNA, 22 nt, Human
gcagcugcaggcaggcuugcug

SEQ ID NO: 1116987 - RNA, 22 nt, Human
ugccugggguuggcaaacugcu

SEQ ID NO: 1116988 - RNA, 22 nt, Human
agacagcaugauacaugaugcu

SEQ ID NO: 1116989 - RNA, 22 nt, Human
augcaguacauacaaacacuga

SEQ ID NO: 1116990 - RNA, 22 nt, Human
gaggcuggugguuaguuccauu

SEQ ID NO: 1116991 - RNA, 22 nt, Human
uccuuucaccaaaaaguguugu

SEQ ID NO: 1116992 - RNA, 20 nt, Human
uucuuucaucuacacguugu

SEQ ID NO: 1116993 - RNA, 22 nt, Human
cagcaauaguguguuuguuuca

SEQ ID NO: 1116994 - RNA, 22 nt, Human
ugggagaagcagcagccaagug

SEQ ID NO: 1116995 - RNA, 22 nt, Human
gcuuggaaguaggauugggaga

SEQ ID NO: 1116996 - RNA, 22 nt, Human
aaggcacugacugugcagggga

SEQ ID NO: 1116997 - RNA, 22 nt, Human
uugcagggaccugcagaaagcu

SEQ ID NO: 1116998 - RNA, 22 nt, Human
ucagggacugcagagggaagcu

SEQ ID NO: 1116999 - RNA, 22 nt, Human
agggauguaaauucuucuucuu

SEQ ID NO: 1117000 - RNA, 20 nt, Human
aggcacuguugucuguaucc

SEQ ID NO: 1117001 - RNA, 22 nt, Human
acacagggggcauucuaggagu

SEQ ID NO: 1117002 - RNA, 22 nt, Human
uuucaaauaccauaaaccuaau

SEQ ID NO: 1117003 - RNA, 22 nt, Human
uuacauuagacccacuuucaug

SEQ ID NO: 1117004 - RNA, 22 nt, Human
accugagccuagggagguugag

SEQ ID NO: 1117005 - RNA, 22 nt, Human
uggaagcacuuggguuuuguug

SEQ ID NO: 1117006 - RNA, 22 nt, Human
caaggagaaaacggcuucugaa

SEQ ID NO: 1117007 - RNA, 22 nt, Human
ccagaggcuggguucaccucag

SEQ ID NO: 1117008 - RNA, 22 nt, Human
cagccagggucaggcagcuucu

SEQ ID NO: 1117009 - RNA, 22 nt, Human
gcugcucucucccuaaguuggg

SEQ ID NO: 1117010 - RNA, 19 nt, Human
agguggucuaggcuggaga

SEQ ID NO: 1117011 - RNA, 22 nt, Human
guccucuggugaaagcauuccc

SEQ ID NO: 1117012 - RNA, 22 nt, Human
uggcucugucaaacugcacaca

SEQ ID NO: 1117013 - RNA, 22 nt, Human
gcaggccucuguugagggccuu

SEQ ID NO: 1117014 - RNA, 22 nt, Human
gcaaggagacuguagggccaag

SEQ ID NO: 1117015 - RNA, 21 nt, Human
cagaggcugagagggcaaucu

SEQ ID NO: 1117016 - RNA, 19 nt, Human
augucuguugaauuucaua

SEQ ID NO: 1117017 - RNA, 22 nt, Human
aggccugaggaccuucuggagg

SEQ ID NO: 1117018 - RNA, 22 nt, Human
uucaagaugcacaguggcauuc

SEQ ID NO: 1117019 - RNA, 22 nt, Human
cugggaggacaacuuggagcuc

SEQ ID NO: 1117020 - RNA, 22 nt, Human
uauucacauguacauaugcuca

SEQ ID NO: 1117021 - RNA, 20 nt, Human
gccugcagguuggaugggau

SEQ ID NO: 1117022 - RNA, 22 nt, Human
uuaaacagucccagaggcugac

SEQ ID NO: 1117023 - RNA, 22 nt, Human
uuuccuucaucaucugagagcu

SEQ ID NO: 1117024 - RNA, 22 nt, Human
agcauggggcaaugcaugugcu

SEQ ID NO: 1117025 - RNA, 22 nt, Human
ucacaggguguacaucaccuau

SEQ ID NO: 1117026 - RNA, 22 nt, Human
uuuuauuggagugauaccaagc

SEQ ID NO: 1117027 - RNA, 22 nt, Human
ccacagggauaggaauggggcu

SEQ ID NO: 1117028 - RNA, 22 nt, Human
uccuccuucgggacugcuugac

SEQ ID NO: 1117029 - RNA, 22 nt, Human
uaauuuauuucaacugccaagg

SEQ ID NO: 1117030 - RNA, 22 nt, Human
ccagcuggagccaagguggacu

SEQ ID NO: 1117031 - RNA, 22 nt, Human
cugggcuggcgcauccgacacg

SEQ ID NO: 1117032 - RNA, 22 nt, Human
ucugagaguagagcugccucuu

SEQ ID NO: 1117033 - RNA, 22 nt, Human
ccagcucuuggugcacuuacau

SEQ ID NO: 1117034 - RNA, 22 nt, Human
ggcugccucuggaagcuggaga

SEQ ID NO: 1117035 - RNA, 22 nt, Human
agagccagguguagucucggag

SEQ ID NO: 1117036 - RNA, 22 nt, Human
aagaggaaaugauugacuauau

SEQ ID NO: 1117037 - RNA, 22 nt, Human
gauuucaagcccccagagauuc

SEQ ID NO: 1117038 - RNA, 22 nt, Human
cagguaagagacggauuggccc

SEQ ID NO: 1117039 - RNA, 22 nt, Human
ugaauggucacugagcaucugu

SEQ ID NO: 1117040 - RNA, 22 nt, Human
cacucugacuggcccugcagga

SEQ ID NO: 1117041 - RNA, 22 nt, Human
cucacaggcaucucaucaggcu

SEQ ID NO: 1117042 - RNA, 22 nt, Human
uuugggaagaggaaucucugga

SEQ ID NO: 1117043 - RNA, 20 nt, Human
aggaaaaauggaaacuggag

SEQ ID NO: 1117044 - RNA, 22 nt, Human
gggcugccuuucuucugggagc

SEQ ID NO: 1117045 - RNA, 22 nt, Human
caggacagagcccagacugugu

SEQ ID NO: 1117046 - RNA, 22 nt, Human
gcacccagaggucagcagugcu

SEQ ID NO: 1117047 - RNA, 22 nt, Human
auuugucuuugagugcccugcu

SEQ ID NO: 1117048 - RNA, 22 nt, Human
gggcaugguggugcacaccugu

SEQ ID NO: 1117049 - RNA, 22 nt, Human
ugggaaauguguuucuggacca

SEQ ID NO: 1117050 - RNA, 22 nt, Human
gcugugcuauaucucugagugu

SEQ ID NO: 1117051 - RNA, 22 nt, Human
agaggccaguggcugugcuguc

SEQ ID NO: 1117052 - RNA, 22 nt, Human
ucuuugcaugcauuuucccuua

SEQ ID NO: 1117053 - RNA, 22 nt, Human
ccuguguggccaggcuggaguc

SEQ ID NO: 1117054 - RNA, 19 nt, Human
auuugaaagcugugcuugc

SEQ ID NO: 1117055 - RNA, 22 nt, Human
ggcugagccuggagcaucuggu

SEQ ID NO: 1117056 - RNA, 22 nt, Human
gcaaaugcucuccuuggucagg

SEQ ID NO: 1117057 - RNA, 22 nt, Human
cuugcugggguaagucugugcu

SEQ ID NO: 1117058 - RNA, 22 nt, Human
ccagucccaggcagaaauccag

SEQ ID NO: 1117059 - RNA, 22 nt, Human
agcagaacugaugagacuugag

SEQ ID NO: 1117060 - RNA, 22 nt, Human
ugcaucuguucagagcugucga

SEQ ID NO: 1117061 - RNA, 22 nt, Human
agggacaguuacaucaucagac

SEQ ID NO: 1117062 - RNA, 22 nt, Human
ucucaggcuaccuugcacaagg

SEQ ID NO: 1117063 - RNA, 22 nt, Human
ucucugucugagccuggcagac

SEQ ID NO: 1117064 - RNA, 22 nt, Human
ucaggcagagcuguggagcucu

SEQ ID NO: 1117065 - RNA, 22 nt, Human
aggccuggccccaguugcuagg

SEQ ID NO: 1117066 - RNA, 22 nt, Human
caagaugaucccugaaggcagc

SEQ ID NO: 1117067 - RNA, 17 nt, Human
ugagacagggcaggccc

SEQ ID NO: 1117068 - RNA, 22 nt, Human
aaaguuucaauagaggaagugg

SEQ ID NO: 1117069 - RNA, 22 nt, Human
guguaauugaaauugagaacca

SEQ ID NO: 1117070 - RNA, 22 nt, Human
ugcaggcuuuagccccauggcu

SEQ ID NO: 1117071 - RNA, 22 nt, Human
aucuggcuuacgaagcacuggu

SEQ ID NO: 1117072 - RNA, 22 nt, Human
gagcugccggcccacaguacua

SEQ ID NO: 1117073 - RNA, 22 nt, Human
uaaguaaauuuauaaugugauu

SEQ ID NO: 1117074 - RNA, 22 nt, Human
cugccagcacugccuccugagg

SEQ ID NO: 1117075 - RNA, 20 nt, Human
ugaaaaggucaggagacaug

SEQ ID NO: 1117076 - RNA, 22 nt, Human
cuagaaauauuuuacagucaag

SEQ ID NO: 1117077 - RNA, 22 nt, Human
aaagaugucauacacauuaaga

SEQ ID NO: 1117078 - RNA, 22 nt, Human
uggcucaggguccccaaauggu

SEQ ID NO: 1117079 - RNA, 22 nt, Human
uuccuguaugucagugaagagc

SEQ ID NO: 1117080 - RNA, 22 nt, Human
ccacagggacuguuaaaacccu

SEQ ID NO: 1117081 - RNA, 22 nt, Human
cccugggacccgcugcagaggc

SEQ ID NO: 1117082 - RNA, 23 nt, Human
agaggcaggaguggcuugcccgg

SEQ ID NO: 1117083 - RNA, 21 nt, Human
ugauuuccagaaaauuggccc

SEQ ID NO: 1117084 - RNA, 23 nt, Human
ucucaggacacacaugucuauca

SEQ ID NO: 1117085 - RNA, 22 nt, Human
ucuuuccuuagaauaauucuuu

SEQ ID NO: 1117086 - RNA, 22 nt, Human
guucccauacaguaucagugcu

SEQ ID NO: 1117087 - RNA, 22 nt, Human
uagcaggguaaauguagaugga

SEQ ID NO: 1117088 - RNA, 22 nt, Human
aagggcuggcccugggaagagu

SEQ ID NO: 1117089 - RNA, 22 nt, Human
gcuggggagggcgucaaggcca

SEQ ID NO: 1117090 - RNA, 22 nt, Human
agucucugccagcuuguccucu

SEQ ID NO: 1117091 - RNA, 22 nt, Human
caguuauuaugaggucauuagg

SEQ ID NO: 1117092 - RNA, 22 nt, Human
ucucuggaauuuugagagugac

SEQ ID NO: 1117093 - RNA, 22 nt, Human
auacaguauuaccuguucagga

SEQ ID NO: 1117094 - RNA, 22 nt, Human
aggcugccuguuccaaucuccu

SEQ ID NO: 1117095 - RNA, 22 nt, Human
uggaggcauuuuagguugucac

SEQ ID NO: 1117096 - RNA, 22 nt, Human
cagcugccccgcuggcugacca

SEQ ID NO: 1117097 - RNA, 22 nt, Human
cccacaggcuagggguagggca

SEQ ID NO: 1117098 - RNA, 22 nt, Human
auguuacagaaagcaaagauga

SEQ ID NO: 1117099 - RNA, 22 nt, Human
agccccacacucucucugagaa

SEQ ID NO: 1117100 - RNA, 22 nt, Human
cagggacaauggcagagccuga

SEQ ID NO: 1117101 - RNA, 22 nt, Human
agggcuggcuaggugcguuccc

SEQ ID NO: 1117102 - RNA, 22 nt, Human
cauuuacagugagaguuuuuac

SEQ ID NO: 1117103 - RNA, 22 nt, Human
gugugccagacaugaugcuaug

SEQ ID NO: 1117104 - RNA, 22 nt, Human
gcugccuccugaaagcgcucug

SEQ ID NO: 1117105 - RNA, 22 nt, Human
gccugugcauagcagcggacuc

SEQ ID NO: 1117106 - RNA, 20 nt, Human
cugggaggucuuccaaauca

SEQ ID NO: 1117107 - RNA, 22 nt, Human
uuugcauuuguuuagaaccuga

SEQ ID NO: 1117108 - RNA, 22 nt, Human
caaaggcaacauauacuuguuu

SEQ ID NO: 1117109 - RNA, 20 nt, Human
ccuaggcaugcugagucucc

SEQ ID NO: 1117110 - RNA, 22 nt, Human
uaugaagauauaucugaucucu

SEQ ID NO: 1117111 - RNA, 22 nt, Human
gggcuuggcacaugggcucagc

SEQ ID NO: 1117112 - RNA, 22 nt, Human
uccucagggaagaugagccuca

SEQ ID NO: 1117113 - RNA, 22 nt, Human
ccaggaguuggagguugcagug

SEQ ID NO: 1117114 - RNA, 22 nt, Human
ccauaagguuuggggccaugca

SEQ ID NO: 1117115 - RNA, 22 nt, Human
ccacagagacagagcccagggu

SEQ ID NO: 1117116 - RNA, 22 nt, Human
agccagcuggugggucagcugg

SEQ ID NO: 1117117 - RNA, 22 nt, Human
aggucccaggcauagcuggucu

SEQ ID NO: 1117118 - RNA, 22 nt, Human
aacucaguucuuuccacaaugc

SEQ ID NO: 1117119 - RNA, 22 nt, Human
acacagggucuagaguuaggcc

SEQ ID NO: 1117120 - RNA, 22 nt, Human
gcugccugucccaggaugagga

SEQ ID NO: 1117121 - RNA, 22 nt, Human
ugcaccugagaggucucugagg

SEQ ID NO: 1117122 - RNA, 22 nt, Human
agcuguucccucacugcaguca

SEQ ID NO: 1117123 - RNA, 22 nt, Human
ugacagcauaacacuggucuug

SEQ ID NO: 1117124 - RNA, 21 nt, Human
cucuggaggcaagggagagug

SEQ ID NO: 1117125 - RNA, 22 nt, Human
agcagccauccuuagagaaaga

SEQ ID NO: 1117126 - RNA, 22 nt, Human
uggcucugugucucccagcagc

SEQ ID NO: 1117127 - RNA, 22 nt, Human
gggagcugguuccugcccucca

SEQ ID NO: 1117128 - RNA, 22 nt, Human
gguggccuccagggcauaggug

SEQ ID NO: 1117129 - RNA, 22 nt, Human
gcuggcuguguuucaucucuga

SEQ ID NO: 1117130 - RNA, 20 nt, Human
cccaggagugagcagcuuua

SEQ ID NO: 1117131 - RNA, 22 nt, Human
gaggccuggguuggaggugcau

SEQ ID NO: 1117132 - RNA, 22 nt, Human
uaugugcaguuugcucuuaaca

SEQ ID NO: 1117133 - RNA, 22 nt, Human
ggcagagacuggguuggcagag

SEQ ID NO: 1117134 - RNA, 23 nt, Human
ccuggcagcaaacgaggagguua

SEQ ID NO: 1117135 - RNA, 22 nt, Human
ggagcugggguuggcaucuucc

SEQ ID NO: 1117136 - RNA, 21 nt, Human
cugaggcagcacagcuaguca

SEQ ID NO: 1117137 - RNA, 22 nt, Human
gagccagccuucuucugagguc

SEQ ID NO: 1117138 - RNA, 22 nt, Human
gugucccaauguucaggacggc

SEQ ID NO: 1117139 - RNA, 21 nt, Human
uccaggaguggcugggcaggg

SEQ ID NO: 1117140 - RNA, 23 nt, Human
ggcagagagcauggcuggggccc

SEQ ID NO: 1117141 - RNA, 19 nt, Human
uuggaaggagccagagugg

SEQ ID NO: 1117142 - RNA, 22 nt, Human
gccuccuggccuuugcuccuca

SEQ ID NO: 1117143 - RNA, 22 nt, Human
cagcagcuacuuggagcagcag

SEQ ID NO: 1117144 - RNA, 22 nt, Human
ggucauuguucuuuucugugau

SEQ ID NO: 1117145 - RNA, 22 nt, Human
cccagccagccucuucccauau

SEQ ID NO: 1117146 - RNA, 22 nt, Human
cacugagaggucucauuuccaa

SEQ ID NO: 1117147 - RNA, 22 nt, Human
agcugcccccagggcugugcuu

SEQ ID NO: 1117148 - RNA, 22 nt, Human
uaacaucuuuagcagcucgaac

SEQ ID NO: 1117149 - RNA, 17 nt, Human
aggugcagaggcagagc

SEQ ID NO: 1117150 - RNA, 22 nt, Human
gaggggcugggguugacuccaa

SEQ ID NO: 1117151 - RNA, 22 nt, Human
agaucucaccucuguguauuau

SEQ ID NO: 1117152 - RNA, 22 nt, Human
ugaaauguuugaagaccacuga

SEQ ID NO: 1117153 - RNA, 18 nt, Human
gucauugcaacauacugu

SEQ ID NO: 1117154 - RNA, 22 nt, Human
uggauaaacucacuguaaguug

SEQ ID NO: 1117155 - RNA, 20 nt, Human
cccucccagaugcuucccaa

SEQ ID NO: 1117156 - RNA, 22 nt, Human
aggcagcuggcagcacccaggg

SEQ ID NO: 1117157 - RNA, 22 nt, Human
cacagcuucugagugaggauuu

SEQ ID NO: 1117158 - RNA, 22 nt, Human
gcuuuguguagaaggaggaugg

SEQ ID NO: 1117159 - RNA, 22 nt, Human
uaucuuuaacuugcaguauuua

SEQ ID NO: 1117160 - RNA, 22 nt, Human
cugggaggcacuauucaggagg

SEQ ID NO: 1117161 - RNA, 22 nt, Human
gcaugugucuccccaguggagg

SEQ ID NO: 1117162 - RNA, 22 nt, Human
caaagcucaugcucuuagccau

SEQ ID NO: 1117163 - RNA, 22 nt, Human
cagcccugccauggagccuccu

SEQ ID NO: 1117164 - RNA, 22 nt, Human
aggugagugugacugcaagaga

SEQ ID NO: 1117165 - RNA, 22 nt, Human
caggagugcagguggugaggca

SEQ ID NO: 1117166 - RNA, 22 nt, Human
uuuucacacaaggugauaaguu

SEQ ID NO: 1117167 - RNA, 22 nt, Human
cagcaggcugcgauugcucauu

SEQ ID NO: 1117168 - RNA, 22 nt, Human
gggcuucuagaccagcagugag

SEQ ID NO: 1117169 - RNA, 22 nt, Human
ggcucuggugcccuggcuccca

SEQ ID NO: 1117170 - RNA, 22 nt, Human
agccucugugacucacagguca

SEQ ID NO: 1117171 - RNA, 21 nt, Human
cugguguagcacucaggugcu

SEQ ID NO: 1117172 - RNA, 22 nt, Human
aggggugugcauccuggaggau

SEQ ID NO: 1117173 - RNA, 22 nt, Human
caguuaaaggcccaauaucugg

SEQ ID NO: 1117174 - RNA, 22 nt, Human
ggcugggccagggccuguggac

SEQ ID NO: 1117175 - RNA, 22 nt, Human
ucacagggcauuauggcuccag

SEQ ID NO: 1117176 - RNA, 22 nt, Human
uuacaaagaguguucuuuucca

SEQ ID NO: 1117177 - RNA, 17 nt, Human
uccagagcacagagcuc

SEQ ID NO: 1117178 - RNA, 22 nt, Human
cagcugccccauaaaucacagu

SEQ ID NO: 1117179 - RNA, 22 nt, Human
gguggcagcgucuaucugacau

SEQ ID NO: 1117180 - RNA, 22 nt, Human
cccuccagccauggacccaggu

SEQ ID NO: 1117181 - RNA, 22 nt, Human
aagcagugcgcucaucuaaggg

SEQ ID NO: 1117182 - RNA, 22 nt, Human
uagucucuggagacucuagggg

SEQ ID NO: 1117183 - RNA, 22 nt, Human
augaagauaagaccaggcugga

SEQ ID NO: 1117184 - RNA, 22 nt, Human
agccuccaaaugucaggucccg

SEQ ID NO: 1117185 - RNA, 22 nt, Human
ccccagccagcaggaccucuga

SEQ ID NO: 1117186 - RNA, 17 nt, Human
cgagggcuugcuggcuc

SEQ ID NO: 1117187 - RNA, 23 nt, Human
uguagcaucucuuauuucucagc

SEQ ID NO: 1117188 - RNA, 22 nt, Human
cuggagcuggcuuccuuccacu

SEQ ID NO: 1117189 - RNA, 22 nt, Human
accugccucuaagcagcaggug

SEQ ID NO: 1117190 - RNA, 22 nt, Human
ccugccuguaagauggguacaa

SEQ ID NO: 1117191 - RNA, 22 nt, Human
ccauggaguuccucuggucuau

SEQ ID NO: 1117192 - RNA, 22 nt, Human
aaguccaucucugccccacaca

SEQ ID NO: 1117193 - RNA, 22 nt, Human
guggagccaggggcuguaggua

SEQ ID NO: 1117194 - RNA, 22 nt, Human
aaggcacuagcagaauuaguga

SEQ ID NO: 1117195 - RNA, 22 nt, Human
ugagccugggagauggaggcug

SEQ ID NO: 1117196 - RNA, 22 nt, Human
ggaggccaaggcagguggaucg

SEQ ID NO: 1117197 - RNA, 22 nt, Human
guuaauaaagguauagaaucag

SEQ ID NO: 1117198 - RNA, 22 nt, Human
cagcccucagguccucagcagc

SEQ ID NO: 1117199 - RNA, 22 nt, Human
agggguggagaguguugccagu

SEQ ID NO: 1117200 - RNA, 22 nt, Human
caaaguccauaguuuacaauag

SEQ ID NO: 1117201 - RNA, 22 nt, Human
gcugccuuugugagccaagggg

SEQ ID NO: 1117202 - RNA, 22 nt, Human
aggcugggaagguaaaguugua

SEQ ID NO: 1117203 - RNA, 22 nt, Human
guggaggacaaaagaagccuuu

SEQ ID NO: 1117204 - RNA, 22 nt, Human
cugagagucagcuucuccuccu

SEQ ID NO: 1117205 - RNA, 22 nt, Human
cuuauguaaacuacagauaaua

SEQ ID NO: 1117206 - RNA, 22 nt, Human
ggcuggccucaggguccucgcu

SEQ ID NO: 1117207 - RNA, 22 nt, Human
agguuuucagcuguauccugag

SEQ ID NO: 1117208 - RNA, 22 nt, Human
uaggaaaagucuagauugauga

SEQ ID NO: 1117209 - RNA, 22 nt, Human
ccucagcucuucccugugcaca

SEQ ID NO: 1117210 - RNA, 22 nt, Human
cauuuguauguuccuccuuagg

SEQ ID NO: 1117211 - RNA, 20 nt, Human
gacaucauguacacauugcc

SEQ ID NO: 1117212 - RNA, 22 nt, Human
ccagcagcagcguccaaggaga

SEQ ID NO: 1117213 - RNA, 22 nt, Human
caagcagacaguaggccuagaa

SEQ ID NO: 1117214 - RNA, 20 nt, Human
cugggcugcccagcuauggg

SEQ ID NO: 1117215 - RNA, 19 nt, Human
ucugcuggcagaauucccu

SEQ ID NO: 1117216 - RNA, 17 nt, Human
ggugaguguccaggugg

SEQ ID NO: 1117217 - RNA, 22 nt, Human
uuaugggagcaauuggggaggu

SEQ ID NO: 1117218 - RNA, 22 nt, Human
aagagcuggucacagguccauu

SEQ ID NO: 1117219 - RNA, 22 nt, Human
gaggcugcccaacuggagugga

SEQ ID NO: 1117220 - RNA, 22 nt, Human
cuauugaaaguguacaauucaa

SEQ ID NO: 1117221 - RNA, 21 nt, Human
ggcacugagccagauggacuc

SEQ ID NO: 1117222 - RNA, 22 nt, Human
ucuggcuccacuuucuucauuu

SEQ ID NO: 1117223 - RNA, 22 nt, Human
uacauuuauaaggcuucucugu

SEQ ID NO: 1117224 - RNA, 22 nt, Human
gggugggaacaggaugccagga

SEQ ID NO: 1117225 - RNA, 20 nt, Human
ucauugcacauaauggaagc

SEQ ID NO: 1117226 - RNA, 22 nt, Human
ggcugccugccuccaagccggg

SEQ ID NO: 1117227 - RNA, 22 nt, Human
guccagggaaauagcgacaggg

SEQ ID NO: 1117228 - RNA, 22 nt, Human
gcucaggagcucuugguggcgc

SEQ ID NO: 1117229 - RNA, 22 nt, Human
ucacugaagacugggcucuaaa

SEQ ID NO: 1117230 - RNA, 22 nt, Human
uggguagagacacagucugggg

SEQ ID NO: 1117231 - RNA, 22 nt, Human
uccucacauggugagccacaca

SEQ ID NO: 1117232 - RNA, 22 nt, Human
uaguaacagauuuauacagucu

SEQ ID NO: 1117233 - RNA, 22 nt, Human
ugucucugugagaucugacgau

SEQ ID NO: 1117234 - RNA, 22 nt, Human
ggccugccucacagucagcacc

SEQ ID NO: 1117235 - RNA, 22 nt, Human
uaacacacugaaggugagaugg

SEQ ID NO: 1117236 - RNA, 22 nt, Human
agagcuggaaucagaccucagg

SEQ ID NO: 1117237 - RNA, 22 nt, Human
gagaaccucuccacaagucugg

SEQ ID NO: 1117238 - RNA, 22 nt, Human
agccaacuaggagauuaaggua

SEQ ID NO: 1117239 - RNA, 23 nt, Human
ccagccucugggucuucauccag

SEQ ID NO: 1117240 - RNA, 22 nt, Human
gcugggagccguaccugucacg

SEQ ID NO: 1117241 - RNA, 20 nt, Human
cucaggauacugcaaaguug

SEQ ID NO: 1117242 - RNA, 22 nt, Human
ggugucccaggccagcugugug

SEQ ID NO: 1117243 - RNA, 22 nt, Human
gcagagccaggagcccaggauc

SEQ ID NO: 1117244 - RNA, 22 nt, Human
cagcugcccaagccccagaugu

SEQ ID NO: 1117245 - RNA, 23 nt, Human
acaaaugcccauacaucuaguuc

SEQ ID NO: 1117246 - RNA, 23 nt, Human
uacauuguggauggaguccuggg

SEQ ID NO: 1117247 - RNA, 22 nt, Human
gucucccacuuucuggccucuu

SEQ ID NO: 1117248 - RNA, 22 nt, Human
ggugaagggccuuaggagacag

SEQ ID NO: 1117249 - RNA, 22 nt, Human
cuugcuuuguccagaaauucag

SEQ ID NO: 1117250 - RNA, 22 nt, Human
cuccugagcucugaggaagcuu

SEQ ID NO: 1117251 - RNA, 22 nt, Human
gggcacugaaugccaagcuagg

SEQ ID NO: 1117252 - RNA, 22 nt, Human
ucucucagcuuugagaccugcu

SEQ ID NO: 1117253 - RNA, 22 nt, Human
gcugugcagccaagugccucug

SEQ ID NO: 1117254 - RNA, 22 nt, Human
uguuauugagguuacuuauaag

SEQ ID NO: 1117255 - RNA, 22 nt, Human
ggcuccuguggcaagacagcuu

SEQ ID NO: 1117256 - RNA, 22 nt, Human
auccuuggaugugucuuuuugu

SEQ ID NO: 1117257 - RNA, 22 nt, Human
aggcuccuaucgcuuucagcaa

SEQ ID NO: 1117258 - RNA, 22 nt, Human
augcuuuuccuaaaaugaugcc

SEQ ID NO: 1117259 - RNA, 22 nt, Human
ucugcagcuugcacaggcaggc

SEQ ID NO: 1117260 - RNA, 20 nt, Human
uaagaacaagacuaggaagc

SEQ ID NO: 1117261 - RNA, 22 nt, Human
ugucccagauacuggacauaga

SEQ ID NO: 1117262 - RNA, 22 nt, Human
caggaucccuggccuccgccca

SEQ ID NO: 1117263 - RNA, 20 nt, Human
uccuggccuucucgggcagu

SEQ ID NO: 1117264 - RNA, 22 nt, Human
uggcagaguucgcuccuauuca

SEQ ID NO: 1117265 - RNA, 22 nt, Human
gggcagcucucacagcagccaa

SEQ ID NO: 1117266 - RNA, 18 nt, Human
agugugugcccuuucagg

SEQ ID NO: 1117267 - RNA, 22 nt, Human
uaucuugagagacaacacagca

SEQ ID NO: 1117268 - RNA, 22 nt, Human
aucuggcucacuuagucuagga

SEQ ID NO: 1117269 - RNA, 22 nt, Human
agaggcugggaaggguccccgg

SEQ ID NO: 1117270 - RNA, 22 nt, Human
agaaauguuacaguuguuauuu

SEQ ID NO: 1117271 - RNA, 22 nt, Human
agaggccuaauugcuacccuuu

SEQ ID NO: 1117272 - RNA, 22 nt, Human
ugaagccaucccucagauggcc

SEQ ID NO: 1117273 - RNA, 22 nt, Human
acauuucuggaguuucucaaca

SEQ ID NO: 1117274 - RNA, 22 nt, Human
aaguuacaggagaaagagauca

SEQ ID NO: 1117275 - RNA, 22 nt, Human
cugaaggauguguggugggagu

SEQ ID NO: 1117276 - RNA, 22 nt, Human
aucuggcuuggguguggguagc

SEQ ID NO: 1117277 - RNA, 22 nt, Human
ucauugcagcuucagguguuca

SEQ ID NO: 1117278 - RNA, 22 nt, Human
uugaagcagagaaauacuugaa

SEQ ID NO: 1117279 - RNA, 22 nt, Human
cugcagccucaaccuccugagc

SEQ ID NO: 1117280 - RNA, 22 nt, Human
cacuucaauuaacuucagcauu

SEQ ID NO: 1117281 - RNA, 22 nt, Human
guuuagaauucuaacuuuaagg

SEQ ID NO: 1117282 - RNA, 23 nt, Human
cagguggcuccacgagggguggg

SEQ ID NO: 1117283 - RNA, 22 nt, Human
ucucaggaguagugggauccau

SEQ ID NO: 1117284 - RNA, 22 nt, Human
gggauggcucaaaggagucagg

SEQ ID NO: 1117285 - RNA, 22 nt, Human
ggccaagauggaaggagagaug

SEQ ID NO: 1117286 - RNA, 22 nt, Human
caggccucaggggcucaggcug

SEQ ID NO: 1117287 - RNA, 22 nt, Human
acaguaauaaguguuggugagg

SEQ ID NO: 1117288 - RNA, 22 nt, Human
uccugccugagcguggaggagg

SEQ ID NO: 1117289 - RNA, 22 nt, Human
cucaggaugaaagucaugguga

SEQ ID NO: 1117290 - RNA, 22 nt, Human
ccugccugcguccucugagggc

SEQ ID NO: 1117291 - RNA, 22 nt, Human
ugaccaaagaguugcuuguauu

SEQ ID NO: 1117292 - RNA, 22 nt, Human
aagaugauagaucugucaaugu

SEQ ID NO: 1117293 - RNA, 22 nt, Human
uggaggagaauuuauggucgaa

SEQ ID NO: 1117294 - RNA, 17 nt, Human
ggaaaaggaugauacag

SEQ ID NO: 1117295 - RNA, 22 nt, Human
ccacagagacaggguccuugcu

SEQ ID NO: 1117296 - RNA, 22 nt, Human
ugugggcaggcccgggucugag

SEQ ID NO: 1117297 - RNA, 22 nt, Human
aaaugcacagaggccagagagg

SEQ ID NO: 1117298 - RNA, 22 nt, Human
guguacauauugagucugcuga

SEQ ID NO: 1117299 - RNA, 22 nt, Human
ugauuuccaauaaggagaaugu

SEQ ID NO: 1117300 - RNA, 22 nt, Human
uggcagggugggcuucagcccc

SEQ ID NO: 1117301 - RNA, 22 nt, Human
ggcagugaaugaaacagaggcu

SEQ ID NO: 1117302 - RNA, 22 nt, Human
agaguguaauaagggcaagggc

SEQ ID NO: 1117303 - RNA, 22 nt, Human
ccccuuccuuccucagacagcc

SEQ ID NO: 1117304 - RNA, 22 nt, Human
acagaaauauagaagguaggaa

SEQ ID NO: 1117305 - RNA, 22 nt, Human
cccauuuagauaacaguucaaa

SEQ ID NO: 1117306 - RNA, 22 nt, Human
agguauagaauugaaaggguuu

SEQ ID NO: 1117307 - RNA, 22 nt, Human
ucauuucuccgaccugcugucc

SEQ ID NO: 1117308 - RNA, 22 nt, Human
uagggcuauucugaguaauaau

SEQ ID NO: 1117309 - RNA, 22 nt, Human
caggccugacccugagcuucac

SEQ ID NO: 1117310 - RNA, 22 nt, Human
cccaggagguggagcuugcagu

SEQ ID NO: 1117311 - RNA, 22 nt, Human
aagaaauguagagccuaguaaa

SEQ ID NO: 1117312 - RNA, 22 nt, Human
gaaaaugugccuuuggguauug

SEQ ID NO: 1117313 - RNA, 22 nt, Human
ucugagcauugaauuuucuucc

SEQ ID NO: 1117314 - RNA, 23 nt, Human
ggcacugaagcuacaauggugag

SEQ ID NO: 1117315 - RNA, 22 nt, Human
gccagccugugggggcucugug

SEQ ID NO: 1117316 - RNA, 22 nt, Human
uauuuuguuaauaauccagucc

SEQ ID NO: 1117317 - RNA, 22 nt, Human
ggccaugguuggggaagacaug

SEQ ID NO: 1117318 - RNA, 22 nt, Human
gcugggcugagcuagacuuggc

SEQ ID NO: 1117319 - RNA, 22 nt, Human
ucuaggagaaccaucagggagg

SEQ ID NO: 1117320 - RNA, 22 nt, Human
ccagggcuggguuugucggugu

SEQ ID NO: 1117321 - RNA, 22 nt, Human
ccuggaagauucaccacuacca

SEQ ID NO: 1117322 - RNA, 22 nt, Human
uuagauaauguagagauaugag

SEQ ID NO: 1117323 - RNA, 22 nt, Human
ccugcacuaccuggggcugcug

SEQ ID NO: 1117324 - RNA, 22 nt, Human
gcagggcaugggcccugucugc

SEQ ID NO: 1117325 - RNA, 22 nt, Human
cugccagccaggccagguaggc

SEQ ID NO: 1117326 - RNA, 22 nt, Human
auguccuuccauuuugaucugu

SEQ ID NO: 1117327 - RNA, 22 nt, Human
ggcucuggguucugcaaugcgu

SEQ ID NO: 1117328 - RNA, 22 nt, Human
agggcugcugaggaagccuugc

SEQ ID NO: 1117329 - RNA, 22 nt, Human
uuguaacaaucugucauaaaug

SEQ ID NO: 1117330 - RNA, 22 nt, Human
uagaacagaguuccagugauca

SEQ ID NO: 1117331 - RNA, 22 nt, Human
gggagccaaggagagaggccuu

SEQ ID NO: 1117332 - RNA, 22 nt, Human
aacucagcauccugcacagaga

SEQ ID NO: 1117333 - RNA, 22 nt, Human
ucugggggcgaccagggacugc

SEQ ID NO: 1117334 - RNA, 22 nt, Human
acacagggcggaaagcaugaga

SEQ ID NO: 1117335 - RNA, 22 nt, Human
ggcaggugcaccugagccaucu

SEQ ID NO: 1117336 - RNA, 22 nt, Human
gaugcagaaaguagacaccauc

SEQ ID NO: 1117337 - RNA, 22 nt, Human
ccagguggaggugugagguccu

SEQ ID NO: 1117338 - RNA, 22 nt, Human
agucugcacucagguggagguc

SEQ ID NO: 1117339 - RNA, 22 nt, Human
cacugcuucuggaggaauuugg

SEQ ID NO: 1117340 - RNA, 22 nt, Human
aguaacuaugcuugagaaucag

SEQ ID NO: 1117341 - RNA, 22 nt, Human
ggcucaggcuggagugcagugg

SEQ ID NO: 1117342 - RNA, 22 nt, Human
agcagagccaggucucucugua

SEQ ID NO: 1117343 - RNA, 22 nt, Human
cccuccagcucaaagcaaccgg

SEQ ID NO: 1117344 - RNA, 22 nt, Human
gagcagcuguccccaaagcuuc

SEQ ID NO: 1117345 - RNA, 21 nt, Human
agcagcugcaguuucuaucug

SEQ ID NO: 1117346 - RNA, 22 nt, Human
cuuucucuguguuucacaugcu

SEQ ID NO: 1117347 - RNA, 22 nt, Human
gagagugucgggggccccagga

SEQ ID NO: 1117348 - RNA, 22 nt, Human
ugauuucccucaucauaacaga

SEQ ID NO: 1117349 - RNA, 22 nt, Human
cuuccucugcggcgccgggcgc

SEQ ID NO: 1117350 - RNA, 22 nt, Human
ccagcuggcacuguggcugccc

SEQ ID NO: 1117351 - RNA, 22 nt, Human
agcagcaggagccgugggguga

SEQ ID NO: 1117352 - RNA, 22 nt, Human
agggccagcacuccuggcagga

SEQ ID NO: 1117353 - RNA, 22 nt, Human
aaaugcauaucaaagacuugaa

SEQ ID NO: 1117354 - RNA, 22 nt, Human
cuggccugcugggugagguccu

SEQ ID NO: 1117355 - RNA, 22 nt, Human
ccacaggaccagaggagaucac

SEQ ID NO: 1117356 - RNA, 22 nt, Human
uggagccuguguuucugcccag

SEQ ID NO: 1117357 - RNA, 22 nt, Human
cucaggaggugguagaggcccu

SEQ ID NO: 1117358 - RNA, 22 nt, Human
ugcaggugaaaauuaugaggau

SEQ ID NO: 1117359 - RNA, 22 nt, Human
cuggagcagguuuaggaguccc

SEQ ID NO: 1117360 - RNA, 22 nt, Human
gcucccaggaugaggagccagg

SEQ ID NO: 1117361 - RNA, 23 nt, Human
uccaagggcuacaaacacagacc

SEQ ID NO: 1117362 - RNA, 23 nt, Human
ccugggcauuggcugcagcuucu

SEQ ID NO: 1117363 - RNA, 22 nt, Human
aucagugcuaaagcaaaugccc

SEQ ID NO: 1117364 - RNA, 22 nt, Human
agcucauggugcuaucucaggg

SEQ ID NO: 1117365 - RNA, 22 nt, Human
cacagccugcugcacucaagaa

SEQ ID NO: 1117366 - RNA, 22 nt, Human
aauucuagcauugugaaaauau

SEQ ID NO: 1117367 - RNA, 22 nt, Human
ggcccacuugaaauggagcuca

SEQ ID NO: 1117368 - RNA, 22 nt, Human
caguacuuuucaaccaguauga

SEQ ID NO: 1117369 - RNA, 22 nt, Human
caguggugaagagcaggggcuc

SEQ ID NO: 1117370 - RNA, 22 nt, Human
cugccuggaccggcagcccucc

SEQ ID NO: 1117371 - RNA, 22 nt, Human
aucucagacauguuguccauga

SEQ ID NO: 1117372 - RNA, 22 nt, Human
ccagagccggcucccucagcuu

SEQ ID NO: 1117373 - RNA, 22 nt, Human
cguguggucccggcaaggcaag

SEQ ID NO: 1117374 - RNA, 22 nt, Human
cacagguggcuccaaguuagag

SEQ ID NO: 1117375 - RNA, 22 nt, Human
cauugcacugcagcccgggcaa

SEQ ID NO: 1117376 - RNA, 22 nt, Human
cuccagggaggucugcaggacu

SEQ ID NO: 1117377 - RNA, 22 nt, Human
auacagaaaaugaugcagaguu

SEQ ID NO: 1117378 - RNA, 22 nt, Human
ucugccugcggcugcagguggc

SEQ ID NO: 1117379 - RNA, 22 nt, Human
ggggauggaggcgugugguccu

SEQ ID NO: 1117380 - RNA, 22 nt, Human
ugugcagggaagggcaugcuau

SEQ ID NO: 1117381 - RNA, 22 nt, Human
auucagcaguuccugcuucagu

SEQ ID NO: 1117382 - RNA, 22 nt, Human
gccaggcucucagugacugccc

SEQ ID NO: 1117383 - RNA, 22 nt, Human
gguguccaucaggcugugcuuc

SEQ ID NO: 1117384 - RNA, 22 nt, Human
gcugccacucugagcuugcuuc

SEQ ID NO: 1117385 - RNA, 21 nt, Human
agagagaaggccauauggucc

SEQ ID NO: 1117386 - RNA, 20 nt, Human
ugaaaggugggaauuguggg

SEQ ID NO: 1117387 - RNA, 22 nt, Human
aggccagggucccacacucgca

SEQ ID NO: 1117388 - RNA, 22 nt, Human
gagggauggugugagaggcuca

SEQ ID NO: 1117389 - RNA, 23 nt, Human
uggcaccaggcauucuaggggua

SEQ ID NO: 1117390 - RNA, 22 nt, Human
gcagcccaauggacugagacag

SEQ ID NO: 1117391 - RNA, 22 nt, Human
ccagagcccgggaccuggacuu

SEQ ID NO: 1117392 - RNA, 22 nt, Human
cccagacucaucccugggagcu

SEQ ID NO: 1117393 - RNA, 22 nt, Human
gaggggcucuugggcaugaagg

SEQ ID NO: 1117394 - RNA, 18 nt, Human
aggagccuuugcacugga

SEQ ID NO: 1117395 - RNA, 22 nt, Human
caggagcucuuaaggaugugau

SEQ ID NO: 1117396 - RNA, 22 nt, Human
ugcuggccgugagcucucggga

SEQ ID NO: 1117397 - RNA, 23 nt, Human
auaauaacgucugucuugucucu

SEQ ID NO: 1117398 - RNA, 22 nt, Human
guguaaggccccagguucuuua

SEQ ID NO: 1117399 - RNA, 22 nt, Human
aggcaguguauugcuagcggcu

SEQ ID NO: 1117400 - RNA, 22 nt, Human
gauuucaaguaucuugggcgag

SEQ ID NO: 1117401 - RNA, 20 nt, Human
ucugcccaccccggcuccca

SEQ ID NO: 1117402 - RNA, 22 nt, Human
gcugggcuugguuucccugcuu

SEQ ID NO: 1117403 - RNA, 22 nt, Human
uaggccagaggagcagcuuugg

SEQ ID NO: 1117404 - RNA, 22 nt, Human
uucaagauaauaggaaugaaaa

SEQ ID NO: 1117405 - RNA, 22 nt, Human
cuacauuuggagaguauaggaa

SEQ ID NO: 1117406 - RNA, 22 nt, Human
ugggacaguuguccuccacucu

SEQ ID NO: 1117407 - RNA, 22 nt, Human
acugugcacaauucuaaguccu

SEQ ID NO: 1117408 - RNA, 22 nt, Human
gccuggaguagcauggcaagcc

SEQ ID NO: 1117409 - RNA, 19 nt, Human
ucaaagucugagucacuuu

SEQ ID NO: 1117410 - RNA, 22 nt, Human
ugagccaggcucaagugauccu

SEQ ID NO: 1117411 - RNA, 22 nt, Human
uccucugcuguucugguucuuu

SEQ ID NO: 1117412 - RNA, 22 nt, Human
uggagcugauacagcuggcuuu

SEQ ID NO: 1117413 - RNA, 22 nt, Human
ggggauggauuccgggucccug

SEQ ID NO: 1117414 - RNA, 22 nt, Human
aagcccagcugaaagcauuuuu

SEQ ID NO: 1117415 - RNA, 22 nt, Human
uggcagcacuagguacugagcu

SEQ ID NO: 1117416 - RNA, 22 nt, Human
aggacuuagaacauuauguacu

SEQ ID NO: 1117417 - RNA, 22 nt, Human
ccugccugggcucacuugccag

SEQ ID NO: 1117418 - RNA, 22 nt, Human
ccucccaccauuuagagagagc

SEQ ID NO: 1117419 - RNA, 22 nt, Human
ugggcuacucugggagccuaac

SEQ ID NO: 1117420 - RNA, 22 nt, Human
aggccuggguguucaccagaag

SEQ ID NO: 1117421 - RNA, 22 nt, Human
cucccugggcagauguggcucu

SEQ ID NO: 1117422 - RNA, 22 nt, Human
gccucugcaauuacauugugcc

SEQ ID NO: 1117423 - RNA, 22 nt, Human
uauuucuuucagguauguguug

SEQ ID NO: 1117424 - RNA, 22 nt, Human
agaugcuucaguguuuaauuua

SEQ ID NO: 1117425 - RNA, 22 nt, Human
uuguauuagcuguaaauuuucu

SEQ ID NO: 1117426 - RNA, 22 nt, Human
cugcugggaaggucugcucagu

SEQ ID NO: 1117427 - RNA, 22 nt, Human
cuccaggccauggcugcggagg

SEQ ID NO: 1117428 - RNA, 22 nt, Human
caguggcaugguugacugcagu

SEQ ID NO: 1117429 - RNA, 19 nt, Human
cuggcagccugucuguguc

SEQ ID NO: 1117430 - RNA, 22 nt, Human
uacaaagcuguauagccugguc

SEQ ID NO: 1117431 - RNA, 22 nt, Human
ccucugagagaaggccuucagc

SEQ ID NO: 1117432 - RNA, 22 nt, Human
uuucauuacguguuugacuugu

SEQ ID NO: 1117433 - RNA, 22 nt, Human
uuucauaaugucacagucaaaa

SEQ ID NO: 1117434 - RNA, 21 nt, Human
ugaagccugaggcauagcccc

SEQ ID NO: 1117435 - RNA, 20 nt, Human
cagccuccacucacucagcu

SEQ ID NO: 1117436 - RNA, 22 nt, Human
uuuaagaugguauuuuauaaag

SEQ ID NO: 1117437 - RNA, 22 nt, Human
cagagcugcgcuuuuuccuggu

SEQ ID NO: 1117438 - RNA, 22 nt, Human
ugggcccugacuucaagcaucc

SEQ ID NO: 1117439 - RNA, 22 nt, Human
uauauagaaaagcagauguugg

SEQ ID NO: 1117440 - RNA, 22 nt, Human
auuucagcccaguaugagcccc

SEQ ID NO: 1117441 - RNA, 22 nt, Human
gguuggaggugggaauagcuag

SEQ ID NO: 1117442 - RNA, 22 nt, Human
uuugugaagggaacagaagugu

SEQ ID NO: 1117443 - RNA, 22 nt, Human
uggccugggugcugcugacauc

SEQ ID NO: 1117444 - RNA, 22 nt, Human
acauuugaggauguuaagaaug

SEQ ID NO: 1117445 - RNA, 22 nt, Human
acagaaagaagguguauuugag

SEQ ID NO: 1117446 - RNA, 22 nt, Human
uugcauguguaauuuuucuaaa

SEQ ID NO: 1117447 - RNA, 22 nt, Human
acaccagggccuagccagggcg

SEQ ID NO: 1117448 - RNA, 22 nt, Human
ggcagggaaacagcugauccca

SEQ ID NO: 1117449 - RNA, 22 nt, Human
gaggucaggcuugcagcagggu

SEQ ID NO: 1117450 - RNA, 22 nt, Human
gugcuaggauuacaggcauggg

SEQ ID NO: 1117451 - RNA, 22 nt, Human
agagccugucugccuuucuacc

SEQ ID NO: 1117452 - RNA, 18 nt, Human
aagaggaggagcagguug

SEQ ID NO: 1117453 - RNA, 22 nt, Human
cagcucucuaaggucuugcuuu

SEQ ID NO: 1117454 - RNA, 22 nt, Human
gugcagcugugugagagcucca

SEQ ID NO: 1117455 - RNA, 22 nt, Human
ggccucugcccucacuccuguc

SEQ ID NO: 1117456 - RNA, 22 nt, Human
agggccagcccauaaugccaaa

SEQ ID NO: 1117457 - RNA, 22 nt, Human
cugccugugccaccgccucauu

SEQ ID NO: 1117458 - RNA, 22 nt, Human
agagccuugaagaucuggaaaa

SEQ ID NO: 1117459 - RNA, 22 nt, Human
ccugucugcggaggaguggaag

SEQ ID NO: 1117460 - RNA, 22 nt, Human
aaugcuguaaagaugcuaucug

SEQ ID NO: 1117461 - RNA, 22 nt, Human
cucucccagucaggcucaggau

SEQ ID NO: 1117462 - RNA, 22 nt, Human
ccugggcuugcaucugugcugg

SEQ ID NO: 1117463 - RNA, 22 nt, Human
gauuucaaggaguuuucacagu

SEQ ID NO: 1117464 - RNA, 22 nt, Human
ccaggaggcagaaguugcagug

SEQ ID NO: 1117465 - RNA, 21 nt, Human
ucugucucuccacugcccugc

SEQ ID NO: 1117466 - RNA, 22 nt, Human
gggcagcucuggcugugggaag

SEQ ID NO: 1117467 - RNA, 18 nt, Human
uugagggaggggcagagu

SEQ ID NO: 1117468 - RNA, 22 nt, Human
agagccaggacugugucucacu

SEQ ID NO: 1117469 - RNA, 22 nt, Human
uagcagggguagauagagugug

SEQ ID NO: 1117470 - RNA, 22 nt, Human
cagcccagcacuaaguagauuu

SEQ ID NO: 1117471 - RNA, 22 nt, Human
ccaggccagcaggcacaccugc

SEQ ID NO: 1117472 - RNA, 22 nt, Human
ucaccacugaacagaccuuugg

SEQ ID NO: 1117473 - RNA, 20 nt, Human
uuccagagaucugcauuuua

SEQ ID NO: 1117474 - RNA, 22 nt, Human
uuuccucugacugcuccccugc

SEQ ID NO: 1117475 - RNA, 22 nt, Human
ugggagcaagcuggugcuggag

SEQ ID NO: 1117476 - RNA, 22 nt, Human
acugagcugcaagucagggagg

SEQ ID NO: 1117477 - RNA, 20 nt, Human
uccucagaagacauuugggg

SEQ ID NO: 1117478 - RNA, 22 nt, Human
uggcuucugggacuugugagca

SEQ ID NO: 1117479 - RNA, 22 nt, Human
ccagagccggauugugaagugc

SEQ ID NO: 1117480 - RNA, 22 nt, Human
ucuggcucauacaagccugcaa

SEQ ID NO: 1117481 - RNA, 22 nt, Human
aaugcacauauauguguauaca

SEQ ID NO: 1117482 - RNA, 22 nt, Human
gcacagggaggcuggccuggcc

SEQ ID NO: 1117483 - RNA, 22 nt, Human
cuacauuuguucuauagcuuuu

SEQ ID NO: 1117484 - RNA, 22 nt, Human
aaaaugcaugagaaugugcucg

SEQ ID NO: 1117485 - RNA, 20 nt, Human
ccuggcuuugcaucugugau

SEQ ID NO: 1117486 - RNA, 22 nt, Human
agcccaaggcuucccugcuggc

SEQ ID NO: 1117487 - RNA, 22 nt, Human
ggugggugagcccugggagcug

SEQ ID NO: 1117488 - RNA, 22 nt, Human
gccuuggccuuccuaggccuga

SEQ ID NO: 1117489 - RNA, 22 nt, Human
agaagccaauucugugugaguc

SEQ ID NO: 1117490 - RNA, 22 nt, Human
gcuggagguuucaccugaguuu

SEQ ID NO: 1117491 - RNA, 20 nt, Human
aaaauauguauaacucuucu

SEQ ID NO: 1117492 - RNA, 22 nt, Human
uaaauucuacaacuucaaagau

SEQ ID NO: 1117493 - RNA, 22 nt, Human
guuauugcaguauagaggucua

SEQ ID NO: 1117494 - RNA, 22 nt, Human
agagugaaggccagguuacagu

SEQ ID NO: 1117495 - RNA, 18 nt, Human
agaguguucucagugaaa

SEQ ID NO: 1117496 - RNA, 22 nt, Human
aggggccauuguucugcccgcu

SEQ ID NO: 1117497 - RNA, 22 nt, Human
aguguuucuggcaaaugaaagu

SEQ ID NO: 1117498 - RNA, 22 nt, Human
ggugugccuggggcuuagcugc

SEQ ID NO: 1117499 - RNA, 22 nt, Human
agaaauguggaucguuuuaaaa

SEQ ID NO: 1117500 - RNA, 22 nt, Human
gcagggucugaggccacagagg

SEQ ID NO: 1117501 - RNA, 22 nt, Human
guguccacggcugagaaugauu

SEQ ID NO: 1117502 - RNA, 17 nt, Human
ugaggccugcaucagug

SEQ ID NO: 1117503 - RNA, 20 nt, Human
gugccuggagaagaggcugu

SEQ ID NO: 1117504 - RNA, 22 nt, Human
uggcagcaauuagcuagagcug

SEQ ID NO: 1117505 - RNA, 22 nt, Human
uccucucagugugguuguggga

SEQ ID NO: 1117506 - RNA, 22 nt, Human
caguugaugggacucauguggg

SEQ ID NO: 1117507 - RNA, 22 nt, Human
auucaagagcccauguuuccug

SEQ ID NO: 1117508 - RNA, 22 nt, Human
gcuccuggcuccaggcagccaa

SEQ ID NO: 1117509 - RNA, 22 nt, Human
ccacucugcugugcuccaugau

SEQ ID NO: 1117510 - RNA, 22 nt, Human
uggcucugucacugugagcuau

SEQ ID NO: 1117511 - RNA, 22 nt, Human
agagcuguucagcagccagguu

SEQ ID NO: 1117512 - RNA, 22 nt, Human
gcugcagcccggcgcgccugag

SEQ ID NO: 1117513 - RNA, 22 nt, Human
agaguguuucagucuuccuaga

SEQ ID NO: 1117514 - RNA, 22 nt, Human
gggcugcuuuuuucuuagcaga

SEQ ID NO: 1117515 - RNA, 22 nt, Human
uugugcauuucucugagugugu

SEQ ID NO: 1117516 - RNA, 22 nt, Human
aaggcaggaugggaaaagauuu

SEQ ID NO: 1117517 - RNA, 22 nt, Human
cugagccauccauaccagcuua

SEQ ID NO: 1117518 - RNA, 22 nt, Human
ugcuuuggccacuagaauucag

SEQ ID NO: 1117519 - RNA, 20 nt, Human
ucugucucugagcuagacuu

SEQ ID NO: 1117520 - RNA, 22 nt, Human
acagcuggaggucugugagcac

SEQ ID NO: 1117521 - RNA, 22 nt, Human
gcagggcaaugaucccgagagg

SEQ ID NO: 1117522 - RNA, 22 nt, Human
agaagccauucccuguaggcuc

SEQ ID NO: 1117523 - RNA, 22 nt, Human
uggcucagagccuugagagcug

SEQ ID NO: 1117524 - RNA, 23 nt, Human
cccuggaguaaauucuuggaagg

SEQ ID NO: 1117525 - RNA, 18 nt, Human
ucugggcuucccgaggcu

SEQ ID NO: 1117526 - RNA, 22 nt, Human
cagaggcucuuccucacugccc

SEQ ID NO: 1117527 - RNA, 22 nt, Human
uagaaaugcaguguacuguguc

SEQ ID NO: 1117528 - RNA, 22 nt, Human
cccagggaaugacucuggccuu

SEQ ID NO: 1117529 - RNA, 22 nt, Human
ucagugcagaauagugaugcau

SEQ ID NO: 1117530 - RNA, 22 nt, Human
ucucagagccuaacuaaccuaa

SEQ ID NO: 1117531 - RNA, 22 nt, Human
ggccacuccgcugcuacuggaa

SEQ ID NO: 1117532 - RNA, 22 nt, Human
aggccugcagcaggagcaaacc

SEQ ID NO: 1117533 - RNA, 22 nt, Human
ggccucaguuucuucaacugua

SEQ ID NO: 1117534 - RNA, 22 nt, Human
cccagcaucuccaggcauggcc

SEQ ID NO: 1117535 - RNA, 22 nt, Human
aaacuguauauuuauggcaugu

SEQ ID NO: 1117536 - RNA, 22 nt, Human
agcagcugguaggaguggccac

SEQ ID NO: 1117537 - RNA, 22 nt, Human
aggccugacuugaauuuagggc

SEQ ID NO: 1117538 - RNA, 22 nt, Human
aggcccugaagucggccccuca

SEQ ID NO: 1117539 - RNA, 22 nt, Human
acucccagguugccuggcaggc

SEQ ID NO: 1117540 - RNA, 22 nt, Human
auugacaaauggauguugacau

SEQ ID NO: 1117541 - RNA, 22 nt, Human
gcucugucauuuugcagacacu

SEQ ID NO: 1117542 - RNA, 22 nt, Human
auguaucaauuaucugucugca

SEQ ID NO: 1117543 - RNA, 22 nt, Human
aacucaguguguuucuuaguau

SEQ ID NO: 1117544 - RNA, 19 nt, Human
gcauuucucuuuacagcca

SEQ ID NO: 1117545 - RNA, 17 nt, Human
gguggccugcaguggcu

SEQ ID NO: 1117546 - RNA, 23 nt, Human
ggcucugugcugggccugcagga

SEQ ID NO: 1117547 - RNA, 22 nt, Human
caguauguuugggagacaugac

SEQ ID NO: 1117548 - RNA, 22 nt, Human
ccacugggcguuucuguccaau

SEQ ID NO: 1117549 - RNA, 22 nt, Human
ccuggagcaaaaaucuaaggag

SEQ ID NO: 1117550 - RNA, 22 nt, Human
uggcagugccccuugaccagug

SEQ ID NO: 1117551 - RNA, 22 nt, Human
ggucccaggcucccucuugucc

SEQ ID NO: 1117552 - RNA, 21 nt, Human
acaugucucuaaucucaguga

SEQ ID NO: 1117553 - RNA, 22 nt, Human
ugcugggcuugaaagcugcuaa

SEQ ID NO: 1117554 - RNA, 21 nt, Human
ucagggcagcugcucuucaga

SEQ ID NO: 1117555 - RNA, 22 nt, Human
auuauaggcuugagccaccgug

SEQ ID NO: 1117556 - RNA, 22 nt, Human
agcuggagaucaugcugauacu

SEQ ID NO: 1117557 - RNA, 22 nt, Human
ccagcucuagccccauguggcu

SEQ ID NO: 1117558 - RNA, 20 nt, Human
aggaaaaggguggugguaga

SEQ ID NO: 1117559 - RNA, 22 nt, Human
cugagccaaccacagcaggagc

SEQ ID NO: 1117560 - RNA, 22 nt, Human
cugagcuggucuauggacuugg

SEQ ID NO: 1117561 - RNA, 22 nt, Human
ggacacagcugcagccacaccc

SEQ ID NO: 1117562 - RNA, 23 nt, Human
aguuuuucugcaugguucuguau

SEQ ID NO: 1117563 - RNA, 18 nt, Human
gcaggugccacugcuguu

SEQ ID NO: 1117564 - RNA, 22 nt, Human
gcuuuccuggcccugucccugc

SEQ ID NO: 1117565 - RNA, 22 nt, Human
accaucaguacuggaugcugac

SEQ ID NO: 1117566 - RNA, 22 nt, Human
agcagccacccagcugcucauu

SEQ ID NO: 1117567 - RNA, 16 nt, Human
gagggcagaggcggaa

SEQ ID NO: 1117568 - RNA, 22 nt, Human
ccugccuggcugucagcagagc

SEQ ID NO: 1117569 - RNA, 22 nt, Human
cagccugcccuggaagcccagc

SEQ ID NO: 1117570 - RNA, 22 nt, Human
cuagucacucagcacugacaaa

SEQ ID NO: 1117571 - RNA, 22 nt, Human
cccaggaggcagagcuugcagu

SEQ ID NO: 1117572 - RNA, 22 nt, Human
cugagaaggaagccuccacucu

SEQ ID NO: 1117573 - RNA, 22 nt, Human
agggaggaucugcuccuugucu

SEQ ID NO: 1117574 - RNA, 22 nt, Human
ccccagcucagugcagggacau

SEQ ID NO: 1117575 - RNA, 22 nt, Human
gacaugcaacaauuuggcauuu

SEQ ID NO: 1117576 - RNA, 22 nt, Human
aaauguguuucuuugugaaugg

SEQ ID NO: 1117577 - RNA, 22 nt, Human
aggaaaugcugaugcuccugga

SEQ ID NO: 1117578 - RNA, 22 nt, Human
cugcugcugcuaucuacccagg

SEQ ID NO: 1117579 - RNA, 22 nt, Human
cuucuuuacuuucuagaaauaa

SEQ ID NO: 1117580 - RNA, 22 nt, Human
gcaggagcuggaaagugauguu

SEQ ID NO: 1117581 - RNA, 22 nt, Human
cagcccugagaaggaggaucuc

SEQ ID NO: 1117582 - RNA, 19 nt, Human
ugccagcauuaggcugaag

SEQ ID NO: 1117583 - RNA, 22 nt, Human
ccagcagcccucuuccaagacu

SEQ ID NO: 1117584 - RNA, 20 nt, Human
gauuucaaagcagaguggcc

SEQ ID NO: 1117585 - RNA, 22 nt, Human
ggcuucuccccuuugagucuuc

SEQ ID NO: 1117586 - RNA, 20 nt, Human
aggagccauugacugcagca

SEQ ID NO: 1117587 - RNA, 22 nt, Human
cugggagucaccaggagcaagg

SEQ ID NO: 1117588 - RNA, 22 nt, Human
agcuucucaggagucugaggca

SEQ ID NO: 1117589 - RNA, 22 nt, Human
gagacacacacaggagguggca

SEQ ID NO: 1117590 - RNA, 22 nt, Human
uuuacuuugugucaagucaaga

SEQ ID NO: 1117591 - RNA, 22 nt, Human
acaggugugagaacaugccuug

SEQ ID NO: 1117592 - RNA, 22 nt, Human
ugagccaguggaagauggcagu

SEQ ID NO: 1117593 - RNA, 22 nt, Human
gggcugagucugcugccuguca

SEQ ID NO: 1117594 - RNA, 22 nt, Human
aacuuuaaggcuauaaauuaug

SEQ ID NO: 1117595 - RNA, 22 nt, Human
agccuggcccugcugaacucug

SEQ ID NO: 1117596 - RNA, 22 nt, Human
ggagccuguuaguugagugcuc

SEQ ID NO: 1117597 - RNA, 22 nt, Human
ugugcccaucccucuggagugu

SEQ ID NO: 1117598 - RNA, 22 nt, Human
gucccagggaagaaggcagcac

SEQ ID NO: 1117599 - RNA, 22 nt, Human
ccagcagcccacaggcgucccu

SEQ ID NO: 1117600 - RNA, 22 nt, Human
cagggcccauggcucagguagg

SEQ ID NO: 1117601 - RNA, 22 nt, Human
uaagacaauucuucagucacaa

SEQ ID NO: 1117602 - RNA, 22 nt, Human
caugggcucuucuggacugcac

SEQ ID NO: 1117603 - RNA, 19 nt, Human
agggagaauuccaagagga

SEQ ID NO: 1117604 - RNA, 22 nt, Human
ugcuggcuacugauggcaggcc

SEQ ID NO: 1117605 - RNA, 22 nt, Human
uuugcauuauauuuauagaaga

SEQ ID NO: 1117606 - RNA, 18 nt, Human
ugucauugccagggaagc

SEQ ID NO: 1117607 - RNA, 22 nt, Human
cagcugaauucuucagacucca

SEQ ID NO: 1117608 - RNA, 22 nt, Human
accucugcaaugcaaugucaug

SEQ ID NO: 1117609 - RNA, 22 nt, Human
cuguguccucccgcugcaccca

SEQ ID NO: 1117610 - RNA, 20 nt, Human
ugucaugcauuagaugaaga

SEQ ID NO: 1117611 - RNA, 22 nt, Human
uccuugaaaggggcugcagggc

SEQ ID NO: 1117612 - RNA, 22 nt, Human
aucaaaguuucccagaaguugu

SEQ ID NO: 1117613 - RNA, 22 nt, Human
uggcaguguauagguggcuccu

SEQ ID NO: 1117614 - RNA, 22 nt, Human
uggcuccuaucaaggagugggu

SEQ ID NO: 1117615 - RNA, 22 nt, Human
gaggacagcuuagggcuuccug

SEQ ID NO: 1117616 - RNA, 22 nt, Human
agagcccucuucacugccccuu

SEQ ID NO: 1117617 - RNA, 22 nt, Human
gggacuggcacagggcugggag

SEQ ID NO: 1117618 - RNA, 22 nt, Human
caggcagcaggagcccugcucg

SEQ ID NO: 1117619 - RNA, 22 nt, Human
agccugucugucuccaaagcug

SEQ ID NO: 1117620 - RNA, 22 nt, Human
caaagguauucucauuuuggaa

SEQ ID NO: 1117621 - RNA, 22 nt, Human
gugucacaugguuuacugcagc

SEQ ID NO: 1117622 - RNA, 20 nt, Human
uggcccuguuuucuccaggc

SEQ ID NO: 1117623 - RNA, 19 nt, Human
ccagcccugucacuucuug

SEQ ID NO: 1117624 - RNA, 22 nt, Human
agcagcauguugggaugugaaa

SEQ ID NO: 1117625 - RNA, 22 nt, Human
gagcaggcauucuaguggcuga

SEQ ID NO: 1117626 - RNA, 22 nt, Human
cgucccaguuccagccgcgcug

SEQ ID NO: 1117627 - RNA, 22 nt, Human
aagggcugaaugaaggguugaa

SEQ ID NO: 1117628 - RNA, 22 nt, Human
uagaaacacagaucugguguca

SEQ ID NO: 1117629 - RNA, 22 nt, Human
cagaaugagauaacccagauug

SEQ ID NO: 1117630 - RNA, 22 nt, Human
uggcagcagccauggaaggccc

SEQ ID NO: 1117631 - RNA, 22 nt, Human
ugccucugaggaagauuguguu

SEQ ID NO: 1117632 - RNA, 22 nt, Human
ucagggcucaccagccucugcc

SEQ ID NO: 1117633 - RNA, 23 nt, Human
uugcauguagcccaugaguaacu

SEQ ID NO: 1117634 - RNA, 22 nt, Human
aggggagcuaacaccagagccc

SEQ ID NO: 1117635 - RNA, 22 nt, Human
cuuucauucuuagauauuagug

SEQ ID NO: 1117636 - RNA, 22 nt, Human
agugugcugcuuaaacaguugu

SEQ ID NO: 1117637 - RNA, 22 nt, Human
agcugcagucaagcugggccac

SEQ ID NO: 1117638 - RNA, 22 nt, Human
aaaggucagacuuaggcugggc

SEQ ID NO: 1117639 - RNA, 22 nt, Human
gagccugagugcugccuccccu

SEQ ID NO: 1117640 - RNA, 22 nt, Human
gcccacacaccagcucaggagg

SEQ ID NO: 1117641 - RNA, 22 nt, Human
ggcaaaaaccgcaauaacuucu

SEQ ID NO: 1117642 - RNA, 22 nt, Human
gcuucauuacugacagucugug

SEQ ID NO: 1117643 - RNA, 18 nt, Human
gcugucugaggucugagg

SEQ ID NO: 1117644 - RNA, 22 nt, Human
agcagugggugacagagcugag

SEQ ID NO: 1117645 - RNA, 18 nt, Human
caggagcaggaguugaac

SEQ ID NO: 1117646 - RNA, 19 nt, Human
guggccucggagcgcgcgg

SEQ ID NO: 1117647 - RNA, 22 nt, Human
uauuuugucuucugcucaucac

SEQ ID NO: 1117648 - RNA, 22 nt, Human
gggaaggagccugcuugcuaga

SEQ ID NO: 1117649 - RNA, 22 nt, Human
agggccuggaacugugggcagg

SEQ ID NO: 1117650 - RNA, 22 nt, Human
auuuguaauuucuuaucugugu

SEQ ID NO: 1117651 - RNA, 22 nt, Human
ggagugaguacuggaguagcug

SEQ ID NO: 1117652 - RNA, 21 nt, Human
agauuguauggaggugagagg

SEQ ID NO: 1117653 - RNA, 22 nt, Human
gcaggagcugcucuccugacga

SEQ ID NO: 1117654 - RNA, 22 nt, Human
auaccuuuuagacauguaguug

SEQ ID NO: 1117655 - RNA, 22 nt, Human
ggagcugcuccuucagccaagu

SEQ ID NO: 1117656 - RNA, 20 nt, Human
uccugcaguuccuaggaggg

SEQ ID NO: 1117657 - RNA, 22 nt, Human
ugcuuuauuuauaaaauagcaa

SEQ ID NO: 1117658 - RNA, 22 nt, Human
uguaccuuuuucugugcaugcu

SEQ ID NO: 1117659 - RNA, 22 nt, Human
gaguggggcguggauccagcgu

SEQ ID NO: 1117660 - RNA, 22 nt, Human
ugcucucucaggccuggcccac

SEQ ID NO: 1117661 - RNA, 22 nt, Human
agucaguguagaaagcccaggc

SEQ ID NO: 1117662 - RNA, 22 nt, Human
aggccuggcaugagaccugaga

SEQ ID NO: 1117663 - RNA, 22 nt, Human
ggagaccagaaggaagcuucga

SEQ ID NO: 1117664 - RNA, 22 nt, Human
aggaccagccuccaggucucuu

SEQ ID NO: 1117665 - RNA, 22 nt, Human
cuggagccacugggucuuguau

SEQ ID NO: 1117666 - RNA, 21 nt, Human
ugccagcauuaaacagucauu

SEQ ID NO: 1117667 - RNA, 18 nt, Human
cugccuguugcugagagg

SEQ ID NO: 1117668 - RNA, 22 nt, Human
aaaugcuugcucuugauuauuu

SEQ ID NO: 1117669 - RNA, 22 nt, Human
cagggcaguuuuacuucucucu

SEQ ID NO: 1117670 - RNA, 22 nt, Human
ggcugcugugaccucaggugau

SEQ ID NO: 1117671 - RNA, 22 nt, Human
caagcuccuuacauccacaggg

SEQ ID NO: 1117672 - RNA, 22 nt, Human
uaagaacaagcuggggguucca

SEQ ID NO: 1117673 - RNA, 21 nt, Human
acagcagacaggcuuaggacc

SEQ ID NO: 1117674 - RNA, 22 nt, Human
gcuggagcugaguucccugggc

SEQ ID NO: 1117675 - RNA, 21 nt, Human
gucagcagauccagcacuugu

SEQ ID NO: 1117676 - RNA, 22 nt, Human
agcaggugcauggcgagcgcgg

SEQ ID NO: 1117677 - RNA, 19 nt, Human
aggccugggguuuugcacu

SEQ ID NO: 1117678 - RNA, 22 nt, Human
cuuggcugucuauaggaaagag

SEQ ID NO: 1117679 - RNA, 22 nt, Human
aagggaggaggauuuauuguac

SEQ ID NO: 1117680 - RNA, 22 nt, Human
ucacaggaaccaucagagaaau

SEQ ID NO: 1117681 - RNA, 22 nt, Human
aggugcagcaugaguccaacgg

SEQ ID NO: 1117682 - RNA, 22 nt, Human
uaugugaauacagcaguggaug

SEQ ID NO: 1117683 - RNA, 22 nt, Human
caaugauucugcaacugugugc

SEQ ID NO: 1117684 - RNA, 22 nt, Human
ccagcuuguuugaagcucguca

SEQ ID NO: 1117685 - RNA, 22 nt, Human
agaaaucuaagaugcucaagga

SEQ ID NO: 1117686 - RNA, 22 nt, Human
uccugcagagacagaggccuca

SEQ ID NO: 1117687 - RNA, 22 nt, Human
gcugaguguaaugauggcagag

SEQ ID NO: 1117688 - RNA, 22 nt, Human
aggcuucuaggguuggcagcgg

SEQ ID NO: 1117689 - RNA, 22 nt, Human
gggagcugagcuggaagagaau

SEQ ID NO: 1117690 - RNA, 21 nt, Human
uucaaaguuugccuaaagauu

SEQ ID NO: 1117691 - RNA, 22 nt, Human
agccccugggaguagcugcugc

SEQ ID NO: 1117692 - RNA, 22 nt, Human
aaauauguauggaguucaugaa

SEQ ID NO: 1117693 - RNA, 22 nt, Human
gcuggguggaucggaggcucug

SEQ ID NO: 1117694 - RNA, 22 nt, Human
caguaugucuacuggacaaagu

SEQ ID NO: 1117695 - RNA, 22 nt, Human
cucucugggggccaugccaaga

SEQ ID NO: 1117696 - RNA, 22 nt, Human
uacuuuggauccuuacaauagc

SEQ ID NO: 1117697 - RNA, 22 nt, Human
gccuuccuuuuaccaccagcca

SEQ ID NO: 1117698 - RNA, 22 nt, Human
cuucaagauccauagauauugc

SEQ ID NO: 1117699 - RNA, 19 nt, Human
gggcuuggggcugaagccu

SEQ ID NO: 1117700 - RNA, 22 nt, Human
uaucuguuccaggcacucagcu

SEQ ID NO: 1117701 - RNA, 22 nt, Human
caggaacacaaguucagggaug

SEQ ID NO: 1117702 - RNA, 22 nt, Human
gggcugcugccaaucacagccu

SEQ ID NO: 1117703 - RNA, 22 nt, Human
gagcagcuccagccgcaugacu

SEQ ID NO: 1117704 - RNA, 22 nt, Human
cagaagaauggugucugagcuc

SEQ ID NO: 1117705 - RNA, 22 nt, Human
cuugccuguggcuaguuggcuc

SEQ ID NO: 1117706 - RNA, 22 nt, Human
ccucuggcaacuucacagccca

SEQ ID NO: 1117707 - RNA, 22 nt, Human
gggcugcuguagagaacauguu

SEQ ID NO: 1117708 - RNA, 22 nt, Human
cagaaauguuuauauguggugu

SEQ ID NO: 1117709 - RNA, 22 nt, Human
gagugugucggucagcguggcg

SEQ ID NO: 1117710 - RNA, 18 nt, Human
caugggugacagguggau

SEQ ID NO: 1117711 - RNA, 20 nt, Human
gcugccuuguccugcuuggu

SEQ ID NO: 1117712 - RNA, 22 nt, Human
gaggccuggucuaugagauguu

SEQ ID NO: 1117713 - RNA, 22 nt, Human
uguaguaagugcgcaauaaaua

SEQ ID NO: 1117714 - RNA, 22 nt, Human
uggcugaacuaaugugcuguuu

SEQ ID NO: 1117715 - RNA, 19 nt, Human
aauguaguguuaugucaac

SEQ ID NO: 1117716 - RNA, 22 nt, Human
ucccuguccugggcaaucccag

SEQ ID NO: 1117717 - RNA, 21 nt, Human
ugcagcagaguaagcagggga

SEQ ID NO: 1117718 - RNA, 22 nt, Human
uuguaacacuuuucuauuaaua

SEQ ID NO: 1117719 - RNA, 22 nt, Human
cuggggcuucaaugcuucggug

SEQ ID NO: 1117720 - RNA, 22 nt, Human
gaaaugcagaaccugagaccau

SEQ ID NO: 1117721 - RNA, 22 nt, Human
ccagcccugaacccugcugcau

SEQ ID NO: 1117722 - RNA, 22 nt, Human
cuuuauguucaguacaaugcuu

SEQ ID NO: 1117723 - RNA, 22 nt, Human
cuccucccucuuugccacacau

SEQ ID NO: 1117724 - RNA, 22 nt, Human
agggcagcagcggcccaggccu

SEQ ID NO: 1117725 - RNA, 22 nt, Human
uccagcagguccgagacaaguu

SEQ ID NO: 1117726 - RNA, 20 nt, Human
cccugagacaaaggaggggc

SEQ ID NO: 1117727 - RNA, 22 nt, Human
uguucuuucaguuagacacagu

SEQ ID NO: 1117728 - RNA, 22 nt, Human
aggcuucccaagcagcugcaaa

SEQ ID NO: 1117729 - RNA, 22 nt, Human
cugggacacccaaggaaagagc

SEQ ID NO: 1117730 - RNA, 22 nt, Human
gggcuggcucugucuagaaagg

SEQ ID NO: 1117731 - RNA, 22 nt, Human
acacagggaggaggugcugugc

SEQ ID NO: 1117732 - RNA, 22 nt, Human
gccagcagguggagagaucaag

SEQ ID NO: 1117733 - RNA, 22 nt, Human
aggggcuguggaaaccaacucu

SEQ ID NO: 1117734 - RNA, 22 nt, Human
auaaggcaagcugucaguuugu

SEQ ID NO: 1117735 - RNA, 22 nt, Human
agcagcuuacauguggccuauc

SEQ ID NO: 1117736 - RNA, 22 nt, Human
guccucugaaguugugcaaugc

SEQ ID NO: 1117737 - RNA, 22 nt, Human
ugauacagucagcucacaauug

SEQ ID NO: 1117738 - RNA, 22 nt, Human
ugccugcuaggcccugcugggu

SEQ ID NO: 1117739 - RNA, 20 nt, Human
agucccagaucaaauuucug

SEQ ID NO: 1117740 - RNA, 22 nt, Human
gggggcuggacuuucccacaca

SEQ ID NO: 1117741 - RNA, 22 nt, Human
augagcugggccauccagugau

SEQ ID NO: 1117742 - RNA, 22 nt, Human
cagcaggcguugggagaaagac

SEQ ID NO: 1117743 - RNA, 22 nt, Human
ggggauggaauguaguagugau

SEQ ID NO: 1117744 - RNA, 22 nt, Human
uguauguguauguacauaugca

SEQ ID NO: 1117745 - RNA, 21 nt, Human
ucagaacaauuccaugccucc

SEQ ID NO: 1117746 - RNA, 22 nt, Human
aagauuuccuggauguaauucc

SEQ ID NO: 1117747 - RNA, 22 nt, Human
gggcuggaggagauccagaggc

SEQ ID NO: 1117748 - RNA, 22 nt, Human
gcucugcugaagccccuugcau

SEQ ID NO: 1117749 - RNA, 22 nt, Human
ggugcagcugcagccugggagc

SEQ ID NO: 1117750 - RNA, 22 nt, Human
ugccuggguguaaagggccaac

SEQ ID NO: 1117751 - RNA, 22 nt, Human
ugcauuguugaccaguugugca

SEQ ID NO: 1117752 - RNA, 22 nt, Human
acagguggcuuauuggcugauu

SEQ ID NO: 1117753 - RNA, 22 nt, Human
caguacuuaacuuauaggagag

SEQ ID NO: 1117754 - RNA, 22 nt, Human
gugcauuuggugacucucaccc

SEQ ID NO: 1117755 - RNA, 22 nt, Human
ccucugccugcacaucauccug

SEQ ID NO: 1117756 - RNA, 22 nt, Human
ugaaaucuacccuauucagggu

SEQ ID NO: 1117757 - RNA, 22 nt, Human
aggcugggaaauguagucuucc

SEQ ID NO: 1117758 - RNA, 22 nt, Human
auagacuugguuaguaaauuug

SEQ ID NO: 1117759 - RNA, 22 nt, Human
gcaggcagguggcaucuuguga

SEQ ID NO: 1117760 - RNA, 22 nt, Human
gcucccucugcucaggcacuug

SEQ ID NO: 1117761 - RNA, 22 nt, Human
guggccaggacauugccaggca

SEQ ID NO: 1117762 - RNA, 23 nt, Human
gggugggccaaauuagguagccu

SEQ ID NO: 1117763 - RNA, 22 nt, Human
auggauaauggugauaguugca

SEQ ID NO: 1117764 - RNA, 22 nt, Human
cacauuucuaggaaauuaaaug

SEQ ID NO: 1117765 - RNA, 22 nt, Human
ucuggaguccagauccauuugg

SEQ ID NO: 1117766 - RNA, 22 nt, Human
aaugaacaucaaaugccuacca

SEQ ID NO: 1117767 - RNA, 22 nt, Human
ucucuucuagcuucuugugguu

SEQ ID NO: 1117768 - RNA, 22 nt, Human
agcacagaguugcagagagcgu

SEQ ID NO: 1117769 - RNA, 22 nt, Human
uaaugaauaaacuugagaguca

SEQ ID NO: 1117770 - RNA, 18 nt, Human
aggaagcaggaggaaggc

SEQ ID NO: 1117771 - RNA, 21 nt, Human
gccugcagaccccaccaggcu

SEQ ID NO: 1117772 - RNA, 22 nt, Human
ucuugggauugcccugcaguuc

SEQ ID NO: 1117773 - RNA, 22 nt, Human
uacauggguagguuaagucaua

SEQ ID NO: 1117774 - RNA, 20 nt, Human
cguaaggcaagugcugcauc

SEQ ID NO: 1117775 - RNA, 22 nt, Human
cugggccugggaggccaggucu

SEQ ID NO: 1117776 - RNA, 22 nt, Human
uggcucagcugacucggcuucu

SEQ ID NO: 1117777 - RNA, 22 nt, Human
cccuggagugugacgaggcauu

SEQ ID NO: 1117778 - RNA, 22 nt, Human
ggucuuccgagaggccugugcu

SEQ ID NO: 1117779 - RNA, 22 nt, Human
cagcugaguguuggcauguuca

SEQ ID NO: 1117780 - RNA, 22 nt, Human
gcugcagccaaauucauuguca

SEQ ID NO: 1117781 - RNA, 22 nt, Human
gaggaaaagagacagguuauug

SEQ ID NO: 1117782 - RNA, 22 nt, Human
cagccagggagggcaaaugaga

SEQ ID NO: 1117783 - RNA, 22 nt, Human
uuuuccucugcagagcaguuag

SEQ ID NO: 1117784 - RNA, 22 nt, Human
gcugcucuuuucagagaugaga

SEQ ID NO: 1117785 - RNA, 22 nt, Human
gccagagcagaauagaguggcc

SEQ ID NO: 1117786 - RNA, 22 nt, Human
cugggaugucuauagaacacuu

SEQ ID NO: 1117787 - RNA, 22 nt, Human
aagggcagcugacagaugcuua

SEQ ID NO: 1117788 - RNA, 22 nt, Human
caugaagcuugaagcaguccac

SEQ ID NO: 1117789 - RNA, 22 nt, Human
augauggugagguugagcacag

SEQ ID NO: 1117790 - RNA, 22 nt, Human
agcuuuauauuuaaugaauucu

SEQ ID NO: 1117791 - RNA, 22 nt, Human
agauacauuguucuaagcauug

SEQ ID NO: 1117792 - RNA, 22 nt, Human
aaacagaaggguagguaaacau

SEQ ID NO: 1117793 - RNA, 22 nt, Human
caggaacaauguaagucucauu

SEQ ID NO: 1117794 - RNA, 22 nt, Human
aaagguuugcauggaauuuacc

SEQ ID NO: 1117795 - RNA, 22 nt, Human
ucccagagacaucauuucuccg

SEQ ID NO: 1117796 - RNA, 22 nt, Human
cacugaagccacuggaagagga

SEQ ID NO: 1117797 - RNA, 21 nt, Human
uggcucuguucaauauaugga

SEQ ID NO: 1117798 - RNA, 22 nt, Human
ccagcucuuuuggcugagugag

SEQ ID NO: 1117799 - RNA, 22 nt, Human
agccucugucaagcuuuucaaa

SEQ ID NO: 1117800 - RNA, 22 nt, Human
agggagaacaguugcagcagac

SEQ ID NO: 1117801 - RNA, 22 nt, Human
uggcucagccauucguguugcc

SEQ ID NO: 1117802 - RNA, 22 nt, Human
aggggcucaguuacuuuggcag

SEQ ID NO: 1117803 - RNA, 22 nt, Human
acaggcugcugggcuccgugcu

SEQ ID NO: 1117804 - RNA, 22 nt, Human
uggccagguugggcuuugcagc

SEQ ID NO: 1117805 - RNA, 23 nt, Human
agcuggguggccugcgugaagcu

SEQ ID NO: 1117806 - RNA, 22 nt, Human
acagagguaggacaugagauau

SEQ ID NO: 1117807 - RNA, 22 nt, Human
aggacccagaggcagaggacgu

SEQ ID NO: 1117808 - RNA, 22 nt, Human
uuugcauuaguuuagauuucaa

SEQ ID NO: 1117809 - RNA, 22 nt, Human
gccaggcagcagcgaggauggu

SEQ ID NO: 1117810 - RNA, 22 nt, Human
cugucugucaaguucaucucca

SEQ ID NO: 1117811 - RNA, 22 nt, Human
cccuggaggcaaagguugcagu

SEQ ID NO: 1117812 - RNA, 22 nt, Human
auggauaagucaaagaguaucc

SEQ ID NO: 1117813 - RNA, 18 nt, Human
gaagggagcuggaaugca

SEQ ID NO: 1117814 - RNA, 22 nt, Human
guccuggguccccgcaggucag

SEQ ID NO: 1117815 - RNA, 22 nt, Human
gggcaguggcucacgccuguaa

SEQ ID NO: 1117816 - RNA, 22 nt, Human
uucuuccucagcagggcugccu

SEQ ID NO: 1117817 - RNA, 22 nt, Human
acugucugcaaaacucauacuc

SEQ ID NO: 1117818 - RNA, 22 nt, Human
ggaggacaggggcugcagcaca

SEQ ID NO: 1117819 - RNA, 18 nt, Human
gagcccugagucugcaca

SEQ ID NO: 1117820 - RNA, 22 nt, Human
gucccuaguggaaagacaugau

SEQ ID NO: 1117821 - RNA, 22 nt, Human
ugcagaguaaaagcagaugcua

SEQ ID NO: 1117822 - RNA, 22 nt, Human
ccagggcugcugugggacucca

SEQ ID NO: 1117823 - RNA, 18 nt, Human
cuuucagauggauaugcu

SEQ ID NO: 1117824 - RNA, 22 nt, Human
uaaaugugaccuucauuuuaua

SEQ ID NO: 1117825 - RNA, 22 nt, Human
guuugcauguguacuuaauugg

SEQ ID NO: 1117826 - RNA, 21 nt, Human
auacuuugaauuacagccuug

SEQ ID NO: 1117827 - RNA, 23 nt, Human
acuuuagauaaauuaugugcaca

SEQ ID NO: 1117828 - RNA, 22 nt, Human
aggccuccugcagggaugagug

SEQ ID NO: 1117829 - RNA, 22 nt, Human
ucugccuucgcugcucccugaa

SEQ ID NO: 1117830 - RNA, 22 nt, Human
ccagcugguuaaaauagagaaa

SEQ ID NO: 1117831 - RNA, 22 nt, Human
ucugagaguccaucuccaagcc

SEQ ID NO: 1117832 - RNA, 22 nt, Human
aggaaaaucgagucuggaggca

SEQ ID NO: 1117833 - RNA, 22 nt, Human
cuggccucauagccaagcugug

SEQ ID NO: 1117834 - RNA, 22 nt, Human
acuuugcacuaaguuacucauu

SEQ ID NO: 1117835 - RNA, 22 nt, Human
uggggacaggagacuuacagcu

SEQ ID NO: 1117836 - RNA, 19 nt, Human
ggcuggcaagugacagugu

SEQ ID NO: 1117837 - RNA, 22 nt, Human
aggagggugauccgggcugguc

SEQ ID NO: 1117838 - RNA, 22 nt, Human
cuggcaggucucgcugacgugu

SEQ ID NO: 1117839 - RNA, 22 nt, Human
aggcucaguuugguuuccauug

SEQ ID NO: 1117840 - RNA, 21 nt, Human
ucagcagcuuuugcagucccu

SEQ ID NO: 1117841 - RNA, 22 nt, Human
acacaggagauauguaauggcu

SEQ ID NO: 1117842 - RNA, 22 nt, Human
gaagagcuuaguuguccuagaa

SEQ ID NO: 1117843 - RNA, 21 nt, Human
ccuucucuugcuucagcuuca

SEQ ID NO: 1117844 - RNA, 22 nt, Human
aagguacagaaauuaacaagga

SEQ ID NO: 1117845 - RNA, 20 nt, Human
uguacacaguacuuuacaau

SEQ ID NO: 1117846 - RNA, 22 nt, Human
ugcauuaucuuuaauguucuca

SEQ ID NO: 1117847 - RNA, 22 nt, Human
uggccuuggcagugagaagagu

SEQ ID NO: 1117848 - RNA, 22 nt, Human
ucccuggcugggggcugccuug

SEQ ID NO: 1117849 - RNA, 22 nt, Human
ugcagaagugagucaugaggaa

SEQ ID NO: 1117850 - RNA, 22 nt, Human
uccuucaguuaaagaucucaca

SEQ ID NO: 1117851 - RNA, 22 nt, Human
ucagcagggagaggagaaugca

SEQ ID NO: 1117852 - RNA, 23 nt, Human
auuuccuacuauaaaagagguaa

SEQ ID NO: 1117853 - RNA, 22 nt, Human
uagaaauguuagauguauugag

SEQ ID NO: 1117854 - RNA, 22 nt, Human
aggcuucccagcugagcucagc

SEQ ID NO: 1117855 - RNA, 22 nt, Human
ugagccugguugcagugucugg

SEQ ID NO: 1117856 - RNA, 18 nt, Human
uguacaguuaugagcauu

SEQ ID NO: 1117857 - RNA, 22 nt, Human
augggcuguccuaguccagccc

SEQ ID NO: 1117858 - RNA, 22 nt, Human
acaaagucaaauugcagccgcc

SEQ ID NO: 1117859 - RNA, 22 nt, Human
ccaaggcuggagugcaguggcg

SEQ ID NO: 1117860 - RNA, 22 nt, Human
ucaggcuggaaugcaguggggc

SEQ ID NO: 1117861 - RNA, 22 nt, Human
ggcagcaguaggagcuaaucuu

SEQ ID NO: 1117862 - RNA, 22 nt, Human
auggaaagcuaagccauuuacc

SEQ ID NO: 1117863 - RNA, 22 nt, Human
uccaguggugguuugaagggca

SEQ ID NO: 1117864 - RNA, 22 nt, Human
uuugaacaagagcuucacauua

SEQ ID NO: 1117865 - RNA, 22 nt, Human
cuggccucaccucagacuuacu

SEQ ID NO: 1117866 - RNA, 22 nt, Human
agcagggcucuguggagggugg

SEQ ID NO: 1117867 - RNA, 22 nt, Human
uaaauguguguagccaucugug

SEQ ID NO: 1117868 - RNA, 22 nt, Human
auaaggaaugauguaucaguuu

SEQ ID NO: 1117869 - RNA, 22 nt, Human
acauuucuaucauccuguaaug

SEQ ID NO: 1117870 - RNA, 16 nt, Human
gggcugggggauucug

SEQ ID NO: 1117871 - RNA, 22 nt, Human
uauuuguauuucaugcaguaaa

SEQ ID NO: 1117872 - RNA, 16 nt, Human
agaggccuugaggaag

SEQ ID NO: 1117873 - RNA, 22 nt, Human
gcucuguccagcgugcacagaa

SEQ ID NO: 1117874 - RNA, 18 nt, Human
acccucuggcuucugagc

SEQ ID NO: 1117875 - RNA, 22 nt, Human
gagaagcaauuuccaacugugc

SEQ ID NO: 1117876 - RNA, 22 nt, Human
cugcaggcccccuuccuggagu

SEQ ID NO: 1117877 - RNA, 22 nt, Human
ucagaagcauguggggagccug

SEQ ID NO: 1117878 - RNA, 21 nt, Human
agagccugagaucuuccagca

SEQ ID NO: 1117879 - RNA, 22 nt, Human
ugguaucagagccaucuguauu

SEQ ID NO: 1117880 - RNA, 19 nt, Human
gcauaaaaugucaaugugu

SEQ ID NO: 1117881 - RNA, 22 nt, Human
accaaggagccacauacaaccu

SEQ ID NO: 1117882 - RNA, 22 nt, Human
ugcagccaggaaauauuugcug

SEQ ID NO: 1117883 - RNA, 22 nt, Human
gcuggggucugugaggagggcu

SEQ ID NO: 1117884 - RNA, 22 nt, Human
ggaagagccuggggugucaggc

SEQ ID NO: 1117885 - RNA, 22 nt, Human
ugaagcaggaaccagcagcauu

SEQ ID NO: 1117886 - RNA, 20 nt, Human
gcuuuuucuaauagcagucc

SEQ ID NO: 1117887 - RNA, 22 nt, Human
ugaaagguguccaauauuucuc

SEQ ID NO: 1117888 - RNA, 22 nt, Human
ucucagagcuucagaaagcacc

SEQ ID NO: 1117889 - RNA, 22 nt, Human
uucauuccugagcccauauuua

SEQ ID NO: 1117890 - RNA, 22 nt, Human
ucucagagcuucaguuauuuuc

SEQ ID NO: 1117891 - RNA, 22 nt, Human
cucccuggcuuuguccugaggc

SEQ ID NO: 1117892 - RNA, 22 nt, Human
agccaggaauuggacaacacau

SEQ ID NO: 1117893 - RNA, 22 nt, Human
augacacaauuuuagagcugaa

SEQ ID NO: 1117894 - RNA, 22 nt, Human
ucagaagcaggagugugcacaa

SEQ ID NO: 1117895 - RNA, 22 nt, Human
uauguuaaauguuugauguuua

SEQ ID NO: 1117896 - RNA, 22 nt, Human
gugcuuaauacaugucaauaac

SEQ ID NO: 1117897 - RNA, 22 nt, Human
acccugagucagacagccugac

SEQ ID NO: 1117898 - RNA, 22 nt, Human
ccugccugcuuucugcuuugca

SEQ ID NO: 1117899 - RNA, 22 nt, Human
ggagcugcauuuagggagccuu

SEQ ID NO: 1117900 - RNA, 22 nt, Human
uccccagccgugaaggagagga

SEQ ID NO: 1117901 - RNA, 22 nt, Human
uggcacugggacagaugcucuc

SEQ ID NO: 1117902 - RNA, 22 nt, Human
cuggagccagccagggcccucu

SEQ ID NO: 1117903 - RNA, 22 nt, Human
agccuucacugggaccuuggau

SEQ ID NO: 1117904 - RNA, 22 nt, Human
gccaggcuccccggaucccugg

SEQ ID NO: 1117905 - RNA, 22 nt, Human
ucucaggaucuaauacauggua

SEQ ID NO: 1117906 - RNA, 22 nt, Human
ccagucacagguguguuuauau

SEQ ID NO: 1117907 - RNA, 22 nt, Human
gcugccuuuugcuccucccacc

SEQ ID NO: 1117908 - RNA, 22 nt, Human
ucugaggcuucagacuguacug

SEQ ID NO: 1117909 - RNA, 22 nt, Human
gugcagcagggggaagacagug

SEQ ID NO: 1117910 - RNA, 19 nt, Human
cccagagcauccugaacuu

SEQ ID NO: 1117911 - RNA, 22 nt, Human
cuucuuaaugacagauuaaaau

SEQ ID NO: 1117912 - RNA, 22 nt, Human
ugaagcaacuggacaaguuggc

SEQ ID NO: 1117913 - RNA, 22 nt, Human
caugcacagugauaucugaaga

SEQ ID NO: 1117914 - RNA, 22 nt, Human
cagccccucacagagcuguccu

SEQ ID NO: 1117915 - RNA, 22 nt, Human
gggcucugguacuuccuggcuc

SEQ ID NO: 1117916 - RNA, 22 nt, Human
auugcaccuuggguuuugaaag

SEQ ID NO: 1117917 - RNA, 22 nt, Human
ccucagagguuuucauucugua

SEQ ID NO: 1117918 - RNA, 22 nt, Human
accaugggucagccaccucagc

SEQ ID NO: 1117919 - RNA, 22 nt, Human
ugugccaugaggcucugauaug

SEQ ID NO: 1117920 - RNA, 22 nt, Human
ugcugucugauucagggugauu

SEQ ID NO: 1117921 - RNA, 22 nt, Human
accaaggaguuugguauuuuag

SEQ ID NO: 1117922 - RNA, 22 nt, Human
cacugcuuuaaggcugaguaac

SEQ ID NO: 1117923 - RNA, 22 nt, Human
gaggagagagggacugucugca

SEQ ID NO: 1117924 - RNA, 21 nt, Human
aggggacagaguagcuccagg

SEQ ID NO: 1117925 - RNA, 22 nt, Human
uagaacagaggguugcccagau

SEQ ID NO: 1117926 - RNA, 22 nt, Human
ccugggcucuauccugacccag

SEQ ID NO: 1117927 - RNA, 20 nt, Human
augccucuaauuuugcaaac

SEQ ID NO: 1117928 - RNA, 22 nt, Human
aagcugccugccacgcuagaua

SEQ ID NO: 1117929 - RNA, 18 nt, Human
acauuucuaugcuucugg

SEQ ID NO: 1117930 - RNA, 18 nt, Human
agggucagugucacuggc

SEQ ID NO: 1117931 - RNA, 22 nt, Human
aggccuggcuuugguuugcuga

SEQ ID NO: 1117932 - RNA, 22 nt, Human
cucugggcuuguugaccugcac

SEQ ID NO: 1117933 - RNA, 22 nt, Human
guccucugggcuuugagcaguc

SEQ ID NO: 1117934 - RNA, 22 nt, Human
gagguauguaugcuacauucuu

SEQ ID NO: 1117935 - RNA, 22 nt, Human
aguauguagugcaaucagucag

SEQ ID NO: 1117936 - RNA, 22 nt, Human
auguuacacauaggcauaaaug

SEQ ID NO: 1117937 - RNA, 22 nt, Human
gucuuguuugggauguggaugg

SEQ ID NO: 1117938 - RNA, 22 nt, Human
auuuagaaguuggagggcaaga

SEQ ID NO: 1117939 - RNA, 22 nt, Human
ucucagagggaaaggccaauuu

SEQ ID NO: 1117940 - RNA, 20 nt, Human
gcauugaguauagacagaug

SEQ ID NO: 1117941 - RNA, 22 nt, Human
auugaaagcacaaagaacaagu

SEQ ID NO: 1117942 - RNA, 22 nt, Human
ugcaggugugguuccucagcca

SEQ ID NO: 1117943 - RNA, 22 nt, Human
cugggcagcuaccaccacugcu

SEQ ID NO: 1117944 - RNA, 19 nt, Human
gagcugccuuuugaagacc

SEQ ID NO: 1117945 - RNA, 21 nt, Human
aggcagcucaggcccagagag

SEQ ID NO: 1117946 - RNA, 23 nt, Human
ucagugauguugaaccuagcagu

SEQ ID NO: 1117947 - RNA, 22 nt, Human
cugggcuguucugccccugggu

SEQ ID NO: 1117948 - RNA, 22 nt, Human
ccccuuccacagugcuuccuaa

SEQ ID NO: 1117949 - RNA, 22 nt, Human
aaggcugcuuuuaacaugcaua

SEQ ID NO: 1117950 - RNA, 22 nt, Human
uccucuggcccagcugccucug

SEQ ID NO: 1117951 - RNA, 22 nt, Human
aacagaauaguugauguacagu

SEQ ID NO: 1117952 - RNA, 22 nt, Human
cagcccugagagaaccaucuau

SEQ ID NO: 1117953 - RNA, 22 nt, Human
uguaagauauucagcuuauuga

SEQ ID NO: 1117954 - RNA, 22 nt, Human
ggcugccaggagaagcucagug

SEQ ID NO: 1117955 - RNA, 22 nt, Human
cugugccuggggggcagagcug

SEQ ID NO: 1117956 - RNA, 22 nt, Human
uuccagggcuaauuccugugga

SEQ ID NO: 1117957 - RNA, 22 nt, Human
caggggcagucugugugcgugg

SEQ ID NO: 1117958 - RNA, 23 nt, Human
uggcucagggucucuuaugaagu

SEQ ID NO: 1117959 - RNA, 22 nt, Human
gggccucugugcagaggggccu

SEQ ID NO: 1117960 - RNA, 22 nt, Human
aggauccugcgcuuugggggag

SEQ ID NO: 1117961 - RNA, 17 nt, Human
uagcugccccgaaugcu

SEQ ID NO: 1117962 - RNA, 22 nt, Human
gcagcugccgugagcucacgcc

SEQ ID NO: 1117963 - RNA, 21 nt, Human
guggcucugccaggacugaaa

SEQ ID NO: 1117964 - RNA, 22 nt, Human
aauaaacugcucaauugcauca

SEQ ID NO: 1117965 - RNA, 22 nt, Human
ugucuuccucuuggcuugagcu

SEQ ID NO: 1117966 - RNA, 22 nt, Human
ccagggcuccauugcucauccu

SEQ ID NO: 1117967 - RNA, 22 nt, Human
cucuggagcgcugcuucccgcg

SEQ ID NO: 1117968 - RNA, 22 nt, Human
uccuccagugucuggggccuug

SEQ ID NO: 1117969 - RNA, 22 nt, Human
agcaugcacaugacuggcuuaa

SEQ ID NO: 1117970 - RNA, 22 nt, Human
aagggagacaguugugugagga

SEQ ID NO: 1117971 - RNA, 22 nt, Human
cugguccuugacgcgugggagg

SEQ ID NO: 1117972 - RNA, 22 nt, Human
caggcagccaggggaccugucc

SEQ ID NO: 1117973 - RNA, 22 nt, Human
cagggagaagucuggucagucc

SEQ ID NO: 1117974 - RNA, 22 nt, Human
agggagcugcucugcuuccgug

SEQ ID NO: 1117975 - RNA, 22 nt, Human
ggaggggcagccauggaacucc

SEQ ID NO: 1117976 - RNA, 22 nt, Human
ugcagaaggccugacauugcac

SEQ ID NO: 1117977 - RNA, 22 nt, Human
gggagggacacaaagaguuccc

SEQ ID NO: 1117978 - RNA, 22 nt, Human
agagggcccauguugggcugcu

SEQ ID NO: 1117979 - RNA, 22 nt, Human
caguacuuauuucuauuuaggg

SEQ ID NO: 1117980 - RNA, 22 nt, Human
gcagcaggcacggucucgacau

SEQ ID NO: 1117981 - RNA, 22 nt, Human
gucucuggguuaagcagugcau

SEQ ID NO: 1117982 - RNA, 22 nt, Human
ggacagagcccugguggccuaa

SEQ ID NO: 1117983 - RNA, 22 nt, Human
aaggagcuuguucgccuuccuc

SEQ ID NO: 1117984 - RNA, 19 nt, Human
gcucugugaugcugagggg

SEQ ID NO: 1117985 - RNA, 22 nt, Human
ggcagcugauuagcaucaagga

SEQ ID NO: 1117986 - RNA, 22 nt, Human
ucagcuuggacagcuugguuga

SEQ ID NO: 1117987 - RNA, 22 nt, Human
ugggcagaguagcucagaagaa

SEQ ID NO: 1117988 - RNA, 22 nt, Human
ccucccuuggccauagccagcc

SEQ ID NO: 1117989 - RNA, 22 nt, Human
aggggaggagcuuuucuugccu

SEQ ID NO: 1117990 - RNA, 22 nt, Human
cacuuaagcaguuaauuuaucu

SEQ ID NO: 1117991 - RNA, 22 nt, Human
cuaggaggcgggggcugcagua

SEQ ID NO: 1117992 - RNA, 22 nt, Human
agucccagaugacccagcuacu

SEQ ID NO: 1117993 - RNA, 22 nt, Human
cccaucaggaacccaggagccc

SEQ ID NO: 1117994 - RNA, 22 nt, Human
cuuuauguccuugaagaguugu

SEQ ID NO: 1117995 - RNA, 20 nt, Human
uagaaaucuuauaaaagacu

SEQ ID NO: 1117996 - RNA, 22 nt, Human
gaugcacuugccccuccucaga

SEQ ID NO: 1117997 - RNA, 22 nt, Human
acaggcagggaccuuggcuaag

SEQ ID NO: 1117998 - RNA, 22 nt, Human
cugcugcucgaccagucccagg

SEQ ID NO: 1117999 - RNA, 22 nt, Human
uccucaugccgggucucacgcu

SEQ ID NO: 1118000 - RNA, 22 nt, Human
ccuggcuggcaagaucgugaag

SEQ ID NO: 1118001 - RNA, 22 nt, Human
ugugugcauucacaugcaugcc

SEQ ID NO: 1118002 - RNA, 20 nt, Human
acaaaugcauucugugacau

SEQ ID NO: 1118003 - RNA, 22 nt, Human
gccugggugaauuugauccuaa

SEQ ID NO: 1118004 - RNA, 22 nt, Human
uggagugaaguaaagaggacaa

SEQ ID NO: 1118005 - RNA, 23 nt, Human
aaccagauaaauggcuccagggc

SEQ ID NO: 1118006 - RNA, 22 nt, Human
uuaaacagacaguaaaugaaac

SEQ ID NO: 1118007 - RNA, 22 nt, Human
ugcugguggagaaaguggaggu

SEQ ID NO: 1118008 - RNA, 22 nt, Human
acauuucugucuuagggacugu

SEQ ID NO: 1118009 - RNA, 22 nt, Human
ugcccacaggaagacaccagcg

SEQ ID NO: 1118010 - RNA, 22 nt, Human
cagcugcccugccuugcccuua

SEQ ID NO: 1118011 - RNA, 22 nt, Human
uucaguuucagucuugcaaaaa

SEQ ID NO: 1118012 - RNA, 22 nt, Human
uccagccaagccuugguagcug

SEQ ID NO: 1118013 - RNA, 22 nt, Human
cauacauaugcauguguguaua

SEQ ID NO: 1118014 - RNA, 22 nt, Human
ccacagaggacaacugccuggc

SEQ ID NO: 1118015 - RNA, 22 nt, Human
uggcagaggagaauuaagauua

SEQ ID NO: 1118016 - RNA, 22 nt, Human
ucccagggacugggcuaggcuu

SEQ ID NO: 1118017 - RNA, 22 nt, Human
acaggugaccugcucauaugaa

SEQ ID NO: 1118018 - RNA, 22 nt, Human
gaaagaagcuuuagauggcuau

SEQ ID NO: 1118019 - RNA, 20 nt, Human
caccacagaauuggggacag

SEQ ID NO: 1118020 - RNA, 22 nt, Human
agcagcuggugagcaagcucag

SEQ ID NO: 1118021 - RNA, 22 nt, Human
agcagcucugagaggccagcac

SEQ ID NO: 1118022 - RNA, 22 nt, Human
cagcucugaagaaaggugucua

SEQ ID NO: 1118023 - RNA, 19 nt, Human
aucuuacagagcagaguac

SEQ ID NO: 1118024 - RNA, 22 nt, Human
agauuucagaugcucggcaguu

SEQ ID NO: 1118025 - RNA, 21 nt, Human
aacugcuggucuuuucugucu

SEQ ID NO: 1118026 - RNA, 22 nt, Human
ugguggcaauguccuggagaag

SEQ ID NO: 1118027 - RNA, 22 nt, Human
cuggccugaggucggcuguagg

SEQ ID NO: 1118028 - RNA, 21 nt, Human
cauugucgacauuuuccccuc

SEQ ID NO: 1118029 - RNA, 22 nt, Human
gcugagcucccagcaguaucug

SEQ ID NO: 1118030 - RNA, 22 nt, Human
ugccuucaaucaggauggucuc

SEQ ID NO: 1118031 - RNA, 22 nt, Human
ugagccuggagucguggagggg

SEQ ID NO: 1118032 - RNA, 22 nt, Human
ucccaggauguuggcggcaggu

SEQ ID NO: 1118033 - RNA, 22 nt, Human
cugccucucagccugaccgcca

SEQ ID NO: 1118034 - RNA, 22 nt, Human
uacaugcaugucacagaaugaa

SEQ ID NO: 1118035 - RNA, 19 nt, Human
ccagcagacacagcugccc

SEQ ID NO: 1118036 - RNA, 22 nt, Human
uuuauuauagugguggggacug

SEQ ID NO: 1118037 - RNA, 22 nt, Human
gccugugcuuaacugacgugag

SEQ ID NO: 1118038 - RNA, 22 nt, Human
uucauucccuuauauuagcauu

SEQ ID NO: 1118039 - RNA, 22 nt, Human
ccagcccugccagagagagcug

SEQ ID NO: 1118040 - RNA, 22 nt, Human
gccuggcacauugcaguggauu

SEQ ID NO: 1118041 - RNA, 22 nt, Human
auagucuuagaucagauaaagu

SEQ ID NO: 1118042 - RNA, 22 nt, Human
gccgaagcugccgucugguccu

SEQ ID NO: 1118043 - RNA, 22 nt, Human
agcugcagauucuaucuagaag

SEQ ID NO: 1118044 - RNA, 20 nt, Human
uaugaagauaugugaacagc

SEQ ID NO: 1118045 - RNA, 23 nt, Human
gacagagugagaccuugucuuac

SEQ ID NO: 1118046 - RNA, 22 nt, Human
gcagaagcccggucagcgcacg

SEQ ID NO: 1118047 - RNA, 22 nt, Human
cuggccuguccugacccagccu

SEQ ID NO: 1118048 - RNA, 22 nt, Human
uggaaagaaaaacaggccauga

SEQ ID NO: 1118049 - RNA, 22 nt, Human
cuggagccacuuuuuauccuuu

SEQ ID NO: 1118050 - RNA, 22 nt, Human
uggaagagggagcuggguggcc

SEQ ID NO: 1118051 - RNA, 22 nt, Human
aaaugcagguucuugagccaag

SEQ ID NO: 1118052 - RNA, 22 nt, Human
agcaggugacccaagcaggcug

SEQ ID NO: 1118053 - RNA, 22 nt, Human
ggaggccaaggaggagcuugcc

SEQ ID NO: 1118054 - RNA, 22 nt, Human
ggccaggagcaagccaggcucu

SEQ ID NO: 1118055 - RNA, 22 nt, Human
uguaugcagggcuuguaugcag

SEQ ID NO: 1118056 - RNA, 19 nt, Human
auaaggcaggaggaaauuu

SEQ ID NO: 1118057 - RNA, 22 nt, Human
ccagaggcauguucaaagcaau

SEQ ID NO: 1118058 - RNA, 22 nt, Human
uuugcauuuguucaaguauuga

SEQ ID NO: 1118059 - RNA, 22 nt, Human
ccagcccugccucucagggccc

SEQ ID NO: 1118060 - RNA, 22 nt, Human
uuucuaaaugguggcugcauug

SEQ ID NO: 1118061 - RNA, 22 nt, Human
ccagaagggcuauugcagugac

SEQ ID NO: 1118062 - RNA, 20 nt, Human
ggcagcaggaguuuccucuu

SEQ ID NO: 1118063 - RNA, 22 nt, Human
ugcuugggaauguggagucaga

SEQ ID NO: 1118064 - RNA, 22 nt, Human
gagguggccucaagcagucuuc

SEQ ID NO: 1118065 - RNA, 23 nt, Human
uggagcugggcucagacccuggg

SEQ ID NO: 1118066 - RNA, 22 nt, Human
agggcagccugagugcuggccc

SEQ ID NO: 1118067 - RNA, 22 nt, Human
cuuucacauaauugaccuugaa

SEQ ID NO: 1118068 - RNA, 22 nt, Human
uguaaucauuacaguacaugga

SEQ ID NO: 1118069 - RNA, 17 nt, Human
ucagagggaugagcagg

SEQ ID NO: 1118070 - RNA, 22 nt, Human
ccucucuguguggccucuccau

SEQ ID NO: 1118071 - RNA, 22 nt, Human
cauaucccauuggccaggacau

SEQ ID NO: 1118072 - RNA, 22 nt, Human
gcagauggacuguaugaccuga

SEQ ID NO: 1118073 - RNA, 22 nt, Human
aauguacaaaagucagccaacu

SEQ ID NO: 1118074 - RNA, 22 nt, Human
cugucaggggcggguggagcgg

SEQ ID NO: 1118075 - RNA, 22 nt, Human
ccacccagccagaugcaggaag

SEQ ID NO: 1118076 - RNA, 22 nt, Human
uaaacagaaagcagauguacuu

SEQ ID NO: 1118077 - RNA, 22 nt, Human
cuuccaaagcacuuuauggacc

SEQ ID NO: 1118078 - RNA, 22 nt, Human
uugcuuccucgaggccagcgug

SEQ ID NO: 1118079 - RNA, 22 nt, Human
aggaagccugcaggugacugcu

SEQ ID NO: 1118080 - RNA, 22 nt, Human
ucauguaaguauagaaagcagu

SEQ ID NO: 1118081 - RNA, 22 nt, Human
gcacagggcaacaggucuguua

SEQ ID NO: 1118082 - RNA, 22 nt, Human
agccagcaggugagugcagccu

SEQ ID NO: 1118083 - RNA, 22 nt, Human
gccaggcagauaugugagcuua

SEQ ID NO: 1118084 - RNA, 22 nt, Human
ggcugccugaggcagugagaga

SEQ ID NO: 1118085 - RNA, 22 nt, Human
gaauucuuuucuuucugaaagu

SEQ ID NO: 1118086 - RNA, 22 nt, Human
ggcuucuuccugugaacauguu

SEQ ID NO: 1118087 - RNA, 22 nt, Human
uggcucugaccagguagaggag

SEQ ID NO: 1118088 - RNA, 22 nt, Human
ggggcuguuuuuggaauggcug

SEQ ID NO: 1118089 - RNA, 22 nt, Human
uuuagaguugaguauucauugg

SEQ ID NO: 1118090 - RNA, 22 nt, Human
ugccuggcaagaggggcuggcu

SEQ ID NO: 1118091 - RNA, 22 nt, Human
cacacaggaugaagcagcagaa

SEQ ID NO: 1118092 - RNA, 22 nt, Human
ccagggcaucacauccaguguu

SEQ ID NO: 1118093 - RNA, 22 nt, Human
ggccuugguaaagggaugcaug

SEQ ID NO: 1118094 - RNA, 22 nt, Human
ugcagcccuuccuuccucuggg

SEQ ID NO: 1118095 - RNA, 22 nt, Human
ggagcagagcauuucacagccu

SEQ ID NO: 1118096 - RNA, 22 nt, Human
ccugggagggcaagugcugaug

SEQ ID NO: 1118097 - RNA, 22 nt, Human
aguguauugauuggaacagccu

SEQ ID NO: 1118098 - RNA, 22 nt, Human
gcuggccauucucuuugagaug

SEQ ID NO: 1118099 - RNA, 18 nt, Human
uggccuggagacaacucu

SEQ ID NO: 1118100 - RNA, 22 nt, Human
agagagcccgggccagggcaca

SEQ ID NO: 1118101 - RNA, 22 nt, Human
ucucagggagggcgagucagcg

SEQ ID NO: 1118102 - RNA, 22 nt, Human
ucccagaguucaaugggaaggu

SEQ ID NO: 1118103 - RNA, 22 nt, Human
aaguucaagaucaagguuccag

SEQ ID NO: 1118104 - RNA, 22 nt, Human
ggcuucucucccccagcuccac

SEQ ID NO: 1118105 - RNA, 22 nt, Human
uuccaaagaaauugaccaagac

SEQ ID NO: 1118106 - RNA, 19 nt, Human
cuugguuaugguaugaugc

SEQ ID NO: 1118107 - RNA, 22 nt, Human
ggcaggagauaaaauauuaguu

SEQ ID NO: 1118108 - RNA, 22 nt, Human
cacaggcuuccaguccccagcu

SEQ ID NO: 1118109 - RNA, 19 nt, Human
cuggugcuugagugaguca

SEQ ID NO: 1118110 - RNA, 22 nt, Human
uuuuuccuuagggguuacucac

SEQ ID NO: 1118111 - RNA, 22 nt, Human
aggucaaaccacagcucuaggc

SEQ ID NO: 1118112 - RNA, 22 nt, Human
uuauuauugugaccugagaaug

SEQ ID NO: 1118113 - RNA, 22 nt, Human
uuacaugguuguuggaaaugcu

SEQ ID NO: 1118114 - RNA, 22 nt, Human
uccuuuccaugcuucuagaggc

SEQ ID NO: 1118115 - RNA, 22 nt, Human
uugaauucauuucucauugagu

SEQ ID NO: 1118116 - RNA, 19 nt, Human
uggggccuccugucccugg

SEQ ID NO: 1118117 - RNA, 22 nt, Human
acccuggggguggccagugcca

SEQ ID NO: 1118118 - RNA, 22 nt, Human
ugugugcagccucugucuuugg

SEQ ID NO: 1118119 - RNA, 20 nt, Human
ccagcugagccaaggggaga

SEQ ID NO: 1118120 - RNA, 22 nt, Human
gcagugugaccgagcuugcuuc

SEQ ID NO: 1118121 - RNA, 22 nt, Human
acagaguagcucaagaagauug

SEQ ID NO: 1118122 - RNA, 18 nt, Human
uggugaaggguggaggag

SEQ ID NO: 1118123 - RNA, 21 nt, Human
cugcuuuacuucagaggaucu

SEQ ID NO: 1118124 - RNA, 22 nt, Human
ugcucugugguccaagauggcu

SEQ ID NO: 1118125 - RNA, 22 nt, Human
uaaggcacuucaauguuuagaa

SEQ ID NO: 1118126 - RNA, 21 nt, Human
aguguccuugaucuugccuug

SEQ ID NO: 1118127 - RNA, 22 nt, Human
cauuuucucaaugaacccucuu

SEQ ID NO: 1118128 - RNA, 22 nt, Human
ugugaugguucacugggcauga

SEQ ID NO: 1118129 - RNA, 22 nt, Human
auauucuuccaaaacaucauuu

SEQ ID NO: 1118130 - RNA, 22 nt, Human
auugaauagaugcauuauacua

SEQ ID NO: 1118131 - RNA, 18 nt, Human
uccucucuuuccccaggg

SEQ ID NO: 1118132 - RNA, 22 nt, Human
agcugccagaugacagugcuau

SEQ ID NO: 1118133 - RNA, 22 nt, Human
ugcagaggagucagccugggca

SEQ ID NO: 1118134 - RNA, 22 nt, Human
cugggccaucagaggggcugga

SEQ ID NO: 1118135 - RNA, 22 nt, Human
ggggccuguagagcuucaggga

SEQ ID NO: 1118136 - RNA, 22 nt, Human
gcucccagauuucagccuugug

SEQ ID NO: 1118137 - RNA, 22 nt, Human
uggcagagcccagacuccaguc

SEQ ID NO: 1118138 - RNA, 22 nt, Human
gaggcccaguccugcaagcacg

SEQ ID NO: 1118139 - RNA, 22 nt, Human
cagcugucuaaguugagcagga

SEQ ID NO: 1118140 - RNA, 22 nt, Human
cuggagcauccaugcccagggu

SEQ ID NO: 1118141 - RNA, 22 nt, Human
ucagaggaaaggucagauggcu

SEQ ID NO: 1118142 - RNA, 22 nt, Human
ugagagucucagaccuccuggu

SEQ ID NO: 1118143 - RNA, 22 nt, Human
ggcagccagagggcagcuggau

SEQ ID NO: 1118144 - RNA, 22 nt, Human
agagccuggcucccagcuaccg

SEQ ID NO: 1118145 - RNA, 22 nt, Human
ucaaugauaucagcaggaugug

SEQ ID NO: 1118146 - RNA, 22 nt, Human
ggggcagaaagcccacagagug

SEQ ID NO: 1118147 - RNA, 22 nt, Human
uucacagggccacuggcaggag

SEQ ID NO: 1118148 - RNA, 22 nt, Human
uccucugcuccaggcuggacuu

SEQ ID NO: 1118149 - RNA, 22 nt, Human
uagucuuuugagaaguauaucu

SEQ ID NO: 1118150 - RNA, 22 nt, Human
accaggggaugguuggcacugu

SEQ ID NO: 1118151 - RNA, 22 nt, Human
cagggugggcacccagccucca

SEQ ID NO: 1118152 - RNA, 22 nt, Human
gagcugcugguugcuggugccu

SEQ ID NO: 1118153 - RNA, 22 nt, Human
ucugggagcacacgcagugauc

SEQ ID NO: 1118154 - RNA, 17 nt, Human
gauuuccugaaguucuu

SEQ ID NO: 1118155 - RNA, 22 nt, Human
ggagauagacuuggugagccac

SEQ ID NO: 1118156 - RNA, 22 nt, Human
gccuuucaguuccaucaaagga

SEQ ID NO: 1118157 - RNA, 22 nt, Human
aggauccuguauggagaagcug

SEQ ID NO: 1118158 - RNA, 22 nt, Human
ucagggcaccaaaaaagaugcc

SEQ ID NO: 1118159 - RNA, 22 nt, Human
ugcucuguugugcaugugggau

SEQ ID NO: 1118160 - RNA, 22 nt, Human
agccuggagaggcgccauacac

SEQ ID NO: 1118161 - RNA, 22 nt, Human
uggaaggcaugggaacuguucu

SEQ ID NO: 1118162 - RNA, 22 nt, Human
aaaucugggagcagcucggcca

SEQ ID NO: 1118163 - RNA, 22 nt, Human
guauucuugguuaucaaaauac

SEQ ID NO: 1118164 - RNA, 22 nt, Human
gcagcugggacacugaggccag

SEQ ID NO: 1118165 - RNA, 22 nt, Human
ucauugaacgaagagcuccauu

SEQ ID NO: 1118166 - RNA, 22 nt, Human
ggagagcaggguccugagauac

SEQ ID NO: 1118167 - RNA, 22 nt, Human
aaaguucagauuagacucaaga

SEQ ID NO: 1118168 - RNA, 22 nt, Human
gaggcugcugagagcccuguuu

SEQ ID NO: 1118169 - RNA, 22 nt, Human
ucuggcccagccccugagguca

SEQ ID NO: 1118170 - RNA, 22 nt, Human
uugaggagcaggaugggaggcu

SEQ ID NO: 1118171 - RNA, 22 nt, Human
uaaauguguuguggaugaaguu

SEQ ID NO: 1118172 - RNA, 22 nt, Human
ggucauugucagagccuguacu

SEQ ID NO: 1118173 - RNA, 20 nt, Human
aauguauauuuuaugccagg

SEQ ID NO: 1118174 - RNA, 22 nt, Human
gccagagcugagugagguucuu

SEQ ID NO: 1118175 - RNA, 22 nt, Human
ucccuggcagcuaagggugguc

SEQ ID NO: 1118176 - RNA, 22 nt, Human
gcagcugauggaaguccuauug

SEQ ID NO: 1118177 - RNA, 22 nt, Human
aguaaugucccuuaaauguggu

SEQ ID NO: 1118178 - RNA, 19 nt, Human
uuuggcacucugaaguguu

SEQ ID NO: 1118179 - RNA, 22 nt, Human
uggggccugagguggagcugca

SEQ ID NO: 1118180 - RNA, 22 nt, Human
cacugaaggaaggacuacugca

SEQ ID NO: 1118181 - RNA, 22 nt, Human
uggcucagcuuacuuuugaggg

SEQ ID NO: 1118182 - RNA, 22 nt, Human
ugcugcacucaccaacagauaa

SEQ ID NO: 1118183 - RNA, 22 nt, Human
ggcagccuccagggcacuggug

SEQ ID NO: 1118184 - RNA, 22 nt, Human
gggacaggccccucgcuagcuu

SEQ ID NO: 1118185 - RNA, 18 nt, Human
uuccauaauguauguaac

SEQ ID NO: 1118186 - RNA, 22 nt, Human
agagcagauggagcuggaagag

SEQ ID NO: 1118187 - RNA, 22 nt, Human
gcagggccagguacaagaagca

SEQ ID NO: 1118188 - RNA, 22 nt, Human
uagggcagccacccaggcugcu

SEQ ID NO: 1118189 - RNA, 22 nt, Human
ugagccagauaagggcucacgc

SEQ ID NO: 1118190 - RNA, 22 nt, Human
uggcugccuagugucugagcag

SEQ ID NO: 1118191 - RNA, 22 nt, Human
agccacagucaaccuguccaua

SEQ ID NO: 1118192 - RNA, 22 nt, Human
gauggguggucucagacuugcc

SEQ ID NO: 1118193 - RNA, 22 nt, Human
gcugggagugggcaagaugaga

SEQ ID NO: 1118194 - RNA, 22 nt, Human
gggacugggagauccuccuggc

SEQ ID NO: 1118195 - RNA, 22 nt, Human
ucuuacauauagcaugaguaca

SEQ ID NO: 1118196 - RNA, 22 nt, Human
ucuggccuuaucuguccaagcc

SEQ ID NO: 1118197 - RNA, 20 nt, Human
gagagcuggggaugaggcug

SEQ ID NO: 1118198 - RNA, 22 nt, Human
aggugccagaugcacagcugaa

SEQ ID NO: 1118199 - RNA, 22 nt, Human
uucacagggcagcagcugagcc

SEQ ID NO: 1118200 - RNA, 22 nt, Human
gaagcagcugccagagaugucu

SEQ ID NO: 1118201 - RNA, 22 nt, Human
cagcagccuacaaugcacagaa

SEQ ID NO: 1118202 - RNA, 22 nt, Human
gauccuugcaacucugugaggu

SEQ ID NO: 1118203 - RNA, 22 nt, Human
ggccucucuggcauggcugccc

SEQ ID NO: 1118204 - RNA, 22 nt, Human
gggcagugguccaggcuacagc

SEQ ID NO: 1118205 - RNA, 22 nt, Human
gguggguauugaauacaggugu

SEQ ID NO: 1118206 - RNA, 22 nt, Human
gagcuggugaucagcuggagga

SEQ ID NO: 1118207 - RNA, 22 nt, Human
acagcuguauccccagagcuca

SEQ ID NO: 1118208 - RNA, 22 nt, Human
gcugucuguggugucagcugac

SEQ ID NO: 1118209 - RNA, 22 nt, Human
ggcucuggcaaggggaggcuac

SEQ ID NO: 1118210 - RNA, 20 nt, Human
cucuggcuccgcgugaccgc

SEQ ID NO: 1118211 - RNA, 22 nt, Human
uggagcugguaaacagugacau

SEQ ID NO: 1118212 - RNA, 22 nt, Human
ccucacucugcacccugcagca

SEQ ID NO: 1118213 - RNA, 22 nt, Human
ugccuguccugaggaugagggu

SEQ ID NO: 1118214 - RNA, 22 nt, Human
aagguacaguuuuaagaauaag

SEQ ID NO: 1118215 - RNA, 22 nt, Human
ucugucugcucauuuaccucag

SEQ ID NO: 1118216 - RNA, 22 nt, Human
ucagaagacuacuaggacacau

SEQ ID NO: 1118217 - RNA, 22 nt, Human
uccuugaaugaagagaggugac

SEQ ID NO: 1118218 - RNA, 22 nt, Human
cagccaucccagccugugguuc

SEQ ID NO: 1118219 - RNA, 22 nt, Human
gccuggcacucacugaagaggc

SEQ ID NO: 1118220 - RNA, 22 nt, Human
uccugccucuccaugcuaacua

SEQ ID NO: 1118221 - RNA, 22 nt, Human
aacaaauguguuuuguaauuaa

SEQ ID NO: 1118222 - RNA, 22 nt, Human
ucacugcaaucucugccuucca

SEQ ID NO: 1118223 - RNA, 23 nt, Human
aucaaaguggaaaucaauuaucu

SEQ ID NO: 1118224 - RNA, 22 nt, Human
gucauuucuguuucuucagugc

SEQ ID NO: 1118225 - RNA, 22 nt, Human
agugggaggcggcugacgggcg

SEQ ID NO: 1118226 - RNA, 22 nt, Human
ucuccucaccaccagcagcaga

SEQ ID NO: 1118227 - RNA, 22 nt, Human
uuccauuuauucuuguccagau

SEQ ID NO: 1118228 - RNA, 22 nt, Human
aagauucucagagugaaagaau

SEQ ID NO: 1118229 - RNA, 22 nt, Human
agggccagaggcaccuugcagc

SEQ ID NO: 1118230 - RNA, 19 nt, Human
gcccugcaggagguggggc

SEQ ID NO: 1118231 - RNA, 22 nt, Human
cuccagggcagcauggcagugg

SEQ ID NO: 1118232 - RNA, 22 nt, Human
uugcauaaagauuuuauugcau

SEQ ID NO: 1118233 - RNA, 22 nt, Human
aguguccccuccaagggccugg

SEQ ID NO: 1118234 - RNA, 17 nt, Human
ggcagcugccacuuuuu

SEQ ID NO: 1118235 - RNA, 22 nt, Human
aaaggcuaugagauagaagaua

SEQ ID NO: 1118236 - RNA, 21 nt, Human
ccagaggccucucuuggccac

SEQ ID NO: 1118237 - RNA, 22 nt, Human
caugggagguuggcuuggcaug

SEQ ID NO: 1118238 - RNA, 22 nt, Human
ggcacugaaccaggacacaagc

SEQ ID NO: 1118239 - RNA, 22 nt, Human
acagcaggauuuggcgauguug

SEQ ID NO: 1118240 - RNA, 22 nt, Human
agccuucagcaguucaggugcc

SEQ ID NO: 1118241 - RNA, 23 nt, Human
ccaaagucgaagucuaguccaga

SEQ ID NO: 1118242 - RNA, 22 nt, Human
agaacuuaggaacaacagcuua

SEQ ID NO: 1118243 - RNA, 22 nt, Human
cccaggagguggagguugcagu

SEQ ID NO: 1118244 - RNA, 22 nt, Human
ucagggcaggcgagcagcugcu

SEQ ID NO: 1118245 - RNA, 22 nt, Human
agaaguuaccacauacuucucu

SEQ ID NO: 1118246 - RNA, 22 nt, Human
ggcagauggaagaggcuggguc

SEQ ID NO: 1118247 - RNA, 22 nt, Human
gugccagcucuccccacaucug

SEQ ID NO: 1118248 - RNA, 22 nt, Human
gcagaggccaucaacuuugcca

SEQ ID NO: 1118249 - RNA, 17 nt, Human
ucuuuccugccaugcuc

SEQ ID NO: 1118250 - RNA, 22 nt, Human
cucaaggacuuauucaugccug

SEQ ID NO: 1118251 - RNA, 22 nt, Human
ucauugcacuccagccugggca

SEQ ID NO: 1118252 - RNA, 22 nt, Human
cacagaggacuguagcggggag

SEQ ID NO: 1118253 - RNA, 22 nt, Human
aaaucaguaaauguucauuaac

SEQ ID NO: 1118254 - RNA, 22 nt, Human
cagaagaaaguggggagacaag

SEQ ID NO: 1118255 - RNA, 22 nt, Human
gucccuggaucugggacagcug

SEQ ID NO: 1118256 - RNA, 22 nt, Human
ucuccuggucaccucagaaguc

SEQ ID NO: 1118257 - RNA, 22 nt, Human
gcguggugcugcccugcacaca

SEQ ID NO: 1118258 - RNA, 22 nt, Human
ggcucugccugcccagcagcac

SEQ ID NO: 1118259 - RNA, 22 nt, Human
ccucuggggugagugggccacu

SEQ ID NO: 1118260 - RNA, 22 nt, Human
agaggcaggagguugacuugag

SEQ ID NO: 1118261 - RNA, 22 nt, Human
aguuuauguagaauuggcaaua

SEQ ID NO: 1118262 - RNA, 22 nt, Human
ggaagggcaaaagagaugaacu

SEQ ID NO: 1118263 - RNA, 22 nt, Human
cagggcagagggaaacuccuuu

SEQ ID NO: 1118264 - RNA, 17 nt, Human
uccuucagugccucugc

SEQ ID NO: 1118265 - RNA, 22 nt, Human
uacuuuuagccuauuugauucu

SEQ ID NO: 1118266 - RNA, 22 nt, Human
acagagguguguguaggacagu

SEQ ID NO: 1118267 - RNA, 22 nt, Human
aucuggcucccuuggaauccgu

SEQ ID NO: 1118268 - RNA, 23 nt, Human
aacaauagguuuuggcagaauag

SEQ ID NO: 1118269 - RNA, 22 nt, Human
cugcccugagggccuguguguu

SEQ ID NO: 1118270 - RNA, 22 nt, Human
ucugccuggaugauggcagggc

SEQ ID NO: 1118271 - RNA, 22 nt, Human
agcagccagagucugaacauua

SEQ ID NO: 1118272 - RNA, 20 nt, Human
cagcugccuggcucugggau

SEQ ID NO: 1118273 - RNA, 22 nt, Human
agucuucccugugccagagugu

SEQ ID NO: 1118274 - RNA, 22 nt, Human
gggcagcagcaggaggucucug

SEQ ID NO: 1118275 - RNA, 22 nt, Human
auaugugugccauuucagcagu

SEQ ID NO: 1118276 - RNA, 22 nt, Human
cagccucucuguaucucaggau

SEQ ID NO: 1118277 - RNA, 22 nt, Human
accagagcuuacaugcuagaaa

SEQ ID NO: 1118278 - RNA, 18 nt, Human
uggagcaggaagccuggc

SEQ ID NO: 1118279 - RNA, 22 nt, Human
auagugguuggauaugucagag

SEQ ID NO: 1118280 - RNA, 22 nt, Human
ugcuggaggccugacuguguuu

SEQ ID NO: 1118281 - RNA, 22 nt, Human
ugccucuguugagccuuggcug

SEQ ID NO: 1118282 - RNA, 22 nt, Human
uggcucuggcgugaagcccaga

SEQ ID NO: 1118283 - RNA, 22 nt, Human
guaacacagaaaugaaauucca

SEQ ID NO: 1118284 - RNA, 22 nt, Human
ggagcugcucagagccaguccc

SEQ ID NO: 1118285 - RNA, 19 nt, Human
ugagaaggcaguggggagc

SEQ ID NO: 1118286 - RNA, 22 nt, Human
cagggcuguaaauuagugcuga

SEQ ID NO: 1118287 - RNA, 22 nt, Human
gagcugucucuauaugaaugcu

SEQ ID NO: 1118288 - RNA, 21 nt, Human
ccacaggggcuccccugucag

SEQ ID NO: 1118289 - RNA, 22 nt, Human
uggccucuuaggacauccucua

SEQ ID NO: 1118290 - RNA, 22 nt, Human
uuucaaauggagucgugaaaug

SEQ ID NO: 1118291 - RNA, 22 nt, Human
aucaguuucacuugcuugcaaa

SEQ ID NO: 1118292 - RNA, 22 nt, Human
ucauugcauuuauucacuggca

SEQ ID NO: 1118293 - RNA, 22 nt, Human
ggcccagcugugcuuccagccc

SEQ ID NO: 1118294 - RNA, 22 nt, Human
gccuaggagacaagcgugaaag

SEQ ID NO: 1118295 - RNA, 22 nt, Human
gcagccaccucccauggcgggg

SEQ ID NO: 1118296 - RNA, 22 nt, Human
cacugcaggucugagauggggg

SEQ ID NO: 1118297 - RNA, 22 nt, Human
caguagcagggauuauuuuagg

SEQ ID NO: 1118298 - RNA, 22 nt, Human
uggcagagcccagaacugagca

SEQ ID NO: 1118299 - RNA, 22 nt, Human
ggcucagguugggucacaugac

SEQ ID NO: 1118300 - RNA, 18 nt, Human
ccauuucaugauuauuac

SEQ ID NO: 1118301 - RNA, 22 nt, Human
cauggaaggcaaaagacacaga

SEQ ID NO: 1118302 - RNA, 22 nt, Human
uauuuccugcauggugauguaa

SEQ ID NO: 1118303 - RNA, 22 nt, Human
agcucccaauugacuugaacua

SEQ ID NO: 1118304 - RNA, 22 nt, Human
ugugucccuuggaaccucagcu

SEQ ID NO: 1118305 - RNA, 22 nt, Human
gcaaggcuuugugaauuuuaaa

SEQ ID NO: 1118306 - RNA, 22 nt, Human
agccccaguaagggagggccug

SEQ ID NO: 1118307 - RNA, 22 nt, Human
acagagcuguacaugugccaug

SEQ ID NO: 1118308 - RNA, 22 nt, Human
ugcauuauuugcaugugccugu

SEQ ID NO: 1118309 - RNA, 22 nt, Human
uucaagaucuggguuuucagcu

SEQ ID NO: 1118310 - RNA, 22 nt, Human
gaagagcuguagccugcucuuu

SEQ ID NO: 1118311 - RNA, 22 nt, Human
cagcacugcuucgcagccaggg

SEQ ID NO: 1118312 - RNA, 18 nt, Human
ucucuuuuccccucauug

SEQ ID NO: 1118313 - RNA, 22 nt, Human
guuuccauggcucuguuaaugg

SEQ ID NO: 1118314 - RNA, 22 nt, Human
ucaaguauaucuagucauuagg

SEQ ID NO: 1118315 - RNA, 22 nt, Human
cugggggcaauggucagagugu

SEQ ID NO: 1118316 - RNA, 22 nt, Human
aggcuauuuccacucuucucau

SEQ ID NO: 1118317 - RNA, 20 nt, Human
ucagagucaucaaagauggu

SEQ ID NO: 1118318 - RNA, 22 nt, Human
ugggauggcauccugggccuug

SEQ ID NO: 1118319 - RNA, 22 nt, Human
gccuggagaaaggaagguggga

SEQ ID NO: 1118320 - RNA, 22 nt, Human
gucuggggaagucagggcauca

SEQ ID NO: 1118321 - RNA, 22 nt, Human
ccuggagcucacugggagccgg

SEQ ID NO: 1118322 - RNA, 22 nt, Human
gcccauggacacccaagugcca

SEQ ID NO: 1118323 - RNA, 22 nt, Human
uguuuguucccucucuuuccug

SEQ ID NO: 1118324 - RNA, 22 nt, Human
cagcaggcagccauuucacugu

SEQ ID NO: 1118325 - RNA, 19 nt, Human
cucagcuguagcucaugug

SEQ ID NO: 1118326 - RNA, 22 nt, Human
ucacagugagccaugucagaga

SEQ ID NO: 1118327 - RNA, 22 nt, Human
agcagugaugcaugacagccua

SEQ ID NO: 1118328 - RNA, 22 nt, Human
ggcauggcuggguucuggugag

SEQ ID NO: 1118329 - RNA, 22 nt, Human
auaaguucagguaaagaaauca

SEQ ID NO: 1118330 - RNA, 22 nt, Human
ggggcagagcauagcuccaauu

SEQ ID NO: 1118331 - RNA, 20 nt, Human
aggagaaauucgggacaccu

SEQ ID NO: 1118332 - RNA, 22 nt, Human
uaacagaagagcaggcagcccu

SEQ ID NO: 1118333 - RNA, 22 nt, Human
uccaagaagucaucuaaacugu

SEQ ID NO: 1118334 - RNA, 22 nt, Human
cugaagaugucugagaugcuca

SEQ ID NO: 1118335 - RNA, 22 nt, Human
ugcagugccucggcagugcagc

SEQ ID NO: 1118336 - RNA, 22 nt, Human
caggcagccugagggaucuggg

SEQ ID NO: 1118337 - RNA, 22 nt, Human
acaaagguggaccauguggcuu

SEQ ID NO: 1118338 - RNA, 22 nt, Human
uccagggcuuggcugggacggu

SEQ ID NO: 1118339 - RNA, 22 nt, Human
ccacccuggacaggccucugag

SEQ ID NO: 1118340 - RNA, 18 nt, Human
uucacaggaaaugucuuu

SEQ ID NO: 1118341 - RNA, 22 nt, Human
aaggucauggcaaauuacuuuu

SEQ ID NO: 1118342 - RNA, 22 nt, Human
gaucaaaagcuggguucuaaaa

SEQ ID NO: 1118343 - RNA, 22 nt, Human
aguuacuugagacguuuaugaa

SEQ ID NO: 1118344 - RNA, 22 nt, Human
acacugcagaugaaagcauaag

SEQ ID NO: 1118345 - RNA, 22 nt, Human
ucuguggauuuuaguguucaug

SEQ ID NO: 1118346 - RNA, 22 nt, Human
cacugcaguuccccagugcgca

SEQ ID NO: 1118347 - RNA, 22 nt, Human
uuuuuaagagauucuccagucu

SEQ ID NO: 1118348 - RNA, 22 nt, Human
aggagccaguuccaccccagga

SEQ ID NO: 1118349 - RNA, 22 nt, Human
agggagcuuccgaacuacagcu

SEQ ID NO: 1118350 - RNA, 22 nt, Human
gcugccaccguggagaugagug

SEQ ID NO: 1118351 - RNA, 22 nt, Human
gccaggcuccaggcccuccuga

SEQ ID NO: 1118352 - RNA, 22 nt, Human
uccuugaaugaauguucucucc

SEQ ID NO: 1118353 - RNA, 22 nt, Human
uguacuuccccaaugacagcac

SEQ ID NO: 1118354 - RNA, 22 nt, Human
gcuggccugggcagccugucgg

SEQ ID NO: 1118355 - RNA, 22 nt, Human
gaacccaguccaggugcagccu

SEQ ID NO: 1118356 - RNA, 22 nt, Human
ccagggcagggaccacgugucu

SEQ ID NO: 1118357 - RNA, 22 nt, Human
uuaaacaguguuucaugugggg

SEQ ID NO: 1118358 - RNA, 23 nt, Human
ugcagagggacugaagccagcuu

SEQ ID NO: 1118359 - RNA, 22 nt, Human
agaggcuggauugagcauagac

SEQ ID NO: 1118360 - RNA, 22 nt, Human
ugaaagcucugucaucauuccu

SEQ ID NO: 1118361 - RNA, 22 nt, Human
ucccuggagauaacuucuggga

SEQ ID NO: 1118362 - RNA, 22 nt, Human
uaucuacaggugucagguaaga

SEQ ID NO: 1118363 - RNA, 22 nt, Human
ugccugucuuaauaucuggaaa

SEQ ID NO: 1118364 - RNA, 18 nt, Human
uccagagguguuggagcc

SEQ ID NO: 1118365 - RNA, 22 nt, Human
agggcagcauugccuuucucca

SEQ ID NO: 1118366 - RNA, 22 nt, Human
ugaaggagcucaaugaugaugc

SEQ ID NO: 1118367 - RNA, 20 nt, Human
acagccagaggaggcagaca

SEQ ID NO: 1118368 - RNA, 22 nt, Human
cacuggggaaaacaggcuucuu

SEQ ID NO: 1118369 - RNA, 22 nt, Human
augauggugggagaugacccag

SEQ ID NO: 1118370 - RNA, 22 nt, Human
agacccagaaagcagcugcauu

SEQ ID NO: 1118371 - RNA, 22 nt, Human
gagcugcccugagcuuugcaug

SEQ ID NO: 1118372 - RNA, 22 nt, Human
gugcauguuaaugguguacaaa

SEQ ID NO: 1118373 - RNA, 18 nt, Human
ucugucucuguccuugcu

SEQ ID NO: 1118374 - RNA, 22 nt, Human
cccuucagcugagugggacagc

SEQ ID NO: 1118375 - RNA, 22 nt, Human
aucuggcucauucagggaacgg

SEQ ID NO: 1118376 - RNA, 17 nt, Human
cagacagauauccuggg

SEQ ID NO: 1118377 - RNA, 22 nt, Human
cacagggcagagaccugggugc

SEQ ID NO: 1118378 - RNA, 22 nt, Human
gccagcucccaagugagccccu

SEQ ID NO: 1118379 - RNA, 22 nt, Human
ggccagggccuggggacugucc

SEQ ID NO: 1118380 - RNA, 22 nt, Human
uacauuaacuuacguccacaug

SEQ ID NO: 1118381 - RNA, 22 nt, Human
agcuggggcugcagagaacagg

SEQ ID NO: 1118382 - RNA, 22 nt, Human
ugcugccuuagcagccaggcaa

SEQ ID NO: 1118383 - RNA, 22 nt, Human
uggcccuguguccugcugccag

SEQ ID NO: 1118384 - RNA, 21 nt, Human
ucuuugcaucaguuguuuucu

SEQ ID NO: 1118385 - RNA, 22 nt, Human
cacauuucucuaccucacacaa

SEQ ID NO: 1118386 - RNA, 22 nt, Human
agucccagaucuccauucgguc

SEQ ID NO: 1118387 - RNA, 22 nt, Human
cuggggugugcucagagcaggg

SEQ ID NO: 1118388 - RNA, 22 nt, Human
ugcaguggaaucuggagagcag

SEQ ID NO: 1118389 - RNA, 22 nt, Human
gagagcacaugaacauggagga

SEQ ID NO: 1118390 - RNA, 22 nt, Human
auacauacguacauacguaugu

SEQ ID NO: 1118391 - RNA, 22 nt, Human
uccucagaaaccccugugaggu

SEQ ID NO: 1118392 - RNA, 22 nt, Human
uuagucaauagugaauauagag

SEQ ID NO: 1118393 - RNA, 22 nt, Human
cagggcagugaagaacacacgu

SEQ ID NO: 1118394 - RNA, 22 nt, Human
uccuugaagagugggcggucga

SEQ ID NO: 1118395 - RNA, 19 nt, Human
ugucacugucauggcccag

SEQ ID NO: 1118396 - RNA, 22 nt, Human
ccucuggcuguaccacuggcac

SEQ ID NO: 1118397 - RNA, 22 nt, Human
aaacagaaauuuccucaugcuc

SEQ ID NO: 1118398 - RNA, 22 nt, Human
agccagcagggcuuagaggaca

SEQ ID NO: 1118399 - RNA, 23 nt, Human
acuuaaaugguucuuuaucucag

SEQ ID NO: 1118400 - RNA, 22 nt, Human
acaagagauuaucuacagauga

SEQ ID NO: 1118401 - RNA, 22 nt, Human
gugucccacucuggaggugaag

SEQ ID NO: 1118402 - RNA, 22 nt, Human
acagggccaggugagaggugcu

SEQ ID NO: 1118403 - RNA, 22 nt, Human
gcucugcuguguuuguucagca

SEQ ID NO: 1118404 - RNA, 22 nt, Human
ggccugugagcccuugcaugua

SEQ ID NO: 1118405 - RNA, 22 nt, Human
cauuguauugaggauacuuaag

SEQ ID NO: 1118406 - RNA, 22 nt, Human
guggcagcaaaauccugcauuc

SEQ ID NO: 1118407 - RNA, 22 nt, Human
gcagggcuguggacacuuuggu

SEQ ID NO: 1118408 - RNA, 22 nt, Human
ccuccaggcugaauaucuagaa

SEQ ID NO: 1118409 - RNA, 22 nt, Human
ucaaugauaguacaaucagccu

SEQ ID NO: 1118410 - RNA, 22 nt, Human
acagagccuccaggagugcugg

SEQ ID NO: 1118411 - RNA, 22 nt, Human
cagcauggggaucacuguaggc

SEQ ID NO: 1118412 - RNA, 22 nt, Human
ucacagaauagcacuguaagcg

SEQ ID NO: 1118413 - RNA, 21 nt, Human
cucaggaucuuauauauuagu

SEQ ID NO: 1118414 - RNA, 22 nt, Human
ugaaacagucuccagacuugga

SEQ ID NO: 1118415 - RNA, 22 nt, Human
ugguccugccccgugcacagag

SEQ ID NO: 1118416 - RNA, 22 nt, Human
ccugccugcggcccgcggggag

SEQ ID NO: 1118417 - RNA, 22 nt, Human
ggaggccuagccagcuccaguu

SEQ ID NO: 1118418 - RNA, 22 nt, Human
gccaccucuuugucucugccgc

SEQ ID NO: 1118419 - RNA, 22 nt, Human
aggcuggaguacaguggcuauu

SEQ ID NO: 1118420 - RNA, 22 nt, Human
ucaaagucucugcuucuguaac

SEQ ID NO: 1118421 - RNA, 22 nt, Human
cagacuggccacaucugcacug

SEQ ID NO: 1118422 - RNA, 22 nt, Human
cucuggaggccuaaggaagugg

SEQ ID NO: 1118423 - RNA, 22 nt, Human
uugagucaguaauuccauuucu

SEQ ID NO: 1118424 - RNA, 17 nt, Human
gcacugaacaauccugu

SEQ ID NO: 1118425 - RNA, 22 nt, Human
uuuugaaagggugauuuggcuu

SEQ ID NO: 1118426 - RNA, 22 nt, Human
ggagccaggggaccuucacaga

SEQ ID NO: 1118427 - RNA, 22 nt, Human
aguggcaguagaugagcugguu

SEQ ID NO: 1118428 - RNA, 22 nt, Human
ugcagccaucgcagagucugua

SEQ ID NO: 1118429 - RNA, 22 nt, Human
aaugggaggauuuucucucuug

SEQ ID NO: 1118430 - RNA, 22 nt, Human
ccagaccacccuggccaugcac

SEQ ID NO: 1118431 - RNA, 22 nt, Human
aaaguguggagauugaacuaaa

SEQ ID NO: 1118432 - RNA, 22 nt, Human
cagggugacugcccuggccacu

SEQ ID NO: 1118433 - RNA, 22 nt, Human
ucaggggacagccagcuggagg

SEQ ID NO: 1118434 - RNA, 22 nt, Human
uccagggaccucccugagagcu

SEQ ID NO: 1118435 - RNA, 22 nt, Human
ucacugcagacaaccucaguca

SEQ ID NO: 1118436 - RNA, 22 nt, Human
gaguggagcaaaagagguagau

SEQ ID NO: 1118437 - RNA, 22 nt, Human
acccugggucauauacagugug

SEQ ID NO: 1118438 - RNA, 22 nt, Human
ucagccucucugaguccagacc

SEQ ID NO: 1118439 - RNA, 22 nt, Human
cugcucugugguccaugagaca

SEQ ID NO: 1118440 - RNA, 22 nt, Human
uuaguaauguguuaauaugaau

SEQ ID NO: 1118441 - RNA, 22 nt, Human
auacauguaacugcauuguaau

SEQ ID NO: 1118442 - RNA, 22 nt, Human
aggugccagugcuguggucccc

SEQ ID NO: 1118443 - RNA, 22 nt, Human
ugaagcaggaucguuugcuuca

SEQ ID NO: 1118444 - RNA, 22 nt, Human
caggggcuguuugccucaggcc

SEQ ID NO: 1118445 - RNA, 22 nt, Human
aggcagaauguuggaaaggaag

SEQ ID NO: 1118446 - RNA, 22 nt, Human
aggcuucuuagauuggcuggag

SEQ ID NO: 1118447 - RNA, 23 nt, Human
agaaaagcuuggacacauggccu

SEQ ID NO: 1118448 - RNA, 22 nt, Human
ccaggcucaggugcgagagaca

SEQ ID NO: 1118449 - RNA, 22 nt, Human
acauuucugcuagaauagguga

SEQ ID NO: 1118450 - RNA, 21 nt, Human
aacauuucugggagaacucac

SEQ ID NO: 1118451 - RNA, 22 nt, Human
guucacaucacuucacugaacc

SEQ ID NO: 1118452 - RNA, 22 nt, Human
ccugccuggagcugagugugga

SEQ ID NO: 1118453 - RNA, 22 nt, Human
ugggcuggugagggaucauuua

SEQ ID NO: 1118454 - RNA, 22 nt, Human
gggcugucaugugucagugacc

SEQ ID NO: 1118455 - RNA, 22 nt, Human
cucccacuccuggcucaccaca

SEQ ID NO: 1118456 - RNA, 19 nt, Human
ccagucccauacaggagau

SEQ ID NO: 1118457 - RNA, 23 nt, Human
aucagucuugguagcugugccca

SEQ ID NO: 1118458 - RNA, 22 nt, Human
ugucugucugcaagccagaaag

SEQ ID NO: 1118459 - RNA, 22 nt, Human
cauuuagaaacuguuuuuaaca

SEQ ID NO: 1118460 - RNA, 22 nt, Human
gagcucagcccaaagagcagug

SEQ ID NO: 1118461 - RNA, 22 nt, Human
gaggcuggcagaaaagcacagg

SEQ ID NO: 1118462 - RNA, 21 nt, Human
aaugugugcuauuuaucuuuu

SEQ ID NO: 1118463 - RNA, 22 nt, Human
ggcucaggagaggggcuaaaag

SEQ ID NO: 1118464 - RNA, 23 nt, Human
augcaguauaugucaguaguuua

SEQ ID NO: 1118465 - RNA, 22 nt, Human
ugaagccagcuuuggaagacac

SEQ ID NO: 1118466 - RNA, 22 nt, Human
ccaggcuggagugcaauggugc

SEQ ID NO: 1118467 - RNA, 22 nt, Human
gcuggccauauauuuugcuguu

SEQ ID NO: 1118468 - RNA, 22 nt, Human
agggucugacaaugugacuuag

SEQ ID NO: 1118469 - RNA, 22 nt, Human
ccugccagauccccugagcuga

SEQ ID NO: 1118470 - RNA, 22 nt, Human
cauugcucaggcccagcaggaa

SEQ ID NO: 1118471 - RNA, 22 nt, Human
aacugcauuugcauaaguccau

SEQ ID NO: 1118472 - RNA, 22 nt, Human
cggcuggguagaggugccgggu

SEQ ID NO: 1118473 - RNA, 22 nt, Human
uggcacugccuggcagggcccc

SEQ ID NO: 1118474 - RNA, 22 nt, Human
uuauuuucagcuaggaaagcca

SEQ ID NO: 1118475 - RNA, 22 nt, Human
gagcuuugcuggaagccugggg

SEQ ID NO: 1118476 - RNA, 22 nt, Human
auugaaagauuuugggcucaug

SEQ ID NO: 1118477 - RNA, 20 nt, Human
ggcacuggaagcacacagga

SEQ ID NO: 1118478 - RNA, 22 nt, Human
gagcucugacugcugggugaca

SEQ ID NO: 1118479 - RNA, 22 nt, Human
cauggcaggugcagauucugug

SEQ ID NO: 1118480 - RNA, 22 nt, Human
acucaagauagggaaaguacaa

SEQ ID NO: 1118481 - RNA, 22 nt, Human
aagcgccaugguuccugcgcag

SEQ ID NO: 1118482 - RNA, 22 nt, Human
augggcagcagcugccauucau

SEQ ID NO: 1118483 - RNA, 22 nt, Human
ggcugaaguguaguggcucacu

SEQ ID NO: 1118484 - RNA, 22 nt, Human
aauuucaauuacuuuugcacca

SEQ ID NO: 1118485 - RNA, 22 nt, Human
aacaucagaauauccauguugg

SEQ ID NO: 1118486 - RNA, 22 nt, Human
ccaggaaugaaauguagauaaa

SEQ ID NO: 1118487 - RNA, 22 nt, Human
auccaguucucagugcuuacag

SEQ ID NO: 1118488 - RNA, 22 nt, Human
gugcugcagagucucgugccgc

SEQ ID NO: 1118489 - RNA, 22 nt, Human
aaugagcugcugcuguuccacc

SEQ ID NO: 1118490 - RNA, 22 nt, Human
agcagcucuguuuaccuggagg

SEQ ID NO: 1118491 - RNA, 22 nt, Human
cugugcccuggccaggccucuc

SEQ ID NO: 1118492 - RNA, 22 nt, Human
gggcagagguucaacuucaaca

SEQ ID NO: 1118493 - RNA, 22 nt, Human
ucugucacucccugaugaugaa

SEQ ID NO: 1118494 - RNA, 21 nt, Human
gauuucacuuaccuucauuua

SEQ ID NO: 1118495 - RNA, 20 nt, Human
cccagggaccugagcuccau

SEQ ID NO: 1118496 - RNA, 22 nt, Human
uuuggaaaguguacaaauuuga

SEQ ID NO: 1118497 - RNA, 18 nt, Human
guccugagcucugcugua

SEQ ID NO: 1118498 - RNA, 22 nt, Human
uccauuuucaucucauguauaa

SEQ ID NO: 1118499 - RNA, 21 nt, Human
cagaggcagguccugggacgg

SEQ ID NO: 1118500 - RNA, 22 nt, Human
gcauccagucuuggcuccugga

SEQ ID NO: 1118501 - RNA, 22 nt, Human
uggcuuccugcauggauccucu

SEQ ID NO: 1118502 - RNA, 22 nt, Human
ugaugggacugccagcugcuga

SEQ ID NO: 1118503 - RNA, 22 nt, Human
uagagcauuuagaggggcagga

SEQ ID NO: 1118504 - RNA, 22 nt, Human
cuccucccugcgauugcucugc

SEQ ID NO: 1118505 - RNA, 22 nt, Human
gaugcacuuucuuuucaacagu

SEQ ID NO: 1118506 - RNA, 21 nt, Human
agaaaauggcguuuuagauuu

SEQ ID NO: 1118507 - RNA, 22 nt, Human
uggugcaagucucugaggaggg

SEQ ID NO: 1118508 - RNA, 22 nt, Human
augaaaacggaccagagcuauu

SEQ ID NO: 1118509 - RNA, 21 nt, Human
aggcagaaagagcccaggcug

SEQ ID NO: 1118510 - RNA, 22 nt, Human
ccugggcagggcuggacucuca

SEQ ID NO: 1118511 - RNA, 22 nt, Human
gaggcucagagggagcaugguc

SEQ ID NO: 1118512 - RNA, 21 nt, Human
gccaccccuggcacaggugcu

SEQ ID NO: 1118513 - RNA, 22 nt, Human
uguaugugcuugagaagguggg

SEQ ID NO: 1118514 - RNA, 22 nt, Human
gcaggggcugcugggaacucgg

SEQ ID NO: 1118515 - RNA, 17 nt, Human
gcaaucucagucuccuu

SEQ ID NO: 1118516 - RNA, 22 nt, Human
ggggacccucaggacugcgucu

SEQ ID NO: 1118517 - RNA, 22 nt, Human
ggucucagaucuuuauuaaggc

SEQ ID NO: 1118518 - RNA, 22 nt, Human
acauguguauagccuguauaga

SEQ ID NO: 1118519 - RNA, 22 nt, Human
cagguggagcugacugagggca

SEQ ID NO: 1118520 - RNA, 22 nt, Human
ugcucacagcccagaacauaau

SEQ ID NO: 1118521 - RNA, 20 nt, Human
ggagagcagggaagacagua

SEQ ID NO: 1118522 - RNA, 22 nt, Human
uacaaagccugguagauaucug

SEQ ID NO: 1118523 - RNA, 22 nt, Human
ucaggagauggucuuuauaggc

SEQ ID NO: 1118524 - RNA, 22 nt, Human
ugggcuccucgucacucgcugu

SEQ ID NO: 1118525 - RNA, 22 nt, Human
gcucaaggcaggcagacaugag

SEQ ID NO: 1118526 - RNA, 22 nt, Human
aagggcagaaagggacgcuuug

SEQ ID NO: 1118527 - RNA, 22 nt, Human
gaagagcugcaguuuccugggc

SEQ ID NO: 1118528 - RNA, 22 nt, Human
cagagcuggagcuugaauggag

SEQ ID NO: 1118529 - RNA, 22 nt, Human
aggggcugacuggaaagugcca

SEQ ID NO: 1118530 - RNA, 22 nt, Human
gcuggcugggucccugagaggc

SEQ ID NO: 1118531 - RNA, 23 nt, Human
gggagaauaugaggaugauggug

SEQ ID NO: 1118532 - RNA, 22 nt, Human
ccagccucacuggcaucaccua

SEQ ID NO: 1118533 - RNA, 22 nt, Human
cagagacagaaaauggaucuag

SEQ ID NO: 1118534 - RNA, 22 nt, Human
gagcucagcacuaaaaucaugu

SEQ ID NO: 1118535 - RNA, 22 nt, Human
cagcaguggaacuacccaggga

SEQ ID NO: 1118536 - RNA, 22 nt, Human
uauaucuuauaugugcagguac

SEQ ID NO: 1118537 - RNA, 22 nt, Human
ccagccugaaaugccucauccu

SEQ ID NO: 1118538 - RNA, 22 nt, Human
ccagcccuugagauggaaggga

SEQ ID NO: 1118539 - RNA, 22 nt, Human
agugaguggacccugcaaggaa

SEQ ID NO: 1118540 - RNA, 22 nt, Human
acagcagccugcagcccugugu

SEQ ID NO: 1118541 - RNA, 22 nt, Human
ggaaagagcuaaaagggugaga

SEQ ID NO: 1118542 - RNA, 22 nt, Human
acuuucuccagaaaaccaagga

SEQ ID NO: 1118543 - RNA, 22 nt, Human
uuggcuucuggcagucuggacg

SEQ ID NO: 1118544 - RNA, 22 nt, Human
cucaggccauucuuccagcugc

SEQ ID NO: 1118545 - RNA, 22 nt, Human
ucccagagaaagucaaggucuu

SEQ ID NO: 1118546 - RNA, 23 nt, Human
ggagccuggcauaugagacgcau

SEQ ID NO: 1118547 - RNA, 22 nt, Human
gcagccacucucauuccacgug

SEQ ID NO: 1118548 - RNA, 22 nt, Human
agcugggucuugggccaggaga

SEQ ID NO: 1118549 - RNA, 22 nt, Human
gccaugccugugucuccaggcc

SEQ ID NO: 1118550 - RNA, 22 nt, Human
agagccagcaacucuagcccug

SEQ ID NO: 1118551 - RNA, 22 nt, Human
caagagcuacccugugccauau

SEQ ID NO: 1118552 - RNA, 22 nt, Human
uaugcacacaggcuuaauucau

SEQ ID NO: 1118553 - RNA, 22 nt, Human
cagcaucaccgccauuucugau

SEQ ID NO: 1118554 - RNA, 22 nt, Human
cugggcugcaucaaagaggcau

SEQ ID NO: 1118555 - RNA, 22 nt, Human
acugucucucuagcaguucagg

SEQ ID NO: 1118556 - RNA, 20 nt, Human
auguagaugaaagcaaaggc

SEQ ID NO: 1118557 - RNA, 22 nt, Human
gccugccuguuggcugaggugc

SEQ ID NO: 1118558 - RNA, 19 nt, Human
ucucagaggaaaaauugcu

SEQ ID NO: 1118559 - RNA, 22 nt, Human
gaaaugcagauucugauucugu

SEQ ID NO: 1118560 - RNA, 22 nt, Human
cccagcauuucugggcugcacu

SEQ ID NO: 1118561 - RNA, 22 nt, Human
gccuucaguagugucagcugua

SEQ ID NO: 1118562 - RNA, 20 nt, Human
cagcuuggaugagaggcuga

SEQ ID NO: 1118563 - RNA, 22 nt, Human
gccugagauucugcauuucuaa

SEQ ID NO: 1118564 - RNA, 22 nt, Human
guggccaggccgacugccaggc

SEQ ID NO: 1118565 - RNA, 22 nt, Human
gcaggguccauggaggcagccc

SEQ ID NO: 1118566 - RNA, 22 nt, Human
ccagccuggguguuagaagaca

SEQ ID NO: 1118567 - RNA, 22 nt, Human
ggaugcugcuaucaggcuucga

SEQ ID NO: 1118568 - RNA, 22 nt, Human
uggcagcuccggguaggggcug

SEQ ID NO: 1118569 - RNA, 17 nt, Human
ggagagugggaauggcc

SEQ ID NO: 1118570 - RNA, 22 nt, Human
uccuugaagcuuguaucuaaua

SEQ ID NO: 1118571 - RNA, 22 nt, Human
gaggaggcuaagugggcucugg

SEQ ID NO: 1118572 - RNA, 22 nt, Human
cagcagcaaaucuagaagagga

SEQ ID NO: 1118573 - RNA, 22 nt, Human
cagaaguaagauuacugugagu

SEQ ID NO: 1118574 - RNA, 22 nt, Human
ucccagcagagccagcaagccg

SEQ ID NO: 1118575 - RNA, 22 nt, Human
gccaggccugcaagugcuggug

SEQ ID NO: 1118576 - RNA, 22 nt, Human
cacugcuuaguugguaaaugug

SEQ ID NO: 1118577 - RNA, 22 nt, Human
aggagugcaaauaguccagaga

SEQ ID NO: 1118578 - RNA, 22 nt, Human
ugaacgcagguccacauggcuc

SEQ ID NO: 1118579 - RNA, 21 nt, Human
uuucugucucugccacuaguu

SEQ ID NO: 1118580 - RNA, 22 nt, Human
uuuauguaauuucauaggugug

SEQ ID NO: 1118581 - RNA, 22 nt, Human
cauugaaauauggaaacugaug

SEQ ID NO: 1118582 - RNA, 22 nt, Human
agagccagcaagugaauaguga

SEQ ID NO: 1118583 - RNA, 22 nt, Human
cagggccugagggcugcucugc

SEQ ID NO: 1118584 - RNA, 22 nt, Human
uggcccugacagguccugggca

SEQ ID NO: 1118585 - RNA, 22 nt, Human
cucccagagaccaagcugagaa

SEQ ID NO: 1118586 - RNA, 22 nt, Human
uccagccacucagcagggauug

SEQ ID NO: 1118587 - RNA, 22 nt, Human
aauuuagauugauaaacaugga

SEQ ID NO: 1118588 - RNA, 22 nt, Human
ugcaauaacccaguaucuguga

SEQ ID NO: 1118589 - RNA, 22 nt, Human
ugagggaguuggguguauagga

SEQ ID NO: 1118590 - RNA, 22 nt, Human
gcuguccucuuggacucagggc

SEQ ID NO: 1118591 - RNA, 22 nt, Human
aaaaucugguaauuugaaugug

SEQ ID NO: 1118592 - RNA, 18 nt, Human
uggcagcaggaagccauu

SEQ ID NO: 1118593 - RNA, 22 nt, Human
ggcggggguccaggagccugca

SEQ ID NO: 1118594 - RNA, 22 nt, Human
accugccuauggagccacaugg

SEQ ID NO: 1118595 - RNA, 20 nt, Human
cacaagagaauacacacugg

SEQ ID NO: 1118596 - RNA, 23 nt, Human
gugcucugcggucugcuagucug

SEQ ID NO: 1118597 - RNA, 22 nt, Human
caggcagauuugcugcccucca

SEQ ID NO: 1118598 - RNA, 22 nt, Human
ggacccugggcuugcuccuggg

SEQ ID NO: 1118599 - RNA, 22 nt, Human
agcagcugaucaaagcacuuau

SEQ ID NO: 1118600 - RNA, 22 nt, Human
gcugucaguuuuacccacagac

SEQ ID NO: 1118601 - RNA, 20 nt, Human
ucacaggggaccaggagcag

SEQ ID NO: 1118602 - RNA, 22 nt, Human
gaauguaauagucaguagaaca

SEQ ID NO: 1118603 - RNA, 22 nt, Human
aagcugccagcugagcugaggc

SEQ ID NO: 1118604 - RNA, 22 nt, Human
gcagagugaggaagagcuucca

SEQ ID NO: 1118605 - RNA, 17 nt, Human
uggagcugcguguguuc

SEQ ID NO: 1118606 - RNA, 22 nt, Human
acuccugggugcugaccagcgu

SEQ ID NO: 1118607 - RNA, 22 nt, Human
uccagucaagcuugagaauuuc

SEQ ID NO: 1118608 - RNA, 22 nt, Human
ggcccacacugacagcugagcu

SEQ ID NO: 1118609 - RNA, 23 nt, Human
uuguuuuuagagguggcaugaga

SEQ ID NO: 1118610 - RNA, 22 nt, Human
gccuggcccagggcuccgcagg

SEQ ID NO: 1118611 - RNA, 22 nt, Human
ggccuggcucuugcccagccug

SEQ ID NO: 1118612 - RNA, 22 nt, Human
gcagcugcuggaaguuccugcc

SEQ ID NO: 1118613 - RNA, 22 nt, Human
ggagggagcauccccuugcuga

SEQ ID NO: 1118614 - RNA, 22 nt, Human
guugggaagcagauggaugagc

SEQ ID NO: 1118615 - RNA, 21 nt, Human
uggccucccacacuuccaugg

SEQ ID NO: 1118616 - RNA, 22 nt, Human
ccagagcugcauccagcagguu

SEQ ID NO: 1118617 - RNA, 22 nt, Human
uguggcugucuguucuccuagg

SEQ ID NO: 1118618 - RNA, 22 nt, Human
ucagaacagaagaaggaacacg

SEQ ID NO: 1118619 - RNA, 19 nt, Human
gcuggcagauguggccgug

SEQ ID NO: 1118620 - RNA, 22 nt, Human
agggcagcuagcuguagaaaga

SEQ ID NO: 1118621 - RNA, 22 nt, Human
cuuucagagguuacucaggaaa

SEQ ID NO: 1118622 - RNA, 22 nt, Human
ggcuggguuauuuauggccaag

SEQ ID NO: 1118623 - RNA, 22 nt, Human
cucuugggagugcucuggagaa

SEQ ID NO: 1118624 - RNA, 19 nt, Human
acacugaauguagaauugg

SEQ ID NO: 1118625 - RNA, 22 nt, Human
uggccuccccuaacagccucuu

SEQ ID NO: 1118626 - RNA, 22 nt, Human
ugggugggagcgcccugucugg

SEQ ID NO: 1118627 - RNA, 22 nt, Human
cccagccugugacagccguccu

SEQ ID NO: 1118628 - RNA, 22 nt, Human
ggagugggaacaaugacauggu

SEQ ID NO: 1118629 - RNA, 22 nt, Human
cuguuuauacgacagguggagg

SEQ ID NO: 1118630 - RNA, 20 nt, Human
aggaagccaaaggcugucuu

SEQ ID NO: 1118631 - RNA, 22 nt, Human
cagagacauuaagugccaugau

SEQ ID NO: 1118632 - RNA, 22 nt, Human
guguaucaaagcacagacuuca

SEQ ID NO: 1118633 - RNA, 22 nt, Human
ccagcugauucgguggugguug

SEQ ID NO: 1118634 - RNA, 20 nt, Human
aggcacuggggauagguaag

SEQ ID NO: 1118635 - RNA, 22 nt, Human
agcugggccugagcuggaagcu

SEQ ID NO: 1118636 - RNA, 22 nt, Human
aaaaguucccugguuagaaaag

SEQ ID NO: 1118637 - RNA, 22 nt, Human
ucugagccguauggcuuggcua

SEQ ID NO: 1118638 - RNA, 22 nt, Human
caaaugcagucccuuuguugcu

SEQ ID NO: 1118639 - RNA, 22 nt, Human
acagagcuuaauucaggagcuu

SEQ ID NO: 1118640 - RNA, 22 nt, Human
aguaucaaggaucuccagcacc

SEQ ID NO: 1118641 - RNA, 22 nt, Human
uggcuuccugcacagugucugc

SEQ ID NO: 1118642 - RNA, 17 nt, Human
ccugggaggaguuauga

SEQ ID NO: 1118643 - RNA, 22 nt, Human
ucucagaguuccucuggagucc

SEQ ID NO: 1118644 - RNA, 22 nt, Human
ugcauauugugaaaauguagau

SEQ ID NO: 1118645 - RNA, 22 nt, Human
caguuuuuagauuaguuggugg

SEQ ID NO: 1118646 - RNA, 22 nt, Human
aaaugcagauuuugaugcagca

SEQ ID NO: 1118647 - RNA, 22 nt, Human
ggccagggggcuucagacucca

SEQ ID NO: 1118648 - RNA, 22 nt, Human
aagauuucagaguuugggggaa

SEQ ID NO: 1118649 - RNA, 22 nt, Human
acacccagagcgccagugccga

SEQ ID NO: 1118650 - RNA, 22 nt, Human
agggcugccauuucuggcccaa

SEQ ID NO: 1118651 - RNA, 22 nt, Human
ccaggcucugucuggucagaag

SEQ ID NO: 1118652 - RNA, 22 nt, Human
agccagcuggagaccacuguuu

SEQ ID NO: 1118653 - RNA, 22 nt, Human
gacagggcgagacucagucuca

SEQ ID NO: 1118654 - RNA, 22 nt, Human
ccacagggccuuuccugcuggc

SEQ ID NO: 1118655 - RNA, 22 nt, Human
acugucuuccaggucuggaggu

SEQ ID NO: 1118656 - RNA, 23 nt, Human
aucaaacuggugagaaugucagu

SEQ ID NO: 1118657 - RNA, 22 nt, Human
ucuccaagcagggcugcaaggc

SEQ ID NO: 1118658 - RNA, 22 nt, Human
uccagaguacggaagagucauc

SEQ ID NO: 1118659 - RNA, 22 nt, Human
ugugccauuucuauucugcagc

SEQ ID NO: 1118660 - RNA, 21 nt, Human
ugcuuuaugggaaaaauguca

SEQ ID NO: 1118661 - RNA, 22 nt, Human
cuggagcucuccagagccccgu

SEQ ID NO: 1118662 - RNA, 22 nt, Human
cuggccuuuuguuucuggagaa

SEQ ID NO: 1118663 - RNA, 22 nt, Human
gucccagaaacauauugcuggu

SEQ ID NO: 1118664 - RNA, 22 nt, Human
ugcuggccaacaaggcuccaag

SEQ ID NO: 1118665 - RNA, 22 nt, Human
agugggcagcccaggaggucuu

SEQ ID NO: 1118666 - RNA, 22 nt, Human
gcuccagaugaaaggccagagg

SEQ ID NO: 1118667 - RNA, 22 nt, Human
uucagcagugcagacacccagu

SEQ ID NO: 1118668 - RNA, 22 nt, Human
agccugcaggaugggcagcacc

SEQ ID NO: 1118669 - RNA, 22 nt, Human
uuacaguaugaucaacuuuuca

SEQ ID NO: 1118670 - RNA, 22 nt, Human
caggcuugauuauucagacaau

SEQ ID NO: 1118671 - RNA, 22 nt, Human
uccuuggcuuucuggagcuucu

SEQ ID NO: 1118672 - RNA, 22 nt, Human
cucugaacucuugggcagcaug

SEQ ID NO: 1118673 - RNA, 22 nt, Human
ggcacugagcugccuuggggca

SEQ ID NO: 1118674 - RNA, 22 nt, Human
aguggcaggaaaguggaagaga

SEQ ID NO: 1118675 - RNA, 18 nt, Human
gaggauggaaggagaugc

SEQ ID NO: 1118676 - RNA, 22 nt, Human
aggcagcaaagaaaugaugcug

SEQ ID NO: 1118677 - RNA, 21 nt, Human
ugauccuuucccccauguugc

SEQ ID NO: 1118678 - RNA, 22 nt, Human
ugccuuccuggagcugaaggcu

SEQ ID NO: 1118679 - RNA, 22 nt, Human
agggcagaaaucgauuacaccu

SEQ ID NO: 1118680 - RNA, 22 nt, Human
agugaccaacaaugcugagaag

SEQ ID NO: 1118681 - RNA, 22 nt, Human
ucucacuggguauaaaugagua

SEQ ID NO: 1118682 - RNA, 22 nt, Human
agcugccaggccccugagaacc

SEQ ID NO: 1118683 - RNA, 22 nt, Human
gcugaagggagugcugagucug

SEQ ID NO: 1118684 - RNA, 22 nt, Human
ucagaggauugccucagcgagc

SEQ ID NO: 1118685 - RNA, 22 nt, Human
uuccgcuggggccgccuggcgg

SEQ ID NO: 1118686 - RNA, 22 nt, Human
agaugaaaagauaagcagcaau

SEQ ID NO: 1118687 - RNA, 22 nt, Human
acagcagccuuguugguuucga

SEQ ID NO: 1118688 - RNA, 20 nt, Human
cccugcagccaugggagugg

SEQ ID NO: 1118689 - RNA, 22 nt, Human
acugaaggaaagccuuugcaug

SEQ ID NO: 1118690 - RNA, 22 nt, Human
cagcucugggugacaggagggc

SEQ ID NO: 1118691 - RNA, 22 nt, Human
cucagcccagcccaggaccagg

SEQ ID NO: 1118692 - RNA, 22 nt, Human
gagggagagugauggaccauug

SEQ ID NO: 1118693 - RNA, 22 nt, Human
acagggcaaccucugggagacu

SEQ ID NO: 1118694 - RNA, 22 nt, Human
guacucucuugaaggccuuucu

SEQ ID NO: 1118695 - RNA, 18 nt, Human
gaaaugugauucuagggc

SEQ ID NO: 1118696 - RNA, 22 nt, Human
agagcuuauaucuuggccaucc

SEQ ID NO: 1118697 - RNA, 22 nt, Human
cugaagcaaaggaucgagcuaa

SEQ ID NO: 1118698 - RNA, 22 nt, Human
caguagcacucugucagugaag

SEQ ID NO: 1118699 - RNA, 22 nt, Human
ucagggcauacucuucaagguc

SEQ ID NO: 1118700 - RNA, 22 nt, Human
acagccugagaguggagcuggc

SEQ ID NO: 1118701 - RNA, 18 nt, Human
ucagagguacagaaaagu

SEQ ID NO: 1118702 - RNA, 22 nt, Human
ugauuucccuguagccucugaa

SEQ ID NO: 1118703 - RNA, 22 nt, Human
ugucaugcagguuuguuauaga

SEQ ID NO: 1118704 - RNA, 22 nt, Human
cagagugaaauaggggaucaag

SEQ ID NO: 1118705 - RNA, 21 nt, Human
acccuggguucuccauacccu

SEQ ID NO: 1118706 - RNA, 22 nt, Human
cuguggcuaugguguacauacu

SEQ ID NO: 1118707 - RNA, 22 nt, Human
uuggaaggugagucccuggguu

SEQ ID NO: 1118708 - RNA, 22 nt, Human
aguuuauagcccagauucaugg

SEQ ID NO: 1118709 - RNA, 22 nt, Human
uugaagcacaaugucuuuuauc

SEQ ID NO: 1118710 - RNA, 22 nt, Human
uaaaaguuuuaguuguacauaa

SEQ ID NO: 1118711 - RNA, 19 nt, Human
ucaaaugccaaugucacag

SEQ ID NO: 1118712 - RNA, 22 nt, Human
ggccucugguucguggugaccu

SEQ ID NO: 1118713 - RNA, 22 nt, Human
agauuuagugguggaauuuugg

SEQ ID NO: 1118714 - RNA, 22 nt, Human
acuuuauuuccuauugcaucca

SEQ ID NO: 1118715 - RNA, 20 nt, Human
gcagcugaaaguaugacacc

SEQ ID NO: 1118716 - RNA, 22 nt, Human
cucugagcuccuggaagcgugc

SEQ ID NO: 1118717 - RNA, 23 nt, Human
cucugcaggagagugggcagggc

SEQ ID NO: 1118718 - RNA, 22 nt, Human
cugaggaguuuggguuguucaa

SEQ ID NO: 1118719 - RNA, 22 nt, Human
gcagccaggaaagcuggacccu

SEQ ID NO: 1118720 - RNA, 22 nt, Human
cccaggaggcagagguugcagu

SEQ ID NO: 1118721 - RNA, 17 nt, Human
gagugcugguggagcuc

SEQ ID NO: 1118722 - RNA, 22 nt, Human
cccagcugcaccucuauggccu

SEQ ID NO: 1118723 - RNA, 19 nt, Human
agauggggaagagugugag

SEQ ID NO: 1118724 - RNA, 22 nt, Human
gcucugucaacagcuagcugug

SEQ ID NO: 1118725 - RNA, 22 nt, Human
cuacccaggcuggagugcagua

SEQ ID NO: 1118726 - RNA, 22 nt, Human
ugucagugaguuaguugcaagu

SEQ ID NO: 1118727 - RNA, 22 nt, Human
cucugcaggggaggcaugcacu

SEQ ID NO: 1118728 - RNA, 19 nt, Human
acagaagcauagaaaagga

SEQ ID NO: 1118729 - RNA, 22 nt, Human
gggcagaggggcgcuucccucu

SEQ ID NO: 1118730 - RNA, 22 nt, Human
cauugcacagcccuguggugau

SEQ ID NO: 1118731 - RNA, 23 nt, Human
ugucccagagggagggauaggcu

SEQ ID NO: 1118732 - RNA, 22 nt, Human
ugggcuguccagcaccugggcu

SEQ ID NO: 1118733 - RNA, 22 nt, Human
cagacuuucaaggagugaaggc

SEQ ID NO: 1118734 - RNA, 22 nt, Human
ggagagcugguagcuggcucca

SEQ ID NO: 1118735 - RNA, 22 nt, Human
aagauuuccuucaguagagcua

SEQ ID NO: 1118736 - RNA, 22 nt, Human
ggcuccuggggaggugagcuug

SEQ ID NO: 1118737 - RNA, 22 nt, Human
auccuugagaaaauaaaugacc

SEQ ID NO: 1118738 - RNA, 22 nt, Human
agagccuggaccugagcuacaa

SEQ ID NO: 1118739 - RNA, 22 nt, Human
aagaacagauucagccugaacu

SEQ ID NO: 1118740 - RNA, 22 nt, Human
ugcccuuggguaacuugcugau

SEQ ID NO: 1118741 - RNA, 22 nt, Human
aagcccaguuucacacugagac

SEQ ID NO: 1118742 - RNA, 22 nt, Human
uauguacaaucagcaguucaua

SEQ ID NO: 1118743 - RNA, 22 nt, Human
aguugaaauuagaguccuggcu

SEQ ID NO: 1118744 - RNA, 22 nt, Human
uggagcaggaagucuauggcug

SEQ ID NO: 1118745 - RNA, 22 nt, Human
cauguacacucauguaacuaua

SEQ ID NO: 1118746 - RNA, 22 nt, Human
ucucagggcgcagugaggcagu

SEQ ID NO: 1118747 - RNA, 22 nt, Human
gagcccuggcagucugggaugg

SEQ ID NO: 1118748 - RNA, 22 nt, Human
gcucugagucucagcuaccaca

SEQ ID NO: 1118749 - RNA, 22 nt, Human
gggagagagaaaacguggcgca

SEQ ID NO: 1118750 - RNA, 17 nt, Human
ccuuucucuuucaucuc

SEQ ID NO: 1118751 - RNA, 22 nt, Human
guauuuauaggggaaugagagu

SEQ ID NO: 1118752 - RNA, 22 nt, Human
cucuuuccucagccacagucua

SEQ ID NO: 1118753 - RNA, 22 nt, Human
ugcucccaggcucuguggucug

SEQ ID NO: 1118754 - RNA, 22 nt, Human
gagagcuguccggcugagcagc

SEQ ID NO: 1118755 - RNA, 22 nt, Human
agugaaauuccuggucuuuguu

SEQ ID NO: 1118756 - RNA, 22 nt, Human
gccagacacuccccugggcagg

SEQ ID NO: 1118757 - RNA, 22 nt, Human
ccugagcuggaagagcuugugc

SEQ ID NO: 1118758 - RNA, 22 nt, Human
uggggcugugagacuacaggau

SEQ ID NO: 1118759 - RNA, 22 nt, Human
uggcuggcccugggagugcaga

SEQ ID NO: 1118760 - RNA, 22 nt, Human
ugcucccaaacgaccuacugug

SEQ ID NO: 1118761 - RNA, 22 nt, Human
aggcuggcgacaucuggcgggc

SEQ ID NO: 1118762 - RNA, 22 nt, Human
uggagccagagcgcagccuggg

SEQ ID NO: 1118763 - RNA, 22 nt, Human
ugaaagguuaaaaguaguauug

SEQ ID NO: 1118764 - RNA, 19 nt, Human
ccugucugucuucagcuag

SEQ ID NO: 1118765 - RNA, 21 nt, Human
ggucagggggugccuccaggu

SEQ ID NO: 1118766 - RNA, 22 nt, Human
aggcacugggggaugagcaagg

SEQ ID NO: 1118767 - RNA, 22 nt, Human
cugagauggaguuuugcucuug

SEQ ID NO: 1118768 - RNA, 22 nt, Human
uacagggguaacaguggggaau

SEQ ID NO: 1118769 - RNA, 22 nt, Human
gccaggcucagcagucaaccug

SEQ ID NO: 1118770 - RNA, 22 nt, Human
aaucuuucccuauuaaaugugg

SEQ ID NO: 1118771 - RNA, 22 nt, Human
augauucagcaauuuuauaucu

SEQ ID NO: 1118772 - RNA, 22 nt, Human
aauuaacaaauguagcugugau

SEQ ID NO: 1118773 - RNA, 22 nt, Human
agccuggauucgugcauccaca

SEQ ID NO: 1118774 - RNA, 22 nt, Human
uugggguguuggauggagcaag

SEQ ID NO: 1118775 - RNA, 22 nt, Human
cugccuggguucaaguccuguu

SEQ ID NO: 1118776 - RNA, 22 nt, Human
agggggugcuacuuccagaguu

SEQ ID NO: 1118777 - RNA, 22 nt, Human
auggaaaggcuguggaaacuua

SEQ ID NO: 1118778 - RNA, 22 nt, Human
ucucccacagucucccauggcu

SEQ ID NO: 1118779 - RNA, 22 nt, Human
gcucagaggaugcuccuuuaug

SEQ ID NO: 1118780 - RNA, 22 nt, Human
cugagcccaggcgggagcugag

SEQ ID NO: 1118781 - RNA, 22 nt, Human
uucauguaauuccauaagguaa

SEQ ID NO: 1118782 - RNA, 22 nt, Human
cuuguagaauugaaauggucuc

SEQ ID NO: 1118783 - RNA, 22 nt, Human
aauaacaggcucaucagaugcu

SEQ ID NO: 1118784 - RNA, 22 nt, Human
ugaggcagcaauuguauuguau

SEQ ID NO: 1118785 - RNA, 19 nt, Human
acagggcagcaauaggaua

SEQ ID NO: 1118786 - RNA, 22 nt, Human
uaagaacaagauguuccuguuu

SEQ ID NO: 1118787 - RNA, 22 nt, Human
agcugcugagagucugccgggc

SEQ ID NO: 1118788 - RNA, 23 nt, Human
uccagcagccaagaaggguagaa

SEQ ID NO: 1118789 - RNA, 22 nt, Human
ucaagcaggguagcaagcuggu

SEQ ID NO: 1118790 - RNA, 22 nt, Human
uauugaguuacagaaaauacuu

SEQ ID NO: 1118791 - RNA, 22 nt, Human
agaacagaggccuuauguuuca

SEQ ID NO: 1118792 - RNA, 22 nt, Human
ggcuggaaaagacaaagcuauu

SEQ ID NO: 1118793 - RNA, 22 nt, Human
ugucucagaggcaggaagagcc

SEQ ID NO: 1118794 - RNA, 18 nt, Human
cagggccccagaauuauc

SEQ ID NO: 1118795 - RNA, 22 nt, Human
aggcaguggcugagaccagggg

SEQ ID NO: 1118796 - RNA, 22 nt, Human
ccagcuggcaggagagucaggg

SEQ ID NO: 1118797 - RNA, 22 nt, Human
ggcuccugaaagacuaugggaa

SEQ ID NO: 1118798 - RNA, 19 nt, Human
acagaaauuaguuauuuuc

SEQ ID NO: 1118799 - RNA, 22 nt, Human
cccagacugcagagcgggcaga

SEQ ID NO: 1118800 - RNA, 22 nt, Human
ggucacaggggagaagagugau

SEQ ID NO: 1118801 - RNA, 20 nt, Human
uguuccaugacuauuuggau

SEQ ID NO: 1118802 - RNA, 19 nt, Human
acaggcagaauugggugug

SEQ ID NO: 1118803 - RNA, 22 nt, Human
ggagccagugcccucuggugga

SEQ ID NO: 1118804 - RNA, 22 nt, Human
cucuguccacagguuugucccu

SEQ ID NO: 1118805 - RNA, 22 nt, Human
aggucaaggccaaaagaguggu

SEQ ID NO: 1118806 - RNA, 22 nt, Human
ccuggccucgugcucacggcuc

SEQ ID NO: 1118807 - RNA, 22 nt, Human
aggacccugagcgggcaugccg

SEQ ID NO: 1118808 - RNA, 22 nt, Human
gggcagugguuacacagcugag

SEQ ID NO: 1118809 - RNA, 22 nt, Human
guuugcauaucugugaaaugga

SEQ ID NO: 1118810 - RNA, 22 nt, Human
ccaggccucuggcugcuuaguc

SEQ ID NO: 1118811 - RNA, 22 nt, Human
ucaguuuucucaucuguaauuu

SEQ ID NO: 1118812 - RNA, 22 nt, Human
ccagcugcagguguuccagaug

SEQ ID NO: 1118813 - RNA, 22 nt, Human
ggcagugaaaaaguauguuucc

SEQ ID NO: 1118814 - RNA, 22 nt, Human
agugucugccaacugcaugguc

SEQ ID NO: 1118815 - RNA, 22 nt, Human
gaacagaauuaccgaagaucug

SEQ ID NO: 1118816 - RNA, 22 nt, Human
cuggggacuugcagacacaauu

SEQ ID NO: 1118817 - RNA, 22 nt, Human
gguggccugcccugaucccugg

SEQ ID NO: 1118818 - RNA, 22 nt, Human
gccugucaauuuuguguacaau

SEQ ID NO: 1118819 - RNA, 22 nt, Human
aggcucugcagaccccagcugu

SEQ ID NO: 1118820 - RNA, 22 nt, Human
cacugaagguaggaccaaggcu

SEQ ID NO: 1118821 - RNA, 22 nt, Human
cagugcauagauccugaggccu

SEQ ID NO: 1118822 - RNA, 22 nt, Human
ucucagaguuuacggggcugaa

SEQ ID NO: 1118823 - RNA, 17 nt, Human
uuccuggaagucauucc

SEQ ID NO: 1118824 - RNA, 22 nt, Human
ucugagcuuuuauuaucaaccu

SEQ ID NO: 1118825 - RNA, 22 nt, Human
gcugcucuugaggggcucacug

SEQ ID NO: 1118826 - RNA, 23 nt, Human
ucugcucugaaguucggcugagc

SEQ ID NO: 1118827 - RNA, 22 nt, Human
gugggcuggacccuccugcucc

SEQ ID NO: 1118828 - RNA, 22 nt, Human
aaaguuacuaucacaaugaaau

SEQ ID NO: 1118829 - RNA, 22 nt, Human
cagccaggagcucccccugcuc

SEQ ID NO: 1118830 - RNA, 22 nt, Human
gcucagagggaacaaggggcug

SEQ ID NO: 1118831 - RNA, 22 nt, Human
agccaggaaugcaugcucugcu

SEQ ID NO: 1118832 - RNA, 22 nt, Human
uccucugccaaagggaguugcc

SEQ ID NO: 1118833 - RNA, 22 nt, Human
gugcgccagcucaaggggaggc

SEQ ID NO: 1118834 - RNA, 22 nt, Human
uggcuucagacuucugcuacgu

SEQ ID NO: 1118835 - RNA, 22 nt, Human
ugcuucucccaaccagggccug

SEQ ID NO: 1118836 - RNA, 22 nt, Human
agucucagaaaauaugcuuuuu

SEQ ID NO: 1118837 - RNA, 22 nt, Human
cacagcagagggagccauugaa

SEQ ID NO: 1118838 - RNA, 22 nt, Human
uaccuugggcuauuaucuuuga

SEQ ID NO: 1118839 - RNA, 22 nt, Human
agccauugaauuuagugccuuu

SEQ ID NO: 1118840 - RNA, 22 nt, Human
aguguuucccaguaggaugaaa

SEQ ID NO: 1118841 - RNA, 22 nt, Human
gcucaagggaugggagugggug

SEQ ID NO: 1118842 - RNA, 22 nt, Human
auaaaaacugacccauccuuug

SEQ ID NO: 1118843 - RNA, 22 nt, Human
aaaugugucauauucaaaguca

SEQ ID NO: 1118844 - RNA, 22 nt, Human
uaugcauaugaccccaagcuug

SEQ ID NO: 1118845 - RNA, 22 nt, Human
gggcugccaagccugccugccu

SEQ ID NO: 1118846 - RNA, 22 nt, Human
uacauguaggugacauuuuaau

SEQ ID NO: 1118847 - RNA, 22 nt, Human
ugucccagucaaggcugucauc

SEQ ID NO: 1118848 - RNA, 22 nt, Human
ccugucagaugaaguaauugug

SEQ ID NO: 1118849 - RNA, 22 nt, Human
caucaguguggcaguucacugu

SEQ ID NO: 1118850 - RNA, 22 nt, Human
uccuuggcaugccgucuucucc

SEQ ID NO: 1118851 - RNA, 21 nt, Human
aaggcagaagcauggaaugag

SEQ ID NO: 1118852 - RNA, 22 nt, Human
ugucucagaauggcucauaaua

SEQ ID NO: 1118853 - RNA, 20 nt, Human
ccagguggugccuggagagg

SEQ ID NO: 1118854 - RNA, 22 nt, Human
cggggcugcgcucuuccugccg

SEQ ID NO: 1118855 - RNA, 22 nt, Human
uguguacacaaugauugcagag

SEQ ID NO: 1118856 - RNA, 22 nt, Human
ugcagcauugcaaagcagucuu

SEQ ID NO: 1118857 - RNA, 22 nt, Human
ccuguguggaaaccgcaugacg

SEQ ID NO: 1118858 - RNA, 22 nt, Human
agggaagagcuugcaagaaacc

SEQ ID NO: 1118859 - RNA, 22 nt, Human
cuggagcuccagggucuccucu

SEQ ID NO: 1118860 - RNA, 22 nt, Human
auuuuuccaugauacuuaucug

SEQ ID NO: 1118861 - RNA, 22 nt, Human
cagguggaucucuaaggacuga

SEQ ID NO: 1118862 - RNA, 22 nt, Human
uugaacauuaacuucagucuau

SEQ ID NO: 1118863 - RNA, 23 nt, Human
agcagccauagggaagcaauaca

SEQ ID NO: 1118864 - RNA, 21 nt, Human
gggcagaggggccuccugggu

SEQ ID NO: 1118865 - RNA, 22 nt, Human
gggaucagaaacauagcccuga

SEQ ID NO: 1118866 - RNA, 22 nt, Human
aaaagagguuaaccaggugugu

SEQ ID NO: 1118867 - RNA, 22 nt, Human
ccucagagccuccagaaggaau

SEQ ID NO: 1118868 - RNA, 22 nt, Human
ugaggggagaagcagcagccug

SEQ ID NO: 1118869 - RNA, 22 nt, Human
ucugaggcccugcaggcagugu

SEQ ID NO: 1118870 - RNA, 22 nt, Human
gagagugaggccugggaaucua

SEQ ID NO: 1118871 - RNA, 22 nt, Human
caggugaccuuuguccuaaguu

SEQ ID NO: 1118872 - RNA, 22 nt, Human
cccugcagccuugcaugccuuc

SEQ ID NO: 1118873 - RNA, 22 nt, Human
gcugcagcaagcccuccagggg

SEQ ID NO: 1118874 - RNA, 22 nt, Human
uuucaguguaagguuuccagga

SEQ ID NO: 1118875 - RNA, 22 nt, Human
cucccaggguagggagagacua

SEQ ID NO: 1118876 - RNA, 22 nt, Human
auaaacagcuccauuuagugcc

SEQ ID NO: 1118877 - RNA, 22 nt, Human
aggaagcucggagagggcaaau

SEQ ID NO: 1118878 - RNA, 19 nt, Human
ggcucucuuaaagcuguuu

SEQ ID NO: 1118879 - RNA, 22 nt, Human
aucagcaaucaaauugcagagu

SEQ ID NO: 1118880 - RNA, 22 nt, Human
agccccaguccgcugcgggcgg

SEQ ID NO: 1118881 - RNA, 23 nt, Human
aagcuuccuucacgucuccuggg

SEQ ID NO: 1118882 - RNA, 22 nt, Human
uagaaaucagguuuuuagaaag

SEQ ID NO: 1118883 - RNA, 22 nt, Human
aauuuggcagugucuugaagua

SEQ ID NO: 1118884 - RNA, 22 nt, Human
uugcagggcaggaccauggaca

SEQ ID NO: 1118885 - RNA, 22 nt, Human
guguguccucaguaguggcaug

SEQ ID NO: 1118886 - RNA, 22 nt, Human
gagguucacaggcuaucacagu

SEQ ID NO: 1118887 - RNA, 22 nt, Human
ugcuucaggagaugucaccaug

SEQ ID NO: 1118888 - RNA, 22 nt, Human
cagggcugguuugucgaagaaa

SEQ ID NO: 1118889 - RNA, 22 nt, Human
cggcuggggcuguccccaugac

SEQ ID NO: 1118890 - RNA, 20 nt, Human
ugccaugguaacagagugug

SEQ ID NO: 1118891 - RNA, 22 nt, Human
cagagcugacccaaggauugaa

SEQ ID NO: 1118892 - RNA, 22 nt, Human
gggauggggagcuggaaagggg

SEQ ID NO: 1118893 - RNA, 22 nt, Human
gccugagcaggcguggaccaug

SEQ ID NO: 1118894 - RNA, 22 nt, Human
agaggggcucauauccugucau

SEQ ID NO: 1118895 - RNA, 22 nt, Human
cugggagcccugacuagccugg

SEQ ID NO: 1118896 - RNA, 22 nt, Human
cccaggagguagagguugcagu

SEQ ID NO: 1118897 - RNA, 22 nt, Human
gcugucuccauagcuguguguc

SEQ ID NO: 1118898 - RNA, 22 nt, Human
agccucucugaugugacagcua

SEQ ID NO: 1118899 - RNA, 22 nt, Human
guuugcauuuauuagucuucug

SEQ ID NO: 1118900 - RNA, 22 nt, Human
cagagcucagagcagggcacuc

SEQ ID NO: 1118901 - RNA, 22 nt, Human
ucuggagcgaggucccugucug

SEQ ID NO: 1118902 - RNA, 22 nt, Human
uugucugugaaauggaaauagu

SEQ ID NO: 1118903 - RNA, 22 nt, Human
cccaggccccagggcuugucag

SEQ ID NO: 1118904 - RNA, 22 nt, Human
uuccauauguauauagcuguua

SEQ ID NO: 1118905 - RNA, 19 nt, Human
agccuggcuuugcucugcu

SEQ ID NO: 1118906 - RNA, 22 nt, Human
uggcucuggggacaguaagucc

SEQ ID NO: 1118907 - RNA, 22 nt, Human
agggcugcaucugccuggugaa

SEQ ID NO: 1118908 - RNA, 22 nt, Human
aagaggaagucuccauggagag

SEQ ID NO: 1118909 - RNA, 22 nt, Human
uccagccaugacucggacagug

SEQ ID NO: 1118910 - RNA, 22 nt, Human
acaauguaggauauguacuugu

SEQ ID NO: 1118911 - RNA, 22 nt, Human
acagaacugggaaaugcacaua

SEQ ID NO: 1118912 - RNA, 22 nt, Human
gugccagcaguuauggugauuu

SEQ ID NO: 1118913 - RNA, 22 nt, Human
augggggccugaacaggcaaaa

SEQ ID NO: 1118914 - RNA, 22 nt, Human
ggcagcucacugauuagcaauu

SEQ ID NO: 1118915 - RNA, 18 nt, Human
uggacaggguggagaaaa

SEQ ID NO: 1118916 - RNA, 22 nt, Human
uaggccagcccuuaguccuguc

SEQ ID NO: 1118917 - RNA, 22 nt, Human
ugaggugaagaguggagcucag

SEQ ID NO: 1118918 - RNA, 22 nt, Human
agguaaagacagugaaagaggg

SEQ ID NO: 1118919 - RNA, 22 nt, Human
ugaaggaaugagggaguggguc

SEQ ID NO: 1118920 - RNA, 22 nt, Human
ccuuggcccuagccucaggcaa

SEQ ID NO: 1118921 - RNA, 22 nt, Human
gccccuggcuggccagcuccuc

SEQ ID NO: 1118922 - RNA, 22 nt, Human
acagauauaugauuguguaaau

SEQ ID NO: 1118923 - RNA, 22 nt, Human
ucaguguaaguuauguagaugu

SEQ ID NO: 1118924 - RNA, 22 nt, Human
gcugucugucucugucccacca

SEQ ID NO: 1118925 - RNA, 21 nt, Human
cauuucuauugaugagaaaag

SEQ ID NO: 1118926 - RNA, 22 nt, Human
agggggcccuugcaggugagcg

SEQ ID NO: 1118927 - RNA, 22 nt, Human
cagagcagaaaccugggugauu

SEQ ID NO: 1118928 - RNA, 22 nt, Human
gggaaggagguggcuugaagug

SEQ ID NO: 1118929 - RNA, 22 nt, Human
aagcuggagaguuaggugaaua

SEQ ID NO: 1118930 - RNA, 22 nt, Human
aaugcugcucucauaauuauag

SEQ ID NO: 1118931 - RNA, 22 nt, Human
ggucccagaauugguuagcaca

SEQ ID NO: 1118932 - RNA, 22 nt, Human
ugcaugcagcuggugauaagaa

SEQ ID NO: 1118933 - RNA, 20 nt, Human
gagauuuccaaucaugccca

SEQ ID NO: 1118934 - RNA, 22 nt, Human
caucagcagucacaugaugcug

SEQ ID NO: 1118935 - RNA, 22 nt, Human
auguacauuuagaucauuucug

SEQ ID NO: 1118936 - RNA, 22 nt, Human
aauguguauaugaacauacagg

SEQ ID NO: 1118937 - RNA, 22 nt, Human
ggcucugcuucagaaggcucau

SEQ ID NO: 1118938 - RNA, 22 nt, Human
gcugagcuagcuaucucagucu

SEQ ID NO: 1118939 - RNA, 22 nt, Human
ggagccuguggcugcuugaagc

SEQ ID NO: 1118940 - RNA, 22 nt, Human
uuccucuccucccaccagguga

SEQ ID NO: 1118941 - RNA, 22 nt, Human
uuacuuuggauggucaagaaag

SEQ ID NO: 1118942 - RNA, 22 nt, Human
gcagggaggaagagaugcuucc

SEQ ID NO: 1118943 - RNA, 22 nt, Human
ugugggcucccccucacucugu

SEQ ID NO: 1118944 - RNA, 22 nt, Human
acuggcagccacaacuggcagg

SEQ ID NO: 1118945 - RNA, 22 nt, Human
guaacugaggcagcuuuuaaga

SEQ ID NO: 1118946 - RNA, 22 nt, Human
uaaguucauaagcuuauucuua

SEQ ID NO: 1118947 - RNA, 22 nt, Human
aaauaauuauagcgagucuauc

SEQ ID NO: 1118948 - RNA, 22 nt, Human
gcagcguggggacaggagcuca

SEQ ID NO: 1118949 - RNA, 22 nt, Human
cugcagggcagggccuccuggc

SEQ ID NO: 1118950 - RNA, 22 nt, Human
gcucaggauuucauccaugugu

SEQ ID NO: 1118951 - RNA, 22 nt, Human
ugggcaaguaucggacucugag

SEQ ID NO: 1118952 - RNA, 22 nt, Human
gagagcuggccagcuucaguau

SEQ ID NO: 1118953 - RNA, 22 nt, Human
cugagcugguggaagcaugcag

SEQ ID NO: 1118954 - RNA, 22 nt, Human
cgcuggccauagccuccugugu

SEQ ID NO: 1118955 - RNA, 22 nt, Human
aagaugauaggacuugcuuaag

SEQ ID NO: 1118956 - RNA, 20 nt, Human
gcugcucuccacggucugca

SEQ ID NO: 1118957 - RNA, 22 nt, Human
accucugcaacccuggaauggg

SEQ ID NO: 1118958 - RNA, 22 nt, Human
caugaagcauguuuugucauga

SEQ ID NO: 1118959 - RNA, 22 nt, Human
aggaggcugguucaggccauau

SEQ ID NO: 1118960 - RNA, 22 nt, Human
aggcccaguuauccuacuuguu

SEQ ID NO: 1118961 - RNA, 22 nt, Human
guucacauccuugugaggauuu

SEQ ID NO: 1118962 - RNA, 22 nt, Human
acagcuguggccacuugcaucc

SEQ ID NO: 1118963 - RNA, 22 nt, Human
caguagcacuagauaugugugg

SEQ ID NO: 1118964 - RNA, 20 nt, Human
cagcccuccaguggaggcag

SEQ ID NO: 1118965 - RNA, 22 nt, Human
aagaacagguucuagaaccauu

SEQ ID NO: 1118966 - RNA, 21 nt, Human
aguucauacugaguaacaaaa

SEQ ID NO: 1118967 - RNA, 22 nt, Human
gggaggugauggcaagcagcgg

SEQ ID NO: 1118968 - RNA, 21 nt, Human
gaggccacuaauaggggcaga

SEQ ID NO: 1118969 - RNA, 22 nt, Human
ucucucagucagaugcuaaaga

SEQ ID NO: 1118970 - RNA, 22 nt, Human
aggggugauuugggacaggaca

SEQ ID NO: 1118971 - RNA, 22 nt, Human
uuggcucaggaccccugugacu

SEQ ID NO: 1118972 - RNA, 22 nt, Human
cugucuccagggcaggugcagg

SEQ ID NO: 1118973 - RNA, 22 nt, Human
cugcccuguggcucugagucau

SEQ ID NO: 1118974 - RNA, 22 nt, Human
gcagccacuaguuuuccuguuu

SEQ ID NO: 1118975 - RNA, 22 nt, Human
ccacacagggggaugaguuauu

SEQ ID NO: 1118976 - RNA, 22 nt, Human
agggcuggagccacagcuggga

SEQ ID NO: 1118977 - RNA, 22 nt, Human
gcugaagcccacguggcuugua

SEQ ID NO: 1118978 - RNA, 22 nt, Human
gggcagccucggugccugcugc

SEQ ID NO: 1118979 - RNA, 22 nt, Human
cagcaggggaacugugggccag

SEQ ID NO: 1118980 - RNA, 22 nt, Human
uggcagaggaggcucagauuga

SEQ ID NO: 1118981 - RNA, 22 nt, Human
agcuggcccucgagagccaauu

SEQ ID NO: 1118982 - RNA, 22 nt, Human
gggccugggaacuugcauuuag

SEQ ID NO: 1118983 - RNA, 22 nt, Human
agggagagguugaaaccucagu

SEQ ID NO: 1118984 - RNA, 22 nt, Human
cugccuguuagucuagcaguua

SEQ ID NO: 1118985 - RNA, 22 nt, Human
uucuuucagaacacaagugauu

SEQ ID NO: 1118986 - RNA, 21 nt, Human
aauaaaacaguuggugucaau

SEQ ID NO: 1118987 - RNA, 22 nt, Human
aaaugcagcagcuaauugaaaa

SEQ ID NO: 1118988 - RNA, 17 nt, Human
agguggcugcugcgccu

SEQ ID NO: 1118989 - RNA, 22 nt, Human
agucucugcacaguaagaagca

SEQ ID NO: 1118990 - RNA, 18 nt, Human
gggaucaggcugccuagg

SEQ ID NO: 1118991 - RNA, 22 nt, Human
auacagaagaacuauagccacu

SEQ ID NO: 1118992 - RNA, 22 nt, Human
cucugagagagcuggugagcac

SEQ ID NO: 1118993 - RNA, 22 nt, Human
uaagacauuugaaaugugaucc

SEQ ID NO: 1118994 - RNA, 22 nt, Human
agcccagaggcugggcgugcau

SEQ ID NO: 1118995 - RNA, 22 nt, Human
cugcucugagaggcucuuccua

SEQ ID NO: 1118996 - RNA, 22 nt, Human
guugggaaggcaagaaguagaa

SEQ ID NO: 1118997 - RNA, 22 nt, Human
cagugucuccagaugcuccaau

SEQ ID NO: 1118998 - RNA, 22 nt, Human
aaaaguuuaagacucauucuag

SEQ ID NO: 1118999 - RNA, 22 nt, Human
gcugagagcaaagcaugucuag

SEQ ID NO: 1119000 - RNA, 22 nt, Human
cuggcucaguucuugguuuuca

SEQ ID NO: 1119001 - RNA, 22 nt, Human
gucucagggacugcuucugggg

SEQ ID NO: 1119002 - RNA, 22 nt, Human
cauguacauucuguagauggag

SEQ ID NO: 1119003 - RNA, 22 nt, Human
aggcugucaucuuugcaggcag

SEQ ID NO: 1119004 - RNA, 22 nt, Human
ugcugccaccugguggcugaag

SEQ ID NO: 1119005 - RNA, 22 nt, Human
caggaguggugugagggacucc

SEQ ID NO: 1119006 - RNA, 22 nt, Human
ccugcagcuccggauuucuggg

SEQ ID NO: 1119007 - RNA, 22 nt, Human
cuagaaaugcucaagagaaagu

SEQ ID NO: 1119008 - RNA, 22 nt, Human
acaauucuggguauuuauauag

SEQ ID NO: 1119009 - RNA, 22 nt, Human
agggcagcagcccauggcucug

SEQ ID NO: 1119010 - RNA, 22 nt, Human
augcaguggcagcuccuggugu

SEQ ID NO: 1119011 - RNA, 22 nt, Human
cacaguggcagguguggguugu

SEQ ID NO: 1119012 - RNA, 22 nt, Human
ggcagauggagaagcagcaggu

SEQ ID NO: 1119013 - RNA, 22 nt, Human
uggggcuggcacagucucuauu

SEQ ID NO: 1119014 - RNA, 22 nt, Human
acuuccugcuaugagcuucugu

SEQ ID NO: 1119015 - RNA, 22 nt, Human
uucaagaugucuucacaauagu

SEQ ID NO: 1119016 - RNA, 22 nt, Human
ugucauuuaguccucugugugu

SEQ ID NO: 1119017 - RNA, 22 nt, Human
uauguacauaacaugaaaugca

SEQ ID NO: 1119018 - RNA, 22 nt, Human
cugcagugaaaucaggaagcaa

SEQ ID NO: 1119019 - RNA, 22 nt, Human
agcucacagaaauccugcagga

SEQ ID NO: 1119020 - RNA, 22 nt, Human
agccacgucccugucaggguca

SEQ ID NO: 1119021 - RNA, 22 nt, Human
ggcccagcacagugcuuggggg

SEQ ID NO: 1119022 - RNA, 22 nt, Human
gucucccaaccccugugcccag

SEQ ID NO: 1119023 - RNA, 22 nt, Human
ggauaagaaaauuguaauaacu

SEQ ID NO: 1119024 - RNA, 19 nt, Human
aagggcugggcaccucacu

SEQ ID NO: 1119025 - RNA, 22 nt, Human
gagagaagaauguuccgaggcc

SEQ ID NO: 1119026 - RNA, 22 nt, Human
augaaauaucuugaagaaauuc

SEQ ID NO: 1119027 - RNA, 22 nt, Human
cagcccaggccgacaguuccuc

SEQ ID NO: 1119028 - RNA, 22 nt, Human
ccuggugcuuaccagagcuuuu

SEQ ID NO: 1119029 - RNA, 22 nt, Human
ucuccuucgaggcccagcuccc

SEQ ID NO: 1119030 - RNA, 22 nt, Human
cccccagccagcagugcucagc

SEQ ID NO: 1119031 - RNA, 21 nt, Human
gcacagugccaggcacacagu

SEQ ID NO: 1119032 - RNA, 22 nt, Human
acuaaggaauaugacaaacuca

SEQ ID NO: 1119033 - RNA, 22 nt, Human
caaggaaacaugaaaugcauug

SEQ ID NO: 1119034 - RNA, 22 nt, Human
uccagggaugguaaugagcagu

SEQ ID NO: 1119035 - RNA, 22 nt, Human
cauggggagacaccuagggaaa

SEQ ID NO: 1119036 - RNA, 22 nt, Human
uucccaggcugugcuaccagag

SEQ ID NO: 1119037 - RNA, 22 nt, Human
gcacccagcccagggcgugaug

SEQ ID NO: 1119038 - RNA, 22 nt, Human
gagaggccaccugacgagcagu

SEQ ID NO: 1119039 - RNA, 22 nt, Human
aaggagaaaugguagaugugca

SEQ ID NO: 1119040 - RNA, 22 nt, Human
ugggccuggaguuuguccagag

SEQ ID NO: 1119041 - RNA, 23 nt, Human
uuacaguaggaguuggaaaacca

SEQ ID NO: 1119042 - RNA, 22 nt, Human
uacaguaaccagucuacuuaga

SEQ ID NO: 1119043 - RNA, 22 nt, Human
auaacagauacucucugugagg

SEQ ID NO: 1119044 - RNA, 22 nt, Human
augucuuuggcuuugacauggc

SEQ ID NO: 1119045 - RNA, 22 nt, Human
ccugccugaaggucagccaccc

SEQ ID NO: 1119046 - RNA, 22 nt, Human
guugaguggguuaggaugcuga

SEQ ID NO: 1119047 - RNA, 23 nt, Human
gcccaugcuguugggcccgagca

SEQ ID NO: 1119048 - RNA, 22 nt, Human
uuugcauuccugccugcauuca

SEQ ID NO: 1119049 - RNA, 22 nt, Human
agauggguaacuggagucugcu

SEQ ID NO: 1119050 - RNA, 22 nt, Human
aagugacaaaaggguauccaaa

SEQ ID NO: 1119051 - RNA, 22 nt, Human
ggcccugggaugcucagcagug

SEQ ID NO: 1119052 - RNA, 22 nt, Human
ucccagccuuccuuguggugaa

SEQ ID NO: 1119053 - RNA, 22 nt, Human
cggcuggguucggcugcaggcc

SEQ ID NO: 1119054 - RNA, 22 nt, Human
gaugggggccagggccugcuuu

SEQ ID NO: 1119055 - RNA, 22 nt, Human
cagcugaacauguagagcaucu

SEQ ID NO: 1119056 - RNA, 22 nt, Human
ccagggcacuuaggcccagccc

SEQ ID NO: 1119057 - RNA, 22 nt, Human
ugggcaagucacuucugucuuu

SEQ ID NO: 1119058 - RNA, 22 nt, Human
gcguaaggccucuggucucgga

SEQ ID NO: 1119059 - RNA, 22 nt, Human
cuggcagcaguuaugaaacaau

SEQ ID NO: 1119060 - RNA, 22 nt, Human
cuguccuugcuggccagguaug

SEQ ID NO: 1119061 - RNA, 22 nt, Human
auucauucugaccucaagagaa

SEQ ID NO: 1119062 - RNA, 22 nt, Human
gaaaucugucuuuguuugaaua

SEQ ID NO: 1119063 - RNA, 22 nt, Human
gguggggucacgacagagggaa

SEQ ID NO: 1119064 - RNA, 22 nt, Human
gggcugggcaugguguucccuc

SEQ ID NO: 1119065 - RNA, 22 nt, Human
gcccucugcuggccucaccucg

SEQ ID NO: 1119066 - RNA, 22 nt, Human
ccagggcaggggcuggaguuca

SEQ ID NO: 1119067 - RNA, 22 nt, Human
uggcagcaguggagguagaaag

SEQ ID NO: 1119068 - RNA, 22 nt, Human
cacugaaggacaguaggaaggg

SEQ ID NO: 1119069 - RNA, 22 nt, Human
gcuggccagggcugcucgcgga

SEQ ID NO: 1119070 - RNA, 22 nt, Human
ucagaggagaaguugggaaaau

SEQ ID NO: 1119071 - RNA, 22 nt, Human
auaauaaaccaggaugggucug

SEQ ID NO: 1119072 - RNA, 22 nt, Human
uuaaaguucauuaaaugagcca

SEQ ID NO: 1119073 - RNA, 22 nt, Human
gguccuggaaauugacggaaag

SEQ ID NO: 1119074 - RNA, 22 nt, Human
uggcccugcugggucagagcug

SEQ ID NO: 1119075 - RNA, 22 nt, Human
gagcugcuucugugugccgggu

SEQ ID NO: 1119076 - RNA, 22 nt, Human
aagcagaauuucccacuaguug

SEQ ID NO: 1119077 - RNA, 22 nt, Human
gagauggggucagcugggacau

SEQ ID NO: 1119078 - RNA, 21 nt, Human
agcagaacagucgagcacugc

SEQ ID NO: 1119079 - RNA, 20 nt, Human
gugcuucagaagccauugcu

SEQ ID NO: 1119080 - RNA, 22 nt, Human
ucuuuccuaggugauaugcaau

SEQ ID NO: 1119081 - RNA, 22 nt, Human
cuggggcuggugaggcaggcuc

SEQ ID NO: 1119082 - RNA, 22 nt, Human
uuccaaaggaauggggagcuau

SEQ ID NO: 1119083 - RNA, 22 nt, Human
ugucccaggccucauguugcca

SEQ ID NO: 1119084 - RNA, 22 nt, Human
cagagguauugcaaaagccuag

SEQ ID NO: 1119085 - RNA, 18 nt, Human
ugggcugccuggccucug

SEQ ID NO: 1119086 - RNA, 22 nt, Human
aagcaaagaguuuaguggguga

SEQ ID NO: 1119087 - RNA, 22 nt, Human
gccagggaacccaagggccuca

SEQ ID NO: 1119088 - RNA, 22 nt, Human
gagaaacuuggaguuauucugg

SEQ ID NO: 1119089 - RNA, 22 nt, Human
uguauuuugugaggaucacucu

SEQ ID NO: 1119090 - RNA, 22 nt, Human
caugucuggguauaugcauaug

SEQ ID NO: 1119091 - RNA, 22 nt, Human
acagcuuuucaauucugcugag

SEQ ID NO: 1119092 - RNA, 22 nt, Human
uggaaggggagcuggaaagggg

SEQ ID NO: 1119093 - RNA, 22 nt, Human
uggguaaacugggucuggagag

SEQ ID NO: 1119094 - RNA, 22 nt, Human
gaagcccuauccucuccuggga

SEQ ID NO: 1119095 - RNA, 22 nt, Human
agucccaggcagccgagccggu

SEQ ID NO: 1119096 - RNA, 22 nt, Human
ccucagccuuggccccaggcag

SEQ ID NO: 1119097 - RNA, 22 nt, Human
uguacacugcaggaugcauugc

SEQ ID NO: 1119098 - RNA, 22 nt, Human
ucucaggccccugaguuucucu

SEQ ID NO: 1119099 - RNA, 22 nt, Human
gccaggugcauggcugagucuc

SEQ ID NO: 1119100 - RNA, 22 nt, Human
gcuggaccaggugugcacaggc

SEQ ID NO: 1119101 - RNA, 22 nt, Human
uaagaauuguguugaauagagu

SEQ ID NO: 1119102 - RNA, 22 nt, Human
caggccucuccuuagucuggca

SEQ ID NO: 1119103 - RNA, 22 nt, Human
gcugcagcucgccuuccggccu

SEQ ID NO: 1119104 - RNA, 22 nt, Human
gugcagggcuggcaccggaggc

SEQ ID NO: 1119105 - RNA, 22 nt, Human
cagcauggugccagugagucca

SEQ ID NO: 1119106 - RNA, 22 nt, Human
ucaggccacggcucacugagac

SEQ ID NO: 1119107 - RNA, 22 nt, Human
auaaaacuuauuagaauugugu

SEQ ID NO: 1119108 - RNA, 22 nt, Human
aggcaaaauuacaaaguuauua

SEQ ID NO: 1119109 - RNA, 22 nt, Human
cugcagagguugguucuaagau

SEQ ID NO: 1119110 - RNA, 20 nt, Human
ugucauuguuucuaggaccu

SEQ ID NO: 1119111 - RNA, 22 nt, Human
aagacuuucucccaaauccuca

SEQ ID NO: 1119112 - RNA, 22 nt, Human
uuugcauuuauaaguuggugga

SEQ ID NO: 1119113 - RNA, 22 nt, Human
cugggguggauggguccaaguu

SEQ ID NO: 1119114 - RNA, 22 nt, Human
ucuccuuugaaaguuaggacug

SEQ ID NO: 1119115 - RNA, 18 nt, Human
cagcugccagcucaugga

SEQ ID NO: 1119116 - RNA, 22 nt, Human
auuucuucaggucagaaauaga

SEQ ID NO: 1119117 - RNA, 20 nt, Human
agacccuguguccuguggcc

SEQ ID NO: 1119118 - RNA, 22 nt, Human
uuaacagacauauauauuugua

SEQ ID NO: 1119119 - RNA, 22 nt, Human
uguggcuguguccaccugcugc

SEQ ID NO: 1119120 - RNA, 22 nt, Human
augcaagauguauagaagacuu

SEQ ID NO: 1119121 - RNA, 22 nt, Human
guacaaaguggaccugauagua

SEQ ID NO: 1119122 - RNA, 22 nt, Human
gggcuggaucuccugcaggcag

SEQ ID NO: 1119123 - RNA, 22 nt, Human
ugucccagggaaggcccagcac

SEQ ID NO: 1119124 - RNA, 22 nt, Human
uaaggcacgcauaagagggggc

SEQ ID NO: 1119125 - RNA, 22 nt, Human
cugcaggcucgaagacacggau

SEQ ID NO: 1119126 - RNA, 22 nt, Human
cuggcagcugcccgagaugccc

SEQ ID NO: 1119127 - RNA, 22 nt, Human
uggcagcuacagacagagguga

SEQ ID NO: 1119128 - RNA, 22 nt, Human
ucagagugaggcccagcaaucu

SEQ ID NO: 1119129 - RNA, 22 nt, Human
caggggaagaugccaagggaga

SEQ ID NO: 1119130 - RNA, 22 nt, Human
cugaaggaagcagguggccugu

SEQ ID NO: 1119131 - RNA, 22 nt, Human
ggagccuggccuggcucugugu

SEQ ID NO: 1119132 - RNA, 22 nt, Human
cucuggaguucucaugaggaac

SEQ ID NO: 1119133 - RNA, 21 nt, Human
guguuuccuguuuauggcuug

SEQ ID NO: 1119134 - RNA, 22 nt, Human
uggccugucuuguugugcuaga

SEQ ID NO: 1119135 - RNA, 22 nt, Human
gcaagauguuaacauagggaga

SEQ ID NO: 1119136 - RNA, 22 nt, Human
uuuccucuuuguaccuugacua

SEQ ID NO: 1119137 - RNA, 22 nt, Human
cauuuagagucuugcaauuuua

SEQ ID NO: 1119138 - RNA, 21 nt, Human
ugcauaaagaaauacaaauac

SEQ ID NO: 1119139 - RNA, 22 nt, Human
gaaacuguauguaguuuuuggg

SEQ ID NO: 1119140 - RNA, 22 nt, Human
aaugcaguuucauuuguagaau

SEQ ID NO: 1119141 - RNA, 22 nt, Human
cgcugccaggauccccugccgg

SEQ ID NO: 1119142 - RNA, 22 nt, Human
cugggcugcaguuccugguccu

SEQ ID NO: 1119143 - RNA, 22 nt, Human
ggcagucagugugguucauaaa

SEQ ID NO: 1119144 - RNA, 17 nt, Human
ccagguggaaucgugga

SEQ ID NO: 1119145 - RNA, 22 nt, Human
cagagacagggcagggagugug

SEQ ID NO: 1119146 - RNA, 22 nt, Human
agcacagauucugaagaguccu

SEQ ID NO: 1119147 - RNA, 22 nt, Human
agccuggauccauguggcuacc

SEQ ID NO: 1119148 - RNA, 22 nt, Human
cccucugaccuccugccacagu

SEQ ID NO: 1119149 - RNA, 22 nt, Human
gggagcuguaguccagauaccg

SEQ ID NO: 1119150 - RNA, 22 nt, Human
cugugcugauucagcacaggcc

SEQ ID NO: 1119151 - RNA, 22 nt, Human
gcuuccuucuaccacaucaugc

SEQ ID NO: 1119152 - RNA, 22 nt, Human
ccagggcagccaacccagaugc

SEQ ID NO: 1119153 - RNA, 22 nt, Human
cagagccaaaccucagggcccg

SEQ ID NO: 1119154 - RNA, 22 nt, Human
gcuguccugggaacaggcacua

SEQ ID NO: 1119155 - RNA, 22 nt, Human
ucauuacagagauauaaucuac

SEQ ID NO: 1119156 - RNA, 22 nt, Human
uuguccuuggaugaagcuggga

SEQ ID NO: 1119157 - RNA, 22 nt, Human
aaaguguugauaugugacaucc

SEQ ID NO: 1119158 - RNA, 22 nt, Human
agaugagggguagaaaggacuu

SEQ ID NO: 1119159 - RNA, 19 nt, Human
ugccugucaguagaucuca

SEQ ID NO: 1119160 - RNA, 22 nt, Human
ggcagcagggcugucucccuac

SEQ ID NO: 1119161 - RNA, 20 nt, Human
acauguacuaaugaauacag

SEQ ID NO: 1119162 - RNA, 22 nt, Human
ugggccugauucuugaauccug

SEQ ID NO: 1119163 - RNA, 22 nt, Human
gagcacagaaucuucccaugca

SEQ ID NO: 1119164 - RNA, 22 nt, Human
uccucaggaucuaggagugcuu

SEQ ID NO: 1119165 - RNA, 22 nt, Human
gccuggugguauccuggcaaga

SEQ ID NO: 1119166 - RNA, 22 nt, Human
uuuaaauaggacuccugggggu

SEQ ID NO: 1119167 - RNA, 22 nt, Human
agucauaauuauaaacaucagu

SEQ ID NO: 1119168 - RNA, 22 nt, Human
uugcauugugauuacagaggug

SEQ ID NO: 1119169 - RNA, 22 nt, Human
uguauuagaucugagaacuucu

SEQ ID NO: 1119170 - RNA, 23 nt, Human
uggcucucucagugcugcagagg

SEQ ID NO: 1119171 - RNA, 22 nt, Human
aacagaaaucauuuagggcucu

SEQ ID NO: 1119172 - RNA, 22 nt, Human
gauggggaugagaagugagcag

SEQ ID NO: 1119173 - RNA, 22 nt, Human
aggggcugccuggcuuggcacu

SEQ ID NO: 1119174 - RNA, 22 nt, Human
agaucaaagccaugagagauuu

SEQ ID NO: 1119175 - RNA, 22 nt, Human
cagcucugcugggaggaugcag

SEQ ID NO: 1119176 - RNA, 22 nt, Human
aggagaguaccauugggccgca

SEQ ID NO: 1119177 - RNA, 22 nt, Human
cucuggagguggagguugcagu

SEQ ID NO: 1119178 - RNA, 22 nt, Human
auccaguuuaugucauauucuu

SEQ ID NO: 1119179 - RNA, 22 nt, Human
gagcagggccacuucuguaccu

SEQ ID NO: 1119180 - RNA, 22 nt, Human
ccaaggagcaaguuuacaccug

SEQ ID NO: 1119181 - RNA, 22 nt, Human
cagcuccccaugguuccugaag

SEQ ID NO: 1119182 - RNA, 19 nt, Human
ccauggcaaugaucugaug

SEQ ID NO: 1119183 - RNA, 22 nt, Human
agugggcaugaucuggugucug

SEQ ID NO: 1119184 - RNA, 22 nt, Human
ugcucccagggacucuggcugg

SEQ ID NO: 1119185 - RNA, 22 nt, Human
accagcucagaagccagaaaga

SEQ ID NO: 1119186 - RNA, 22 nt, Human
ugccucagucuaaagucucuca

SEQ ID NO: 1119187 - RNA, 22 nt, Human
uaaaauguuugcaagagaccag

SEQ ID NO: 1119188 - RNA, 22 nt, Human
agggcccaggacagcaucaggg

SEQ ID NO: 1119189 - RNA, 22 nt, Human
uuuauuccaugugucuaugacc

SEQ ID NO: 1119190 - RNA, 22 nt, Human
cagaauuuuucgaauguacugu

SEQ ID NO: 1119191 - RNA, 22 nt, Human
uaaauguguuagucaugguuuu

SEQ ID NO: 1119192 - RNA, 22 nt, Human
ggagcagagcucuucaucugca

SEQ ID NO: 1119193 - RNA, 22 nt, Human
ucugaggcuaagagacagaggc

SEQ ID NO: 1119194 - RNA, 22 nt, Human
gaggggcugcccuggugucagg

SEQ ID NO: 1119195 - RNA, 22 nt, Human
gcugcugcgcuugucuacuguu

SEQ ID NO: 1119196 - RNA, 22 nt, Human
auaguggugagcugcauuuaug

SEQ ID NO: 1119197 - RNA, 22 nt, Human
cugaaggauucaaaauggcagg

SEQ ID NO: 1119198 - RNA, 22 nt, Human
aggaaaaauaaggcagcagggc

SEQ ID NO: 1119199 - RNA, 16 nt, Human
cagaguguaaacagga

SEQ ID NO: 1119200 - RNA, 22 nt, Human
uuaauaaaguaugaauuggaaa

SEQ ID NO: 1119201 - RNA, 22 nt, Human
uuugacagcuuguuacaaaguu

SEQ ID NO: 1119202 - RNA, 22 nt, Human
uaauuuaauccaaguguuacau

SEQ ID NO: 1119203 - RNA, 22 nt, Human
acuuggagagcauugcugggga

SEQ ID NO: 1119204 - RNA, 22 nt, Human
ggccccacgggggaguccuagu

SEQ ID NO: 1119205 - RNA, 22 nt, Human
ggcccuguuagagcucccacaa

SEQ ID NO: 1119206 - RNA, 22 nt, Human
gggcacuguggggcccaugcug

SEQ ID NO: 1119207 - RNA, 23 nt, Human
ugagcccaggaggucaaggcugc

SEQ ID NO: 1119208 - RNA, 22 nt, Human
agggcuggcuccguuaccuuga

SEQ ID NO: 1119209 - RNA, 22 nt, Human
guggccugggguuuguucugag

SEQ ID NO: 1119210 - RNA, 22 nt, Human
cauucugugauucuaaaucccu

SEQ ID NO: 1119211 - RNA, 22 nt, Human
aauguguguucggggcccagag

SEQ ID NO: 1119212 - RNA, 22 nt, Human
ggggagugacgcagggccauag

SEQ ID NO: 1119213 - RNA, 22 nt, Human
guggcagcugguaugcagacag

SEQ ID NO: 1119214 - RNA, 22 nt, Human
cuucaagaagacagcagagcau

SEQ ID NO: 1119215 - RNA, 18 nt, Human
uccugccugugccccagg

SEQ ID NO: 1119216 - RNA, 22 nt, Human
ccuggcagguggcgcccucggc

SEQ ID NO: 1119217 - RNA, 22 nt, Human
ucagagcuuaucucuugcugga

SEQ ID NO: 1119218 - RNA, 22 nt, Human
cauugcacaucugagaagagau

SEQ ID NO: 1119219 - RNA, 22 nt, Human
cagccuucugaaugaacguacu

SEQ ID NO: 1119220 - RNA, 22 nt, Human
agcaggcuuguuaugucugaga

SEQ ID NO: 1119221 - RNA, 22 nt, Human
agugcauugcaucucugcuuca

SEQ ID NO: 1119222 - RNA, 19 nt, Human
cuguggcugaccucuggcc

SEQ ID NO: 1119223 - RNA, 22 nt, Human
aggggcuggcuuaucugagagu

SEQ ID NO: 1119224 - RNA, 22 nt, Human
gugacucacacaggccugggcu

SEQ ID NO: 1119225 - RNA, 22 nt, Human
gcugauccuuuuaugucuagcu

SEQ ID NO: 1119226 - RNA, 22 nt, Human
ugggacagugugccuugcuccu

SEQ ID NO: 1119227 - RNA, 22 nt, Human
cuugaaagauuuggccucugug

SEQ ID NO: 1119228 - RNA, 22 nt, Human
ugaaagcacucacuucugcucu

SEQ ID NO: 1119229 - RNA, 22 nt, Human
ucaguaacuuacuuauucaccu

SEQ ID NO: 1119230 - RNA, 20 nt, Human
cacagcuugccuuuuaugac

SEQ ID NO: 1119231 - RNA, 22 nt, Human
caagagcugaggcuggagaggu

SEQ ID NO: 1119232 - RNA, 22 nt, Human
ccugggcaaaugccagagacaa

SEQ ID NO: 1119233 - RNA, 22 nt, Human
ccagggugugagaaggaaguag

SEQ ID NO: 1119234 - RNA, 22 nt, Human
uagaauaugugguaggaucugg

SEQ ID NO: 1119235 - RNA, 22 nt, Human
agggcagacuaggauggaagug

SEQ ID NO: 1119236 - RNA, 22 nt, Human
aggucagaagugccagggaauu

SEQ ID NO: 1119237 - RNA, 20 nt, Human
ccugggcuccaggagccccg

SEQ ID NO: 1119238 - RNA, 22 nt, Human
auuuaaaugcuuaagaggguuu

SEQ ID NO: 1119239 - RNA, 22 nt, Human
aagcugccacacggugaguacu

SEQ ID NO: 1119240 - RNA, 22 nt, Human
ggcucccugccuguccucaguc

SEQ ID NO: 1119241 - RNA, 22 nt, Human
ugccagcaguagcaguaggcca

SEQ ID NO: 1119242 - RNA, 22 nt, Human
ucagaggucacacagcaaguuu

SEQ ID NO: 1119243 - RNA, 22 nt, Human
cuggaggcugaguugggucucc

SEQ ID NO: 1119244 - RNA, 22 nt, Human
acacagggcagagagcuggcuc

SEQ ID NO: 1119245 - RNA, 17 nt, Human
ggccuguguggcugcag

SEQ ID NO: 1119246 - RNA, 22 nt, Human
uccaggcuggacaugaggcggg

SEQ ID NO: 1119247 - RNA, 22 nt, Human
ggcugcugguggaaugguaggc

SEQ ID NO: 1119248 - RNA, 22 nt, Human
caucacuguccaaaguucaguu

SEQ ID NO: 1119249 - RNA, 21 nt, Human
cuguuucuugugaagugacac

SEQ ID NO: 1119250 - RNA, 23 nt, Human
cccagcgcugagcccugcaggca

SEQ ID NO: 1119251 - RNA, 22 nt, Human
aaguuauaucaucucauugacg

SEQ ID NO: 1119252 - RNA, 22 nt, Human
gcugagguggagauugcaguga

SEQ ID NO: 1119253 - RNA, 22 nt, Human
uucauguauuuaucauguaaau

SEQ ID NO: 1119254 - RNA, 22 nt, Human
acauuucuuuucaucucuauau

SEQ ID NO: 1119255 - RNA, 22 nt, Human
caucaaauggcaagugaaagcu

SEQ ID NO: 1119256 - RNA, 22 nt, Human
uggcccugcuggccaaaggcua

SEQ ID NO: 1119257 - RNA, 22 nt, Human
cucuuccuacagucugcuaugc

SEQ ID NO: 1119258 - RNA, 22 nt, Human
ugggccugaguuugggaacugg

SEQ ID NO: 1119259 - RNA, 22 nt, Human
ugucacauaggcaaaauguuuu

SEQ ID NO: 1119260 - RNA, 22 nt, Human
cagggcaggaugcugugauuau

SEQ ID NO: 1119261 - RNA, 22 nt, Human
gugucccaggccucuggaauua

SEQ ID NO: 1119262 - RNA, 22 nt, Human
auggacagugugucuguuucca

SEQ ID NO: 1119263 - RNA, 21 nt, Human
uccucugcucucauaccacaa

SEQ ID NO: 1119264 - RNA, 22 nt, Human
ggcugcuucucacucauuugca

SEQ ID NO: 1119265 - RNA, 22 nt, Human
ugggcugcacccucagccucug

SEQ ID NO: 1119266 - RNA, 22 nt, Human
gcugggcaccggagagacccca

SEQ ID NO: 1119267 - RNA, 22 nt, Human
caggaacagcaccaggagcuag

SEQ ID NO: 1119268 - RNA, 22 nt, Human
aucauuccacauguaccacuag

SEQ ID NO: 1119269 - RNA, 22 nt, Human
ugcuuccuucccguucuucucc

SEQ ID NO: 1119270 - RNA, 22 nt, Human
aaucaguuguucacucugaaaa

SEQ ID NO: 1119271 - RNA, 22 nt, Human
ccuggcagcgccgaagcuggcc

SEQ ID NO: 1119272 - RNA, 22 nt, Human
gcuaggagauugagcucugaag

SEQ ID NO: 1119273 - RNA, 22 nt, Human
cccccaaggccaggcugagacc

SEQ ID NO: 1119274 - RNA, 22 nt, Human
ugucauugaggaaaacuaggug

SEQ ID NO: 1119275 - RNA, 20 nt, Human
gagauggcuaagugcugaac

SEQ ID NO: 1119276 - RNA, 22 nt, Human
uccuggagccacggagcuuuca

SEQ ID NO: 1119277 - RNA, 22 nt, Human
uucacauuagugguucuauaua

SEQ ID NO: 1119278 - RNA, 22 nt, Human
agggcugcccagugugagagcu

SEQ ID NO: 1119279 - RNA, 22 nt, Human
gccuuugccugcgacguggcug

SEQ ID NO: 1119280 - RNA, 21 nt, Human
ggccucugccuugccccacuc

SEQ ID NO: 1119281 - RNA, 22 nt, Human
uauuucugucagccagauaugg

SEQ ID NO: 1119282 - RNA, 22 nt, Human
gcugccugaagugucuacacug

SEQ ID NO: 1119283 - RNA, 22 nt, Human
acagcagcuaaccccugggcca

SEQ ID NO: 1119284 - RNA, 23 nt, Human
ccugugugcccuuaauucacagc

SEQ ID NO: 1119285 - RNA, 19 nt, Human
ggaggccuggguauuugcc

SEQ ID NO: 1119286 - RNA, 22 nt, Human
acagggcagagggcaguuggua

SEQ ID NO: 1119287 - RNA, 22 nt, Human
agguggagaagagaugggcagu

SEQ ID NO: 1119288 - RNA, 22 nt, Human
agcuuccuacaaccaucucaga

SEQ ID NO: 1119289 - RNA, 22 nt, Human
ucacacgugagguucuauccug

SEQ ID NO: 1119290 - RNA, 21 nt, Human
ggugggcacaggagagcagag

SEQ ID NO: 1119291 - RNA, 22 nt, Human
gcauccagagguagccacugug

SEQ ID NO: 1119292 - RNA, 22 nt, Human
cuguucaugcugauucuguaug

SEQ ID NO: 1119293 - RNA, 22 nt, Human
ggcugagggccagggcuagucu

SEQ ID NO: 1119294 - RNA, 17 nt, Human
ucuggccuuccugaacu

SEQ ID NO: 1119295 - RNA, 22 nt, Human
augucccagcugagagacaacu

SEQ ID NO: 1119296 - RNA, 22 nt, Human
cacccaggcuagagugcagugg

SEQ ID NO: 1119297 - RNA, 22 nt, Human
ucugucacuauuggccagaaca

SEQ ID NO: 1119298 - RNA, 22 nt, Human
gcugccucuguagcuuuggacc

SEQ ID NO: 1119299 - RNA, 22 nt, Human
uuauuuucuccucagaaagugg

SEQ ID NO: 1119300 - RNA, 22 nt, Human
acagagcacauagauuggaguu

SEQ ID NO: 1119301 - RNA, 22 nt, Human
caagagcucaccggagagcauu

SEQ ID NO: 1119302 - RNA, 22 nt, Human
gcuuccuggagggagagagcug

SEQ ID NO: 1119303 - RNA, 20 nt, Human
cacaggccuugugagcagac

SEQ ID NO: 1119304 - RNA, 22 nt, Human
uuuauuauucucuggagaaugu

SEQ ID NO: 1119305 - RNA, 22 nt, Human
gcucugcuggaaguucucugga

SEQ ID NO: 1119306 - RNA, 22 nt, Human
gcaucuucacacaaagccagug

SEQ ID NO: 1119307 - RNA, 22 nt, Human
agagugaaaagcuagagcagua

SEQ ID NO: 1119308 - RNA, 22 nt, Human
aaugaugguuucaucacuugaa

SEQ ID NO: 1119309 - RNA, 22 nt, Human
cucacagguaccagcacccucc

SEQ ID NO: 1119310 - RNA, 22 nt, Human
gccauuuagggaggcaagguga

SEQ ID NO: 1119311 - RNA, 22 nt, Human
acagagcacugcccugugccgc

SEQ ID NO: 1119312 - RNA, 22 nt, Human
cuggcagccaagugggauacuc

SEQ ID NO: 1119313 - RNA, 21 nt, Human
ucucugggcccuccugugggg

SEQ ID NO: 1119314 - RNA, 21 nt, Human
gccagagcaguacaaugaggu

SEQ ID NO: 1119315 - RNA, 22 nt, Human
gcagaugguggggcaggaaaau

SEQ ID NO: 1119316 - RNA, 22 nt, Human
cuucccugauaagagccucaga

SEQ ID NO: 1119317 - RNA, 20 nt, Human
gaggaaaagcugccaggccu

SEQ ID NO: 1119318 - RNA, 22 nt, Human
caaagguaguauauauauuguu

SEQ ID NO: 1119319 - RNA, 22 nt, Human
caggccuggguucaaaucccuu

SEQ ID NO: 1119320 - RNA, 22 nt, Human
agucucagccacacagaccuau

SEQ ID NO: 1119321 - RNA, 22 nt, Human
ggcaccugcucaucuggacuca

SEQ ID NO: 1119322 - RNA, 22 nt, Human
cagcaggcccaggugcugguga

SEQ ID NO: 1119323 - RNA, 22 nt, Human
gcagugggaagguuggcacaug

SEQ ID NO: 1119324 - RNA, 22 nt, Human
uuagucuucuuccuuauauguu

SEQ ID NO: 1119325 - RNA, 22 nt, Human
aggggccuggacauggacgcgc

SEQ ID NO: 1119326 - RNA, 22 nt, Human
aaugaugggaaggagaaaagca

SEQ ID NO: 1119327 - RNA, 22 nt, Human
ugcuggcccaguauggacugca

SEQ ID NO: 1119328 - RNA, 22 nt, Human
cagggucuuauaaggccaauuu

SEQ ID NO: 1119329 - RNA, 22 nt, Human
uggagcaggugggaugucguga

SEQ ID NO: 1119330 - RNA, 22 nt, Human
cccaagaucuuucgugcacuaa

SEQ ID NO: 1119331 - RNA, 22 nt, Human
uuuccucuaaacgcauuugcuu

SEQ ID NO: 1119332 - RNA, 22 nt, Human
cuggcuggccggagcgaggcgg

SEQ ID NO: 1119333 - RNA, 22 nt, Human
cugggaggugcagcaaaaauca

SEQ ID NO: 1119334 - RNA, 22 nt, Human
cucccuggaggcccagaccugg

SEQ ID NO: 1119335 - RNA, 21 nt, Human
uugaagcaaggguggcucuga

SEQ ID NO: 1119336 - RNA, 22 nt, Human
ggcucugggucuguggggagcg

SEQ ID NO: 1119337 - RNA, 22 nt, Human
uuucauguuuucuuaaauggca

SEQ ID NO: 1119338 - RNA, 22 nt, Human
cagggguggcugcagcagaggu

SEQ ID NO: 1119339 - RNA, 22 nt, Human
cucuggaauguuuacaugcccu

SEQ ID NO: 1119340 - RNA, 22 nt, Human
uaaggcagaaauaugagcaggg

SEQ ID NO: 1119341 - RNA, 22 nt, Human
ugcuggggcucugaccacucca

SEQ ID NO: 1119342 - RNA, 22 nt, Human
gcuggccuucugcagaguucug

SEQ ID NO: 1119343 - RNA, 22 nt, Human
cagagccuuccuagcagacucu

SEQ ID NO: 1119344 - RNA, 22 nt, Human
guggcuucacauggcauuuggc

SEQ ID NO: 1119345 - RNA, 22 nt, Human
ccuuucucuuugcugaucaugu

SEQ ID NO: 1119346 - RNA, 17 nt, Human
agcagcuggguugaucu

SEQ ID NO: 1119347 - RNA, 18 nt, Human
ucaaagucuggcuccacu

SEQ ID NO: 1119348 - RNA, 22 nt, Human
ugggaggaaugucacugagcca

SEQ ID NO: 1119349 - RNA, 22 nt, Human
agggcuggaggguacuaguuua

SEQ ID NO: 1119350 - RNA, 22 nt, Human
ggccucugccucaucugggcac

SEQ ID NO: 1119351 - RNA, 22 nt, Human
gaagcccacguuuggugaugua

SEQ ID NO: 1119352 - RNA, 22 nt, Human
uucaaucauuagaaucucaggc

SEQ ID NO: 1119353 - RNA, 21 nt, Human
cagagcuguccaaacccugac

SEQ ID NO: 1119354 - RNA, 22 nt, Human
ugaaggaagaauaggcaguguu

SEQ ID NO: 1119355 - RNA, 22 nt, Human
ugcagcuucuccaucuccuugu

SEQ ID NO: 1119356 - RNA, 22 nt, Human
auuuuuaugacaaaccauccuc

SEQ ID NO: 1119357 - RNA, 22 nt, Human
gaaugugucacccugucccaug

SEQ ID NO: 1119358 - RNA, 22 nt, Human
auacaaagacaaaucucaaucu

SEQ ID NO: 1119359 - RNA, 23 nt, Human
ggagugcaauggcgccaucucgg

SEQ ID NO: 1119360 - RNA, 22 nt, Human
uugggcaaaguguuucuggagc

SEQ ID NO: 1119361 - RNA, 22 nt, Human
ggagauggcucugcaaggucua

SEQ ID NO: 1119362 - RNA, 22 nt, Human
agcagacaacccagaugaccca

SEQ ID NO: 1119363 - RNA, 22 nt, Human
uuauuuauggcacuguuggugg

SEQ ID NO: 1119364 - RNA, 18 nt, Human
agcugcagaccaggaggu

SEQ ID NO: 1119365 - RNA, 22 nt, Human
cagcaucuaaucuucaugccgg

SEQ ID NO: 1119366 - RNA, 22 nt, Human
gccuuuuuuguugcucugucac

SEQ ID NO: 1119367 - RNA, 22 nt, Human
ccaggagcagauauggacauaa

SEQ ID NO: 1119368 - RNA, 22 nt, Human
aguguccccuacagaggcauuc

SEQ ID NO: 1119369 - RNA, 22 nt, Human
ucucuuccaguaagagucuuua

SEQ ID NO: 1119370 - RNA, 22 nt, Human
gacaaaggaucagagguuggga

SEQ ID NO: 1119371 - RNA, 22 nt, Human
auguuauuuuggaaaauacaaa

SEQ ID NO: 1119372 - RNA, 22 nt, Human
uccaaagggaagcgcuuucugu

SEQ ID NO: 1119373 - RNA, 22 nt, Human
aucauaaagugcuaucugauug

SEQ ID NO: 1119374 - RNA, 22 nt, Human
auugaaagaguuuucugcugca

SEQ ID NO: 1119375 - RNA, 22 nt, Human
uuagaaaacauaagugguaaag

SEQ ID NO: 1119376 - RNA, 22 nt, Human
ugggcagaggcagcagaaaccu

SEQ ID NO: 1119377 - RNA, 19 nt, Human
ucucuggggacacuuucac

SEQ ID NO: 1119378 - RNA, 22 nt, Human
cagagcugugauaaauagauau

SEQ ID NO: 1119379 - RNA, 22 nt, Human
uuuccucugcugccauugcccc

SEQ ID NO: 1119380 - RNA, 22 nt, Human
guggccucaugucuauaaagag

SEQ ID NO: 1119381 - RNA, 22 nt, Human
cuacuuuaauuuucugcagaga

SEQ ID NO: 1119382 - RNA, 22 nt, Human
uucaggagcuggcugcgaagga

SEQ ID NO: 1119383 - RNA, 22 nt, Human
uagcagcugugaguaaaagcca

SEQ ID NO: 1119384 - RNA, 22 nt, Human
auuugucuuuggaccugugaga

SEQ ID NO: 1119385 - RNA, 22 nt, Human
ggcaggaggugaguggcgggug

SEQ ID NO: 1119386 - RNA, 22 nt, Human
ggggcagaaguagugccccuga

SEQ ID NO: 1119387 - RNA, 18 nt, Human
gguggcucagucaugggg

SEQ ID NO: 1119388 - RNA, 22 nt, Human
cuggagccaugucuugacugcu

SEQ ID NO: 1119389 - RNA, 22 nt, Human
ugagagugguucagcucagaag

SEQ ID NO: 1119390 - RNA, 22 nt, Human
gcucagaaaagugaggcucagu

SEQ ID NO: 1119391 - RNA, 20 nt, Human
ggucccugcccucugucauc

SEQ ID NO: 1119392 - RNA, 22 nt, Human
agucccagaucuacaggaggga

SEQ ID NO: 1119393 - RNA, 22 nt, Human
cuggggcugcagcgaucuucau

SEQ ID NO: 1119394 - RNA, 22 nt, Human
ccuggcagcauugguagagauu

SEQ ID NO: 1119395 - RNA, 22 nt, Human
gagaggagucccuaucacaguu

SEQ ID NO: 1119396 - RNA, 22 nt, Human
uuuuccucuguauuugaaaugc

SEQ ID NO: 1119397 - RNA, 22 nt, Human
ggucccaggauugguugcgcag

SEQ ID NO: 1119398 - RNA, 22 nt, Human
ggagcugucuguagggcacagg

SEQ ID NO: 1119399 - RNA, 22 nt, Human
uucacaggaauguaggggucuu

SEQ ID NO: 1119400 - RNA, 22 nt, Human
ggcagggucuggacugaaagcu

SEQ ID NO: 1119401 - RNA, 22 nt, Human
ugcaguggugguaaagaugcuc

SEQ ID NO: 1119402 - RNA, 23 nt, Human
ucuggcucuaugugacagcucuc

SEQ ID NO: 1119403 - RNA, 22 nt, Human
ggcagcugaccuagcaccaucc

SEQ ID NO: 1119404 - RNA, 22 nt, Human
ucacaggagggagagacaccca

SEQ ID NO: 1119405 - RNA, 18 nt, Human
ccuggcuuccaucuuggu

SEQ ID NO: 1119406 - RNA, 22 nt, Human
gcaagcaagcagguagagcuga

SEQ ID NO: 1119407 - RNA, 22 nt, Human
aagggcagcuauuaucgucauc

SEQ ID NO: 1119408 - RNA, 22 nt, Human
ugcugccuccaacuccugggcu

SEQ ID NO: 1119409 - RNA, 22 nt, Human
uccucaggcugccuggaagacu

SEQ ID NO: 1119410 - RNA, 21 nt, Human
gagacagacuuucguccccug

SEQ ID NO: 1119411 - RNA, 22 nt, Human
gaagaacacuucaugauucauu

SEQ ID NO: 1119412 - RNA, 22 nt, Human
uaggagcuaaaauauuuuauau

SEQ ID NO: 1119413 - RNA, 22 nt, Human
uaacacugguauuucauuuagu

SEQ ID NO: 1119414 - RNA, 22 nt, Human
cugagcugggcucucuugaggg

SEQ ID NO: 1119415 - RNA, 22 nt, Human
aagggccauaacuugcaguguu

SEQ ID NO: 1119416 - RNA, 22 nt, Human
auaaggcagucccuuaacaagg

SEQ ID NO: 1119417 - RNA, 22 nt, Human
agagcagguggcaacucuggga

SEQ ID NO: 1119418 - RNA, 22 nt, Human
uuccuguauucuaaagggaaag

SEQ ID NO: 1119419 - RNA, 22 nt, Human
aaagcaaugaugguagacacgu

SEQ ID NO: 1119420 - RNA, 20 nt, Human
aggcucagcugagcucuugg

SEQ ID NO: 1119421 - RNA, 22 nt, Human
ugcuuccugaggccgucuucuc

SEQ ID NO: 1119422 - RNA, 23 nt, Human
aggauccugguacaggagcagag

SEQ ID NO: 1119423 - RNA, 18 nt, Human
uggagcugagugcugugc

SEQ ID NO: 1119424 - RNA, 22 nt, Human
ugcugggggcuuucuggauacc

SEQ ID NO: 1119425 - RNA, 22 nt, Human
ccucugcucccuggugucugag

SEQ ID NO: 1119426 - RNA, 22 nt, Human
uucuggagcuaaaguccacucu

SEQ ID NO: 1119427 - RNA, 22 nt, Human
aacagcagggggaccugcuggu

SEQ ID NO: 1119428 - RNA, 22 nt, Human
uaggccaguggcagguugugug

SEQ ID NO: 1119429 - RNA, 22 nt, Human
aaaagguagauucuccuucuau

SEQ ID NO: 1119430 - RNA, 22 nt, Human
guagcuuauuagggauaauagu

SEQ ID NO: 1119431 - RNA, 22 nt, Human
caggccuggggcuggcuuccag

SEQ ID NO: 1119432 - RNA, 22 nt, Human
cuggggcucucuggaaugcuug

SEQ ID NO: 1119433 - RNA, 22 nt, Human
uguggcugcucaggugcagacc

SEQ ID NO: 1119434 - RNA, 20 nt, Human
ccaccuggccaaggcugugc

SEQ ID NO: 1119435 - RNA, 17 nt, Human
gccuuccuuccuccaca

SEQ ID NO: 1119436 - RNA, 22 nt, Human
agagugggccucugagucccag

SEQ ID NO: 1119437 - RNA, 22 nt, Human
gcagaaggucuggcacuucagg

SEQ ID NO: 1119438 - RNA, 22 nt, Human
aaggucauuguugcauguucuc

SEQ ID NO: 1119439 - RNA, 22 nt, Human
cuggggcugcgguggaggagcc

SEQ ID NO: 1119440 - RNA, 22 nt, Human
ugaggccaggaucccaggcucu

SEQ ID NO: 1119441 - RNA, 22 nt, Human
ccugcucugguuuagucagucu

SEQ ID NO: 1119442 - RNA, 22 nt, Human
cagcagcugggaaggaggcuga

SEQ ID NO: 1119443 - RNA, 22 nt, Human
cucuggccagagccugcgggaa

SEQ ID NO: 1119444 - RNA, 22 nt, Human
gcagccagccccucugaccucu

SEQ ID NO: 1119445 - RNA, 22 nt, Human
gcagagccuugcgucaugugcc

SEQ ID NO: 1119446 - RNA, 22 nt, Human
uucuguguggguagcuccuguu

SEQ ID NO: 1119447 - RNA, 22 nt, Human
aauaaauguuaagauugucuca

SEQ ID NO: 1119448 - RNA, 18 nt, Human
gaaaggagagacaguagg

SEQ ID NO: 1119449 - RNA, 22 nt, Human
ugagcuguagcagaugcuguug

SEQ ID NO: 1119450 - RNA, 22 nt, Human
uagcuuuacaaagugcugcacc

SEQ ID NO: 1119451 - RNA, 22 nt, Human
agccagccaguucacuaggaaa

SEQ ID NO: 1119452 - RNA, 22 nt, Human
uccagggccaagucauggaacc

SEQ ID NO: 1119453 - RNA, 22 nt, Human
uccuggaggggacagcaugggc

SEQ ID NO: 1119454 - RNA, 22 nt, Human
cuucagggugacgcaggcugca

SEQ ID NO: 1119455 - RNA, 22 nt, Human
gcccagcugcacccuggugggu

SEQ ID NO: 1119456 - RNA, 22 nt, Human
cagggagaucuuggcuccuggu

SEQ ID NO: 1119457 - RNA, 22 nt, Human
gugcucuguguauuaggauguc

SEQ ID NO: 1119458 - RNA, 22 nt, Human
cagagcagugaggaguugugua

SEQ ID NO: 1119459 - RNA, 22 nt, Human
gggcugcacguauucugcucac

SEQ ID NO: 1119460 - RNA, 18 nt, Human
aagcugcccucaggcagg

SEQ ID NO: 1119461 - RNA, 22 nt, Human
caggaaagaaaugagaacacca

SEQ ID NO: 1119462 - RNA, 22 nt, Human
ggcucacgcaauuaucccggcc

SEQ ID NO: 1119463 - RNA, 20 nt, Human
gcugaccccugcugucaugc

SEQ ID NO: 1119464 - RNA, 22 nt, Human
aagagcuggauggaaucuggga

SEQ ID NO: 1119465 - RNA, 22 nt, Human
uuccuauuuccaugaaacacaa

SEQ ID NO: 1119466 - RNA, 22 nt, Human
gcugccacauuuucaggacuaa

SEQ ID NO: 1119467 - RNA, 22 nt, Human
ggccuggccuccagaugugggc

SEQ ID NO: 1119468 - RNA, 20 nt, Human
ggcugugcccuuccguggcc

SEQ ID NO: 1119469 - RNA, 22 nt, Human
ugucagggcaugcgguccagcc

SEQ ID NO: 1119470 - RNA, 22 nt, Human
ugcaggcaggggaugagcagcc

SEQ ID NO: 1119471 - RNA, 22 nt, Human
uuacaggggacauuggggacau

SEQ ID NO: 1119472 - RNA, 22 nt, Human
gcagcuggggccacacuuaggc

SEQ ID NO: 1119473 - RNA, 22 nt, Human
cagccugggcuccagagucccu

SEQ ID NO: 1119474 - RNA, 22 nt, Human
agaaugcaagauaaacuuuauu

SEQ ID NO: 1119475 - RNA, 22 nt, Human
cugggagcggcugucacugguu

SEQ ID NO: 1119476 - RNA, 22 nt, Human
guggccagaagacugcaaugcu

SEQ ID NO: 1119477 - RNA, 22 nt, Human
ccucuccuugcacccgucccgc

SEQ ID NO: 1119478 - RNA, 22 nt, Human
ccucucuguaagggucccuccc

SEQ ID NO: 1119479 - RNA, 22 nt, Human
aggcugggcaccguuuugaucc

SEQ ID NO: 1119480 - RNA, 22 nt, Human
agaagccacuggagguugagau

SEQ ID NO: 1119481 - RNA, 22 nt, Human
uuucaugugcaauuagcaauau

SEQ ID NO: 1119482 - RNA, 22 nt, Human
gcucccaccaggcagaccuacc

SEQ ID NO: 1119483 - RNA, 22 nt, Human
caccagcuacagacuacugugu

SEQ ID NO: 1119484 - RNA, 22 nt, Human
cagggccagagagggcuggcug

SEQ ID NO: 1119485 - RNA, 23 nt, Human
uuucuguuggguauauauccaag

SEQ ID NO: 1119486 - RNA, 22 nt, Human
cuccaguaucuguaggaaaagg

SEQ ID NO: 1119487 - RNA, 22 nt, Human
augcaucauggaaaacucaguu

SEQ ID NO: 1119488 - RNA, 22 nt, Human
uaaaugugggggccacgggcuu

SEQ ID NO: 1119489 - RNA, 22 nt, Human
ugggcacaaacaucugccuguu

SEQ ID NO: 1119490 - RNA, 22 nt, Human
gccugccucaaaaucccaguuc

SEQ ID NO: 1119491 - RNA, 22 nt, Human
uaacagaauccuguuauugcca

SEQ ID NO: 1119492 - RNA, 22 nt, Human
uguggcccagaugagugugcua

SEQ ID NO: 1119493 - RNA, 22 nt, Human
aaguuugacagaaguuucuaau

SEQ ID NO: 1119494 - RNA, 22 nt, Human
ugccacagaggugaagcccacu

SEQ ID NO: 1119495 - RNA, 22 nt, Human
aagagguugucugugaugaguu

SEQ ID NO: 1119496 - RNA, 22 nt, Human
acuuucucaggaauucacagac

SEQ ID NO: 1119497 - RNA, 22 nt, Human
ucuguuccauguuuuguuccau

SEQ ID NO: 1119498 - RNA, 22 nt, Human
aaaucaaaagacauguguuuua

SEQ ID NO: 1119499 - RNA, 22 nt, Human
agacaggacacaagcugcauaa

SEQ ID NO: 1119500 - RNA, 22 nt, Human
guccuggcccacuggcaggcug

SEQ ID NO: 1119501 - RNA, 22 nt, Human
acaggcagcgucauugcugcuc

SEQ ID NO: 1119502 - RNA, 22 nt, Human
cauugucacccaaagcucauag

SEQ ID NO: 1119503 - RNA, 22 nt, Human
uucuggagaucugccuauggga

SEQ ID NO: 1119504 - RNA, 22 nt, Human
ugggcaggauaauaucucaugu

SEQ ID NO: 1119505 - RNA, 22 nt, Human
auaaaaguaggaccaacuuaca

SEQ ID NO: 1119506 - RNA, 22 nt, Human
agagacaggguuuugucguguu

SEQ ID NO: 1119507 - RNA, 22 nt, Human
aaaggugacacucugccagcug

SEQ ID NO: 1119508 - RNA, 22 nt, Human
agcugguguccuccuggagcug

SEQ ID NO: 1119509 - RNA, 17 nt, Human
ggugagaccucccacuc

SEQ ID NO: 1119510 - RNA, 22 nt, Human
uggagcagagaugggagcccaa

SEQ ID NO: 1119511 - RNA, 22 nt, Human
ggcucuggagcacagacgucug

SEQ ID NO: 1119512 - RNA, 22 nt, Human
gcccugagggguggugucugua

SEQ ID NO: 1119513 - RNA, 22 nt, Human
ggaaggaggaugcucuggccuu

SEQ ID NO: 1119514 - RNA, 22 nt, Human
ucccagcagcauagcucagaau

SEQ ID NO: 1119515 - RNA, 19 nt, Human
uagcagcugccaaaggaga

SEQ ID NO: 1119516 - RNA, 22 nt, Human
agcagccaggaaucugcagagc

SEQ ID NO: 1119517 - RNA, 22 nt, Human
uuuauguacauauccacaagga

SEQ ID NO: 1119518 - RNA, 22 nt, Human
ucucugggugauggcagggcac

SEQ ID NO: 1119519 - RNA, 22 nt, Human
gccaggcacaguucuaggugcu

SEQ ID NO: 1119520 - RNA, 22 nt, Human
gagcagggagacaacucuggug

SEQ ID NO: 1119521 - RNA, 22 nt, Human
gaacagcuucuugggagcuggg

SEQ ID NO: 1119522 - RNA, 22 nt, Human
agauacauagcugugagcacac

SEQ ID NO: 1119523 - RNA, 22 nt, Human
gcucagaggagcaucauaagga

SEQ ID NO: 1119524 - RNA, 22 nt, Human
uguacacaauucuuaacauaca

SEQ ID NO: 1119525 - RNA, 22 nt, Human
uccagccaccaccuugauugcc

SEQ ID NO: 1119526 - RNA, 22 nt, Human
acccuggguucccgcagcacca

SEQ ID NO: 1119527 - RNA, 22 nt, Human
ggugcagaucuuucucuucagg

SEQ ID NO: 1119528 - RNA, 22 nt, Human
gaaaauguuagcuucauaguca

SEQ ID NO: 1119529 - RNA, 22 nt, Human
gaggccuggaccagccacagag

SEQ ID NO: 1119530 - RNA, 22 nt, Human
ugugccuggaucucugugacaa

SEQ ID NO: 1119531 - RNA, 22 nt, Human
gucagaggaauggaugagugau

SEQ ID NO: 1119532 - RNA, 22 nt, Human
uaaugugugucaucaguagagu

SEQ ID NO: 1119533 - RNA, 23 nt, Human
ggaaagagaggaguugugcauag

SEQ ID NO: 1119534 - RNA, 22 nt, Human
uuccucaucugugcaccucacu

SEQ ID NO: 1119535 - RNA, 22 nt, Human
ugcaggagaaaguacggagcgu

SEQ ID NO: 1119536 - RNA, 22 nt, Human
ggaggccauaguuugggaguca

SEQ ID NO: 1119537 - RNA, 22 nt, Human
gcaggugggggucggugcaucu

SEQ ID NO: 1119538 - RNA, 22 nt, Human
auugacaagacaauggcucuua

SEQ ID NO: 1119539 - RNA, 22 nt, Human
cucuuucaguucugauagucuc

SEQ ID NO: 1119540 - RNA, 22 nt, Human
auguaucaacaaauuguacagu

SEQ ID NO: 1119541 - RNA, 22 nt, Human
agggcagcucucaccucuggcc

SEQ ID NO: 1119542 - RNA, 22 nt, Human
uauucacaaaaugagguccuca

SEQ ID NO: 1119543 - RNA, 22 nt, Human
aagcugccaccagcccagggca

SEQ ID NO: 1119544 - RNA, 22 nt, Human
cccuggugguacggcacuggca

SEQ ID NO: 1119545 - RNA, 22 nt, Human
aaagauuugaaauuaggcauca

SEQ ID NO: 1119546 - RNA, 22 nt, Human
gggcugcuuuuaagggucucag

SEQ ID NO: 1119547 - RNA, 22 nt, Human
ugccagaagauucucuaucaga

SEQ ID NO: 1119548 - RNA, 22 nt, Human
gagguuagaggucagugcaguc

SEQ ID NO: 1119549 - RNA, 22 nt, Human
uuccaguuaaggaagcuauucu

SEQ ID NO: 1119550 - RNA, 22 nt, Human
aagcugccugggaggaagggcu

SEQ ID NO: 1119551 - RNA, 22 nt, Human
gugcucaggaagcuguuccugc

SEQ ID NO: 1119552 - RNA, 22 nt, Human
ggaugcaggacggcauggaugu

SEQ ID NO: 1119553 - RNA, 19 nt, Human
ucugaggguccagaugcau

SEQ ID NO: 1119554 - RNA, 20 nt, Human
auacacauauucuugcaacu

SEQ ID NO: 1119555 - RNA, 22 nt, Human
gcaggggcaggagaucucaggc

SEQ ID NO: 1119556 - RNA, 22 nt, Human
aucaaaguaggcauauguuuuu

SEQ ID NO: 1119557 - RNA, 22 nt, Human
ggagcagagcugggcuuggcug

SEQ ID NO: 1119558 - RNA, 22 nt, Human
aagaauguucauuaaacuguug

SEQ ID NO: 1119559 - RNA, 22 nt, Human
cccaggagagaggccaguuggc

SEQ ID NO: 1119560 - RNA, 22 nt, Human
guuguauagagggcaugaaucu

SEQ ID NO: 1119561 - RNA, 22 nt, Human
ccaggguggcguagaugcuggg

SEQ ID NO: 1119562 - RNA, 22 nt, Human
cuggagccccagacagggagag

SEQ ID NO: 1119563 - RNA, 22 nt, Human
aaaguucagugccuucuauaca

SEQ ID NO: 1119564 - RNA, 22 nt, Human
uggcucucaggccugcugcguu

SEQ ID NO: 1119565 - RNA, 22 nt, Human
gcugucaggaacaugccuuggu

SEQ ID NO: 1119566 - RNA, 22 nt, Human
aacagugagaagguggacagga

SEQ ID NO: 1119567 - RNA, 22 nt, Human
auguguaggugaaucgaggcug

SEQ ID NO: 1119568 - RNA, 20 nt, Human
gccuggaggcaaugggaaga

SEQ ID NO: 1119569 - RNA, 22 nt, Human
ccccagcugcauacuugccaag

SEQ ID NO: 1119570 - RNA, 19 nt, Human
ggagccuggagcacgugcc

SEQ ID NO: 1119571 - RNA, 22 nt, Human
uucacauuauaaucaguucugc

SEQ ID NO: 1119572 - RNA, 22 nt, Human
ugggggucaggaugaggccuug

SEQ ID NO: 1119573 - RNA, 22 nt, Human
agccacagcaacaagugcaauu

SEQ ID NO: 1119574 - RNA, 22 nt, Human
gcugucuugcucacucuugcag

SEQ ID NO: 1119575 - RNA, 22 nt, Human
uuuucauuuacauuagggaaga

SEQ ID NO: 1119576 - RNA, 22 nt, Human
uacuuuaaaaacugauaauuca

SEQ ID NO: 1119577 - RNA, 22 nt, Human
aucucccagccacagcauucuu

SEQ ID NO: 1119578 - RNA, 22 nt, Human
agcagagcggggccuccggaag

SEQ ID NO: 1119579 - RNA, 22 nt, Human
cuccuugguguaguacugagca

SEQ ID NO: 1119580 - RNA, 22 nt, Human
ggcucaggccuguaauccuagc

SEQ ID NO: 1119581 - RNA, 22 nt, Human
agggcucugggguggcagagau

SEQ ID NO: 1119582 - RNA, 22 nt, Human
agggcagagaaauguaguugag

SEQ ID NO: 1119583 - RNA, 17 nt, Human
ugagcaguagaagaugc

SEQ ID NO: 1119584 - RNA, 22 nt, Human
cugucuguuuuaccuucuccag

SEQ ID NO: 1119585 - RNA, 22 nt, Human
aucuggcugcugugcuuaagcu

SEQ ID NO: 1119586 - RNA, 20 nt, Human
ccugucuggagacaaagaga

SEQ ID NO: 1119587 - RNA, 22 nt, Human
uccagccaagggagguuacuag

SEQ ID NO: 1119588 - RNA, 22 nt, Human
agggaucaaaaaauguacaugc

SEQ ID NO: 1119589 - RNA, 22 nt, Human
uugaagcaaggcgaaucuugug

SEQ ID NO: 1119590 - RNA, 22 nt, Human
uuccaggaauucagcucucagu

SEQ ID NO: 1119591 - RNA, 19 nt, Human
cagagccucagagcuagaa

SEQ ID NO: 1119592 - RNA, 19 nt, Human
ggaccagguccugggcagc

SEQ ID NO: 1119593 - RNA, 22 nt, Human
aaaugucuuucuucugcuacgu

SEQ ID NO: 1119594 - RNA, 22 nt, Human
cucacugcaaguuccaccuacc

SEQ ID NO: 1119595 - RNA, 22 nt, Human
ggcagcuggccuccucgcccac

SEQ ID NO: 1119596 - RNA, 22 nt, Human
agcagcuucuuucacuccugga

SEQ ID NO: 1119597 - RNA, 22 nt, Human
gaacagcccuguuaagucuguu

SEQ ID NO: 1119598 - RNA, 22 nt, Human
acagaagagcacauuuaguaug

SEQ ID NO: 1119599 - RNA, 21 nt, Human
agcagcugggcaacauggagg

SEQ ID NO: 1119600 - RNA, 22 nt, Human
uccucuggggucagggcacuac

SEQ ID NO: 1119601 - RNA, 22 nt, Human
ugugcagcuaguccuggacuug

SEQ ID NO: 1119602 - RNA, 22 nt, Human
aaauauguaagauuagcacuag

SEQ ID NO: 1119603 - RNA, 22 nt, Human
gaagccccaaacccucgccauc

SEQ ID NO: 1119604 - RNA, 20 nt, Human
ccaagagcaugcaugaggaa

SEQ ID NO: 1119605 - RNA, 22 nt, Human
caccaggcuggagugcagaggu

SEQ ID NO: 1119606 - RNA, 22 nt, Human
cucaggaugcaggucacaggac

SEQ ID NO: 1119607 - RNA, 20 nt, Human
cagggccacgcuccaaggca

SEQ ID NO: 1119608 - RNA, 22 nt, Human
gcugguuagaaaacagagcuca

SEQ ID NO: 1119609 - RNA, 22 nt, Human
gacaggggucccucugggcugu

SEQ ID NO: 1119610 - RNA, 22 nt, Human
cucugugcccuacugcucagcu

SEQ ID NO: 1119611 - RNA, 22 nt, Human
ccaggcugggcuacaaguugag

SEQ ID NO: 1119612 - RNA, 22 nt, Human
cugugcuugcggguguggagcc

SEQ ID NO: 1119613 - RNA, 22 nt, Human
caggcugcagaggccuuucaug

SEQ ID NO: 1119614 - RNA, 22 nt, Human
cugggugguuuugaugugaauu

SEQ ID NO: 1119615 - RNA, 22 nt, Human
cuuguccuuuacuugagacuca

SEQ ID NO: 1119616 - RNA, 22 nt, Human
ugccugucuucaggagugucac

SEQ ID NO: 1119617 - RNA, 22 nt, Human
cucagggggaaucaggucacag

SEQ ID NO: 1119618 - RNA, 22 nt, Human
auaaacaguagagaaagguggu

SEQ ID NO: 1119619 - RNA, 22 nt, Human
uuuagaaauucaucuauggccu

SEQ ID NO: 1119620 - RNA, 21 nt, Human
cagagguggccugaccucuga

SEQ ID NO: 1119621 - RNA, 22 nt, Human
gcuguguccucacacagccuuu

SEQ ID NO: 1119622 - RNA, 22 nt, Human
gcacccagggacuuggcuggcc

SEQ ID NO: 1119623 - RNA, 22 nt, Human
ggaaccaguggaaugauaugcu

SEQ ID NO: 1119624 - RNA, 17 nt, Human
agguggguggaucaccu

SEQ ID NO: 1119625 - RNA, 22 nt, Human
agugugggugagggaggcccuc

SEQ ID NO: 1119626 - RNA, 22 nt, Human
cacugccuggaaggagagacau

SEQ ID NO: 1119627 - RNA, 20 nt, Human
cuguggcucaugcaucugcc

SEQ ID NO: 1119628 - RNA, 22 nt, Human
cagggccagccauccugcuggg

SEQ ID NO: 1119629 - RNA, 22 nt, Human
cccaggcugauguucagcgggu

SEQ ID NO: 1119630 - RNA, 22 nt, Human
cuccaggccagggaaguggaca

SEQ ID NO: 1119631 - RNA, 22 nt, Human
agaggccuaaccaagauguccu

SEQ ID NO: 1119632 - RNA, 22 nt, Human
ugcuuccuugagcucuccaauc

SEQ ID NO: 1119633 - RNA, 22 nt, Human
aggguggcaguuacuggagcaa

SEQ ID NO: 1119634 - RNA, 20 nt, Human
caggaggcaaggucaagguc

SEQ ID NO: 1119635 - RNA, 22 nt, Human
caucugcuguuccuuggacuca

SEQ ID NO: 1119636 - RNA, 22 nt, Human
agaugaagacucaggagcaggu

SEQ ID NO: 1119637 - RNA, 22 nt, Human
aagcagccacuggccaguuaua

SEQ ID NO: 1119638 - RNA, 22 nt, Human
uaagcuauuccugaagaagguu

SEQ ID NO: 1119639 - RNA, 22 nt, Human
agcccagccggauucccaguuc

SEQ ID NO: 1119640 - RNA, 22 nt, Human
aggccaaguagcuagcauugaa

SEQ ID NO: 1119641 - RNA, 22 nt, Human
gcauuuguguucuuccuagagc

SEQ ID NO: 1119642 - RNA, 22 nt, Human
guguccagagaaacucacagcu

SEQ ID NO: 1119643 - RNA, 22 nt, Human
uagaaaugauuuugaugcuuca

SEQ ID NO: 1119644 - RNA, 22 nt, Human
gcccagccuccaagcuccaagg

SEQ ID NO: 1119645 - RNA, 21 nt, Human
uggagcugaauuuuuggcauc

SEQ ID NO: 1119646 - RNA, 22 nt, Human
ugcugccauggucgcugguguc

SEQ ID NO: 1119647 - RNA, 22 nt, Human
cucuguagaaacagggcagaag

SEQ ID NO: 1119648 - RNA, 20 nt, Human
aagagcauaguacaggaaga

SEQ ID NO: 1119649 - RNA, 22 nt, Human
ccagugcaggugagcaccaggu

SEQ ID NO: 1119650 - RNA, 22 nt, Human
ggacuggccggcgcugaggccc

SEQ ID NO: 1119651 - RNA, 22 nt, Human
ugucuucaguaaaauacacuau

SEQ ID NO: 1119652 - RNA, 22 nt, Human
gccaggcuguggggaacuugaa

SEQ ID NO: 1119653 - RNA, 22 nt, Human
agagauguucauucagcauguu

SEQ ID NO: 1119654 - RNA, 22 nt, Human
ucaaaugcggucauggcuuuua

SEQ ID NO: 1119655 - RNA, 21 nt, Human
gccagccuguuuaccuguggu

SEQ ID NO: 1119656 - RNA, 22 nt, Human
gucccagaggacagggucacau

SEQ ID NO: 1119657 - RNA, 22 nt, Human
gggcugcuuccuggggaaugcu

SEQ ID NO: 1119658 - RNA, 22 nt, Human
gggcguggauggucagugcagg

SEQ ID NO: 1119659 - RNA, 22 nt, Human
ccucaugguacuuacuguagcu

SEQ ID NO: 1119660 - RNA, 22 nt, Human
cuacauuaaauuggcuuacuua

SEQ ID NO: 1119661 - RNA, 22 nt, Human
ucaggcugaggucaucugcauc

SEQ ID NO: 1119662 - RNA, 21 nt, Human
gcucccugcucagcuccuggg

SEQ ID NO: 1119663 - RNA, 22 nt, Human
aauuaacagagggcuuauuacu

SEQ ID NO: 1119664 - RNA, 22 nt, Human
gagacagcagggccagggccug

SEQ ID NO: 1119665 - RNA, 22 nt, Human
ggguggcacaggugcagagggu

SEQ ID NO: 1119666 - RNA, 23 nt, Human
uugugggcagauuccauggggag

SEQ ID NO: 1119667 - RNA, 22 nt, Human
ucagcuggagaugagaaccgaa

SEQ ID NO: 1119668 - RNA, 23 nt, Human
cccagagcacagccuccagaugc

SEQ ID NO: 1119669 - RNA, 22 nt, Human
agggccagagucuguguagaua

SEQ ID NO: 1119670 - RNA, 22 nt, Human
caggccuggagugcaauggcac

SEQ ID NO: 1119671 - RNA, 22 nt, Human
ucaggggagguugaaucgucuc

SEQ ID NO: 1119672 - RNA, 22 nt, Human
gagcaacaguuuaugguuuuuc

SEQ ID NO: 1119673 - RNA, 22 nt, Human
gcugccuggcuuuaguccacuu

SEQ ID NO: 1119674 - RNA, 22 nt, Human
aggauccuccuuagaaaagacc

SEQ ID NO: 1119675 - RNA, 22 nt, Human
cuggacagaaagggcugcugug

SEQ ID NO: 1119676 - RNA, 22 nt, Human
ucagcaguggcucucaugcagu

SEQ ID NO: 1119677 - RNA, 22 nt, Human
uauucacauucucaggccuggu

SEQ ID NO: 1119678 - RNA, 22 nt, Human
ccagcuccugggucuuagucag

SEQ ID NO: 1119679 - RNA, 22 nt, Human
uugaagcaugguacuuguucaa

SEQ ID NO: 1119680 - RNA, 22 nt, Human
ccucccacauccuagcucugcu

SEQ ID NO: 1119681 - RNA, 22 nt, Human
gugcuuccugccuggugccuuu

SEQ ID NO: 1119682 - RNA, 21 nt, Human
agcagcagaucuggugagggc

SEQ ID NO: 1119683 - RNA, 22 nt, Human
agccagccgggggaccacagug

SEQ ID NO: 1119684 - RNA, 22 nt, Human
agccaggauggucucgaucggc

SEQ ID NO: 1119685 - RNA, 22 nt, Human
guuccauaucacagcagacgaa

SEQ ID NO: 1119686 - RNA, 22 nt, Human
cagcugagcucccaggccauca

SEQ ID NO: 1119687 - RNA, 22 nt, Human
agugccuggaccccaugacaua

SEQ ID NO: 1119688 - RNA, 22 nt, Human
uagcagagcagggaucagagcc

SEQ ID NO: 1119689 - RNA, 22 nt, Human
ccuggcugaaccaaugaagugg

SEQ ID NO: 1119690 - RNA, 22 nt, Human
gcugucugggaugucacugcug

SEQ ID NO: 1119691 - RNA, 20 nt, Human
ccuggagccuggaaggaguc

SEQ ID NO: 1119692 - RNA, 17 nt, Human
gagaguguauuggaugc

SEQ ID NO: 1119693 - RNA, 22 nt, Human
gcaaagcugggugugaaugcac

SEQ ID NO: 1119694 - RNA, 22 nt, Human
ggucccagcugcucaagaggcu

SEQ ID NO: 1119695 - RNA, 22 nt, Human
ugaugggaggugcugcaggacc

SEQ ID NO: 1119696 - RNA, 20 nt, Human
ugcagaagaacguucugguu

SEQ ID NO: 1119697 - RNA, 22 nt, Human
ccauaaggagccagacauucca

SEQ ID NO: 1119698 - RNA, 22 nt, Human
cugccuggagcauucugaaggu

SEQ ID NO: 1119699 - RNA, 22 nt, Human
cgggcagauugggaagguucau

SEQ ID NO: 1119700 - RNA, 22 nt, Human
ugcuccauucucuagccagugc

SEQ ID NO: 1119701 - RNA, 18 nt, Human
cagaugagaugcaaucuc

SEQ ID NO: 1119702 - RNA, 22 nt, Human
gagccagguuggaggcugcagu

SEQ ID NO: 1119703 - RNA, 22 nt, Human
agccacagcgaaccucucuucc

SEQ ID NO: 1119704 - RNA, 22 nt, Human
cagcuucucagaaagcugaggu

SEQ ID NO: 1119705 - RNA, 22 nt, Human
ccaaagugcugggguuacaggc

SEQ ID NO: 1119706 - RNA, 20 nt, Human
guucucacugaucugcaggg

SEQ ID NO: 1119707 - RNA, 22 nt, Human
uuauguacaauguuaauguaaa

SEQ ID NO: 1119708 - RNA, 22 nt, Human
ugugccugucacccucagagag

SEQ ID NO: 1119709 - RNA, 22 nt, Human
agugcauuauauguuucaaugg

SEQ ID NO: 1119710 - RNA, 22 nt, Human
cccuggagguggagguugcagg

SEQ ID NO: 1119711 - RNA, 22 nt, Human
gcuggcagaauuucuucuugcu

SEQ ID NO: 1119712 - RNA, 22 nt, Human
uggcagcugucuguggggucuc

SEQ ID NO: 1119713 - RNA, 22 nt, Human
aagacauuacuggaaucugacu

SEQ ID NO: 1119714 - RNA, 22 nt, Human
uccugccuuagagcaaggaaaa

SEQ ID NO: 1119715 - RNA, 22 nt, Human
guggccagcaagugcugccucu

SEQ ID NO: 1119716 - RNA, 22 nt, Human
guggagcccugguagggacccc

SEQ ID NO: 1119717 - RNA, 22 nt, Human
gaaggagacccugaagaugcug

SEQ ID NO: 1119718 - RNA, 21 nt, Human
ugcccacagcaaaugcagagg

SEQ ID NO: 1119719 - RNA, 22 nt, Human
ugcauuguuuagaacucuuugg

SEQ ID NO: 1119720 - RNA, 22 nt, Human
accuuucauuaaagucuguagu

SEQ ID NO: 1119721 - RNA, 22 nt, Human
caggauggucagaugcauuguc

SEQ ID NO: 1119722 - RNA, 22 nt, Human
ccagcuccagguagaugggcag

SEQ ID NO: 1119723 - RNA, 21 nt, Human
agagaauugccuuagauguuc

SEQ ID NO: 1119724 - RNA, 22 nt, Human
uuuccucugaugcugacuugga

SEQ ID NO: 1119725 - RNA, 22 nt, Human
ggcacugaaguggguguugggu

SEQ ID NO: 1119726 - RNA, 17 nt, Human
gguguauggggagggaa

SEQ ID NO: 1119727 - RNA, 22 nt, Human
aaggccaggacaccaggggacu

SEQ ID NO: 1119728 - RNA, 22 nt, Human
ugccaggggaccuagggauguc

SEQ ID NO: 1119729 - RNA, 22 nt, Human
gaugauggacaaagcauuggug

SEQ ID NO: 1119730 - RNA, 22 nt, Human
aggggcugggacagagccaagc

SEQ ID NO: 1119731 - RNA, 22 nt, Human
gucccaggcuuauguggagcuu

SEQ ID NO: 1119732 - RNA, 22 nt, Human
uaagacacaugcguacaagaua

SEQ ID NO: 1119733 - RNA, 22 nt, Human
auaaagaggauguauuuacagc

SEQ ID NO: 1119734 - RNA, 22 nt, Human
ccaaagugcugagauuacaggu

SEQ ID NO: 1119735 - RNA, 22 nt, Human
augauacaagcaaaacuaauca

SEQ ID NO: 1119736 - RNA, 22 nt, Human
gcccaggcuggagugcaguagc

SEQ ID NO: 1119737 - RNA, 22 nt, Human
gaaaggucaguuccacuuccau

SEQ ID NO: 1119738 - RNA, 22 nt, Human
aaguuuaagguggaaguggugg

SEQ ID NO: 1119739 - RNA, 22 nt, Human
cagcccuggccccagguggucu

SEQ ID NO: 1119740 - RNA, 22 nt, Human
uaugcacgucuauuuaugaaga

SEQ ID NO: 1119741 - RNA, 22 nt, Human
gccuggcaggggccugggagug

SEQ ID NO: 1119742 - RNA, 22 nt, Human
gcagggugaaggucacauagaa

SEQ ID NO: 1119743 - RNA, 22 nt, Human
caguggggaggccaggauagaa

SEQ ID NO: 1119744 - RNA, 22 nt, Human
ggcucaggacugcagcguagag

SEQ ID NO: 1119745 - RNA, 22 nt, Human
uucuuuccacagaggggaugau

SEQ ID NO: 1119746 - RNA, 22 nt, Human
ccaggcagcaaauuuucugaau

SEQ ID NO: 1119747 - RNA, 22 nt, Human
ccuggaaggugaugguacagca

SEQ ID NO: 1119748 - RNA, 20 nt, Human
uucauucauuccacaacuuc

SEQ ID NO: 1119749 - RNA, 22 nt, Human
guggccugucagaagccguggg

SEQ ID NO: 1119750 - RNA, 22 nt, Human
ccuggcucuucagagguuccua

SEQ ID NO: 1119751 - RNA, 22 nt, Human
agaaaucauucccaaacccaua

SEQ ID NO: 1119752 - RNA, 22 nt, Human
ggcgaggccgggacaggcugga

SEQ ID NO: 1119753 - RNA, 22 nt, Human
aaaaguguccagauuaugaaga

SEQ ID NO: 1119754 - RNA, 22 nt, Human
ucuggccugggccugccggugc

SEQ ID NO: 1119755 - RNA, 22 nt, Human
uaaaugcagauuccugagccua

SEQ ID NO: 1119756 - RNA, 22 nt, Human
uaauaaaugaaagugcuggcau

SEQ ID NO: 1119757 - RNA, 18 nt, Human
cagauccaggcagcuauu

SEQ ID NO: 1119758 - RNA, 22 nt, Human
ggugaaggcacaagagggcaag

SEQ ID NO: 1119759 - RNA, 20 nt, Human
agugucuggugcagggccuc

SEQ ID NO: 1119760 - RNA, 21 nt, Human
agcuuccugcagugggagguc

SEQ ID NO: 1119761 - RNA, 23 nt, Human
gccugggacucaggaggagcuca

SEQ ID NO: 1119762 - RNA, 22 nt, Human
aggagcugacuuguaaagcauu

SEQ ID NO: 1119763 - RNA, 21 nt, Human
augaagucuaugcuucugugu

SEQ ID NO: 1119764 - RNA, 22 nt, Human
gauuucuguaacacuucagaua

SEQ ID NO: 1119765 - RNA, 22 nt, Human
caguauuuauggcuugaguauu

SEQ ID NO: 1119766 - RNA, 22 nt, Human
agcugcccugggucuugcugcu

SEQ ID NO: 1119767 - RNA, 21 nt, Human
gagugucuaauccaggcuguc

SEQ ID NO: 1119768 - RNA, 22 nt, Human
gcaaaaaaugcuuguugcuuag

SEQ ID NO: 1119769 - RNA, 22 nt, Human
gcuuagucaauuauaaauaggc

SEQ ID NO: 1119770 - RNA, 22 nt, Human
ggcuggccuguguggccgccac

SEQ ID NO: 1119771 - RNA, 21 nt, Human
ucagcagcaucugccuagagu

SEQ ID NO: 1119772 - RNA, 22 nt, Human
ucuguaguagguuguaguucuu

SEQ ID NO: 1119773 - RNA, 22 nt, Human
uccagggguaccggccaggcag

SEQ ID NO: 1119774 - RNA, 22 nt, Human
auacauauaugguacuuccugg

SEQ ID NO: 1119775 - RNA, 22 nt, Human
aggagcagaccguaguccugca

SEQ ID NO: 1119776 - RNA, 22 nt, Human
ccugggcaggaugggcccggug

SEQ ID NO: 1119777 - RNA, 22 nt, Human
aggcagcagggccacuggcuga

SEQ ID NO: 1119778 - RNA, 21 nt, Human
ucccacucuaaauggacugaa

SEQ ID NO: 1119779 - RNA, 22 nt, Human
agaagauuuagguugacgcuau

SEQ ID NO: 1119780 - RNA, 22 nt, Human
gccuucugaucgcuggacugac

SEQ ID NO: 1119781 - RNA, 22 nt, Human
cugggcagugcagcuauagaac

SEQ ID NO: 1119782 - RNA, 22 nt, Human
ccucccacuucuugcugagguc

SEQ ID NO: 1119783 - RNA, 22 nt, Human
ggcugcagaaguacuuccggau

SEQ ID NO: 1119784 - RNA, 22 nt, Human
gguggagcuguggacaggaagg

SEQ ID NO: 1119785 - RNA, 22 nt, Human
ucccaggguccucuucuggaau

SEQ ID NO: 1119786 - RNA, 22 nt, Human
ucagcugaaguggagaagcaga

SEQ ID NO: 1119787 - RNA, 22 nt, Human
gagcacagcuggagguagcauu

SEQ ID NO: 1119788 - RNA, 22 nt, Human
ucucaggguuuccugggggcug

SEQ ID NO: 1119789 - RNA, 22 nt, Human
aacaaauguaaaaugcagaugc

SEQ ID NO: 1119790 - RNA, 22 nt, Human
auuugucuagugguauucacgu

SEQ ID NO: 1119791 - RNA, 22 nt, Human
ggcucugcaugugagugggugg

SEQ ID NO: 1119792 - RNA, 22 nt, Human
gcagaagcugggcagcgaggug

SEQ ID NO: 1119793 - RNA, 22 nt, Human
ccucagagaaagguauggcuga

SEQ ID NO: 1119794 - RNA, 22 nt, Human
ugccaggcauauggccucuuug

SEQ ID NO: 1119795 - RNA, 22 nt, Human
agggguggccugccuuacuccc

SEQ ID NO: 1119796 - RNA, 22 nt, Human
ucaaaagucugcauucuucaca

SEQ ID NO: 1119797 - RNA, 22 nt, Human
gggcugacucugcacugagcca

SEQ ID NO: 1119798 - RNA, 22 nt, Human
acagaauuaaaguguuugugga

SEQ ID NO: 1119799 - RNA, 22 nt, Human
gaaaugcauggaucuuggcaga

SEQ ID NO: 1119800 - RNA, 22 nt, Human
gaaaucugaacaacagcuguca

SEQ ID NO: 1119801 - RNA, 22 nt, Human
ucucagaggucuucagccucug

SEQ ID NO: 1119802 - RNA, 22 nt, Human
cuucuccucugaguccugggag

SEQ ID NO: 1119803 - RNA, 22 nt, Human
ucccagggacucucugccuucc

SEQ ID NO: 1119804 - RNA, 22 nt, Human
aggaccaguaugagagcaucug

SEQ ID NO: 1119805 - RNA, 22 nt, Human
ugaacagaucaauagaacugac

SEQ ID NO: 1119806 - RNA, 22 nt, Human
uauguacauguuaaagggcaaa

SEQ ID NO: 1119807 - RNA, 22 nt, Human
gcacugcagccucagauggugg

SEQ ID NO: 1119808 - RNA, 22 nt, Human
uuagauaacaguagaauaucaa

SEQ ID NO: 1119809 - RNA, 22 nt, Human
ucauaaaacacaccagguaguu

SEQ ID NO: 1119810 - RNA, 22 nt, Human
agggaaagguagugaggucaca

SEQ ID NO: 1119811 - RNA, 22 nt, Human
caggccucuauggucagcugag

SEQ ID NO: 1119812 - RNA, 22 nt, Human
ugcagaggagcuggaaggcugg

SEQ ID NO: 1119813 - RNA, 22 nt, Human
ggcuucaccgcgggguugcagg

SEQ ID NO: 1119814 - RNA, 22 nt, Human
caagagcuggguggcaagcuag

SEQ ID NO: 1119815 - RNA, 22 nt, Human
gccuguccacuaaacagccaag

SEQ ID NO: 1119816 - RNA, 22 nt, Human
agccacaccuguccugccagcu

SEQ ID NO: 1119817 - RNA, 22 nt, Human
ccuggagccccucuggccagcc

SEQ ID NO: 1119818 - RNA, 22 nt, Human
cuggccugagaaugcuacccuu

SEQ ID NO: 1119819 - RNA, 22 nt, Human
guguggcugugggagauguuca

SEQ ID NO: 1119820 - RNA, 22 nt, Human
ugugcuucaucacuucucaguu

SEQ ID NO: 1119821 - RNA, 22 nt, Human
aggcagaggagaaugaucuucc

SEQ ID NO: 1119822 - RNA, 22 nt, Human
ugggcagaaggaagagccaccu

SEQ ID NO: 1119823 - RNA, 22 nt, Human
ugucccaguuuaucugggacug

SEQ ID NO: 1119824 - RNA, 22 nt, Human
uggcagggucuugcuguguugc

SEQ ID NO: 1119825 - RNA, 22 nt, Human
uguggucucguuauguugccca

SEQ ID NO: 1119826 - RNA, 22 nt, Human
caggcugggaacgccacccgcu

SEQ ID NO: 1119827 - RNA, 22 nt, Human
caggacaguuugcuuugcccug

SEQ ID NO: 1119828 - RNA, 22 nt, Human
cagggcagggagcuuagaauga

SEQ ID NO: 1119829 - RNA, 22 nt, Human
caagagcuuuagaaaugcucau

SEQ ID NO: 1119830 - RNA, 22 nt, Human
uagccucuggaauccuuucucu

SEQ ID NO: 1119831 - RNA, 22 nt, Human
gagcugggcacacgccacuuga

SEQ ID NO: 1119832 - RNA, 22 nt, Human
cacucugcagcugaagggcugg

SEQ ID NO: 1119833 - RNA, 22 nt, Human
aagggaggccagagguuuugca

SEQ ID NO: 1119834 - RNA, 22 nt, Human
aauguguagcauuuaaugcagu

SEQ ID NO: 1119835 - RNA, 22 nt, Human
uccacugcagcuucugauggaa

SEQ ID NO: 1119836 - RNA, 22 nt, Human
gggugggagucuggcccucaaa

SEQ ID NO: 1119837 - RNA, 22 nt, Human
gagucacaaagccuuucuuauu

SEQ ID NO: 1119838 - RNA, 22 nt, Human
ggaaaaggccauuguuucucug

SEQ ID NO: 1119839 - RNA, 22 nt, Human
gccugcuggcuguccauugcag

SEQ ID NO: 1119840 - RNA, 22 nt, Human
aaguaacaaugcuguugaauug

SEQ ID NO: 1119841 - RNA, 22 nt, Human
gacauuucaaucucauuauggg

SEQ ID NO: 1119842 - RNA, 22 nt, Human
cuggaagaggaagccagcugga

SEQ ID NO: 1119843 - RNA, 22 nt, Human
ugaggccacuuccccacagccc

SEQ ID NO: 1119844 - RNA, 22 nt, Human
ucagaggguggcugggagcauc

SEQ ID NO: 1119845 - RNA, 19 nt, Human
agcagagcagggccguggg

SEQ ID NO: 1119846 - RNA, 22 nt, Human
gcuccaggagagggaagcagau

SEQ ID NO: 1119847 - RNA, 22 nt, Human
acuggcagcuguaggaugcaug

SEQ ID NO: 1119848 - RNA, 22 nt, Human
uuagauaaauugcaacuugauu

SEQ ID NO: 1119849 - RNA, 22 nt, Human
gagagcugauagaugagcuacu

SEQ ID NO: 1119850 - RNA, 22 nt, Human
gcagagccaggcuggggcaggu

SEQ ID NO: 1119851 - RNA, 17 nt, Human
ucagcaggggccaagcu

SEQ ID NO: 1119852 - RNA, 22 nt, Human
ccucugcugcuguugagcaccg

SEQ ID NO: 1119853 - RNA, 22 nt, Human
acucugaggcaggucagggcag

SEQ ID NO: 1119854 - RNA, 22 nt, Human
cagagcugguaagugguagagg

SEQ ID NO: 1119855 - RNA, 22 nt, Human
gcugucuguucgagcguguguu

SEQ ID NO: 1119856 - RNA, 22 nt, Human
gccucaggacuggcauacucau

SEQ ID NO: 1119857 - RNA, 22 nt, Human
gccuccuggauuuuagugccau

SEQ ID NO: 1119858 - RNA, 22 nt, Human
gcagagccccucaagccagccu

SEQ ID NO: 1119859 - RNA, 22 nt, Human
ugggaggcagguaggugaugau

SEQ ID NO: 1119860 - RNA, 22 nt, Human
agcagagcuauucuugugcaau

SEQ ID NO: 1119861 - RNA, 22 nt, Human
augguuuguguggcccagauga

SEQ ID NO: 1119862 - RNA, 22 nt, Human
uagaaacugauagucuugugcu

SEQ ID NO: 1119863 - RNA, 22 nt, Human
gggugggaucuguggagccuca

SEQ ID NO: 1119864 - RNA, 22 nt, Human
cuguggcugcagccuugguccu

SEQ ID NO: 1119865 - RNA, 22 nt, Human
uggcagaguaggauggcccugu

SEQ ID NO: 1119866 - RNA, 19 nt, Human
uggcaggcccaggauggac

SEQ ID NO: 1119867 - RNA, 22 nt, Human
ucccuggaacagagagacaacg

SEQ ID NO: 1119868 - RNA, 22 nt, Human
ggcagcaguggcugcuauuguc

SEQ ID NO: 1119869 - RNA, 22 nt, Human
uggaggaugccauccaggauac

SEQ ID NO: 1119870 - RNA, 22 nt, Human
ugagaaccaugaaaagcuguca

SEQ ID NO: 1119871 - RNA, 20 nt, Human
agcuggccuguccuaggccu

SEQ ID NO: 1119872 - RNA, 22 nt, Human
uggcucagagcagggacucugg

SEQ ID NO: 1119873 - RNA, 17 nt, Human
ugcauuguuggaaauuu

SEQ ID NO: 1119874 - RNA, 22 nt, Human
caucuggcuagcuaucauugug

SEQ ID NO: 1119875 - RNA, 22 nt, Human
caggcagcagccacucugguau

SEQ ID NO: 1119876 - RNA, 22 nt, Human
uauuucugaauccaaaagguca

SEQ ID NO: 1119877 - RNA, 22 nt, Human
cagagccugcucacgucucugu

SEQ ID NO: 1119878 - RNA, 22 nt, Human
gcaugggcaagaggacuggggg

SEQ ID NO: 1119879 - RNA, 22 nt, Human
augggaguuuucucugaugcuc

SEQ ID NO: 1119880 - RNA, 22 nt, Human
aagggcuggaucucucugagca

SEQ ID NO: 1119881 - RNA, 22 nt, Human
ggaaggaggggcaaagcaguuc

SEQ ID NO: 1119882 - RNA, 22 nt, Human
ggcacugauaauguccucucuc

SEQ ID NO: 1119883 - RNA, 22 nt, Human
ccaggcugcuuagccuuaucuu

SEQ ID NO: 1119884 - RNA, 22 nt, Human
aauguuaaaaccuucagugcuu

SEQ ID NO: 1119885 - RNA, 22 nt, Human
uggggcuguccuuagucugaga

SEQ ID NO: 1119886 - RNA, 22 nt, Human
accaaggaagagauucucaguu

SEQ ID NO: 1119887 - RNA, 23 nt, Human
gcagauggccccagagugcugcc

SEQ ID NO: 1119888 - RNA, 22 nt, Human
ugcaagagguaaaaugaaagga

SEQ ID NO: 1119889 - RNA, 22 nt, Human
cucugagagcggucuguggcuu

SEQ ID NO: 1119890 - RNA, 22 nt, Human
caucagcaggcaacacucuugg

SEQ ID NO: 1119891 - RNA, 22 nt, Human
cugccagguuggcgcucgcucu

SEQ ID NO: 1119892 - RNA, 22 nt, Human
cuggaaugccucccugucagag

SEQ ID NO: 1119893 - RNA, 22 nt, Human
cccugccuacaggguuuucuuu

SEQ ID NO: 1119894 - RNA, 22 nt, Human
cucugcagaauuugagcugcuc

SEQ ID NO: 1119895 - RNA, 22 nt, Human
gggagggaggugaugcuuggcu

SEQ ID NO: 1119896 - RNA, 22 nt, Human
uaaagucaucuuuacaucuuug

SEQ ID NO: 1119897 - RNA, 22 nt, Human
ucccaggacaggccacauggaa

SEQ ID NO: 1119898 - RNA, 22 nt, Human
uauuuugacuauuaaaccaaca

SEQ ID NO: 1119899 - RNA, 22 nt, Human
acgcagaagggccuggcgugcc

SEQ ID NO: 1119900 - RNA, 23 nt, Human
uggcucugugucacauacaggau

SEQ ID NO: 1119901 - RNA, 21 nt, Human
gagcucucaggcaagaagcag

SEQ ID NO: 1119902 - RNA, 22 nt, Human
ggcagggugccuggcuccuguu

SEQ ID NO: 1119903 - RNA, 22 nt, Human
ugaaaucuuauacuuugguagu

SEQ ID NO: 1119904 - RNA, 22 nt, Human
gcuggcagguccaagauagagc

SEQ ID NO: 1119905 - RNA, 18 nt, Human
ggcugugcguggaggcug

SEQ ID NO: 1119906 - RNA, 22 nt, Human
acguuuucuagagaauaugcag

SEQ ID NO: 1119907 - RNA, 22 nt, Human
agcagcuccugccaugagugcu

SEQ ID NO: 1119908 - RNA, 22 nt, Human
ucagcaguguaguuuaucauuc

SEQ ID NO: 1119909 - RNA, 22 nt, Human
uacaaaugaaccaacuuugaug

SEQ ID NO: 1119910 - RNA, 22 nt, Human
ccagucccgcaugguccagaau

SEQ ID NO: 1119911 - RNA, 22 nt, Human
caaaugcaaaauauaacccugu

SEQ ID NO: 1119912 - RNA, 19 nt, Human
gcaugcuugguggcuucug

SEQ ID NO: 1119913 - RNA, 22 nt, Human
cugugccaggcccagcugacuu

SEQ ID NO: 1119914 - RNA, 22 nt, Human
acaaacuaccuacagauguuca

SEQ ID NO: 1119915 - RNA, 22 nt, Human
cagcuggguuuaguggggugug

SEQ ID NO: 1119916 - RNA, 22 nt, Human
cagucccagacauaguaaggga

SEQ ID NO: 1119917 - RNA, 18 nt, Human
gagacacaagggccugga

SEQ ID NO: 1119918 - RNA, 19 nt, Human
uuacaucugcaacacuggu

SEQ ID NO: 1119919 - RNA, 22 nt, Human
cuguccccgcgaguccagagcu

SEQ ID NO: 1119920 - RNA, 23 nt, Human
gcucugagggcuuaucccuccca

SEQ ID NO: 1119921 - RNA, 22 nt, Human
augaagcuaaacccugcagcca

SEQ ID NO: 1119922 - RNA, 22 nt, Human
gccuugccucagccauggaaac

SEQ ID NO: 1119923 - RNA, 22 nt, Human
aaaugcauugguuucuacuugu

SEQ ID NO: 1119924 - RNA, 22 nt, Human
uucucuuagcuguaaagucaau

SEQ ID NO: 1119925 - RNA, 22 nt, Human
uggcagcaauuugugauguuga

SEQ ID NO: 1119926 - RNA, 22 nt, Human
cuagaaauacaggcacgugcca

SEQ ID NO: 1119927 - RNA, 22 nt, Human
cuggcagcauuaacagagagca

SEQ ID NO: 1119928 - RNA, 22 nt, Human
cugccucuguugggcauggucu

SEQ ID NO: 1119929 - RNA, 22 nt, Human
gugcaguggcagauccuagcuc

SEQ ID NO: 1119930 - RNA, 22 nt, Human
cugcaggaauucaaagugagcu

SEQ ID NO: 1119931 - RNA, 22 nt, Human
gaggcagcugaaggagugacag

SEQ ID NO: 1119932 - RNA, 17 nt, Human
cauguguaugugggagu

SEQ ID NO: 1119933 - RNA, 22 nt, Human
auauucguggucaaguaaggcc

SEQ ID NO: 1119934 - RNA, 22 nt, Human
ugcucugggcaacagccucccu

SEQ ID NO: 1119935 - RNA, 22 nt, Human
aucaguuucuaccauguggaau

SEQ ID NO: 1119936 - RNA, 22 nt, Human
ccuuccuggagcccaugcagau

SEQ ID NO: 1119937 - RNA, 22 nt, Human
ggggugggguuacucauugugc

SEQ ID NO: 1119938 - RNA, 18 nt, Human
agcagaauucuaggguuc

SEQ ID NO: 1119939 - RNA, 22 nt, Human
cccuggaguccggagcucaccu

SEQ ID NO: 1119940 - RNA, 22 nt, Human
caaagguauaaguuaauauaca

SEQ ID NO: 1119941 - RNA, 22 nt, Human
acagagcugggaucugaaccca

SEQ ID NO: 1119942 - RNA, 22 nt, Human
uguuucagucccuguguucaau

SEQ ID NO: 1119943 - RNA, 22 nt, Human
cucugguguccuuuagaauuua

SEQ ID NO: 1119944 - RNA, 22 nt, Human
ugcagcucauugcuggggucug

SEQ ID NO: 1119945 - RNA, 22 nt, Human
ggggaugguggcauuuguaaaa

SEQ ID NO: 1119946 - RNA, 22 nt, Human
auucugucuuuuuaaaauaaua

SEQ ID NO: 1119947 - RNA, 22 nt, Human
aaggaagggaaauagugauguc

SEQ ID NO: 1119948 - RNA, 22 nt, Human
agugaaauggaugcugcuacug

SEQ ID NO: 1119949 - RNA, 22 nt, Human
gcagauggcugagccugcagau

SEQ ID NO: 1119950 - RNA, 22 nt, Human
ugacucuguaccugucugccuu

SEQ ID NO: 1119951 - RNA, 22 nt, Human
uugaaggacauccuauuucuag

SEQ ID NO: 1119952 - RNA, 22 nt, Human
cuggcugggagcgagcugcuca

SEQ ID NO: 1119953 - RNA, 22 nt, Human
aucagcaaguccuguuaauucu

SEQ ID NO: 1119954 - RNA, 16 nt, Human
uggaaggggucuccgg

SEQ ID NO: 1119955 - RNA, 21 nt, Human
uagggcaggcauuggaagaga

SEQ ID NO: 1119956 - RNA, 22 nt, Human
auaucacaaacaagucuguacu

SEQ ID NO: 1119957 - RNA, 22 nt, Human
gccugcuggauguggccaggcc

SEQ ID NO: 1119958 - RNA, 22 nt, Human
gcaggagagucugugccagguu

SEQ ID NO: 1119959 - RNA, 22 nt, Human
gacccagcuuaagucacauguu

SEQ ID NO: 1119960 - RNA, 22 nt, Human
uuguuuucacagcuuugcccgg

SEQ ID NO: 1119961 - RNA, 22 nt, Human
uaggaaaaauacagaauuauau

SEQ ID NO: 1119962 - RNA, 19 nt, Human
aggcucugagcuccuggag

SEQ ID NO: 1119963 - RNA, 22 nt, Human
gcagauggaaagugcuugaggg

SEQ ID NO: 1119964 - RNA, 22 nt, Human
gggcaggaugcaguuucagaga

SEQ ID NO: 1119965 - RNA, 22 nt, Human
agggaaauuaaugugagcaaug

SEQ ID NO: 1119966 - RNA, 20 nt, Human
cccuggagagaagcuccacg

SEQ ID NO: 1119967 - RNA, 22 nt, Human
ggugaggggagagugaaagaaa

SEQ ID NO: 1119968 - RNA, 22 nt, Human
aggucauugaaguuauuuucuu

SEQ ID NO: 1119969 - RNA, 22 nt, Human
uacauaguauucacauuguuuu

SEQ ID NO: 1119970 - RNA, 22 nt, Human
aaguaaaagcuuuaccaugcgc

SEQ ID NO: 1119971 - RNA, 21 nt, Human
gcaggggauagaaauggucug

SEQ ID NO: 1119972 - RNA, 22 nt, Human
ggggaugguagaccggugacgu

SEQ ID NO: 1119973 - RNA, 22 nt, Human
uggcucugagacacaggcucuc

SEQ ID NO: 1119974 - RNA, 22 nt, Human
cucucugaggcaggccuguggg

SEQ ID NO: 1119975 - RNA, 22 nt, Human
auauaaaguguuuagaaagcug

SEQ ID NO: 1119976 - RNA, 20 nt, Human
gcugaggucauuaugccuca

SEQ ID NO: 1119977 - RNA, 22 nt, Human
auuccaguucuccucucuaaag

SEQ ID NO: 1119978 - RNA, 22 nt, Human
aaaugaacucuuccugcauccc

SEQ ID NO: 1119979 - RNA, 22 nt, Human
cauugcaccacauugcaucccu

SEQ ID NO: 1119980 - RNA, 22 nt, Human
gcagcugaauguccauugcugc

SEQ ID NO: 1119981 - RNA, 22 nt, Human
gauuuccuugcauauugguaau

SEQ ID NO: 1119982 - RNA, 22 nt, Human
agagcagauggccagggggccu

SEQ ID NO: 1119983 - RNA, 22 nt, Human
gcugucacucuccggccuuccc

SEQ ID NO: 1119984 - RNA, 22 nt, Human
cccuggccagcucaugucugag

SEQ ID NO: 1119985 - RNA, 22 nt, Human
cugguucauccccuuccaggaa

SEQ ID NO: 1119986 - RNA, 21 nt, Human
aaacugaccuugccugagaca

SEQ ID NO: 1119987 - RNA, 22 nt, Human
uguccucaaggagcuucagucu

SEQ ID NO: 1119988 - RNA, 22 nt, Human
cagcugaguuuccaagucugcc

SEQ ID NO: 1119989 - RNA, 22 nt, Human
uggcaggagguuuucuccagga

SEQ ID NO: 1119990 - RNA, 22 nt, Human
aaauguauugcauaggauauuu

SEQ ID NO: 1119991 - RNA, 22 nt, Human
gauacaaauucaugucugaauu

SEQ ID NO: 1119992 - RNA, 22 nt, Human
ucuucucaguuucucuaggaug

SEQ ID NO: 1119993 - RNA, 22 nt, Human
ccaggccugauugggaaucuug

SEQ ID NO: 1119994 - RNA, 22 nt, Human
guccuggggaauacagaagccg

SEQ ID NO: 1119995 - RNA, 22 nt, Human
uggugcugauaauggcaggauu

SEQ ID NO: 1119996 - RNA, 22 nt, Human
ucacagaaauaagauaguuauu

SEQ ID NO: 1119997 - RNA, 22 nt, Human
ucaggcaguagaauugcuugaa

SEQ ID NO: 1119998 - RNA, 18 nt, Human
acagaacucaggggcacc

SEQ ID NO: 1119999 - RNA, 22 nt, Human
ggcaccuggagguuuacuggau

SEQ ID NO: 1120000 - RNA, 22 nt, Human
ggcucagguuuaaagugcuuua

SEQ ID NO: 1120001 - RNA, 22 nt, Human
uccuucaaagcuccuagugagc

SEQ ID NO: 1120002 - RNA, 22 nt, Human
auaugcauaugucaaaacuuau

SEQ ID NO: 1120003 - RNA, 22 nt, Human
ucacauuuucuacuacuguacg

SEQ ID NO: 1120004 - RNA, 22 nt, Human
guuacacaggaaaacauuagca

SEQ ID NO: 1120005 - RNA, 22 nt, Human
ucccagcccagauuugugugac

SEQ ID NO: 1120006 - RNA, 22 nt, Human
cagacacagauaugcauauggc

SEQ ID NO: 1120007 - RNA, 22 nt, Human
ccuggccugcucggcucuuaag

SEQ ID NO: 1120008 - RNA, 22 nt, Human
ugucacauugaauaugauuuau

SEQ ID NO: 1120009 - RNA, 22 nt, Human
ucacugcaaccucugccuuccg

SEQ ID NO: 1120010 - RNA, 22 nt, Human
ccaaggcuccucagcuggucuu

SEQ ID NO: 1120011 - RNA, 22 nt, Human
cugggcagugguggcccuuccc

SEQ ID NO: 1120012 - RNA, 21 nt, Human
agaugcugugcuccaggagca

SEQ ID NO: 1120013 - RNA, 21 nt, Human
aagccucaagcagaagacaga

SEQ ID NO: 1120014 - RNA, 22 nt, Human
gccugcagccucaagggcugag

SEQ ID NO: 1120015 - RNA, 22 nt, Human
uggagcugacucacaccagcua

SEQ ID NO: 1120016 - RNA, 22 nt, Human
ugucaccagcugcuccucagga

SEQ ID NO: 1120017 - RNA, 22 nt, Human
agguggagacccagagaaggcg

SEQ ID NO: 1120018 - RNA, 22 nt, Human
caaacugagcaucagaaaguuu

SEQ ID NO: 1120019 - RNA, 22 nt, Human
cugccagcagaggccagcgcug

SEQ ID NO: 1120020 - RNA, 22 nt, Human
cugaaggacacgugaggagcca

SEQ ID NO: 1120021 - RNA, 19 nt, Human
acccucucagugccugagg

SEQ ID NO: 1120022 - RNA, 22 nt, Human
uuccauaauaggcuuaagugaa

SEQ ID NO: 1120023 - RNA, 22 nt, Human
cagcucuggcgucagggagcga

SEQ ID NO: 1120024 - RNA, 22 nt, Human
agguggccggugccagccgggc

SEQ ID NO: 1120025 - RNA, 22 nt, Human
uaacagaaguuguucauugugg

SEQ ID NO: 1120026 - RNA, 22 nt, Human
ugcucuccggcuuccguggccu

SEQ ID NO: 1120027 - RNA, 22 nt, Human
gaagcagcgaaguggaagggac

SEQ ID NO: 1120028 - RNA, 22 nt, Human
ccuggagcacucucccuggcug

SEQ ID NO: 1120029 - RNA, 22 nt, Human
agccuggaauuaaggaaaugca

SEQ ID NO: 1120030 - RNA, 22 nt, Human
uugcucuguaauaaucuggggu

SEQ ID NO: 1120031 - RNA, 22 nt, Human
auguccuucuccucuuaccugc

SEQ ID NO: 1120032 - RNA, 22 nt, Human
uuugacaguaauaaagcacaag

SEQ ID NO: 1120033 - RNA, 22 nt, Human
agagcagcacguuguccccaca

SEQ ID NO: 1120034 - RNA, 19 nt, Human
uggcagcauugguaccuug

SEQ ID NO: 1120035 - RNA, 22 nt, Human
ugagacaguucugcagcugggu

SEQ ID NO: 1120036 - RNA, 22 nt, Human
gaagaacaagcagugcuuuccu

SEQ ID NO: 1120037 - RNA, 21 nt, Human
aagcaggacauaugaugcccu

SEQ ID NO: 1120038 - RNA, 22 nt, Human
gcucugaggcugggagcacucu

SEQ ID NO: 1120039 - RNA, 22 nt, Human
cagaacauucacucauaugugg

SEQ ID NO: 1120040 - RNA, 22 nt, Human
gggagggaaagcuugaucuguc

SEQ ID NO: 1120041 - RNA, 22 nt, Human
gggcacagagggucuugaagaa

SEQ ID NO: 1120042 - RNA, 19 nt, Human
uguguaaagucugugguca

SEQ ID NO: 1120043 - RNA, 22 nt, Human
accucugcuucccggguucaag

SEQ ID NO: 1120044 - RNA, 22 nt, Human
gagagcuguaauagucaugucu

SEQ ID NO: 1120045 - RNA, 22 nt, Human
uuuugucuaagaacuuugcaaa

SEQ ID NO: 1120046 - RNA, 22 nt, Human
gcacccaggcuugggcagcaac

SEQ ID NO: 1120047 - RNA, 18 nt, Human
cauuguacaaugcuuuau

SEQ ID NO: 1120048 - RNA, 22 nt, Human
ucucuggagcugcagauccagg

SEQ ID NO: 1120049 - RNA, 22 nt, Human
gagcagaacuacucacauaucg

SEQ ID NO: 1120050 - RNA, 22 nt, Human
uggcucaggagggaucuuugcu

SEQ ID NO: 1120051 - RNA, 22 nt, Human
aagaacugugcuccaggcucca

SEQ ID NO: 1120052 - RNA, 22 nt, Human
ccugggcucaagugauccuccu

SEQ ID NO: 1120053 - RNA, 22 nt, Human
acauuucucuuagaguuggacu

SEQ ID NO: 1120054 - RNA, 22 nt, Human
guggccuggaaaggcuggucug

SEQ ID NO: 1120055 - RNA, 22 nt, Human
gugugccaggaacuggcugcug

SEQ ID NO: 1120056 - RNA, 18 nt, Human
ugacagaaccuggagccu

SEQ ID NO: 1120057 - RNA, 22 nt, Human
ggcugcagggcagcuggugugg

SEQ ID NO: 1120058 - RNA, 22 nt, Human
ggccagaaaguuaagcuguggc

SEQ ID NO: 1120059 - RNA, 22 nt, Human
accaaggaagaaucuauuugag

SEQ ID NO: 1120060 - RNA, 22 nt, Human
aggcccugcccagugccacaag

SEQ ID NO: 1120061 - RNA, 22 nt, Human
uagcugccuaugugauaagaga

SEQ ID NO: 1120062 - RNA, 22 nt, Human
aaauugugagcuauagaucuag

SEQ ID NO: 1120063 - RNA, 22 nt, Human
ccugucuggccaccagggcgau

SEQ ID NO: 1120064 - RNA, 22 nt, Human
uucuuucccaguagaugugaaa

SEQ ID NO: 1120065 - RNA, 22 nt, Human
gggccagagcuuggcagcuggg

SEQ ID NO: 1120066 - RNA, 22 nt, Human
cccagcucaagcagagagcuaa

SEQ ID NO: 1120067 - RNA, 22 nt, Human
gccccugggagcagagccacca

SEQ ID NO: 1120068 - RNA, 22 nt, Human
agagcuggacgucugagcccua

SEQ ID NO: 1120069 - RNA, 22 nt, Human
cuggcuccauccuugagcucug

SEQ ID NO: 1120070 - RNA, 22 nt, Human
agcagagaagacacaggcuuca

SEQ ID NO: 1120071 - RNA, 22 nt, Human
ugcaucuuacguuuugaaaggg

SEQ ID NO: 1120072 - RNA, 22 nt, Human
gccagggggucagcaggcacuu

SEQ ID NO: 1120073 - RNA, 22 nt, Human
agagcuguuuggacaucugagu

SEQ ID NO: 1120074 - RNA, 22 nt, Human
uggcucagcuuuccccaucugg

SEQ ID NO: 1120075 - RNA, 22 nt, Human
aaggccugggaguacugggaca

SEQ ID NO: 1120076 - RNA, 22 nt, Human
uacaguagacaauguuaguaug

SEQ ID NO: 1120077 - RNA, 22 nt, Human
aguucacauuccgagguacugg

SEQ ID NO: 1120078 - RNA, 22 nt, Human
aauguguguauuucuaggcgag

SEQ ID NO: 1120079 - RNA, 22 nt, Human
acaggugggcuuaagagucggc

SEQ ID NO: 1120080 - RNA, 22 nt, Human
ggguguguuccuaaggaaacca

SEQ ID NO: 1120081 - RNA, 22 nt, Human
uggcccugcuaugauccugcaa

SEQ ID NO: 1120082 - RNA, 21 nt, Human
uccagggaacuucucaggaau

SEQ ID NO: 1120083 - RNA, 20 nt, Human
cccagccccuaccuguugcc

SEQ ID NO: 1120084 - RNA, 22 nt, Human
uggcucaguagcagugugguca

SEQ ID NO: 1120085 - RNA, 22 nt, Human
uaaaugcaguuaguacuugcca

SEQ ID NO: 1120086 - RNA, 22 nt, Human
caggguccaucuuucaucacug

SEQ ID NO: 1120087 - RNA, 22 nt, Human
gugccugcagcaauccauggca

SEQ ID NO: 1120088 - RNA, 22 nt, Human
guggcugggcuccgagcggcuu

SEQ ID NO: 1120089 - RNA, 22 nt, Human
agggcugcaccggggcuucgcg

SEQ ID NO: 1120090 - RNA, 22 nt, Human
cuucaagagaaugcagggaugu

SEQ ID NO: 1120091 - RNA, 22 nt, Human
uccuggagggaggcggugcuac

SEQ ID NO: 1120092 - RNA, 22 nt, Human
auguacauuuguaguaauauca

SEQ ID NO: 1120093 - RNA, 22 nt, Human
ucauugcagaaauaaaggugaa

SEQ ID NO: 1120094 - RNA, 22 nt, Human
gcugcuucucugauggagucca

SEQ ID NO: 1120095 - RNA, 22 nt, Human
ucuuuucuggacucugcaugga

SEQ ID NO: 1120096 - RNA, 22 nt, Human
cagaacugggcagggagcagag

SEQ ID NO: 1120097 - RNA, 22 nt, Human
uucugaggcacuggcucuccca

SEQ ID NO: 1120098 - RNA, 22 nt, Human
ggcugggcaaacaagacucuuc

SEQ ID NO: 1120099 - RNA, 22 nt, Human
cuggcagcgcagcaugaagucg

SEQ ID NO: 1120100 - RNA, 22 nt, Human
uuguuuuggagaugagcuaaaa

SEQ ID NO: 1120101 - RNA, 22 nt, Human
aaaaguuaccucuguaauauaa

SEQ ID NO: 1120102 - RNA, 22 nt, Human
gggauggggucaacauguaccu

SEQ ID NO: 1120103 - RNA, 22 nt, Human
gacugucauucuagugcccaug

SEQ ID NO: 1120104 - RNA, 22 nt, Human
uuucacauuuuauacuuaagcc

SEQ ID NO: 1120105 - RNA, 22 nt, Human
ucugugaacaucacauugacag

SEQ ID NO: 1120106 - RNA, 22 nt, Human
gcuggagauaguaggauccaua

SEQ ID NO: 1120107 - RNA, 22 nt, Human
ucagaguguggugagaugugca

SEQ ID NO: 1120108 - RNA, 22 nt, Human
agccuggagguaaugaggaaac

SEQ ID NO: 1120109 - RNA, 22 nt, Human
ucucaggaauagaguggcagca

SEQ ID NO: 1120110 - RNA, 22 nt, Human
ugagcccagucugucugacaug

SEQ ID NO: 1120111 - RNA, 22 nt, Human
gugcaugucggggugcauguca

SEQ ID NO: 1120112 - RNA, 22 nt, Human
uacauauagacaguuacucuag

SEQ ID NO: 1120113 - RNA, 22 nt, Human
gaggcagcagggcugguuccuu

SEQ ID NO: 1120114 - RNA, 22 nt, Human
caggccuggcugcagcucgccu

SEQ ID NO: 1120115 - RNA, 22 nt, Human
agagcucaagacgcucacagua

SEQ ID NO: 1120116 - RNA, 22 nt, Human
uuaugcuaagugcaacaagcca

SEQ ID NO: 1120117 - RNA, 22 nt, Human
ugggggugaaagucuggacagu

SEQ ID NO: 1120118 - RNA, 19 nt, Human
uugcauuguaguuggacug

SEQ ID NO: 1120119 - RNA, 19 nt, Human
ggcugucuggcguguggau

SEQ ID NO: 1120120 - RNA, 22 nt, Human
agcaggguuccaggaguugcag

SEQ ID NO: 1120121 - RNA, 22 nt, Human
auucuucacuguuucagaauga

SEQ ID NO: 1120122 - RNA, 22 nt, Human
acagggccucagcugauucugg

SEQ ID NO: 1120123 - RNA, 22 nt, Human
gccugggagggcagcagugugg

SEQ ID NO: 1120124 - RNA, 22 nt, Human
gcaggguauaauacuuagguga

SEQ ID NO: 1120125 - RNA, 22 nt, Human
uuuuccuacugauaaacaguua

SEQ ID NO: 1120126 - RNA, 22 nt, Human
cagcuggcccuuugguagccuu

SEQ ID NO: 1120127 - RNA, 22 nt, Human
cugggccagauccagccucaca

SEQ ID NO: 1120128 - RNA, 22 nt, Human
uucuugauuucaugcaguuaag

SEQ ID NO: 1120129 - RNA, 22 nt, Human
gcugucucggggcuuucuccug

SEQ ID NO: 1120130 - RNA, 22 nt, Human
auucuguauggaaaagcacuau

SEQ ID NO: 1120131 - RNA, 22 nt, Human
acauuuguaugcguuuuuacug

SEQ ID NO: 1120132 - RNA, 22 nt, Human
ugcugcucuguaaagugaugag

SEQ ID NO: 1120133 - RNA, 22 nt, Human
gccuggagggauagaaugcaag

SEQ ID NO: 1120134 - RNA, 22 nt, Human
agggccaggaacaccugaaggg

SEQ ID NO: 1120135 - RNA, 22 nt, Human
ugauuuuuagcuauucugaaga

SEQ ID NO: 1120136 - RNA, 22 nt, Human
gccuggagacagcagaggcggc

SEQ ID NO: 1120137 - RNA, 22 nt, Human
uauguagaagcugcucaaagaa

SEQ ID NO: 1120138 - RNA, 22 nt, Human
agcagcagauccaaaaaaugug

SEQ ID NO: 1120139 - RNA, 21 nt, Human
uaagaacauuaucuucuuccu

SEQ ID NO: 1120140 - RNA, 22 nt, Human
ugucucugguauuaggugaaaa

SEQ ID NO: 1120141 - RNA, 22 nt, Human
cggggcuguagcacagcugagc

SEQ ID NO: 1120142 - RNA, 20 nt, Human
uccuucaggcagggccuagu

SEQ ID NO: 1120143 - RNA, 22 nt, Human
gcaguggcaccgcuggcucugg

SEQ ID NO: 1120144 - RNA, 22 nt, Human
cuagagaggcagauguccugug

SEQ ID NO: 1120145 - RNA, 22 nt, Human
caggaaaggugugucaugaugg

SEQ ID NO: 1120146 - RNA, 22 nt, Human
cacauccuucagcugagcccag

SEQ ID NO: 1120147 - RNA, 22 nt, Human
cccagcucugcagaccugcccu

SEQ ID NO: 1120148 - RNA, 23 nt, Human
ggcagcucucaucugaugacuga

SEQ ID NO: 1120149 - RNA, 22 nt, Human
agugguaacuaaguccugcuua

SEQ ID NO: 1120150 - RNA, 22 nt, Human
gcucugcugcuuacuagauggu

SEQ ID NO: 1120151 - RNA, 22 nt, Human
uguuuauaccuugguauaacca

SEQ ID NO: 1120152 - RNA, 18 nt, Human
agcagcugugccacacug

SEQ ID NO: 1120153 - RNA, 22 nt, Human
cuucccuuggugaacagagcau

SEQ ID NO: 1120154 - RNA, 18 nt, Human
cagucccaaaccuuagga

SEQ ID NO: 1120155 - RNA, 22 nt, Human
caggaccuggaaugcuugugaa

SEQ ID NO: 1120156 - RNA, 22 nt, Human
cugggugaguugaugaaggaga

SEQ ID NO: 1120157 - RNA, 22 nt, Human
caggcugucugaauggaggccc

SEQ ID NO: 1120158 - RNA, 22 nt, Human
auacaucucauguaagagauaa

SEQ ID NO: 1120159 - RNA, 23 nt, Human
gucagggcuggggucagagugac

SEQ ID NO: 1120160 - RNA, 22 nt, Human
gaaugugugacucuauugagca

SEQ ID NO: 1120161 - RNA, 22 nt, Human
gugauuucuaaucaucugaaug

SEQ ID NO: 1120162 - RNA, 22 nt, Human
uggaagcaucacuucuugccug

SEQ ID NO: 1120163 - RNA, 22 nt, Human
ccugccagggccuuggaagaaa

SEQ ID NO: 1120164 - RNA, 22 nt, Human
ggagucccagcaaagccuuccc

SEQ ID NO: 1120165 - RNA, 19 nt, Human
gcucugagaggggcauggg

SEQ ID NO: 1120166 - RNA, 21 nt, Human
ugcaugcuauguuuuuauuuc

SEQ ID NO: 1120167 - RNA, 22 nt, Human
uuagauaaauuaagacuuuaca

SEQ ID NO: 1120168 - RNA, 22 nt, Human
agcuguguguuuccacugagcu

SEQ ID NO: 1120169 - RNA, 21 nt, Human
acagccugucaucucaugguc

SEQ ID NO: 1120170 - RNA, 22 nt, Human
gucugaggaagaugcaggggga

SEQ ID NO: 1120171 - RNA, 22 nt, Human
uggggcuggggaucuugagccu

SEQ ID NO: 1120172 - RNA, 22 nt, Human
gauuuccucacuaacauccauc

SEQ ID NO: 1120173 - RNA, 22 nt, Human
aucuucaacuugaucauuugaa

SEQ ID NO: 1120174 - RNA, 22 nt, Human
ccaggccucccuuuuccagcca

SEQ ID NO: 1120175 - RNA, 22 nt, Human
agcugauuccacuuuuucccca

SEQ ID NO: 1120176 - RNA, 22 nt, Human
cagagccagaacuagaccuugu

SEQ ID NO: 1120177 - RNA, 18 nt, Human
acauuucuaggugaaagc

SEQ ID NO: 1120178 - RNA, 23 nt, Human
aaaguguagccagguuaagaacc

SEQ ID NO: 1120179 - RNA, 22 nt, Human
ugccugaguuuaacccucagag

SEQ ID NO: 1120180 - RNA, 22 nt, Human
gcaccacaucaaugaggggagc

SEQ ID NO: 1120181 - RNA, 22 nt, Human
ccaaaguccacaguuuacauua

SEQ ID NO: 1120182 - RNA, 22 nt, Human
cagagagaggccacugcuauua

SEQ ID NO: 1120183 - RNA, 20 nt, Human
gccuggcacccggggcuggc

SEQ ID NO: 1120184 - RNA, 22 nt, Human
accaucagagcacaguccgugc

SEQ ID NO: 1120185 - RNA, 22 nt, Human
agauaacuuuuggguauucaug

SEQ ID NO: 1120186 - RNA, 22 nt, Human
caagagcauuuaguuagcuggu

SEQ ID NO: 1120187 - RNA, 22 nt, Human
gccugcagggugaugggcugcc

SEQ ID NO: 1120188 - RNA, 22 nt, Human
aggucauuguuaagucaccaua

SEQ ID NO: 1120189 - RNA, 22 nt, Human
cagggaguuuuuguuccucuag

SEQ ID NO: 1120190 - RNA, 22 nt, Human
ccuggagggcgccgcacagucc

SEQ ID NO: 1120191 - RNA, 22 nt, Human
aggcacuggguaauuaguagcu

SEQ ID NO: 1120192 - RNA, 22 nt, Human
cugggagcuagcucugagcuga

SEQ ID NO: 1120193 - RNA, 22 nt, Human
ugaacauauucaccucuaaaua

SEQ ID NO: 1120194 - RNA, 22 nt, Human
caggcagagugagguggucuaa

SEQ ID NO: 1120195 - RNA, 22 nt, Human
cugggaggcaccgcgucgugcu

SEQ ID NO: 1120196 - RNA, 22 nt, Human
uccagugguaguaaagaggucu

SEQ ID NO: 1120197 - RNA, 22 nt, Human
auggggugaccaugagcauuua

SEQ ID NO: 1120198 - RNA, 22 nt, Human
cagguggguacaucacagagac

SEQ ID NO: 1120199 - RNA, 22 nt, Human
aagagcuggaugaagaaaucaa

SEQ ID NO: 1120200 - RNA, 22 nt, Human
gggcugggaauggcuaaguaug

SEQ ID NO: 1120201 - RNA, 22 nt, Human
uugaggagcacuagucagguau

SEQ ID NO: 1120202 - RNA, 22 nt, Human
aaaguuugaaugauauauuagu

SEQ ID NO: 1120203 - RNA, 22 nt, Human
ugggcugcggauaggccucgga

SEQ ID NO: 1120204 - RNA, 22 nt, Human
ccaggccuagccccugagggua

SEQ ID NO: 1120205 - RNA, 23 nt, Human
gcugucaguuguuuuugucucua

SEQ ID NO: 1120206 - RNA, 22 nt, Human
aagagcuggaguuugcagcccu

SEQ ID NO: 1120207 - RNA, 22 nt, Human
gcuggcugaggucuagcucuuu

SEQ ID NO: 1120208 - RNA, 20 nt, Human
uagauuucauacuucucuuu

SEQ ID NO: 1120209 - RNA, 22 nt, Human
cuccagggggcauccacacagc

SEQ ID NO: 1120210 - RNA, 22 nt, Human
uaaagaacacagggaauagcac

SEQ ID NO: 1120211 - RNA, 22 nt, Human
agugaccauuuucagcuagagg

SEQ ID NO: 1120212 - RNA, 22 nt, Human
ucauugcaggcauuccccugcc

SEQ ID NO: 1120213 - RNA, 22 nt, Human
cuggguggcuguccagccagcc

SEQ ID NO: 1120214 - RNA, 22 nt, Human
ucagggcaaaagggaaaccauu

SEQ ID NO: 1120215 - RNA, 22 nt, Human
ucaggauccauagacucccaaa

SEQ ID NO: 1120216 - RNA, 19 nt, Human
agcagagcccugaagaucc

SEQ ID NO: 1120217 - RNA, 22 nt, Human
uuacaucuaaacugugaacaau

SEQ ID NO: 1120218 - RNA, 22 nt, Human
auuuguagugaagugaaaauaa

SEQ ID NO: 1120219 - RNA, 21 nt, Human
agaagccuggguggagguggg

SEQ ID NO: 1120220 - RNA, 20 nt, Human
gcaaggcacagugaggaggg

SEQ ID NO: 1120221 - RNA, 22 nt, Human
gccucugcucggacuuugccuc

SEQ ID NO: 1120222 - RNA, 22 nt, Human
cuggccuagcucucugcuugaa

SEQ ID NO: 1120223 - RNA, 22 nt, Human
agagcagugcugaagaguaggg

SEQ ID NO: 1120224 - RNA, 22 nt, Human
aguguugucaaacggcucagca

SEQ ID NO: 1120225 - RNA, 22 nt, Human
ucuguucuauuggucuaugugu

SEQ ID NO: 1120226 - RNA, 22 nt, Human
ggagugacucucggggccacua

SEQ ID NO: 1120227 - RNA, 22 nt, Human
ugucccucauugacgcugugcc

SEQ ID NO: 1120228 - RNA, 22 nt, Human
ggcagugacuguucagacgucc

SEQ ID NO: 1120229 - RNA, 22 nt, Human
aggcugcagugcagguaggauu

SEQ ID NO: 1120230 - RNA, 22 nt, Human
ugaagcagcaaaugaugggaga

SEQ ID NO: 1120231 - RNA, 22 nt, Human
ccugucauacuaacguaguggg

SEQ ID NO: 1120232 - RNA, 20 nt, Human
cuuagaaauuuuuacccugg

SEQ ID NO: 1120233 - RNA, 22 nt, Human
uggcagaguggaccauacucaa

SEQ ID NO: 1120234 - RNA, 17 nt, Human
uauguaguacuuauaaa

SEQ ID NO: 1120235 - RNA, 23 nt, Human
agccagggcacugguggagauug

SEQ ID NO: 1120236 - RNA, 22 nt, Human
auugucugaauccaaagcucug

SEQ ID NO: 1120237 - RNA, 22 nt, Human
ucagagugcagggaguagcagc

SEQ ID NO: 1120238 - RNA, 22 nt, Human
cuucccacuaguaucacagagc

SEQ ID NO: 1120239 - RNA, 22 nt, Human
ucagagaugcagugccaccuac

SEQ ID NO: 1120240 - RNA, 22 nt, Human
ugggcugcuguuacaggggcug

SEQ ID NO: 1120241 - RNA, 22 nt, Human
aaaggucaagcuggacucaggu

SEQ ID NO: 1120242 - RNA, 22 nt, Human
gccuggaguuguggugaagcca

SEQ ID NO: 1120243 - RNA, 22 nt, Human
gggcagcagaggaucccuuaau

SEQ ID NO: 1120244 - RNA, 22 nt, Human
ucaaauguucccuguacuggcc

SEQ ID NO: 1120245 - RNA, 22 nt, Human
ucaaaugcugccuuugugugcc

SEQ ID NO: 1120246 - RNA, 22 nt, Human
uggcucagucuggguugacuga

SEQ ID NO: 1120247 - RNA, 19 nt, Human
ucucacaucagcuccuagc

SEQ ID NO: 1120248 - RNA, 22 nt, Human
agcugcaguaaagcucuccagg

SEQ ID NO: 1120249 - RNA, 22 nt, Human
agcugcuccuuuccugcaggcg

SEQ ID NO: 1120250 - RNA, 22 nt, Human
ugggccuggagcccuggagagu

SEQ ID NO: 1120251 - RNA, 22 nt, Human
agcugcugcggaaagaugccac

SEQ ID NO: 1120252 - RNA, 22 nt, Human
gccuggcccagggcucuuguug

SEQ ID NO: 1120253 - RNA, 22 nt, Human
agagcagaggcauggccguggg

SEQ ID NO: 1120254 - RNA, 22 nt, Human
ucuuccagcaaugugaaaucac

SEQ ID NO: 1120255 - RNA, 22 nt, Human
acugugugcccugacgccaggg

SEQ ID NO: 1120256 - RNA, 22 nt, Human
cagagccaaaugcugugguuau

SEQ ID NO: 1120257 - RNA, 22 nt, Human
ucucuggggauggaccugggag

SEQ ID NO: 1120258 - RNA, 22 nt, Human
auguguaaaaagugcuuaauau

SEQ ID NO: 1120259 - RNA, 23 nt, Human
gggcugcuccaggccaaggcugg

SEQ ID NO: 1120260 - RNA, 22 nt, Human
uggcuccuucauucuccugcca

SEQ ID NO: 1120261 - RNA, 22 nt, Human
gccuggagaauuaaaaggaagg

SEQ ID NO: 1120262 - RNA, 22 nt, Human
cugggcugcaggaguggggcaa

SEQ ID NO: 1120263 - RNA, 22 nt, Human
ggcugccuucccugagccccgg

SEQ ID NO: 1120264 - RNA, 22 nt, Human
aggcugcuuccuuacguggcug

SEQ ID NO: 1120265 - RNA, 22 nt, Human
aguggcagaucucuggucugga

SEQ ID NO: 1120266 - RNA, 19 nt, Human
ggugaccaccuggucagug

SEQ ID NO: 1120267 - RNA, 19 nt, Human
gcagccaggugcucuaccu

SEQ ID NO: 1120268 - RNA, 22 nt, Human
gguggccuuucaguggaucagg

SEQ ID NO: 1120269 - RNA, 22 nt, Human
ccugccugcaaaaugggacaag

SEQ ID NO: 1120270 - RNA, 22 nt, Human
gcugugcagucuuuggugugcc

SEQ ID NO: 1120271 - RNA, 22 nt, Human
auggaaagccaguguuccauca

SEQ ID NO: 1120272 - RNA, 22 nt, Human
caaagucccagcugcuuagaga

SEQ ID NO: 1120273 - RNA, 22 nt, Human
cagggcuggcucaugaaaaguu

SEQ ID NO: 1120274 - RNA, 22 nt, Human
ggucccugaagaggccuggggu

SEQ ID NO: 1120275 - RNA, 22 nt, Human
uucaagauccagcacaacagug

SEQ ID NO: 1120276 - RNA, 22 nt, Human
gagccugggacugggggucaug

SEQ ID NO: 1120277 - RNA, 22 nt, Human
uacacuuuuuacuacagauucu

SEQ ID NO: 1120278 - RNA, 23 nt, Human
aggcugcagaagaauagggucau

SEQ ID NO: 1120279 - RNA, 22 nt, Human
ugggggugugccagggaccucc

SEQ ID NO: 1120280 - RNA, 22 nt, Human
caagaugccccugguagggauc

SEQ ID NO: 1120281 - RNA, 22 nt, Human
augcucuggaguacgugaaauu

SEQ ID NO: 1120282 - RNA, 21 nt, Human
agaaaaaccagcauguuuuca

SEQ ID NO: 1120283 - RNA, 22 nt, Human
gaggccugaggcugccuggagc

SEQ ID NO: 1120284 - RNA, 21 nt, Human
gcacagcaugaguguuggcau

SEQ ID NO: 1120285 - RNA, 22 nt, Human
uugaaaggccuguuuauccagc

SEQ ID NO: 1120286 - RNA, 21 nt, Human
gcagccagccgagaccaugcc

SEQ ID NO: 1120287 - RNA, 22 nt, Human
gcccccucuuuggagccagcca

SEQ ID NO: 1120288 - RNA, 21 nt, Human
ccagcuccaggaccuuggauc

SEQ ID NO: 1120289 - RNA, 22 nt, Human
gugucccaggagaggagacaau

SEQ ID NO: 1120290 - RNA, 22 nt, Human
accuuaaaacugacacauggag

SEQ ID NO: 1120291 - RNA, 22 nt, Human
uuugacaggacuaacauauggc

SEQ ID NO: 1120292 - RNA, 23 nt, Human
aguguuccaguugguugagagug

SEQ ID NO: 1120293 - RNA, 22 nt, Human
ggcuguccuuggccaaggcacu

SEQ ID NO: 1120294 - RNA, 22 nt, Human
cacauguacagaagcaggcugg

SEQ ID NO: 1120295 - RNA, 22 nt, Human
cauugcugugggcauuugcugc

SEQ ID NO: 1120296 - RNA, 22 nt, Human
uuuuaauacugcuauuguagga

SEQ ID NO: 1120297 - RNA, 22 nt, Human
gcuguuccugcuuagaggucgg

SEQ ID NO: 1120298 - RNA, 22 nt, Human
ucccagagcccaaguuggagag

SEQ ID NO: 1120299 - RNA, 22 nt, Human
gccacagggcagaugcgcagag

SEQ ID NO: 1120300 - RNA, 22 nt, Human
agucccagugacuuggccagaa

SEQ ID NO: 1120301 - RNA, 19 nt, Human
ucauucaggaccaguggau

SEQ ID NO: 1120302 - RNA, 22 nt, Human
agagccacugggagacagagca

SEQ ID NO: 1120303 - RNA, 22 nt, Human
ccagguggaaggucugugcucu

SEQ ID NO: 1120304 - RNA, 22 nt, Human
guagcccaccuggggagggcga

SEQ ID NO: 1120305 - RNA, 22 nt, Human
aagauuuagggccaguuuacau

SEQ ID NO: 1120306 - RNA, 22 nt, Human
aucuaagauguauugagcacuu

SEQ ID NO: 1120307 - RNA, 22 nt, Human
uuucuguuaggcaucauuuuaa

SEQ ID NO: 1120308 - RNA, 22 nt, Human
uguagcauguaaauugguuauu

SEQ ID NO: 1120309 - RNA, 22 nt, Human
gggagggaucugcuaggcaaug

SEQ ID NO: 1120310 - RNA, 22 nt, Human
cagcucaaguuucccaggucag

SEQ ID NO: 1120311 - RNA, 22 nt, Human
gcaggggcuacucugagcuucc

SEQ ID NO: 1120312 - RNA, 22 nt, Human
gcagggcacagacagugccaag

SEQ ID NO: 1120313 - RNA, 22 nt, Human
ugccagcccaccuuggggccuc

SEQ ID NO: 1120314 - RNA, 20 nt, Human
aagcaauauagugcaaaugu

SEQ ID NO: 1120315 - RNA, 22 nt, Human
agaauguagucuuggagauuua

SEQ ID NO: 1120316 - RNA, 22 nt, Human
caagagcuagaaauugguuaga

SEQ ID NO: 1120317 - RNA, 22 nt, Human
ugcugcacgauaaauaauuucu

SEQ ID NO: 1120318 - RNA, 22 nt, Human
ccacacagucaguuuccaagaa

SEQ ID NO: 1120319 - RNA, 22 nt, Human
gccuucugauaucucuuggcau

SEQ ID NO: 1120320 - RNA, 22 nt, Human
gaacaguaaauuuaugcagcac

SEQ ID NO: 1120321 - RNA, 22 nt, Human
cagggccuccuaaggcaucuaa

SEQ ID NO: 1120322 - RNA, 22 nt, Human
gcugucagugaggugagacaug

SEQ ID NO: 1120323 - RNA, 22 nt, Human
aacaucuuuuuguuugcugaaa

SEQ ID NO: 1120324 - RNA, 22 nt, Human
cauuucugucacguucuuuuau

SEQ ID NO: 1120325 - RNA, 22 nt, Human
cugccuggcauggagaagagaa

SEQ ID NO: 1120326 - RNA, 22 nt, Human
cuggggcccaucgagggcugag

SEQ ID NO: 1120327 - RNA, 22 nt, Human
ugcagcagguuccaaaggguua

SEQ ID NO: 1120328 - RNA, 22 nt, Human
cugggacuuuacccuguggccc

SEQ ID NO: 1120329 - RNA, 21 nt, Human
auugaaagucaacaaucaguu

SEQ ID NO: 1120330 - RNA, 22 nt, Human
gggcuggggcucaauaauuugu

SEQ ID NO: 1120331 - RNA, 22 nt, Human
aggagcugggcugcugcuggga

SEQ ID NO: 1120332 - RNA, 22 nt, Human
agcccccaaaagugcuuaugau

SEQ ID NO: 1120333 - RNA, 22 nt, Human
agaauaguggcaaugacugcac

SEQ ID NO: 1120334 - RNA, 22 nt, Human
uuccaaagucauguugcugaua

SEQ ID NO: 1120335 - RNA, 22 nt, Human
uacuuuuugucucuuugaaugu

SEQ ID NO: 1120336 - RNA, 22 nt, Human
gggcuucucuuuagugagcuga

SEQ ID NO: 1120337 - RNA, 18 nt, Human
ccagguggugacagagau

SEQ ID NO: 1120338 - RNA, 22 nt, Human
ggggacugccuuccacagacac

SEQ ID NO: 1120339 - RNA, 22 nt, Human
uggcuuccuccagagcaggagg

SEQ ID NO: 1120340 - RNA, 22 nt, Human
cugcucuggcguacucggcauc

SEQ ID NO: 1120341 - RNA, 22 nt, Human
ggcaaggccuugcccagcauuc

SEQ ID NO: 1120342 - RNA, 21 nt, Human
caggaaaagcggaagucuagc

SEQ ID NO: 1120343 - RNA, 22 nt, Human
gccuggcugagguggggaggca

SEQ ID NO: 1120344 - RNA, 22 nt, Human
agccagugcaacagcagugaag

SEQ ID NO: 1120345 - RNA, 18 nt, Human
aggcuucuuggcucaguc

SEQ ID NO: 1120346 - RNA, 22 nt, Human
guggcagagguuccucagugug

SEQ ID NO: 1120347 - RNA, 22 nt, Human
cccaggaggccaagguugcagu

SEQ ID NO: 1120348 - RNA, 22 nt, Human
acauuguagacuuuucauaugu

SEQ ID NO: 1120349 - RNA, 22 nt, Human
aggauccuuuuucugcuguuug

SEQ ID NO: 1120350 - RNA, 22 nt, Human
cuuagaaaugcagauucucagg

SEQ ID NO: 1120351 - RNA, 22 nt, Human
uccagggaagagcagaggcuac

SEQ ID NO: 1120352 - RNA, 22 nt, Human
caggccucagagaguggcgggg

SEQ ID NO: 1120353 - RNA, 22 nt, Human
ucagagugugacuuggucauga

SEQ ID NO: 1120354 - RNA, 22 nt, Human
gaguuauuaauggcugaguuug

SEQ ID NO: 1120355 - RNA, 22 nt, Human
ugguuucccauuaucugcagga

SEQ ID NO: 1120356 - RNA, 22 nt, Human
acauuuacagugcuagacaauc

SEQ ID NO: 1120357 - RNA, 22 nt, Human
ccaggguggaggcuggauggag

SEQ ID NO: 1120358 - RNA, 22 nt, Human
ggaaggucgagcugcaucuggc

SEQ ID NO: 1120359 - RNA, 22 nt, Human
aaggcugaguaaaacagagaac

SEQ ID NO: 1120360 - RNA, 22 nt, Human
ggagcugcacgcucugaagccu

SEQ ID NO: 1120361 - RNA, 22 nt, Human
aauugugcuaugauuaugaaag

SEQ ID NO: 1120362 - RNA, 22 nt, Human
ccugggagguggagguugcagu

SEQ ID NO: 1120363 - RNA, 17 nt, Human
agcuccugcccauggcu

SEQ ID NO: 1120364 - RNA, 22 nt, Human
cauugcuuugugcauauuuaaa

SEQ ID NO: 1120365 - RNA, 22 nt, Human
aucacaaaggcugcuucaugau

SEQ ID NO: 1120366 - RNA, 22 nt, Human
ugaagacagaccaaggagaaug

SEQ ID NO: 1120367 - RNA, 22 nt, Human
cugagccaaaaagcagagcuug

SEQ ID NO: 1120368 - RNA, 22 nt, Human
gggcagagacucagaaacagaa

SEQ ID NO: 1120369 - RNA, 22 nt, Human
ucugucacccgagcaggcgaga

SEQ ID NO: 1120370 - RNA, 22 nt, Human
uaaguucagaguucucauuugu

SEQ ID NO: 1120371 - RNA, 22 nt, Human
ugccugucucugacugccauua

SEQ ID NO: 1120372 - RNA, 22 nt, Human
ugcacacaaguuggagaaugaa

SEQ ID NO: 1120373 - RNA, 22 nt, Human
ccuggcuccugccucugcaggg

SEQ ID NO: 1120374 - RNA, 22 nt, Human
agcaguggccuggggcucugug

SEQ ID NO: 1120375 - RNA, 22 nt, Human
auuuugaaaccaaguuauuucc

SEQ ID NO: 1120376 - RNA, 20 nt, Human
agugacagagacuguguggc

SEQ ID NO: 1120377 - RNA, 22 nt, Human
ggagccugacagugcccagcau

SEQ ID NO: 1120378 - RNA, 22 nt, Human
ugcugucccccgugucugggcu

SEQ ID NO: 1120379 - RNA, 22 nt, Human
uuuuuccuuggaugugucucuc

SEQ ID NO: 1120380 - RNA, 22 nt, Human
gugccuggagcuaauguguaua

SEQ ID NO: 1120381 - RNA, 22 nt, Human
gcugugugaaaacugggccugg

SEQ ID NO: 1120382 - RNA, 22 nt, Human
gucugucaucugagauggagug

SEQ ID NO: 1120383 - RNA, 22 nt, Human
gcagugacagggcugcugccuu

SEQ ID NO: 1120384 - RNA, 22 nt, Human
ggcagcaugagccuggugaauu

SEQ ID NO: 1120385 - RNA, 22 nt, Human
ccugucugcaugagugagcaua

SEQ ID NO: 1120386 - RNA, 22 nt, Human
ucagggcauccauugccuguug

SEQ ID NO: 1120387 - RNA, 23 nt, Human
ugucacauuuaguuggcauuguu

SEQ ID NO: 1120388 - RNA, 22 nt, Human
acaugauuggacuccuuccccu

SEQ ID NO: 1120389 - RNA, 22 nt, Human
ucuggcucggauuugucuagca

SEQ ID NO: 1120390 - RNA, 22 nt, Human
aacucagucauaaagcgaaugc

SEQ ID NO: 1120391 - RNA, 22 nt, Human
caguagcauguaauaaagacag

SEQ ID NO: 1120392 - RNA, 22 nt, Human
agagccagccuucucagcuuac

SEQ ID NO: 1120393 - RNA, 21 nt, Human
agcagaggggacauguuugau

SEQ ID NO: 1120394 - RNA, 22 nt, Human
aggcacugauucuguuuuccau

SEQ ID NO: 1120395 - RNA, 22 nt, Human
ugagcaguaggucugaauagug

SEQ ID NO: 1120396 - RNA, 22 nt, Human
aagaauguuaguuucugauaca

SEQ ID NO: 1120397 - RNA, 22 nt, Human
uagcaguggaaucuuuugucca

SEQ ID NO: 1120398 - RNA, 22 nt, Human
ucuggcucugaauucacuucug

SEQ ID NO: 1120399 - RNA, 22 nt, Human
cauucauuagaauagauaugua

SEQ ID NO: 1120400 - RNA, 22 nt, Human
ucuguuccaguagaaaggugca

SEQ ID NO: 1120401 - RNA, 22 nt, Human
ccuggagguggagguugcagug

SEQ ID NO: 1120402 - RNA, 22 nt, Human
uuugggaaacuuaggggucaga

SEQ ID NO: 1120403 - RNA, 22 nt, Human
acagggcaccugagguaggaag

SEQ ID NO: 1120404 - RNA, 22 nt, Human
cagcaauauacacagucuaugg

SEQ ID NO: 1120405 - RNA, 20 nt, Human
cucucccagcacagcuuccu

SEQ ID NO: 1120406 - RNA, 22 nt, Human
gcacuaaaccaacauguaauaa

SEQ ID NO: 1120407 - RNA, 22 nt, Human
ugucucugugacuccuuccgcc

SEQ ID NO: 1120408 - RNA, 22 nt, Human
aaucagucauuagcucugaccu

SEQ ID NO: 1120409 - RNA, 22 nt, Human
gcucccagcauugcugcugaau

SEQ ID NO: 1120410 - RNA, 22 nt, Human
cccagcuccgagcuccgagccg

SEQ ID NO: 1120411 - RNA, 22 nt, Human
gagcuggcuccgccaugcugcu

SEQ ID NO: 1120412 - RNA, 22 nt, Human
aaggcuaugaucuuuuucauga

SEQ ID NO: 1120413 - RNA, 22 nt, Human
uucuccgcuaaguucucugcag

SEQ ID NO: 1120414 - RNA, 22 nt, Human
uugucuguccaggcaccccaag

SEQ ID NO: 1120415 - RNA, 22 nt, Human
cuguagcagugugcucuuuuuc

SEQ ID NO: 1120416 - RNA, 22 nt, Human
aaacagcugucauuguuuuaaa

SEQ ID NO: 1120417 - RNA, 22 nt, Human
aucuacaggauuuuacagaguu

SEQ ID NO: 1120418 - RNA, 22 nt, Human
agucucaggcagaggaaggcua

SEQ ID NO: 1120419 - RNA, 22 nt, Human
gcuguucugcgucccaggcugg

SEQ ID NO: 1120420 - RNA, 22 nt, Human
gcuucuggaggagcugggcuga

SEQ ID NO: 1120421 - RNA, 22 nt, Human
cagggcaguaacgggaacaucu

SEQ ID NO: 1120422 - RNA, 22 nt, Human
caaaguuuaaaguagauuucag

SEQ ID NO: 1120423 - RNA, 22 nt, Human
agaagcaguuauuuuuugcaca

SEQ ID NO: 1120424 - RNA, 22 nt, Human
gagccaggguuugaaacuagac

SEQ ID NO: 1120425 - RNA, 22 nt, Human
caguggccaugguggcaggggu

SEQ ID NO: 1120426 - RNA, 20 nt, Human
agagaauucccuuuggagau

SEQ ID NO: 1120427 - RNA, 22 nt, Human
ggcuccugauaggagaaugcgg

SEQ ID NO: 1120428 - RNA, 22 nt, Human
gugcauuucucauacacuaaau

SEQ ID NO: 1120429 - RNA, 22 nt, Human
gggaagggagggaccucagucu

SEQ ID NO: 1120430 - RNA, 22 nt, Human
ugcugccagggcucugcccaca

SEQ ID NO: 1120431 - RNA, 22 nt, Human
cagcuugggucaggugccugcu

SEQ ID NO: 1120432 - RNA, 22 nt, Human
uacauauuugucuuuguacugu

SEQ ID NO: 1120433 - RNA, 22 nt, Human
aauguguacaugacagauagaa

SEQ ID NO: 1120434 - RNA, 19 nt, Human
guuuuucccagacgaggca

SEQ ID NO: 1120435 - RNA, 19 nt, Human
ucccagagucuagagguug

SEQ ID NO: 1120436 - RNA, 22 nt, Human
cccaggucuaugccagcucuga

SEQ ID NO: 1120437 - RNA, 22 nt, Human
gcugucagcgcccaaggagcuc

SEQ ID NO: 1120438 - RNA, 22 nt, Human
cagggacagccuugggguggcg

SEQ ID NO: 1120439 - RNA, 22 nt, Human
cccacucuggcucccuucuagu

SEQ ID NO: 1120440 - RNA, 21 nt, Human
ugcagccauucagcccuaugc

SEQ ID NO: 1120441 - RNA, 22 nt, Human
ccuggcagcgugccgagcugcg

SEQ ID NO: 1120442 - RNA, 22 nt, Human
uugcauuguaggauguuagaag

SEQ ID NO: 1120443 - RNA, 22 nt, Human
cugugcaagacuuacuuuaaua

SEQ ID NO: 1120444 - RNA, 22 nt, Human
cugccugggccggccacccucu

SEQ ID NO: 1120445 - RNA, 20 nt, Human
agucucuguagugccugaga

SEQ ID NO: 1120446 - RNA, 22 nt, Human
cuggagagauccuccugaaaaa

SEQ ID NO: 1120447 - RNA, 22 nt, Human
gagcuuccacucuagaaggagu

SEQ ID NO: 1120448 - RNA, 22 nt, Human
ccucuucugagugagacucccu

SEQ ID NO: 1120449 - RNA, 22 nt, Human
aaaugcacagaaaggaugugga

SEQ ID NO: 1120450 - RNA, 23 nt, Human
aaaguugauuugcaguuuaagag

SEQ ID NO: 1120451 - RNA, 22 nt, Human
cugcccugcuugaugacagcga

SEQ ID NO: 1120452 - RNA, 22 nt, Human
aggaagccaugguggacgucua

SEQ ID NO: 1120453 - RNA, 22 nt, Human
ugacaauacagagagagcaaaa

SEQ ID NO: 1120454 - RNA, 22 nt, Human
cugggcuguaauguggcacuga

SEQ ID NO: 1120455 - RNA, 20 nt, Human
uggagcuccagcguccaugu

SEQ ID NO: 1120456 - RNA, 19 nt, Human
uuucaauggcuuagagaaa

SEQ ID NO: 1120457 - RNA, 22 nt, Human
cugugucccaguaccuugggua

SEQ ID NO: 1120458 - RNA, 22 nt, Human
gagggcagagucuaaugaugca

SEQ ID NO: 1120459 - RNA, 22 nt, Human
agggauggaagcucgucugcaa

SEQ ID NO: 1120460 - RNA, 18 nt, Human
aggcacagagcauacaua

SEQ ID NO: 1120461 - RNA, 22 nt, Human
aggcacugacagauucuguguc

SEQ ID NO: 1120462 - RNA, 22 nt, Human
cagacccucgggugaguuggcc

SEQ ID NO: 1120463 - RNA, 18 nt, Human
agagaugguguagaguuu

SEQ ID NO: 1120464 - RNA, 22 nt, Human
uggcucuguugagguauggauu

SEQ ID NO: 1120465 - RNA, 22 nt, Human
ugaaggaaagagggaacauccc

SEQ ID NO: 1120466 - RNA, 22 nt, Human
gcccucuggcagccuuggcugg

SEQ ID NO: 1120467 - RNA, 22 nt, Human
gugauugcccagcaccauuguu

SEQ ID NO: 1120468 - RNA, 22 nt, Human
acauuucucuugaugucucuau

SEQ ID NO: 1120469 - RNA, 22 nt, Human
gccuggagcccaguguggggcu

SEQ ID NO: 1120470 - RNA, 22 nt, Human
caggguccggcugccuggcugu

SEQ ID NO: 1120471 - RNA, 22 nt, Human
ucuggcucaggagcuguguuca

SEQ ID NO: 1120472 - RNA, 22 nt, Human
ucauacaucuuguauaucuauc

SEQ ID NO: 1120473 - RNA, 22 nt, Human
gagaaguuucugguuugcauag

SEQ ID NO: 1120474 - RNA, 22 nt, Human
gccuucugugcuccuggccuuu

SEQ ID NO: 1120475 - RNA, 19 nt, Human
cccaaggcccugggcaggc

SEQ ID NO: 1120476 - RNA, 22 nt, Human
guguggcugauugacaugguca

SEQ ID NO: 1120477 - RNA, 23 nt, Human
ugccucugccucccuagucugca

SEQ ID NO: 1120478 - RNA, 22 nt, Human
uugaacaguuuugucagguuca

SEQ ID NO: 1120479 - RNA, 23 nt, Human
cuggggcuuucaaaucugggcag

SEQ ID NO: 1120480 - RNA, 19 nt, Human
ugagaggcuuaaggcagcu

SEQ ID NO: 1120481 - RNA, 22 nt, Human
ugggauggagccugaguauagu

SEQ ID NO: 1120482 - RNA, 22 nt, Human
ugggcagaggacagggaagauc

SEQ ID NO: 1120483 - RNA, 22 nt, Human
ugugaaagauacuaggcagagg

SEQ ID NO: 1120484 - RNA, 22 nt, Human
aguguuucucagaagggccuau

SEQ ID NO: 1120485 - RNA, 22 nt, Human
uaaggcaccuguccaggcuggg

SEQ ID NO: 1120486 - RNA, 22 nt, Human
cucaggauauugggcuggagca

SEQ ID NO: 1120487 - RNA, 22 nt, Human
agcuggguguguaucagauaaa

SEQ ID NO: 1120488 - RNA, 22 nt, Human
cuguguggccucaagccagccu

SEQ ID NO: 1120489 - RNA, 22 nt, Human
uuuagaaauugcagagugggug

SEQ ID NO: 1120490 - RNA, 22 nt, Human
cuacauuuuaauaagcugcuua

SEQ ID NO: 1120491 - RNA, 22 nt, Human
agggccugagcuggcugaccuc

SEQ ID NO: 1120492 - RNA, 22 nt, Human
cacucugagaaguacaagcucc

SEQ ID NO: 1120493 - RNA, 22 nt, Human
ucagggcaagauugguuaauaa

SEQ ID NO: 1120494 - RNA, 22 nt, Human
gcagcugagcgugaggaagagu

SEQ ID NO: 1120495 - RNA, 22 nt, Human
agcagcugcagggagggucugc

SEQ ID NO: 1120496 - RNA, 22 nt, Human
cuggcucucugagauauugagu

SEQ ID NO: 1120497 - RNA, 22 nt, Human
agauuucacaugcugcucuauu

SEQ ID NO: 1120498 - RNA, 22 nt, Human
uuugcauuucucguaaggaaac

SEQ ID NO: 1120499 - RNA, 22 nt, Human
acuuccugcaaucguccacucc

SEQ ID NO: 1120500 - RNA, 18 nt, Human
gggcucugauccuucacc

SEQ ID NO: 1120501 - RNA, 22 nt, Human
agagccugcaucaggcuugggg

SEQ ID NO: 1120502 - RNA, 22 nt, Human
uucauucaucucuaaaaugccu

SEQ ID NO: 1120503 - RNA, 22 nt, Human
gagggcugccacguugggcgag

SEQ ID NO: 1120504 - RNA, 22 nt, Human
agggcagagacaugcuuccuga

SEQ ID NO: 1120505 - RNA, 21 nt, Human
auggagccuaagaguggaggu

SEQ ID NO: 1120506 - RNA, 22 nt, Human
aaggagucucagcugggccuga

SEQ ID NO: 1120507 - RNA, 22 nt, Human
ugggaggacuugugggcuucau

SEQ ID NO: 1120508 - RNA, 17 nt, Human
uggcuucccugggccac

SEQ ID NO: 1120509 - RNA, 22 nt, Human
auuucauugaaguuaauucuuc

SEQ ID NO: 1120510 - RNA, 22 nt, Human
gaggcugggaaguccaagacca

SEQ ID NO: 1120511 - RNA, 22 nt, Human
acaaaaguguaggaauuccuua

SEQ ID NO: 1120512 - RNA, 22 nt, Human
ggccauggaccccgagcugacc

SEQ ID NO: 1120513 - RNA, 23 nt, Human
cugcagucgccggccugggugcc

SEQ ID NO: 1120514 - RNA, 22 nt, Human
aaggcacuacgcugcuggggcg

SEQ ID NO: 1120515 - RNA, 22 nt, Human
uugaaaggaauacagaggccua

SEQ ID NO: 1120516 - RNA, 20 nt, Human
gccugagcuccgccuccugu

SEQ ID NO: 1120517 - RNA, 22 nt, Human
ccagggcuggugggagaugcug

SEQ ID NO: 1120518 - RNA, 22 nt, Human
ugcugcucuucaccauggccuc

SEQ ID NO: 1120519 - RNA, 21 nt, Human
accagcaggagaucagaagga

SEQ ID NO: 1120520 - RNA, 22 nt, Human
uccucaggcggugaggaggggc

SEQ ID NO: 1120521 - RNA, 22 nt, Human
ggugggcacccgagacuggauc

SEQ ID NO: 1120522 - RNA, 22 nt, Human
guuauguacuuuuuaaaucuug

SEQ ID NO: 1120523 - RNA, 22 nt, Human
auuuuucucuuuccacugagau

SEQ ID NO: 1120524 - RNA, 17 nt, Human
ucugggcuucagugguc

SEQ ID NO: 1120525 - RNA, 22 nt, Human
cucagcuggcaauucuggcucc

SEQ ID NO: 1120526 - RNA, 23 nt, Human
agcagggccagaauacuugcugu

SEQ ID NO: 1120527 - RNA, 22 nt, Human
ugucugagugugccugggcauu

SEQ ID NO: 1120528 - RNA, 22 nt, Human
cacagcuugggcucugacaaua

SEQ ID NO: 1120529 - RNA, 22 nt, Human
ugauuuccacagucaggggugc

SEQ ID NO: 1120530 - RNA, 22 nt, Human
gaaaggugccccauaggcagga

SEQ ID NO: 1120531 - RNA, 22 nt, Human
uuugcauuucuaaugagcuccg

SEQ ID NO: 1120532 - RNA, 22 nt, Human
agcugcuguccuaggcacugua

SEQ ID NO: 1120533 - RNA, 22 nt, Human
cugcucuguuucuuagcugggu

SEQ ID NO: 1120534 - RNA, 22 nt, Human
agagccugugauugucaucacc

SEQ ID NO: 1120535 - RNA, 22 nt, Human
caguuucucucaauaagcaucg

SEQ ID NO: 1120536 - RNA, 22 nt, Human
ggagugacucacagcugggaca

SEQ ID NO: 1120537 - RNA, 22 nt, Human
caggaugugaggaggccauuug

SEQ ID NO: 1120538 - RNA, 22 nt, Human
cugcugagcccuggcacaggug

SEQ ID NO: 1120539 - RNA, 22 nt, Human
uccuucagaggacggcagccag

SEQ ID NO: 1120540 - RNA, 22 nt, Human
gucaccagucccagcuccugaa

SEQ ID NO: 1120541 - RNA, 18 nt, Human
gugacagcugcuagcuca

SEQ ID NO: 1120542 - RNA, 22 nt, Human
uggguagaggaauugggcuacc

SEQ ID NO: 1120543 - RNA, 22 nt, Human
gaggagagggcugcgggcccac

SEQ ID NO: 1120544 - RNA, 22 nt, Human
uccagggcuggguuggcucagc

SEQ ID NO: 1120545 - RNA, 18 nt, Human
ggagccagucugucucug

SEQ ID NO: 1120546 - RNA, 22 nt, Human
uggcugucagcugccuggugcg

SEQ ID NO: 1120547 - RNA, 20 nt, Human
uccaguuuuggagacauucu

SEQ ID NO: 1120548 - RNA, 22 nt, Human
aguaaugugccugaaauacuug

SEQ ID NO: 1120549 - RNA, 22 nt, Human
gcagggcugggugggagacaga

SEQ ID NO: 1120550 - RNA, 22 nt, Human
agaauaaaucaaauguccugag

SEQ ID NO: 1120551 - RNA, 22 nt, Human
ugugcucuggaguugccuucac

SEQ ID NO: 1120552 - RNA, 22 nt, Human
ucucccaggcugcccuguggac

SEQ ID NO: 1120553 - RNA, 22 nt, Human
uuucacaaguaaaguccuaagu

SEQ ID NO: 1120554 - RNA, 17 nt, Human
agagagagcaugccacc

SEQ ID NO: 1120555 - RNA, 22 nt, Human
uugggaaggcguggaagcagaa

SEQ ID NO: 1120556 - RNA, 20 nt, Human
ccaggcacugucccaugcag

SEQ ID NO: 1120557 - RNA, 22 nt, Human
ugcugccacugguagucucauu

SEQ ID NO: 1120558 - RNA, 22 nt, Human
ggcagcuccuccuagucugccc

SEQ ID NO: 1120559 - RNA, 22 nt, Human
gcagcuggcucagagagguggg

SEQ ID NO: 1120560 - RNA, 20 nt, Human
ugaugguucuuuccggguug

SEQ ID NO: 1120561 - RNA, 22 nt, Human
aucaaaguggaaguuuacuagg

SEQ ID NO: 1120562 - RNA, 22 nt, Human
agcuuaggaggaugaugaacau

SEQ ID NO: 1120563 - RNA, 22 nt, Human
aggugauguccacagcuugcag

SEQ ID NO: 1120564 - RNA, 22 nt, Human
ccuggccucagccuagggcuga

SEQ ID NO: 1120565 - RNA, 22 nt, Human
ucuggagcuuguuucagauggu

SEQ ID NO: 1120566 - RNA, 22 nt, Human
acauuucuuccuaauuaucccu

SEQ ID NO: 1120567 - RNA, 17 nt, Human
ucugccgacugccagcu

SEQ ID NO: 1120568 - RNA, 22 nt, Human
gccccagguugccugucccagg

SEQ ID NO: 1120569 - RNA, 22 nt, Human
gggaccaggugggugcauuccg

SEQ ID NO: 1120570 - RNA, 20 nt, Human
ucugcucagcccucaguggc

SEQ ID NO: 1120571 - RNA, 22 nt, Human
ugucccagaucacaggagggga

SEQ ID NO: 1120572 - RNA, 22 nt, Human
augccaggccccacgcugggca

SEQ ID NO: 1120573 - RNA, 22 nt, Human
aaguucaagagugacauauuag

SEQ ID NO: 1120574 - RNA, 22 nt, Human
ggagccagagucugcaguguaa

SEQ ID NO: 1120575 - RNA, 22 nt, Human
guguccaucagcagccacugug

SEQ ID NO: 1120576 - RNA, 22 nt, Human
cccugcagccggccagcucauu

SEQ ID NO: 1120577 - RNA, 22 nt, Human
ugcaggcuguaaucugaggcua

SEQ ID NO: 1120578 - RNA, 22 nt, Human
cucaaggaaagucuggagaaga

SEQ ID NO: 1120579 - RNA, 22 nt, Human
agccuggccugggcaggcacau

SEQ ID NO: 1120580 - RNA, 22 nt, Human
ccucucccacguggcagaggcu

SEQ ID NO: 1120581 - RNA, 22 nt, Human
agggcugccugcucugcauuga

SEQ ID NO: 1120582 - RNA, 22 nt, Human
uguucaauccccagguccugaa

SEQ ID NO: 1120583 - RNA, 22 nt, Human
ucugcaggaggcuggcugcagg

SEQ ID NO: 1120584 - RNA, 22 nt, Human
ugaagcaggguggccagauugu

SEQ ID NO: 1120585 - RNA, 22 nt, Human
ggcacugacacuagcauggcac

SEQ ID NO: 1120586 - RNA, 20 nt, Human
auaaaauaacugccacaaga

SEQ ID NO: 1120587 - RNA, 22 nt, Human
agccuggcuguaaccucauggu

SEQ ID NO: 1120588 - RNA, 22 nt, Human
uuaauuuauguccaaaccagau

SEQ ID NO: 1120589 - RNA, 23 nt, Human
aggaacugaggccuagggaggua

SEQ ID NO: 1120590 - RNA, 22 nt, Human
caucacuguccucagcauucca

SEQ ID NO: 1120591 - RNA, 22 nt, Human
uggcucuguucgccaucaggag

SEQ ID NO: 1120592 - RNA, 22 nt, Human
aucaguuucugugaagaacaca

SEQ ID NO: 1120593 - RNA, 22 nt, Human
auguguccacaggugugagaga

SEQ ID NO: 1120594 - RNA, 22 nt, Human
agcugguucauucauucauggu

SEQ ID NO: 1120595 - RNA, 22 nt, Human
guccucugcuucaugcccugau

SEQ ID NO: 1120596 - RNA, 22 nt, Human
ggauccuuaacuaucacaguga

SEQ ID NO: 1120597 - RNA, 22 nt, Human
uagcuuuaccauagaagaguau

SEQ ID NO: 1120598 - RNA, 22 nt, Human
uggccugggccugccggugcaa

SEQ ID NO: 1120599 - RNA, 22 nt, Human
cuuguacauagagaagaagccu

SEQ ID NO: 1120600 - RNA, 22 nt, Human
uggcucagaugcucuuccagug

SEQ ID NO: 1120601 - RNA, 22 nt, Human
caugcacaacauacucaagagg

SEQ ID NO: 1120602 - RNA, 23 nt, Human
ccucccaccuauuucacuuucuu

SEQ ID NO: 1120603 - RNA, 22 nt, Human
uggagggcucuuucaccuggua

SEQ ID NO: 1120604 - RNA, 22 nt, Human
cucucuguuaugcuuucaugaa

SEQ ID NO: 1120605 - RNA, 22 nt, Human
agggagacacaugaggaaguca

SEQ ID NO: 1120606 - RNA, 22 nt, Human
ccaggcaggcgauggugcagug

SEQ ID NO: 1120607 - RNA, 22 nt, Human
cccuggagggauuucucaauca

SEQ ID NO: 1120608 - RNA, 23 nt, Human
cuugcagggcuggaggcuuagaa

SEQ ID NO: 1120609 - RNA, 22 nt, Human
agaccacagucaggcuccuggu

SEQ ID NO: 1120610 - RNA, 22 nt, Human
aggcaagggggcgccaccuucc

SEQ ID NO: 1120611 - RNA, 22 nt, Human
agagccuguuuugugggagaug

SEQ ID NO: 1120612 - RNA, 22 nt, Human
ggcuucauggaggaggugaguc

SEQ ID NO: 1120613 - RNA, 19 nt, Human
agaggccucagcagcuggc

SEQ ID NO: 1120614 - RNA, 23 nt, Human
cuggcucauccugguugcagugg

SEQ ID NO: 1120615 - RNA, 22 nt, Human
ucugcagauuuaucagcagcug

SEQ ID NO: 1120616 - RNA, 22 nt, Human
ucucagagaacaguuggugcuu

SEQ ID NO: 1120617 - RNA, 22 nt, Human
uaacagaauagcagaaacagaa

SEQ ID NO: 1120618 - RNA, 22 nt, Human
cccacucccugcacgccugccg

SEQ ID NO: 1120619 - RNA, 22 nt, Human
uuccuuguuuguagcucuggga

SEQ ID NO: 1120620 - RNA, 22 nt, Human
caggcugggcagccuccccggc

SEQ ID NO: 1120621 - RNA, 20 nt, Human
uuuuuccuucucuacaggca

SEQ ID NO: 1120622 - RNA, 22 nt, Human
ugcauuccuccaccuccugcac

SEQ ID NO: 1120623 - RNA, 22 nt, Human
aucuuucaguuucauaccaauu

SEQ ID NO: 1120624 - RNA, 22 nt, Human
gcagagccugacgggauuuuuc

SEQ ID NO: 1120625 - RNA, 22 nt, Human
ccagcauggcaccugagaugag

SEQ ID NO: 1120626 - RNA, 22 nt, Human
uggugaagucagcggagcccgg

SEQ ID NO: 1120627 - RNA, 22 nt, Human
uagcaggguccaaugugaggca

SEQ ID NO: 1120628 - RNA, 22 nt, Human
gcagggagguuugcugaccugg

SEQ ID NO: 1120629 - RNA, 22 nt, Human
ggcugagcucaggggcagcagg

SEQ ID NO: 1120630 - RNA, 23 nt, Human
ugcugggguaguuuguggcacag

SEQ ID NO: 1120631 - RNA, 22 nt, Human
cagaauuuagcacaauguaugg

SEQ ID NO: 1120632 - RNA, 22 nt, Human
uacuacauuaauaaaacauuca

SEQ ID NO: 1120633 - RNA, 22 nt, Human
cuggugccauucuguggccuag

SEQ ID NO: 1120634 - RNA, 22 nt, Human
uauuaucauugguaauaugguc

SEQ ID NO: 1120635 - RNA, 22 nt, Human
cacauuuaaagguugaagcuga

SEQ ID NO: 1120636 - RNA, 22 nt, Human
ugcccugucuaagcugucagua

SEQ ID NO: 1120637 - RNA, 22 nt, Human
aucuucaaagcacaucguuugu

SEQ ID NO: 1120638 - RNA, 22 nt, Human
uggccuggaagagaggucgagg

SEQ ID NO: 1120639 - RNA, 22 nt, Human
gccuguguggaugcgccggugc

SEQ ID NO: 1120640 - RNA, 22 nt, Human
uccagucaggcugaauucaagg

SEQ ID NO: 1120641 - RNA, 22 nt, Human
gcugcagcuguaggacacaauu

SEQ ID NO: 1120642 - RNA, 22 nt, Human
ggaguuggugagcaccaggcuu

SEQ ID NO: 1120643 - RNA, 22 nt, Human
caagggcucacggucugcuggg

SEQ ID NO: 1120644 - RNA, 22 nt, Human
acagccaggaauucuggagaag

SEQ ID NO: 1120645 - RNA, 22 nt, Human
ucaaagucacaacucucuaauu

SEQ ID NO: 1120646 - RNA, 22 nt, Human
uucuuacuaguauguuucagca

SEQ ID NO: 1120647 - RNA, 22 nt, Human
uuuauuauguacaggcacuaua

SEQ ID NO: 1120648 - RNA, 22 nt, Human
ggucucagcaguugcuuugacu

SEQ ID NO: 1120649 - RNA, 22 nt, Human
cuuuggaagugaccacaauccu

SEQ ID NO: 1120650 - RNA, 22 nt, Human
agauaauuugaguaaauuaauu

SEQ ID NO: 1120651 - RNA, 22 nt, Human
ccugaagagcacucuagaguug

SEQ ID NO: 1120652 - RNA, 22 nt, Human
gacagccucaugaggagcaaaa

SEQ ID NO: 1120653 - RNA, 19 nt, Human
gccagcagaaugaugaggc

SEQ ID NO: 1120654 - RNA, 22 nt, Human
uaugcacacauguaugcaugug

SEQ ID NO: 1120655 - RNA, 22 nt, Human
cagcuggcagaaccugcaucca

SEQ ID NO: 1120656 - RNA, 22 nt, Human
agcagcugagccccagcuguga

SEQ ID NO: 1120657 - RNA, 22 nt, Human
gagggcaggggucuugcacggu

SEQ ID NO: 1120658 - RNA, 22 nt, Human
agcugccacagagccuggccag

SEQ ID NO: 1120659 - RNA, 22 nt, Human
cagcccuggugccaagguuccc

SEQ ID NO: 1120660 - RNA, 22 nt, Human
ccugcaggggagagacuucuag

SEQ ID NO: 1120661 - RNA, 22 nt, Human
ggcaccuggauguagcagugaa

SEQ ID NO: 1120662 - RNA, 22 nt, Human
ggagaaggugcuggucacugug

SEQ ID NO: 1120663 - RNA, 17 nt, Human
agugaaauuuacauugc

SEQ ID NO: 1120664 - RNA, 22 nt, Human
cacaugggugugccuggaggaa

SEQ ID NO: 1120665 - RNA, 22 nt, Human
uuucuuaggcucuaaaaugacu

SEQ ID NO: 1120666 - RNA, 22 nt, Human
uuagaaaauuugcuucuuugga

SEQ ID NO: 1120667 - RNA, 20 nt, Human
uauuucugggcaaccauuua

SEQ ID NO: 1120668 - RNA, 23 nt, Human
ggccuccuggucuaggcuagacu

SEQ ID NO: 1120669 - RNA, 22 nt, Human
uuagaaaggaaucuucauuuca

SEQ ID NO: 1120670 - RNA, 22 nt, Human
uaugcacaguuacaagaauauc

SEQ ID NO: 1120671 - RNA, 22 nt, Human
guguuuccuaguuuaaugaaug

SEQ ID NO: 1120672 - RNA, 22 nt, Human
aucuggcugacuuugugggaca

SEQ ID NO: 1120673 - RNA, 22 nt, Human
cucuucagauaaaagggauauu

SEQ ID NO: 1120674 - RNA, 22 nt, Human
ccugcccuagagaugacacaau

SEQ ID NO: 1120675 - RNA, 22 nt, Human
ccaguggguaggccauggugag

SEQ ID NO: 1120676 - RNA, 21 nt, Human
guauugcagaguuaugugcuc

SEQ ID NO: 1120677 - RNA, 22 nt, Human
gagagcugggaaagccguggag

SEQ ID NO: 1120678 - RNA, 22 nt, Human
caagauggacauaaggagagaa

SEQ ID NO: 1120679 - RNA, 22 nt, Human
accuuucacgguaucagacauc

SEQ ID NO: 1120680 - RNA, 22 nt, Human
agaacuguccuuggaggagagu

SEQ ID NO: 1120681 - RNA, 22 nt, Human
agccuccacagaugcaaagggc

SEQ ID NO: 1120682 - RNA, 22 nt, Human
ucucugauguauaucagagaac

SEQ ID NO: 1120683 - RNA, 22 nt, Human
guccucugacucagccuuggga

SEQ ID NO: 1120684 - RNA, 22 nt, Human
uuugcauuugcaaauaaugaaa

SEQ ID NO: 1120685 - RNA, 22 nt, Human
gccucacugcagccccaggaag

SEQ ID NO: 1120686 - RNA, 22 nt, Human
guccucagagugggcagguccu

SEQ ID NO: 1120687 - RNA, 22 nt, Human
agcagcuguacuuucaucuguu

SEQ ID NO: 1120688 - RNA, 22 nt, Human
agauguguuucuaguuccugca

SEQ ID NO: 1120689 - RNA, 22 nt, Human
uaaaguucuggugagagguaag

SEQ ID NO: 1120690 - RNA, 22 nt, Human
ucugucaccauucagcuugaau

SEQ ID NO: 1120691 - RNA, 22 nt, Human
cugcagaggccucgccuccucu

SEQ ID NO: 1120692 - RNA, 22 nt, Human
ucaaagucauggcaggcucaga

SEQ ID NO: 1120693 - RNA, 22 nt, Human
ugggcagaguugugaugaacug

SEQ ID NO: 1120694 - RNA, 19 nt, Human
cucugccucccuccugggu

SEQ ID NO: 1120695 - RNA, 22 nt, Human
gcugccuguggcccuucugggu

SEQ ID NO: 1120696 - RNA, 22 nt, Human
auuuccucaugaucauaaugca

SEQ ID NO: 1120697 - RNA, 22 nt, Human
acagaacuuccugcuggagugg

SEQ ID NO: 1120698 - RNA, 22 nt, Human
uggacagguuugggugccuguu

SEQ ID NO: 1120699 - RNA, 22 nt, Human
acacugaauaauugagaguuga

SEQ ID NO: 1120700 - RNA, 22 nt, Human
gcugccuuuuaaagccucgcuu

SEQ ID NO: 1120701 - RNA, 18 nt, Human
aucucccauuggccaagg

SEQ ID NO: 1120702 - RNA, 22 nt, Human
ggggcugguggugguuucucca

SEQ ID NO: 1120703 - RNA, 22 nt, Human
uggcuucugcuuucaguggagg

SEQ ID NO: 1120704 - RNA, 22 nt, Human
aaugucugccugaacuuuauau

SEQ ID NO: 1120705 - RNA, 22 nt, Human
cuggaaggucuguccccacugc

SEQ ID NO: 1120706 - RNA, 22 nt, Human
gcucagagauguucaguagcuu

SEQ ID NO: 1120707 - RNA, 22 nt, Human
cacaggggcaaacuguagggga

SEQ ID NO: 1120708 - RNA, 20 nt, Human
agcuggagaagggcccuucc

SEQ ID NO: 1120709 - RNA, 22 nt, Human
augccuguaaucccagugcuuu

SEQ ID NO: 1120710 - RNA, 22 nt, Human
ucugggugaugaaaugcacugu

SEQ ID NO: 1120711 - RNA, 22 nt, Human
gcagcugcuguggcaucaagcu

SEQ ID NO: 1120712 - RNA, 22 nt, Human
uuugggaacucuaucauggaaa

SEQ ID NO: 1120713 - RNA, 22 nt, Human
uggcagcugauuagauggugcc

SEQ ID NO: 1120714 - RNA, 22 nt, Human
guaaaguucuauuugaauuuag

SEQ ID NO: 1120715 - RNA, 22 nt, Human
uaguaucuauuaguaacaagag

SEQ ID NO: 1120716 - RNA, 22 nt, Human
gcagugaaacaauaggaucaaa

SEQ ID NO: 1120717 - RNA, 22 nt, Human
gcagagcaguacucucuugacu

SEQ ID NO: 1120718 - RNA, 23 nt, Human
aggcccugccugucccucuuuuu

SEQ ID NO: 1120719 - RNA, 22 nt, Human
uccaguucuaggucacucucug

SEQ ID NO: 1120720 - RNA, 22 nt, Human
ugagccagucugucugggugaa

SEQ ID NO: 1120721 - RNA, 22 nt, Human
ucucccacgguacaggauaaac

SEQ ID NO: 1120722 - RNA, 22 nt, Human
gaagcagcuggugagauggagc

SEQ ID NO: 1120723 - RNA, 22 nt, Human
agggagguaggagcuucuagcu

SEQ ID NO: 1120724 - RNA, 22 nt, Human
ccagcagcuuuauuggcucucc

SEQ ID NO: 1120725 - RNA, 22 nt, Human
gccuggagcuacuggacacuga

SEQ ID NO: 1120726 - RNA, 22 nt, Human
aagccagcauuuucccauuccu

SEQ ID NO: 1120727 - RNA, 22 nt, Human
caccaggcugaaccagagggga

SEQ ID NO: 1120728 - RNA, 22 nt, Human
cucaggggaccuggcuccgagu

SEQ ID NO: 1120729 - RNA, 22 nt, Human
accaguccgcggagcuccgggg

SEQ ID NO: 1120730 - RNA, 22 nt, Human
gggcugugcugaguaggaggug

SEQ ID NO: 1120731 - RNA, 22 nt, Human
aggccaggcaacauucugaagu

SEQ ID NO: 1120732 - RNA, 20 nt, Human
ucugugugccaucaccuaac

SEQ ID NO: 1120733 - RNA, 21 nt, Human
ugcucacagaugugcucagug

SEQ ID NO: 1120734 - RNA, 22 nt, Human
guggcuucugcggugugcgcag

SEQ ID NO: 1120735 - RNA, 22 nt, Human
ccugccagcccgcguucaugcc

SEQ ID NO: 1120736 - RNA, 22 nt, Human
gaggaaaauggaguguaauuaa

SEQ ID NO: 1120737 - RNA, 22 nt, Human
auggggagagaagggcugagcu

SEQ ID NO: 1120738 - RNA, 22 nt, Human
gcaagcaguuguggcuucugag

SEQ ID NO: 1120739 - RNA, 22 nt, Human
cucuuccucucaugcggucaua

SEQ ID NO: 1120740 - RNA, 22 nt, Human
ccaggcagagggauccccaucc

SEQ ID NO: 1120741 - RNA, 19 nt, Human
acacagggaucagaggguu

SEQ ID NO: 1120742 - RNA, 22 nt, Human
gagcagcucgagaaggaagcag

SEQ ID NO: 1120743 - RNA, 20 nt, Human
caguagcaauaauuagaagc

SEQ ID NO: 1120744 - RNA, 22 nt, Human
cuuucacaguccugacugagcg

SEQ ID NO: 1120745 - RNA, 22 nt, Human
uuucacaucagagguagauuag

SEQ ID NO: 1120746 - RNA, 22 nt, Human
cuugaaagucacaugcagcccu

SEQ ID NO: 1120747 - RNA, 22 nt, Human
ggcagagcugcaugagcacuca

SEQ ID NO: 1120748 - RNA, 22 nt, Human
acugcagccuagggaccacagu

SEQ ID NO: 1120749 - RNA, 22 nt, Human
ugucaugccauuuaaaauguuu

SEQ ID NO: 1120750 - RNA, 22 nt, Human
uggcagagguauauugggagga

SEQ ID NO: 1120751 - RNA, 22 nt, Human
ggccucucuccuuggcuugcag

SEQ ID NO: 1120752 - RNA, 22 nt, Human
ugacacagauuagagacauacc

SEQ ID NO: 1120753 - RNA, 22 nt, Human
ugcaggugcguuuucaagccuc

SEQ ID NO: 1120754 - RNA, 19 nt, Human
gucacauuugucucccagg

SEQ ID NO: 1120755 - RNA, 21 nt, Human
ugggggagaauugguugcuuu

SEQ ID NO: 1120756 - RNA, 21 nt, Human
auccauccaucuuggccuaac

SEQ ID NO: 1120757 - RNA, 22 nt, Human
agcagaagaaagccacaugacu

SEQ ID NO: 1120758 - RNA, 22 nt, Human
uuacuuuguucucaagauaugu

SEQ ID NO: 1120759 - RNA, 22 nt, Human
ucucagggaccaugaugaugac

SEQ ID NO: 1120760 - RNA, 22 nt, Human
agaggcuguuacacucccagau

SEQ ID NO: 1120761 - RNA, 22 nt, Human
ugcauuauacuuuuagaaauuu

SEQ ID NO: 1120762 - RNA, 22 nt, Human
aagcagccuggacuugggcugg

SEQ ID NO: 1120763 - RNA, 22 nt, Human
aguguuccugcucucaggaagc

SEQ ID NO: 1120764 - RNA, 18 nt, Human
aggcuucccaggcaggcc

SEQ ID NO: 1120765 - RNA, 22 nt, Human
cccagcagccagaaugaggagc

SEQ ID NO: 1120766 - RNA, 22 nt, Human
aagcugcccuguguuagaguuc

SEQ ID NO: 1120767 - RNA, 16 nt, Human
agcagccagcacugga

SEQ ID NO: 1120768 - RNA, 22 nt, Human
ugucuccucauacugucauauu

SEQ ID NO: 1120769 - RNA, 22 nt, Human
cauugcacucuggcuggaacgg

SEQ ID NO: 1120770 - RNA, 22 nt, Human
agugaaaugauaguguaaauac

SEQ ID NO: 1120771 - RNA, 22 nt, Human
cagggccagcgucucgggcuau

SEQ ID NO: 1120772 - RNA, 22 nt, Human
aauuucaagucuugaagaagua

SEQ ID NO: 1120773 - RNA, 22 nt, Human
uaccugagcccagugcagcaua

SEQ ID NO: 1120774 - RNA, 22 nt, Human
aggcuggcuuggcucuccugug

SEQ ID NO: 1120775 - RNA, 21 nt, Human
uuguucuuccagaagcaaagu

SEQ ID NO: 1120776 - RNA, 22 nt, Human
aguacuucagaggcugcccagg

SEQ ID NO: 1120777 - RNA, 22 nt, Human
ccagcugcugugcagggaggcu

SEQ ID NO: 1120778 - RNA, 22 nt, Human
ggucccugcugaagccuuggug

SEQ ID NO: 1120779 - RNA, 22 nt, Human
ggaaagaggauaguggguaggu

SEQ ID NO: 1120780 - RNA, 22 nt, Human
caggguggcccuguggucucau

SEQ ID NO: 1120781 - RNA, 22 nt, Human
aaucuggcucagaagaagauga

SEQ ID NO: 1120782 - RNA, 22 nt, Human
ccugccuggaucagccauccug

SEQ ID NO: 1120783 - RNA, 22 nt, Human
aggucauuccuugucuucuugc

SEQ ID NO: 1120784 - RNA, 22 nt, Human
uuuuuccuagugcuuucuggua

SEQ ID NO: 1120785 - RNA, 22 nt, Human
gcaggcagaucaccugucagga

SEQ ID NO: 1120786 - RNA, 22 nt, Human
agccuggcacugaggcagggcg

SEQ ID NO: 1120787 - RNA, 22 nt, Human
aaggcacuuuucuaaagaccuu

SEQ ID NO: 1120788 - RNA, 22 nt, Human
uauuucugauugcucaugaggc

SEQ ID NO: 1120789 - RNA, 22 nt, Human
accauguuggccaagcuggucu

SEQ ID NO: 1120790 - RNA, 21 nt, Human
cagaggggcuagccuggcugc

SEQ ID NO: 1120791 - RNA, 22 nt, Human
cagccaggccuggugaccaaag

SEQ ID NO: 1120792 - RNA, 22 nt, Human
ugccuugguucucuacuuggag

SEQ ID NO: 1120793 - RNA, 22 nt, Human
cuggguggaucgcagccccagg

SEQ ID NO: 1120794 - RNA, 22 nt, Human
agcugaguuaauucaucacuua

SEQ ID NO: 1120795 - RNA, 22 nt, Human
uguauguaaaguuuguaauaga

SEQ ID NO: 1120796 - RNA, 22 nt, Human
aaagacuagcauuuauauguac

SEQ ID NO: 1120797 - RNA, 21 nt, Human
cagggcacacagaggauggua

SEQ ID NO: 1120798 - RNA, 22 nt, Human
agcugguaugaacaggauagga

SEQ ID NO: 1120799 - RNA, 22 nt, Human
cagccagcuucagauccaagcc

SEQ ID NO: 1120800 - RNA, 22 nt, Human
agagcugcaggguggacccagg

SEQ ID NO: 1120801 - RNA, 22 nt, Human
gcuggcuguguuccuucugcca

SEQ ID NO: 1120802 - RNA, 22 nt, Human
ccucauggaccucagacugucc

SEQ ID NO: 1120803 - RNA, 22 nt, Human
agucccaguucgguucuuccuc

SEQ ID NO: 1120804 - RNA, 22 nt, Human
ucuuuggauaucgcuagaccgu

SEQ ID NO: 1120805 - RNA, 22 nt, Human
gcucucugguuccagucaggaa

SEQ ID NO: 1120806 - RNA, 22 nt, Human
cagagagagugggguguggauu

SEQ ID NO: 1120807 - RNA, 22 nt, Human
guuccacaaaauguacccaguu

SEQ ID NO: 1120808 - RNA, 22 nt, Human
uccuggguccauggcagccgaa

SEQ ID NO: 1120809 - RNA, 22 nt, Human
aagagguaaccauagcaaccac

SEQ ID NO: 1120810 - RNA, 22 nt, Human
gggauggcuuuguggcugacuc

SEQ ID NO: 1120811 - RNA, 22 nt, Human
cuccagggagcugcgggagcca

SEQ ID NO: 1120812 - RNA, 22 nt, Human
auucucaaacaagugguuugau

SEQ ID NO: 1120813 - RNA, 22 nt, Human
gagggcugaagauuguggcccc

SEQ ID NO: 1120814 - RNA, 22 nt, Human
ggcccugagcugaaguacugug

SEQ ID NO: 1120815 - RNA, 22 nt, Human
gcugcucuggcucugcaguguc

SEQ ID NO: 1120816 - RNA, 22 nt, Human
uucacauuugcccuuaugugug

SEQ ID NO: 1120817 - RNA, 22 nt, Human
ugaugguugauuauaaaucagu

SEQ ID NO: 1120818 - RNA, 22 nt, Human
cugugaggcccugggugcugga

SEQ ID NO: 1120819 - RNA, 22 nt, Human
auuuuucucuccacuccauuaa

SEQ ID NO: 1120820 - RNA, 22 nt, Human
ccaucagcaugggagcaugggc

SEQ ID NO: 1120821 - RNA, 22 nt, Human
uggcucugcaccucaguguacc

SEQ ID NO: 1120822 - RNA, 22 nt, Human
uauuucuugaguggucaguuuc

SEQ ID NO: 1120823 - RNA, 18 nt, Human
ugucucugaauuccagug

SEQ ID NO: 1120824 - RNA, 22 nt, Human
agaugcugugaggaagcuagga

SEQ ID NO: 1120825 - RNA, 22 nt, Human
ggcaguagccagggacuggcag

SEQ ID NO: 1120826 - RNA, 22 nt, Human
gcugagguaggagguugcagug

SEQ ID NO: 1120827 - RNA, 22 nt, Human
ggagggagucagcugauuagaa

SEQ ID NO: 1120828 - RNA, 22 nt, Human
cucagaauuacaucccauuuua

SEQ ID NO: 1120829 - RNA, 22 nt, Human
ugcuggagaucauuaauguuca

SEQ ID NO: 1120830 - RNA, 22 nt, Human
uggccugguuguugcugccguu

SEQ ID NO: 1120831 - RNA, 22 nt, Human
aagccagggauuccugagggag

SEQ ID NO: 1120832 - RNA, 22 nt, Human
uaggcagcugcaaacuucgguc

SEQ ID NO: 1120833 - RNA, 22 nt, Human
augaguaagaccauaauuuuug

SEQ ID NO: 1120834 - RNA, 22 nt, Human
ggaggcccagagaggugaagug

SEQ ID NO: 1120835 - RNA, 22 nt, Human
gcagugguccaguucacaccca

SEQ ID NO: 1120836 - RNA, 22 nt, Human
aaauguguuccuuugcuacaga

SEQ ID NO: 1120837 - RNA, 22 nt, Human
ugggcacaggggaauggaugaa

SEQ ID NO: 1120838 - RNA, 19 nt, Human
ugucucagugucccuuccu

SEQ ID NO: 1120839 - RNA, 22 nt, Human
uuguuucagcuguaugcuaugu

SEQ ID NO: 1120840 - RNA, 22 nt, Human
cagggcagaacauauagauagu

SEQ ID NO: 1120841 - RNA, 22 nt, Human
cacugcagcaccaugcagggcu

SEQ ID NO: 1120842 - RNA, 17 nt, Human
agcagcugaagcagcca

SEQ ID NO: 1120843 - RNA, 20 nt, Human
cugagcugagcuccaugggu

SEQ ID NO: 1120844 - RNA, 22 nt, Human
gccuaauaugcaaaauugauac

SEQ ID NO: 1120845 - RNA, 22 nt, Human
aaaaugugcaguuuuuaagcug

SEQ ID NO: 1120846 - RNA, 22 nt, Human
ugcucuguaacaaauugacaug

SEQ ID NO: 1120847 - RNA, 19 nt, Human
acagagcucucugcuucug

SEQ ID NO: 1120848 - RNA, 22 nt, Human
cuugugcaauugacauugaauc

SEQ ID NO: 1120849 - RNA, 22 nt, Human
ucucagagauucagggagaagu

SEQ ID NO: 1120850 - RNA, 22 nt, Human
uggccucucuaccaggcagccu

SEQ ID NO: 1120851 - RNA, 22 nt, Human
gguucacacuuucaugauuuca

SEQ ID NO: 1120852 - RNA, 22 nt, Human
uguggcugacuccuggucccca

SEQ ID NO: 1120853 - RNA, 22 nt, Human
uggcucaggcuugaaaauagau

SEQ ID NO: 1120854 - RNA, 22 nt, Human
ucugcagcgugcaggcuggugc

SEQ ID NO: 1120855 - RNA, 22 nt, Human
ucuggcucaggucagacaggga

SEQ ID NO: 1120856 - RNA, 22 nt, Human
ucaugacaacuauauuauucca

SEQ ID NO: 1120857 - RNA, 22 nt, Human
ccucaggggcuuuucguuguug

SEQ ID NO: 1120858 - RNA, 22 nt, Human
cccuggaggaaaaucugaggcu

SEQ ID NO: 1120859 - RNA, 22 nt, Human
cagagcagaagcgguccucaca

SEQ ID NO: 1120860 - RNA, 22 nt, Human
gaacagaagaggcuggugccac

SEQ ID NO: 1120861 - RNA, 22 nt, Human
ggaggccaaggagggcggauca

SEQ ID NO: 1120862 - RNA, 22 nt, Human
aaaguuugcaauuuauguuaau

SEQ ID NO: 1120863 - RNA, 20 nt, Human
cuggcaggagcgagucuacc

SEQ ID NO: 1120864 - RNA, 22 nt, Human
caugagauaauuuuucuccagu

SEQ ID NO: 1120865 - RNA, 22 nt, Human
uccucagacuucccuuugugua

SEQ ID NO: 1120866 - RNA, 22 nt, Human
ccagagcccagggucaugcagg

SEQ ID NO: 1120867 - RNA, 22 nt, Human
acacaggaagucagcacugaug

SEQ ID NO: 1120868 - RNA, 22 nt, Human
cagggcccaggccacuggguug

SEQ ID NO: 1120869 - RNA, 22 nt, Human
aaagaggaaccaagagcacgug

SEQ ID NO: 1120870 - RNA, 22 nt, Human
ucccagagugugggcaucaagg

SEQ ID NO: 1120871 - RNA, 22 nt, Human
gagccaggcaccuucuguguug

SEQ ID NO: 1120872 - RNA, 22 nt, Human
cagcuggggcagccacgugcgg

SEQ ID NO: 1120873 - RNA, 22 nt, Human
ugaagcccugugucagcuucca

SEQ ID NO: 1120874 - RNA, 22 nt, Human
guauuugauagauuucaaagga

SEQ ID NO: 1120875 - RNA, 22 nt, Human
ggcucugcuggauugaggccag

SEQ ID NO: 1120876 - RNA, 22 nt, Human
gugcauuugacgaauacucacu

SEQ ID NO: 1120877 - RNA, 22 nt, Human
auugaaagcauggauuuggauu

SEQ ID NO: 1120878 - RNA, 23 nt, Human
uggugccucagaagcagugggcu

SEQ ID NO: 1120879 - RNA, 22 nt, Human
ggccugcuucucagugagcuug

SEQ ID NO: 1120880 - RNA, 22 nt, Human
uagaaauccccagucucauagu

SEQ ID NO: 1120881 - RNA, 20 nt, Human
ugucagugccugaggcacag

SEQ ID NO: 1120882 - RNA, 22 nt, Human
agcugagcuaguaguuccagug

SEQ ID NO: 1120883 - RNA, 22 nt, Human
gcugagggcuguaacagcagag

SEQ ID NO: 1120884 - RNA, 22 nt, Human
ggcccugggcagaggagugggc

SEQ ID NO: 1120885 - RNA, 22 nt, Human
gcaggcaguuugcuuuucccuc

SEQ ID NO: 1120886 - RNA, 22 nt, Human
ggcaggagggcggacaaugacc

SEQ ID NO: 1120887 - RNA, 22 nt, Human
uggggacauagccagucuggcu

SEQ ID NO: 1120888 - RNA, 22 nt, Human
uacauacacaaauauacuguuu

SEQ ID NO: 1120889 - RNA, 22 nt, Human
agccagggacgcugcaggcuac

SEQ ID NO: 1120890 - RNA, 22 nt, Human
ucaggggcugugcauuucccag

SEQ ID NO: 1120891 - RNA, 22 nt, Human
aaagauuugaguucugcuuaua

SEQ ID NO: 1120892 - RNA, 23 nt, Human
cccagcagagaugaggagggguc

SEQ ID NO: 1120893 - RNA, 20 nt, Human
cugcucugcuuugcaggugg

SEQ ID NO: 1120894 - RNA, 22 nt, Human
cugcugucuuuauuucacugcu

SEQ ID NO: 1120895 - RNA, 22 nt, Human
cauagcaacagcaucaagucaa

SEQ ID NO: 1120896 - RNA, 22 nt, Human
ggcacugacugugcagcgcacc

SEQ ID NO: 1120897 - RNA, 22 nt, Human
uuuucauuuuuguagaugcaag

SEQ ID NO: 1120898 - RNA, 22 nt, Human
gagcugaguuaccuccagauca

SEQ ID NO: 1120899 - RNA, 22 nt, Human
cauuuacuguugaaucccuagc

SEQ ID NO: 1120900 - RNA, 22 nt, Human
guccucugggagccuugagccu

SEQ ID NO: 1120901 - RNA, 22 nt, Human
ccaccagcuucagcagccgcgg

SEQ ID NO: 1120902 - RNA, 22 nt, Human
uggagccaggagccugggaguc

SEQ ID NO: 1120903 - RNA, 22 nt, Human
cuacugaguccuucagcugcca

SEQ ID NO: 1120904 - RNA, 18 nt, Human
cuccagggaacucaguca

SEQ ID NO: 1120905 - RNA, 22 nt, Human
aaucuggcauuugagaguagga

SEQ ID NO: 1120906 - RNA, 22 nt, Human
ucccagaguauuagcaauugcu

SEQ ID NO: 1120907 - RNA, 22 nt, Human
uguacaguaggaacuuguuauu

SEQ ID NO: 1120908 - RNA, 22 nt, Human
uuggaaggagucaaccagcuga

SEQ ID NO: 1120909 - RNA, 22 nt, Human
gagagcugcaagguagggcggg

SEQ ID NO: 1120910 - RNA, 18 nt, Human
gcuccuggaccaggucac

SEQ ID NO: 1120911 - RNA, 22 nt, Human
gcauuuauuucuuuacugcauc

SEQ ID NO: 1120912 - RNA, 22 nt, Human
ucuggcuccacucugugcaugc

SEQ ID NO: 1120913 - RNA, 22 nt, Human
cacagaaucugugacuccaaga

SEQ ID NO: 1120914 - RNA, 22 nt, Human
uggccugguaccacauagauuu

SEQ ID NO: 1120915 - RNA, 22 nt, Human
cugccacuuacuaggcauggug

SEQ ID NO: 1120916 - RNA, 22 nt, Human
uggcucaguuucugcccagcug

SEQ ID NO: 1120917 - RNA, 22 nt, Human
caaaguauauuggauugaaugg

SEQ ID NO: 1120918 - RNA, 22 nt, Human
uccuggaggcaaaugaagacuc

SEQ ID NO: 1120919 - RNA, 22 nt, Human
agcagcaacuuauuuuucuuau

SEQ ID NO: 1120920 - RNA, 22 nt, Human
agcugcugugugcucaggcagg

SEQ ID NO: 1120921 - RNA, 20 nt, Human
gaggcucugggcauggcgcc

SEQ ID NO: 1120922 - RNA, 22 nt, Human
acugaaagauaaaucaguuagc

SEQ ID NO: 1120923 - RNA, 22 nt, Human
ugacagggugauuaugagagcu

SEQ ID NO: 1120924 - RNA, 22 nt, Human
cugccgaguacagccauagaaa

SEQ ID NO: 1120925 - RNA, 22 nt, Human
agcagcucuuaacaaagcaugg

SEQ ID NO: 1120926 - RNA, 22 nt, Human
guucagggagggacagaugaag

SEQ ID NO: 1120927 - RNA, 22 nt, Human
agcaggcuuucaagagucuucu

SEQ ID NO: 1120928 - RNA, 19 nt, Human
acagaaauguaagugagac

SEQ ID NO: 1120929 - RNA, 22 nt, Human
cugagccaguagucagggacaa

SEQ ID NO: 1120930 - RNA, 22 nt, Human
aggaggccgauuucagaggucg

SEQ ID NO: 1120931 - RNA, 22 nt, Human
guucauuuaugauguaacaugu

SEQ ID NO: 1120932 - RNA, 22 nt, Human
uggcucagccagcccuaggaac

SEQ ID NO: 1120933 - RNA, 22 nt, Human
gggucucucucggcuccacgcg

SEQ ID NO: 1120934 - RNA, 22 nt, Human
ggaggugggagacauaggcggc

SEQ ID NO: 1120935 - RNA, 22 nt, Human
gccaccaggagcccaguccaaa

SEQ ID NO: 1120936 - RNA, 22 nt, Human
ggauccuucuuugaccucacag

SEQ ID NO: 1120937 - RNA, 22 nt, Human
ugaaaucuccucuuuauauauc

SEQ ID NO: 1120938 - RNA, 22 nt, Human
gagccuggagcuggaacgaagc

SEQ ID NO: 1120939 - RNA, 22 nt, Human
uagagcuggaauuugcagcaag

SEQ ID NO: 1120940 - RNA, 19 nt, Human
uacuuuuucaggacagagu

SEQ ID NO: 1120941 - RNA, 22 nt, Human
cucaguuucuucauauuguagg

SEQ ID NO: 1120942 - RNA, 22 nt, Human
agaauucuccuucagggcagga

SEQ ID NO: 1120943 - RNA, 19 nt, Human
agcauccagucaugggauc

SEQ ID NO: 1120944 - RNA, 22 nt, Human
gucucagaccacccucuuuggc

SEQ ID NO: 1120945 - RNA, 22 nt, Human
cucuccuugcagauggcugccu

SEQ ID NO: 1120946 - RNA, 22 nt, Human
gaaugcacacgugugugcaugc

SEQ ID NO: 1120947 - RNA, 22 nt, Human
ugucccagcacuuugggagucu

SEQ ID NO: 1120948 - RNA, 22 nt, Human
aaugaugguauugaugagcuaa

SEQ ID NO: 1120949 - RNA, 22 nt, Human
aauguguauacuggcaauuaag

SEQ ID NO: 1120950 - RNA, 22 nt, Human
ggggcagagaauaaaaaccuaa

SEQ ID NO: 1120951 - RNA, 22 nt, Human
agggcagagagaugaaugggau

SEQ ID NO: 1120952 - RNA, 22 nt, Human
uguacauuuagagcucaauaga

SEQ ID NO: 1120953 - RNA, 22 nt, Human
aaguucaaggugauaguggcag

SEQ ID NO: 1120954 - RNA, 22 nt, Human
caggccuccacuccacgcagac

SEQ ID NO: 1120955 - RNA, 22 nt, Human
agucucugugagcucccaaugg

SEQ ID NO: 1120956 - RNA, 22 nt, Human
gaugccugcauuucaggagagu

SEQ ID NO: 1120957 - RNA, 22 nt, Human
gcaggggcuaaggacacagaga

SEQ ID NO: 1120958 - RNA, 22 nt, Human
agcucccaggcagucaugagga

SEQ ID NO: 1120959 - RNA, 22 nt, Human
aggcacuguucccaguuauccu

SEQ ID NO: 1120960 - RNA, 22 nt, Human
agcagcugucccuuaacaucag

SEQ ID NO: 1120961 - RNA, 22 nt, Human
aggcacugaaagguggccagag

SEQ ID NO: 1120962 - RNA, 22 nt, Human
aaagaacaaauuagcuguuuua

SEQ ID NO: 1120963 - RNA, 22 nt, Human
agauggggcucaguguggaggc

SEQ ID NO: 1120964 - RNA, 19 nt, Human
uggcuccugccugccuucu

SEQ ID NO: 1120965 - RNA, 22 nt, Human
caaaguccuagaacagugcuug

SEQ ID NO: 1120966 - RNA, 22 nt, Human
accaucagucacauguagagaa

SEQ ID NO: 1120967 - RNA, 22 nt, Human
caggcuggaguuaccuuuaggg

SEQ ID NO: 1120968 - RNA, 23 nt, Human
uccugagaugagacagugcugcc

SEQ ID NO: 1120969 - RNA, 22 nt, Human
ugggcagaaugugggauccaga

SEQ ID NO: 1120970 - RNA, 22 nt, Human
cucugggcacauuuuccaggac

SEQ ID NO: 1120971 - RNA, 22 nt, Human
cagcugaggucaaagaagcagg

SEQ ID NO: 1120972 - RNA, 22 nt, Human
cccuggagggacagcugcucua

SEQ ID NO: 1120973 - RNA, 22 nt, Human
cauugcacuccagcuugggcaa

SEQ ID NO: 1120974 - RNA, 19 nt, Human
uggcagggagaguuugaag

SEQ ID NO: 1120975 - RNA, 22 nt, Human
uuccaguucccaugaggauuaa

SEQ ID NO: 1120976 - RNA, 22 nt, Human
cugaggcuuugugugcaugccu

SEQ ID NO: 1120977 - RNA, 22 nt, Human
gguccccagcaguggcugcuuc

SEQ ID NO: 1120978 - RNA, 22 nt, Human
uauuuagaacagacaauagaaa

SEQ ID NO: 1120979 - RNA, 22 nt, Human
ccugggcauucuuugaguucuc

SEQ ID NO: 1120980 - RNA, 22 nt, Human
gcugggcagccuggccgcugcc

SEQ ID NO: 1120981 - RNA, 22 nt, Human
auggccugggcccgcuucagau

SEQ ID NO: 1120982 - RNA, 22 nt, Human
accuggccauccagcuggcauc

SEQ ID NO: 1120983 - RNA, 22 nt, Human
auguacaguuucuagacucaaa

SEQ ID NO: 1120984 - RNA, 22 nt, Human
ggugacuggagggacccaggcc

SEQ ID NO: 1120985 - RNA, 22 nt, Human
uuugaaaauuuaagugcuacac

SEQ ID NO: 1120986 - RNA, 22 nt, Human
uagaucugauacaauucaucug

SEQ ID NO: 1120987 - RNA, 22 nt, Human
cucagaguccccaguggguuug

SEQ ID NO: 1120988 - RNA, 22 nt, Human
ugcuggccaauggcagaggcgg

SEQ ID NO: 1120989 - RNA, 22 nt, Human
ggccuugggauguggcugcagc

SEQ ID NO: 1120990 - RNA, 22 nt, Human
aagacaagcaucaaaucaggca

SEQ ID NO: 1120991 - RNA, 23 nt, Human
gccugccugaccugugcaaaguc

SEQ ID NO: 1120992 - RNA, 22 nt, Human
ggccucagaccggagcuggcca

SEQ ID NO: 1120993 - RNA, 22 nt, Human
gccugaugagcuuccagcugag

SEQ ID NO: 1120994 - RNA, 22 nt, Human
uguguacaagaguguuuacugu

SEQ ID NO: 1120995 - RNA, 22 nt, Human
cagagcuguccaaacccugaca

SEQ ID NO: 1120996 - RNA, 18 nt, Human
cccagcccaccauuucuc

SEQ ID NO: 1120997 - RNA, 22 nt, Human
gugcuuuccauccucccugcug

SEQ ID NO: 1120998 - RNA, 22 nt, Human
ugguaaaguguacugaauauga

SEQ ID NO: 1120999 - RNA, 22 nt, Human
aaaaaugaaacggcugguuggc

SEQ ID NO: 1121000 - RNA, 22 nt, Human
aggcuuccuggaggaagaggua

SEQ ID NO: 1121001 - RNA, 22 nt, Human
aguuauauuccauagauucaga

SEQ ID NO: 1121002 - RNA, 22 nt, Human
ugcauuugucuugucucaugaa

SEQ ID NO: 1121003 - RNA, 19 nt, Human
gcugucugaugcugagguc

SEQ ID NO: 1121004 - RNA, 22 nt, Human
agaaaucaugacuaagagcagu

SEQ ID NO: 1121005 - RNA, 22 nt, Human
ugccagccagguucugaggcua

SEQ ID NO: 1121006 - RNA, 23 nt, Human
cccuguagcccaggacaggcuuu

SEQ ID NO: 1121007 - RNA, 22 nt, Human
uacuuccagcaaucugcauauu

SEQ ID NO: 1121008 - RNA, 22 nt, Human
uggagcagggcaucacugugcg

SEQ ID NO: 1121009 - RNA, 22 nt, Human
gggcucuggauggagccugcag

SEQ ID NO: 1121010 - RNA, 22 nt, Human
ccagggcugagcugugaccaug

SEQ ID NO: 1121011 - RNA, 22 nt, Human
agcuggcauacuuugcuaggaa

SEQ ID NO: 1121012 - RNA, 17 nt, Human
agcugccagggagugug

SEQ ID NO: 1121013 - RNA, 22 nt, Human
ugccucuguggaaauggugguc

SEQ ID NO: 1121014 - RNA, 22 nt, Human
cagcagagcuuauguuggguca

SEQ ID NO: 1121015 - RNA, 22 nt, Human
cacaaugcguacauauaucaaa

SEQ ID NO: 1121016 - RNA, 22 nt, Human
gccuggugcuaugagggccagc

SEQ ID NO: 1121017 - RNA, 22 nt, Human
cccuggaguccuggcaguugau

SEQ ID NO: 1121018 - RNA, 22 nt, Human
cccuggaggaccccaauguggc

SEQ ID NO: 1121019 - RNA, 22 nt, Human
agauuguagaaacuguagcauu

SEQ ID NO: 1121020 - RNA, 19 nt, Human
ggcuccuguggcugcagcc

SEQ ID NO: 1121021 - RNA, 22 nt, Human
uagacacauccguggaagcuuc

SEQ ID NO: 1121022 - RNA, 22 nt, Human
ggucaggggcugcucuacagag

SEQ ID NO: 1121023 - RNA, 22 nt, Human
uggugcuguggaggggcagaag

SEQ ID NO: 1121024 - RNA, 21 nt, Human
acaggcuuuagaaaaugacuc

SEQ ID NO: 1121025 - RNA, 22 nt, Human
cacagggcaccaguuggccauc

SEQ ID NO: 1121026 - RNA, 23 nt, Human
ugcauuauccucucugaagacca

SEQ ID NO: 1121027 - RNA, 22 nt, Human
ggccaccuuccaguugccugca

SEQ ID NO: 1121028 - RNA, 22 nt, Human
uggccugggucacaccaggguc

SEQ ID NO: 1121029 - RNA, 22 nt, Human
gggugggccugucuggccaugu

SEQ ID NO: 1121030 - RNA, 22 nt, Human
uagagugguuaacaguuuagaa

SEQ ID NO: 1121031 - RNA, 22 nt, Human
ugacagaaagaauaugucaauc

SEQ ID NO: 1121032 - RNA, 22 nt, Human
ucccaaagcuacucuucugacu

SEQ ID NO: 1121033 - RNA, 20 nt, Human
ggcagagcuaugucuguugc

SEQ ID NO: 1121034 - RNA, 22 nt, Human
ugccucagagugggcuugcuau

SEQ ID NO: 1121035 - RNA, 22 nt, Human
aaugcacacauuugguacugaa

SEQ ID NO: 1121036 - RNA, 22 nt, Human
ggagcugaaggggugggcucag

SEQ ID NO: 1121037 - RNA, 22 nt, Human
aggagcugcaaauauuaguaau

SEQ ID NO: 1121038 - RNA, 22 nt, Human
agggagaaaauuggaugcacaa

SEQ ID NO: 1121039 - RNA, 22 nt, Human
gcagggcucugcuguaguccua

SEQ ID NO: 1121040 - RNA, 22 nt, Human
ucagcaaugagaacuggcauuu

SEQ ID NO: 1121041 - RNA, 22 nt, Human
ugguacuuggaggcagaaaaau

SEQ ID NO: 1121042 - RNA, 22 nt, Human
gccugcuguuaacugcaggaau

SEQ ID NO: 1121043 - RNA, 22 nt, Human
gcucugagagugggugauucug

SEQ ID NO: 1121044 - RNA, 22 nt, Human
uggccacccagcugacgccuuc

SEQ ID NO: 1121045 - RNA, 22 nt, Human
cuggccuggagccucugggugg

SEQ ID NO: 1121046 - RNA, 22 nt, Human
aucuggcuggauucuuagcguu

SEQ ID NO: 1121047 - RNA, 22 nt, Human
ucagaggagccaaaguucugag

SEQ ID NO: 1121048 - RNA, 22 nt, Human
aggcugagauagguggaucauu

SEQ ID NO: 1121049 - RNA, 22 nt, Human
cagcaauaaugucuacaaaucu

SEQ ID NO: 1121050 - RNA, 22 nt, Human
cagagccucagaauccugugga

SEQ ID NO: 1121051 - RNA, 22 nt, Human
cucuggagcauuucaccuacau

SEQ ID NO: 1121052 - RNA, 20 nt, Human
aggcagagcgcacuuuuaga

SEQ ID NO: 1121053 - RNA, 22 nt, Human
cucacaggagaaagucaugguc

SEQ ID NO: 1121054 - RNA, 22 nt, Human
gcagagugggagcccagggcug

SEQ ID NO: 1121055 - RNA, 22 nt, Human
ccagcccugucaccaacuggag

SEQ ID NO: 1121056 - RNA, 22 nt, Human
cagcuccagcccaggcagcucc

SEQ ID NO: 1121057 - RNA, 22 nt, Human
gaugcacaugugaguauagaag

SEQ ID NO: 1121058 - RNA, 21 nt, Human
uuaagagcuuagcaguaggcc

SEQ ID NO: 1121059 - RNA, 22 nt, Human
gcuggcugcgucaucacagggc

SEQ ID NO: 1121060 - RNA, 22 nt, Human
cccaggcagagagcuggugagc

SEQ ID NO: 1121061 - RNA, 22 nt, Human
ugggcugcugcggugcucuugg

SEQ ID NO: 1121062 - RNA, 22 nt, Human
aggucacauggauaaugaucag

SEQ ID NO: 1121063 - RNA, 22 nt, Human
cagaggugcauacaggucauua

SEQ ID NO: 1121064 - RNA, 22 nt, Human
gcuggccacacugcugauggag

SEQ ID NO: 1121065 - RNA, 22 nt, Human
guguuuccucacuucucugacu

SEQ ID NO: 1121066 - RNA, 22 nt, Human
aaaucagucccucuuggaauuu

SEQ ID NO: 1121067 - RNA, 22 nt, Human
auuugagaugguaaauaacuuu

SEQ ID NO: 1121068 - RNA, 22 nt, Human
ccuggcagcuccuccccggcgg

SEQ ID NO: 1121069 - RNA, 22 nt, Human
uuuguaaauagcaguacucaug

SEQ ID NO: 1121070 - RNA, 18 nt, Human
ggcugccuguuccugaag

SEQ ID NO: 1121071 - RNA, 22 nt, Human
uggggacacagagguucguugg

SEQ ID NO: 1121072 - RNA, 22 nt, Human
uagacagauuucuuguuagaca

SEQ ID NO: 1121073 - RNA, 22 nt, Human
aaugcacaugccacauguggua

SEQ ID NO: 1121074 - RNA, 22 nt, Human
ugccuaggaaaccucaugcuuc

SEQ ID NO: 1121075 - RNA, 22 nt, Human
cagcagggcccccgggugcgcc

SEQ ID NO: 1121076 - RNA, 22 nt, Human
aaaagguuuugaguacaaauau

SEQ ID NO: 1121077 - RNA, 22 nt, Human
ggugggcaacauuuggccugag

SEQ ID NO: 1121078 - RNA, 22 nt, Human
ugucuucaucuccaugcacaga

SEQ ID NO: 1121079 - RNA, 22 nt, Human
caaagcaaggcucaguuugaac

SEQ ID NO: 1121080 - RNA, 22 nt, Human
gcucacuggccugaagaggacg

SEQ ID NO: 1121081 - RNA, 22 nt, Human
caggaugggugucggccagcac

SEQ ID NO: 1121082 - RNA, 22 nt, Human
cucagaguccauaguuuacagu

SEQ ID NO: 1121083 - RNA, 22 nt, Human
gcaggcaggcuuccuugaacug

SEQ ID NO: 1121084 - RNA, 22 nt, Human
agaugggcgcccuggacugagg

SEQ ID NO: 1121085 - RNA, 22 nt, Human
ccuggcugggguagaagugagg

SEQ ID NO: 1121086 - RNA, 22 nt, Human
auugacaagcaguaugucuuag

SEQ ID NO: 1121087 - RNA, 22 nt, Human
guacauuuugagguuaaaacaa

SEQ ID NO: 1121088 - RNA, 22 nt, Human
ccuuuccuuuuuagugugggag

SEQ ID NO: 1121089 - RNA, 22 nt, Human
aaguucaauggaaaagcuuuag

SEQ ID NO: 1121090 - RNA, 22 nt, Human
agagaauuacagaagaauguca

SEQ ID NO: 1121091 - RNA, 22 nt, Human
ccucagaggugaacaucagugc

SEQ ID NO: 1121092 - RNA, 22 nt, Human
aagagcugauuaagucaugagg

SEQ ID NO: 1121093 - RNA, 22 nt, Human
acagagcaauaacagggagagg

SEQ ID NO: 1121094 - RNA, 22 nt, Human
cccuggagcugcuugcauguug

SEQ ID NO: 1121095 - RNA, 22 nt, Human
gcugggagucgcgucuguggcc

SEQ ID NO: 1121096 - RNA, 20 nt, Human
uaggcagagcugugcagccu

SEQ ID NO: 1121097 - RNA, 17 nt, Human
agugacuuggaaagagc

SEQ ID NO: 1121098 - RNA, 22 nt, Human
ggagauuuauagcacacuucag

SEQ ID NO: 1121099 - RNA, 22 nt, Human
cuauugaauagcccaaaucauu

SEQ ID NO: 1121100 - RNA, 22 nt, Human
uggcuuucucccccagcuucuc

SEQ ID NO: 1121101 - RNA, 22 nt, Human
agucccagcccaguccuguaag

SEQ ID NO: 1121102 - RNA, 22 nt, Human
cuugucugugucggauaaaacu

SEQ ID NO: 1121103 - RNA, 22 nt, Human
gcagauggugccaugucuugug

SEQ ID NO: 1121104 - RNA, 22 nt, Human
gccuggcaggccuguuggggcu

SEQ ID NO: 1121105 - RNA, 22 nt, Human
caaauguguagagcuuuugggg

SEQ ID NO: 1121106 - RNA, 22 nt, Human
ucaucacuguaucauugauaga

SEQ ID NO: 1121107 - RNA, 22 nt, Human
uucagugugugauaccugcugu

SEQ ID NO: 1121108 - RNA, 20 nt, Human
uccaagggcagcagaaucag

SEQ ID NO: 1121109 - RNA, 22 nt, Human
gccagagcugagacacgagucc

SEQ ID NO: 1121110 - RNA, 22 nt, Human
gaaugcagauggcugguguaug

SEQ ID NO: 1121111 - RNA, 22 nt, Human
acaauucucucauaucuuauua

SEQ ID NO: 1121112 - RNA, 22 nt, Human
gcacccagaauaaggacaggac

SEQ ID NO: 1121113 - RNA, 22 nt, Human
gcacacaguauaugcucauuaa

SEQ ID NO: 1121114 - RNA, 18 nt, Human
agcagagcccaugcauuc

SEQ ID NO: 1121115 - RNA, 22 nt, Human
uagauuucucauucauagauug

SEQ ID NO: 1121116 - RNA, 19 nt, Human
auagucuuuccaauuauac

SEQ ID NO: 1121117 - RNA, 22 nt, Human
ugcuggaggaguuuacuguggc

SEQ ID NO: 1121118 - RNA, 22 nt, Human
gcaaggcugagcacauuugcau

SEQ ID NO: 1121119 - RNA, 22 nt, Human
ccaggugguucaggucaccaua

SEQ ID NO: 1121120 - RNA, 22 nt, Human
ggcugcuguuucagagacuguu

SEQ ID NO: 1121121 - RNA, 22 nt, Human
cugugucggacgugggcagcag

SEQ ID NO: 1121122 - RNA, 22 nt, Human
gaggcagaaguugcagugagca

SEQ ID NO: 1121123 - RNA, 22 nt, Human
gaaguucaggugggaauugagc

SEQ ID NO: 1121124 - RNA, 22 nt, Human
ccagucccagcucugccaugcu

SEQ ID NO: 1121125 - RNA, 22 nt, Human
gccucugcacuguggcacacca

SEQ ID NO: 1121126 - RNA, 22 nt, Human
auugacaagugagcugggcugc

SEQ ID NO: 1121127 - RNA, 22 nt, Human
acagcagcauaaacugacuaag

SEQ ID NO: 1121128 - RNA, 22 nt, Human
agcaccuggucuccuggcgcug

SEQ ID NO: 1121129 - RNA, 19 nt, Human
uuagaaacuguugacacug

SEQ ID NO: 1121130 - RNA, 22 nt, Human
aggcccagggcugcucucugaa

SEQ ID NO: 1121131 - RNA, 22 nt, Human
ugcagugguguccagguguacu

SEQ ID NO: 1121132 - RNA, 22 nt, Human
ucccuuaaaacucauguguugu

SEQ ID NO: 1121133 - RNA, 22 nt, Human
ggccucucuccagucagugcag

SEQ ID NO: 1121134 - RNA, 22 nt, Human
gagcagcuggacaggccucccu

SEQ ID NO: 1121135 - RNA, 23 nt, Human
cagaagcaccuguugacugcugc

SEQ ID NO: 1121136 - RNA, 22 nt, Human
uaacagaaaagaacugaguuug

SEQ ID NO: 1121137 - RNA, 19 nt, Human
gcugcucugggucucaucu

SEQ ID NO: 1121138 - RNA, 22 nt, Human
acguguucaauuuccaucugac

SEQ ID NO: 1121139 - RNA, 22 nt, Human
ccagcugcaggggagcagugga

SEQ ID NO: 1121140 - RNA, 22 nt, Human
auaacagaguugggaagugaaa

SEQ ID NO: 1121141 - RNA, 22 nt, Human
uguuacacagcagaauagcaag

SEQ ID NO: 1121142 - RNA, 16 nt, Human
uguuagcugugcauua

SEQ ID NO: 1121143 - RNA, 22 nt, Human
aggagaguucacacuggucaga

SEQ ID NO: 1121144 - RNA, 22 nt, Human
aaccaggacaauuuugaaagua

SEQ ID NO: 1121145 - RNA, 22 nt, Human
gccagcccagcuccaggggaaa

SEQ ID NO: 1121146 - RNA, 22 nt, Human
ccaaaugcuccacugacuuugg

SEQ ID NO: 1121147 - RNA, 18 nt, Human
cagaaguccuucaaggcc

SEQ ID NO: 1121148 - RNA, 17 nt, Human
agaugcuggccacaugu

SEQ ID NO: 1121149 - RNA, 22 nt, Human
ccagcagagggucuuggccauu

SEQ ID NO: 1121150 - RNA, 22 nt, Human
guggcugguuuccugcaugcaa

SEQ ID NO: 1121151 - RNA, 22 nt, Human
cugcaggggccucgagcacagg

SEQ ID NO: 1121152 - RNA, 22 nt, Human
cugcagagcauaaaucugaaua

SEQ ID NO: 1121153 - RNA, 22 nt, Human
aaggcacugcuuugcugcgccc

SEQ ID NO: 1121154 - RNA, 22 nt, Human
agcucccagaagccagagucgg

SEQ ID NO: 1121155 - RNA, 22 nt, Human
ugcaggccucacaccuggcacc

SEQ ID NO: 1121156 - RNA, 22 nt, Human
agucucagaguaccugagggac

SEQ ID NO: 1121157 - RNA, 22 nt, Human
uggacucagugcugccauuccc

SEQ ID NO: 1121158 - RNA, 22 nt, Human
aacacaaagaagcugcaggauc

SEQ ID NO: 1121159 - RNA, 22 nt, Human
cagccagcugaauguaccauga

SEQ ID NO: 1121160 - RNA, 22 nt, Human
cccaggcugaguuagagguguc

SEQ ID NO: 1121161 - RNA, 18 nt, Human
augggaggggccaagaga

SEQ ID NO: 1121162 - RNA, 22 nt, Human
ccucccagugccuccagagcag

SEQ ID NO: 1121163 - RNA, 22 nt, Human
ccagcuugaagaugugcugguu

SEQ ID NO: 1121164 - RNA, 22 nt, Human
gagcccuccauggagccaggca

SEQ ID NO: 1121165 - RNA, 22 nt, Human
augguguagcaugugauaugac

SEQ ID NO: 1121166 - RNA, 22 nt, Human
ugggccacggggguggagagcu

SEQ ID NO: 1121167 - RNA, 22 nt, Human
ccugucugcagauaucucaggu

SEQ ID NO: 1121168 - RNA, 22 nt, Human
gccuggcaggccucaugagggg

SEQ ID NO: 1121169 - RNA, 22 nt, Human
uagccgggugugguggaacucc

SEQ ID NO: 1121170 - RNA, 22 nt, Human
ugccucugguuaucugguaccu

SEQ ID NO: 1121171 - RNA, 22 nt, Human
cugaggcaugaaugugggcuuu

SEQ ID NO: 1121172 - RNA, 22 nt, Human
aaggcucuuggagugaaugcag

SEQ ID NO: 1121173 - RNA, 22 nt, Human
gggagggaagguaccuguguga

SEQ ID NO: 1121174 - RNA, 22 nt, Human
auuuccuagccucucuugcagu

SEQ ID NO: 1121175 - RNA, 22 nt, Human
auuguauuuccagcuugaaugu

SEQ ID NO: 1121176 - RNA, 16 nt, Human
gccuggaguggcaggg

SEQ ID NO: 1121177 - RNA, 22 nt, Human
caggcagcugcuggguucagcc

SEQ ID NO: 1121178 - RNA, 22 nt, Human
uuagcugcauuaucaaaguuau

SEQ ID NO: 1121179 - RNA, 22 nt, Human
agucagugaaggcauugcucaa

SEQ ID NO: 1121180 - RNA, 22 nt, Human
cuuggcagcuuuuggaggagcc

SEQ ID NO: 1121181 - RNA, 22 nt, Human
gcugugugcucacguaguggaa

SEQ ID NO: 1121182 - RNA, 22 nt, Human
agaaaugcauuagcacauauag

SEQ ID NO: 1121183 - RNA, 22 nt, Human
gccugggaagacuaagugggag

SEQ ID NO: 1121184 - RNA, 22 nt, Human
gagauucuguagucaggcaucu

SEQ ID NO: 1121185 - RNA, 22 nt, Human
gccugccuagaauugcagcuuu

SEQ ID NO: 1121186 - RNA, 22 nt, Human
cuuauguacacacauauauugu

SEQ ID NO: 1121187 - RNA, 22 nt, Human
ucagaggaccuuacugagaacc

SEQ ID NO: 1121188 - RNA, 22 nt, Human
aucuacagugcacaggacagcc

SEQ ID NO: 1121189 - RNA, 22 nt, Human
ugccugaugcaggaguaucaga

SEQ ID NO: 1121190 - RNA, 22 nt, Human
uggaggcauaggccugggcccu

SEQ ID NO: 1121191 - RNA, 22 nt, Human
ugcucuggggagcuccucugcg

SEQ ID NO: 1121192 - RNA, 22 nt, Human
uuuuaagaugcuaguauuucag

SEQ ID NO: 1121193 - RNA, 22 nt, Human
acguuuucagccuuaauguaga

SEQ ID NO: 1121194 - RNA, 22 nt, Human
ucucugguggcuccaucaguag

SEQ ID NO: 1121195 - RNA, 22 nt, Human
acaggggaauuuacugucauua

SEQ ID NO: 1121196 - RNA, 22 nt, Human
ugucccaguuuugcagguuaga

SEQ ID NO: 1121197 - RNA, 22 nt, Human
agacuuugagcucuuagagaag

SEQ ID NO: 1121198 - RNA, 22 nt, Human
gccugucucuuggaacuuggua

SEQ ID NO: 1121199 - RNA, 22 nt, Human
agagcugaauuuggguggugga

SEQ ID NO: 1121200 - RNA, 22 nt, Human
uucacauuaucaggauuguuuc

SEQ ID NO: 1121201 - RNA, 22 nt, Human
gaaccaaguaggauacaaggag

SEQ ID NO: 1121202 - RNA, 22 nt, Human
cuggugugauugagcccaggug

SEQ ID NO: 1121203 - RNA, 22 nt, Human
cccagagcuccgguccugccca

SEQ ID NO: 1121204 - RNA, 22 nt, Human
uggccugacugucaggcuguau

SEQ ID NO: 1121205 - RNA, 22 nt, Human
uuucacaauuuuaaggagcaaa

SEQ ID NO: 1121206 - RNA, 22 nt, Human
uauugaaauucuucauguccuc

SEQ ID NO: 1121207 - RNA, 22 nt, Human
aacucaguuacauauuagaaua

SEQ ID NO: 1121208 - RNA, 22 nt, Human
cauggcccucuucuggagcaau

SEQ ID NO: 1121209 - RNA, 22 nt, Human
cagcuggcguggagugauugca

SEQ ID NO: 1121210 - RNA, 22 nt, Human
aggggccugguuggccucuguu

SEQ ID NO: 1121211 - RNA, 22 nt, Human
cucugggcaggaccaguggacc

SEQ ID NO: 1121212 - RNA, 22 nt, Human
acagccuguuugaucuggugcu

SEQ ID NO: 1121213 - RNA, 23 nt, Human
guggagccacaucacaggcuccu

SEQ ID NO: 1121214 - RNA, 22 nt, Human
ugcagcauuauucacaguagcc

SEQ ID NO: 1121215 - RNA, 22 nt, Human
gcugccaugguccaggcuccag

SEQ ID NO: 1121216 - RNA, 22 nt, Human
ucugagccaauuucugugucca

SEQ ID NO: 1121217 - RNA, 22 nt, Human
cucuguccuaugcuugauagaa

SEQ ID NO: 1121218 - RNA, 18 nt, Human
ucugagggugcgggagcu

SEQ ID NO: 1121219 - RNA, 21 nt, Human
ucugucugguuuuagaguggc

SEQ ID NO: 1121220 - RNA, 22 nt, Human
caguugcuacaguucaagugug

SEQ ID NO: 1121221 - RNA, 22 nt, Human
cugugcaguaggucagggcugg

SEQ ID NO: 1121222 - RNA, 22 nt, Human
uugcaccauuucacuuccauua

SEQ ID NO: 1121223 - RNA, 20 nt, Human
agagccuugaggaagaugau

SEQ ID NO: 1121224 - RNA, 22 nt, Human
uacccagcuucaagucaggacu

SEQ ID NO: 1121225 - RNA, 19 nt, Human
cauaauacaguggaucuga

SEQ ID NO: 1121226 - RNA, 22 nt, Human
uugcacagaugagggugaugcu

SEQ ID NO: 1121227 - RNA, 22 nt, Human
gcagagccaugggagguuuuug

SEQ ID NO: 1121228 - RNA, 22 nt, Human
augcaguagauaggcacuuuua

SEQ ID NO: 1121229 - RNA, 23 nt, Human
cauguacacacagcuguacagug

SEQ ID NO: 1121230 - RNA, 22 nt, Human
gucccagggaugcagacaugag

SEQ ID NO: 1121231 - RNA, 22 nt, Human
auuuauuaugggauuuggcaca

SEQ ID NO: 1121232 - RNA, 22 nt, Human
gcucuccacugaccacggggca

SEQ ID NO: 1121233 - RNA, 22 nt, Human
ucaaaugcuucuacuccuaaga

SEQ ID NO: 1121234 - RNA, 22 nt, Human
agcagccaaccuuacauucauc

SEQ ID NO: 1121235 - RNA, 21 nt, Human
aaagugguaaggauuauuuug

SEQ ID NO: 1121236 - RNA, 22 nt, Human
agcugguucagaaauuagaugg

SEQ ID NO: 1121237 - RNA, 22 nt, Human
agcccugggaggccagcuugua

SEQ ID NO: 1121238 - RNA, 22 nt, Human
cuggagccccaggcugugcaga

SEQ ID NO: 1121239 - RNA, 22 nt, Human
cagugccaugucugagccccua

SEQ ID NO: 1121240 - RNA, 22 nt, Human
ugagcugggcugggcugagcug

SEQ ID NO: 1121241 - RNA, 17 nt, Human
aguggcaggcagauggg

SEQ ID NO: 1121242 - RNA, 22 nt, Human
uauguuuuucaagugcacacua

SEQ ID NO: 1121243 - RNA, 22 nt, Human
ucccagaaaaaggaggcuauga

SEQ ID NO: 1121244 - RNA, 22 nt, Human
gaaggaagucauuagugcagac

SEQ ID NO: 1121245 - RNA, 22 nt, Human
cacagcagaaauaugaaggcag

SEQ ID NO: 1121246 - RNA, 21 nt, Human
ggcagcccgcccucuccuggc

SEQ ID NO: 1121247 - RNA, 22 nt, Human
gggcucugggaugcucuuagag

SEQ ID NO: 1121248 - RNA, 22 nt, Human
gaggccuggagccgccuaggcg

SEQ ID NO: 1121249 - RNA, 22 nt, Human
ggcaggagcucuccaguuugcc

SEQ ID NO: 1121250 - RNA, 22 nt, Human
cuggcccagucucagaguguca

SEQ ID NO: 1121251 - RNA, 20 nt, Human
ucucaggguucagcaaagua

SEQ ID NO: 1121252 - RNA, 20 nt, Human
aagaaacuugaaaguacaag

SEQ ID NO: 1121253 - RNA, 22 nt, Human
gggcuacauugugagagaaguu

SEQ ID NO: 1121254 - RNA, 22 nt, Human
gccuggcaggccugggccagca

SEQ ID NO: 1121255 - RNA, 22 nt, Human
uggccugauuuugcuaagagaa

SEQ ID NO: 1121256 - RNA, 22 nt, Human
ugggccagcaauugcugcucag

SEQ ID NO: 1121257 - RNA, 22 nt, Human
acaaaugcuuaguucaccaaaa

SEQ ID NO: 1121258 - RNA, 19 nt, Human
guggccugcgcugggugcg

SEQ ID NO: 1121259 - RNA, 22 nt, Human
caaaugcaugagaaauaagagg

SEQ ID NO: 1121260 - RNA, 22 nt, Human
auggccuggggagcaugggaag

SEQ ID NO: 1121261 - RNA, 18 nt, Human
uggagccagcucuaggau

SEQ ID NO: 1121262 - RNA, 22 nt, Human
gcuuccugauauucauacuguu

SEQ ID NO: 1121263 - RNA, 18 nt, Human
gggcaucauucacaaagu

SEQ ID NO: 1121264 - RNA, 18 nt, Human
ggccugaggauuucagca

SEQ ID NO: 1121265 - RNA, 22 nt, Human
cucagagucccuucccucgugg

SEQ ID NO: 1121266 - RNA, 22 nt, Human
caggguggaaaagcuaguugga

SEQ ID NO: 1121267 - RNA, 22 nt, Human
aucuggcuuaccuagggugccu

SEQ ID NO: 1121268 - RNA, 22 nt, Human
cacaugggcguaauguccaugg

SEQ ID NO: 1121269 - RNA, 22 nt, Human
aaaaguaauugcaauuuuguag

SEQ ID NO: 1121270 - RNA, 22 nt, Human
uacacauguuuggcaaguaugu

SEQ ID NO: 1121271 - RNA, 22 nt, Human
gaccagagaaaggcacuggaag

SEQ ID NO: 1121272 - RNA, 23 nt, Human
ucaguuuuggcuguucaguguug

SEQ ID NO: 1121273 - RNA, 22 nt, Human
agugaaaugacugaaucagaua

SEQ ID NO: 1121274 - RNA, 22 nt, Human
cuggccuuuaaaaugaccuuau

SEQ ID NO: 1121275 - RNA, 22 nt, Human
uuagagaaauucugguaaugua

SEQ ID NO: 1121276 - RNA, 22 nt, Human
gaggccugcagcguggucccug

SEQ ID NO: 1121277 - RNA, 22 nt, Human
ggcuggcauccagggaaaucca

SEQ ID NO: 1121278 - RNA, 22 nt, Human
ggucccaguugcccaggucagg

SEQ ID NO: 1121279 - RNA, 22 nt, Human
cgucuuccucuuacgaugcgcu

SEQ ID NO: 1121280 - RNA, 22 nt, Human
uguguacagcaggauuucucaa

SEQ ID NO: 1121281 - RNA, 18 nt, Human
uguuccaaggaaggaauc

SEQ ID NO: 1121282 - RNA, 22 nt, Human
cagccugcauuuguaucuguau

SEQ ID NO: 1121283 - RNA, 23 nt, Human
aggugccaacugagagcugagag

SEQ ID NO: 1121284 - RNA, 22 nt, Human
cugcugagcaucagggcugccc

SEQ ID NO: 1121285 - RNA, 22 nt, Human
aaguuauuuccucgugacugaa

SEQ ID NO: 1121286 - RNA, 22 nt, Human
ucagggacuaggugcugccuga

SEQ ID NO: 1121287 - RNA, 22 nt, Human
acaaaguuaacaguuggauagu

SEQ ID NO: 1121288 - RNA, 22 nt, Human
uccuucagaaaaccucagucuu

SEQ ID NO: 1121289 - RNA, 22 nt, Human
aacaaaugauuguugguuggag

SEQ ID NO: 1121290 - RNA, 22 nt, Human
ucccugggccuccugcuaugca

SEQ ID NO: 1121291 - RNA, 22 nt, Human
aagauuucugcuuuuggaggca

SEQ ID NO: 1121292 - RNA, 22 nt, Human
gcaggaguguauuugcauguaa

SEQ ID NO: 1121293 - RNA, 22 nt, Human
agccuccuggaguuucugggau

SEQ ID NO: 1121294 - RNA, 16 nt, Human
ccuuucucugccuucc

SEQ ID NO: 1121295 - RNA, 22 nt, Human
uguacaugugucuguauaucuu

SEQ ID NO: 1121296 - RNA, 22 nt, Human
gugccuuccccgguggucuguu

SEQ ID NO: 1121297 - RNA, 22 nt, Human
guauccuuugcggaaauuucua

SEQ ID NO: 1121298 - RNA, 20 nt, Human
uuguuucugcuauuuucuaa

SEQ ID NO: 1121299 - RNA, 20 nt, Human
ugugugcacacaugacauuc

SEQ ID NO: 1121300 - RNA, 22 nt, Human
ggcuuccuggggccuccugcaa

SEQ ID NO: 1121301 - RNA, 22 nt, Human
ucuggcucucucaucacccaau

SEQ ID NO: 1121302 - RNA, 22 nt, Human
cagcugccuaugaccuagccuc

SEQ ID NO: 1121303 - RNA, 22 nt, Human
ccugagccugaguggugcaggg

SEQ ID NO: 1121304 - RNA, 22 nt, Human
gcaggaguuaggcgucguggau

SEQ ID NO: 1121305 - RNA, 22 nt, Human
uauacagaaccgccugaagucu

SEQ ID NO: 1121306 - RNA, 17 nt, Human
aucuggcugcuucuaga

SEQ ID NO: 1121307 - RNA, 22 nt, Human
gggcaugagagggcagcuggca

SEQ ID NO: 1121308 - RNA, 22 nt, Human
gcuggccauggccugcgccauc

SEQ ID NO: 1121309 - RNA, 20 nt, Human
ccugggguacacuggcaugu

SEQ ID NO: 1121310 - RNA, 20 nt, Human
ccuccaggcacacccaugug

SEQ ID NO: 1121311 - RNA, 22 nt, Human
gugccugugccaggggugugcu

SEQ ID NO: 1121312 - RNA, 22 nt, Human
auuuaaauuuucugauggagag

SEQ ID NO: 1121313 - RNA, 22 nt, Human
agcaaggcagucagcuggcugg

SEQ ID NO: 1121314 - RNA, 22 nt, Human
aacccagccguguagcugccgc

SEQ ID NO: 1121315 - RNA, 22 nt, Human
ggcuggaaguccaagaucaagg

SEQ ID NO: 1121316 - RNA, 22 nt, Human
auuauguaacugugguucagca

SEQ ID NO: 1121317 - RNA, 22 nt, Human
ucagaacaauugggaaccauua

SEQ ID NO: 1121318 - RNA, 22 nt, Human
uuauacauguguuuugagauga

SEQ ID NO: 1121319 - RNA, 22 nt, Human
cagagccuaaaacgacuccacu

SEQ ID NO: 1121320 - RNA, 22 nt, Human
uuauuauaaugagggauaaaaa

SEQ ID NO: 1121321 - RNA, 22 nt, Human
cucagggacguuagaggacagg

SEQ ID NO: 1121322 - RNA, 22 nt, Human
uaugaguacaaggacucugucu

SEQ ID NO: 1121323 - RNA, 22 nt, Human
aaagccuugggauuugugauca

SEQ ID NO: 1121324 - RNA, 22 nt, Human
cuggcccagagagcagagcuua

SEQ ID NO: 1121325 - RNA, 22 nt, Human
augaaaacuuuagccucauuag

SEQ ID NO: 1121326 - RNA, 21 nt, Human
aaggccugcuuacugcuaguu

SEQ ID NO: 1121327 - RNA, 22 nt, Human
caagccugucucaccagugcua

SEQ ID NO: 1121328 - RNA, 22 nt, Human
uggagcagccaugaugacagag

SEQ ID NO: 1121329 - RNA, 22 nt, Human
ggagagcagggaggcugcucug

SEQ ID NO: 1121330 - RNA, 22 nt, Human
aacagacagaaaaaugugaucu

SEQ ID NO: 1121331 - RNA, 19 nt, Human
gcugugccucucuccugcu

SEQ ID NO: 1121332 - RNA, 22 nt, Human
cgcugggcgccgaccugcuggc

SEQ ID NO: 1121333 - RNA, 19 nt, Human
ucaggacugacuugaaguc

SEQ ID NO: 1121334 - RNA, 22 nt, Human
gugauuucagguuuuucauacu

SEQ ID NO: 1121335 - RNA, 22 nt, Human
ucacaucuuauuagaguaucuc

SEQ ID NO: 1121336 - RNA, 22 nt, Human
uaauuauaacaguuacaucuua

SEQ ID NO: 1121337 - RNA, 22 nt, Human
uauuucuguaacucagggucug

SEQ ID NO: 1121338 - RNA, 20 nt, Human
ggcucugcuugugagcagcc

SEQ ID NO: 1121339 - RNA, 22 nt, Human
uuccucuccucacaugagucac

SEQ ID NO: 1121340 - RNA, 22 nt, Human
gacagcaggagaucaugauaga

SEQ ID NO: 1121341 - RNA, 22 nt, Human
cccagcucucugcucuuagccu

SEQ ID NO: 1121342 - RNA, 22 nt, Human
cagccaggagccucugcaacua

SEQ ID NO: 1121343 - RNA, 22 nt, Human
ccucaggggugcccacagcugc

SEQ ID NO: 1121344 - RNA, 22 nt, Human
cugugcuggagaugggccagag

SEQ ID NO: 1121345 - RNA, 19 nt, Human
uccuccuuacuuccucuug

SEQ ID NO: 1121346 - RNA, 22 nt, Human
caggaaauaucuccuggcagag

SEQ ID NO: 1121347 - RNA, 22 nt, Human
agagacaccgcgcaucauggcu

SEQ ID NO: 1121348 - RNA, 20 nt, Human
ugcagcuucaccugugucau

SEQ ID NO: 1121349 - RNA, 22 nt, Human
gcagugcugaucccauggcaga

SEQ ID NO: 1121350 - RNA, 22 nt, Human
cuuuggcaaugaaacacaagaa

SEQ ID NO: 1121351 - RNA, 22 nt, Human
uucacauuggugauauguuucu

SEQ ID NO: 1121352 - RNA, 22 nt, Human
gcagcaggcuuuucauaccuug

SEQ ID NO: 1121353 - RNA, 23 nt, Human
gccugggacugguagugugaccu

SEQ ID NO: 1121354 - RNA, 22 nt, Human
caggcaggugcagauuccucuu

SEQ ID NO: 1121355 - RNA, 23 nt, Human
acagagguccaaacaguauaagc

SEQ ID NO: 1121356 - RNA, 22 nt, Human
caugcuuuaccaaagcagugau

SEQ ID NO: 1121357 - RNA, 22 nt, Human
cacacagaugguaagggaggga

SEQ ID NO: 1121358 - RNA, 22 nt, Human
aggcucagagaugaguaagcac

SEQ ID NO: 1121359 - RNA, 22 nt, Human
gccuaggaguggggauggcggu

SEQ ID NO: 1121360 - RNA, 22 nt, Human
agugaaaugauucugagcaaga

SEQ ID NO: 1121361 - RNA, 22 nt, Human
acacugaaugcuguuuagaaau

SEQ ID NO: 1121362 - RNA, 22 nt, Human
cagagccccucagcucucuccc

SEQ ID NO: 1121363 - RNA, 22 nt, Human
ccaccuccaccuauugccagcc

SEQ ID NO: 1121364 - RNA, 22 nt, Human
agccuucaaccuagcuagagca

SEQ ID NO: 1121365 - RNA, 22 nt, Human
aggaaaaaagucugugauuaua

SEQ ID NO: 1121366 - RNA, 22 nt, Human
gcugggagaggcccugaaguga

SEQ ID NO: 1121367 - RNA, 22 nt, Human
uucagagcaucucuaaagccag

SEQ ID NO: 1121368 - RNA, 22 nt, Human
uggccugccuucgcugagcuga

SEQ ID NO: 1121369 - RNA, 22 nt, Human
acagagcaugcucaguguguga

SEQ ID NO: 1121370 - RNA, 22 nt, Human
gauuauauaauggaagcucuug

SEQ ID NO: 1121371 - RNA, 22 nt, Human
uccauggguagcccugguugag

SEQ ID NO: 1121372 - RNA, 15 nt, Human
ugauuuccuacuaac

SEQ ID NO: 1121373 - RNA, 22 nt, Human
cccagcccccgagugucuggaa

SEQ ID NO: 1121374 - RNA, 22 nt, Human
ccugggugaaaucucuccugca

SEQ ID NO: 1121375 - RNA, 22 nt, Human
uucaaaggcaggauagcagcug

SEQ ID NO: 1121376 - RNA, 22 nt, Human
uucuggagagaaaccuuacaaa

SEQ ID NO: 1121377 - RNA, 22 nt, Human
ucuggccauggcaagccgagug

SEQ ID NO: 1121378 - RNA, 22 nt, Human
gcaguggggcgcugggaguugg

SEQ ID NO: 1121379 - RNA, 22 nt, Human
aaggagagguuguccguguugu

SEQ ID NO: 1121380 - RNA, 17 nt, Human
auccccagcaucuagaa

SEQ ID NO: 1121381 - RNA, 22 nt, Human
gcagacuguaucaaugucagua

SEQ ID NO: 1121382 - RNA, 22 nt, Human
acuuccuguguuggucuugcug

SEQ ID NO: 1121383 - RNA, 22 nt, Human
uuuauguaaguggaaugaugcc

SEQ ID NO: 1121384 - RNA, 22 nt, Human
ggcugcugguagggguaggaag

SEQ ID NO: 1121385 - RNA, 22 nt, Human
uacauuguucaugcaugagaaa

SEQ ID NO: 1121386 - RNA, 22 nt, Human
uggcagcaaaaccagaaucaga

SEQ ID NO: 1121387 - RNA, 22 nt, Human
cuggccuggucuggccucucca

SEQ ID NO: 1121388 - RNA, 22 nt, Human
cccagcaguuguuggugcacau

SEQ ID NO: 1121389 - RNA, 23 nt, Human
gccuggagaaaagcugcaguuca

SEQ ID NO: 1121390 - RNA, 22 nt, Human
uugugucugggggagugacauc

SEQ ID NO: 1121391 - RNA, 22 nt, Human
aaggcaggaugcggacccaucu

SEQ ID NO: 1121392 - RNA, 22 nt, Human
ggagagaauuccauggacaugu

SEQ ID NO: 1121393 - RNA, 22 nt, Human
cuggcagcgguuugcagccugg

SEQ ID NO: 1121394 - RNA, 22 nt, Human
acagaauuaucaggaaauguua

SEQ ID NO: 1121395 - RNA, 22 nt, Human
gaagagcugacagugucauccu

SEQ ID NO: 1121396 - RNA, 19 nt, Human
agcagcuggagguggagug

SEQ ID NO: 1121397 - RNA, 22 nt, Human
gcucccaccuuugcuaucagua

SEQ ID NO: 1121398 - RNA, 22 nt, Human
agggcagagcacugaauuggga

SEQ ID NO: 1121399 - RNA, 22 nt, Human
ugcagauucaaaugaaaugcaa

SEQ ID NO: 1121400 - RNA, 22 nt, Human
cacucaggcugugucaggagga

SEQ ID NO: 1121401 - RNA, 20 nt, Human
cccugagaccagagagcagc

SEQ ID NO: 1121402 - RNA, 22 nt, Human
gaugcacugcaguauauacugu

SEQ ID NO: 1121403 - RNA, 22 nt, Human
agucucagcuacuugggaggcu

SEQ ID NO: 1121404 - RNA, 20 nt, Human
ugaagcagccuugauucugu

SEQ ID NO: 1121405 - RNA, 22 nt, Human
cauacauugcucauucaguauc

SEQ ID NO: 1121406 - RNA, 21 nt, Human
ccccugggagcccugucagua

SEQ ID NO: 1121407 - RNA, 22 nt, Human
cugggagguggagguugcauug

SEQ ID NO: 1121408 - RNA, 22 nt, Human
ccagcagagcauggggaggaag

SEQ ID NO: 1121409 - RNA, 23 nt, Human
cuuuccuuucuuugacacccagc

SEQ ID NO: 1121410 - RNA, 23 nt, Human
uggcucuguggaucccucaggag

SEQ ID NO: 1121411 - RNA, 22 nt, Human
ggcuccuguccuccuggagcuc

SEQ ID NO: 1121412 - RNA, 22 nt, Human
caugugucaaaugauguagcug

SEQ ID NO: 1121413 - RNA, 23 nt, Human
ugcagccacucaggagcucagug

SEQ ID NO: 1121414 - RNA, 22 nt, Human
ucagcaaugugauacugugcaa

SEQ ID NO: 1121415 - RNA, 22 nt, Human
guccugggcccaggggcugccu

SEQ ID NO: 1121416 - RNA, 22 nt, Human
cuccuguauguugggcuucaca

SEQ ID NO: 1121417 - RNA, 22 nt, Human
gagcucauucauucauugccug

SEQ ID NO: 1121418 - RNA, 22 nt, Human
gccucugcugcaagccugguug

SEQ ID NO: 1121419 - RNA, 18 nt, Human
cuuguucuucucuuggcg

SEQ ID NO: 1121420 - RNA, 22 nt, Human
cugguuuagcuguaagguuccc

SEQ ID NO: 1121421 - RNA, 22 nt, Human
gagauggggaauaggagcaagc

SEQ ID NO: 1121422 - RNA, 22 nt, Human
ggucccaguccucucccugcua

SEQ ID NO: 1121423 - RNA, 22 nt, Human
uuagauaauguuauuguaauuu

SEQ ID NO: 1121424 - RNA, 22 nt, Human
cauuuacauuuaagguuaauau

SEQ ID NO: 1121425 - RNA, 22 nt, Human
gcugucugacuccaaguuggag

SEQ ID NO: 1121426 - RNA, 20 nt, Human
aaucagaaagugugagcucu

SEQ ID NO: 1121427 - RNA, 22 nt, Human
cuggcucaauuuguacugcugu

SEQ ID NO: 1121428 - RNA, 22 nt, Human
guggcugcagagggcacagcau

SEQ ID NO: 1121429 - RNA, 22 nt, Human
cccuggagcuagucugagcaga

SEQ ID NO: 1121430 - RNA, 18 nt, Human
ucacagugcucuugccua

SEQ ID NO: 1121431 - RNA, 22 nt, Human
cacauugaaaugacccaauaau

SEQ ID NO: 1121432 - RNA, 22 nt, Human
aagcuggcaauuaucaaaacug

SEQ ID NO: 1121433 - RNA, 22 nt, Human
ucauaacagcuaagucccuuuc

SEQ ID NO: 1121434 - RNA, 19 nt, Human
ucgagucaagacacuaggc

SEQ ID NO: 1121435 - RNA, 22 nt, Human
aggcugcucugcgaagucagcu

SEQ ID NO: 1121436 - RNA, 22 nt, Human
guggcccaggcuuggcgcuggc

SEQ ID NO: 1121437 - RNA, 21 nt, Human
ucuuguccuugcucucccacu

SEQ ID NO: 1121438 - RNA, 22 nt, Human
uuuaaaaaacuagucugagucu

SEQ ID NO: 1121439 - RNA, 22 nt, Human
gcugccaguguggcaugaugca

SEQ ID NO: 1121440 - RNA, 22 nt, Human
agcaccuguggcucaugcucgu

SEQ ID NO: 1121441 - RNA, 21 nt, Human
agaggccuuacaggauagacc

SEQ ID NO: 1121442 - RNA, 22 nt, Human
ucuggcucucauacucgccagu

SEQ ID NO: 1121443 - RNA, 21 nt, Human
acagaugggaugagcacacug

SEQ ID NO: 1121444 - RNA, 22 nt, Human
uccagugguuugaaaggggugu

SEQ ID NO: 1121445 - RNA, 22 nt, Human
agccauugaguuuuaugugcua

SEQ ID NO: 1121446 - RNA, 22 nt, Human
guucuccauucagcuuccugug

SEQ ID NO: 1121447 - RNA, 22 nt, Human
gugcagugaaaaaagaaugucc

SEQ ID NO: 1121448 - RNA, 22 nt, Human
auucuuggcaaggagauuuaaa

SEQ ID NO: 1121449 - RNA, 21 nt, Human
aagcuucccugcucuccaggg

SEQ ID NO: 1121450 - RNA, 22 nt, Human
ucuuuacacaagacaagaauaa

SEQ ID NO: 1121451 - RNA, 20 nt, Human
aggcugggguguuuugccca

SEQ ID NO: 1121452 - RNA, 22 nt, Human
gcaggaugggagcuucacucug

SEQ ID NO: 1121453 - RNA, 22 nt, Human
gcagagaaaguuuuguccucag

SEQ ID NO: 1121454 - RNA, 19 nt, Human
caguggccuggaggucucu

SEQ ID NO: 1121455 - RNA, 17 nt, Human
gcugccaccuuuggagc

SEQ ID NO: 1121456 - RNA, 20 nt, Human
cugccaugauugauagagug

SEQ ID NO: 1121457 - RNA, 22 nt, Human
ccaggagccacucaggcccaca

SEQ ID NO: 1121458 - RNA, 22 nt, Human
ucucagagaggggccgggccuu

SEQ ID NO: 1121459 - RNA, 22 nt, Human
ccuggugccacuagagaauguc

SEQ ID NO: 1121460 - RNA, 22 nt, Human
cugggaggcagucucucuagaa

SEQ ID NO: 1121461 - RNA, 22 nt, Human
agagugaucagauaucaggugu

SEQ ID NO: 1121462 - RNA, 22 nt, Human
gcccaugcacuuucugugaugg

SEQ ID NO: 1121463 - RNA, 22 nt, Human
uuuuuccuaagcaguggagcug

SEQ ID NO: 1121464 - RNA, 22 nt, Human
caggagcccagaguccucagcu

SEQ ID NO: 1121465 - RNA, 17 nt, Human
gcagccagugcagcagg

SEQ ID NO: 1121466 - RNA, 22 nt, Human
uggccugcuuucauuugaugcu

SEQ ID NO: 1121467 - RNA, 22 nt, Human
cacagcugcccuacuccaugug

SEQ ID NO: 1121468 - RNA, 20 nt, Human
gguagcagcugcugucaucc

SEQ ID NO: 1121469 - RNA, 22 nt, Human
aacaaauggaacacaaaucuuu

SEQ ID NO: 1121470 - RNA, 22 nt, Human
acugagcugugacaaugcuuaa

SEQ ID NO: 1121471 - RNA, 22 nt, Human
gcagggucuugagaggcagcca

SEQ ID NO: 1121472 - RNA, 22 nt, Human
gcugcccugucugcagcaggac

SEQ ID NO: 1121473 - RNA, 22 nt, Human
aucacgucaugguuugaucugg

SEQ ID NO: 1121474 - RNA, 22 nt, Human
ccugggcaacauagugagaccu

SEQ ID NO: 1121475 - RNA, 22 nt, Human
uccauggggcccaggaugagag

SEQ ID NO: 1121476 - RNA, 22 nt, Human
agggucaggagacacuggcaac

SEQ ID NO: 1121477 - RNA, 22 nt, Human
aacuagaacgucuaguugcugg

SEQ ID NO: 1121478 - RNA, 22 nt, Human
cuggcucuucagugcuugguuc

SEQ ID NO: 1121479 - RNA, 22 nt, Human
caggagcuacucagguuggguu

SEQ ID NO: 1121480 - RNA, 22 nt, Human
acagccuggacuggcucucugc

SEQ ID NO: 1121481 - RNA, 19 nt, Human
ugagagugaggaaggcuuc

SEQ ID NO: 1121482 - RNA, 23 nt, Human
auacauacagucuuacugacuuu

SEQ ID NO: 1121483 - RNA, 22 nt, Human
guccucaggaaagcagauaaca

SEQ ID NO: 1121484 - RNA, 22 nt, Human
cucaggaugucggugacuauug

SEQ ID NO: 1121485 - RNA, 22 nt, Human
agaggagguggugaugcuuuaa

SEQ ID NO: 1121486 - RNA, 22 nt, Human
acagagauguggaugagggauu

SEQ ID NO: 1121487 - RNA, 22 nt, Human
agaggcccucucucuccugaug

SEQ ID NO: 1121488 - RNA, 22 nt, Human
uacaaaaguaauuacgguuuuu

SEQ ID NO: 1121489 - RNA, 22 nt, Human
aguguguguuugggcgguuuau

SEQ ID NO: 1121490 - RNA, 20 nt, Human
uggcuccucuuggcuguggc

SEQ ID NO: 1121491 - RNA, 22 nt, Human
ugcaaacaggagaguaaguaua

SEQ ID NO: 1121492 - RNA, 22 nt, Human
cagcucccagagugaccagcag

SEQ ID NO: 1121493 - RNA, 22 nt, Human
ggucaggguuccagguaucuuc

SEQ ID NO: 1121494 - RNA, 22 nt, Human
aaaugugucaguuucauucucu

SEQ ID NO: 1121495 - RNA, 22 nt, Human
ggcucagggaaugaggaagaau

SEQ ID NO: 1121496 - RNA, 22 nt, Human
uggcugaauaauauucuguugu

SEQ ID NO: 1121497 - RNA, 22 nt, Human
cagcaaaauuugaggauugccu

SEQ ID NO: 1121498 - RNA, 22 nt, Human
ucaaaugcucuuugcagagagg

SEQ ID NO: 1121499 - RNA, 22 nt, Human
uguuuuaugagccauauaaccu

SEQ ID NO: 1121500 - RNA, 22 nt, Human
ucaaggugcugugcugugcuag

SEQ ID NO: 1121501 - RNA, 22 nt, Human
caugcuccaaaaacaagagaau

SEQ ID NO: 1121502 - RNA, 22 nt, Human
gcccucagaguuccccacagug

SEQ ID NO: 1121503 - RNA, 22 nt, Human
uuuuccuauaugcaaagaaugc

SEQ ID NO: 1121504 - RNA, 22 nt, Human
aacugcauucagaaagcucacu

SEQ ID NO: 1121505 - RNA, 22 nt, Human
uacaggaggauuaucaaaggau

SEQ ID NO: 1121506 - RNA, 22 nt, Human
ggucccaggagaauaggugcaa

SEQ ID NO: 1121507 - RNA, 22 nt, Human
cggcagcaaaggaagccagguc

SEQ ID NO: 1121508 - RNA, 22 nt, Human
ggcugccuccucgagacaggau

SEQ ID NO: 1121509 - RNA, 22 nt, Human
ugggcucuccuggaggacaaca

SEQ ID NO: 1121510 - RNA, 22 nt, Human
cuugccuucuuuuccuauagaa

SEQ ID NO: 1121511 - RNA, 22 nt, Human
agagcugaaaaagcugacccgg

SEQ ID NO: 1121512 - RNA, 22 nt, Human
cugcucuggcuguguacuucag

SEQ ID NO: 1121513 - RNA, 22 nt, Human
agggaagaagcugguaguaggu

SEQ ID NO: 1121514 - RNA, 22 nt, Human
uuugacagacauuuacuacauu

SEQ ID NO: 1121515 - RNA, 22 nt, Human
ccuggaaggcaggcauggauug

SEQ ID NO: 1121516 - RNA, 22 nt, Human
ugcagcugcuggcccaggugcu

SEQ ID NO: 1121517 - RNA, 22 nt, Human
ggcugccuccugcugggcugga

SEQ ID NO: 1121518 - RNA, 22 nt, Human
ugccucagaguugucccuacca

SEQ ID NO: 1121519 - RNA, 22 nt, Human
ggccagagaauaugccuuacgu

SEQ ID NO: 1121520 - RNA, 22 nt, Human
agggcagcagcuccuccuagcu

SEQ ID NO: 1121521 - RNA, 22 nt, Human
gcaggcuccaggccggccccuu

SEQ ID NO: 1121522 - RNA, 22 nt, Human
cagcaggcccagaguuucaugg

SEQ ID NO: 1121523 - RNA, 22 nt, Human
uucaaaacagcuagauauugga

SEQ ID NO: 1121524 - RNA, 22 nt, Human
agggcccucuggcaggccaggc

SEQ ID NO: 1121525 - RNA, 22 nt, Human
aaauguguuucgaaaacuggug

SEQ ID NO: 1121526 - RNA, 22 nt, Human
uaaaugcaagugcuccugggag

SEQ ID NO: 1121527 - RNA, 22 nt, Human
agugaaauugcuguaagaggaa

SEQ ID NO: 1121528 - RNA, 22 nt, Human
acagggcagguggcuacugguc

SEQ ID NO: 1121529 - RNA, 22 nt, Human
ggcugggcugcugggucagagc

SEQ ID NO: 1121530 - RNA, 22 nt, Human
gagcuggcaggaggcuccccga

SEQ ID NO: 1121531 - RNA, 22 nt, Human
gugccagggggcacugaacaga

SEQ ID NO: 1121532 - RNA, 22 nt, Human
auugaaagguuuugagcagaua

SEQ ID NO: 1121533 - RNA, 22 nt, Human
gucacacucagaaugacuagag

SEQ ID NO: 1121534 - RNA, 22 nt, Human
acugagcugcuugaagugaacu

SEQ ID NO: 1121535 - RNA, 22 nt, Human
agcuuuauuugucauucacggc

SEQ ID NO: 1121536 - RNA, 22 nt, Human
cucugagcccgcugcagcccca

SEQ ID NO: 1121537 - RNA, 22 nt, Human
gcugugugacugagagccuggc

SEQ ID NO: 1121538 - RNA, 19 nt, Human
agcuccugggcucugggcc

SEQ ID NO: 1121539 - RNA, 22 nt, Human
aaguucaaggaagccuccaguu

SEQ ID NO: 1121540 - RNA, 22 nt, Human
caggggcugagaaggaacgucc

SEQ ID NO: 1121541 - RNA, 22 nt, Human
cucagaaucugccaaguucagg

SEQ ID NO: 1121542 - RNA, 20 nt, Human
uccuugaaagugggguauau

SEQ ID NO: 1121543 - RNA, 22 nt, Human
ggcuuucuagaucuagcucugu

SEQ ID NO: 1121544 - RNA, 22 nt, Human
aucagcaaaaaugccuucagaa

SEQ ID NO: 1121545 - RNA, 22 nt, Human
ucccagagcucuggagguugga

SEQ ID NO: 1121546 - RNA, 22 nt, Human
uagaggugucacuuugggaagu

SEQ ID NO: 1121547 - RNA, 22 nt, Human
caagaacaguuugccaaauugg

SEQ ID NO: 1121548 - RNA, 22 nt, Human
ggcuggaaguccaagaucaaga

SEQ ID NO: 1121549 - RNA, 22 nt, Human
ccaggguggggcaggcccacug

SEQ ID NO: 1121550 - RNA, 22 nt, Human
cccugagagugagugccaccuu

SEQ ID NO: 1121551 - RNA, 22 nt, Human
aagccagguguuuaggccagcg

SEQ ID NO: 1121552 - RNA, 22 nt, Human
ugucccagguccuagaugacca

SEQ ID NO: 1121553 - RNA, 22 nt, Human
guggcugcagagccagcaagcu

SEQ ID NO: 1121554 - RNA, 22 nt, Human
agcugcucucacuggacgccug

SEQ ID NO: 1121555 - RNA, 22 nt, Human
auguuaaaugguuuauuauuaa

SEQ ID NO: 1121556 - RNA, 22 nt, Human
uguaucaaggguuuauguaagc

SEQ ID NO: 1121557 - RNA, 22 nt, Human
aaguugaaugcguacgugacau

SEQ ID NO: 1121558 - RNA, 22 nt, Human
aucaguuuaacugucaagagcc

SEQ ID NO: 1121559 - RNA, 22 nt, Human
cugcagccuaggugcagcuggg

SEQ ID NO: 1121560 - RNA, 22 nt, Human
gcugcaggcgccugcggucucu

SEQ ID NO: 1121561 - RNA, 22 nt, Human
ucccagcagucagagcuaugug

SEQ ID NO: 1121562 - RNA, 18 nt, Human
cauuaugugguuauagaa

SEQ ID NO: 1121563 - RNA, 22 nt, Human
gcuggccucuggagaagggcuu

SEQ ID NO: 1121564 - RNA, 22 nt, Human
agaaaagguugaaaguaggauu

SEQ ID NO: 1121565 - RNA, 22 nt, Human
gcuggcuguaucaccuggccag

SEQ ID NO: 1121566 - RNA, 22 nt, Human
gcuggcauuacaggagagaacc

SEQ ID NO: 1121567 - RNA, 18 nt, Human
ucagcuggggcugcagcc

SEQ ID NO: 1121568 - RNA, 22 nt, Human
cagcaauaagguaagcuucucc

SEQ ID NO: 1121569 - RNA, 22 nt, Human
cugcagcuguagaggacagugg

SEQ ID NO: 1121570 - RNA, 22 nt, Human
gccuucccacccugcgaggcug

SEQ ID NO: 1121571 - RNA, 22 nt, Human
ccagccaggcauugcaaacuga

SEQ ID NO: 1121572 - RNA, 21 nt, Human
ucucuacacuuucacuaggcu

SEQ ID NO: 1121573 - RNA, 22 nt, Human
ccugcagcuguaggagaaggcg

SEQ ID NO: 1121574 - RNA, 22 nt, Human
auuguggugucaguuauaggca

SEQ ID NO: 1121575 - RNA, 22 nt, Human
cccaggaggcagaaguugcagu

SEQ ID NO: 1121576 - RNA, 22 nt, Human
uuuuuaagcuccuuugauguca

SEQ ID NO: 1121577 - RNA, 22 nt, Human
cagcauuggguuaccuuuguuu

SEQ ID NO: 1121578 - RNA, 22 nt, Human
cugggcugugguguggcccaaa

SEQ ID NO: 1121579 - RNA, 18 nt, Human
uggcucagauggcuuuaa

SEQ ID NO: 1121580 - RNA, 22 nt, Human
agggggcaucagguccuggcuc

SEQ ID NO: 1121581 - RNA, 22 nt, Human
aaauaauugaguuggucaauau

SEQ ID NO: 1121582 - RNA, 22 nt, Human
ucuggagcaacagagcaggaca

SEQ ID NO: 1121583 - RNA, 22 nt, Human
ccaggcugggcggggaaccugg

SEQ ID NO: 1121584 - RNA, 17 nt, Human
uggcucugaggcugaau

SEQ ID NO: 1121585 - RNA, 22 nt, Human
ugguuugcccacucgagugauu

SEQ ID NO: 1121586 - RNA, 22 nt, Human
ucaggaaagaagaugcucagug

SEQ ID NO: 1121587 - RNA, 22 nt, Human
ggcuucaccaggugcaugcaug

SEQ ID NO: 1121588 - RNA, 22 nt, Human
ggccaggcuggucucagacuuc

SEQ ID NO: 1121589 - RNA, 22 nt, Human
auugucuuuggugcuuccagga

SEQ ID NO: 1121590 - RNA, 22 nt, Human
cagcuccugcagcugcugccgu

SEQ ID NO: 1121591 - RNA, 22 nt, Human
aaaugcagaucccugaaucuca

SEQ ID NO: 1121592 - RNA, 22 nt, Human
agauaugacuagaagcucauuu

SEQ ID NO: 1121593 - RNA, 22 nt, Human
cuccucuggaaauuccucugcc

SEQ ID NO: 1121594 - RNA, 23 nt, Human
cagggccaggcagcagcugucac

SEQ ID NO: 1121595 - RNA, 22 nt, Human
ugggugagugggaaaagcccag

SEQ ID NO: 1121596 - RNA, 21 nt, Human
ugccaggccugagcugggguc

SEQ ID NO: 1121597 - RNA, 22 nt, Human
ucaacacuauccaggcaaucuu

SEQ ID NO: 1121598 - RNA, 22 nt, Human
cugugcaagcccaagauaaaac

SEQ ID NO: 1121599 - RNA, 22 nt, Human
cagacaggcuagccagacucac

SEQ ID NO: 1121600 - RNA, 22 nt, Human
uaugaagaaguucugugaaaug

SEQ ID NO: 1121601 - RNA, 22 nt, Human
guacauguugguuguuuccagu

SEQ ID NO: 1121602 - RNA, 21 nt, Human
gcucuuggaaggggcucagcu

SEQ ID NO: 1121603 - RNA, 20 nt, Human
uccagcugucuuucagagac

SEQ ID NO: 1121604 - RNA, 17 nt, Human
ccagagcuacugagacu

SEQ ID NO: 1121605 - RNA, 22 nt, Human
gcugcccauuccacuggauggu

SEQ ID NO: 1121606 - RNA, 23 nt, Human
gugagcagcccacuaggaaugcc

SEQ ID NO: 1121607 - RNA, 22 nt, Human
cugggcuccuaaccauccaggu

SEQ ID NO: 1121608 - RNA, 22 nt, Human
ggagccuggcaaugcugcgucc

SEQ ID NO: 1121609 - RNA, 22 nt, Human
ucagugcuucggcgagcaccua

SEQ ID NO: 1121610 - RNA, 19 nt, Human
ucuggcuccgccucuuagu

SEQ ID NO: 1121611 - RNA, 22 nt, Human
uccucuggggcgugguccugga

SEQ ID NO: 1121612 - RNA, 22 nt, Human
ccaggagcaacuugaaggcaag

SEQ ID NO: 1121613 - RNA, 22 nt, Human
agccaggacguugcucagcucc

SEQ ID NO: 1121614 - RNA, 22 nt, Human
accagcuguguccuggcugcag

SEQ ID NO: 1121615 - RNA, 23 nt, Human
uggccugcagaguuucugcuggg

SEQ ID NO: 1121616 - RNA, 20 nt, Human
cucaguguggccugaguguu

SEQ ID NO: 1121617 - RNA, 22 nt, Human
cucuggacacuggcaugggguc

SEQ ID NO: 1121618 - RNA, 22 nt, Human
aggcacugaauauccaguaaaa

SEQ ID NO: 1121619 - RNA, 22 nt, Human
uagaaaguaaaucaguuuuauu

SEQ ID NO: 1121620 - RNA, 22 nt, Human
aaguuguauauaccgcuuuaag

SEQ ID NO: 1121621 - RNA, 22 nt, Human
agcauugccugccuauugcuaa

SEQ ID NO: 1121622 - RNA, 21 nt, Human
cagcuuugucugucuucgggg

SEQ ID NO: 1121623 - RNA, 22 nt, Human
acacaugagaaacaucaguugu

SEQ ID NO: 1121624 - RNA, 22 nt, Human
gccuggccgcuccgagcuccgc

SEQ ID NO: 1121625 - RNA, 20 nt, Human
gugggcagcaggcauacugg

SEQ ID NO: 1121626 - RNA, 21 nt, Human
cugcucugacagugaggccag

SEQ ID NO: 1121627 - RNA, 22 nt, Human
ugagcuggucuugaguguagcu

SEQ ID NO: 1121628 - RNA, 22 nt, Human
cuggcuccacucccugccugac

SEQ ID NO: 1121629 - RNA, 22 nt, Human
uuagggcuuuucugaauaggcc

SEQ ID NO: 1121630 - RNA, 22 nt, Human
ccuggagcuuggucacgcugcg

SEQ ID NO: 1121631 - RNA, 22 nt, Human
cagcugagucugagguucuuug

SEQ ID NO: 1121632 - RNA, 22 nt, Human
auuuccauacacccauuucuga

SEQ ID NO: 1121633 - RNA, 22 nt, Human
ugagcccagagcccuuguaggg

SEQ ID NO: 1121634 - RNA, 22 nt, Human
ggaaggagggcggcaaugauga

SEQ ID NO: 1121635 - RNA, 22 nt, Human
uuucuucucacccaggacagag

SEQ ID NO: 1121636 - RNA, 22 nt, Human
ggggcggggcucugagaagcau

SEQ ID NO: 1121637 - RNA, 22 nt, Human
gggcugggauugcuugcuguga

SEQ ID NO: 1121638 - RNA, 22 nt, Human
acacagccaggguaguaaggcu

SEQ ID NO: 1121639 - RNA, 22 nt, Human
caguuucuucaucaguuaagca

SEQ ID NO: 1121640 - RNA, 22 nt, Human
agggucuguggaugcaucuggg

SEQ ID NO: 1121641 - RNA, 22 nt, Human
agggacugagcuaggaucuagu

SEQ ID NO: 1121642 - RNA, 22 nt, Human
cagggcucaucugugugaccag

SEQ ID NO: 1121643 - RNA, 22 nt, Human
gaggaguguauuccacaccacu

SEQ ID NO: 1121644 - RNA, 20 nt, Human
guggccuguccuguuguggg

SEQ ID NO: 1121645 - RNA, 18 nt, Human
ggcucaggcuauccuaac

SEQ ID NO: 1121646 - RNA, 20 nt, Human
agcaggaaugaugcuuucau

SEQ ID NO: 1121647 - RNA, 22 nt, Human
uggcccugaggacccagugugg

SEQ ID NO: 1121648 - RNA, 22 nt, Human
cuggagccuucaccaggggaaa

SEQ ID NO: 1121649 - RNA, 22 nt, Human
gcucagagcaucccagugaaug

SEQ ID NO: 1121650 - RNA, 22 nt, Human
gccagggcaggggagcaucugc

SEQ ID NO: 1121651 - RNA, 23 nt, Human
ugggcaucuccucugugccaggc

SEQ ID NO: 1121652 - RNA, 22 nt, Human
caagagcucagaaacccuugcu

SEQ ID NO: 1121653 - RNA, 22 nt, Human
cugccugugcaugcagucagaa

SEQ ID NO: 1121654 - RNA, 23 nt, Human
cacugcagcguggucuggcagga

SEQ ID NO: 1121655 - RNA, 22 nt, Human
cugcagcuuuggaaaccuguuu

SEQ ID NO: 1121656 - RNA, 22 nt, Human
cagggcagcuuccuuuguuagg

SEQ ID NO: 1121657 - RNA, 22 nt, Human
ccugaagcaaggguaggcaggu

SEQ ID NO: 1121658 - RNA, 22 nt, Human
ugccucugugugcaggugagca

SEQ ID NO: 1121659 - RNA, 22 nt, Human
aaaaugaggucaauauccuuuu

SEQ ID NO: 1121660 - RNA, 20 nt, Human
cuguaucagguuacaaagua

SEQ ID NO: 1121661 - RNA, 22 nt, Human
gagcagugacuggagcaugaga

SEQ ID NO: 1121662 - RNA, 22 nt, Human
agaggggcucaagcaguggucu

SEQ ID NO: 1121663 - RNA, 22 nt, Human
gcaggccugacuguagggggca

SEQ ID NO: 1121664 - RNA, 17 nt, Human
aggagucucagaugagc

SEQ ID NO: 1121665 - RNA, 22 nt, Human
cugaaggagguagagugacaua

SEQ ID NO: 1121666 - RNA, 22 nt, Human
cagcugccaugacauguccugc

SEQ ID NO: 1121667 - RNA, 22 nt, Human
cuacuucugugaugaaacuaca

SEQ ID NO: 1121668 - RNA, 22 nt, Human
agaacagcagcacgucaagcug

SEQ ID NO: 1121669 - RNA, 22 nt, Human
acagaaugcguagugcauguug

SEQ ID NO: 1121670 - RNA, 22 nt, Human
uuccucucgcucuccggggccc

SEQ ID NO: 1121671 - RNA, 22 nt, Human
aggcaggugggucacuugaguc

SEQ ID NO: 1121672 - RNA, 23 nt, Human
uggccuggagagaaaagaugagu

SEQ ID NO: 1121673 - RNA, 22 nt, Human
cuggcucaugugaugagggcaa

SEQ ID NO: 1121674 - RNA, 22 nt, Human
gggccuggugcuucugacuccu

SEQ ID NO: 1121675 - RNA, 22 nt, Human
guaagggauuugaacauagguu

SEQ ID NO: 1121676 - RNA, 22 nt, Human
ucagguggcuucggggaguggc

SEQ ID NO: 1121677 - RNA, 22 nt, Human
guaacagaggguuugcagauau

SEQ ID NO: 1121678 - RNA, 22 nt, Human
uggcagcuuccugcucauagga

SEQ ID NO: 1121679 - RNA, 23 nt, Human
aaguaacagggauaauagcaguu

SEQ ID NO: 1121680 - RNA, 22 nt, Human
aagcaauaagccagauuuggau

SEQ ID NO: 1121681 - RNA, 22 nt, Human
cuacauuuuucaccgagccucu

SEQ ID NO: 1121682 - RNA, 22 nt, Human
gagagcccugcuccuaucccag

SEQ ID NO: 1121683 - RNA, 22 nt, Human
cuuauguauaauguuccacaua

SEQ ID NO: 1121684 - RNA, 22 nt, Human
uucaagucaaggaaagaggucu

SEQ ID NO: 1121685 - RNA, 22 nt, Human
uggguggcggccugguucugag

SEQ ID NO: 1121686 - RNA, 22 nt, Human
gcuggccucgcaggcaggaugu

SEQ ID NO: 1121687 - RNA, 22 nt, Human
gccucugcugacaagauggaca

SEQ ID NO: 1121688 - RNA, 22 nt, Human
augccacugacauggacaauuu

SEQ ID NO: 1121689 - RNA, 22 nt, Human
acccugggcuuggccugcucag

SEQ ID NO: 1121690 - RNA, 22 nt, Human
agagaggcgaguuaccugugcu

SEQ ID NO: 1121691 - RNA, 22 nt, Human
ggcagcuggguuggccagaaac

SEQ ID NO: 1121692 - RNA, 23 nt, Human
uggcagagacccagaaucuacau

SEQ ID NO: 1121693 - RNA, 21 nt, Human
gccucugcugucuuauuguga

SEQ ID NO: 1121694 - RNA, 22 nt, Human
cagcaggguuaagugacucacc

SEQ ID NO: 1121695 - RNA, 22 nt, Human
cugagcugcucccgcugcagcg

SEQ ID NO: 1121696 - RNA, 22 nt, Human
cagagccccccuucugaucaca

SEQ ID NO: 1121697 - RNA, 22 nt, Human
uaaggcacacaguugcugcaug

SEQ ID NO: 1121698 - RNA, 22 nt, Human
gccaggcaaauuaaggaaugca

SEQ ID NO: 1121699 - RNA, 22 nt, Human
gcaggggaguccacucuaugca

SEQ ID NO: 1121700 - RNA, 22 nt, Human
auccccagaaaauaggugccua

SEQ ID NO: 1121701 - RNA, 22 nt, Human
cucagaguccccacaucugggu

SEQ ID NO: 1121702 - RNA, 22 nt, Human
cucuggccgcagcucagcucug

SEQ ID NO: 1121703 - RNA, 22 nt, Human
aagggcaggagaagacggauau

SEQ ID NO: 1121704 - RNA, 22 nt, Human
acuuccugggcaugcagagucc

SEQ ID NO: 1121705 - RNA, 22 nt, Human
cagcccuuuccuucucagcuuu

SEQ ID NO: 1121706 - RNA, 22 nt, Human
ccugaggacacacgcugcagga

SEQ ID NO: 1121707 - RNA, 22 nt, Human
uccauuuacuauucucauaucg

SEQ ID NO: 1121708 - RNA, 22 nt, Human
gacagaggcaagaccagaagcc

SEQ ID NO: 1121709 - RNA, 22 nt, Human
cugccucuccccagaguggccc

SEQ ID NO: 1121710 - RNA, 22 nt, Human
gaaggagggugcggaucugagc

SEQ ID NO: 1121711 - RNA, 23 nt, Human
cuguggcugaguccuguuggagu

SEQ ID NO: 1121712 - RNA, 21 nt, Human
auuauuauuucuguguccagc

SEQ ID NO: 1121713 - RNA, 22 nt, Human
cucaggaucgcuugcccuaggg

SEQ ID NO: 1121714 - RNA, 22 nt, Human
aagggcagggaguuugugucua

SEQ ID NO: 1121715 - RNA, 22 nt, Human
ucuuugcaucccuuccauaguu

SEQ ID NO: 1121716 - RNA, 22 nt, Human
auucuuggagcagucaaagaag

SEQ ID NO: 1121717 - RNA, 22 nt, Human
agagccugcuguguaagucaca

SEQ ID NO: 1121718 - RNA, 22 nt, Human
cuggccuggcagggagggcaug

SEQ ID NO: 1121719 - RNA, 22 nt, Human
uggccuuguguuuuagagaaag

SEQ ID NO: 1121720 - RNA, 22 nt, Human
ggagcugggacccugucaucug

SEQ ID NO: 1121721 - RNA, 22 nt, Human
aacagacaacuccuguggcuca

SEQ ID NO: 1121722 - RNA, 20 nt, Human
ugggccuguggcagaagucu

SEQ ID NO: 1121723 - RNA, 22 nt, Human
ggcuggcuuucucuccgcaccu

SEQ ID NO: 1121724 - RNA, 23 nt, Human
ucuuuccucagcacacaccaaga

SEQ ID NO: 1121725 - RNA, 22 nt, Human
cuucccagaccuuagagugcag

SEQ ID NO: 1121726 - RNA, 22 nt, Human
cagggacugagauccagacugu

SEQ ID NO: 1121727 - RNA, 22 nt, Human
cuuauguauauuuggaacguac

SEQ ID NO: 1121728 - RNA, 22 nt, Human
cugcuuuguggaaucacacugg

SEQ ID NO: 1121729 - RNA, 22 nt, Human
agcagccagagaaugaugcagu

SEQ ID NO: 1121730 - RNA, 22 nt, Human
caguggcuguuucuggaaggca

SEQ ID NO: 1121731 - RNA, 22 nt, Human
ugaagcaguuacuggguguuaa

SEQ ID NO: 1121732 - RNA, 22 nt, Human
agccuggaagaaccugaagucu

SEQ ID NO: 1121733 - RNA, 22 nt, Human
ggugaagggugucauggcauuu

SEQ ID NO: 1121734 - RNA, 22 nt, Human
auccaaaucaugucagaagaac

SEQ ID NO: 1121735 - RNA, 22 nt, Human
agcuuccucaccucagaggucu

SEQ ID NO: 1121736 - RNA, 22 nt, Human
ccugccuggcuuccagaagaga

SEQ ID NO: 1121737 - RNA, 22 nt, Human
ccauuguaguaucuguuuuagu

SEQ ID NO: 1121738 - RNA, 23 nt, Human
uggcccugugcaugcugcuuccc

SEQ ID NO: 1121739 - RNA, 22 nt, Human
gggcuucucuuaugcuaacugg

SEQ ID NO: 1121740 - RNA, 22 nt, Human
uaaucacaucaggguaaauggg

SEQ ID NO: 1121741 - RNA, 23 nt, Human
ugggccuggaaagccuuagagag

SEQ ID NO: 1121742 - RNA, 22 nt, Human
gcucugggcugcccucuggaca

SEQ ID NO: 1121743 - RNA, 22 nt, Human
ggagggcugccagguggagcgg

SEQ ID NO: 1121744 - RNA, 23 nt, Human
uggcccugaaucuguccuggagg

SEQ ID NO: 1121745 - RNA, 22 nt, Human
ugcacagcgggugucugucagg

SEQ ID NO: 1121746 - RNA, 22 nt, Human
ccuggcaguggugaagaagagg

SEQ ID NO: 1121747 - RNA, 22 nt, Human
agccuggaguucccaggagaag

SEQ ID NO: 1121748 - RNA, 22 nt, Human
aaggcacucauucaaggagaua

SEQ ID NO: 1121749 - RNA, 22 nt, Human
gcccaugcucucaggcgggccu

SEQ ID NO: 1121750 - RNA, 22 nt, Human
gcucccaggaagagaagggcca

SEQ ID NO: 1121751 - RNA, 22 nt, Human
ccaggcucugcgcuggacaugg

SEQ ID NO: 1121752 - RNA, 22 nt, Human
caguggaggccuugggaccuuu

SEQ ID NO: 1121753 - RNA, 22 nt, Human
cuccuuccccuacucagcaucc

SEQ ID NO: 1121754 - RNA, 22 nt, Human
cauggacucugguuuggggagc

SEQ ID NO: 1121755 - RNA, 22 nt, Human
caggccaggcugcauuugcccc

SEQ ID NO: 1121756 - RNA, 22 nt, Human
gagccauacaaccuauaaagug

SEQ ID NO: 1121757 - RNA, 22 nt, Human
ggcauggcucggagucagaaca

SEQ ID NO: 1121758 - RNA, 19 nt, Human
ugagugggccccugcagac

SEQ ID NO: 1121759 - RNA, 22 nt, Human
agccuguggaucccugcacugg

SEQ ID NO: 1121760 - RNA, 22 nt, Human
aaacuuuaagacaguccucaag

SEQ ID NO: 1121761 - RNA, 22 nt, Human
gcucuggagauggagccuugag

SEQ ID NO: 1121762 - RNA, 22 nt, Human
aaaugcuguguuuuaacauaga

SEQ ID NO: 1121763 - RNA, 22 nt, Human
uaccuuggguugaguucauucu

SEQ ID NO: 1121764 - RNA, 20 nt, Human
aggagaugauccagagucag

SEQ ID NO: 1121765 - RNA, 22 nt, Human
uugaggagucaggggcacggaa

SEQ ID NO: 1121766 - RNA, 22 nt, Human
aucugguuuggggauccuugug

SEQ ID NO: 1121767 - RNA, 22 nt, Human
agccaaggcagcuagagcucug

SEQ ID NO: 1121768 - RNA, 22 nt, Human
gcagggacagggcagggccuuu

SEQ ID NO: 1121769 - RNA, 22 nt, Human
cuggagcaggcuugucccagcu

SEQ ID NO: 1121770 - RNA, 22 nt, Human
gcucucugccuuucucaaugac

SEQ ID NO: 1121771 - RNA, 18 nt, Human
acagaaauagcugugccu

SEQ ID NO: 1121772 - RNA, 22 nt, Human
guaggcagauaggagugcagcc

SEQ ID NO: 1121773 - RNA, 22 nt, Human
agauacaucuugaacuucuaga

SEQ ID NO: 1121774 - RNA, 22 nt, Human
cagggccaugaggcacaggguc

SEQ ID NO: 1121775 - RNA, 21 nt, Human
agcuuguguguaucacagugu

SEQ ID NO: 1121776 - RNA, 22 nt, Human
cuguggcuuucucugccuccuu

SEQ ID NO: 1121777 - RNA, 20 nt, Human
cugagcccccagccugcagg

SEQ ID NO: 1121778 - RNA, 22 nt, Human
ucagggcauucaagaggccugg

SEQ ID NO: 1121779 - RNA, 22 nt, Human
uaugcacauugguuuccucauu

SEQ ID NO: 1121780 - RNA, 22 nt, Human
ucuuuacaucacaauuguaugg

SEQ ID NO: 1121781 - RNA, 22 nt, Human
cuguccugauggugccacuggu

SEQ ID NO: 1121782 - RNA, 22 nt, Human
cucaggauagcugcgcagccug

SEQ ID NO: 1121783 - RNA, 22 nt, Human
gcagagcucuguucuuaucucc

SEQ ID NO: 1121784 - RNA, 22 nt, Human
cucagggccaaggaugcuguug

SEQ ID NO: 1121785 - RNA, 22 nt, Human
cuggagccuagguugaccuggg

SEQ ID NO: 1121786 - RNA, 22 nt, Human
uauugacaauaggcaacugagg

SEQ ID NO: 1121787 - RNA, 22 nt, Human
ugggcagaaaucaguaucagau

SEQ ID NO: 1121788 - RNA, 22 nt, Human
cuggcaggaagaggaaagguca

SEQ ID NO: 1121789 - RNA, 22 nt, Human
auaucuuuguuuuugccaagau

SEQ ID NO: 1121790 - RNA, 22 nt, Human
gggcagauggggcacaggcuga

SEQ ID NO: 1121791 - RNA, 22 nt, Human
gccagagccggcuucacaggau

SEQ ID NO: 1121792 - RNA, 22 nt, Human
ucucagaguuugaaucuggagu

SEQ ID NO: 1121793 - RNA, 22 nt, Human
ccuuucucauuuuaagcauuag

SEQ ID NO: 1121794 - RNA, 22 nt, Human
ugaaggugucuuugugaacauc

SEQ ID NO: 1121795 - RNA, 22 nt, Human
gcuggggcugggcugaggaaga

SEQ ID NO: 1121796 - RNA, 22 nt, Human
cucuggagaacuccuugugucu

SEQ ID NO: 1121797 - RNA, 18 nt, Human
cugaaggauccaggugua

SEQ ID NO: 1121798 - RNA, 22 nt, Human
cugauuccugauucaugcucuu

SEQ ID NO: 1121799 - RNA, 22 nt, Human
cugagccacugcuuguucagug

SEQ ID NO: 1121800 - RNA, 22 nt, Human
ggaggcugcugccucacguggg

SEQ ID NO: 1121801 - RNA, 22 nt, Human
gguucacauauugagaguauuc

SEQ ID NO: 1121802 - RNA, 22 nt, Human
ggccccugcggacugccuagag

SEQ ID NO: 1121803 - RNA, 22 nt, Human
gcagcuuggauuucuguaguuu

SEQ ID NO: 1121804 - RNA, 22 nt, Human
cuuacauugucuuaguuuucaa

SEQ ID NO: 1121805 - RNA, 22 nt, Human
acagggcauuuccucuaugugu

SEQ ID NO: 1121806 - RNA, 22 nt, Human
aaugcagugagccauuaaaugg

SEQ ID NO: 1121807 - RNA, 22 nt, Human
ucaaggaggugcuuggcuucac

SEQ ID NO: 1121808 - RNA, 22 nt, Human
gugggccucuugaggguggcua

SEQ ID NO: 1121809 - RNA, 22 nt, Human
aggccagguggucaugcuugcu

SEQ ID NO: 1121810 - RNA, 22 nt, Human
ggcaaaaaccauaauuacuuuu

SEQ ID NO: 1121811 - RNA, 22 nt, Human
uuuuaaguuaauauaauugagg

SEQ ID NO: 1121812 - RNA, 22 nt, Human
aagccagggucaggggccuccu

SEQ ID NO: 1121813 - RNA, 20 nt, Human
uccagggcuagggagcucau

SEQ ID NO: 1121814 - RNA, 22 nt, Human
cuuuggcaugguccucacuaua

SEQ ID NO: 1121815 - RNA, 22 nt, Human
ucagcugccuuucccaugcuag

SEQ ID NO: 1121816 - RNA, 22 nt, Human
cugugccuuuguagcugugccu

SEQ ID NO: 1121817 - RNA, 22 nt, Human
caggugcuguccugcacauguc

SEQ ID NO: 1121818 - RNA, 22 nt, Human
uguacauugucacucaucaagu

SEQ ID NO: 1121819 - RNA, 22 nt, Human
aaggcagagggcuggaucagag

SEQ ID NO: 1121820 - RNA, 22 nt, Human
augcaguacagauaauucuaca

SEQ ID NO: 1121821 - RNA, 22 nt, Human
ugccugugucacagugauguuu

SEQ ID NO: 1121822 - RNA, 18 nt, Human
gggcuguguucaugccca

SEQ ID NO: 1121823 - RNA, 22 nt, Human
agcugggagcagagccacagcc

SEQ ID NO: 1121824 - RNA, 22 nt, Human
cauaacuagagugaaauguuga

SEQ ID NO: 1121825 - RNA, 22 nt, Human
cagaagcaaaugccuugcugag

SEQ ID NO: 1121826 - RNA, 22 nt, Human
uugggcugaacccugcagcuga

SEQ ID NO: 1121827 - RNA, 22 nt, Human
uuaugaaagacauuucuguugg

SEQ ID NO: 1121828 - RNA, 22 nt, Human
ccaggcaggcagcguucucagg

SEQ ID NO: 1121829 - RNA, 22 nt, Human
cucuccuccaacagcccugccg

SEQ ID NO: 1121830 - RNA, 22 nt, Human
ugaaggcauugaugaaggaauc

SEQ ID NO: 1121831 - RNA, 22 nt, Human
gggccaggucggugaaugguca

SEQ ID NO: 1121832 - RNA, 22 nt, Human
cuggugcaggaaggagcuggca

SEQ ID NO: 1121833 - RNA, 22 nt, Human
uuggcugaagguuaagugcugg

SEQ ID NO: 1121834 - RNA, 22 nt, Human
aggugccaauuuucagugaaca

SEQ ID NO: 1121835 - RNA, 22 nt, Human
ccaaagucugcauuuuaacaug

SEQ ID NO: 1121836 - RNA, 22 nt, Human
gccucugcaugcucagcaccca

SEQ ID NO: 1121837 - RNA, 22 nt, Human
guaaaguucuacuagaaucaac

SEQ ID NO: 1121838 - RNA, 22 nt, Human
gggagcaggagccugccugcca

SEQ ID NO: 1121839 - RNA, 22 nt, Human
auaugaagucagacaaacuggg

SEQ ID NO: 1121840 - RNA, 22 nt, Human
agggucugacuccucuggcaag

SEQ ID NO: 1121841 - RNA, 22 nt, Human
gcacugcaucuacuggcaagua

SEQ ID NO: 1121842 - RNA, 22 nt, Human
agagcuguucaacguagcaaug

SEQ ID NO: 1121843 - RNA, 22 nt, Human
acauuucuaauuuaauguaaca

SEQ ID NO: 1121844 - RNA, 22 nt, Human
gggcacuggaaggcucucaggc

SEQ ID NO: 1121845 - RNA, 22 nt, Human
cucugagaaagcugugagcuaa

SEQ ID NO: 1121846 - RNA, 22 nt, Human
aauuagagaucaguucuuugac

SEQ ID NO: 1121847 - RNA, 23 nt, Human
ucugucaccuauggcugcucuuc

SEQ ID NO: 1121848 - RNA, 22 nt, Human
gcuggccugaccagccacaggc

SEQ ID NO: 1121849 - RNA, 22 nt, Human
cagcagcugcgugcccaggccg

SEQ ID NO: 1121850 - RNA, 22 nt, Human
aggguggagggagucccugagc

SEQ ID NO: 1121851 - RNA, 22 nt, Human
uggcugaaggaagauucuucua

SEQ ID NO: 1121852 - RNA, 22 nt, Human
ggacagaggguugacagaguau

SEQ ID NO: 1121853 - RNA, 22 nt, Human
aaucaguuguccaaaguucaca

SEQ ID NO: 1121854 - RNA, 22 nt, Human
ugcagaaggaggaggaaaucca

SEQ ID NO: 1121855 - RNA, 22 nt, Human
gugcucuggcuggucucccggu

SEQ ID NO: 1121856 - RNA, 22 nt, Human
gggccuccggggugagcugugg

SEQ ID NO: 1121857 - RNA, 19 nt, Human
aguguguacugaaagcacu

SEQ ID NO: 1121858 - RNA, 22 nt, Human
gagcugccaguguaugaauucu

SEQ ID NO: 1121859 - RNA, 22 nt, Human
auacaucuugucagauucaugu

SEQ ID NO: 1121860 - RNA, 20 nt, Human
agccugccagcuggcccaga

SEQ ID NO: 1121861 - RNA, 18 nt, Human
aaaaugcaggcgacaugg

SEQ ID NO: 1121862 - RNA, 21 nt, Human
ggccuuggcgggggccgaauu

SEQ ID NO: 1121863 - RNA, 22 nt, Human
acuuugaaacuaaaauucauua

SEQ ID NO: 1121864 - RNA, 22 nt, Human
uccagagguauguagagaguau

SEQ ID NO: 1121865 - RNA, 22 nt, Human
aggcacuguacuagguacaggg

SEQ ID NO: 1121866 - RNA, 22 nt, Human
agcccagguugaggcugcagug

SEQ ID NO: 1121867 - RNA, 22 nt, Human
gacccaggguuucugcacaggg

SEQ ID NO: 1121868 - RNA, 20 nt, Human
cagagaccugucuucacaga

SEQ ID NO: 1121869 - RNA, 20 nt, Human
gggcuggcgcauggggaaag

SEQ ID NO: 1121870 - RNA, 22 nt, Human
ugcaauaacuacuuuaauguug

SEQ ID NO: 1121871 - RNA, 22 nt, Human
cccaggagguggagguugcagc

SEQ ID NO: 1121872 - RNA, 22 nt, Human
uucucauucugacucaguguag

SEQ ID NO: 1121873 - RNA, 22 nt, Human
auguacaguggaaacuaacaaa

SEQ ID NO: 1121874 - RNA, 22 nt, Human
uaacagaaacagauaaguguaa

SEQ ID NO: 1121875 - RNA, 22 nt, Human
gcagagccccauugcuggcggg

SEQ ID NO: 1121876 - RNA, 22 nt, Human
gcaguggcuaagcucgcaugca

SEQ ID NO: 1121877 - RNA, 22 nt, Human
cagcugagaccagaaugcaggu

SEQ ID NO: 1121878 - RNA, 22 nt, Human
ucaagaaagggcuucaccagga

SEQ ID NO: 1121879 - RNA, 22 nt, Human
uguuuuauuucuccaagaggga

SEQ ID NO: 1121880 - RNA, 22 nt, Human
ggacacagauaaucacacagau

SEQ ID NO: 1121881 - RNA, 22 nt, Human
accugagggcccaaacuuggua

SEQ ID NO: 1121882 - RNA, 22 nt, Human
aggcucugaucagguggcugug

SEQ ID NO: 1121883 - RNA, 20 nt, Human
ugugcccaauguccagguuc

SEQ ID NO: 1121884 - RNA, 19 nt, Human
gggcuucugggaucaagag

SEQ ID NO: 1121885 - RNA, 22 nt, Human
ugggaggaucgcuugagcccag

SEQ ID NO: 1121886 - RNA, 22 nt, Human
aaggcacuugcccagagcugca

SEQ ID NO: 1121887 - RNA, 22 nt, Human
ugggccugggcuccuguccucu

SEQ ID NO: 1121888 - RNA, 22 nt, Human
gacagggcaagacucugucuaa

SEQ ID NO: 1121889 - RNA, 22 nt, Human
aggcacuggucuaccccuuagu

SEQ ID NO: 1121890 - RNA, 22 nt, Human
agugcacagcgugauguauugg

SEQ ID NO: 1121891 - RNA, 22 nt, Human
cuggcucacuagcccugcccug

SEQ ID NO: 1121892 - RNA, 23 nt, Human
uaguuauuuucucuguaauuugc

SEQ ID NO: 1121893 - RNA, 22 nt, Human
gugcucuccuggcugcccugac

SEQ ID NO: 1121894 - RNA, 22 nt, Human
ugcagggcccuugggguugaac

SEQ ID NO: 1121895 - RNA, 22 nt, Human
guuauaaaugacugcaaaaguu

SEQ ID NO: 1121896 - RNA, 22 nt, Human
uguaggacauguacuuguaaca

SEQ ID NO: 1121897 - RNA, 22 nt, Human
cccagcuaccucugcuaggaga

SEQ ID NO: 1121898 - RNA, 22 nt, Human
ggcuucccuuuccgagaggaga

SEQ ID NO: 1121899 - RNA, 22 nt, Human
cugggcaguuuauucaguucug

SEQ ID NO: 1121900 - RNA, 22 nt, Human
gggccuguguguucaggagccu

SEQ ID NO: 1121901 - RNA, 22 nt, Human
aagugagauuauauguacggga

SEQ ID NO: 1121902 - RNA, 22 nt, Human
uaagcauucaaugcuuagcacu

SEQ ID NO: 1121903 - RNA, 22 nt, Human
augucccaagauacagcuagag

SEQ ID NO: 1121904 - RNA, 22 nt, Human
cugcugccggcgagccucccuu

SEQ ID NO: 1121905 - RNA, 22 nt, Human
gagauuucuuuugaugccuguc

SEQ ID NO: 1121906 - RNA, 22 nt, Human
acuuccuguuaugugugccucu

SEQ ID NO: 1121907 - RNA, 17 nt, Human
acagagguuauacagac

SEQ ID NO: 1121908 - RNA, 22 nt, Human
agaugaagauaucugcaggggc

SEQ ID NO: 1121909 - RNA, 22 nt, Human
ggcugggagcuggacaggccgg

SEQ ID NO: 1121910 - RNA, 22 nt, Human
aggaugggccugggauaugcuu

SEQ ID NO: 1121911 - RNA, 22 nt, Human
uggaggaugagugugggcucug

SEQ ID NO: 1121912 - RNA, 22 nt, Human
cuucugggcauucagcugcaca

SEQ ID NO: 1121913 - RNA, 22 nt, Human
cacacaugaaucccuaguaccu

SEQ ID NO: 1121914 - RNA, 22 nt, Human
uuaugcuaaaugaaucaaguca

SEQ ID NO: 1121915 - RNA, 22 nt, Human
cugcccugucuuuuucugauga

SEQ ID NO: 1121916 - RNA, 22 nt, Human
ccagccugguucagaauuggcu

SEQ ID NO: 1121917 - RNA, 22 nt, Human
auuuauguaucuguguagauca

SEQ ID NO: 1121918 - RNA, 22 nt, Human
ucuuuccuacuuuauugugaac

SEQ ID NO: 1121919 - RNA, 22 nt, Human
caguuucuguuuuaaauagcag

SEQ ID NO: 1121920 - RNA, 22 nt, Human
ugcagcagcagggaggaggcuc

SEQ ID NO: 1121921 - RNA, 20 nt, Human
ccagagcugauggcugcccg

SEQ ID NO: 1121922 - RNA, 22 nt, Human
cuggcucaggguggucuggguc

SEQ ID NO: 1121923 - RNA, 22 nt, Human
ugcauuguugaauauuucauag

SEQ ID NO: 1121924 - RNA, 22 nt, Human
gugugcagugagcaaaagaucu

SEQ ID NO: 1121925 - RNA, 22 nt, Human
ugaagcagcaccauuuuagagc

SEQ ID NO: 1121926 - RNA, 22 nt, Human
cugggcagccucacacaauguu

SEQ ID NO: 1121927 - RNA, 22 nt, Human
cugucucuguugccuguaggug

SEQ ID NO: 1121928 - RNA, 22 nt, Human
auuuuucucucacacuuaccag

SEQ ID NO: 1121929 - RNA, 22 nt, Human
gggagccuugggagugccagcc

SEQ ID NO: 1121930 - RNA, 22 nt, Human
gaggugggaugugugugcuacu

SEQ ID NO: 1121931 - RNA, 22 nt, Human
cugagcugcggcaggcaccugg

SEQ ID NO: 1121932 - RNA, 22 nt, Human
ccagggugagaaaaggcuggau

SEQ ID NO: 1121933 - RNA, 22 nt, Human
acagaggaaggcugagcugccc

SEQ ID NO: 1121934 - RNA, 22 nt, Human
agcuggccuucggugucacugg

SEQ ID NO: 1121935 - RNA, 22 nt, Human
uguguauuaccauuuuacagcu

SEQ ID NO: 1121936 - RNA, 22 nt, Human
aaguuuuaacaaguacuuacua

SEQ ID NO: 1121937 - RNA, 22 nt, Human
augagcuguaagguggcuuccu

SEQ ID NO: 1121938 - RNA, 21 nt, Human
cagaaguaaggguaacuucuc

SEQ ID NO: 1121939 - RNA, 22 nt, Human
uucauucccaagaguaaacaua

SEQ ID NO: 1121940 - RNA, 22 nt, Human
ggguccagaguugaagagguua

SEQ ID NO: 1121941 - RNA, 22 nt, Human
ccagggcauccucacaucgcag

SEQ ID NO: 1121942 - RNA, 22 nt, Human
agcagcugccagagagaguucc

SEQ ID NO: 1121943 - RNA, 22 nt, Human
caggcacugugcuagauccuug

SEQ ID NO: 1121944 - RNA, 22 nt, Human
aggagcagaacuguuguggagg

SEQ ID NO: 1121945 - RNA, 22 nt, Human
ugucuguaagguguuuauguua

SEQ ID NO: 1121946 - RNA, 22 nt, Human
aggcugcagaacagucaggugc

SEQ ID NO: 1121947 - RNA, 22 nt, Human
ggccugcucugcagccucuaca

SEQ ID NO: 1121948 - RNA, 22 nt, Human
ucacuguauuugcugaugcaua

SEQ ID NO: 1121949 - RNA, 22 nt, Human
cccuggcagaaugucucugggc

SEQ ID NO: 1121950 - RNA, 22 nt, Human
auugaaaguccuaucuaaggga

SEQ ID NO: 1121951 - RNA, 22 nt, Human
ucagagagccucaggcacugcc

SEQ ID NO: 1121952 - RNA, 22 nt, Human
ccugggcaacauagugagaccc

SEQ ID NO: 1121953 - RNA, 21 nt, Human
agcagaggcagaauguaugca

SEQ ID NO: 1121954 - RNA, 22 nt, Human
gcacagggagacagccguggcc

SEQ ID NO: 1121955 - RNA, 22 nt, Human
acagaguauuggaaaggcagug

SEQ ID NO: 1121956 - RNA, 22 nt, Human
gcacacagccagcugagggcua

SEQ ID NO: 1121957 - RNA, 22 nt, Human
cuggcugccacuucagggucuu

SEQ ID NO: 1121958 - RNA, 22 nt, Human
ccucccucuguuagagcugucu

SEQ ID NO: 1121959 - RNA, 22 nt, Human
acagcuugcaauggcuuucaac

SEQ ID NO: 1121960 - RNA, 22 nt, Human
ugggcuggcguggagaguuuag

SEQ ID NO: 1121961 - RNA, 22 nt, Human
acauucaugucccacuucuagc

SEQ ID NO: 1121962 - RNA, 22 nt, Human
uggcucagugcauucacaguaa

SEQ ID NO: 1121963 - RNA, 22 nt, Human
uugggcuggcagagguggucuu

SEQ ID NO: 1121964 - RNA, 22 nt, Human
agggacacacuccaguguuauu

SEQ ID NO: 1121965 - RNA, 17 nt, Human
cccagagaugcugccuu

SEQ ID NO: 1121966 - RNA, 22 nt, Human
cacagagagcuacgugcagcgu

SEQ ID NO: 1121967 - RNA, 22 nt, Human
uucauucauuacgugccaggca

SEQ ID NO: 1121968 - RNA, 22 nt, Human
auaaggcacacauagauagggu

SEQ ID NO: 1121969 - RNA, 22 nt, Human
gcucccaguucccaaagugacc

SEQ ID NO: 1121970 - RNA, 22 nt, Human
aaagaacagauguguggugcau

SEQ ID NO: 1121971 - RNA, 22 nt, Human
ucaaagucuaucuguaauuacu

SEQ ID NO: 1121972 - RNA, 22 nt, Human
aucaguuuugggggacauacug

SEQ ID NO: 1121973 - RNA, 22 nt, Human
ccagcuccucuucccaguguca

SEQ ID NO: 1121974 - RNA, 22 nt, Human
uguccugggaaugggaugcagu

SEQ ID NO: 1121975 - RNA, 22 nt, Human
cacagaggaaaggcaguuggua

SEQ ID NO: 1121976 - RNA, 22 nt, Human
cuggcucauccagguguugcuc

SEQ ID NO: 1121977 - RNA, 22 nt, Human
gcaggagagccagcaggcuucc

SEQ ID NO: 1121978 - RNA, 22 nt, Human
aagccagguuccauggaggagc

SEQ ID NO: 1121979 - RNA, 20 nt, Human
agugccagggcaggugagag

SEQ ID NO: 1121980 - RNA, 22 nt, Human
ugggcugcuucuauuggugguc

SEQ ID NO: 1121981 - RNA, 22 nt, Human
guggauggauuuugaggaaugg

SEQ ID NO: 1121982 - RNA, 20 nt, Human
ucugaggcugagcucuacuu

SEQ ID NO: 1121983 - RNA, 22 nt, Human
uagggcagaguccaggaugggc

SEQ ID NO: 1121984 - RNA, 22 nt, Human
aguuuauguaaaauuaguaaug

SEQ ID NO: 1121985 - RNA, 22 nt, Human
ccuuucagaugggcauggaccg

SEQ ID NO: 1121986 - RNA, 22 nt, Human
cagucccacuagugccaauacc

SEQ ID NO: 1121987 - RNA, 22 nt, Human
gcagagcuucuguccuucagga

SEQ ID NO: 1121988 - RNA, 22 nt, Human
agccugagagccaagcugugca

SEQ ID NO: 1121989 - RNA, 22 nt, Human
gccucugcggggcccgagcccg

SEQ ID NO: 1121990 - RNA, 22 nt, Human
gugccuggcacacagaaggcaa

SEQ ID NO: 1121991 - RNA, 22 nt, Human
gugcuucucuucacacccaacu

SEQ ID NO: 1121992 - RNA, 22 nt, Human
ugcauccuuaaccagcaucacu

SEQ ID NO: 1121993 - RNA, 22 nt, Human
gcuuccuagaucugugguacuc

SEQ ID NO: 1121994 - RNA, 22 nt, Human
ucagccacuacccaccuuaaca

SEQ ID NO: 1121995 - RNA, 22 nt, Human
gccugccuuuguaugacccuga

SEQ ID NO: 1121996 - RNA, 22 nt, Human
uggcagcacaagguggcccaug

SEQ ID NO: 1121997 - RNA, 22 nt, Human
gggaucagcaagccacugcacc

SEQ ID NO: 1121998 - RNA, 22 nt, Human
gagagcugugguuugaccaggc

SEQ ID NO: 1121999 - RNA, 22 nt, Human
uucccaguauuaccuucaggaa

SEQ ID NO: 1122000 - RNA, 22 nt, Human
agggccucugacgcccccagcc

SEQ ID NO: 1122001 - RNA, 22 nt, Human
agugugugcaugcauucgugca

SEQ ID NO: 1122002 - RNA, 22 nt, Human
ucugagaggauuccugucccga

SEQ ID NO: 1122003 - RNA, 22 nt, Human
cucaggaggaggaaguucauug

SEQ ID NO: 1122004 - RNA, 20 nt, Human
agagccuggaaaaagacauc

SEQ ID NO: 1122005 - RNA, 22 nt, Human
aaaagcucuuucugcuguagau

SEQ ID NO: 1122006 - RNA, 22 nt, Human
acuuugaaggggaacauuuuaa

SEQ ID NO: 1122007 - RNA, 22 nt, Human
gcuggccucuacaggccggcca

SEQ ID NO: 1122008 - RNA, 22 nt, Human
ugauuuccccagucuugcugcu

SEQ ID NO: 1122009 - RNA, 22 nt, Human
agagucugaggcagcugcagcc

SEQ ID NO: 1122010 - RNA, 22 nt, Human
gcagggcagcuuagucccuguc

SEQ ID NO: 1122011 - RNA, 22 nt, Human
gcugucugcugugcacugagca

SEQ ID NO: 1122012 - RNA, 22 nt, Human
gggcugcuuauacugaugauaa

SEQ ID NO: 1122013 - RNA, 21 nt, Human
uuucaauguguucuuuguagu

SEQ ID NO: 1122014 - RNA, 22 nt, Human
caggcugaggcaguaggguuug

SEQ ID NO: 1122015 - RNA, 22 nt, Human
guacaugucaaaaaaugcauaa

SEQ ID NO: 1122016 - RNA, 22 nt, Human
ccagagcaauucucacagaacu

SEQ ID NO: 1122017 - RNA, 22 nt, Human
uggccugcagcucucagggaag

SEQ ID NO: 1122018 - RNA, 22 nt, Human
cagccugcuagggcaaugccuu

SEQ ID NO: 1122019 - RNA, 22 nt, Human
gcucagagauggggaaugaaaa

SEQ ID NO: 1122020 - RNA, 22 nt, Human
ucagcagcagcucagcauguuu

SEQ ID NO: 1122021 - RNA, 21 nt, Human
ucuggagcccuaagcugagaa

SEQ ID NO: 1122022 - RNA, 22 nt, Human
uacuguauuugauaagugaagu

SEQ ID NO: 1122023 - RNA, 22 nt, Human
agaagccauugaagcagaccuc

SEQ ID NO: 1122024 - RNA, 22 nt, Human
uaagaacaucuguccccagauu

SEQ ID NO: 1122025 - RNA, 18 nt, Human
aaugcacacauuuacucc

SEQ ID NO: 1122026 - RNA, 22 nt, Human
gcuucucuggccugcagggcau

SEQ ID NO: 1122027 - RNA, 22 nt, Human
acuguguggaccacucugaggc

SEQ ID NO: 1122028 - RNA, 23 nt, Human
uucaagauacgguuuccaggcug

SEQ ID NO: 1122029 - RNA, 22 nt, Human
ucacugcucucuaagcaucgcc

SEQ ID NO: 1122030 - RNA, 22 nt, Human
acagguggccccgagggagugg

SEQ ID NO: 1122031 - RNA, 22 nt, Human
cccagcuccuuacagggccgaa

SEQ ID NO: 1122032 - RNA, 22 nt, Human
gccuucaggaggguuccagaca

SEQ ID NO: 1122033 - RNA, 22 nt, Human
uguuuaaucuauaaaauggaga

SEQ ID NO: 1122034 - RNA, 22 nt, Human
uagaaguuaaaggaauacagaa

SEQ ID NO: 1122035 - RNA, 22 nt, Human
cagggccugccugguuccugga

SEQ ID NO: 1122036 - RNA, 22 nt, Human
auguaagguucagaguauguga

SEQ ID NO: 1122037 - RNA, 22 nt, Human
acagagcucccagccaucuccu

SEQ ID NO: 1122038 - RNA, 17 nt, Human
ucaggcugggugcagug

SEQ ID NO: 1122039 - RNA, 22 nt, Human
uacaaaguagaaauucaguaaa

SEQ ID NO: 1122040 - RNA, 22 nt, Human
gucacaggccuggaugaggggc

SEQ ID NO: 1122041 - RNA, 22 nt, Human
ggggccugcgagguucaacuuc

SEQ ID NO: 1122042 - RNA, 22 nt, Human
cugccugcuucugagccagagg

SEQ ID NO: 1122043 - RNA, 22 nt, Human
auuguggcuagacagucacaau

SEQ ID NO: 1122044 - RNA, 22 nt, Human
agccacagugcaagagagaaaa

SEQ ID NO: 1122045 - RNA, 22 nt, Human
agggcucuguccccagaggccc

SEQ ID NO: 1122046 - RNA, 22 nt, Human
accucccagcucugagcuuggg

SEQ ID NO: 1122047 - RNA, 22 nt, Human
gagagugaugaaugguuaaaca

SEQ ID NO: 1122048 - RNA, 23 nt, Human
gaguguucauagcaggcucuugc

SEQ ID NO: 1122049 - RNA, 22 nt, Human
aggcagcaugcucugcuucuac

SEQ ID NO: 1122050 - RNA, 22 nt, Human
gccucugggcucugccccuggc

SEQ ID NO: 1122051 - RNA, 22 nt, Human
gcugagugauugauauuuuagu

SEQ ID NO: 1122052 - RNA, 22 nt, Human
aguuacaaccaugacacaagca

SEQ ID NO: 1122053 - RNA, 22 nt, Human
gcucccagggaccgcagggcag

SEQ ID NO: 1122054 - RNA, 22 nt, Human
ugcucccaggcauucucuguug

SEQ ID NO: 1122055 - RNA, 22 nt, Human
caguguuccaggcggcagugaa

SEQ ID NO: 1122056 - RNA, 22 nt, Human
cuggccugagcacagcggcugc

SEQ ID NO: 1122057 - RNA, 22 nt, Human
ugggugcuucgucagcucugag

SEQ ID NO: 1122058 - RNA, 22 nt, Human
aaggcacugagccagccgucuc

SEQ ID NO: 1122059 - RNA, 22 nt, Human
ccuucugcuggucaucccagug

SEQ ID NO: 1122060 - RNA, 22 nt, Human
uagcugccagaccauucuuacu

SEQ ID NO: 1122061 - RNA, 22 nt, Human
cagcugugcuguauuaagcucu

SEQ ID NO: 1122062 - RNA, 22 nt, Human
auccaggguguggagagagcuc

SEQ ID NO: 1122063 - RNA, 22 nt, Human
uauuuugagguauuuuugagcu

SEQ ID NO: 1122064 - RNA, 19 nt, Human
ugaagcaggcagagaagau

SEQ ID NO: 1122065 - RNA, 22 nt, Human
gagcuguccgccccugggccga

SEQ ID NO: 1122066 - RNA, 22 nt, Human
ccagggcaggagaaagacucac

SEQ ID NO: 1122067 - RNA, 22 nt, Human
agaauuuuugauuaucuacucg

SEQ ID NO: 1122068 - RNA, 22 nt, Human
gaggagggagcuggaagcucuu

SEQ ID NO: 1122069 - RNA, 22 nt, Human
ggccucagugggccgcugcagg

SEQ ID NO: 1122070 - RNA, 22 nt, Human
agacagcugcucgcagagcuau

SEQ ID NO: 1122071 - RNA, 22 nt, Human
ccagagccucuuaugaagaucg

SEQ ID NO: 1122072 - RNA, 21 nt, Human
ccaccaggucuucugcucggg

SEQ ID NO: 1122073 - RNA, 22 nt, Human
caguccuggggaccaggcugag

SEQ ID NO: 1122074 - RNA, 22 nt, Human
uugcaaaagccgaggcacucca

SEQ ID NO: 1122075 - RNA, 21 nt, Human
ugggaugggucugggaccagc

SEQ ID NO: 1122076 - RNA, 22 nt, Human
ggugcucaagagggcauccucu

SEQ ID NO: 1122077 - RNA, 17 nt, Human
ugagaaguaggcaucau

SEQ ID NO: 1122078 - RNA, 22 nt, Human
ccaaggcuucccagagaugcuc

SEQ ID NO: 1122079 - RNA, 22 nt, Human
agggccugacacccuugccagc

SEQ ID NO: 1122080 - RNA, 22 nt, Human
cacccaggcagguggcugagaa

SEQ ID NO: 1122081 - RNA, 23 nt, Human
uggcagugaucaaaagcuuacau

SEQ ID NO: 1122082 - RNA, 22 nt, Human
ggccugggcccacugucaagag

SEQ ID NO: 1122083 - RNA, 23 nt, Human
ugcaggggaggcuuaaagcaggu

SEQ ID NO: 1122084 - RNA, 22 nt, Human
uaggacaggugaggggcugugg

SEQ ID NO: 1122085 - RNA, 22 nt, Human
gccagcuggagacuggcagggg

SEQ ID NO: 1122086 - RNA, 22 nt, Human
augcuuuacaguuuuccaaaca

SEQ ID NO: 1122087 - RNA, 22 nt, Human
agagcuggguggacuuguaguu

SEQ ID NO: 1122088 - RNA, 22 nt, Human
ugcuggggagugauugaccauc

SEQ ID NO: 1122089 - RNA, 22 nt, Human
aaggcugagagucacaguccua

SEQ ID NO: 1122090 - RNA, 23 nt, Human
ucugucacuuucugcuguggagu

SEQ ID NO: 1122091 - RNA, 23 nt, Human
uuucauaugguguggaugaagaa

SEQ ID NO: 1122092 - RNA, 22 nt, Human
uaaggucauggugaauaauaag

SEQ ID NO: 1122093 - RNA, 19 nt, Human
cugugcaggccgggcugag

SEQ ID NO: 1122094 - RNA, 22 nt, Human
ucuuuccuguaacugcuguuca

SEQ ID NO: 1122095 - RNA, 22 nt, Human
cagagcugagaauguugaugcu

SEQ ID NO: 1122096 - RNA, 22 nt, Human
cugcagaggguuugagcauccu

SEQ ID NO: 1122097 - RNA, 22 nt, Human
caggaugggauguagugggccc

SEQ ID NO: 1122098 - RNA, 22 nt, Human
guacauuuuacuuuguuugaau

SEQ ID NO: 1122099 - RNA, 22 nt, Human
ugugccaggcacuugcccaggc

SEQ ID NO: 1122100 - RNA, 22 nt, Human
acacaugcugauaagaauauaa

SEQ ID NO: 1122101 - RNA, 22 nt, Human
aucuggcuuucuuaaugacuua

SEQ ID NO: 1122102 - RNA, 22 nt, Human
gcagggugauagugaggcucag

SEQ ID NO: 1122103 - RNA, 22 nt, Human
uaaauguguaaaccuccauuac

SEQ ID NO: 1122104 - RNA, 22 nt, Human
ccagcagcucccucaggguccg

SEQ ID NO: 1122105 - RNA, 22 nt, Human
aaaaucugcuuccuuuuacaga

SEQ ID NO: 1122106 - RNA, 22 nt, Human
ugggccuggacaaggccacuag

SEQ ID NO: 1122107 - RNA, 22 nt, Human
aaacaugagcaucucuucaagc

SEQ ID NO: 1122108 - RNA, 22 nt, Human
ucaguuuugauuccugguucuc

SEQ ID NO: 1122109 - RNA, 20 nt, Human
cucucuggaaggugggagcc

SEQ ID NO: 1122110 - RNA, 22 nt, Human
gcuugggauaugcugauguaaa

SEQ ID NO: 1122111 - RNA, 22 nt, Human
uaagaacagugacagccaacau

SEQ ID NO: 1122112 - RNA, 22 nt, Human
ggcagggaggaggugaaaguga

SEQ ID NO: 1122113 - RNA, 22 nt, Human
gcugaaggaggcucugguacua

SEQ ID NO: 1122114 - RNA, 22 nt, Human
gcucaggaaacagcagggcuug

SEQ ID NO: 1122115 - RNA, 18 nt, Human
agcuggcccuggcugccg

SEQ ID NO: 1122116 - RNA, 22 nt, Human
cuggacuuuggcccaucugcca

SEQ ID NO: 1122117 - RNA, 21 nt, Human
cugugcuuuuuaagugugaug

SEQ ID NO: 1122118 - RNA, 22 nt, Human
ucugaggccccugggcaggaug

SEQ ID NO: 1122119 - RNA, 22 nt, Human
ggaccagagaagugagcaccug

SEQ ID NO: 1122120 - RNA, 22 nt, Human
agccuggacagcuacggagaac

SEQ ID NO: 1122121 - RNA, 22 nt, Human
gcccuggaaucucuccauggga

SEQ ID NO: 1122122 - RNA, 22 nt, Human
caagagcuggagaggcagucua

SEQ ID NO: 1122123 - RNA, 22 nt, Human
cugagcugggaguggauagugg

SEQ ID NO: 1122124 - RNA, 22 nt, Human
acauuaucccuggcacaacugc

SEQ ID NO: 1122125 - RNA, 22 nt, Human
uacagaaaaacuggcauugaag

SEQ ID NO: 1122126 - RNA, 22 nt, Human
uuuugaaagccagguuuguaug

SEQ ID NO: 1122127 - RNA, 22 nt, Human
cugugucccuugucccagagcc

SEQ ID NO: 1122128 - RNA, 22 nt, Human
ucucuggguuuuuguccuguac

SEQ ID NO: 1122129 - RNA, 22 nt, Human
ucccagcauuaaugccugucag

SEQ ID NO: 1122130 - RNA, 22 nt, Human
augggaugaacuugaucugcuu

SEQ ID NO: 1122131 - RNA, 22 nt, Human
acugaaggcuuaacucuuucau

SEQ ID NO: 1122132 - RNA, 22 nt, Human
agagaaaagaguucaggcuuug

SEQ ID NO: 1122133 - RNA, 22 nt, Human
guauuuucaagagcaguaguau

SEQ ID NO: 1122134 - RNA, 22 nt, Human
ggucccagguugacagggagac

SEQ ID NO: 1122135 - RNA, 22 nt, Human
gagacagaguuucacucuuguu

SEQ ID NO: 1122136 - RNA, 22 nt, Human
gagggacagcuaaagagaaauu

SEQ ID NO: 1122137 - RNA, 22 nt, Human
aaccaggacaauuugaauagaa

SEQ ID NO: 1122138 - RNA, 21 nt, Human
uggcucuggguaggagagugc

SEQ ID NO: 1122139 - RNA, 22 nt, Human
aagcugccuagaguugaauguc

SEQ ID NO: 1122140 - RNA, 22 nt, Human
aaaucuaggcucauccuggucc

SEQ ID NO: 1122141 - RNA, 19 nt, Human
ccagguggaacugagguag

SEQ ID NO: 1122142 - RNA, 22 nt, Human
ucaguggauauuucuguggcug

SEQ ID NO: 1122143 - RNA, 22 nt, Human
caguacuuugaagauauuuuag

SEQ ID NO: 1122144 - RNA, 22 nt, Human
gucccagggagguucagggcuu

SEQ ID NO: 1122145 - RNA, 22 nt, Human
ugcugaggagguggcugugcuu

SEQ ID NO: 1122146 - RNA, 22 nt, Human
uggggaagggcacccuggagac

SEQ ID NO: 1122147 - RNA, 23 nt, Human
ugauuuccagugagucaguggga

SEQ ID NO: 1122148 - RNA, 22 nt, Human
ggagcagacauaaccuuacaga

SEQ ID NO: 1122149 - RNA, 21 nt, Human
ugcuucucuagaucaacuacu

SEQ ID NO: 1122150 - RNA, 22 nt, Human
agggaaaggcugaugcuguggg

SEQ ID NO: 1122151 - RNA, 22 nt, Human
agcaguggcuggauggugugcu

SEQ ID NO: 1122152 - RNA, 22 nt, Human
aauguuguuuuucugcaugucu

SEQ ID NO: 1122153 - RNA, 22 nt, Human
ccucacagggccaggccccuca

SEQ ID NO: 1122154 - RNA, 22 nt, Human
uucugggacaucuggacaguuu

SEQ ID NO: 1122155 - RNA, 22 nt, Human
uuucaauguaugucuuucugag

SEQ ID NO: 1122156 - RNA, 22 nt, Human
gggcuacagacaugcucuaagc

SEQ ID NO: 1122157 - RNA, 22 nt, Human
gggcucagccccauugaaccag

SEQ ID NO: 1122158 - RNA, 22 nt, Human
aagagcuggagcugcuacagga

SEQ ID NO: 1122159 - RNA, 22 nt, Human
caggagcugggucuggaagcag

SEQ ID NO: 1122160 - RNA, 22 nt, Human
cuucaucaacucuaacaaaugu

SEQ ID NO: 1122161 - RNA, 22 nt, Human
cccaaggcugcagugagcauga

SEQ ID NO: 1122162 - RNA, 22 nt, Human
ucagcugaguucuagagcacuc

SEQ ID NO: 1122163 - RNA, 21 nt, Human
guggcccugguguggcugcac

SEQ ID NO: 1122164 - RNA, 22 nt, Human
ugcauuguaggauguuuagcag

SEQ ID NO: 1122165 - RNA, 22 nt, Human
gaaaaugugucaucccuacugu

SEQ ID NO: 1122166 - RNA, 22 nt, Human
cguuggagacacuugaggacuu

SEQ ID NO: 1122167 - RNA, 22 nt, Human
caaggccugccucuggcagaaa

SEQ ID NO: 1122168 - RNA, 22 nt, Human
cagcauggggcuuggagucagc

SEQ ID NO: 1122169 - RNA, 22 nt, Human
auaagguaugaaaaguaaaugg

SEQ ID NO: 1122170 - RNA, 22 nt, Human
ugugccuuaugaauucuuucug

SEQ ID NO: 1122171 - RNA, 22 nt, Human
agcagaaccacagcacuguuga

SEQ ID NO: 1122172 - RNA, 22 nt, Human
cacauaaguggguuccauugca

SEQ ID NO: 1122173 - RNA, 22 nt, Human
augaagcugaccuugucuugcu

SEQ ID NO: 1122174 - RNA, 22 nt, Human
agcugcccuggcggagcugcuc

SEQ ID NO: 1122175 - RNA, 22 nt, Human
cagagccaugguaugggcuugu

SEQ ID NO: 1122176 - RNA, 22 nt, Human
auccagggauaaaaguaagguu

SEQ ID NO: 1122177 - RNA, 22 nt, Human
ccugucagcugauggcuaugua

SEQ ID NO: 1122178 - RNA, 21 nt, Human
cuugaaagguagagucuacag

SEQ ID NO: 1122179 - RNA, 22 nt, Human
ggccccuggcaccaggcugauu

SEQ ID NO: 1122180 - RNA, 17 nt, Human
uuagcaaaauagcacuu

SEQ ID NO: 1122181 - RNA, 22 nt, Human
cacauuugaaggaauuagcauu

SEQ ID NO: 1122182 - RNA, 17 nt, Human
agauggcaggaggcaga

SEQ ID NO: 1122183 - RNA, 22 nt, Human
gugccugccccacuccucagca

SEQ ID NO: 1122184 - RNA, 22 nt, Human
aggaggccgcugaugggcuccc

SEQ ID NO: 1122185 - RNA, 22 nt, Human
caguggcagagaacagagaccu

SEQ ID NO: 1122186 - RNA, 22 nt, Human
uuuuccucaggaaugcuaagcu

SEQ ID NO: 1122187 - RNA, 23 nt, Human
uguaaaaugggguaguguuacca

SEQ ID NO: 1122188 - RNA, 22 nt, Human
ucagcagauggguuguguuggc

SEQ ID NO: 1122189 - RNA, 23 nt, Human
agacagaggcugaggcuggccgc

SEQ ID NO: 1122190 - RNA, 19 nt, Human
ucaguuuuagucaucaguu

SEQ ID NO: 1122191 - RNA, 19 nt, Human
ggccuggauuuagggcucc

SEQ ID NO: 1122192 - RNA, 22 nt, Human
ugaucagucccaugaucuucca

SEQ ID NO: 1122193 - RNA, 22 nt, Human
agccucucuuuauucccagcua

SEQ ID NO: 1122194 - RNA, 22 nt, Human
agugaaauacugucguuuuuag

SEQ ID NO: 1122195 - RNA, 22 nt, Human
caauauucaguggaaaagccau

SEQ ID NO: 1122196 - RNA, 22 nt, Human
uugauacauagcacaguuuagg

SEQ ID NO: 1122197 - RNA, 22 nt, Human
cucaggauggaagccuacagga

SEQ ID NO: 1122198 - RNA, 22 nt, Human
cugugagcuggguggccaggac

SEQ ID NO: 1122199 - RNA, 22 nt, Human
uuugggcaguagauguaucacu

SEQ ID NO: 1122200 - RNA, 22 nt, Human
aaaagaggagugguuuaugaca

SEQ ID NO: 1122201 - RNA, 22 nt, Human
agauuucagguuggggcagaag

SEQ ID NO: 1122202 - RNA, 22 nt, Human
aggccuggugugccggaugcag

SEQ ID NO: 1122203 - RNA, 22 nt, Human
aaauguguuuagaugguuuauu

SEQ ID NO: 1122204 - RNA, 22 nt, Human
gcaccaggcuuagagccccagg

SEQ ID NO: 1122205 - RNA, 22 nt, Human
ugcaguggaggccgugagacag

SEQ ID NO: 1122206 - RNA, 20 nt, Human
ugacucugcaaccgucucuc

SEQ ID NO: 1122207 - RNA, 22 nt, Human
aggcacuguggguguggccgga

SEQ ID NO: 1122208 - RNA, 22 nt, Human
gccugugcuuaacugacgugag

SEQ ID NO: 1122209 - RNA, 22 nt, Human
uuugugcaagagggccaccuua

SEQ ID NO: 1122210 - RNA, 22 nt, Human
guguggucgaaguucucccgga

SEQ ID NO: 1122211 - RNA, 22 nt, Human
ucccagucuagagccggauugg

SEQ ID NO: 1122212 - RNA, 22 nt, Human
aguggcaguagaugagcugguu

SEQ ID NO: 1122213 - RNA, 22 nt, Human
ccagugugcauuaucauguguc

SEQ ID NO: 1122214 - RNA, 22 nt, Human
cgggcacucagggucgaggugg

SEQ ID NO: 1122215 - RNA, 22 nt, Human
uucuccucagcaaggcagcuuu

SEQ ID NO: 1122216 - RNA, 22 nt, Human
uuauggcauucauuggggcuuu

SEQ ID NO: 1122217 - RNA, 22 nt, Human
ccugugggagggagcggcugga

SEQ ID NO: 1122218 - RNA, 19 nt, Human
acacaccagugccugugac

SEQ ID NO: 1122219 - RNA, 22 nt, Human
uccagccauaucuuguagcccu

SEQ ID NO: 1122220 - RNA, 22 nt, Human
cagcccacugccucugugguag

SEQ ID NO: 1122221 - RNA, 22 nt, Human
guguggcuaggauggcuuugcu

SEQ ID NO: 1122222 - RNA, 21 nt, Human
uccuccuguagaggguccugg

SEQ ID NO: 1122223 - RNA, 22 nt, Human
agccagucggggccaugcuggg

SEQ ID NO: 1122224 - RNA, 22 nt, Human
ccuaggcuaauucaguccagua

SEQ ID NO: 1122225 - RNA, 23 nt, Human
uagauccuuccaacuacucuuac

SEQ ID NO: 1122226 - RNA, 22 nt, Human
agcaccauugcaaauauggcag

SEQ ID NO: 1122227 - RNA, 22 nt, Human
gguggcaccuuacccugcgcag

SEQ ID NO: 1122228 - RNA, 22 nt, Human
gggcagcaggcuccacguuccu

SEQ ID NO: 1122229 - RNA, 22 nt, Human
gcacugggggcagcagugaggg

SEQ ID NO: 1122230 - RNA, 22 nt, Human
cucugggguggaggaggcugac

SEQ ID NO: 1122231 - RNA, 22 nt, Human
uuccuggugguggugacagcac

SEQ ID NO: 1122232 - RNA, 22 nt, Human
gcagcuuuggagguggaacucu

SEQ ID NO: 1122233 - RNA, 22 nt, Human
ucuccucuauuucuguauguau

SEQ ID NO: 1122234 - RNA, 22 nt, Human
ucuccucuccuuucauguuguu

SEQ ID NO: 1122235 - RNA, 22 nt, Human
gggcagcaaaucugagucuggu

SEQ ID NO: 1122236 - RNA, 17 nt, Human
ugaggccugcaucagug

SEQ ID NO: 1122237 - RNA, 22 nt, Human
ucgcagcacuagcccugcauug

SEQ ID NO: 1122238 - RNA, 17 nt, Human
uggcacagaggugcuau

SEQ ID NO: 1122239 - RNA, 22 nt, Human
acuuccagaaaugauuuaauuu

SEQ ID NO: 1122240 - RNA, 22 nt, Human
ccaggugugcucugcaguggau

SEQ ID NO: 1122241 - RNA, 22 nt, Human
uaacuucucugagccucauucc

SEQ ID NO: 1122242 - RNA, 21 nt, Human
uuccuccucuggagaagaaga

SEQ ID NO: 1122243 - RNA, 20 nt, Human
uccugggguaagccaugguc

SEQ ID NO: 1122244 - RNA, 20 nt, Human
ucucuaacaugaaugcuauc

SEQ ID NO: 1122245 - RNA, 22 nt, Human
cugagggccuucuaugcugagc

SEQ ID NO: 1122246 - RNA, 19 nt, Human
uggcagcauugguaccuug

SEQ ID NO: 1122247 - RNA, 22 nt, Human
ugguggcacugacaucagacac

SEQ ID NO: 1122248 - RNA, 21 nt, Human
ccaccaggucuucugcucggg

SEQ ID NO: 1122249 - RNA, 22 nt, Human
cucucagugccugcccuaggcu

SEQ ID NO: 1122250 - RNA, 22 nt, Human
ucuccuggcauuugguugagua

SEQ ID NO: 1122251 - RNA, 22 nt, Human
uccuggguccauggcagccgaa

SEQ ID NO: 1122252 - RNA, 22 nt, Human
ccuggggaccugccucagcccu

SEQ ID NO: 1122253 - RNA, 20 nt, Human
agcuuugguuaagccagugg

SEQ ID NO: 1122254 - RNA, 22 nt, Human
aggguugaagucugguccucau

SEQ ID NO: 1122255 - RNA, 22 nt, Human
uuuacagcuacuguccuauuuc

SEQ ID NO: 1122256 - RNA, 22 nt, Human
ucuuccuggauggggguugaug

SEQ ID NO: 1122257 - RNA, 22 nt, Human
ccaguccaggccauggauuuug

SEQ ID NO: 1122258 - RNA, 22 nt, Human
cagcuccagcccaggcagcucc

SEQ ID NO: 1122259 - RNA, 19 nt, Human
guuggcacugaaaauggcu

SEQ ID NO: 1122260 - RNA, 22 nt, Human
acaugggcaucuaugaggcucu

SEQ ID NO: 1122261 - RNA, 22 nt, Human
uaccugggcccaccagugccug

SEQ ID NO: 1122262 - RNA, 22 nt, Human
cccuggcucugccucagagccc

SEQ ID NO: 1122263 - RNA, 22 nt, Human
cugggcuuucaggcccuaaggc

SEQ ID NO: 1122264 - RNA, 22 nt, Human
uccuggggaggucgaggcugag

SEQ ID NO: 1122265 - RNA, 22 nt, Human
gucuccuuguggaucucaagga

SEQ ID NO: 1122266 - RNA, 22 nt, Human
ccuccugggccuugcucuguga

SEQ ID NO: 1122267 - RNA, 20 nt, Human
uccagccacuuccgcugguc

SEQ ID NO: 1122268 - RNA, 22 nt, Human
ccugcacuaccuggggcugcug

SEQ ID NO: 1122269 - RNA, 22 nt, Human
uucccuucuaguuuugagagac

SEQ ID NO: 1122270 - RNA, 22 nt, Human
uccuccuuuccccgcuggagcc

SEQ ID NO: 1122271 - RNA, 19 nt, Human
uccuggggaggggcauggc

SEQ ID NO: 1122272 - RNA, 22 nt, Human
uggccugauuuugcuaagagaa

SEQ ID NO: 1122273 - RNA, 22 nt, Human
uggcagcauuuuuuccagaaca

SEQ ID NO: 1122274 - RNA, 22 nt, Human
uggcagcagggccccuggagga

SEQ ID NO: 1122275 - RNA, 22 nt, Human
ccugguguuaucauaggucaug

SEQ ID NO: 1122276 - RNA, 22 nt, Human
aggggcacgaguagagcucuag

SEQ ID NO: 1122277 - RNA, 22 nt, Human
ccgcguggcacccuccuggagg

SEQ ID NO: 1122278 - RNA, 20 nt, Human
uccuccuugcagagcccaga

SEQ ID NO: 1122279 - RNA, 22 nt, Human
gucccucugccugugguucucu

SEQ ID NO: 1122280 - RNA, 22 nt, Human
aucccuggccacgaagcugccc

SEQ ID NO: 1122281 - RNA, 18 nt, Human
ucaguccuccauagagcu

SEQ ID NO: 1122282 - RNA, 22 nt, Human
cuccuuccugguuagcaccuua

SEQ ID NO: 1122283 - RNA, 22 nt, Human
ggggucugggcuuagcuggaau

SEQ ID NO: 1122284 - RNA, 22 nt, Human
auucccuuugacgaucccuagg

SEQ ID NO: 1122285 - RNA, 22 nt, Human
ucaccucucuggccgucuaccu

SEQ ID NO: 1122286 - RNA, 22 nt, Human
gggcagcaucaggaggggcuuu

SEQ ID NO: 1122287 - RNA, 22 nt, Human
gccuggggaacuugauccuguc

SEQ ID NO: 1122288 - RNA, 23 nt, Human
cugagggcuggucugaagucugc

SEQ ID NO: 1122289 - RNA, 22 nt, Human
ggucuccugaccuuuagucccu

SEQ ID NO: 1122290 - RNA, 22 nt, Human
gguggcugugagcauuauguga

SEQ ID NO: 1122291 - RNA, 22 nt, Human
ucacagcugggguuuuggcagc

SEQ ID NO: 1122292 - RNA, 22 nt, Human
gcacugggagucuguggggguu

SEQ ID NO: 1122293 - RNA, 22 nt, Human
cggggccuagucuaccucggca

SEQ ID NO: 1122294 - RNA, 22 nt, West Nile virus
guggcugguugugcagagcaga

SEQ ID NO: 1122295 - RNA, 22 nt, West Nile virus
guguucuagcaccaccagccac

SEQ ID NO: 1122296 - RNA, 22 nt, Human
ucucuggaagcgcagaucuguu

SEQ ID NO: 1122297 - RNA, 22 nt, Human
cuccagggggcauccacacagc

SEQ ID NO: 1122298 - RNA, 22 nt, Human
uuacauuuggcuauguccucua

SEQ ID NO: 1122299 - RNA, 22 nt, Human
cccugcaggggaccugcagccu

SEQ ID NO: 1122300 - RNA, 22 nt, Human
agcuguguagggaaucagagaa

SEQ ID NO: 1122301 - RNA, 22 nt, Human
gaugggaggaaccugggucccu

SEQ ID NO: 1122302 - RNA, 22 nt, Human
uauuucuuucagguauguguug

SEQ ID NO: 1122303 - RNA, 21 nt, Human
cuccugggcuaagauauagug

SEQ ID NO: 1122304 - RNA, 22 nt, Human
ggccugcuuuccgagccugcag

SEQ ID NO: 1122305 - RNA, 22 nt, Human
ugugcuucuugcagcuccugua

SEQ ID NO: 1122306 - RNA, 22 nt, Human
caggccugacccugagcuucac

SEQ ID NO: 1122307 - RNA, 22 nt, Human
ucggagcuguagaugaaacccu

SEQ ID NO: 1122308 - RNA, 22 nt, Human
uucuggagaucugccuauggga

SEQ ID NO: 1122309 - RNA, 22 nt, Human
agagacaggauaucugcucaug

SEQ ID NO: 1122310 - RNA, 22 nt, Human
gcuguguccucacacagccuuu

SEQ ID NO: 1122311 - RNA, 22 nt, Human
gucaugccuggcuucuuagaca

SEQ ID NO: 1122312 - RNA, 22 nt, Human
ugggugggagcgcccugucugg

SEQ ID NO: 1122313 - RNA, 22 nt, Human
gugucccacucuggaggugaag

SEQ ID NO: 1122314 - RNA, 18 nt, Human
uggguggcuagggaguuu

SEQ ID NO: 1122315 - RNA, 22 nt, Human
gugcuuccccaagccacagccu

SEQ ID NO: 1122316 - RNA, 22 nt, Human
ccuccagcgcgauccacuccgg

SEQ ID NO: 1122317 - RNA, 22 nt, Human
augcagagacagauguggcaug

SEQ ID NO: 1122318 - RNA, 22 nt, Human
cuggugccuccucccugugcuu

SEQ ID NO: 1122319 - RNA, 22 nt, Human
aaugggaggauuuucucucuug

SEQ ID NO: 1122320 - RNA, 22 nt, Human
agccuggaccaggggccucaga

SEQ ID NO: 1122321 - RNA, 22 nt, Human
uagcugccauugcuccaggaag

SEQ ID NO: 1122322 - RNA, 22 nt, Human
ugccugucuccucugcagggug

SEQ ID NO: 1122323 - RNA, 22 nt, Human
cccucugcaggcuggaccugcc

SEQ ID NO: 1122324 - RNA, 22 nt, Human
cagcugccugcaacacaagcuu

SEQ ID NO: 1122325 - RNA, 22 nt, Human
aggccuagaggaauggccaggg

SEQ ID NO: 1122326 - RNA, 22 nt, Human
ugugggcucccccucacucugu

SEQ ID NO: 1122327 - RNA, 23 nt, Human
ugagcugguauuguccaucucca

SEQ ID NO: 1122328 - RNA, 21 nt, Human
auugaaagucaacaaucaguu

SEQ ID NO: 1122329 - RNA, 22 nt, Human
uuggcuucucuuaacccuaaag

SEQ ID NO: 1122330 - RNA, 22 nt, Human
uuagagaaauucugguaaugua

SEQ ID NO: 1122331 - RNA, 22 nt, Human
caagagcucagaaacccuugcu

SEQ ID NO: 1122332 - RNA, 22 nt, Human
ugcugccaagcccgugcuccug

SEQ ID NO: 1122333 - RNA, 22 nt, Human
ugcauuucagaagaaaauucgg

SEQ ID NO: 1122334 - RNA, 22 nt, Human
acagcagcacuauugacauuuu

SEQ ID NO: 1122335 - RNA, 22 nt, Human
ucugucacuauuggccagaaca

SEQ ID NO: 1122336 - RNA, 22 nt, Human
cccucugcugccuggcuggguc

SEQ ID NO: 1122337 - RNA, 22 nt, Human
ccucuuugugccugcaggcugc

SEQ ID NO: 1122338 - RNA, 22 nt, Human
ggaggagacaguaaaaagcacg

SEQ ID NO: 1122339 - RNA, 22 nt, Human
acugucugcuggccccugguua

SEQ ID NO: 1122340 - RNA, 22 nt, Human
ugacuuccugcacucaggugau

SEQ ID NO: 1122341 - RNA, 22 nt, Human
cagcucuguaaauuccuucauc

SEQ ID NO: 1122342 - RNA, 22 nt, Human
ccaggccuuucuucuuggucug

SEQ ID NO: 1122343 - RNA, 22 nt, Human
gcacagcaauuucuauaagcuc

SEQ ID NO: 1122344 - RNA, 22 nt, Human
uaaugugugucaucaguagagu

SEQ ID NO: 1122345 - RNA, 22 nt, Human
acagaguacauucagagacuau

SEQ ID NO: 1122346 - RNA, 19 nt, Human
acagggcagcaauaggaua

SEQ ID NO: 1122347 - RNA, 22 nt, Human
ggccugcugacccaaguccugu

SEQ ID NO: 1122348 - RNA, 22 nt, Human
uuacuuuggauggucaagaaag

SEQ ID NO: 1122349 - RNA, 22 nt, Human
agaaauguuuauggcugccuau

SEQ ID NO: 1122350 - RNA, 22 nt, Human
agagcugcccacacagcagauu

SEQ ID NO: 1122351 - RNA, 22 nt, Human
uauaaagugugaacugugagua

SEQ ID NO: 1122352 - RNA, 20 nt, Human
agccagaagaaggcuggaga

SEQ ID NO: 1122353 - RNA, 22 nt, Human
gcugccugccuaguuccacagu

SEQ ID NO: 1122354 - RNA, 22 nt, Human
ugaggcagcuuuuucugugugu

SEQ ID NO: 1122355 - RNA, 22 nt, Human
ccagagucuaugaguccucauu

SEQ ID NO: 1122356 - RNA, 22 nt, Human
uaccuuggguugaguucauucu

SEQ ID NO: 1122357 - RNA, 22 nt, Human
cugcccugaccugccucagagu

SEQ ID NO: 1122358 - RNA, 22 nt, Human
aggagccccucuucaguccugg

SEQ ID NO: 1122359 - RNA, 22 nt, Human
uauguguggagccagccuggag

SEQ ID NO: 1122360 - RNA, 22 nt, Human
gccucugggcucugccccuggc

SEQ ID NO: 1122361 - RNA, 22 nt, Human
uugcuuccucgaggccagcgug

SEQ ID NO: 1122362 - RNA, 21 nt, Human
cugccuugaaugguacuggga

SEQ ID NO: 1122363 - RNA, 22 nt, Human
acccacgaagaugagcggcaug

SEQ ID NO: 1122364 - RNA, 22 nt, Human
agugcugaagacuggcuaggga

SEQ ID NO: 1122365 - RNA, 22 nt, Human
ccagagcccgggaccuggacuu

SEQ ID NO: 1122366 - RNA, 22 nt, Human
aggaggugacagccugcaucug

SEQ ID NO: 1122367 - RNA, 22 nt, Human
uauauuaacacccacuugccuc

SEQ ID NO: 1122368 - RNA, 22 nt, Human
aucuggcucucucauuuacaaa

SEQ ID NO: 1122369 - RNA, 22 nt, Human
ugaagcaguucucagaaguggg

SEQ ID NO: 1122370 - RNA, 22 nt, Human
cagcagggcccccgggugcgcc

SEQ ID NO: 1122371 - RNA, 22 nt, Human
uguuccaucaguuuuugguuga

SEQ ID NO: 1122372 - RNA, 22 nt, Human
gcacuaaaccaacauguaauaa

SEQ ID NO: 1122373 - RNA, 22 nt, Human
gccacccccaaguagguggucu

SEQ ID NO: 1122374 - RNA, 22 nt, Human
acagcugggugcugcucagagc

SEQ ID NO: 1122375 - RNA, 22 nt, Human
aagccaagaguuaacuauuugu

SEQ ID NO: 1122376 - RNA, 22 nt, Human
acagaggucauggagaguucuc

SEQ ID NO: 1122377 - RNA, 22 nt, Human
uggcucagucuggguugacuga

SEQ ID NO: 1122378 - RNA, 22 nt, Human
acaggcagggaccuuggcuaag

SEQ ID NO: 1122379 - RNA, 22 nt, Human
uguuuuaaucucccauugcucu

SEQ ID NO: 1122380 - RNA, 22 nt, Human
cagagcugggaucccaugggcg

SEQ ID NO: 1122381 - RNA, 22 nt, Human
aaguccauaguuugcauuaggg

SEQ ID NO: 1122382 - RNA, 19 nt, Human
gcacacccugcaccaccau

SEQ ID NO: 1122383 - RNA, 22 nt, Human
aaaguucaugguguuauagaaa

SEQ ID NO: 1122384 - RNA, 22 nt, Human
gcuggccagggcugcucgcgga

SEQ ID NO: 1122385 - RNA, 22 nt, Human
ugcauuguugaauauuucauag

SEQ ID NO: 1122386 - RNA, 23 nt, Human
agagcuuucuaaaauguaaaucu

SEQ ID NO: 1122387 - RNA, 22 nt, Human
caggauccuggcugcauggacg

SEQ ID NO: 1122388 - RNA, 22 nt, Human
ucucagagcaucauuuucuuag

SEQ ID NO: 1122389 - RNA, 22 nt, Human
uugcagggaccugcagaaagcu

SEQ ID NO: 1122390 - RNA, 22 nt, Human
cugacucuccucaagcauaaau

SEQ ID NO: 1122391 - RNA, 20 nt, Human
cagccuccacucacucagcu

SEQ ID NO: 1122392 - RNA, 22 nt, Human
uccucucagugugguuguggga

SEQ ID NO: 1122393 - RNA, 22 nt, Human
cuagaaauacaggcacgugcca

SEQ ID NO: 1122394 - RNA, 22 nt, Human
ucaguuuugauuccugguucuc

SEQ ID NO: 1122395 - RNA, 22 nt, Human
aaaaugcaugagaaugugcucg

SEQ ID NO: 1122396 - RNA, 22 nt, Human
cuucagggugacgcaggcugca

SEQ ID NO: 1122397 - RNA, 22 nt, Human
uccucagacuucccuuugugua

SEQ ID NO: 1122398 - RNA, 22 nt, Human
gagcugccuacauugccaagag

SEQ ID NO: 1122399 - RNA, 22 nt, Human
gagggcugauaacaggaauaca

SEQ ID NO: 1122400 - RNA, 22 nt, Human
ccuuucucauuuuaagcauuag

SEQ ID NO: 1122401 - RNA, 22 nt, Human
ugaaggaagaauaggcaguguu

SEQ ID NO: 1122402 - RNA, 22 nt, Human
gagguuagaggucagugcaguc

SEQ ID NO: 1122403 - RNA, 22 nt, Human
aaugaacaggugaaugucagau

SEQ ID NO: 1122404 - RNA, 20 nt, Human
guucucacugaucugcaggg

SEQ ID NO: 1122405 - RNA, 22 nt, Human
cugcucugacccuuucaccuuc

SEQ ID NO: 1122406 - RNA, 22 nt, Human
cuggguggcgucuggggccagu

SEQ ID NO: 1122407 - RNA, 22 nt, Human
uuucucuaaauagggaggcuua

SEQ ID NO: 1122408 - RNA, 19 nt, Human
cagcugcaccgugaccauc

SEQ ID NO: 1122409 - RNA, 22 nt, Human
caugggagcuaucuccaucacu

SEQ ID NO: 1122410 - RNA, 22 nt, Human
acagagguaggacaugagauau

SEQ ID NO: 1122411 - RNA, 22 nt, Human
aggcacugaagugguaaaugua

SEQ ID NO: 1122412 - RNA, 22 nt, Human
uucauucaucucuaaaaugccu

SEQ ID NO: 1122413 - RNA, 22 nt, Human
aagacuuucucccaaauccuca

SEQ ID NO: 1122414 - RNA, 22 nt, Human
ugggcucugcugcguaccaguu

SEQ ID NO: 1122415 - RNA, 18 nt, Human
cuucagugacagucuggc

SEQ ID NO: 1122416 - RNA, 22 nt, Human
ugccucugugggccuuccuggc

SEQ ID NO: 1122417 - RNA, 22 nt, Human
agccccaguccgcugcgggcgg

SEQ ID NO: 1122418 - RNA, 22 nt, Human
cagcaggcccagaguuucaugg

SEQ ID NO: 1122419 - RNA, 23 nt, Human
cauuucugggagauuuauaaaau

SEQ ID NO: 1122420 - RNA, 22 nt, Human
augcacaagaggcuagaaaaga

SEQ ID NO: 1122421 - RNA, 22 nt, Human
ucauaacagcuaagucccuuuc

SEQ ID NO: 1122422 - RNA, 22 nt, Human
gccagggcaggggagcaucugc

SEQ ID NO: 1122423 - RNA, 20 nt, Human
ggcacuggaagcacacagga

SEQ ID NO: 1122424 - RNA, 22 nt, Human
uggcagcacuagguacugagcu

SEQ ID NO: 1122425 - RNA, 22 nt, Human
ugcaccccauuuuacauuuaca

SEQ ID NO: 1122426 - RNA, 22 nt, Human
cagucccagcugcucagaaggc

SEQ ID NO: 1122427 - RNA, 22 nt, Human
agggaaggaaaagcugucgcuu

SEQ ID NO: 1122428 - RNA, 22 nt, Human
ucagggcauguauguuucuuua

SEQ ID NO: 1122429 - RNA, 19 nt, Human
agcuccugggcucugggcc

SEQ ID NO: 1122430 - RNA, 22 nt, Human
cucuggagugcagccugguggc

SEQ ID NO: 1122431 - RNA, 22 nt, Human
guccaugguugcuuucauguaa

SEQ ID NO: 1122432 - RNA, 22 nt, Human
ggugaaggaggaagcugaugga

SEQ ID NO: 1122433 - RNA, 22 nt, Human
cugaagccaugugcucacuggu

SEQ ID NO: 1122434 - RNA, 22 nt, Human
aaaugugugcacaaagacagcu

SEQ ID NO: 1122435 - RNA, 22 nt, Human
gccuggccugaacuaggaggug

SEQ ID NO: 1122436 - RNA, 22 nt, Human
aagcugccuuccaugugaggaa

SEQ ID NO: 1122437 - RNA, 22 nt, Human
agaggcaguauacaauccgagc

SEQ ID NO: 1122438 - RNA, 22 nt, Human
ugcaauaacccaguaucuguga

SEQ ID NO: 1122439 - RNA, 22 nt, Human
augggaggaaggaggcccuuga

SEQ ID NO: 1122440 - RNA, 22 nt, Human
aggucacacuuggaucauagaa

SEQ ID NO: 1122441 - RNA, 22 nt, Human
cauugcccaguaggaucaccag

SEQ ID NO: 1122442 - RNA, 22 nt, Human
aaaugcacaggagaaccaauuc

SEQ ID NO: 1122443 - RNA, 22 nt, Human
ucuggcucaggucagacaggga

SEQ ID NO: 1122444 - RNA, 22 nt, Human
auaucuuuuagagcaagcuugu

SEQ ID NO: 1122445 - RNA, 22 nt, Human
cagggcugaaaucaagguguag

SEQ ID NO: 1122446 - RNA, 22 nt, Human
gguaacaguauguagaguaaga

SEQ ID NO: 1122447 - RNA, 22 nt, Human
augucuuucucacagccaguuc

SEQ ID NO: 1122448 - RNA, 22 nt, Human
cuggugggaggcaagguggaag

SEQ ID NO: 1122449 - RNA, 22 nt, Human
cucucccagucaggcucaggau

SEQ ID NO: 1122450 - RNA, 20 nt, Human
auguuuuauaaaagaacggg

SEQ ID NO: 1122451 - RNA, 22 nt, Human
uugaaaggguuaaagugguaaa

SEQ ID NO: 1122452 - RNA, 22 nt, Human
ugugggcaggcccgggucugag

SEQ ID NO: 1122453 - RNA, 22 nt, Human
ugcugccaugcagagcaacaga

SEQ ID NO: 1122454 - RNA, 22 nt, Human
agccuggaggccaggagacagu

SEQ ID NO: 1122455 - RNA, 22 nt, Human
accaaugugaugauauuaggag

SEQ ID NO: 1122456 - RNA, 22 nt, Human
uguuuuaagggucaacugucac

SEQ ID NO: 1122457 - RNA, 22 nt, Human
ucugggugcccuuugcucuguu

SEQ ID NO: 1122458 - RNA, 22 nt, Human
ggcucugcugguaagaugccuc

SEQ ID NO: 1122459 - RNA, 22 nt, Human
ccagggcaauaggaacacuuuu

SEQ ID NO: 1122460 - RNA, 22 nt, Human
ucagaaaugaucguuauucauu

SEQ ID NO: 1122461 - RNA, 22 nt, Human
gcauuccugagaaugcagagug

SEQ ID NO: 1122462 - RNA, 22 nt, Human
ugagccuguccugugcauguga

SEQ ID NO: 1122463 - RNA, 22 nt, Human
ccugggagguggagguugcagc

SEQ ID NO: 1122464 - RNA, 22 nt, Human
acaagagauuaucuacagauga

SEQ ID NO: 1122465 - RNA, 22 nt, Human
ggagcagagcauuucacagccu

SEQ ID NO: 1122466 - RNA, 22 nt, Human
auuuugaaaagcauuugaguaa

SEQ ID NO: 1122467 - RNA, 22 nt, Human
ugucaugccauuuaaaauguuu

SEQ ID NO: 1122468 - RNA, 22 nt, Human
gcagagcuaucuucuggauuug

SEQ ID NO: 1122469 - RNA, 22 nt, Human
aaaaaugucauuauggaacuga

SEQ ID NO: 1122470 - RNA, 22 nt, Human
gcugccuguugaagggucugug

SEQ ID NO: 1122471 - RNA, 22 nt, Human
gagaaagcuucuuucccacagg

SEQ ID NO: 1122472 - RNA, 22 nt, Human
guggcugcagagccagcaagcu

SEQ ID NO: 1122473 - RNA, 22 nt, Human
cucaggaugaaagucaugguga

SEQ ID NO: 1122474 - RNA, 19 nt, Human
ccagagcccgccagauggg

SEQ ID NO: 1122475 - RNA, 22 nt, Human
guguacauagaauugugcuuug

SEQ ID NO: 1122476 - RNA, 22 nt, Human
ggucucagaucuuuauuaaggc

SEQ ID NO: 1122477 - RNA, 22 nt, Human
gugccagggggcacugaacaga

SEQ ID NO: 1122478 - RNA, 22 nt, Human
gcaguccucucauuggccuccu

SEQ ID NO: 1122479 - RNA, 22 nt, Human
caugaagcuugaagcaguccac

SEQ ID NO: 1122480 - RNA, 22 nt, Human
aaagauuucacaucccaagccu

SEQ ID NO: 1122481 - RNA, 20 nt, Human
agugugcauuuagagucugc

SEQ ID NO: 1122482 - RNA, 22 nt, Human
gcaucuuucuguccauucagca

SEQ ID NO: 1122483 - RNA, 22 nt, Human
ggagggcucaauugacuccuga

SEQ ID NO: 1122484 - RNA, 22 nt, Human
gccaggcuggcaaaaggaaacc

SEQ ID NO: 1122485 - RNA, 22 nt, Human
gaggcuggugguuaguuccauu

SEQ ID NO: 1122486 - RNA, 19 nt, Human
uggcuucuguuuucauguu

SEQ ID NO: 1122487 - RNA, 22 nt, Human
gcagggugauagugaggcucag

SEQ ID NO: 1122488 - RNA, 22 nt, Human
ccagcucuuggugcacuuacau

SEQ ID NO: 1122489 - RNA, 22 nt, Human
gagagugagauaauuucacaua

SEQ ID NO: 1122490 - RNA, 22 nt, Human
cugggcuucucccccuggcaga

SEQ ID NO: 1122491 - RNA, 22 nt, Human
ccugggagugucagacuugcuu

SEQ ID NO: 1122492 - RNA, 22 nt, Human
ggguccagacacuccagaggaa

SEQ ID NO: 1122493 - RNA, 22 nt, Human
cacaagagagugcgcguugcaa

SEQ ID NO: 1122494 - RNA, 22 nt, Human
uuagaaauacaagugagguuga

SEQ ID NO: 1122495 - RNA, 22 nt, Human
gugggaugcaguggugaguggc

SEQ ID NO: 1122496 - RNA, 22 nt, Human
aaggccauuauucugauauauu

SEQ ID NO: 1122497 - RNA, 22 nt, Human
ucauuuccucaaauucaagguu

SEQ ID NO: 1122498 - RNA, 17 nt, Human
gcagcagagagacccuc

SEQ ID NO: 1122499 - RNA, 22 nt, Human
gccuucugaucgcuggacugac

SEQ ID NO: 1122500 - RNA, 22 nt, Human
aggcugcuggcaggcguggacg

SEQ ID NO: 1122501 - RNA, 22 nt, Human
ccaaggagcugcaggcacuugu

SEQ ID NO: 1122502 - RNA, 22 nt, Human
acuguguggaaauuugugaggg

SEQ ID NO: 1122503 - RNA, 22 nt, Human
uuucuguauuuaaaagaucugg

SEQ ID NO: 1122504 - RNA, 22 nt, Human
acaaaaguguaggaauuccuua

SEQ ID NO: 1122505 - RNA, 22 nt, Human
ggagccugugcccaagcccaga

SEQ ID NO: 1122506 - RNA, 22 nt, Human
cauggccuugagugacugcacu

SEQ ID NO: 1122507 - RNA, 22 nt, Human
ucugaggccccugggcaggaug

SEQ ID NO: 1122508 - RNA, 22 nt, Human
ugcaggugcguuuucaagccuc

SEQ ID NO: 1122509 - RNA, 22 nt, Human
cagcugccaagaaucuuuucua

SEQ ID NO: 1122510 - RNA, 22 nt, Human
gcucccaccaggcagaccuacc

SEQ ID NO: 1122511 - RNA, 22 nt, Human
ccugccagggccuuggaagaaa

SEQ ID NO: 1122512 - RNA, 20 nt, Human
cagucccaauccagggccag

SEQ ID NO: 1122513 - RNA, 22 nt, Human
agcagcugagaugguaagauuc

SEQ ID NO: 1122514 - RNA, 22 nt, Human
uaaagguagcaugaaacugcaa

SEQ ID NO: 1122515 - RNA, 22 nt, Human
ucaguuuuucuauacuuuguag

SEQ ID NO: 1122516 - RNA, 22 nt, Human
aggcacugcagauuacaggcgc

SEQ ID NO: 1122517 - RNA, 22 nt, Human
acaccagggccuagccagggcg

SEQ ID NO: 1122518 - RNA, 22 nt, Human
cuggcagcgguuugcagccugg

SEQ ID NO: 1122519 - RNA, 17 nt, Human
uagcugccccgaaugcu

SEQ ID NO: 1122520 - RNA, 22 nt, Human
uuuuuccuaagcaguggagcug

SEQ ID NO: 1122521 - RNA, 22 nt, Human
aaaugcagauugucauucagga

SEQ ID NO: 1122522 - RNA, 22 nt, Human
ggauccuucuuugaccucacag

SEQ ID NO: 1122523 - RNA, 22 nt, Human
aucuucaaagcacaucguuugu

SEQ ID NO: 1122524 - RNA, 22 nt, Human
uauugaaaugaaugacagugau

SEQ ID NO: 1122525 - RNA, 22 nt, Human
uagggcagccacccaggcugcu

SEQ ID NO: 1122526 - RNA, 22 nt, Human
agaaugcuccagagcugaaaga

SEQ ID NO: 1122527 - RNA, 22 nt, Human
ggccugcuauuggugggcagac

SEQ ID NO: 1122528 - RNA, 22 nt, Human
ucccaggguccucuucuggaau

SEQ ID NO: 1122529 - RNA, 22 nt, Human
aggcacugacagauucuguguc

SEQ ID NO: 1122530 - RNA, 22 nt, Human
ggagcugggguuggcaucuucc

SEQ ID NO: 1122531 - RNA, 22 nt, Human
acauuucugcauguaggguaau

SEQ ID NO: 1122532 - RNA, 22 nt, Human
uuaucauugucgcagucuaauu

SEQ ID NO: 1122533 - RNA, 22 nt, Human
gugcagggagcccagaaggucc

SEQ ID NO: 1122534 - RNA, 22 nt, Human
gcagagcuucuguccuucagga

SEQ ID NO: 1122535 - RNA, 22 nt, Human
acccaggccugagagacaggag

SEQ ID NO: 1122536 - RNA, 22 nt, Human
uuaggcaauuugauuuuucaag

SEQ ID NO: 1122537 - RNA, 22 nt, Human
gcucuggagauggagccuugag

SEQ ID NO: 1122538 - RNA, 23 nt, Human
ggagugcaauggcgccaucucgg

SEQ ID NO: 1122539 - RNA, 22 nt, Human
ugcagcagcagggaggaggcuc

SEQ ID NO: 1122540 - RNA, 22 nt, Human
ccugagagcauuccacacugaa

SEQ ID NO: 1122541 - RNA, 22 nt, Human
acauacuuuuuaaaagauugcu

SEQ ID NO: 1122542 - RNA, 22 nt, Human
agagccagguguagucucggag

SEQ ID NO: 1122543 - RNA, 22 nt, Human
gagacacacacaggagguggca

SEQ ID NO: 1122544 - RNA, 22 nt, Human
uccuugaaugaauguucucucc

SEQ ID NO: 1122545 - RNA, 22 nt, Human
aaaguuugcaauuuauguuaau

SEQ ID NO: 1122546 - RNA, 22 nt, Human
ggaggccaucagggagggcauu

SEQ ID NO: 1122547 - RNA, 22 nt, Human
uuggcuucuggcagucuggacg

SEQ ID NO: 1122548 - RNA, 22 nt, Human
agugaaaugauaguguaaauac

SEQ ID NO: 1122549 - RNA, 22 nt, Human
ugugaagcuggauccuggagcu

SEQ ID NO: 1122550 - RNA, 22 nt, Human
cugaaggacuuggugauaguug

SEQ ID NO: 1122551 - RNA, 22 nt, Human
agagugaaguaauuguuaggau

SEQ ID NO: 1122552 - RNA, 22 nt, Human
caccugagugucaguauucuca

SEQ ID NO: 1122553 - RNA, 22 nt, Human
aaauguguuucuuugugaaugg

SEQ ID NO: 1122554 - RNA, 23 nt, Human
aggagccaggugcagcccuugug

SEQ ID NO: 1122555 - RNA, 22 nt, Human
aaagaauuuguacacccuacua

SEQ ID NO: 1122556 - RNA, 15 nt, Human
ugauuuccuacuaac

SEQ ID NO: 1122557 - RNA, 22 nt, Human
gccuggagcuacuggacacuga

SEQ ID NO: 1122558 - RNA, 22 nt, Human
auaagguaugaaaaguaaaugg

SEQ ID NO: 1122559 - RNA, 22 nt, Human
aggguauaaagagcaagcagaa

SEQ ID NO: 1122560 - RNA, 22 nt, Human
guggccugccagcagauggcgc

SEQ ID NO: 1122561 - RNA, 22 nt, Human
ccacagggcacagacaggaagc

SEQ ID NO: 1122562 - RNA, 22 nt, Human
ccaggcaucacgggcauguggc

SEQ ID NO: 1122563 - RNA, 22 nt, Human
ccugggaggcggagguugcagu

SEQ ID NO: 1122564 - RNA, 22 nt, Human
auguguagaacuguaaugccca

SEQ ID NO: 1122565 - RNA, 22 nt, Human
ccugcagaccacacucaguccu

SEQ ID NO: 1122566 - RNA, 22 nt, Human
ccagcucccugaagccuggucu

SEQ ID NO: 1122567 - RNA, 18 nt, Human
uguacaguuaugagcauu

SEQ ID NO: 1122568 - RNA, 22 nt, Human
aaguuugagaagcuuauagaua

SEQ ID NO: 1122569 - RNA, 22 nt, Human
ucuggcucugaauucacuucug

SEQ ID NO: 1122570 - RNA, 22 nt, Human
agagcugggacuuggacucaau

SEQ ID NO: 1122571 - RNA, 22 nt, Human
gccaugccugugucuccaggcc

SEQ ID NO: 1122572 - RNA, 22 nt, Human
gaggaaaauggaguguaauuaa

SEQ ID NO: 1122573 - RNA, 22 nt, Human
aguuauauaacuaucuagaugc

SEQ ID NO: 1122574 - RNA, 22 nt, Human
cugcagcuguagaggacagugg

SEQ ID NO: 1122575 - RNA, 22 nt, Human
ggcagagacuggguuggcagag

SEQ ID NO: 1122576 - RNA, 22 nt, Human
aggauccuuuuucugcuguuug

SEQ ID NO: 1122577 - RNA, 22 nt, Human
ggccgggcaggucucagccagc

SEQ ID NO: 1122578 - RNA, 22 nt, Human
agccaugcaccuuacucuugcu

SEQ ID NO: 1122579 - RNA, 20 nt, Human
cucucucuccauucccaggg

SEQ ID NO: 1122580 - RNA, 22 nt, Human
uggaaggagcuaaggaccuggg

SEQ ID NO: 1122581 - RNA, 22 nt, Human
aggucacauggauaaugaucag

SEQ ID NO: 1122582 - RNA, 22 nt, Human
cagggcugcuggccgugcccuc

SEQ ID NO: 1122583 - RNA, 22 nt, Human
ucuguucuauuggucuaugugu

SEQ ID NO: 1122584 - RNA, 22 nt, Human
agcagcucuguuuaccuggagg

SEQ ID NO: 1122585 - RNA, 22 nt, Human
cagaggcugcucuggguggcau

SEQ ID NO: 1122586 - RNA, 22 nt, Human
aggggccugguuggccucuguu

SEQ ID NO: 1122587 - RNA, 19 nt, Human
uaauccaaggcugcucuua

SEQ ID NO: 1122588 - RNA, 22 nt, Human
ugccugggccuucccaccucug

SEQ ID NO: 1122589 - RNA, 22 nt, Human
aauuucaauuacuuuugcacca

SEQ ID NO: 1122590 - RNA, 22 nt, Human
auucaguuaaaaacuguacuuc

SEQ ID NO: 1122591 - RNA, 22 nt, Human
agggccuggaacuggagaccac

SEQ ID NO: 1122592 - RNA, 22 nt, Human
cacacauugaauucauucuugu

SEQ ID NO: 1122593 - RNA, 22 nt, Human
uggcagcuccggguaggggcug

SEQ ID NO: 1122594 - RNA, 22 nt, Human
ugggacugcucuugcugggguc

SEQ ID NO: 1122595 - RNA, 22 nt, Human
agcugcucaggagagccagguc

SEQ ID NO: 1122596 - RNA, 22 nt, Human
caagaugaucccugaaggcagc

SEQ ID NO: 1122597 - RNA, 22 nt, Human
ggccacuccgcugcuacuggaa

SEQ ID NO: 1122598 - RNA, 22 nt, Human
agucugcacucagguggagguc

SEQ ID NO: 1122599 - RNA, 22 nt, Human
aaguguuaaaagauuaaaugcu

SEQ ID NO: 1122600 - RNA, 22 nt, Human
aggcaagggggcgccaccuucc

SEQ ID NO: 1122601 - RNA, 22 nt, Human
gugcuucucuucacacccaacu

SEQ ID NO: 1122602 - RNA, 22 nt, Human
ccugccugaaggucagccaccc

SEQ ID NO: 1122603 - RNA, 22 nt, Human
cuggaagguuccucccagcucc

SEQ ID NO: 1122604 - RNA, 22 nt, Human
gcccagcuuuuugaggcaggca

SEQ ID NO: 1122605 - RNA, 22 nt, Human
cacucugagaaguacaagcucc

SEQ ID NO: 1122606 - RNA, 22 nt, Human
uggaggaugagugugggcucug

SEQ ID NO: 1122607 - RNA, 22 nt, Human
gagccugggacugggggucaug

SEQ ID NO: 1122608 - RNA, 22 nt, Human
ugagccugguugcagugucugg

SEQ ID NO: 1122609 - RNA, 22 nt, Human
gggugggguguaucggauccua

SEQ ID NO: 1122610 - RNA, 22 nt, Human
ugccuguccugaggaugagggu

SEQ ID NO: 1122611 - RNA, 22 nt, Human
gaagccaagugcaaaugccuua

SEQ ID NO: 1122612 - RNA, 22 nt, Human
ucucuggaauuuugagagugac

SEQ ID NO: 1122613 - RNA, 22 nt, Human
agcugagcuaguaguuccagug

SEQ ID NO: 1122614 - RNA, 22 nt, Human
aacagacaacuccuguggcuca

SEQ ID NO: 1122615 - RNA, 22 nt, Human
ccagagugacgugaagugugaa

SEQ ID NO: 1122616 - RNA, 22 nt, Human
guuauguaugggggccuuauga

SEQ ID NO: 1122617 - RNA, 22 nt, Human
ucccuggguccugcuugcucuc

SEQ ID NO: 1122618 - RNA, 22 nt, Human
uggggugccgacagggagggca

SEQ ID NO: 1122619 - RNA, 22 nt, Human
uccuggaguugugcagugcaca

SEQ ID NO: 1122620 - RNA, 22 nt, Human
ggcucacgcaauuaucccggcc

SEQ ID NO: 1122621 - RNA, 22 nt, Human
aggccugcagcaggagcaaacc

SEQ ID NO: 1122622 - RNA, 22 nt, Human
cagcuggccugaucccuguggc

SEQ ID NO: 1122623 - RNA, 20 nt, Human
cacaggcuauaugagagcca

SEQ ID NO: 1122624 - RNA, 22 nt, Human
gcagggugccgacuucagggau

SEQ ID NO: 1122625 - RNA, 22 nt, Human
caggcugaucagggcugggaug

SEQ ID NO: 1122626 - RNA, 22 nt, Human
cauugcacugcagcccgggcaa

SEQ ID NO: 1122627 - RNA, 22 nt, Human
aguuuuaugcaguguucugaua

SEQ ID NO: 1122628 - RNA, 22 nt, Human
ucagccucucugaguccagacc

SEQ ID NO: 1122629 - RNA, 22 nt, Human
ugcuuaauauugugauguaaua

SEQ ID NO: 1122630 - RNA, 22 nt, Human
auacaagacucagcacagacgg

SEQ ID NO: 1122631 - RNA, 22 nt, Human
ggcacugacacuagcauggcac

SEQ ID NO: 1122632 - RNA, 22 nt, Human
ucacaacuugaagcugauuuaa

SEQ ID NO: 1122633 - RNA, 22 nt, Human
uguuuaagcugaugagguaucg

SEQ ID NO: 1122634 - RNA, 22 nt, Human
guccuggcuuaguucgcuguaa

SEQ ID NO: 1122635 - RNA, 22 nt, Human
auauguguauuugguuagccua

SEQ ID NO: 1122636 - RNA, 22 nt, Human
aaggcugccucugccagaggag

SEQ ID NO: 1122637 - RNA, 22 nt, Human
augacacaauuuuagagcugaa

SEQ ID NO: 1122638 - RNA, 22 nt, Human
agaggaugguugaggaagaccu

SEQ ID NO: 1122639 - RNA, 22 nt, Human
cuuuuuccagcuucaggguggg

SEQ ID NO: 1122640 - RNA, 19 nt, Human
auaaggcaauuggauuugg

SEQ ID NO: 1122641 - RNA, 22 nt, Human
cagcaauaaugucuacaaaucu

SEQ ID NO: 1122642 - RNA, 22 nt, Human
aggagcuguuuuguucagcaaa

SEQ ID NO: 1122643 - RNA, 22 nt, Human
cuucagaggggacucaaaguca

SEQ ID NO: 1122644 - RNA, 22 nt, Human
ucaaauaugugauagaagcuaa

SEQ ID NO: 1122645 - RNA, 22 nt, Human
cacugaaggaaggacuacugca

SEQ ID NO: 1122646 - RNA, 22 nt, Human
cacaggaggaggugcccgggcc

SEQ ID NO: 1122647 - RNA, 22 nt, Human
ccagcagcccacaggcgucccu

SEQ ID NO: 1122648 - RNA, 22 nt, Human
gccuggagaccugcuccucuac

SEQ ID NO: 1122649 - RNA, 22 nt, Human
gcugccucaggcaccuccuggc

SEQ ID NO: 1122650 - RNA, 22 nt, Human
gggccaggucggugaaugguca

SEQ ID NO: 1122651 - RNA, 22 nt, Human
cugcuuuggcucagugacauca

SEQ ID NO: 1122652 - RNA, 22 nt, Human
uuuccuaugauauucuaugugu

SEQ ID NO: 1122653 - RNA, 22 nt, Human
cagcugagaccagaaugcaggu

SEQ ID NO: 1122654 - RNA, 22 nt, Human
ggcagcucugaugaugcucugg

SEQ ID NO: 1122655 - RNA, 22 nt, Human
uuuaccaagcuuuaauuacaua

SEQ ID NO: 1122656 - RNA, 22 nt, Human
guccucuggugaaagcauuccc

SEQ ID NO: 1122657 - RNA, 22 nt, Human
agggggcaucagguccuggcuc

SEQ ID NO: 1122658 - RNA, 22 nt, Human
uaggccaggacagagcuuccag

SEQ ID NO: 1122659 - RNA, 22 nt, Human
cuggagccuagguugaccuggg

SEQ ID NO: 1122660 - RNA, 22 nt, Human
agcccagguugaggcugcagug

SEQ ID NO: 1122661 - RNA, 22 nt, Human
agaacuguccuuggaggagagu

SEQ ID NO: 1122662 - RNA, 22 nt, Human
uggcccgaccucugcucaugca

SEQ ID NO: 1122663 - RNA, 22 nt, Human
gaaaggucaguuccacuuccau

SEQ ID NO: 1122664 - RNA, 22 nt, Human
gcccagcugcacccuggugggu

SEQ ID NO: 1122665 - RNA, 22 nt, Human
ugcaggugguuuggacacugcu

SEQ ID NO: 1122666 - RNA, 22 nt, Human
ggaaccaggaguuacacgaguu

SEQ ID NO: 1122667 - RNA, 22 nt, Human
uagugaaacaguuaucaaucug

SEQ ID NO: 1122668 - RNA, 22 nt, Human
uagauuucucauucauagauug

SEQ ID NO: 1122669 - RNA, 22 nt, Human
aaggcacugaacuuaaauucug

SEQ ID NO: 1122670 - RNA, 22 nt, Human
ucacaggacccugaggguggcg

SEQ ID NO: 1122671 - RNA, 22 nt, Human
ucagcaaugagaacuggcauuu

SEQ ID NO: 1122672 - RNA, 22 nt, Human
auauuucuugagcaccugguau

SEQ ID NO: 1122673 - RNA, 22 nt, Human
agucagugaaaacuagaauguu

SEQ ID NO: 1122674 - RNA, 22 nt, Human
uccucagaugcucuuggacgcc

SEQ ID NO: 1122675 - RNA, 22 nt, Human
cuggacagaaagggcugcugug

SEQ ID NO: 1122676 - RNA, 22 nt, Human
cacaggguuguucugaggauuc

SEQ ID NO: 1122677 - RNA, 22 nt, Human
gauuuccuaauguggaucucug

SEQ ID NO: 1122678 - RNA, 22 nt, Human
ugggcccugacuucaagcaucc

SEQ ID NO: 1122679 - RNA, 22 nt, Human
gugcaugugcauccauguguac

SEQ ID NO: 1122680 - RNA, 22 nt, Human
cacagaaaaaggcuugaaaauc

SEQ ID NO: 1122681 - RNA, 22 nt, Human
aauucuagcauugugaaaauau

SEQ ID NO: 1122682 - RNA, 22 nt, Human
gaggaugugucuggucugggca

SEQ ID NO: 1122683 - RNA, 22 nt, Human
gacagcagggacauguaggaag

SEQ ID NO: 1122684 - RNA, 22 nt, Human
ccaggaagccucagaugcugag

SEQ ID NO: 1122685 - RNA, 22 nt, Human
acaggcucucagccaguuggca

SEQ ID NO: 1122686 - RNA, 22 nt, Human
ugagccuggagucguggagggg

SEQ ID NO: 1122687 - RNA, 19 nt, Human
gcuggcagauguggccgug

SEQ ID NO: 1122688 - RNA, 22 nt, Human
uuuauguaaguggaaugaugcc

SEQ ID NO: 1122689 - RNA, 22 nt, Human
ccuggcucucugcagauccugg

SEQ ID NO: 1122690 - RNA, 22 nt, Human
agauacaucuugaacuucuaga

SEQ ID NO: 1122691 - RNA, 22 nt, Human
gggguggauuccuacaggucca

SEQ ID NO: 1122692 - RNA, 22 nt, Human
uguauuuucugaagauaaucaa

SEQ ID NO: 1122693 - RNA, 22 nt, Human
uugcucugacuggagugcagug

SEQ ID NO: 1122694 - RNA, 22 nt, Human
aaucaguucuacaucuuaucca

SEQ ID NO: 1122695 - RNA, 22 nt, Human
gcuguccucuuggacucagggc

SEQ ID NO: 1122696 - RNA, 22 nt, Human
agggaaaggcugaugcuguggg

SEQ ID NO: 1122697 - RNA, 22 nt, Human
agguggggccaaaugcuacagu

SEQ ID NO: 1122698 - RNA, 22 nt, Human
gagacagaguuucacucuuguu

SEQ ID NO: 1122699 - RNA, 22 nt, Human
gccuggaguuguggugaagcca

SEQ ID NO: 1122700 - RNA, 22 nt, Human
aaaguguaaggaauuuaaguaa

SEQ ID NO: 1122701 - RNA, 22 nt, Human
uaggcagggauuaggguugauu

SEQ ID NO: 1122702 - RNA, 22 nt, Human
aaggucauuguugcauguucuc

SEQ ID NO: 1122703 - RNA, 22 nt, Human
gucaggauuuuaaaaucccagu

SEQ ID NO: 1122704 - RNA, 22 nt, Human
aaaucaguuggaacacaagcag

SEQ ID NO: 1122705 - RNA, 17 nt, Human
gcagugaaaagagauca

SEQ ID NO: 1122706 - RNA, 22 nt, Human
ucccaagugucuuggaccaggg

SEQ ID NO: 1122707 - RNA, 22 nt, Human
uugcauugaucccagcuugggc

SEQ ID NO: 1122708 - RNA, 22 nt, Human
augugugugaugggcgccgcca

SEQ ID NO: 1122709 - RNA, 22 nt, Human
ugccucugguuaucugguaccu

SEQ ID NO: 1122710 - RNA, 22 nt, Human
ucucaggcuaccuugcacaagg

SEQ ID NO: 1122711 - RNA, 22 nt, Human
ggccuggaagaggacagagaaa

SEQ ID NO: 1122712 - RNA, 22 nt, Human
caggaggcccaaagggcgcaga

SEQ ID NO: 1122713 - RNA, 22 nt, Human
uuucaaagguggaagagugaau

SEQ ID NO: 1122714 - RNA, 22 nt, Human
ucacagugaugacgugggagca

SEQ ID NO: 1122715 - RNA, 22 nt, Human
uuccauuguuucugucuucacu

SEQ ID NO: 1122716 - RNA, 22 nt, Human
ugcagccaggaaauauuugcug

SEQ ID NO: 1122717 - RNA, 22 nt, Human
guguuuccaguucagaaagcaa

SEQ ID NO: 1122718 - RNA, 22 nt, Human
uaacagaagaugaaacuucuuu

SEQ ID NO: 1122719 - RNA, 22 nt, Human
aaaaacugcaauuacuuuuguc

SEQ ID NO: 1122720 - RNA, 18 nt, Human
aaaaugcaggcgacaugg

SEQ ID NO: 1122721 - RNA, 22 nt, Human
uaugcacacauuagcacagggu

SEQ ID NO: 1122722 - RNA, 19 nt, Human
ggcucucccuugagagagc

SEQ ID NO: 1122723 - RNA, 20 nt, Human
agcccuguuuccuggagaga

SEQ ID NO: 1122724 - RNA, 22 nt, Human
uauucacagcugccgcacucag

SEQ ID NO: 1122725 - RNA, 22 nt, Human
uggcucaguggcagccgcagcu

SEQ ID NO: 1122726 - RNA, 22 nt, Human
cacacaugaaucccuaguaccu

SEQ ID NO: 1122727 - RNA, 22 nt, Human
aggaaaaauaaggcagcagggc

SEQ ID NO: 1122728 - RNA, 22 nt, Human
acucugagcaucccaagucuua

SEQ ID NO: 1122729 - RNA, 22 nt, Human
uaggaaaagucuagauugauga

SEQ ID NO: 1122730 - RNA, 22 nt, Human
ccuggccacucagguguggggc

SEQ ID NO: 1122731 - RNA, 21 nt, Human
uuaagagcuuagcaguaggcc

SEQ ID NO: 1122732 - RNA, 22 nt, Human
gaggccuggaccagccacagag

SEQ ID NO: 1122733 - RNA, 22 nt, Human
ccagccugguucagaauuggcu

SEQ ID NO: 1122734 - RNA, 22 nt, Human
aaggguggauuucugagcucua

SEQ ID NO: 1122735 - RNA, 21 nt, Human
ugcagccauucagcccuaugc

SEQ ID NO: 1122736 - RNA, 22 nt, Human
agcagggggaguuagacuagau

SEQ ID NO: 1122737 - RNA, 22 nt, Human
cccuggaggcggauguugcagu

SEQ ID NO: 1122738 - RNA, 22 nt, Human
ugccucuguugagccuuggcug

SEQ ID NO: 1122739 - RNA, 22 nt, Human
acagcuugcaauggcuuucaac

SEQ ID NO: 1122740 - RNA, 22 nt, Human
ggcucugcgcgguaaagugacu

SEQ ID NO: 1122741 - RNA, 22 nt, Human
aggcagcagggccacuggcuga

SEQ ID NO: 1122742 - RNA, 22 nt, Human
cagggcccaagacacaaugagg

SEQ ID NO: 1122743 - RNA, 22 nt, Human
uugaggagucaggggcacggaa

SEQ ID NO: 1122744 - RNA, 22 nt, Human
ugccuaggaaaccucaugcuuc

SEQ ID NO: 1122745 - RNA, 21 nt, Human
uggcacugcuuagcagguucc

SEQ ID NO: 1122746 - RNA, 22 nt, Human
cuguacaggugaggagggggcu

SEQ ID NO: 1122747 - RNA, 22 nt, Human
aagauuuccauuucuagcucau

SEQ ID NO: 1122748 - RNA, 22 nt, Human
aggaggcuguggagcacuccau

SEQ ID NO: 1122749 - RNA, 22 nt, Human
aaaucaguucacguucugaggu

SEQ ID NO: 1122750 - RNA, 22 nt, Human
uggcuuccacugugugcccccu

SEQ ID NO: 1122751 - RNA, 22 nt, Human
gcucccagcauugcugcugaau

SEQ ID NO: 1122752 - RNA, 22 nt, Human
agggacacacuccaguguuauu

SEQ ID NO: 1122753 - RNA, 18 nt, Human
uaaguaaggucauauggg

SEQ ID NO: 1122754 - RNA, 22 nt, Human
acauugaucagccucccaugca

SEQ ID NO: 1122755 - RNA, 21 nt, Human
ugauuuccagaaaauuggccc

SEQ ID NO: 1122756 - RNA, 22 nt, Human
uggccugguaccacauagauuu

SEQ ID NO: 1122757 - RNA, 20 nt, Human
cugggaggucuuccaaauca

SEQ ID NO: 1122758 - RNA, 22 nt, Human
accugagggcccaaacuuggua

SEQ ID NO: 1122759 - RNA, 16 nt, Human
gagggcagaggcggaa

SEQ ID NO: 1122760 - RNA, 22 nt, Human
cagggcagaacauauagauagu

SEQ ID NO: 1122761 - RNA, 22 nt, Human
uggggacacagagguucguugg

SEQ ID NO: 1122762 - RNA, 22 nt, Human
gcuggggucugugaggagggcu

SEQ ID NO: 1122763 - RNA, 22 nt, Human
uggcagcacaagguggcccaug

SEQ ID NO: 1122764 - RNA, 20 nt, Human
cugcugugugugccucagcc

SEQ ID NO: 1122765 - RNA, 23 nt, Human
gagcugggauacaggcuuacugc

SEQ ID NO: 1122766 - RNA, 22 nt, Human
caaaggcaacauauacuuguuu

SEQ ID NO: 1122767 - RNA, 23 nt, Human
cagagcuggcucagagcugccug

SEQ ID NO: 1122768 - RNA, 22 nt, Human
uuuauuauucucuggagaaugu

SEQ ID NO: 1122769 - RNA, 22 nt, Human
uggagcugaacuuugaggccag

SEQ ID NO: 1122770 - RNA, 22 nt, Human
ugagagugauugguucgaaugu

SEQ ID NO: 1122771 - RNA, 22 nt, Human
gcagcuggagcaucuucucauc

SEQ ID NO: 1122772 - RNA, 22 nt, Human
gccuccccugcaauuguccuug

SEQ ID NO: 1122773 - RNA, 22 nt, Human
uagaacagaguuccagugauca

SEQ ID NO: 1122774 - RNA, 22 nt, Human
gcugagguaggagguugcagug

SEQ ID NO: 1122775 - RNA, 22 nt, Human
agaauucuguucuucgggugug

SEQ ID NO: 1122776 - RNA, 22 nt, Human
uggcagcaauuagcuagagcug

SEQ ID NO: 1122777 - RNA, 23 nt, Human
cuggcucauccugguugcagugg

SEQ ID NO: 1122778 - RNA, 22 nt, Human
cagagccaggguugcaccccug

SEQ ID NO: 1122779 - RNA, 22 nt, Human
uacaaagugagcaaccucuuuu

SEQ ID NO: 1122780 - RNA, 22 nt, Human
gcagggcuauuggaaggagaug

SEQ ID NO: 1122781 - RNA, 22 nt, Human
aagcuuccugaaugcucauuua

SEQ ID NO: 1122782 - RNA, 22 nt, Human
uacuuuuagccuauuugauucu

SEQ ID NO: 1122783 - RNA, 22 nt, Human
gagacugcauuguccaaggguu

SEQ ID NO: 1122784 - RNA, 22 nt, Human
aaagguuaguucuuagaagugc

SEQ ID NO: 1122785 - RNA, 22 nt, Human
uuguuucaugaguguaaaggga

SEQ ID NO: 1122786 - RNA, 21 nt, Human
ucuuuccugcccaguugcccu

SEQ ID NO: 1122787 - RNA, 22 nt, Human
ggagaaggaagaaagcuacuau

SEQ ID NO: 1122788 - RNA, 22 nt, Human
cugcagccuaggugcagcuggg

SEQ ID NO: 1122789 - RNA, 22 nt, Human
cagcuuggcuuccgcuuuacug

SEQ ID NO: 1122790 - RNA, 22 nt, Human
acuuugugcccaacagaaagaa

SEQ ID NO: 1122791 - RNA, 22 nt, Human
gaauuguacgcuuuacauaggu

SEQ ID NO: 1122792 - RNA, 22 nt, Human
uauauagaaaagcagauguugg

SEQ ID NO: 1122793 - RNA, 21 nt, Human
cauugucgacauuuuccccuc

SEQ ID NO: 1122794 - RNA, 22 nt, Human
uguguguauaugcauuuaucua

SEQ ID NO: 1122795 - RNA, 17 nt, Human
gaaaguuucucucucuu

SEQ ID NO: 1122796 - RNA, 22 nt, Human
gcaggaaagguugagacuuugc

SEQ ID NO: 1122797 - RNA, 18 nt, Human
ucugucucuguccuugcu

SEQ ID NO: 1122798 - RNA, 22 nt, Human
uaugcacaguuacaagaauauc

SEQ ID NO: 1122799 - RNA, 22 nt, Human
gcacagggcaacaggucuguua

SEQ ID NO: 1122800 - RNA, 22 nt, Human
acucugccuuucagcagaugaa

SEQ ID NO: 1122801 - RNA, 22 nt, Human
ucagcugccuuucccaugcuag

SEQ ID NO: 1122802 - RNA, 22 nt, Human
guccauggcagagcccuucugc

SEQ ID NO: 1122803 - RNA, 22 nt, Human
uagcagcugugaguaaaagcca

SEQ ID NO: 1122804 - RNA, 22 nt, Human
aggcacugagaggcuguguugc

SEQ ID NO: 1122805 - RNA, 22 nt, Human
ugcaguggaaucuggagagcag

SEQ ID NO: 1122806 - RNA, 22 nt, Human
aaaguggucaccuucucauuuc

SEQ ID NO: 1122807 - RNA, 22 nt, Human
gcugaagcccacguggcuugua

SEQ ID NO: 1122808 - RNA, 22 nt, Human
acgcagaagggccuggcgugcc

SEQ ID NO: 1122809 - RNA, 22 nt, Human
aaguucaagucugcaucuuuuu

SEQ ID NO: 1122810 - RNA, 18 nt, Human
cauuaugugguuauagaa

SEQ ID NO: 1122811 - RNA, 22 nt, Human
uuguuacaucuuauguaagugg

SEQ ID NO: 1122812 - RNA, 20 nt, Human
ggcagcaggaguuuccucuu

SEQ ID NO: 1122813 - RNA, 22 nt, Human
cacagcugaaguagccaugugg

SEQ ID NO: 1122814 - RNA, 22 nt, Human
gagucacaaagccuuucuuauu

SEQ ID NO: 1122815 - RNA, 18 nt, Human
ggcucaggcuauccuaac

SEQ ID NO: 1122816 - RNA, 22 nt, Human
uggauaaacucacuguaaguug

SEQ ID NO: 1122817 - RNA, 22 nt, Human
gucugucaucugagauggagug

SEQ ID NO: 1122818 - RNA, 18 nt, Human
cuccagggaacucaguca

SEQ ID NO: 1122819 - RNA, 22 nt, Human
ugcugccuccaacuccugggcu

SEQ ID NO: 1122820 - RNA, 22 nt, Human
gugucaugggguuuguuauaca

SEQ ID NO: 1122821 - RNA, 23 nt, Human
caugccaguuugugcaggcagau

SEQ ID NO: 1122822 - RNA, 22 nt, Human
agagauucauguuuacuguagg

SEQ ID NO: 1122823 - RNA, 22 nt, Human
uccuucagccaugggcucucca

SEQ ID NO: 1122824 - RNA, 20 nt, Human
aggcacuggggauagguaag

SEQ ID NO: 1122825 - RNA, 22 nt, Human
acagcacaaucugagucccaga

SEQ ID NO: 1122826 - RNA, 22 nt, Human
cuggcugcgucugcucugacag

SEQ ID NO: 1122827 - RNA, 22 nt, Human
ugcaauaacuacuuuaauguug

SEQ ID NO: 1122828 - RNA, 22 nt, Human
augucacagucugacucaguga

SEQ ID NO: 1122829 - RNA, 22 nt, Human
acagccuguuugaucuggugcu

SEQ ID NO: 1122830 - RNA, 22 nt, Human
uccauuuucaucucauguauaa

SEQ ID NO: 1122831 - RNA, 22 nt, Human
ccucuggguaucuguggaagua

SEQ ID NO: 1122832 - RNA, 22 nt, Human
cauggcaggaggcugcuggcag

SEQ ID NO: 1122833 - RNA, 22 nt, Human
gagagugaggcaucaggggcag

SEQ ID NO: 1122834 - RNA, 22 nt, Human
auagauacauuagguaacuugu

SEQ ID NO: 1122835 - RNA, 22 nt, Human
gaaggcaggcuucugauuaggu

SEQ ID NO: 1122836 - RNA, 22 nt, Human
cuugcaggauuuugcugcugua

SEQ ID NO: 1122837 - RNA, 22 nt, Human
gcccucugcuggccucaccucg

SEQ ID NO: 1122838 - RNA, 22 nt, Human
ccaggaguuugaggcugcagug

SEQ ID NO: 1122839 - RNA, 20 nt, Human
ucugaggcugagcucuacuu

SEQ ID NO: 1122840 - RNA, 22 nt, Human
ucagcuggcaguucagaggcug

SEQ ID NO: 1122841 - RNA, 22 nt, Human
ucuccuucgaggcccagcuccc

SEQ ID NO: 1122842 - RNA, 22 nt, Human
cagcccagcagucuuagccugc

SEQ ID NO: 1122843 - RNA, 22 nt, Human
acuaaggaauaugacaaacuca

SEQ ID NO: 1122844 - RNA, 22 nt, Human
accugccucagugcagcuggau

SEQ ID NO: 1122845 - RNA, 22 nt, Human
gaguguuccagaaacuggcccu

SEQ ID NO: 1122846 - RNA, 22 nt, Human
gcagggugaaggucacauagaa

SEQ ID NO: 1122847 - RNA, 22 nt, Human
ggagcugcuccuucagccaagu

SEQ ID NO: 1122848 - RNA, 23 nt, Human
uggcagcuguguaagagaaagca

SEQ ID NO: 1122849 - RNA, 22 nt, Human
gcugccuggaauaacggcuggc

SEQ ID NO: 1122850 - RNA, 22 nt, Human
caagggcuucaaguggccaaga

SEQ ID NO: 1122851 - RNA, 22 nt, Human
agguggggaggagugucucuuu

SEQ ID NO: 1122852 - RNA, 22 nt, Human
augaaacaugagaaauggagag

SEQ ID NO: 1122853 - RNA, 22 nt, Human
ucccaggacaggccacauggaa

SEQ ID NO: 1122854 - RNA, 22 nt, Human
ucugaggcuauguucaggcuaa

SEQ ID NO: 1122855 - RNA, 22 nt, Human
cagggacagccuugggguggcg

SEQ ID NO: 1122856 - RNA, 22 nt, Human
ugcccaaguccuccaccgaggu

SEQ ID NO: 1122857 - RNA, 22 nt, Human
aaguuuguggucauuuauuaua

SEQ ID NO: 1122858 - RNA, 22 nt, Human
gauuuccuugcauauugguaau

SEQ ID NO: 1122859 - RNA, 22 nt, Human
gguucacacuaagcuuaagugg

SEQ ID NO: 1122860 - RNA, 23 nt, Human
cagaccuggcagucauccucaac

SEQ ID NO: 1122861 - RNA, 22 nt, Human
cuggagccauguauagccuaug

SEQ ID NO: 1122862 - RNA, 22 nt, Human
augucacagcucccauuccucc

SEQ ID NO: 1122863 - RNA, 22 nt, Human
gcaaaugcuaaaguguagagac

SEQ ID NO: 1122864 - RNA, 22 nt, Human
aaacuguauauuuauggcaugu

SEQ ID NO: 1122865 - RNA, 22 nt, Human
aggcugggcuccgcccaacucc

SEQ ID NO: 1122866 - RNA, 22 nt, Human
auaaagaggauguauuuacagc

SEQ ID NO: 1122867 - RNA, 22 nt, Human
ggcacagggagccgcaguugca

SEQ ID NO: 1122868 - RNA, 23 nt, Human
uccucccaaauuucagccucauu

SEQ ID NO: 1122869 - RNA, 22 nt, Human
ggacuggacucucaggcucaca

SEQ ID NO: 1122870 - RNA, 22 nt, Human
aggagcugcuuaaaugguuggu

SEQ ID NO: 1122871 - RNA, 22 nt, Human
gugcauuggugcgccacuucac

SEQ ID NO: 1122872 - RNA, 22 nt, Human
uagcugugagcacccaggcugu

SEQ ID NO: 1122873 - RNA, 23 nt, Human
uagggcagcugggagggacaugc

SEQ ID NO: 1122874 - RNA, 22 nt, Human
uauuuugucuucugcucaucac

SEQ ID NO: 1122875 - RNA, 22 nt, Human
uggcagagucucuccuuuccag

SEQ ID NO: 1122876 - RNA, 22 nt, Human
uggccuggaaaaaugcagaugg

SEQ ID NO: 1122877 - RNA, 20 nt, Human
aggagccauugacugcagca

SEQ ID NO: 1122878 - RNA, 22 nt, Human
guuuuccuucucagccauugcc

SEQ ID NO: 1122879 - RNA, 22 nt, Human
uacagaaaaacuggcauugaag

SEQ ID NO: 1122880 - RNA, 22 nt, Human
aaaaauaggucaaccguguaug

SEQ ID NO: 1122881 - RNA, 23 nt, Human
agaaaagcuuggacacauggccu

SEQ ID NO: 1122882 - RNA, 18 nt, Human
gcuccuggaccaggucac

SEQ ID NO: 1122883 - RNA, 22 nt, Human
acuuugaaacuaaaauucauua

SEQ ID NO: 1122884 - RNA, 22 nt, Human
uggcuggacagugggcagugga

SEQ ID NO: 1122885 - RNA, 22 nt, Human
accugccuucucaaggacauga

SEQ ID NO: 1122886 - RNA, 22 nt, Human
aaguucaagcucugccuaaaau

SEQ ID NO: 1122887 - RNA, 22 nt, Human
uguggccucaaggcugcccuca

SEQ ID NO: 1122888 - RNA, 22 nt, Human
cuggcagguggauggggacucc

SEQ ID NO: 1122889 - RNA, 23 nt, Human
gccugggacucaggaggagcuca

SEQ ID NO: 1122890 - RNA, 22 nt, Human
ggcugccuccucgagacaggau

SEQ ID NO: 1122891 - RNA, 22 nt, Human
aggcacugugcuucuuauaugu

SEQ ID NO: 1122892 - RNA, 22 nt, Human
uguguguguuuacaguuucuca

SEQ ID NO: 1122893 - RNA, 17 nt, Human
cacaggugugguuugag

SEQ ID NO: 1122894 - RNA, 18 nt, Human
cuuuaugugcagagcuuu

SEQ ID NO: 1122895 - RNA, 22 nt, Human
ccagaggucuccugcacgggau

SEQ ID NO: 1122896 - RNA, 22 nt, Human
uggcuuccuggacagaugcggu

SEQ ID NO: 1122897 - RNA, 20 nt, Human
uacauucaaaacaaacucug

SEQ ID NO: 1122898 - RNA, 22 nt, Human
gucucagggacugcuucugggg

SEQ ID NO: 1122899 - RNA, 22 nt, Human
ggcucuggagacauguggagag

SEQ ID NO: 1122900 - RNA, 17 nt, Human
gcuuccugugcugggga

SEQ ID NO: 1122901 - RNA, 22 nt, Human
agagcuuauaucuuggccaucc

SEQ ID NO: 1122902 - RNA, 22 nt, Human
uggcugggagcuggaacugggc

SEQ ID NO: 1122903 - RNA, 21 nt, Human
cacugcagccuugaccugggc

SEQ ID NO: 1122904 - RNA, 22 nt, Human
uguguauucagcaagcgaaaca

SEQ ID NO: 1122905 - RNA, 22 nt, Human
ugcagugggccggaggccaggg

SEQ ID NO: 1122906 - RNA, 22 nt, Human
agagaaggucacuaaggaccca

SEQ ID NO: 1122907 - RNA, 22 nt, Human
ucugggcugggagcguguggac

SEQ ID NO: 1122908 - RNA, 22 nt, Human
caggaguggugugagggacucc

SEQ ID NO: 1122909 - RNA, 22 nt, Human
ccugagacaugaaccaggcucc

SEQ ID NO: 1122910 - RNA, 22 nt, Human
ucucugguggcuccaucaguag

SEQ ID NO: 1122911 - RNA, 21 nt, Human
ucucugggaggacuugugaga

SEQ ID NO: 1122912 - RNA, 22 nt, Human
auucuuggagcagucaaagaag

SEQ ID NO: 1122913 - RNA, 22 nt, Human
aagaacagguucuagaaccauu

SEQ ID NO: 1122914 - RNA, 22 nt, Human
augccuguaaucccagugcuuu

SEQ ID NO: 1122915 - RNA, 22 nt, Human
cugaagccacgauagcuuccua

SEQ ID NO: 1122916 - RNA, 22 nt, Human
gagcagaacaggccggguggga

SEQ ID NO: 1122917 - RNA, 22 nt, Human
agucucaggcagaggaaggcua

SEQ ID NO: 1122918 - RNA, 20 nt, Human
cuggguggcaagcaaggggg

SEQ ID NO: 1122919 - RNA, 22 nt, Human
uuucacauacaguguauaguag

SEQ ID NO: 1122920 - RNA, 22 nt, Human
augucccaagauacagcuagag

SEQ ID NO: 1122921 - RNA, 22 nt, Human
uagaaaauagggccuguggagc

SEQ ID NO: 1122922 - RNA, 18 nt, Human
gcucugcccaggcugccc

SEQ ID NO: 1122923 - RNA, 22 nt, Human
ggaagagagggcugggccucaa

SEQ ID NO: 1122924 - RNA, 22 nt, Human
aauguuuucauuauccuaacug

SEQ ID NO: 1122925 - RNA, 22 nt, Human
uaaggcacccuucugaguagag

SEQ ID NO: 1122926 - RNA, 22 nt, Human
cucagcuggcaauucuggcucc

SEQ ID NO: 1122927 - RNA, 22 nt, Human
ggcucugccugcccagcagcac

SEQ ID NO: 1122928 - RNA, 22 nt, Human
ugucagggcaugcgguccagcc

SEQ ID NO: 1122929 - RNA, 22 nt, Human
uaaagguaugucuuaaucaaac

SEQ ID NO: 1122930 - RNA, 22 nt, Human
augugugcaaugcuauuuuggc

SEQ ID NO: 1122931 - RNA, 22 nt, Human
gccauccucugagcacuaggca

SEQ ID NO: 1122932 - RNA, 22 nt, Human
ggaggagacccugugucaguuu

SEQ ID NO: 1122933 - RNA, 22 nt, Human
ucccagagaaagucaaggucuu

SEQ ID NO: 1122934 - RNA, 22 nt, Human
ugucugucugcaagccagaaag

SEQ ID NO: 1122935 - RNA, 22 nt, Human
ugcuuccuucccguucuucucc

SEQ ID NO: 1122936 - RNA, 22 nt, Human
agggccugggguagcuuacugc

SEQ ID NO: 1122937 - RNA, 22 nt, Human
gcucugucuucagcacacagua

SEQ ID NO: 1122938 - RNA, 22 nt, Human
ucucucuucagagauaccuugc

SEQ ID NO: 1122939 - RNA, 22 nt, Human
agaaugcaagauaaacuuuauu

SEQ ID NO: 1122940 - RNA, 22 nt, Human
gcaggccucuguugagggccuu

SEQ ID NO: 1122941 - RNA, 22 nt, Human
cuggcuggucaucagcaguacg

SEQ ID NO: 1122942 - RNA, 22 nt, Human
ucaaggcuaaacuuucagagua

SEQ ID NO: 1122943 - RNA, 20 nt, Human
ucacaggggaccaggagcag

SEQ ID NO: 1122944 - RNA, 22 nt, Human
ucugggcagcagcagcuaguag

SEQ ID NO: 1122945 - RNA, 22 nt, Human
cagggccuuauccugccauuga

SEQ ID NO: 1122946 - RNA, 22 nt, Human
ccugaagaugcuguggccuggu

SEQ ID NO: 1122947 - RNA, 22 nt, Human
uccagggaagagcagaggcuac

SEQ ID NO: 1122948 - RNA, 22 nt, Human
ucagagaacacagaggugaugu

SEQ ID NO: 1122949 - RNA, 22 nt, Human
ugggcagaucuuugguggcuag

SEQ ID NO: 1122950 - RNA, 22 nt, Human
gcccuuccaacccagagggcaa

SEQ ID NO: 1122951 - RNA, 22 nt, Human
agcagccagagaaugaugcagu

SEQ ID NO: 1122952 - RNA, 22 nt, Human
agcucagggcgaucugucucgg

SEQ ID NO: 1122953 - RNA, 22 nt, Human
cugccagcacugccuccugagg

SEQ ID NO: 1122954 - RNA, 22 nt, Human
ugaagcaggaucguuugcuuca

SEQ ID NO: 1122955 - RNA, 22 nt, Human
agggcagagagaugaaugggau

SEQ ID NO: 1122956 - RNA, 22 nt, Human
cagcuggcagcccuggcccugc

SEQ ID NO: 1122957 - RNA, 22 nt, Human
acugaaggcuuaacucuuucau

SEQ ID NO: 1122958 - RNA, 22 nt, Human
agcccucauggaacagcuccua

SEQ ID NO: 1122959 - RNA, 22 nt, Human
ugaggccagucucaucacaggc

SEQ ID NO: 1122960 - RNA, 22 nt, Human
ggcaggagauaaaauauuaguu

SEQ ID NO: 1122961 - RNA, 18 nt, Human
gaugggagcaagagaaga

SEQ ID NO: 1122962 - RNA, 21 nt, Human
gccaccucgucucggagcagc

SEQ ID NO: 1122963 - RNA, 22 nt, Human
cagagugagggccugcaccugc

SEQ ID NO: 1122964 - RNA, 22 nt, Human
ccuauugacaauucucuucucc

SEQ ID NO: 1122965 - RNA, 22 nt, Human
ucauuacagagauauaaucuac

SEQ ID NO: 1122966 - RNA, 22 nt, Human
gccucugcggggcccgagcccg

SEQ ID NO: 1122967 - RNA, 22 nt, Human
uaaauguauaggcacuaaaccu

SEQ ID NO: 1122968 - RNA, 22 nt, Human
ucacaggguuuggaagccuccu

SEQ ID NO: 1122969 - RNA, 22 nt, Human
cugcucugugguccaugagaca

SEQ ID NO: 1122970 - RNA, 22 nt, Human
ucaaacuagccugacugguauu

SEQ ID NO: 1122971 - RNA, 22 nt, Human
agccuggcccugcugaacucug

SEQ ID NO: 1122972 - RNA, 22 nt, Human
gucccugcaucaccacgggacu

SEQ ID NO: 1122973 - RNA, 22 nt, Human
agagccaggcggcugggcaccu

SEQ ID NO: 1122974 - RNA, 22 nt, Human
acagguggccccgagggagugg

SEQ ID NO: 1122975 - RNA, 22 nt, Human
aacaaaugauaccaguucucaa

SEQ ID NO: 1122976 - RNA, 22 nt, Human
aaggccugaacaugaggagaug

SEQ ID NO: 1122977 - RNA, 22 nt, Human
uaaguucagaguucucauuugu

SEQ ID NO: 1122978 - RNA, 21 nt, Human
cugcucuggggaccggcugug

SEQ ID NO: 1122979 - RNA, 20 nt, Human
agccugccagcuggcccaga

SEQ ID NO: 1122980 - RNA, 22 nt, Human
gggcucuggauggagccugcag

SEQ ID NO: 1122981 - RNA, 22 nt, Human
gacaugcaacaauuuggcauuu

SEQ ID NO: 1122982 - RNA, 21 nt, Human
ucuggagcccuaagcugagaa

SEQ ID NO: 1122983 - RNA, 21 nt, Human
cccuguguuccacagcagaca

SEQ ID NO: 1122984 - RNA, 22 nt, Human
ggagcagagcucuucaucugca

SEQ ID NO: 1122985 - RNA, 18 nt, Human
ugaacagaugaguugaag

SEQ ID NO: 1122986 - RNA, 22 nt, Human
uucauauauaugcacuacguac

SEQ ID NO: 1122987 - RNA, 22 nt, Human
cuggcugcuuguagacucgacu

SEQ ID NO: 1122988 - RNA, 22 nt, Human
uggcacugggaugcuacuguua

SEQ ID NO: 1122989 - RNA, 22 nt, Human
ucugggagcacacgcagugauc

SEQ ID NO: 1122990 - RNA, 22 nt, Human
ggugcagaucuuucucuucagg

SEQ ID NO: 1122991 - RNA, 22 nt, Human
uccagccaacugccuagggagc

SEQ ID NO: 1122992 - RNA, 22 nt, Human
gcugucuggguugagggcccug

SEQ ID NO: 1122993 - RNA, 22 nt, Human
acuuccuguuaugugugccucu

SEQ ID NO: 1122994 - RNA, 22 nt, Human
aucaguuuugggggacauacug

SEQ ID NO: 1122995 - RNA, 22 nt, Human
ggagccuguuaguugagugcuc

SEQ ID NO: 1122996 - RNA, 22 nt, Human
ucagaggacaagcucccuggug

SEQ ID NO: 1122997 - RNA, 22 nt, Human
aaggcugaguaaaacagagaac

SEQ ID NO: 1122998 - RNA, 22 nt, Human
aagcugccauagaacgagaggu

SEQ ID NO: 1122999 - RNA, 22 nt, Human
aaguccauagguuucaugaggg

SEQ ID NO: 1123000 - RNA, 22 nt, Human
agccuggagaggcgccauacac

SEQ ID NO: 1123001 - RNA, 22 nt, Human
cccuggguucuggcugggcugc

SEQ ID NO: 1123002 - RNA, 22 nt, Human
gcuggccacauugugccguccu

SEQ ID NO: 1123003 - RNA, 22 nt, Human
caaaggagguaaugggugugag

SEQ ID NO: 1123004 - RNA, 22 nt, Human
gcauccagucuuggcuccugga

SEQ ID NO: 1123005 - RNA, 22 nt, Human
gaagcagcaaaucugcaguauc

SEQ ID NO: 1123006 - RNA, 20 nt, Human
gugcuucagaagccauugcu

SEQ ID NO: 1123007 - RNA, 22 nt, Human
caggagcucuuaaggaugugau

SEQ ID NO: 1123008 - RNA, 22 nt, Human
gccuggaggggacagucucugg

SEQ ID NO: 1123009 - RNA, 21 nt, Human
cucuggaggcaagggagagug

SEQ ID NO: 1123010 - RNA, 22 nt, Human
auguacacaugcaugcaugugc

SEQ ID NO: 1123011 - RNA, 22 nt, Human
gcagccagccccucugaccucu

SEQ ID NO: 1123012 - RNA, 22 nt, Human
ucaguggauauuucuguggcug

SEQ ID NO: 1123013 - RNA, 22 nt, Human
cugaggucaauuaaucaacaac

SEQ ID NO: 1123014 - RNA, 17 nt, Human
cccugccaccaggaagc

SEQ ID NO: 1123015 - RNA, 17 nt, Human
aggaaacauuuucuuuc

SEQ ID NO: 1123016 - RNA, 22 nt, Human
aagcugccugccacgcuagaua

SEQ ID NO: 1123017 - RNA, 22 nt, Human
gaagagcugcaguuuccugggc

SEQ ID NO: 1123018 - RNA, 22 nt, Human
cagcugucuaaguugagcagga

SEQ ID NO: 1123019 - RNA, 22 nt, Human
uccucugcuguucugguucuuu

SEQ ID NO: 1123020 - RNA, 22 nt, Human
ccaaggagaaugacaccaugga

SEQ ID NO: 1123021 - RNA, 22 nt, Human
ccccagccagcaggaccucuga

SEQ ID NO: 1123022 - RNA, 22 nt, Human
gucccagaugucuggaacuccc

SEQ ID NO: 1123023 - RNA, 17 nt, Human
uuuucucucuuggauuc

SEQ ID NO: 1123024 - RNA, 22 nt, Human
cucucuguuaugcuuucaugaa

SEQ ID NO: 1123025 - RNA, 22 nt, Human
uuaaacagagucugaaauguaa

SEQ ID NO: 1123026 - RNA, 22 nt, Human
gucucagaguccuacuuauucc

SEQ ID NO: 1123027 - RNA, 22 nt, Human
ugagccuggguggucgaggcug

SEQ ID NO: 1123028 - RNA, 23 nt, Human
aagcugccuucgcaguuggucug

SEQ ID NO: 1123029 - RNA, 22 nt, Human
acaggggcuccgaaggugaggg

SEQ ID NO: 1123030 - RNA, 22 nt, Human
aggggagccccugguccuggug

SEQ ID NO: 1123031 - RNA, 22 nt, Human
cagcugaguuacucugaggucu

SEQ ID NO: 1123032 - RNA, 22 nt, Human
agggcagcuaaggugcugacug

SEQ ID NO: 1123033 - RNA, 22 nt, Human
uaaaugugggggccacgggcuu

SEQ ID NO: 1123034 - RNA, 22 nt, Human
uccucaggcggugaggaggggc

SEQ ID NO: 1123035 - RNA, 22 nt, Human
gggauggcuuuguggcugacuc

SEQ ID NO: 1123036 - RNA, 22 nt, Human
guuauguacuuuuuaaaucuug

SEQ ID NO: 1123037 - RNA, 22 nt, Human
guacaguuuucaguguucacug

SEQ ID NO: 1123038 - RNA, 22 nt, Human
ccagggcaucacauccaguguu

SEQ ID NO: 1123039 - RNA, 22 nt, Human
gagcacagaaucuucccaugca

SEQ ID NO: 1123040 - RNA, 22 nt, Human
aauauuucuccuucguuauagc

SEQ ID NO: 1123041 - RNA, 22 nt, Human
ugcagcccuuccuuccucuggg

SEQ ID NO: 1123042 - RNA, 22 nt, Human
auccaaagauggaaagaacuuu

SEQ ID NO: 1123043 - RNA, 22 nt, Human
cacugcuuauaaauucuaggca

SEQ ID NO: 1123044 - RNA, 22 nt, Human
ugcagcuguuacggacccuguc

SEQ ID NO: 1123045 - RNA, 22 nt, Human
ccagccugaaaugccucauccu

SEQ ID NO: 1123046 - RNA, 22 nt, Human
uauuucugucagccagauaugg

SEQ ID NO: 1123047 - RNA, 22 nt, Human
gugaggugggcuggccagagac

SEQ ID NO: 1123048 - RNA, 22 nt, Human
ucacaugcuacugagccagacc

SEQ ID NO: 1123049 - RNA, 22 nt, Human
uuuccauauucugcgucugcca

SEQ ID NO: 1123050 - RNA, 22 nt, Human
cucacugcccugaaguuggguu

SEQ ID NO: 1123051 - RNA, 22 nt, Human
ucucagaguuuacggggcugaa

SEQ ID NO: 1123052 - RNA, 22 nt, Human
uguacaaugccagggaacacca

SEQ ID NO: 1123053 - RNA, 22 nt, Human
aaguucaauggaaaagcuuuag

SEQ ID NO: 1123054 - RNA, 22 nt, Human
ucacuuauaaaaugcaagaucu

SEQ ID NO: 1123055 - RNA, 22 nt, Human
ucucaccauggugcuugcuuau

SEQ ID NO: 1123056 - RNA, 22 nt, Human
gcugcucuccauggccgugagu

SEQ ID NO: 1123057 - RNA, 22 nt, Human
ccagcugagaaguguaaaguga

SEQ ID NO: 1123058 - RNA, 22 nt, Human
ggcucagguuuccuucccagcu

SEQ ID NO: 1123059 - RNA, 22 nt, Human
cucagaaguucagccuagagua

SEQ ID NO: 1123060 - RNA, 22 nt, Human
caccagggacaaugcuaggggu

SEQ ID NO: 1123061 - RNA, 22 nt, Human
agaaaaggcuugaagagguuuu

SEQ ID NO: 1123062 - RNA, 22 nt, Human
uccaggagaggccugaccaggu

SEQ ID NO: 1123063 - RNA, 22 nt, Human
gccugggaacucugaucuccug

SEQ ID NO: 1123064 - RNA, 22 nt, Human
cugcccugagucaugccagaug

SEQ ID NO: 1123065 - RNA, 22 nt, Human
aguguuguaugggaugacugcu

SEQ ID NO: 1123066 - RNA, 22 nt, Human
gccugagaaggauaggaagcga

SEQ ID NO: 1123067 - RNA, 22 nt, Human
uggguaaacugggucuggagag

SEQ ID NO: 1123068 - RNA, 22 nt, Human
ugcagcuccucuggcugccuga

SEQ ID NO: 1123069 - RNA, 22 nt, Human
cugaagagcucuccuguccccu

SEQ ID NO: 1123070 - RNA, 22 nt, Human
ucccagagcccaaguuggagag

SEQ ID NO: 1123071 - RNA, 22 nt, Human
cagcucugugcaggccugggga

SEQ ID NO: 1123072 - RNA, 22 nt, Human
ccagagcuucggggcggcugua

SEQ ID NO: 1123073 - RNA, 22 nt, Human
uuuauuguuguuagucauaagu

SEQ ID NO: 1123074 - RNA, 22 nt, Human
ccagcagccaccuucucgaaau

SEQ ID NO: 1123075 - RNA, 22 nt, Human
uguucuugggaaucuuacaguu

SEQ ID NO: 1123076 - RNA, 22 nt, Human
agggcagacuaggauggaagug

SEQ ID NO: 1123077 - RNA, 22 nt, Human
ggcuagaacuuuacacuuugca

SEQ ID NO: 1123078 - RNA, 22 nt, Human
gccaggaguucagaugcauguu

SEQ ID NO: 1123079 - RNA, 22 nt, Human
cagccugcagggcugccuguug

SEQ ID NO: 1123080 - RNA, 22 nt, Human
agggacuggcucucugagcagg

SEQ ID NO: 1123081 - RNA, 22 nt, Human
agcauggggcaaugcaugugcu

SEQ ID NO: 1123082 - RNA, 22 nt, Human
cugcagagcuaggcugagugaa

SEQ ID NO: 1123083 - RNA, 22 nt, Human
uaaaguuuggcagacaauaaca

SEQ ID NO: 1123084 - RNA, 22 nt, Human
ucugucacccaggcuggagugc

SEQ ID NO: 1123085 - RNA, 22 nt, Human
aaaaaucacuuuuauaggcagc

SEQ ID NO: 1123086 - RNA, 22 nt, Human
aagugguaggaagagagcacug

SEQ ID NO: 1123087 - RNA, 19 nt, Human
ccucugcgcuguccugcuc

SEQ ID NO: 1123088 - RNA, 22 nt, Human
gggugggccugucuggccaugu

SEQ ID NO: 1123089 - RNA, 22 nt, Human
agacccugcaccucucgugggc

SEQ ID NO: 1123090 - RNA, 22 nt, Human
uguccugggaaugggaugcagu

SEQ ID NO: 1123091 - RNA, 22 nt, Human
uaagacauuugaaaugugaucc

SEQ ID NO: 1123092 - RNA, 22 nt, Human
agugcugucccgacaacugagg

SEQ ID NO: 1123093 - RNA, 18 nt, Human
gguggcaggucagaugcc

SEQ ID NO: 1123094 - RNA, 22 nt, Human
agcccaugcaacaggccuagcg

SEQ ID NO: 1123095 - RNA, 19 nt, Human
ggcccaaguacugagugcc

SEQ ID NO: 1123096 - RNA, 22 nt, Human
ucagagccaaucauggugcauu

SEQ ID NO: 1123097 - RNA, 22 nt, Human
agauuuccugcacugccuuuga

SEQ ID NO: 1123098 - RNA, 21 nt, Human
gcacagcaugaguguuggcau

SEQ ID NO: 1123099 - RNA, 22 nt, Human
ggagccagugcccucuggugga

SEQ ID NO: 1123100 - RNA, 22 nt, Human
gaacagaauuaccgaagaucug

SEQ ID NO: 1123101 - RNA, 22 nt, Human
ucagagugguagccuauuuucu

SEQ ID NO: 1123102 - RNA, 22 nt, Human
gcagacuggucuucagccuugg

SEQ ID NO: 1123103 - RNA, 22 nt, Human
aggggcugcuggguccgccccu

SEQ ID NO: 1123104 - RNA, 22 nt, Human
ggccagggggcuucagacucca

SEQ ID NO: 1123105 - RNA, 21 nt, Human
ccugugugucugacugggcua

SEQ ID NO: 1123106 - RNA, 22 nt, Human
gggcacuguggggcccaugcug

SEQ ID NO: 1123107 - RNA, 22 nt, Human
ucugagaggauuccugucccga

SEQ ID NO: 1123108 - RNA, 22 nt, Human
uugaaagggauauaucuuucug

SEQ ID NO: 1123109 - RNA, 22 nt, Human
uauaacacucagaaagaaucau

SEQ ID NO: 1123110 - RNA, 22 nt, Human
ugcaccauuaauuuaugugaga

SEQ ID NO: 1123111 - RNA, 21 nt, Human
accucaagcaacaaccaaggu

SEQ ID NO: 1123112 - RNA, 22 nt, Human
uuugcauuguuucaaaagugaa

SEQ ID NO: 1123113 - RNA, 20 nt, Human
ugcagcugguuucacaggga

SEQ ID NO: 1123114 - RNA, 21 nt, Human
acagcagggcuggcaugacag

SEQ ID NO: 1123115 - RNA, 22 nt, Human
cagaguguugaccauaagccca

SEQ ID NO: 1123116 - RNA, 22 nt, Human
ccugggaggcugugggucugcu

SEQ ID NO: 1123117 - RNA, 22 nt, Human
auccuugacacacuccaguacu

SEQ ID NO: 1123118 - RNA, 22 nt, Human
ucugccuggguguggagcagag

SEQ ID NO: 1123119 - RNA, 22 nt, Human
ugcuggcugggcugcuggagac

SEQ ID NO: 1123120 - RNA, 22 nt, Human
uccuuccugcaggccaaguccu

SEQ ID NO: 1123121 - RNA, 22 nt, Human
aaguuuguucauucauucaucc

SEQ ID NO: 1123122 - RNA, 22 nt, Human
uccaaugugacuaucagggagc

SEQ ID NO: 1123123 - RNA, 22 nt, Human
ucagaagccggaagugcuccuc

SEQ ID NO: 1123124 - RNA, 22 nt, Human
aucaguuucugugaagaacaca

SEQ ID NO: 1123125 - RNA, 22 nt, Human
gccuggagacaaggacaaaggg

SEQ ID NO: 1123126 - RNA, 22 nt, Human
uaacagaaauaguaggugaggg

SEQ ID NO: 1123127 - RNA, 22 nt, Human
acugcagggcauccuggccaag

SEQ ID NO: 1123128 - RNA, 22 nt, Human
ucagcagggccuccuugugcag

SEQ ID NO: 1123129 - RNA, 22 nt, Human
cacuggugacuucugagcugga

SEQ ID NO: 1123130 - RNA, 22 nt, Human
ucaggagagaaagaauacaauu

SEQ ID NO: 1123131 - RNA, 22 nt, Human
gcugcucugcuguguaagcagg

SEQ ID NO: 1123132 - RNA, 19 nt, Human
auagaaaggguuaaagaca

SEQ ID NO: 1123133 - RNA, 21 nt, Human
ggcagcugaccgcgcggugca

SEQ ID NO: 1123134 - RNA, 22 nt, Human
uggcccugacuuggaggccuga

SEQ ID NO: 1123135 - RNA, 22 nt, Human
uguuuuaagagcgcacuuuaua

SEQ ID NO: 1123136 - RNA, 22 nt, Human
ugcagcugguuuagaacuagau

SEQ ID NO: 1123137 - RNA, 22 nt, Human
ugagggaggcccuuugagcaga

SEQ ID NO: 1123138 - RNA, 22 nt, Human
agagaggcugggcguagggcuu

SEQ ID NO: 1123139 - RNA, 22 nt, Human
uaagugcaauguuuuacuuaaa

SEQ ID NO: 1123140 - RNA, 23 nt, Human
ucuuuacauacugaugaguucuc

SEQ ID NO: 1123141 - RNA, 22 nt, Human
agucccagaucuacaggaggga

SEQ ID NO: 1123142 - RNA, 18 nt, Human
caugggugacagguggau

SEQ ID NO: 1123143 - RNA, 22 nt, Human
caggccucaggggcucaggcug

SEQ ID NO: 1123144 - RNA, 22 nt, Human
acagcuggcaggggggcaugaa

SEQ ID NO: 1123145 - RNA, 21 nt, Human
uuuauguacuucauagaguag

SEQ ID NO: 1123146 - RNA, 22 nt, Human
uaaggcauucucaugcugugaa

SEQ ID NO: 1123147 - RNA, 22 nt, Human
gaagagcuuagacagaaucaaa

SEQ ID NO: 1123148 - RNA, 22 nt, Human
caaagucccagcugcuuagaga

SEQ ID NO: 1123149 - RNA, 22 nt, Human
aagagcuggaguuugcagcccu

SEQ ID NO: 1123150 - RNA, 22 nt, Human
acuuaggccuugcuaagcauuu

SEQ ID NO: 1123151 - RNA, 22 nt, Human
uccagccaagccuugguagcug

SEQ ID NO: 1123152 - RNA, 21 nt, Human
auggagccuaagaguggaggu

SEQ ID NO: 1123153 - RNA, 22 nt, Human
caggggcucugggugaugugag

SEQ ID NO: 1123154 - RNA, 22 nt, Human
ugucucugauaaguaguucagu

SEQ ID NO: 1123155 - RNA, 22 nt, Human
cagcugggagcuccauuagaua

SEQ ID NO: 1123156 - RNA, 22 nt, Human
ugggagagugcucaaugugcaa

SEQ ID NO: 1123157 - RNA, 22 nt, Human
acugucugcaaaacucauacuc

SEQ ID NO: 1123158 - RNA, 22 nt, Human
aaaugucuaucuggcauauucc

SEQ ID NO: 1123159 - RNA, 22 nt, Human
ugucuucaguaaaauacacuau

SEQ ID NO: 1123160 - RNA, 22 nt, Human
gcagccacccucaaggcugaau

SEQ ID NO: 1123161 - RNA, 22 nt, Human
accaggggaugguuggcacugu

SEQ ID NO: 1123162 - RNA, 22 nt, Human
auaaacacuucuagggcacaca

SEQ ID NO: 1123163 - RNA, 22 nt, Human
gaugccugcauuucaggagagu

SEQ ID NO: 1123164 - RNA, 22 nt, Human
caggaggcaucauggagcggac

SEQ ID NO: 1123165 - RNA, 22 nt, Human
aagauguaucaguuaagucuuc

SEQ ID NO: 1123166 - RNA, 18 nt, Human
auuuugaacaaugcugua

SEQ ID NO: 1123167 - RNA, 22 nt, Human
ucaggagaaucagggcuguccu

SEQ ID NO: 1123168 - RNA, 20 nt, Human
cacaggccuugugagcagac

SEQ ID NO: 1123169 - RNA, 22 nt, Human
agagcagguggcaacucuggga

SEQ ID NO: 1123170 - RNA, 22 nt, Human
ggcuccuguccccucagcugcu

SEQ ID NO: 1123171 - RNA, 22 nt, Human
ugaaaucuuauacuuugguagu

SEQ ID NO: 1123172 - RNA, 22 nt, Human
cauggcagagaaggggaacugg

SEQ ID NO: 1123173 - RNA, 23 nt, Human
acagagguccaaacaguauaagc

SEQ ID NO: 1123174 - RNA, 22 nt, Human
aaaugucuuuaucucauguaac

SEQ ID NO: 1123175 - RNA, 22 nt, Human
ugccuggguguaaagggccaac

SEQ ID NO: 1123176 - RNA, 22 nt, Human
caggcuugcugcuagagcacuu

SEQ ID NO: 1123177 - RNA, 21 nt, Human
ccuucucuugcuucagcuuca

SEQ ID NO: 1123178 - RNA, 22 nt, Human
uuuuagauugggaaauguaaag

SEQ ID NO: 1123179 - RNA, 22 nt, Human
augggaggaucacuugaggcca

SEQ ID NO: 1123180 - RNA, 22 nt, Human
gagcuuccacucuagaaggagu

SEQ ID NO: 1123181 - RNA, 22 nt, Human
aagccucaccuuuuagaagcua

SEQ ID NO: 1123182 - RNA, 22 nt, Human
auaugaagucagacaaacuggg

SEQ ID NO: 1123183 - RNA, 22 nt, Human
ggaggcucugcuccguguguuc

SEQ ID NO: 1123184 - RNA, 22 nt, Human
gaagcagcgaaguggaagggac

SEQ ID NO: 1123185 - RNA, 22 nt, Human
uggagcaggaagucuauggcug

SEQ ID NO: 1123186 - RNA, 22 nt, Human
gccuggcugagguggggaggca

SEQ ID NO: 1123187 - RNA, 22 nt, Human
ggcugccugccuccaagccggg

SEQ ID NO: 1123188 - RNA, 22 nt, Human
ugcucacugaacucuugcuguc

SEQ ID NO: 1123189 - RNA, 22 nt, Human
cugccuugaggagguuguggga

SEQ ID NO: 1123190 - RNA, 22 nt, Human
uuugcauuuauaaguuggugga

SEQ ID NO: 1123191 - RNA, 22 nt, Human
ugggcugcuuccucagcugaga

SEQ ID NO: 1123192 - RNA, 21 nt, Human
uggcugccuacaugcugcagg

SEQ ID NO: 1123193 - RNA, 22 nt, Human
gggaaauugugugagaucuuug

SEQ ID NO: 1123194 - RNA, 22 nt, Human
gccugccugcugucaucugccu

SEQ ID NO: 1123195 - RNA, 22 nt, Human
aaaguccaauuuuguucaggcu

SEQ ID NO: 1123196 - RNA, 22 nt, Human
uuugaguugcuuauuuaauagg

SEQ ID NO: 1123197 - RNA, 22 nt, Human
cauugcacgggcgucugucugu

SEQ ID NO: 1123198 - RNA, 22 nt, Human
aggagugcaaauaguccagaga

SEQ ID NO: 1123199 - RNA, 22 nt, Human
uaaaguucagugcaugaaugug

SEQ ID NO: 1123200 - RNA, 22 nt, Human
cuguagcagugugcucuuuuuc

SEQ ID NO: 1123201 - RNA, 22 nt, Human
gcucuggguagccacugccugg

SEQ ID NO: 1123202 - RNA, 21 nt, Human
ucagaguguguuacagcaagc

SEQ ID NO: 1123203 - RNA, 22 nt, Human
uauacagaaccgccugaagucu

SEQ ID NO: 1123204 - RNA, 22 nt, Human
uuuuuccuuggaugugucucuc

SEQ ID NO: 1123205 - RNA, 22 nt, Human
uuucacaaguaaaguccuaagu

SEQ ID NO: 1123206 - RNA, 22 nt, Human
cuccagggagcugcgggagcca

SEQ ID NO: 1123207 - RNA, 22 nt, Human
cagccagggucaggcagcuucu

SEQ ID NO: 1123208 - RNA, 22 nt, Human
acacagggggcauucuaggagu

SEQ ID NO: 1123209 - RNA, 22 nt, Human
gggagggaagguaccuguguga

SEQ ID NO: 1123210 - RNA, 22 nt, Human
caggacaguauaggcuuuagga

SEQ ID NO: 1123211 - RNA, 22 nt, Human
cagcugaacauguagagcaucu

SEQ ID NO: 1123212 - RNA, 22 nt, Human
auaguacacauccuacaauguu

SEQ ID NO: 1123213 - RNA, 22 nt, Human
gggcugcugcugccagcgacac

SEQ ID NO: 1123214 - RNA, 22 nt, Human
guggugcaggccagcaggggcg

SEQ ID NO: 1123215 - RNA, 22 nt, Human
caugucuggguauaugcauaug

SEQ ID NO: 1123216 - RNA, 22 nt, Human
ugcaguggugguaaagaugcuc

SEQ ID NO: 1123217 - RNA, 22 nt, Human
caauguuucuuguaaccaguga

SEQ ID NO: 1123218 - RNA, 22 nt, Human
ccugucucccuggcauggcuca

SEQ ID NO: 1123219 - RNA, 23 nt, Human
ccaggcaguagcuauugaaguga

SEQ ID NO: 1123220 - RNA, 22 nt, Human
cuggcagcguguuuaugaacau

SEQ ID NO: 1123221 - RNA, 22 nt, Human
ucuuuccuagaggcugaugagu

SEQ ID NO: 1123222 - RNA, 22 nt, Human
aggaugggccugggauaugcuu

SEQ ID NO: 1123223 - RNA, 17 nt, Human
ggugagaccucccacuc

SEQ ID NO: 1123224 - RNA, 22 nt, Human
agcagcuggggccugugacgau

SEQ ID NO: 1123225 - RNA, 22 nt, Human
cugggccugguagggcuugaaa

SEQ ID NO: 1123226 - RNA, 22 nt, Human
agagccaggacugugucucacu

SEQ ID NO: 1123227 - RNA, 22 nt, Human
uugcaaaagccgaggcacucca

SEQ ID NO: 1123228 - RNA, 22 nt, Human
uccugggccuguacuccauccg

SEQ ID NO: 1123229 - RNA, 22 nt, Human
cagagcugucauuugccaguga

SEQ ID NO: 1123230 - RNA, 22 nt, Human
aaaguuugucacuuggcuagaa

SEQ ID NO: 1123231 - RNA, 22 nt, Human
gagauggggaauaggagcaagc

SEQ ID NO: 1123232 - RNA, 23 nt, Human
cagcugaagcagccugggcugga

SEQ ID NO: 1123233 - RNA, 21 nt, Human
agagcugggacuugccugaga

SEQ ID NO: 1123234 - RNA, 22 nt, Human
uaagaauuguguugaauagagu

SEQ ID NO: 1123235 - RNA, 23 nt, Human
ugggccuggaaagccuuagagag

SEQ ID NO: 1123236 - RNA, 19 nt, Human
ucauucaggaccaguggau

SEQ ID NO: 1123237 - RNA, 22 nt, Human
uccucaggcugccuggaagacu

SEQ ID NO: 1123238 - RNA, 21 nt, Human
auacuuugaauuacagccuug

SEQ ID NO: 1123239 - RNA, 22 nt, Human
agaagcaguuauuuuuugcaca

SEQ ID NO: 1123240 - RNA, 19 nt, Human
aacuagaaagguuuugaga

SEQ ID NO: 1123241 - RNA, 22 nt, Human
ugccugcucuuaccacucuccc

SEQ ID NO: 1123242 - RNA, 22 nt, Human
cuccagggaggucugcaggacu

SEQ ID NO: 1123243 - RNA, 22 nt, Human
ugaaagcuguccacuaggcugu

SEQ ID NO: 1123244 - RNA, 17 nt, Human
uggagcugcguguguuc

SEQ ID NO: 1123245 - RNA, 22 nt, Human
uccagucaggcugaauucaagg

SEQ ID NO: 1123246 - RNA, 22 nt, Human
ugccugcugcuaagcucuuugu

SEQ ID NO: 1123247 - RNA, 22 nt, Human
agaagcugacagaugcagcagg

SEQ ID NO: 1123248 - RNA, 22 nt, Human
agauacauuaguaguuacuugu

SEQ ID NO: 1123249 - RNA, 22 nt, Human
aggcugccaaagcuucugucuc

SEQ ID NO: 1123250 - RNA, 22 nt, Human
uuacaaagagaaguuguagaau

SEQ ID NO: 1123251 - RNA, 22 nt, Human
uuacaaagcguugagacaagua

SEQ ID NO: 1123252 - RNA, 22 nt, Human
aggaggccgauuucagaggucg

SEQ ID NO: 1123253 - RNA, 22 nt, Human
gcagagccccauugcuggcggg

SEQ ID NO: 1123254 - RNA, 22 nt, Human
cugccucugcgucccacagagu

SEQ ID NO: 1123255 - RNA, 22 nt, Human
aaugaacaaaauaugcuuugca

SEQ ID NO: 1123256 - RNA, 22 nt, Human
cuagucacucagcacugacaaa

SEQ ID NO: 1123257 - RNA, 22 nt, Human
uaucuacuccucuuucagaugc

SEQ ID NO: 1123258 - RNA, 22 nt, Human
gagccaggucgggccgcggcga

SEQ ID NO: 1123259 - RNA, 18 nt, Human
uacaugcauaaaugaagc

SEQ ID NO: 1123260 - RNA, 22 nt, Human
acauacauaugacaacuuuccu

SEQ ID NO: 1123261 - RNA, 22 nt, Human
acauuuaaugauccuacuguga

SEQ ID NO: 1123262 - RNA, 22 nt, Human
gcugccacgaucucugcuguag

SEQ ID NO: 1123263 - RNA, 22 nt, Human
uggagcuggaauuugagcugga

SEQ ID NO: 1123264 - RNA, 17 nt, Human
gcuuccucaugcaguuc

SEQ ID NO: 1123265 - RNA, 22 nt, Human
aagccagguuccauggaggagc

SEQ ID NO: 1123266 - RNA, 22 nt, Human
ccagcuggugggucuuucucug

SEQ ID NO: 1123267 - RNA, 22 nt, Human
gggcugcuguagagaacauguu

SEQ ID NO: 1123268 - RNA, 22 nt, Human
ugaggcaggaguucaggcugcg

SEQ ID NO: 1123269 - RNA, 22 nt, Human
gcucugcucuugacuuaccagg

SEQ ID NO: 1123270 - RNA, 22 nt, Human
gggacagcuguagugcuuggcu

SEQ ID NO: 1123271 - RNA, 22 nt, Human
cuguccugauggugccacuggu

SEQ ID NO: 1123272 - RNA, 22 nt, Human
gccagcugguaggcaccuagcc

SEQ ID NO: 1123273 - RNA, 22 nt, Human
acagguggggaggcugagguuc

SEQ ID NO: 1123274 - RNA, 22 nt, Human
auugaaagcauggauuuggauu

SEQ ID NO: 1123275 - RNA, 19 nt, Human
acucaagucuaaugaaauc

SEQ ID NO: 1123276 - RNA, 22 nt, Human
cugccucugguuuuggucccug

SEQ ID NO: 1123277 - RNA, 22 nt, Human
gccaggugggagacagacagca

SEQ ID NO: 1123278 - RNA, 22 nt, Human
uagggcagaguccaggaugggc

SEQ ID NO: 1123279 - RNA, 22 nt, Human
uagcaggguaaauguagaugga

SEQ ID NO: 1123280 - RNA, 23 nt, Human
aguuuuucugcaugguucuguau

SEQ ID NO: 1123281 - RNA, 22 nt, Human
agauuucacaugcugcucuauu

SEQ ID NO: 1123282 - RNA, 22 nt, Human
uguuuuauuucuccaagaggga

SEQ ID NO: 1123283 - RNA, 22 nt, Human
cugagucucccggcaguggagg

SEQ ID NO: 1123284 - RNA, 22 nt, Human
uuucuguagggauuucacaguu

SEQ ID NO: 1123285 - RNA, 22 nt, Human
gugucauguagaaauugaugaa

SEQ ID NO: 1123286 - RNA, 22 nt, Human
aaggagaaaugguagaugugca

SEQ ID NO: 1123287 - RNA, 22 nt, Human
cuggagccugcaguuuucacuu

SEQ ID NO: 1123288 - RNA, 22 nt, Human
aggguauguuuuuaucuacugu

SEQ ID NO: 1123289 - RNA, 22 nt, Human
ugcuggcuguauaugugagagu

SEQ ID NO: 1123290 - RNA, 22 nt, Human
auguaguguagagauuagucuc

SEQ ID NO: 1123291 - RNA, 22 nt, Human
acagcaagccagcuugucacug

SEQ ID NO: 1123292 - RNA, 22 nt, Human
uaugcacauugguuuccucauu

SEQ ID NO: 1123293 - RNA, 22 nt, Human
ucccagagacaucauuucuccg

SEQ ID NO: 1123294 - RNA, 22 nt, Human
guccucugcccaggucaagguu

SEQ ID NO: 1123295 - RNA, 22 nt, Human
cacagaguggaggcuuggccug

SEQ ID NO: 1123296 - RNA, 22 nt, Human
uuagaaaucugcugccaugcaa

SEQ ID NO: 1123297 - RNA, 22 nt, Human
uuguuuucuccacugcaucuua

SEQ ID NO: 1123298 - RNA, 22 nt, Human
cugacucagcagcugaugaucc

SEQ ID NO: 1123299 - RNA, 21 nt, Human
ccucugcucgggcaugcguuu

SEQ ID NO: 1123300 - RNA, 22 nt, Human
acagaaauaacuuuuuauguuu

SEQ ID NO: 1123301 - RNA, 22 nt, Human
uaugcauaauuggauaaguaga

SEQ ID NO: 1123302 - RNA, 17 nt, Human
acacagccagguucucc

SEQ ID NO: 1123303 - RNA, 22 nt, Human
uccaguggguugcugagggagg

SEQ ID NO: 1123304 - RNA, 22 nt, Human
aagucauugguagcuugauagg

SEQ ID NO: 1123305 - RNA, 22 nt, Human
ccucuggggugagugggccacu

SEQ ID NO: 1123306 - RNA, 22 nt, Human
cugagguggaacagaggugaag

SEQ ID NO: 1123307 - RNA, 22 nt, Human
gcagcugccuauucagggcuug

SEQ ID NO: 1123308 - RNA, 22 nt, Human
aguaacuaugcuugagaaucag

SEQ ID NO: 1123309 - RNA, 22 nt, Human
ucagaggacgcacuaggguugu

SEQ ID NO: 1123310 - RNA, 22 nt, Human
gaggagcuggcagcgucuccgc

SEQ ID NO: 1123311 - RNA, 22 nt, Human
gggcccuggggccugauuugca

SEQ ID NO: 1123312 - RNA, 22 nt, Human
cacagaggacuguagcggggag

SEQ ID NO: 1123313 - RNA, 22 nt, Human
agcugguuagcaaucuaaguga

SEQ ID NO: 1123314 - RNA, 22 nt, Human
gggcccagcgugguuccaucug

SEQ ID NO: 1123315 - RNA, 22 nt, Human
gcugucugggaggccuccacuu

SEQ ID NO: 1123316 - RNA, 22 nt, Human
aauuccugucuuaacaguucug

SEQ ID NO: 1123317 - RNA, 22 nt, Human
aggagcugcaaauauuaguaau

SEQ ID NO: 1123318 - RNA, 22 nt, Human
accuuucaaaguggcuaucacu

SEQ ID NO: 1123319 - RNA, 22 nt, Human
acuccuggggcugccaucacag

SEQ ID NO: 1123320 - RNA, 22 nt, Human
aagagguugucugugaugaguu

SEQ ID NO: 1123321 - RNA, 22 nt, Human
guccucugggcagcugccccac

SEQ ID NO: 1123322 - RNA, 22 nt, Human
caguaugucuacuggacaaagu

SEQ ID NO: 1123323 - RNA, 22 nt, Human
uccuugaaaagaaugucuccau

SEQ ID NO: 1123324 - RNA, 22 nt, Human
cccaccccuggacaggugagug

SEQ ID NO: 1123325 - RNA, 22 nt, Human
uccuugaaugaagagaggugac

SEQ ID NO: 1123326 - RNA, 22 nt, Human
gcuggccucaucacugacuucu

SEQ ID NO: 1123327 - RNA, 22 nt, Human
uaccaggcagcugcacagaggc

SEQ ID NO: 1123328 - RNA, 20 nt, Human
ggguggaguugcggucugug

SEQ ID NO: 1123329 - RNA, 22 nt, Human
ccacagaaaguugucuagagua

SEQ ID NO: 1123330 - RNA, 22 nt, Human
cagcccuggccccagguggucu

SEQ ID NO: 1123331 - RNA, 22 nt, Human
guauguguugaauucagggguc

SEQ ID NO: 1123332 - RNA, 22 nt, Human
uaugcacgucuauuuaugaaga

SEQ ID NO: 1123333 - RNA, 22 nt, Human
acagagcuguacaugugccaug

SEQ ID NO: 1123334 - RNA, 22 nt, Human
ugguugaauguagcauuuaugg

SEQ ID NO: 1123335 - RNA, 22 nt, Human
ccagcuggcacuguggcugccc

SEQ ID NO: 1123336 - RNA, 22 nt, Human
gggcugggauggcuugaagauu

SEQ ID NO: 1123337 - RNA, 22 nt, Human
ugaagccaucccucagauggcc

SEQ ID NO: 1123338 - RNA, 22 nt, Human
ccagaggcuggguucaccucag

SEQ ID NO: 1123339 - RNA, 22 nt, Human
uagcagggaagaugaucagaau

SEQ ID NO: 1123340 - RNA, 23 nt, Human
ucucagaggauuccugggccuug

SEQ ID NO: 1123341 - RNA, 22 nt, Human
uaaauguguuagucaugguuuu

SEQ ID NO: 1123342 - RNA, 19 nt, Human
gcugucugaugcugagguc

SEQ ID NO: 1123343 - RNA, 22 nt, Human
acuuucuccagaaaaccaagga

SEQ ID NO: 1123344 - RNA, 22 nt, Human
ccuggcagcuccuccccggcgg

SEQ ID NO: 1123345 - RNA, 22 nt, Human
cagagacagggcagggagugug

SEQ ID NO: 1123346 - RNA, 22 nt, Human
gcugcagcagcugcaggguugu

SEQ ID NO: 1123347 - RNA, 22 nt, Human
gcugugcuggaaggggaccugc

SEQ ID NO: 1123348 - RNA, 22 nt, Human
aggucaaaccacagcucuaggc

SEQ ID NO: 1123349 - RNA, 22 nt, Human
guaaaguucuacuagaaucaac

SEQ ID NO: 1123350 - RNA, 22 nt, Human
ucucagggcgcagugaggcagu

SEQ ID NO: 1123351 - RNA, 19 nt, Human
ccagguggaacugagguag

SEQ ID NO: 1123352 - RNA, 22 nt, Human
cuugcugggguaagucugugcu

SEQ ID NO: 1123353 - RNA, 22 nt, Human
aggcugccuguuccaaucuccu

SEQ ID NO: 1123354 - RNA, 22 nt, Human
aaaagacauaugugggcauucu

SEQ ID NO: 1123355 - RNA, 22 nt, Human
aagcagccagccaucaugcccg

SEQ ID NO: 1123356 - RNA, 22 nt, Human
aaugggagagaacacaaagucc

SEQ ID NO: 1123357 - RNA, 22 nt, Human
gcagggucuugagaggcagcca

SEQ ID NO: 1123358 - RNA, 22 nt, Human
ugggccugggucuuugcugcca

SEQ ID NO: 1123359 - RNA, 22 nt, Human
ggaggggcagccauggaacucc

SEQ ID NO: 1123360 - RNA, 22 nt, Human
aagggcaggugggcauuucugg

SEQ ID NO: 1123361 - RNA, 22 nt, Human
guccucaguaagagggccucug

SEQ ID NO: 1123362 - RNA, 22 nt, Human
gcagggcagcuuagucccuguc

SEQ ID NO: 1123363 - RNA, 22 nt, Human
uggcuggcuagugggcaggauu

SEQ ID NO: 1123364 - RNA, 22 nt, Human
cccucugccugcgcccuggugu

SEQ ID NO: 1123365 - RNA, 22 nt, Human
gaguggggcccacugcugggug

SEQ ID NO: 1123366 - RNA, 22 nt, Human
cccagcuccuuacagggccgaa

SEQ ID NO: 1123367 - RNA, 22 nt, Human
ccuggcagcgccgaagcuggcc

SEQ ID NO: 1123368 - RNA, 22 nt, Human
uggaagcacuuggguuuuguug

SEQ ID NO: 1123369 - RNA, 22 nt, Human
aggagcagaccguaguccugca

SEQ ID NO: 1123370 - RNA, 22 nt, Human
ucucagaguuccucuggagucc

SEQ ID NO: 1123371 - RNA, 22 nt, Human
acaaagucugaaaccugaggca

SEQ ID NO: 1123372 - RNA, 22 nt, Human
auauauauugcccaggcugguu

SEQ ID NO: 1123373 - RNA, 22 nt, Human
gguggguauugaauacaggugu

SEQ ID NO: 1123374 - RNA, 22 nt, Human
uccuugaaaaucuugguuuaga

SEQ ID NO: 1123375 - RNA, 22 nt, Human
caggaggcuccuagggcucugu

SEQ ID NO: 1123376 - RNA, 23 nt, Human
aggagaagagauuuccacaugca

SEQ ID NO: 1123377 - RNA, 22 nt, Human
uuugggcaguagauguaucacu

SEQ ID NO: 1123378 - RNA, 22 nt, Human
uaauacuuugaaugagagcuaa

SEQ ID NO: 1123379 - RNA, 22 nt, Human
ggggcagauggaacagagcaca

SEQ ID NO: 1123380 - RNA, 22 nt, Human
aagcagccacuggccaguuaua

SEQ ID NO: 1123381 - RNA, 22 nt, Human
caggccucuauggucagcugag

SEQ ID NO: 1123382 - RNA, 22 nt, Human
cucugugauuuugugagccaga

SEQ ID NO: 1123383 - RNA, 20 nt, Human
gggcuggcgcauggggaaag

SEQ ID NO: 1123384 - RNA, 20 nt, Human
uucuuucaucuacacguugu

SEQ ID NO: 1123385 - RNA, 22 nt, Human
gagcuuccugaugccgaccagu

SEQ ID NO: 1123386 - RNA, 22 nt, Human
caggccucagagaguggcgggg

SEQ ID NO: 1123387 - RNA, 22 nt, Human
uggaaagagguagaggaucugg

SEQ ID NO: 1123388 - RNA, 22 nt, Human
cagagugaaauaggggaucaag

SEQ ID NO: 1123389 - RNA, 22 nt, Human
auauuucuccaaauguuuucaa

SEQ ID NO: 1123390 - RNA, 22 nt, Human
cacaguggauugggugaugccc

SEQ ID NO: 1123391 - RNA, 22 nt, Human
uccagcagggaauuaguagucu

SEQ ID NO: 1123392 - RNA, 21 nt, Human
uucaaaguuugccuaaagauu

SEQ ID NO: 1123393 - RNA, 22 nt, Human
uugugucccccuuugagagcca

SEQ ID NO: 1123394 - RNA, 22 nt, Human
cuggugccauucuguggccuag

SEQ ID NO: 1123395 - RNA, 22 nt, Human
ugaaccaggaggcagccagcac

SEQ ID NO: 1123396 - RNA, 22 nt, Human
aagcugccuugcugaggagaaa

SEQ ID NO: 1123397 - RNA, 22 nt, Human
cuguguggacugguugaggccc

SEQ ID NO: 1123398 - RNA, 22 nt, Human
ucucagggcagcaaggaagcau

SEQ ID NO: 1123399 - RNA, 22 nt, Human
ucugggggcgaccagggacugc

SEQ ID NO: 1123400 - RNA, 22 nt, Human
ugggagaagcagcagccaagug

SEQ ID NO: 1123401 - RNA, 22 nt, Human
aauguuuucucugugaacacau

SEQ ID NO: 1123402 - RNA, 22 nt, Human
ggcagugaaaaaguauguuucc

SEQ ID NO: 1123403 - RNA, 22 nt, Human
acacuuuguuguggcauauacg

SEQ ID NO: 1123404 - RNA, 22 nt, Human
uccuggccugucuggaguagcu

SEQ ID NO: 1123405 - RNA, 22 nt, Human
acugugcaaugaguaauaaacu

SEQ ID NO: 1123406 - RNA, 22 nt, Human
aggagcuggaguccaggcaagu

SEQ ID NO: 1123407 - RNA, 22 nt, Human
ucugagaguacgggcugcgcgc

SEQ ID NO: 1123408 - RNA, 23 nt, Human
cauguacacacagcuguacagug

SEQ ID NO: 1123409 - RNA, 22 nt, Human
aaaaaugcugugguagcugugu

SEQ ID NO: 1123410 - RNA, 22 nt, Human
agggcagaccacgugcaaggau

SEQ ID NO: 1123411 - RNA, 22 nt, Human
uucuaguguccuuggacuugcu

SEQ ID NO: 1123412 - RNA, 22 nt, Human
gggccugacugagagcuccuca

SEQ ID NO: 1123413 - RNA, 22 nt, Human
gcagcugggacacugaggccag

SEQ ID NO: 1123414 - RNA, 22 nt, Human
gauggggaugagaagugagcag

SEQ ID NO: 1123415 - RNA, 15 nt, Human
aggcacugugggacc

SEQ ID NO: 1123416 - RNA, 22 nt, Human
ccucccaccauuuagagagagc

SEQ ID NO: 1123417 - RNA, 22 nt, Human
cagggccaugaggcacaggguc

SEQ ID NO: 1123418 - RNA, 17 nt, Human
ucaggcugggugcagug

SEQ ID NO: 1123419 - RNA, 23 nt, Human
gcagagcugcccuauugccuugg

SEQ ID NO: 1123420 - RNA, 22 nt, Human
gccugggugaauuugauccuaa

SEQ ID NO: 1123421 - RNA, 22 nt, Human
acaauucucucauaucuuauua

SEQ ID NO: 1123422 - RNA, 22 nt, Human
ggcuucagugagcugagcucac

SEQ ID NO: 1123423 - RNA, 22 nt, Human
cugggcacaggggagcagaguc

SEQ ID NO: 1123424 - RNA, 18 nt, Human
ucagcuggggcugcagcc

SEQ ID NO: 1123425 - RNA, 22 nt, Human
gugauugcccagcaccauuguu

SEQ ID NO: 1123426 - RNA, 18 nt, Human
aaaugcuaggcuacauga

SEQ ID NO: 1123427 - RNA, 22 nt, Human
agauuucaaugugagcauuagu

SEQ ID NO: 1123428 - RNA, 22 nt, Human
auugaaaguccuaucuaaggga

SEQ ID NO: 1123429 - RNA, 23 nt, Human
uaagaacagacaagcauuuacau

SEQ ID NO: 1123430 - RNA, 22 nt, Human
caguacuugggaaugcugggga

SEQ ID NO: 1123431 - RNA, 18 nt, Human
aggcacagagcauacaua

SEQ ID NO: 1123432 - RNA, 22 nt, Human
ucccagacaaucauuggccacc

SEQ ID NO: 1123433 - RNA, 22 nt, Human
agcagaacugaugagacuugag

SEQ ID NO: 1123434 - RNA, 22 nt, Human
caggggcugagaaggaacgucc

SEQ ID NO: 1123435 - RNA, 22 nt, Human
aaagacuagcauuuauauguac

SEQ ID NO: 1123436 - RNA, 22 nt, Human
cccagcaucccagugggcagca

SEQ ID NO: 1123437 - RNA, 22 nt, Human
aaaugcauguagaauaauagag

SEQ ID NO: 1123438 - RNA, 22 nt, Human
ccucauggaccucagacugucc

SEQ ID NO: 1123439 - RNA, 22 nt, Human
aguccaugguucugacucaucu

SEQ ID NO: 1123440 - RNA, 22 nt, Human
aagauuuacuagcauaauagcu

SEQ ID NO: 1123441 - RNA, 22 nt, Human
cugccugugccaaugcuccuuu

SEQ ID NO: 1123442 - RNA, 22 nt, Human
cagaaguaagauuacugugagu

SEQ ID NO: 1123443 - RNA, 22 nt, Human
aucagcaagauugugucuugua

SEQ ID NO: 1123444 - RNA, 22 nt, Human
uuguggcucgugagauguuagg

SEQ ID NO: 1123445 - RNA, 22 nt, Human
gcagggcugggugggagacaga

SEQ ID NO: 1123446 - RNA, 22 nt, Human
agccuggccugggcaggcacau

SEQ ID NO: 1123447 - RNA, 22 nt, Human
gaggcagagucacaaagagucu

SEQ ID NO: 1123448 - RNA, 22 nt, Human
agcaccuguggcucaugcucgu

SEQ ID NO: 1123449 - RNA, 22 nt, Human
uaugcacauuaucuaauccauu

SEQ ID NO: 1123450 - RNA, 22 nt, Human
uugaaaggugaacaugaugcac

SEQ ID NO: 1123451 - RNA, 22 nt, Human
ugauuuccuggcuuuggaguuc

SEQ ID NO: 1123452 - RNA, 22 nt, Human
cucuuuccucagccacagucua

SEQ ID NO: 1123453 - RNA, 22 nt, Human
gaggcuggcagaaaagcacagg

SEQ ID NO: 1123454 - RNA, 21 nt, Human
gcaggcuggucaaaccucagu

SEQ ID NO: 1123455 - RNA, 22 nt, Human
uagagcugauaaugaggccaag

SEQ ID NO: 1123456 - RNA, 22 nt, Human
agcucccagaguccucugccca

SEQ ID NO: 1123457 - RNA, 19 nt, Human
gagcccucuccauggccac

SEQ ID NO: 1123458 - RNA, 22 nt, Human
ucagcaaugugauacugugcaa

SEQ ID NO: 1123459 - RNA, 22 nt, Human
ucagaacauugacauucuuauu

SEQ ID NO: 1123460 - RNA, 22 nt, Human
acuggagcccguggaggcgcag

SEQ ID NO: 1123461 - RNA, 22 nt, Human
caagagcuggagaggcagucua

SEQ ID NO: 1123462 - RNA, 22 nt, Human
uuugaauaaucacugggcauua

SEQ ID NO: 1123463 - RNA, 22 nt, Human
auucaguucuaaggucagugcc

SEQ ID NO: 1123464 - RNA, 22 nt, Human
agaccacagucaggcuccuggu

SEQ ID NO: 1123465 - RNA, 22 nt, Human
gcuuagucaauuauaaauaggc

SEQ ID NO: 1123466 - RNA, 22 nt, Human
ucauugcaguagggagagaccc

SEQ ID NO: 1123467 - RNA, 22 nt, Human
cugagcugcggcaggcaccugg

SEQ ID NO: 1123468 - RNA, 21 nt, Human
aggcagcucaggcccagagag

SEQ ID NO: 1123469 - RNA, 22 nt, Human
ggcugaaacagauuucaagaca

SEQ ID NO: 1123470 - RNA, 21 nt, Human
agcugcuccagggagcucagg

SEQ ID NO: 1123471 - RNA, 22 nt, Human
uguauguguggauagauguaua

SEQ ID NO: 1123472 - RNA, 22 nt, Human
cagcuuccaucuccacugcccu

SEQ ID NO: 1123473 - RNA, 22 nt, Human
guuagaaagugucugcuugggu

SEQ ID NO: 1123474 - RNA, 22 nt, Human
acagugucuccugguacccagu

SEQ ID NO: 1123475 - RNA, 22 nt, Human
uguaugcagggcuuguaugcag

SEQ ID NO: 1123476 - RNA, 22 nt, Human
cuggagcccugaaugggcagga

SEQ ID NO: 1123477 - RNA, 22 nt, Human
uggggacaggagacuuacagcu

SEQ ID NO: 1123478 - RNA, 22 nt, Human
uauguacaguccuuaacuuaaa

SEQ ID NO: 1123479 - RNA, 22 nt, Human
ugcugcucaaugagaugccauc

SEQ ID NO: 1123480 - RNA, 22 nt, Human
gaaggagacccugaagaugcug

SEQ ID NO: 1123481 - RNA, 22 nt, Human
uugauaaaaugauaucuucuuu

SEQ ID NO: 1123482 - RNA, 22 nt, Human
gccuucccacccugcgaggcug

SEQ ID NO: 1123483 - RNA, 22 nt, Human
gaagcagcuaggaucuucauuu

SEQ ID NO: 1123484 - RNA, 22 nt, Human
ccaggacuuuaaguccagcacu

SEQ ID NO: 1123485 - RNA, 22 nt, Human
gggcaugguggcaggcaccugu

SEQ ID NO: 1123486 - RNA, 22 nt, Human
uucuggaguauuccuggcaccu

SEQ ID NO: 1123487 - RNA, 22 nt, Human
agccagggacgcugcaggcuac

SEQ ID NO: 1123488 - RNA, 22 nt, Human
caggccagguggcaggcaaaac

SEQ ID NO: 1123489 - RNA, 22 nt, Human
gucuugaucuccugaccuugug

SEQ ID NO: 1123490 - RNA, 21 nt, Human
gcaggaugcaucuuggugucu

SEQ ID NO: 1123491 - RNA, 22 nt, Human
uaccugagcccagugcagcaua

SEQ ID NO: 1123492 - RNA, 20 nt, Human
uccagccacuuccgcugguc

SEQ ID NO: 1123493 - RNA, 22 nt, Human
agcugcccccagggcugugcuu

SEQ ID NO: 1123494 - RNA, 22 nt, Human
cuuccucccggcccaugcucug

SEQ ID NO: 1123495 - RNA, 19 nt, Human
gcugcuggcucuggcugga

SEQ ID NO: 1123496 - RNA, 22 nt, Human
acuggcugaaguuuacuuuuug

SEQ ID NO: 1123497 - RNA, 22 nt, Human
acauuucucagggaguuuugcu

SEQ ID NO: 1123498 - RNA, 22 nt, Human
gccugccuucggugcgcagcgg

SEQ ID NO: 1123499 - RNA, 22 nt, Human
gccagcuggagacuggcagggg

SEQ ID NO: 1123500 - RNA, 22 nt, Human
aagaauuauugcaauacuagau

SEQ ID NO: 1123501 - RNA, 22 nt, Human
ugucugguggguugacaggcag

SEQ ID NO: 1123502 - RNA, 22 nt, Human
aaaugcacugaacacauguugu

SEQ ID NO: 1123503 - RNA, 19 nt, Human
ggcucucuuaaagcuguuu

SEQ ID NO: 1123504 - RNA, 22 nt, Human
aaguauauuuuuugaagcauau

SEQ ID NO: 1123505 - RNA, 22 nt, Human
cugagccagggccacacaugga

SEQ ID NO: 1123506 - RNA, 22 nt, Human
agcccaagcauaggagggaggc

SEQ ID NO: 1123507 - RNA, 22 nt, Human
auuucuuuucaagagggugcuu

SEQ ID NO: 1123508 - RNA, 22 nt, Human
ugagccugaguucaaggcugca

SEQ ID NO: 1123509 - RNA, 22 nt, Human
auguuauuuuggaaaauacaaa

SEQ ID NO: 1123510 - RNA, 22 nt, Human
agaggccuccgaaaggugggcu

SEQ ID NO: 1123511 - RNA, 22 nt, Human
gaagcagccacggggagacaga

SEQ ID NO: 1123512 - RNA, 18 nt, Human
cggcagagugcuucuagc

SEQ ID NO: 1123513 - RNA, 22 nt, Human
ggugaaggucuacugugugcca

SEQ ID NO: 1123514 - RNA, 20 nt, Human
acugcuucuuucucugaccu

SEQ ID NO: 1123515 - RNA, 22 nt, Human
cccuucccuucugggagaucca

SEQ ID NO: 1123516 - RNA, 22 nt, Human
gcagagcugggucuguauccaa

SEQ ID NO: 1123517 - RNA, 22 nt, Human
ugccaggcauauggccucuuug

SEQ ID NO: 1123518 - RNA, 22 nt, Human
uaaaugugucuauggacccgcc

SEQ ID NO: 1123519 - RNA, 18 nt, Human
gcagcugcaguuguagcu

SEQ ID NO: 1123520 - RNA, 22 nt, Human
aggcccugcuuuccagagcuca

SEQ ID NO: 1123521 - RNA, 22 nt, Human
uggccuggcagagcaaggccug

SEQ ID NO: 1123522 - RNA, 22 nt, Human
uugagucaguaauuccauuucu

SEQ ID NO: 1123523 - RNA, 22 nt, Human
ggaggccuagccagcuccaguu

SEQ ID NO: 1123524 - RNA, 22 nt, Human
uguucguagcacguaguuucuu

SEQ ID NO: 1123525 - RNA, 22 nt, Human
gggccacacagaaccuccuggu

SEQ ID NO: 1123526 - RNA, 22 nt, Human
uuuugucuaagaacuuugcaaa

SEQ ID NO: 1123527 - RNA, 19 nt, Human
ugucucugaaagaugagcu

SEQ ID NO: 1123528 - RNA, 22 nt, Human
uggggugguaauacaccguucu

SEQ ID NO: 1123529 - RNA, 22 nt, Human
ccuccaggaacuugagagacac

SEQ ID NO: 1123530 - RNA, 22 nt, Human
gccagagcugagugagguucuu

SEQ ID NO: 1123531 - RNA, 22 nt, Human
ucucacucauuuccuaggucuu

SEQ ID NO: 1123532 - RNA, 22 nt, Human
ugaacagaucaauagaacugac

SEQ ID NO: 1123533 - RNA, 22 nt, Human
ugacacagauuagagacauacc

SEQ ID NO: 1123534 - RNA, 22 nt, Human
agcagggcugcagugugucuuu

SEQ ID NO: 1123535 - RNA, 20 nt, Human
uccuugaaagugggguauau

SEQ ID NO: 1123536 - RNA, 22 nt, Human
uccuccaggucuaggguggcuu

SEQ ID NO: 1123537 - RNA, 22 nt, Human
agcacaggaccaaggaagcugu

SEQ ID NO: 1123538 - RNA, 22 nt, Human
ggcuggcuuucucuccgcaccu

SEQ ID NO: 1123539 - RNA, 22 nt, Human
ucagcagauggguuguguuggc

SEQ ID NO: 1123540 - RNA, 21 nt, Human
ugcccacagcaaaugcagagg

SEQ ID NO: 1123541 - RNA, 22 nt, Human
gaagagcugugauucaggcuua

SEQ ID NO: 1123542 - RNA, 22 nt, Human
agggcagccugagugcuggccc

SEQ ID NO: 1123543 - RNA, 22 nt, Human
gugcauguuaaugguguacaaa

SEQ ID NO: 1123544 - RNA, 22 nt, Human
caagagcugugaccucauucac

SEQ ID NO: 1123545 - RNA, 22 nt, Human
ugaaauauuuagagaguaaguu

SEQ ID NO: 1123546 - RNA, 20 nt, Human
gaagcagcuucauguagaca

SEQ ID NO: 1123547 - RNA, 22 nt, Human
ccagagccagagaggugccugc

SEQ ID NO: 1123548 - RNA, 22 nt, Human
uggcacuggaaucguagccuug

SEQ ID NO: 1123549 - RNA, 22 nt, Human
gucacuggggccacaugcagaa

SEQ ID NO: 1123550 - RNA, 18 nt, Human
cucugcuaaugggcagcu

SEQ ID NO: 1123551 - RNA, 20 nt, Human
cugggcagguguuugaucuc

SEQ ID NO: 1123552 - RNA, 22 nt, Human
cacugaguucccugacauuuca

SEQ ID NO: 1123553 - RNA, 22 nt, Human
agcuaggaaauugaggcugaga

SEQ ID NO: 1123554 - RNA, 22 nt, Human
gcucugagagugggugauucug

SEQ ID NO: 1123555 - RNA, 22 nt, Human
caguagcacuagauaugugugg

SEQ ID NO: 1123556 - RNA, 22 nt, Human
ugugccagaaaauaugcugagg

SEQ ID NO: 1123557 - RNA, 20 nt, Human
caguagcaauaauuagaagc

SEQ ID NO: 1123558 - RNA, 22 nt, Human
uagacagauuuaaaggaaugga

SEQ ID NO: 1123559 - RNA, 22 nt, Human
ucugagagucucugaggcagau

SEQ ID NO: 1123560 - RNA, 22 nt, Human
aaaaguguccagauuaugaaga

SEQ ID NO: 1123561 - RNA, 22 nt, Human
uccagggcuuggcugggacggu

SEQ ID NO: 1123562 - RNA, 19 nt, Human
gugaggauacugcucagag

SEQ ID NO: 1123563 - RNA, 22 nt, Human
uguaugcuuuccaaaaaugcug

SEQ ID NO: 1123564 - RNA, 22 nt, Human
uuaucguacgcuucagaaauuu

SEQ ID NO: 1123565 - RNA, 22 nt, Human
cuucccuuggugaacagagcau

SEQ ID NO: 1123566 - RNA, 22 nt, Human
gagcugucucuauaugaaugcu

SEQ ID NO: 1123567 - RNA, 22 nt, Human
gcagaagcugggcagcgaggug

SEQ ID NO: 1123568 - RNA, 22 nt, Human
gaggcaggguguugauuacaga

SEQ ID NO: 1123569 - RNA, 22 nt, Human
ccucucccacguggcagaggcu

SEQ ID NO: 1123570 - RNA, 22 nt, Human
gcucucugucguuaugcuucau

SEQ ID NO: 1123571 - RNA, 22 nt, Human
aucccuggacggcgccucccca

SEQ ID NO: 1123572 - RNA, 22 nt, Human
acaaacuaccuacagauguuca

SEQ ID NO: 1123573 - RNA, 19 nt, Human
caugagcugcucacuuccc

SEQ ID NO: 1123574 - RNA, 22 nt, Human
cuuguacaggaauccaugguau

SEQ ID NO: 1123575 - RNA, 22 nt, Human
aggagagaauguuccaggcuug

SEQ ID NO: 1123576 - RNA, 22 nt, Human
uguguacacaaugauugcagag

SEQ ID NO: 1123577 - RNA, 22 nt, Human
uggccagguguggguucucaga

SEQ ID NO: 1123578 - RNA, 22 nt, Human
ugacacagaaauuaagcuguca

SEQ ID NO: 1123579 - RNA, 22 nt, Human
gccuguccuggaugcucugcaa

SEQ ID NO: 1123580 - RNA, 22 nt, Human
aucagcaagcaugguuaggugu

SEQ ID NO: 1123581 - RNA, 21 nt, Human
aaggcagaagcauggaaugag

SEQ ID NO: 1123582 - RNA, 22 nt, Human
gcagcuggugcaaaugucacuc

SEQ ID NO: 1123583 - RNA, 21 nt, Human
aguucauacugaguaacaaaa

SEQ ID NO: 1123584 - RNA, 22 nt, Human
aggcagaggagaaugaucuucc

SEQ ID NO: 1123585 - RNA, 22 nt, Human
uauguacaugauuucauuugcu

SEQ ID NO: 1123586 - RNA, 21 nt, Human
gcugagagguugggaaguuca

SEQ ID NO: 1123587 - RNA, 22 nt, Human
gcaccuggcugcccagguggag

SEQ ID NO: 1123588 - RNA, 19 nt, Human
acacagggaucagaggguu

SEQ ID NO: 1123589 - RNA, 22 nt, Human
ggcuggucacaccacugcaggg

SEQ ID NO: 1123590 - RNA, 22 nt, Human
gagauguacaauguguauuaau

SEQ ID NO: 1123591 - RNA, 22 nt, Human
cccuccagcucaaagcaaccgg

SEQ ID NO: 1123592 - RNA, 22 nt, Human
uaaaauguagcuucuaggcugg

SEQ ID NO: 1123593 - RNA, 22 nt, Human
uggcagcagggccccuggagga

SEQ ID NO: 1123594 - RNA, 22 nt, Human
gcucccugaaaagaacaaaguc

SEQ ID NO: 1123595 - RNA, 22 nt, Human
gcaggugguccccguggagugg

SEQ ID NO: 1123596 - RNA, 22 nt, Human
guggaggacaaaagaagccuuu

SEQ ID NO: 1123597 - RNA, 22 nt, Human
acuuccugcuaugagcuucugu

SEQ ID NO: 1123598 - RNA, 22 nt, Human
cugggccuuggauugacacugu

SEQ ID NO: 1123599 - RNA, 22 nt, Human
ucugugcucuucucaguaucac

SEQ ID NO: 1123600 - RNA, 19 nt, Human
uggcagggagaguuugaag

SEQ ID NO: 1123601 - RNA, 22 nt, Human
uccucugcuggaagggcaagag

SEQ ID NO: 1123602 - RNA, 23 nt, Human
ugcauuauccucucugaagacca

SEQ ID NO: 1123603 - RNA, 22 nt, Human
cacccaggcagguggcugagaa

SEQ ID NO: 1123604 - RNA, 22 nt, Human
ccugugccauccugagcauccc

SEQ ID NO: 1123605 - RNA, 22 nt, Human
ugagaggccccagcucuuggcc

SEQ ID NO: 1123606 - RNA, 22 nt, Human
gcugucugucucugucccacca

SEQ ID NO: 1123607 - RNA, 22 nt, Human
uuuuuaagcuccuuugauguca

SEQ ID NO: 1123608 - RNA, 22 nt, Human
cccuggaguccuggcaguugau

SEQ ID NO: 1123609 - RNA, 22 nt, Human
gaagagcugacagugucauccu

SEQ ID NO: 1123610 - RNA, 22 nt, Human
acagcugugaaaauccacagga

SEQ ID NO: 1123611 - RNA, 22 nt, Human
uggcagcuugaaugcagucuuu

SEQ ID NO: 1123612 - RNA, 22 nt, Human
gcugucacucaccaggccugca

SEQ ID NO: 1123613 - RNA, 22 nt, Human
caggguggggcuggcuaucaaa

SEQ ID NO: 1123614 - RNA, 19 nt, Human
ccucuccgcccaccagccc

SEQ ID NO: 1123615 - RNA, 22 nt, Human
uguuuugugcacuucuauagca

SEQ ID NO: 1123616 - RNA, 22 nt, Human
gcucugugcaguucagggacac

SEQ ID NO: 1123617 - RNA, 21 nt, Human
cagagcuguccaaacccugac

SEQ ID NO: 1123618 - RNA, 22 nt, Human
gacuguguccaugugcuggauu

SEQ ID NO: 1123619 - RNA, 22 nt, Human
uauuggugggggcagagagaga

SEQ ID NO: 1123620 - RNA, 22 nt, Human
cuggcucucugagauauugagu

SEQ ID NO: 1123621 - RNA, 22 nt, Human
gaggugggaugugugugcuacu

SEQ ID NO: 1123622 - RNA, 20 nt, Human
agugccagggcaggugagag

SEQ ID NO: 1123623 - RNA, 22 nt, Human
guguggcuaccucagaggagca

SEQ ID NO: 1123624 - RNA, 22 nt, Human
agauguguuucuaguuccugca

SEQ ID NO: 1123625 - RNA, 22 nt, Human
gcucccugccuacacggaccuu

SEQ ID NO: 1123626 - RNA, 22 nt, Human
ucagggacauuuagacacugau

SEQ ID NO: 1123627 - RNA, 22 nt, Human
gacagggcgcccagccuguuuc

SEQ ID NO: 1123628 - RNA, 22 nt, Human
agcugccaggccccugagaacc

SEQ ID NO: 1123629 - RNA, 21 nt, Human
aggcacuguuugugguuuggg

SEQ ID NO: 1123630 - RNA, 22 nt, Human
ucccagagcagaugugcuaaag

SEQ ID NO: 1123631 - RNA, 22 nt, Human
uggcucuguugugcugagccag

SEQ ID NO: 1123632 - RNA, 22 nt, Human
uuugacagcuuguuacaaaguu

SEQ ID NO: 1123633 - RNA, 22 nt, Human
ggucucagacuggcaggcagug

SEQ ID NO: 1123634 - RNA, 22 nt, Human
uugacaauguccuuugaauuuc

SEQ ID NO: 1123635 - RNA, 22 nt, Human
aggcccugcccagagcuccucg

SEQ ID NO: 1123636 - RNA, 21 nt, Human
aagagcugucaggaaggcugc

SEQ ID NO: 1123637 - RNA, 21 nt, Human
cugcucugacagugaggccag

SEQ ID NO: 1123638 - RNA, 22 nt, Human
cccucccaggaguggccagaga

SEQ ID NO: 1123639 - RNA, 22 nt, Human
auugucuuuggugcuuccagga

SEQ ID NO: 1123640 - RNA, 22 nt, Human
gugugcaguagagaaagagcag

SEQ ID NO: 1123641 - RNA, 22 nt, Human
accacugggcgggcagccugcu

SEQ ID NO: 1123642 - RNA, 22 nt, Human
agaauucugacaauagaauugg

SEQ ID NO: 1123643 - RNA, 22 nt, Human
gcucugucaacagcuagcugug

SEQ ID NO: 1123644 - RNA, 22 nt, Human
ucagcagggaggcucugugccc

SEQ ID NO: 1123645 - RNA, 22 nt, Human
aggguggagggagucccugagc

SEQ ID NO: 1123646 - RNA, 22 nt, Human
aucuggcuuuuacugaauugcu

SEQ ID NO: 1123647 - RNA, 22 nt, Human
uacaguaaccuuauuugucauu

SEQ ID NO: 1123648 - RNA, 22 nt, Human
aggcucaggcaggaauggcgga

SEQ ID NO: 1123649 - RNA, 17 nt, Human
ugcauuguuggaaauuu

SEQ ID NO: 1123650 - RNA, 22 nt, Human
agaggugacauaggagaggcuc

SEQ ID NO: 1123651 - RNA, 22 nt, Human
ucugucaccauucagcuugaau

SEQ ID NO: 1123652 - RNA, 22 nt, Human
ucccugggccacagcugugagc

SEQ ID NO: 1123653 - RNA, 22 nt, Human
ucuaggagaaccaucagggagg

SEQ ID NO: 1123654 - RNA, 22 nt, Human
ggagcugcauuuagggagccuu

SEQ ID NO: 1123655 - RNA, 22 nt, Human
aagacaagcaucaaaucaggca

SEQ ID NO: 1123656 - RNA, 22 nt, Human
cuggccagcauuuuugcuuuag

SEQ ID NO: 1123657 - RNA, 22 nt, Human
gcccucagaguuccccacagug

SEQ ID NO: 1123658 - RNA, 22 nt, Human
gagucaguaauggauaugucau

SEQ ID NO: 1123659 - RNA, 22 nt, Human
ggcucagguugggucacaugac

SEQ ID NO: 1123660 - RNA, 22 nt, Human
ugcccugucuaagcugucagua

SEQ ID NO: 1123661 - RNA, 22 nt, Human
gcuggagcugaguucccugggc

SEQ ID NO: 1123662 - RNA, 22 nt, Human
ucaaagucacaacucucuaauu

SEQ ID NO: 1123663 - RNA, 22 nt, Human
auggcagcaaaugucuggcugg

SEQ ID NO: 1123664 - RNA, 22 nt, Human
ggcugcagguugguuggcagcu

SEQ ID NO: 1123665 - RNA, 22 nt, Human
aaucaguuucuuggcaaguuua

SEQ ID NO: 1123666 - RNA, 22 nt, Human
ggucccaguccucucccugcua

SEQ ID NO: 1123667 - RNA, 22 nt, Human
ucagguguuagaagaaauuuca

SEQ ID NO: 1123668 - RNA, 22 nt, Human
ggaaggucgagcugcaucuggc

SEQ ID NO: 1123669 - RNA, 22 nt, Human
ggcucuggugaggguaggagau

SEQ ID NO: 1123670 - RNA, 22 nt, Human
ccagcugguguuccuuaggacc

SEQ ID NO: 1123671 - RNA, 22 nt, Human
cuggugucugcucccucacagc

SEQ ID NO: 1123672 - RNA, 22 nt, Human
gcuggaaggcuaggcucaguug

SEQ ID NO: 1123673 - RNA, 22 nt, Human
auuucugauaaacguaagcugc

SEQ ID NO: 1123674 - RNA, 22 nt, Human
uuaauaaaguaugaauuggaaa

SEQ ID NO: 1123675 - RNA, 22 nt, Human
uugggugcugucauggggcacg

SEQ ID NO: 1123676 - RNA, 22 nt, Human
cagcaaaauuugaggauugccu

SEQ ID NO: 1123677 - RNA, 22 nt, Human
uucaaaacagcuagauauugga

SEQ ID NO: 1123678 - RNA, 22 nt, Human
ggggcugguggugguuucucca

SEQ ID NO: 1123679 - RNA, 21 nt, Human
cagaggcagguccugggacgg

SEQ ID NO: 1123680 - RNA, 22 nt, Human
gcauguguggaggagaugugcu

SEQ ID NO: 1123681 - RNA, 22 nt, Human
auuucuucaggucagaaauaga

SEQ ID NO: 1123682 - RNA, 20 nt, Human
agcuggagaagggcccuucc

SEQ ID NO: 1123683 - RNA, 22 nt, Human
aggcagugcagaguccucuucu

SEQ ID NO: 1123684 - RNA, 22 nt, Human
ccaggcuggauuuugcaguuca

SEQ ID NO: 1123685 - RNA, 22 nt, Human
acuggcaguuugagaaugcauu

SEQ ID NO: 1123686 - RNA, 22 nt, Human
gauuucaauccagcuuucuucu

SEQ ID NO: 1123687 - RNA, 22 nt, Human
uauuuuguaauuggucauagcu

SEQ ID NO: 1123688 - RNA, 22 nt, Human
uccuuggcaugccgucuucucc

SEQ ID NO: 1123689 - RNA, 22 nt, Human
auguuuuaaauauguguguaaa

SEQ ID NO: 1123690 - RNA, 22 nt, Human
uuccaaagucauguugcugaua

SEQ ID NO: 1123691 - RNA, 22 nt, Human
agcaggaaagaaaaaucugugu

SEQ ID NO: 1123692 - RNA, 22 nt, Human
cuggagcugucuucacaggccu

SEQ ID NO: 1123693 - RNA, 22 nt, Human
ccagcucugccaagcgucagcu

SEQ ID NO: 1123694 - RNA, 22 nt, Human
augggaggaugcucgggugcuc

SEQ ID NO: 1123695 - RNA, 22 nt, Human
agcuggcauacuuugcuaggaa

SEQ ID NO: 1123696 - RNA, 22 nt, Human
uucuucaaaauccagcaugauu

SEQ ID NO: 1123697 - RNA, 22 nt, Human
auuguaaguagaaauguuaugg

SEQ ID NO: 1123698 - RNA, 22 nt, Human
acaaaugcaaguuuuaugucaa

SEQ ID NO: 1123699 - RNA, 22 nt, Human
acacugaauauacaaugaauau

SEQ ID NO: 1123700 - RNA, 22 nt, Human
cccacucccugcacgccugccg

SEQ ID NO: 1123701 - RNA, 22 nt, Human
ucaguuuugaaaacauugaaug

SEQ ID NO: 1123702 - RNA, 22 nt, Human
cagugccucuuaagugucaccc

SEQ ID NO: 1123703 - RNA, 22 nt, Human
agcagcuggugagcaagcucag

SEQ ID NO: 1123704 - RNA, 22 nt, Human
cagcuggcccuuugguagccuu

SEQ ID NO: 1123705 - RNA, 21 nt, Human
ucccacucuaaauggacugaa

SEQ ID NO: 1123706 - RNA, 22 nt, Human
ugccuggguucccaccccaaag

SEQ ID NO: 1123707 - RNA, 22 nt, Human
cucugucccagacccaccucuc

SEQ ID NO: 1123708 - RNA, 22 nt, Human
acucugccaucccaggugcugu

SEQ ID NO: 1123709 - RNA, 22 nt, Human
cagaaaaccugacucuagaacu

SEQ ID NO: 1123710 - RNA, 22 nt, Human
ccaaaauguuugaaugcaugug

SEQ ID NO: 1123711 - RNA, 22 nt, Human
guaagggauuugaacauagguu

SEQ ID NO: 1123712 - RNA, 19 nt, Human
aagaagcaauaagcuguga

SEQ ID NO: 1123713 - RNA, 22 nt, Human
gagaggccauggcugugcagug

SEQ ID NO: 1123714 - RNA, 18 nt, Human
uggcucuggacuugcucc

SEQ ID NO: 1123715 - RNA, 21 nt, Human
gagcauggcuuacaucagcag

SEQ ID NO: 1123716 - RNA, 22 nt, Human
cugcaggcaucuaacugugggc

SEQ ID NO: 1123717 - RNA, 22 nt, Human
aaaggucaaaaucgugacauug

SEQ ID NO: 1123718 - RNA, 22 nt, Human
acugugcacaauucuaaguccu

SEQ ID NO: 1123719 - RNA, 22 nt, Human
agccauugaguuuuaugugcua

SEQ ID NO: 1123720 - RNA, 22 nt, Human
ggaggccaaggcagguggaucg

SEQ ID NO: 1123721 - RNA, 22 nt, Human
agccugagugcuuaggacuguu

SEQ ID NO: 1123722 - RNA, 22 nt, Human
gucucuggguuaagcagugcau

SEQ ID NO: 1123723 - RNA, 22 nt, Human
aggccugagccccagguuuguu

SEQ ID NO: 1123724 - RNA, 20 nt, Human
cagagccaagagcagcaucu

SEQ ID NO: 1123725 - RNA, 22 nt, Human
gaggccugguagccgagcccca

SEQ ID NO: 1123726 - RNA, 22 nt, Human
ugaaauguuugaagaccacuga

SEQ ID NO: 1123727 - RNA, 22 nt, Human
gcauuauuaauagcugcaugag

SEQ ID NO: 1123728 - RNA, 22 nt, Human
ucccagagcucuggagguugga

SEQ ID NO: 1123729 - RNA, 19 nt, Human
uaugugugcauuugugcau

SEQ ID NO: 1123730 - RNA, 22 nt, Human
agcagccacacgccuccuucuc

SEQ ID NO: 1123731 - RNA, 22 nt, Human
uguaacaguaagccugugagcu

SEQ ID NO: 1123732 - RNA, 22 nt, Human
aauauguucaaaauagaucacu

SEQ ID NO: 1123733 - RNA, 18 nt, Human
cagcagagacauucaaaa

SEQ ID NO: 1123734 - RNA, 22 nt, Human
ucauugcaguugaguuguguua

SEQ ID NO: 1123735 - RNA, 22 nt, Human
ccuggccucuccgaguaaccug

SEQ ID NO: 1123736 - RNA, 22 nt, Human
gcucucugaggugcuggcagag

SEQ ID NO: 1123737 - RNA, 22 nt, Human
agcugggucuugggccaggaga

SEQ ID NO: 1123738 - RNA, 22 nt, Human
acugaaggucucagcaaggaug

SEQ ID NO: 1123739 - RNA, 22 nt, Human
cugcccugccuggccagugugg

SEQ ID NO: 1123740 - RNA, 22 nt, Human
aacaugaaguuuucuauaguga

SEQ ID NO: 1123741 - RNA, 22 nt, Human
gcagccaggaaagcuggacccu

SEQ ID NO: 1123742 - RNA, 22 nt, Human
aaaaguaauugaugcaaucgua

SEQ ID NO: 1123743 - RNA, 22 nt, Human
cugagaggugacagcgugcugg

SEQ ID NO: 1123744 - RNA, 22 nt, Human
cggcagcaaaggaagccagguc

SEQ ID NO: 1123745 - RNA, 22 nt, Human
uuccauaauaggcuuaagugaa

SEQ ID NO: 1123746 - RNA, 22 nt, Human
gcccagcacauugcugaggacc

SEQ ID NO: 1123747 - RNA, 22 nt, Human
ucagggcaaagggcagaguuug

SEQ ID NO: 1123748 - RNA, 22 nt, Human
gagagugaugaaugguuaaaca

SEQ ID NO: 1123749 - RNA, 22 nt, Human
ggcccacuugaaauggagcuca

SEQ ID NO: 1123750 - RNA, 22 nt, Human
aucaguuuuuauuaauguagcu

SEQ ID NO: 1123751 - RNA, 22 nt, Human
uccccagccgugaaggagagga

SEQ ID NO: 1123752 - RNA, 23 nt, Human
uugaaggagaaagcuuucuuggu

SEQ ID NO: 1123753 - RNA, 22 nt, Human
uuuauuccaugugucuaugacc

SEQ ID NO: 1123754 - RNA, 22 nt, Human
aagagcuggaagugaagauaac

SEQ ID NO: 1123755 - RNA, 22 nt, Human
caaaguauauuggauugaaugg

SEQ ID NO: 1123756 - RNA, 22 nt, Human
cucuccagaauaugccgccgug

SEQ ID NO: 1123757 - RNA, 22 nt, Human
gcauuuauuucuuuacugcauc

SEQ ID NO: 1123758 - RNA, 22 nt, Human
ccugagagagaagcgaccuggu

SEQ ID NO: 1123759 - RNA, 22 nt, Human
cagagguacaagcuaaguuggg

SEQ ID NO: 1123760 - RNA, 22 nt, Human
gugugccaacaaaagacagugc

SEQ ID NO: 1123761 - RNA, 22 nt, Human
agccccaguaagggagggccug

SEQ ID NO: 1123762 - RNA, 22 nt, Human
gaagaacacuucaugauucauu

SEQ ID NO: 1123763 - RNA, 21 nt, Human
ccugagccuguuuauccagaa

SEQ ID NO: 1123764 - RNA, 22 nt, Human
ucugccugccagucugguccuc

SEQ ID NO: 1123765 - RNA, 22 nt, Human
cuacuuuaauuuucugcagaga

SEQ ID NO: 1123766 - RNA, 22 nt, Human
cucaggguaaugaaagacgaau

SEQ ID NO: 1123767 - RNA, 22 nt, Human
gucucagauaacauguauucua

SEQ ID NO: 1123768 - RNA, 22 nt, Human
cacauguaguaagcaggcaaug

SEQ ID NO: 1123769 - RNA, 22 nt, Human
caggugcucccagagaagugcu

SEQ ID NO: 1123770 - RNA, 20 nt, Human
cccuccagcaaccaggacuu

SEQ ID NO: 1123771 - RNA, 22 nt, Human
cugggcacauuuugacuagugu

SEQ ID NO: 1123772 - RNA, 22 nt, Human
gaggccugggagccuguccucc

SEQ ID NO: 1123773 - RNA, 22 nt, Human
gcagcagaguuugggagauggu

SEQ ID NO: 1123774 - RNA, 22 nt, Human
aguggcaguagaugagcugguu

SEQ ID NO: 1123775 - RNA, 22 nt, Human
guguccaucagcagccacugug

SEQ ID NO: 1123776 - RNA, 22 nt, Human
uaaaucacuccuaauaaucagu

SEQ ID NO: 1123777 - RNA, 22 nt, Human
gcuugggauaugcugauguaaa

SEQ ID NO: 1123778 - RNA, 22 nt, Human
aaaaucugcuuccuuuuacaga

SEQ ID NO: 1123779 - RNA, 22 nt, Human
gggagcugagggaccucugugg

SEQ ID NO: 1123780 - RNA, 22 nt, Human
ggcagggguccugguguugacu

SEQ ID NO: 1123781 - RNA, 23 nt, Human
acaguuauagcugugaauaacau

SEQ ID NO: 1123782 - RNA, 17 nt, Human
auccccagcaucuagaa

SEQ ID NO: 1123783 - RNA, 22 nt, Human
gugccugggcaugagcuuguug

SEQ ID NO: 1123784 - RNA, 22 nt, Human
gcagcugguuaaugggagaauu

SEQ ID NO: 1123785 - RNA, 23 nt, Human
guggagccacaucacaggcuccu

SEQ ID NO: 1123786 - RNA, 22 nt, Human
gggcugcugccaccagguggau

SEQ ID NO: 1123787 - RNA, 22 nt, Human
uuccaugugaguacacugugau

SEQ ID NO: 1123788 - RNA, 17 nt, Human
ucugggcuucagugguc

SEQ ID NO: 1123789 - RNA, 22 nt, Human
gugcuaggauuacaggcauggg

SEQ ID NO: 1123790 - RNA, 22 nt, Human
cugcucuggcuguguacuucag

SEQ ID NO: 1123791 - RNA, 22 nt, Human
gggagggacacaaagaguuccc

SEQ ID NO: 1123792 - RNA, 22 nt, Human
aacagcaugcuggguaacauug

SEQ ID NO: 1123793 - RNA, 22 nt, Human
ucugccuggaugauggcagggc

SEQ ID NO: 1123794 - RNA, 22 nt, Human
agacaucagcuugugugcaggg

SEQ ID NO: 1123795 - RNA, 22 nt, Human
cucuccuugcagauggcugccu

SEQ ID NO: 1123796 - RNA, 22 nt, Human
gggcaguggcucacgccuguaa

SEQ ID NO: 1123797 - RNA, 22 nt, Human
ccaucagcaugggagcaugggc

SEQ ID NO: 1123798 - RNA, 22 nt, Human
ccucagagguuuucauucugua

SEQ ID NO: 1123799 - RNA, 22 nt, Human
ucagagaaaugaaguagggauu

SEQ ID NO: 1123800 - RNA, 22 nt, Human
uggagcccagggugagaaggag

SEQ ID NO: 1123801 - RNA, 22 nt, Human
ggcagcugugaagugccucaca

SEQ ID NO: 1123802 - RNA, 22 nt, Human
agcaggaaguagucuguaagca

SEQ ID NO: 1123803 - RNA, 22 nt, Human
aucuggcuccuacacuugaaga

SEQ ID NO: 1123804 - RNA, 22 nt, Human
ugucaccucuuuggcugcagcu

SEQ ID NO: 1123805 - RNA, 22 nt, Human
cucuuaguuuaucuuugacaaa

SEQ ID NO: 1123806 - RNA, 22 nt, Human
accucugcuucccggguucaag

SEQ ID NO: 1123807 - RNA, 22 nt, Human
uggcccugcugggucagagcug

SEQ ID NO: 1123808 - RNA, 22 nt, Human
cagcugccccauaaaucacagu

SEQ ID NO: 1123809 - RNA, 22 nt, Human
gugggccuugcagggugcaggg

SEQ ID NO: 1123810 - RNA, 22 nt, Human
uugggaaggcguggaagcagaa

SEQ ID NO: 1123811 - RNA, 18 nt, Human
gugacagcugcuagcuca

SEQ ID NO: 1123812 - RNA, 22 nt, Human
auggcucauuuaucuugcagcc

SEQ ID NO: 1123813 - RNA, 22 nt, Human
ucuguagcaagugagaggcauu

SEQ ID NO: 1123814 - RNA, 22 nt, Human
ugcauuauaacugaauguuguu

SEQ ID NO: 1123815 - RNA, 22 nt, Human
gccagcuggagugagagugggc

SEQ ID NO: 1123816 - RNA, 22 nt, Human
uggcacugagcagccgcggcag

SEQ ID NO: 1123817 - RNA, 22 nt, Human
ugaagcagagaauuugacaguc

SEQ ID NO: 1123818 - RNA, 22 nt, Human
agccacagcgaaccucucuucc

SEQ ID NO: 1123819 - RNA, 22 nt, Human
ccagagccucgcccggagccuc

SEQ ID NO: 1123820 - RNA, 17 nt, Human
ucaggcugugccuggua

SEQ ID NO: 1123821 - RNA, 22 nt, Human
ugucaugcuuauguuacauacu

SEQ ID NO: 1123822 - RNA, 22 nt, Human
acagccugagaguggagcuggc

SEQ ID NO: 1123823 - RNA, 22 nt, Human
uacauuguucaugcaugagaaa

SEQ ID NO: 1123824 - RNA, 22 nt, Human
ccaauguuuuauacagaaguac

SEQ ID NO: 1123825 - RNA, 23 nt, Human
ucacagggcacuggcugggguug

SEQ ID NO: 1123826 - RNA, 17 nt, Human
cuggagccuccaacucc

SEQ ID NO: 1123827 - RNA, 22 nt, Human
uggcgugcccuccagacuuggc

SEQ ID NO: 1123828 - RNA, 22 nt, Human
gaaugcacacgugugugcaugc

SEQ ID NO: 1123829 - RNA, 22 nt, Human
ucaucacucauuggacaacaga

SEQ ID NO: 1123830 - RNA, 22 nt, Human
gcagugcuuuagucuguccuuu

SEQ ID NO: 1123831 - RNA, 22 nt, Human
gucagcagugucagcucugggg

SEQ ID NO: 1123832 - RNA, 22 nt, Human
uggcagaggaggcucagauuga

SEQ ID NO: 1123833 - RNA, 22 nt, Human
cccucagcuucucccugcagcu

SEQ ID NO: 1123834 - RNA, 21 nt, Human
gcacagggacagaucaucaca

SEQ ID NO: 1123835 - RNA, 22 nt, Human
ucagggcacauucugcaguggc

SEQ ID NO: 1123836 - RNA, 21 nt, Human
ucagcagcuuuugcagucccu

SEQ ID NO: 1123837 - RNA, 22 nt, Human
gaaggcuugcagcucuguggca

SEQ ID NO: 1123838 - RNA, 22 nt, Human
gugcauuugacgaauacucacu

SEQ ID NO: 1123839 - RNA, 21 nt, Human
agaaaaguagaguuuucagag

SEQ ID NO: 1123840 - RNA, 22 nt, Human
uacaaaugaguuguaugaacca

SEQ ID NO: 1123841 - RNA, 22 nt, Human
ccuccugggccuugcucuguga

SEQ ID NO: 1123842 - RNA, 22 nt, Human
uauauguaagcuauguaagagu

SEQ ID NO: 1123843 - RNA, 22 nt, Human
ugugugugaguccuggcuuucc

SEQ ID NO: 1123844 - RNA, 22 nt, Human
uuuguaaagucuguucugaguu

SEQ ID NO: 1123845 - RNA, 21 nt, Human
cagaggggcuagccuggcugc

SEQ ID NO: 1123846 - RNA, 19 nt, Human
uggggccuccugucccugg

SEQ ID NO: 1123847 - RNA, 22 nt, Human
uccauuuacuauucucauaucg

SEQ ID NO: 1123848 - RNA, 22 nt, Human
aagggagacaguugugugagga

SEQ ID NO: 1123849 - RNA, 23 nt, Human
agccagggcacugguggagauug

SEQ ID NO: 1123850 - RNA, 18 nt, Human
gccugcaggcacgggggu

SEQ ID NO: 1123851 - RNA, 22 nt, Human
ggguggaguagaaagaugaauu

SEQ ID NO: 1123852 - RNA, 22 nt, Human
aagggcagcuuaaauugguagc

SEQ ID NO: 1123853 - RNA, 22 nt, Human
ucagaacaauugggaaccauua

SEQ ID NO: 1123854 - RNA, 22 nt, Human
ccugagcuggaagagcuugugc

SEQ ID NO: 1123855 - RNA, 22 nt, Human
gcucugagucucagcuaccaca

SEQ ID NO: 1123856 - RNA, 22 nt, Human
ccagagcuccagggcuacagaa

SEQ ID NO: 1123857 - RNA, 22 nt, Human
cauuucugauuacagaauacua

SEQ ID NO: 1123858 - RNA, 22 nt, Human
gcugagagaaaagugagguucu

SEQ ID NO: 1123859 - RNA, 22 nt, Human
agcauuuaguuaguaaauguuu

SEQ ID NO: 1123860 - RNA, 21 nt, Human
ggagggcagcccagacuggcu

SEQ ID NO: 1123861 - RNA, 22 nt, Human
uccuugaagcaacgugcagaca

SEQ ID NO: 1123862 - RNA, 22 nt, Human
aacaaaugaccugauuucuucc

SEQ ID NO: 1123863 - RNA, 22 nt, Human
ugcugucugcaacaguacuaca

SEQ ID NO: 1123864 - RNA, 22 nt, Human
gggagcaggagccugccugcca

SEQ ID NO: 1123865 - RNA, 22 nt, Human
ccagggugggguccaggaacca

SEQ ID NO: 1123866 - RNA, 22 nt, Human
acauuguagacuuuucauaugu

SEQ ID NO: 1123867 - RNA, 22 nt, Human
gugcccaggcccaaggcaccac

SEQ ID NO: 1123868 - RNA, 22 nt, Human
aagaagagaaaugugcugcugg

SEQ ID NO: 1123869 - RNA, 22 nt, Human
gccacaggcacuuaagggcugg

SEQ ID NO: 1123870 - RNA, 22 nt, Human
auccaauggggagugaguucuu

SEQ ID NO: 1123871 - RNA, 22 nt, Human
gcccuggaaucucuccauggga

SEQ ID NO: 1123872 - RNA, 20 nt, Human
caggccucugggggcccugg

SEQ ID NO: 1123873 - RNA, 22 nt, Human
agaaaucauucccaaacccaua

SEQ ID NO: 1123874 - RNA, 22 nt, Human
aguguuccuugcuuucccagag

SEQ ID NO: 1123875 - RNA, 22 nt, Human
acauuuaaauaccuauguuucu

SEQ ID NO: 1123876 - RNA, 22 nt, Human
agauuucccacuccauguauug

SEQ ID NO: 1123877 - RNA, 22 nt, Human
ucccagagugagccaggggcag

SEQ ID NO: 1123878 - RNA, 22 nt, Human
ccucccuuggccauagccagcc

SEQ ID NO: 1123879 - RNA, 22 nt, Human
ccuguguguaggccaggggagu

SEQ ID NO: 1123880 - RNA, 22 nt, Human
cccagcaguuguuggugcacau

SEQ ID NO: 1123881 - RNA, 22 nt, Human
cuugcaggcagggccuccugga

SEQ ID NO: 1123882 - RNA, 22 nt, Human
agagcaggcauaaagcuuugaa

SEQ ID NO: 1123883 - RNA, 22 nt, Human
gagcucugggaaacaaagugua

SEQ ID NO: 1123884 - RNA, 17 nt, Human
agcagcuggcacaggag

SEQ ID NO: 1123885 - RNA, 22 nt, Human
aagccuuggggcuccucuguau

SEQ ID NO: 1123886 - RNA, 22 nt, Human
acagggcaccugagguaggaag

SEQ ID NO: 1123887 - RNA, 22 nt, Human
ggucucagcuggaguccuuggu

SEQ ID NO: 1123888 - RNA, 22 nt, Human
agggcuggccacaugauuuggu

SEQ ID NO: 1123889 - RNA, 22 nt, Human
uucaggagcuggcugcgaagga

SEQ ID NO: 1123890 - RNA, 22 nt, Human
ugggcagacgggagcuugccuu

SEQ ID NO: 1123891 - RNA, 22 nt, Human
aaguucaaggugauaguggcag

SEQ ID NO: 1123892 - RNA, 22 nt, Human
ucauucagguugggcaaguguc

SEQ ID NO: 1123893 - RNA, 22 nt, Human
caguacuuggucaaggaagcag

SEQ ID NO: 1123894 - RNA, 22 nt, Human
aauguauaaaguguuaauaacu

SEQ ID NO: 1123895 - RNA, 22 nt, Human
cucuguccuugcacaguuccua

SEQ ID NO: 1123896 - RNA, 22 nt, Human
ccagcccugccucucagggccc

SEQ ID NO: 1123897 - RNA, 22 nt, Human
cccagcccaucucaaaggucua

SEQ ID NO: 1123898 - RNA, 22 nt, Human
ucccagggucaguggugaggcc

SEQ ID NO: 1123899 - RNA, 22 nt, Human
agcacagguacggagaugcuac

SEQ ID NO: 1123900 - RNA, 22 nt, Human
cucuggccgcagcucagcucug

SEQ ID NO: 1123901 - RNA, 22 nt, Human
uggcucuggggacaguaagucc

SEQ ID NO: 1123902 - RNA, 22 nt, Human
cucaggagacaguguccacaug

SEQ ID NO: 1123903 - RNA, 22 nt, Human
ggccuugguaaagggaugcaug

SEQ ID NO: 1123904 - RNA, 21 nt, Human
gcugccaccgcgugcuccagg

SEQ ID NO: 1123905 - RNA, 22 nt, Human
agagccagcauuugggcccugc

SEQ ID NO: 1123906 - RNA, 20 nt, Human
acuuucucgguuucucaccu

SEQ ID NO: 1123907 - RNA, 22 nt, Human
gcagccaccucccauggcgggg

SEQ ID NO: 1123908 - RNA, 21 nt, Human
ggagucagggucuggcugggg

SEQ ID NO: 1123909 - RNA, 21 nt, Human
gccagccuguuuaccuguggu

SEQ ID NO: 1123910 - RNA, 22 nt, Human
ggcugccuucagacuccagcuu

SEQ ID NO: 1123911 - RNA, 22 nt, Human
aagggcagaauagagaagaugg

SEQ ID NO: 1123912 - RNA, 22 nt, Human
aggcuccuuguucaucauccau

SEQ ID NO: 1123913 - RNA, 22 nt, Human
gucaccagucccagcuccugaa

SEQ ID NO: 1123914 - RNA, 22 nt, Human
agucucagaguaccugagggac

SEQ ID NO: 1123915 - RNA, 22 nt, Human
gcaggcagagaaggaacauuua

SEQ ID NO: 1123916 - RNA, 22 nt, Human
cugcaggaauucaaagugagcu

SEQ ID NO: 1123917 - RNA, 22 nt, Human
cagggccucauccucagagauu

SEQ ID NO: 1123918 - RNA, 22 nt, Human
caggaaagggaugggcugccac

SEQ ID NO: 1123919 - RNA, 21 nt, Human
uaaauaauaaguugcugagau

SEQ ID NO: 1123920 - RNA, 21 nt, Human
agaugcugugcuccaggagca

SEQ ID NO: 1123921 - RNA, 22 nt, Human
uacauuaacuuacguccacaug

SEQ ID NO: 1123922 - RNA, 22 nt, Human
acauuucucuugaugucucuau

SEQ ID NO: 1123923 - RNA, 19 nt, Human
ccaggccaucccaguuccc

SEQ ID NO: 1123924 - RNA, 21 nt, Human
agagaauugccuuagauguuc

SEQ ID NO: 1123925 - RNA, 22 nt, Human
ucaggcugagaaaaucuggacc

SEQ ID NO: 1123926 - RNA, 22 nt, Human
gaacagcuucuugggagcuggg

SEQ ID NO: 1123927 - RNA, 20 nt, Human
ugcagcuucaccugugucau

SEQ ID NO: 1123928 - RNA, 22 nt, Human
ggccucugggguccugagccca

SEQ ID NO: 1123929 - RNA, 22 nt, Human
auguguguauauauagucauuu

SEQ ID NO: 1123930 - RNA, 22 nt, Human
ucaggcuggaaugcaguggggc

SEQ ID NO: 1123931 - RNA, 22 nt, Human
uagaaauguuagauguauugag

SEQ ID NO: 1123932 - RNA, 22 nt, Human
ggagugaguacuggaguagcug

SEQ ID NO: 1123933 - RNA, 22 nt, Human
ucagcagggagaggagaaugca

SEQ ID NO: 1123934 - RNA, 22 nt, Human
ccugggugucaugggcagcugg

SEQ ID NO: 1123935 - RNA, 22 nt, Human
cccucugccugggaccaagucc

SEQ ID NO: 1123936 - RNA, 22 nt, Human
aggcugggaaaccugaaguugu

SEQ ID NO: 1123937 - RNA, 22 nt, Human
uguagcauguaaauugguuauu

SEQ ID NO: 1123938 - RNA, 22 nt, Human
ugggaccaagucauuucuuuag

SEQ ID NO: 1123939 - RNA, 22 nt, Human
cagacacagauaugcauauggc

SEQ ID NO: 1123940 - RNA, 22 nt, Human
caugagauaauuuuucuccagu

SEQ ID NO: 1123941 - RNA, 23 nt, Human
aggcacugaaugugucagugagu

SEQ ID NO: 1123942 - RNA, 22 nt, Human
ugcucuccggcuuccguggccu

SEQ ID NO: 1123943 - RNA, 22 nt, Human
ggagacagugguagggccuaag

SEQ ID NO: 1123944 - RNA, 22 nt, Human
gcugcccucccagggcaagcuu

SEQ ID NO: 1123945 - RNA, 22 nt, Human
caggagugcagguggugaggca

SEQ ID NO: 1123946 - RNA, 22 nt, Human
gcaagcugcuuaagcucauugu

SEQ ID NO: 1123947 - RNA, 22 nt, Human
auuugucuuugagugcccugcu

SEQ ID NO: 1123948 - RNA, 22 nt, Human
gccuggugugcgccgcgcagcu

SEQ ID NO: 1123949 - RNA, 22 nt, Human
guaucuuuugguggaaaaauaa

SEQ ID NO: 1123950 - RNA, 22 nt, Human
cggcagcuccgcgccguaggac

SEQ ID NO: 1123951 - RNA, 22 nt, Human
cuguccccgcgaguccagagcu

SEQ ID NO: 1123952 - RNA, 22 nt, Human
gcucccaccuccagccugaguu

SEQ ID NO: 1123953 - RNA, 22 nt, Human
ccaggugggaggaaagcagaga

SEQ ID NO: 1123954 - RNA, 22 nt, Human
caggagugaguuggggucuaca

SEQ ID NO: 1123955 - RNA, 22 nt, Human
gauuuauuggucuuucauuggu

SEQ ID NO: 1123956 - RNA, 22 nt, Human
aagcuggagaguuaggugaaua

SEQ ID NO: 1123957 - RNA, 23 nt, Human
cccagagcacagccuccagaugc

SEQ ID NO: 1123958 - RNA, 22 nt, Human
auguuacagaaagcaaagauga

SEQ ID NO: 1123959 - RNA, 22 nt, Human
gcuccacuugcagcuaggcuug

SEQ ID NO: 1123960 - RNA, 22 nt, Human
agggucuguggaugcaucuggg

SEQ ID NO: 1123961 - RNA, 22 nt, Human
aagcaauaagccagauuuggau

SEQ ID NO: 1123962 - RNA, 22 nt, Human
ugggagcugggguuggacgucu

SEQ ID NO: 1123963 - RNA, 22 nt, Human
ugugaaagucaaauuaauugaa

SEQ ID NO: 1123964 - RNA, 22 nt, Human
agaagccauguuuaguaggaug

SEQ ID NO: 1123965 - RNA, 22 nt, Human
uguuacacagcagaauagcaag

SEQ ID NO: 1123966 - RNA, 22 nt, Human
ugaaaggugacauuucuuggau

SEQ ID NO: 1123967 - RNA, 22 nt, Human
cacagggcuaaaugaaggguug

SEQ ID NO: 1123968 - RNA, 22 nt, Human
aggagccaagauggggcaagua

SEQ ID NO: 1123969 - RNA, 22 nt, Human
aaggccuggauuuagguuguga

SEQ ID NO: 1123970 - RNA, 22 nt, Human
cacagcuggugcacuagcucug

SEQ ID NO: 1123971 - RNA, 22 nt, Human
cugccuggcuaaacucaagucg

SEQ ID NO: 1123972 - RNA, 18 nt, Human
aaauguacuguccauggc

SEQ ID NO: 1123973 - RNA, 22 nt, Human
aggccuggccccaguugcuagg

SEQ ID NO: 1123974 - RNA, 23 nt, Human
ggccauggagacuuagaaugggc

SEQ ID NO: 1123975 - RNA, 22 nt, Human
aaagcccauguggaaguacagg

SEQ ID NO: 1123976 - RNA, 22 nt, Human
cugccuuugcccuugacacugu

SEQ ID NO: 1123977 - RNA, 22 nt, Human
agcagaugagccucaugacugg

SEQ ID NO: 1123978 - RNA, 22 nt, Human
auuuagaaguuggagggcaaga

SEQ ID NO: 1123979 - RNA, 22 nt, Human
agagccaggugcugcuguuuga

SEQ ID NO: 1123980 - RNA, 21 nt, Human
gagugcaggucugaugccauc

SEQ ID NO: 1123981 - RNA, 22 nt, Human
uggcucucaggccugcugcguu

SEQ ID NO: 1123982 - RNA, 22 nt, Human
uagaaauguugguauuaacauu

SEQ ID NO: 1123983 - RNA, 22 nt, Human
uggcucaggccacuucuuuuau

SEQ ID NO: 1123984 - RNA, 22 nt, Human
agggucaggagacacuggcaac

SEQ ID NO: 1123985 - RNA, 22 nt, Human
agagcugcaggguggacccagg

SEQ ID NO: 1123986 - RNA, 22 nt, Human
agucuucagagaaauuaacucu

SEQ ID NO: 1123987 - RNA, 22 nt, Human
aggcugcuuccuuacguggcug

SEQ ID NO: 1123988 - RNA, 22 nt, Human
uuauaaagauccuuccagaguu

SEQ ID NO: 1123989 - RNA, 22 nt, Human
gcaccugggacccagaggcacc

SEQ ID NO: 1123990 - RNA, 18 nt, Human
uggacaggguggagaaaa

SEQ ID NO: 1123991 - RNA, 22 nt, Human
aagcagugcgcucaucuaaggg

SEQ ID NO: 1123992 - RNA, 20 nt, Human
agauggugaaggccagggag

SEQ ID NO: 1123993 - RNA, 22 nt, Human
gagcuuaggccagggacaggga

SEQ ID NO: 1123994 - RNA, 22 nt, Human
aagugaaacauguaucucuuua

SEQ ID NO: 1123995 - RNA, 22 nt, Human
gccaggcauuuguuaggugcug

SEQ ID NO: 1123996 - RNA, 22 nt, Human
ugaagcaggaaccagcagcauu

SEQ ID NO: 1123997 - RNA, 22 nt, Human
gcaggcaggagcccaacugccu

SEQ ID NO: 1123998 - RNA, 22 nt, Human
uggcagggccuaccccaauauc

SEQ ID NO: 1123999 - RNA, 22 nt, Human
ccugagaggcccucucacuguc

SEQ ID NO: 1124000 - RNA, 22 nt, Human
guggcucuccauugacauggaa

SEQ ID NO: 1124001 - RNA, 22 nt, Human
caaaugaagaaccuucucaccu

SEQ ID NO: 1124002 - RNA, 22 nt, Human
aguucuuuugugaacauaugcu

SEQ ID NO: 1124003 - RNA, 22 nt, Human
gcaggaguguauuugcauguaa

SEQ ID NO: 1124004 - RNA, 22 nt, Human
cccuggagugugacgaggcauu

SEQ ID NO: 1124005 - RNA, 22 nt, Human
gacagggccgcagauggagacu

SEQ ID NO: 1124006 - RNA, 22 nt, Human
aaaugucuuucuucugcuacgu

SEQ ID NO: 1124007 - RNA, 22 nt, Human
ugcugccauggucgcugguguc

SEQ ID NO: 1124008 - RNA, 21 nt, Human
aaguuuguucuuguauagucu

SEQ ID NO: 1124009 - RNA, 22 nt, Human
ugcagaguaaaagcagaugcua

SEQ ID NO: 1124010 - RNA, 21 nt, Human
gccagagcaguacaaugaggu

SEQ ID NO: 1124011 - RNA, 22 nt, Human
uuacaguaugaucaacuuuuca

SEQ ID NO: 1124012 - RNA, 22 nt, Human
cacaggcuccggccuugcagcc

SEQ ID NO: 1124013 - RNA, 22 nt, Human
ucccugggccuccugcuaugca

SEQ ID NO: 1124014 - RNA, 22 nt, Human
ugggagcaagcuggugcuggag

SEQ ID NO: 1124015 - RNA, 22 nt, Human
gggcauggaggucugucugcag

SEQ ID NO: 1124016 - RNA, 22 nt, Human
cugaaggacacgugaggagcca

SEQ ID NO: 1124017 - RNA, 22 nt, Human
accuggcacuacaggcaccugu

SEQ ID NO: 1124018 - RNA, 22 nt, Human
uggcucagcuuacuuuugaggg

SEQ ID NO: 1124019 - RNA, 22 nt, Human
cuggguggaaagugcugagaau

SEQ ID NO: 1124020 - RNA, 22 nt, Human
cccagggaaugacucuggccuu

SEQ ID NO: 1124021 - RNA, 22 nt, Human
uggcagcaaaaccagaaucaga

SEQ ID NO: 1124022 - RNA, 22 nt, Human
uaugcauagguaucuauacuca

SEQ ID NO: 1124023 - RNA, 22 nt, Human
gggcccuggauuuaagcaugga

SEQ ID NO: 1124024 - RNA, 22 nt, Human
gccugagagacccauggggcaa

SEQ ID NO: 1124025 - RNA, 22 nt, Human
uacauguaauuuucauaguaag

SEQ ID NO: 1124026 - RNA, 22 nt, Human
cagcaagauuuuuaaagcaagg

SEQ ID NO: 1124027 - RNA, 22 nt, Human
ucuuuucuggacucugcaugga

SEQ ID NO: 1124028 - RNA, 22 nt, Human
ucuuuuguacucaguauugaca

SEQ ID NO: 1124029 - RNA, 22 nt, Human
gggcugugcugaguaggaggug

SEQ ID NO: 1124030 - RNA, 22 nt, Human
ucaggcaguagaauugcuugaa

SEQ ID NO: 1124031 - RNA, 22 nt, Human
ugaugguuuuauuaauaggacc

SEQ ID NO: 1124032 - RNA, 22 nt, Human
ccuuuuucaauauagaauugca

SEQ ID NO: 1124033 - RNA, 22 nt, Human
gcaggggcuaaggacacagaga

SEQ ID NO: 1124034 - RNA, 22 nt, Human
guagcuuauuagggauaauagu

SEQ ID NO: 1124035 - RNA, 22 nt, Human
agaucaaagccaugagagauuu

SEQ ID NO: 1124036 - RNA, 22 nt, Human
agagucuuccaggcagccugag

SEQ ID NO: 1124037 - RNA, 19 nt, Human
ggaaacaggggccagagga

SEQ ID NO: 1124038 - RNA, 22 nt, Human
cagcccagcacuaaguagauuu

SEQ ID NO: 1124039 - RNA, 22 nt, Human
cucaccaggaacagcugcggag

SEQ ID NO: 1124040 - RNA, 22 nt, Human
acacagggcaaugcuuugaccu

SEQ ID NO: 1124041 - RNA, 22 nt, Human
agcagagcggggccuccggaag

SEQ ID NO: 1124042 - RNA, 22 nt, Human
ugcagugguguccagguguacu

SEQ ID NO: 1124043 - RNA, 22 nt, Human
uacuuuggauccuuacaauagc

SEQ ID NO: 1124044 - RNA, 22 nt, Human
uggcucagccagcccuaggaac

SEQ ID NO: 1124045 - RNA, 22 nt, Human
gcagcuggaagugacacucugu

SEQ ID NO: 1124046 - RNA, 22 nt, Human
caggcagcauuuacucugauga

SEQ ID NO: 1124047 - RNA, 22 nt, Human
ggcccuguuagagcucccacaa

SEQ ID NO: 1124048 - RNA, 22 nt, Human
auuguguaauuuucagcucaua

SEQ ID NO: 1124049 - RNA, 22 nt, Human
ugcagcagguuccaaaggguua

SEQ ID NO: 1124050 - RNA, 22 nt, Human
gcagugccuugcuucucugucu

SEQ ID NO: 1124051 - RNA, 22 nt, Human
cuuccugguuugaagcucgccg

SEQ ID NO: 1124052 - RNA, 22 nt, Human
gcugccaguaguuggagcucca

SEQ ID NO: 1124053 - RNA, 22 nt, Human
cucaggaggugguagaggcccu

SEQ ID NO: 1124054 - RNA, 22 nt, Human
ucccagcagagccagcaagccg

SEQ ID NO: 1124055 - RNA, 20 nt, Human
gccugagcuccgccuccugu

SEQ ID NO: 1124056 - RNA, 22 nt, Human
gggcugcacguauucugcucac

SEQ ID NO: 1124057 - RNA, 22 nt, Human
gaugcagggcuggcaggagcuu

SEQ ID NO: 1124058 - RNA, 22 nt, Human
gaggggcuggguagggcaaccc

SEQ ID NO: 1124059 - RNA, 18 nt, Human
ugucucaggcugaaacag

SEQ ID NO: 1124060 - RNA, 22 nt, Human
gaagccccaaacccucgccauc

SEQ ID NO: 1124061 - RNA, 22 nt, Human
cuccagggcagcauggcagugg

SEQ ID NO: 1124062 - RNA, 22 nt, Human
acucugggccccagguggagcu

SEQ ID NO: 1124063 - RNA, 22 nt, Human
guccucugacucagccuuggga

SEQ ID NO: 1124064 - RNA, 22 nt, Human
uagacacaucaaguauaguuaa

SEQ ID NO: 1124065 - RNA, 22 nt, Human
uggcuagcccuuguggggagag

SEQ ID NO: 1124066 - RNA, 22 nt, Human
cacuacuugaaagaauuacaga

SEQ ID NO: 1124067 - RNA, 22 nt, Human
uggaaggcaacggagugagcug

SEQ ID NO: 1124068 - RNA, 22 nt, Human
agagccugcagcugugaagaaa

SEQ ID NO: 1124069 - RNA, 22 nt, Human
cccagagcuccgguccugccca

SEQ ID NO: 1124070 - RNA, 22 nt, Human
auccuugagccaaugacugauu

SEQ ID NO: 1124071 - RNA, 22 nt, Human
gagcuggcaggaggcuccccga

SEQ ID NO: 1124072 - RNA, 22 nt, Human
cugugcaguaggucagggcugg

SEQ ID NO: 1124073 - RNA, 22 nt, Human
ggcagauggaagaggcuggguc

SEQ ID NO: 1124074 - RNA, 22 nt, Human
ggaggaugagcuacgaggagcu

SEQ ID NO: 1124075 - RNA, 22 nt, Human
cccaggcagagagcuggugagc

SEQ ID NO: 1124076 - RNA, 22 nt, Human
ggaggcugcugccucacguggg

SEQ ID NO: 1124077 - RNA, 21 nt, Human
agcuuguguguaucacagugu

SEQ ID NO: 1124078 - RNA, 22 nt, Human
ggccuuggugccauggccaguu

SEQ ID NO: 1124079 - RNA, 22 nt, Human
aucaguuuguauaugaaacacu

SEQ ID NO: 1124080 - RNA, 22 nt, Human
gauuucaaaaguagauccauca

SEQ ID NO: 1124081 - RNA, 22 nt, Human
acauucuagaagucuuugcaau

SEQ ID NO: 1124082 - RNA, 22 nt, Human
aaagagcuucauuuccauuuau

SEQ ID NO: 1124083 - RNA, 22 nt, Human
cuggcucccguuguccuugaag

SEQ ID NO: 1124084 - RNA, 22 nt, Human
ccaggcugggcuacaaguugag

SEQ ID NO: 1124085 - RNA, 22 nt, Human
gcagggcugcagagggcacugu

SEQ ID NO: 1124086 - RNA, 22 nt, Human
cugcagcuccccugagaucaag

SEQ ID NO: 1124087 - RNA, 22 nt, Human
gcaggcaggcuuccuugaacug

SEQ ID NO: 1124088 - RNA, 22 nt, Human
ccugaggggcugcaggccagcu

SEQ ID NO: 1124089 - RNA, 22 nt, Human
gugucacaagagcccaggaaac

SEQ ID NO: 1124090 - RNA, 22 nt, Human
aguguccccuacagaggcauuc

SEQ ID NO: 1124091 - RNA, 22 nt, Human
aguguuucuggcaaaugaaagu

SEQ ID NO: 1124092 - RNA, 22 nt, Human
auucauucugaccucaagagaa

SEQ ID NO: 1124093 - RNA, 19 nt, Human
ucuggcuccugccaggcug

SEQ ID NO: 1124094 - RNA, 22 nt, Human
ucagggacugcagagggaagcu

SEQ ID NO: 1124095 - RNA, 22 nt, Human
ugggcuguggagcaccuuugca

SEQ ID NO: 1124096 - RNA, 22 nt, Human
ucaugcacaugugucaccauca

SEQ ID NO: 1124097 - RNA, 22 nt, Human
uaaaugugcacuuuacuuuuca

SEQ ID NO: 1124098 - RNA, 22 nt, Human
aucuuucaguuucauaccaauu

SEQ ID NO: 1124099 - RNA, 22 nt, Human
gagcagggccacuucuguaccu

SEQ ID NO: 1124100 - RNA, 22 nt, Human
cagggccuccccggcagucuuu

SEQ ID NO: 1124101 - RNA, 22 nt, Human
caauguuugugaucuacugacu

SEQ ID NO: 1124102 - RNA, 22 nt, Human
aucuggcuuacgaagcacuggu

SEQ ID NO: 1124103 - RNA, 22 nt, Human
gcucucuggaggccauggacag

SEQ ID NO: 1124104 - RNA, 22 nt, Human
aggagaaagacuggacagccaa

SEQ ID NO: 1124105 - RNA, 22 nt, Human
cugcugggaaggucugcucagu

SEQ ID NO: 1124106 - RNA, 22 nt, Human
aaggcccuggcaggaagcagga

SEQ ID NO: 1124107 - RNA, 22 nt, Human
ggguguccugugccaagcuggg

SEQ ID NO: 1124108 - RNA, 22 nt, Human
gcuggccauggggagugaggag

SEQ ID NO: 1124109 - RNA, 22 nt, Human
uuacaaagagugccagagugug

SEQ ID NO: 1124110 - RNA, 22 nt, Human
ucaccagucuuucuuaccauug

SEQ ID NO: 1124111 - RNA, 18 nt, Human
caggucagccuggccuca

SEQ ID NO: 1124112 - RNA, 20 nt, Human
uacugggcaagcccacagac

SEQ ID NO: 1124113 - RNA, 22 nt, Human
agagaauuuuaaaagccuugaa

SEQ ID NO: 1124114 - RNA, 22 nt, Human
cuggcagcagcuucuggaucga

SEQ ID NO: 1124115 - RNA, 23 nt, Human
ucuggcucuaugugacagcucuc

SEQ ID NO: 1124116 - RNA, 21 nt, Human
gggccuggcugcgcaggacgg

SEQ ID NO: 1124117 - RNA, 22 nt, Human
ggccauggaccccgagcugacc

SEQ ID NO: 1124118 - RNA, 22 nt, Human
ugcuccagugagcuggccaucc

SEQ ID NO: 1124119 - RNA, 22 nt, Human
gaguggagcaaaagagguagau

SEQ ID NO: 1124120 - RNA, 22 nt, Human
uaagacaauucuucagucacaa

SEQ ID NO: 1124121 - RNA, 22 nt, Human
ugucuguaagguguuuauguua

SEQ ID NO: 1124122 - RNA, 22 nt, Human
acugaaggaaacuuuuguguuu

SEQ ID NO: 1124123 - RNA, 22 nt, Human
ucuggcuccacucugugcaugc

SEQ ID NO: 1124124 - RNA, 22 nt, Human
gcacaugagcugcugggauggg

SEQ ID NO: 1124125 - RNA, 22 nt, Human
auguuuuauguuccacucaagg

SEQ ID NO: 1124126 - RNA, 22 nt, Human
cccaaggcugcagugagcauga

SEQ ID NO: 1124127 - RNA, 22 nt, Human
agugaaauacugucguuuuuag

SEQ ID NO: 1124128 - RNA, 19 nt, Human
cagaccuguccagccugug

SEQ ID NO: 1124129 - RNA, 22 nt, Human
cagugcaguugguggcaggggu

SEQ ID NO: 1124130 - RNA, 22 nt, Human
gggcugugggacccggcacuuu

SEQ ID NO: 1124131 - RNA, 22 nt, Human
gcuggcuguaucaccuggccag

SEQ ID NO: 1124132 - RNA, 22 nt, Human
uauguguaggaggaggacaggg

SEQ ID NO: 1124133 - RNA, 22 nt, Human
cacagaaguuucauagucucga

SEQ ID NO: 1124134 - RNA, 22 nt, Human
gcugagggcuguaacagcagag

SEQ ID NO: 1124135 - RNA, 23 nt, Human
cccagcagagaugaggagggguc

SEQ ID NO: 1124136 - RNA, 22 nt, Human
gccuggcaaggcccuguugacu

SEQ ID NO: 1124137 - RNA, 20 nt, Human
gauuucaaagcagaguggcc

SEQ ID NO: 1124138 - RNA, 22 nt, Human
cagcucugcugggaggaugcag

SEQ ID NO: 1124139 - RNA, 22 nt, Human
acuuaguauuuuucagcuuuga

SEQ ID NO: 1124140 - RNA, 22 nt, Human
acuguguggaccacucugaggc

SEQ ID NO: 1124141 - RNA, 22 nt, Human
aggcagagagcaguggccgucu

SEQ ID NO: 1124142 - RNA, 22 nt, Human
cuuuggaagugaccacaauccu

SEQ ID NO: 1124143 - RNA, 22 nt, Human
ugucccagguccuagaugacca

SEQ ID NO: 1124144 - RNA, 22 nt, Human
uggaagccaggcccgcuccuaa

SEQ ID NO: 1124145 - RNA, 22 nt, Human
cacugcucgcugcagcauggcc

SEQ ID NO: 1124146 - RNA, 22 nt, Human
uuagcugcauuaucaaaguuau

SEQ ID NO: 1124147 - RNA, 22 nt, Human
ucucucuccuaguuuuuagugg

SEQ ID NO: 1124148 - RNA, 22 nt, Human
uaaagguagugugacauauugu

SEQ ID NO: 1124149 - RNA, 22 nt, Human
caguacuuaguucucaugguuu

SEQ ID NO: 1124150 - RNA, 22 nt, Human
cagccugcccuggaagcccagc

SEQ ID NO: 1124151 - RNA, 22 nt, Human
cccagccugucuuucccaauga

SEQ ID NO: 1124152 - RNA, 18 nt, Human
ccagagcuggcuccucgc

SEQ ID NO: 1124153 - RNA, 22 nt, Human
ccagcccugucaccaacuggag

SEQ ID NO: 1124154 - RNA, 22 nt, Human
gggcuuggcacaugggcucagc

SEQ ID NO: 1124155 - RNA, 22 nt, Human
cagcaauaagccagguuagaca

SEQ ID NO: 1124156 - RNA, 22 nt, Human
ucagaggagccaaaguucugag

SEQ ID NO: 1124157 - RNA, 22 nt, Human
acacaggaagucagcacugaug

SEQ ID NO: 1124158 - RNA, 22 nt, Human
uccaugguuucagucuggcugg

SEQ ID NO: 1124159 - RNA, 22 nt, Human
ugucucaggggcauugaaauaa

SEQ ID NO: 1124160 - RNA, 22 nt, Human
cucuggaauguuuacaugcccu

SEQ ID NO: 1124161 - RNA, 22 nt, Human
caagagcucaccggagagcauu

SEQ ID NO: 1124162 - RNA, 22 nt, Human
gcucaggaccgaggggugggaa

SEQ ID NO: 1124163 - RNA, 22 nt, Human
uaaaaguggauaagcuguagga

SEQ ID NO: 1124164 - RNA, 22 nt, Human
ugggggugugccagggaccucc

SEQ ID NO: 1124165 - RNA, 22 nt, Human
ccagcugauucgguggugguug

SEQ ID NO: 1124166 - RNA, 22 nt, Human
ccaggcucugucuggucagaag

SEQ ID NO: 1124167 - RNA, 22 nt, Human
uuaaacagguuuuugaauggcc

SEQ ID NO: 1124168 - RNA, 22 nt, Human
cagagacauuaagugccaugau

SEQ ID NO: 1124169 - RNA, 22 nt, Human
ggacacagauaaucacacagau

SEQ ID NO: 1124170 - RNA, 22 nt, Human
cacauugaaaugacccaauaau

SEQ ID NO: 1124171 - RNA, 22 nt, Human
acagacagauuuugucugaugu

SEQ ID NO: 1124172 - RNA, 17 nt, Human
cugcuuugugcaacgcu

SEQ ID NO: 1124173 - RNA, 22 nt, Human
gauuucaaggauguuagaggug

SEQ ID NO: 1124174 - RNA, 22 nt, Human
ucacuguaucauguugcacuua

SEQ ID NO: 1124175 - RNA, 22 nt, Human
uggagcagccaugaugacagag

SEQ ID NO: 1124176 - RNA, 22 nt, Human
gagcagcucugggugacccagu

SEQ ID NO: 1124177 - RNA, 22 nt, Human
caaauguguagagcuuuugggg

SEQ ID NO: 1124178 - RNA, 22 nt, Human
guggcugguuuccugcaugcaa

SEQ ID NO: 1124179 - RNA, 22 nt, Human
gcuggcuguuggagguaccugc

SEQ ID NO: 1124180 - RNA, 22 nt, Human
uggcuucugggacuugugagca

SEQ ID NO: 1124181 - RNA, 22 nt, Human
aggcagaaaauagucauccaaa

SEQ ID NO: 1124182 - RNA, 22 nt, Human
uaaaauguguuucuguaugguu

SEQ ID NO: 1124183 - RNA, 22 nt, Human
guucuccauucagcuuccugug

SEQ ID NO: 1124184 - RNA, 22 nt, Human
ugcccaagcagaggagugauuc

SEQ ID NO: 1124185 - RNA, 22 nt, Human
uggcucaggcuugaaaauagau

SEQ ID NO: 1124186 - RNA, 22 nt, Human
caggggcuagcacuuaauguuu

SEQ ID NO: 1124187 - RNA, 22 nt, Human
gcagcugaaagggaucucuaca

SEQ ID NO: 1124188 - RNA, 22 nt, Human
ucagcagaggggaaggcaucug

SEQ ID NO: 1124189 - RNA, 22 nt, Human
guggcucuaggugagcauggag

SEQ ID NO: 1124190 - RNA, 19 nt, Human
gggcuuggggcugaagccu

SEQ ID NO: 1124191 - RNA, 22 nt, Human
gcagggugugucucauacaguu

SEQ ID NO: 1124192 - RNA, 22 nt, Human
ggaggggccggcugccugccac

SEQ ID NO: 1124193 - RNA, 22 nt, Human
caggagugaaaugaggcccagg

SEQ ID NO: 1124194 - RNA, 22 nt, Human
aucagcaagauguaauuucuau

SEQ ID NO: 1124195 - RNA, 22 nt, Human
uguggcugacuccuggucccca

SEQ ID NO: 1124196 - RNA, 21 nt, Human
cagcaaaucauugggcagacu

SEQ ID NO: 1124197 - RNA, 22 nt, Human
cugggcacagcguugggcucuu

SEQ ID NO: 1124198 - RNA, 21 nt, Human
ccugagggugguugugaagau

SEQ ID NO: 1124199 - RNA, 22 nt, Human
gucagaggggcagcugccaggc

SEQ ID NO: 1124200 - RNA, 22 nt, Human
agagugggccucugagucccag

SEQ ID NO: 1124201 - RNA, 22 nt, Human
cagagcugcagauugaaggcau

SEQ ID NO: 1124202 - RNA, 22 nt, Human
gugcucuguguauuaggauguc

SEQ ID NO: 1124203 - RNA, 22 nt, Human
agaaaaggauugauggaucaga

SEQ ID NO: 1124204 - RNA, 22 nt, Human
agccucugcuuaugcaaaggua

SEQ ID NO: 1124205 - RNA, 22 nt, Human
ggacucagcagccaggaguggc

SEQ ID NO: 1124206 - RNA, 22 nt, Human
guuuucuuugaaugcuucuaga

SEQ ID NO: 1124207 - RNA, 22 nt, Human
gcucucuggguggugggcaaca

SEQ ID NO: 1124208 - RNA, 22 nt, Human
ccaagggcucugacuugccugc

SEQ ID NO: 1124209 - RNA, 22 nt, Human
ucucagagaccugaacucccug

SEQ ID NO: 1124210 - RNA, 19 nt, Human
caagugaagccugggaugg

SEQ ID NO: 1124211 - RNA, 22 nt, Human
cugaaggauuagagagcacuua

SEQ ID NO: 1124212 - RNA, 22 nt, Human
ucccagggacaccaagcuguuu

SEQ ID NO: 1124213 - RNA, 22 nt, Human
gcacugaacuuuaaucauuucu

SEQ ID NO: 1124214 - RNA, 22 nt, Human
uggcugggggugcuauagcugc

SEQ ID NO: 1124215 - RNA, 22 nt, Human
auaaggcagucacuggaauguu

SEQ ID NO: 1124216 - RNA, 22 nt, Human
aggcccugcccagugccacaag

SEQ ID NO: 1124217 - RNA, 22 nt, Human
uccuggauucugcccugaaggc

SEQ ID NO: 1124218 - RNA, 22 nt, Human
agggaggagaauggacuccuuc

SEQ ID NO: 1124219 - RNA, 23 nt, Human
uucaagauacgguuuccaggcug

SEQ ID NO: 1124220 - RNA, 22 nt, Human
aguuuuuccugauuuuacagaa

SEQ ID NO: 1124221 - RNA, 22 nt, Human
caggggcuguuugccucaggcc

SEQ ID NO: 1124222 - RNA, 22 nt, Human
agcugccacauggugucacugu

SEQ ID NO: 1124223 - RNA, 22 nt, Human
uuuccuucaucaucugagagcu

SEQ ID NO: 1124224 - RNA, 22 nt, Human
ugcugcacgauaaauaauuucu

SEQ ID NO: 1124225 - RNA, 22 nt, Human
gcacccagaauaaggacaggac

SEQ ID NO: 1124226 - RNA, 22 nt, Human
ccacagggaacaugacagccuu

SEQ ID NO: 1124227 - RNA, 22 nt, Human
cuggccaacuugcuuguuggca

SEQ ID NO: 1124228 - RNA, 22 nt, Human
cagcccuggaacagcugacuca

SEQ ID NO: 1124229 - RNA, 22 nt, Human
gagccuggggacccuccugagu

SEQ ID NO: 1124230 - RNA, 22 nt, Human
gccuccugguugcuucuccaac

SEQ ID NO: 1124231 - RNA, 22 nt, Human
gggagcugagcuggaagagaau

SEQ ID NO: 1124232 - RNA, 19 nt, Human
aggcucugagcuccuggag

SEQ ID NO: 1124233 - RNA, 22 nt, Human
ucucagaggugcccuggcaucu

SEQ ID NO: 1124234 - RNA, 22 nt, Human
cagaggccuauccaguguccau

SEQ ID NO: 1124235 - RNA, 22 nt, Human
uguacaugugucuguauaucuu

SEQ ID NO: 1124236 - RNA, 22 nt, Human
cugcugagguccuugcucagac

SEQ ID NO: 1124237 - RNA, 22 nt, Human
uggcagcagccauggaaggccc

SEQ ID NO: 1124238 - RNA, 22 nt, Human
cagggccauaucuugugcacca

SEQ ID NO: 1124239 - RNA, 22 nt, Human
ucugucaggagauuggcagcug

SEQ ID NO: 1124240 - RNA, 22 nt, Human
caguggcaugguugacugcagu

SEQ ID NO: 1124241 - RNA, 22 nt, Human
uacaaacuuguuuuaaguaagu

SEQ ID NO: 1124242 - RNA, 22 nt, Human
ucccagagaagagcuggaugga

SEQ ID NO: 1124243 - RNA, 22 nt, Human
cugcagccuccugggguacaug

SEQ ID NO: 1124244 - RNA, 19 nt, Human
ucugucacuggggguauuc

SEQ ID NO: 1124245 - RNA, 22 nt, Human
gccaggcuguggggaacuugaa

SEQ ID NO: 1124246 - RNA, 22 nt, Human
aaaaguuuaagacucauucuag

SEQ ID NO: 1124247 - RNA, 22 nt, Human
aagcacagaaaaggagcaugga

SEQ ID NO: 1124248 - RNA, 22 nt, Human
acagaguaucuaucaggaguau

SEQ ID NO: 1124249 - RNA, 22 nt, Human
gcucccacaaccuucuugcucc

SEQ ID NO: 1124250 - RNA, 22 nt, Human
aucuagaaguggcaugaauuac

SEQ ID NO: 1124251 - RNA, 22 nt, Human
agagccuugaagaucuggaaaa

SEQ ID NO: 1124252 - RNA, 23 nt, Human
gcccaugcuguugggcccgagca

SEQ ID NO: 1124253 - RNA, 22 nt, Human
gccacagggcagaugcgcagag

SEQ ID NO: 1124254 - RNA, 22 nt, Human
ugcacacacaugaaguagcaug

SEQ ID NO: 1124255 - RNA, 22 nt, Human
ccucugaguccucccugguugc

SEQ ID NO: 1124256 - RNA, 22 nt, Human
gcuggccauggccugcgccauc

SEQ ID NO: 1124257 - RNA, 22 nt, Human
auucacagggacaaugggagag

SEQ ID NO: 1124258 - RNA, 22 nt, Human
caucacuguccucagcauucca

SEQ ID NO: 1124259 - RNA, 22 nt, Human
ugucccaggccucauguugcca

SEQ ID NO: 1124260 - RNA, 22 nt, Human
uccugccuugccugggacauca

SEQ ID NO: 1124261 - RNA, 22 nt, Human
cagggccuccuaaggcaucuaa

SEQ ID NO: 1124262 - RNA, 23 nt, Human
aguguuccaguugguugagagug

SEQ ID NO: 1124263 - RNA, 22 nt, Human
augucuuucgcaucaguagcua

SEQ ID NO: 1124264 - RNA, 22 nt, Human
ucugagagccucuagccuaagu

SEQ ID NO: 1124265 - RNA, 22 nt, Human
augucuaaaagauaaaguuuaa

SEQ ID NO: 1124266 - RNA, 22 nt, Human
uuccuguauucuaaagggaaag

SEQ ID NO: 1124267 - RNA, 22 nt, Human
cuacauuucccagcugccuucc

SEQ ID NO: 1124268 - RNA, 22 nt, Human
ucagggacuaggugcugccuga

SEQ ID NO: 1124269 - RNA, 22 nt, Human
aggagagagaacacuugggucc

SEQ ID NO: 1124270 - RNA, 22 nt, Human
gccagggagucugggccacaga

SEQ ID NO: 1124271 - RNA, 22 nt, Human
uucaaucauuagaaucucaggc

SEQ ID NO: 1124272 - RNA, 21 nt, Human
uagcacuucgcuguaauuggg

SEQ ID NO: 1124273 - RNA, 22 nt, Human
acuuuguauaagacaauaaaga

SEQ ID NO: 1124274 - RNA, 22 nt, Human
ucuggccaggauggcaagacca

SEQ ID NO: 1124275 - RNA, 22 nt, Human
ucuuuccuuagaauaauucuuu

SEQ ID NO: 1124276 - RNA, 22 nt, Human
gggcaugagagggcagcuggca

SEQ ID NO: 1124277 - RNA, 22 nt, Human
caggcuggagugcaguugugca

SEQ ID NO: 1124278 - RNA, 22 nt, Human
ucugccagugguuuggcccuga

SEQ ID NO: 1124279 - RNA, 22 nt, Human
cauuaucugccauugacaccau

SEQ ID NO: 1124280 - RNA, 22 nt, Human
ccuggcagcagcacaugccuuc

SEQ ID NO: 1124281 - RNA, 22 nt, Human
ucagaaauacuaucagcuuuug

SEQ ID NO: 1124282 - RNA, 22 nt, Human
gccagcccagcuccaggggaaa

SEQ ID NO: 1124283 - RNA, 22 nt, Human
uggggcuguggauucucacgaa

SEQ ID NO: 1124284 - RNA, 22 nt, Human
uggcuccuaggauggugccugg

SEQ ID NO: 1124285 - RNA, 21 nt, Human
gcagccagccgagaccaugcc

SEQ ID NO: 1124286 - RNA, 22 nt, Human
ucuccaagcagggcugcaaggc

SEQ ID NO: 1124287 - RNA, 22 nt, Human
cauuuagaaacuguuuuuaaca

SEQ ID NO: 1124288 - RNA, 22 nt, Human
gauucugagcugguguuuuacg

SEQ ID NO: 1124289 - RNA, 22 nt, Human
ugcuagaauaccuaccuggagg

SEQ ID NO: 1124290 - RNA, 22 nt, Human
ggcuggcucagggcuugagaga

SEQ ID NO: 1124291 - RNA, 22 nt, Human
cucaggauucucgacacucaca

SEQ ID NO: 1124292 - RNA, 22 nt, Human
agagcagcacguuguccccaca

SEQ ID NO: 1124293 - RNA, 22 nt, Human
uccagcagaccaucaaggcuca

SEQ ID NO: 1124294 - RNA, 22 nt, Human
cagcuccugccugggcagcugu

SEQ ID NO: 1124295 - RNA, 20 nt, Human
accauaauguuaauuacaaa

SEQ ID NO: 1124296 - RNA, 22 nt, Human
ucuggagaacuugcaagaggau

SEQ ID NO: 1124297 - RNA, 22 nt, Human
uugaagauggaucgccacucuc

SEQ ID NO: 1124298 - RNA, 22 nt, Human
guggagacgggacagaagcuaa

SEQ ID NO: 1124299 - RNA, 18 nt, Human
gagguccugcucuagccc

SEQ ID NO: 1124300 - RNA, 22 nt, Human
ggcucaggaccugggauugcca

SEQ ID NO: 1124301 - RNA, 22 nt, Human
gcagagccugggggucugcgga

SEQ ID NO: 1124302 - RNA, 22 nt, Human
ggagcauguggggugagcaggg

SEQ ID NO: 1124303 - RNA, 22 nt, Human
cauugcugugggcauuugcugc

SEQ ID NO: 1124304 - RNA, 22 nt, Human
agcugcaguaaagcucuccagg

SEQ ID NO: 1124305 - RNA, 22 nt, Human
cacauuucugugagucaauauu

SEQ ID NO: 1124306 - RNA, 21 nt, Human
ugcaugcuauguuuuuauuuc

SEQ ID NO: 1124307 - RNA, 22 nt, Human
gggagccuugggagugccagcc

SEQ ID NO: 1124308 - RNA, 22 nt, Human
cagcuugggaguuugguuuuau

SEQ ID NO: 1124309 - RNA, 22 nt, Human
gaaggaagucauuagugcagac

SEQ ID NO: 1124310 - RNA, 22 nt, Human
ugccuucaaucaggauggucuc

SEQ ID NO: 1124311 - RNA, 22 nt, Human
auguaucaugcaggguccauga

SEQ ID NO: 1124312 - RNA, 22 nt, Human
acuccuggguugcaguccucaa

SEQ ID NO: 1124313 - RNA, 22 nt, Human
gcuggagccaagcugcucuugg

SEQ ID NO: 1124314 - RNA, 22 nt, Human
cauggaaggcaaaagacacaga

SEQ ID NO: 1124315 - RNA, 22 nt, Human
ccagggcuccauugcucauccu

SEQ ID NO: 1124316 - RNA, 22 nt, Human
uccuucagggggccgccugcac

SEQ ID NO: 1124317 - RNA, 22 nt, Human
ucucagagaggggccgggccuu

SEQ ID NO: 1124318 - RNA, 22 nt, Human
gugcuuaauacaugucaauaac

SEQ ID NO: 1124319 - RNA, 22 nt, Human
uucaaugauuuuuagggaucau

SEQ ID NO: 1124320 - RNA, 22 nt, Human
cucuggacagcaggugcugugg

SEQ ID NO: 1124321 - RNA, 22 nt, Human
cuggcagcauuaacagagagca

SEQ ID NO: 1124322 - RNA, 22 nt, Human
cucuccagaucugcugagccag

SEQ ID NO: 1124323 - RNA, 22 nt, Human
uggccacccagcugacgccuuc

SEQ ID NO: 1124324 - RNA, 22 nt, Human
guggcucucgccagccugcggg

SEQ ID NO: 1124325 - RNA, 22 nt, Human
augaagucugcacaugcaugug

SEQ ID NO: 1124326 - RNA, 22 nt, Human
aaaagggacuacucucagcucc

SEQ ID NO: 1124327 - RNA, 22 nt, Human
guuuguaugaauguuuuaugcu

SEQ ID NO: 1124328 - RNA, 22 nt, Human
aggcagcaugcucugcuucuac

SEQ ID NO: 1124329 - RNA, 22 nt, Human
gcagagcuguuaauggagcuga

SEQ ID NO: 1124330 - RNA, 19 nt, Human
agcaaauauaauaguguuc

SEQ ID NO: 1124331 - RNA, 22 nt, Human
agccagagagccccagguucua

SEQ ID NO: 1124332 - RNA, 22 nt, Human
gcagccacucucauuccacgug

SEQ ID NO: 1124333 - RNA, 22 nt, Human
ucacugaagacugggcucuaaa

SEQ ID NO: 1124334 - RNA, 22 nt, Human
aaaauaucagcaaagggugaca

SEQ ID NO: 1124335 - RNA, 22 nt, Human
gggcuggucuggcuuagucagg

SEQ ID NO: 1124336 - RNA, 22 nt, Human
ugauuucccuguagccucugaa

SEQ ID NO: 1124337 - RNA, 22 nt, Human
guauuuucaagagcaguaguau

SEQ ID NO: 1124338 - RNA, 22 nt, Human
agugugggugagggaggcccuc

SEQ ID NO: 1124339 - RNA, 22 nt, Human
agccuggaggaggaguugagca

SEQ ID NO: 1124340 - RNA, 22 nt, Human
acugcuuuagaccuagagcucu

SEQ ID NO: 1124341 - RNA, 22 nt, Human
acagaauuaucaggaaauguua

SEQ ID NO: 1124342 - RNA, 22 nt, Human
acaaaugcagcauaaagugaac

SEQ ID NO: 1124343 - RNA, 22 nt, Human
cugaaggagaaggccacuguuc

SEQ ID NO: 1124344 - RNA, 22 nt, Human
cuggccgguauuugccucuggg

SEQ ID NO: 1124345 - RNA, 22 nt, Human
cucugggcuuguugaccugcac

SEQ ID NO: 1124346 - RNA, 22 nt, Human
aggcccuggguuagggcccacu

SEQ ID NO: 1124347 - RNA, 22 nt, Human
uggccuggcugcccugucugga

SEQ ID NO: 1124348 - RNA, 22 nt, Human
auggcagccuguggacagucaa

SEQ ID NO: 1124349 - RNA, 22 nt, Human
gucccagggagguucagggcuu

SEQ ID NO: 1124350 - RNA, 22 nt, Human
ucauugcagugauguuguaugu

SEQ ID NO: 1124351 - RNA, 22 nt, Human
ucuccuggucaccucagaaguc

SEQ ID NO: 1124352 - RNA, 22 nt, Human
guggccagcaagugcugccucu

SEQ ID NO: 1124353 - RNA, 20 nt, Human
aggcagagcgcacuuuuaga

SEQ ID NO: 1124354 - RNA, 22 nt, Human
ccucagagccuccagaaggaau

SEQ ID NO: 1124355 - RNA, 22 nt, Human
gugcugcucacaucuggaggua

SEQ ID NO: 1124356 - RNA, 22 nt, Human
acaaagucuuuuacaacaguca

SEQ ID NO: 1124357 - RNA, 22 nt, Human
cuugccuguggcuaguuggcuc

SEQ ID NO: 1124358 - RNA, 22 nt, Human
cacacaggaugaagcagcagaa

SEQ ID NO: 1124359 - RNA, 22 nt, Human
agcaguggaccucagugcuauu

SEQ ID NO: 1124360 - RNA, 22 nt, Human
guguguccucaguaguggcaug

SEQ ID NO: 1124361 - RNA, 22 nt, Human
ucucauucauacccuacaugcu

SEQ ID NO: 1124362 - RNA, 22 nt, Human
ucccagagccucugccacucug

SEQ ID NO: 1124363 - RNA, 22 nt, Human
gcacacaguauaugcucauuaa

SEQ ID NO: 1124364 - RNA, 22 nt, Human
ggugcucaagagggcauccucu

SEQ ID NO: 1124365 - RNA, 22 nt, Human
aaguuugugucagagcuguuac

SEQ ID NO: 1124366 - RNA, 22 nt, Human
cagagcugcacauucuaugaug

SEQ ID NO: 1124367 - RNA, 22 nt, Human
cugggaggcagucucucuagaa

SEQ ID NO: 1124368 - RNA, 22 nt, Human
gaugcacuugccccuccucaga

SEQ ID NO: 1124369 - RNA, 22 nt, Human
ugcuguagcccugcacagugca

SEQ ID NO: 1124370 - RNA, 22 nt, Human
gggagcuguaguccagauaccg

SEQ ID NO: 1124371 - RNA, 22 nt, Human
gccuaggaguacagaaugguuu

SEQ ID NO: 1124372 - RNA, 22 nt, Human
caaggagaaaacggcuucugaa

SEQ ID NO: 1124373 - RNA, 22 nt, Human
accucuggccuucaggcaucau

SEQ ID NO: 1124374 - RNA, 22 nt, Human
caggcagccugagggaucuggg

SEQ ID NO: 1124375 - RNA, 22 nt, Human
uggguagagacacagucugggg

SEQ ID NO: 1124376 - RNA, 22 nt, Human
cuggcucagugccuucagaagu

SEQ ID NO: 1124377 - RNA, 22 nt, Human
uacuguauuugauaagugaagu

SEQ ID NO: 1124378 - RNA, 22 nt, Human
ggcaccuggauguagcagugaa

SEQ ID NO: 1124379 - RNA, 22 nt, Human
uauaucuuauaugugcagguac

SEQ ID NO: 1124380 - RNA, 22 nt, Human
agaauuguaagcaauuugauua

SEQ ID NO: 1124381 - RNA, 22 nt, Human
aggaagccaugguggacgucua

SEQ ID NO: 1124382 - RNA, 22 nt, Human
ugcuauugugaacagugccaca

SEQ ID NO: 1124383 - RNA, 22 nt, Human
cuucaucaacucuaacaaaugu

SEQ ID NO: 1124384 - RNA, 22 nt, Human
cagucacauggaugauggauag

SEQ ID NO: 1124385 - RNA, 22 nt, Human
ugcucagggacaauggagaggg

SEQ ID NO: 1124386 - RNA, 22 nt, Human
uuuaaauaggacuccugggggu

SEQ ID NO: 1124387 - RNA, 22 nt, Human
aacaaauguaaaaugcagaugc

SEQ ID NO: 1124388 - RNA, 22 nt, Human
ugagccagaguggagugugccu

SEQ ID NO: 1124389 - RNA, 22 nt, Human
ccuggugccacuagagaauguc

SEQ ID NO: 1124390 - RNA, 22 nt, Human
gcuuuguguagaaggaggaugg

SEQ ID NO: 1124391 - RNA, 22 nt, Human
cauugaaaccuaacauaggcug

SEQ ID NO: 1124392 - RNA, 23 nt, Human
uggagaugccccacucccugucu

SEQ ID NO: 1124393 - RNA, 22 nt, Human
gcaggggcugcugggaacucgg

SEQ ID NO: 1124394 - RNA, 22 nt, Human
ugccucagaguugucccuacca

SEQ ID NO: 1124395 - RNA, 19 nt, Human
ugaagcagcaaacucucag

SEQ ID NO: 1124396 - RNA, 22 nt, Human
aacauuuaugguagucauugca

SEQ ID NO: 1124397 - RNA, 22 nt, Human
ggaccagagaagugagcaccug

SEQ ID NO: 1124398 - RNA, 22 nt, Human
cucucugcuguauccuuaggcu

SEQ ID NO: 1124399 - RNA, 22 nt, Human
cucaccacagagccuguccagc

SEQ ID NO: 1124400 - RNA, 22 nt, Human
acuuggagagcauugcugggga

SEQ ID NO: 1124401 - RNA, 22 nt, Human
aagucagagcaacugagacauu

SEQ ID NO: 1124402 - RNA, 22 nt, Human
uccugagauaaaucucauguga

SEQ ID NO: 1124403 - RNA, 23 nt, Human
aggcccugccugucccucuuuuu

SEQ ID NO: 1124404 - RNA, 22 nt, Human
aaauguguuccuuugcuacaga

SEQ ID NO: 1124405 - RNA, 22 nt, Human
ugccaggcccugugcuggaugc

SEQ ID NO: 1124406 - RNA, 22 nt, Human
uguaagauauucagcuuauuga

SEQ ID NO: 1124407 - RNA, 22 nt, Human
agugcacagcgugauguauugg

SEQ ID NO: 1124408 - RNA, 22 nt, Human
cuggagaggcugggaacagguu

SEQ ID NO: 1124409 - RNA, 23 nt, Human
gccaggcuccggucuguggccac

SEQ ID NO: 1124410 - RNA, 22 nt, Human
uuugcauugcagugguuuacag

SEQ ID NO: 1124411 - RNA, 22 nt, Human
gggccuguguguucaggagccu

SEQ ID NO: 1124412 - RNA, 19 nt, Human
guggccagggcaggggcug

SEQ ID NO: 1124413 - RNA, 22 nt, Human
auucagcauaaucaguagcuug

SEQ ID NO: 1124414 - RNA, 22 nt, Human
aggccugagguuccugugcuca

SEQ ID NO: 1124415 - RNA, 22 nt, Human
ccugccugcagaaaguaucucc

SEQ ID NO: 1124416 - RNA, 22 nt, Human
guuggccugaauggucaagagg

SEQ ID NO: 1124417 - RNA, 22 nt, Human
ugcagucuuccagcugcacaaa

SEQ ID NO: 1124418 - RNA, 22 nt, Human
caugaagcacagcucucuuuuu

SEQ ID NO: 1124419 - RNA, 22 nt, Human
uggcucagaugcucuuccagug

SEQ ID NO: 1124420 - RNA, 22 nt, Human
agcagggcuucugugccugugc

SEQ ID NO: 1124421 - RNA, 22 nt, Human
agcugguucagaaauuagaugg

SEQ ID NO: 1124422 - RNA, 22 nt, Human
uuccaguuaaggaagcuauucu

SEQ ID NO: 1124423 - RNA, 22 nt, Human
cugugcccuggccaggccucuc

SEQ ID NO: 1124424 - RNA, 22 nt, Human
ggcaggcaggagcgugcuuggg

SEQ ID NO: 1124425 - RNA, 22 nt, Human
uauaaaguuggggcugaaguaa

SEQ ID NO: 1124426 - RNA, 22 nt, Human
guggcagcggcccaggccgucu

SEQ ID NO: 1124427 - RNA, 22 nt, Human
caggcuggaguuaccuuuaggg

SEQ ID NO: 1124428 - RNA, 22 nt, Human
caaagguauucucauuuuggaa

SEQ ID NO: 1124429 - RNA, 22 nt, Human
auguuaaaugguuuauuauuaa

SEQ ID NO: 1124430 - RNA, 22 nt, Human
acagaaugcguagugcauguug

SEQ ID NO: 1124431 - RNA, 22 nt, Human
cacagcuuguuuagugacucac

SEQ ID NO: 1124432 - RNA, 22 nt, Human
uccuucagucuucugagccaua

SEQ ID NO: 1124433 - RNA, 22 nt, Human
uucaacacaggaacaugauaua

SEQ ID NO: 1124434 - RNA, 20 nt, Human
uacagaaacaggacuuuugg

SEQ ID NO: 1124435 - RNA, 22 nt, Human
cugggggcaauggucagagugu

SEQ ID NO: 1124436 - RNA, 22 nt, Human
ccagcagacacacaggcguggg

SEQ ID NO: 1124437 - RNA, 22 nt, Human
auacaguauuaccuguucagga

SEQ ID NO: 1124438 - RNA, 22 nt, Human
caggcagccuucucgucucaca

SEQ ID NO: 1124439 - RNA, 22 nt, Human
aaaucacuaaguuauagugugg

SEQ ID NO: 1124440 - RNA, 22 nt, Human
ggccugagucacaucaggagag

SEQ ID NO: 1124441 - RNA, 22 nt, Human
uccuuucaccaaaaaguguugu

SEQ ID NO: 1124442 - RNA, 22 nt, Human
gaaugcagauggcugguguaug

SEQ ID NO: 1124443 - RNA, 19 nt, Human
gcccugcaggagguggggc

SEQ ID NO: 1124444 - RNA, 22 nt, Human
ucucagagagcuguguuuuccu

SEQ ID NO: 1124445 - RNA, 22 nt, Human
agaggcuccaccuucucugucc

SEQ ID NO: 1124446 - RNA, 22 nt, Human
ggccucuguuuggagccaggau

SEQ ID NO: 1124447 - RNA, 22 nt, Human
gccugccucaaaaucccaguuc

SEQ ID NO: 1124448 - RNA, 22 nt, Human
uucauucauuacgugccaggca

SEQ ID NO: 1124449 - RNA, 23 nt, Human
aaucuggcugauguuuuuucucu

SEQ ID NO: 1124450 - RNA, 20 nt, Human
ugucagugccugaggcacag

SEQ ID NO: 1124451 - RNA, 22 nt, Human
gcugccugauguccagcaggac

SEQ ID NO: 1124452 - RNA, 19 nt, Human
ggcugccuggagcgagggc

SEQ ID NO: 1124453 - RNA, 23 nt, Human
aaaguugauuugcaguuuaagag

SEQ ID NO: 1124454 - RNA, 22 nt, Human
guuugaaaaaagcaguauguaa

SEQ ID NO: 1124455 - RNA, 22 nt, Human
aaggccaugcacauccuaggca

SEQ ID NO: 1124456 - RNA, 22 nt, Human
uuaugcuaaaugaaucaaguca

SEQ ID NO: 1124457 - RNA, 22 nt, Human
ccugccugggcucacuugccag

SEQ ID NO: 1124458 - RNA, 20 nt, Human
cagcugccuggcucugggau

SEQ ID NO: 1124459 - RNA, 22 nt, Human
gcuggccugcgagggcaggcug

SEQ ID NO: 1124460 - RNA, 22 nt, Human
aagccaggcaugcuuggacagu

SEQ ID NO: 1124461 - RNA, 22 nt, Human
uacaguaaccagucuacuuaga

SEQ ID NO: 1124462 - RNA, 22 nt, Human
guaacacagaaaugaaauucca

SEQ ID NO: 1124463 - RNA, 22 nt, Human
auaugugugccauuucagcagu

SEQ ID NO: 1124464 - RNA, 22 nt, Human
aucuuuuacuacaaaucaggug

SEQ ID NO: 1124465 - RNA, 22 nt, Human
ccugcagguugcagaggcggaa

SEQ ID NO: 1124466 - RNA, 22 nt, Human
ucauggcacuuagcacaguccu

SEQ ID NO: 1124467 - RNA, 22 nt, Human
cugucucuguugccuguaggug

SEQ ID NO: 1124468 - RNA, 22 nt, Human
ucaugcccagagcaguaaauua

SEQ ID NO: 1124469 - RNA, 22 nt, Human
cuguccuguggaccugaggacg

SEQ ID NO: 1124470 - RNA, 23 nt, Human
ucccagccucuucucuugcauac

SEQ ID NO: 1124471 - RNA, 23 nt, Human
agggcugaugccauugcagcucu

SEQ ID NO: 1124472 - RNA, 22 nt, Human
ucuguuccauguuuuguuccau

SEQ ID NO: 1124473 - RNA, 22 nt, Human
auuuaucaccaguuagcugacu

SEQ ID NO: 1124474 - RNA, 22 nt, Human
ggcucuggagcacagacgucug

SEQ ID NO: 1124475 - RNA, 22 nt, Human
uuuuccuaguaggccuauuaga

SEQ ID NO: 1124476 - RNA, 21 nt, Human
ugcagcugacacugguaugcc

SEQ ID NO: 1124477 - RNA, 22 nt, Human
ugggguggauagaaagugaugu

SEQ ID NO: 1124478 - RNA, 22 nt, Human
aaggcacuagcaagcugccugg

SEQ ID NO: 1124479 - RNA, 22 nt, Human
caagagcuacccugugccauau

SEQ ID NO: 1124480 - RNA, 22 nt, Human
ugagccagauaagggcucacgc

SEQ ID NO: 1124481 - RNA, 22 nt, Human
cucugggcaaguaugauagaaa

SEQ ID NO: 1124482 - RNA, 22 nt, Human
gccuggagugguccugcugccc

SEQ ID NO: 1124483 - RNA, 22 nt, Human
cacaccuguaauaccagcuacu

SEQ ID NO: 1124484 - RNA, 22 nt, Human
gagcacagcuggagguagcauu

SEQ ID NO: 1124485 - RNA, 22 nt, Human
cugcccugagggccuguguguu

SEQ ID NO: 1124486 - RNA, 22 nt, Human
cacagugcaugaugggcagaag

SEQ ID NO: 1124487 - RNA, 22 nt, Human
ugggccugaguuugggaacugg

SEQ ID NO: 1124488 - RNA, 22 nt, Human
ucucagagugguggucccucug

SEQ ID NO: 1124489 - RNA, 22 nt, Human
agccuguggaucccugcacugg

SEQ ID NO: 1124490 - RNA, 22 nt, Human
gagaaagauguaggcugggagg

SEQ ID NO: 1124491 - RNA, 22 nt, Human
gccagagcagaauagaguggcc

SEQ ID NO: 1124492 - RNA, 22 nt, Human
uugaagcagagaaauacuugaa

SEQ ID NO: 1124493 - RNA, 19 nt, Human
uccuuugaauaucaguuga

SEQ ID NO: 1124494 - RNA, 22 nt, Human
cacugaagccugggaguaagac

SEQ ID NO: 1124495 - RNA, 22 nt, Human
acagcaggauuuggcgauguug

SEQ ID NO: 1124496 - RNA, 18 nt, Human
aggcccuggccucgaaca

SEQ ID NO: 1124497 - RNA, 19 nt, Human
uggcagcauugguaccuug

SEQ ID NO: 1124498 - RNA, 22 nt, Human
ucacaugcucaccuaagccaca

SEQ ID NO: 1124499 - RNA, 22 nt, Human
gagcucauucauucauugccug

SEQ ID NO: 1124500 - RNA, 22 nt, Human
gggcuggaucuccugcaggcag

SEQ ID NO: 1124501 - RNA, 22 nt, Human
uccagggacacagaguccuucu

SEQ ID NO: 1124502 - RNA, 22 nt, Human
gcagagugggagcccagggcug

SEQ ID NO: 1124503 - RNA, 22 nt, Human
ugcagagggacagccacagcuc

SEQ ID NO: 1124504 - RNA, 22 nt, Human
agcagagccaggucucucugua

SEQ ID NO: 1124505 - RNA, 22 nt, Human
ccaggcagccaagugugugugu

SEQ ID NO: 1124506 - RNA, 19 nt, Human
ugaaggagggggauggcca

SEQ ID NO: 1124507 - RNA, 22 nt, Human
uuguccuuaccucaaucuggaa

SEQ ID NO: 1124508 - RNA, 22 nt, Human
gcagagaaaguuuuguccucag

SEQ ID NO: 1124509 - RNA, 23 nt, Human
uuucauaugguguggaugaagaa

SEQ ID NO: 1124510 - RNA, 22 nt, Human
gaggcugccccuuccucagcug

SEQ ID NO: 1124511 - RNA, 22 nt, Human
gcaggagagccagcaggcuucc

SEQ ID NO: 1124512 - RNA, 23 nt, Human
auaagccuuuucuuucugcccca

SEQ ID NO: 1124513 - RNA, 21 nt, Human
ugcagcagaguaagcagggga

SEQ ID NO: 1124514 - RNA, 22 nt, Human
gcuggagcugcagccugggccu

SEQ ID NO: 1124515 - RNA, 22 nt, Human
uccagccuaauguucuucccac

SEQ ID NO: 1124516 - RNA, 22 nt, Human
uggccacagccucugccaguuc

SEQ ID NO: 1124517 - RNA, 22 nt, Human
aaaguucagauuagacucaaga

SEQ ID NO: 1124518 - RNA, 22 nt, Human
agcagcugaucaaagcacuuau

SEQ ID NO: 1124519 - RNA, 22 nt, Human
aguguuucucagaagggccuau

SEQ ID NO: 1124520 - RNA, 22 nt, Human
aacagcagggggaccugcuggu

SEQ ID NO: 1124521 - RNA, 22 nt, Human
agcugguucauucauucauggu

SEQ ID NO: 1124522 - RNA, 22 nt, Human
uggcuggggccugaauccugca

SEQ ID NO: 1124523 - RNA, 22 nt, Human
caagaacaguuugccaaauugg

SEQ ID NO: 1124524 - RNA, 22 nt, Human
gggcucuggaaggugcaccaug

SEQ ID NO: 1124525 - RNA, 22 nt, Human
uguccucuaauuggccucuugc

SEQ ID NO: 1124526 - RNA, 22 nt, Human
cagcccuggugccaagguuccc

SEQ ID NO: 1124527 - RNA, 22 nt, Human
ggcccucccugagccagguggg

SEQ ID NO: 1124528 - RNA, 22 nt, Human
uuacuuuguucucaagauaugu

SEQ ID NO: 1124529 - RNA, 20 nt, Human
uauauuuucucuuuggccuu

SEQ ID NO: 1124530 - RNA, 22 nt, Human
ucugugacuugcgggaggagaa

SEQ ID NO: 1124531 - RNA, 22 nt, Human
ugcacccucaucagucaaaugg

SEQ ID NO: 1124532 - RNA, 22 nt, Human
gcagauggugccaugucuugug

SEQ ID NO: 1124533 - RNA, 22 nt, Human
gcaguggcuaagcucgcaugca

SEQ ID NO: 1124534 - RNA, 22 nt, Human
uauccuuguacuauaguauuua

SEQ ID NO: 1124535 - RNA, 22 nt, Human
agggcagcagcuccuccuagcu

SEQ ID NO: 1124536 - RNA, 22 nt, Human
aaaaauguuaucuacuguccga

SEQ ID NO: 1124537 - RNA, 22 nt, Human
gcauaauauacaugcuugaucc

SEQ ID NO: 1124538 - RNA, 22 nt, Human
aaguuucauguggagguagacu

SEQ ID NO: 1124539 - RNA, 22 nt, Human
guggagccaggggcuguaggua

SEQ ID NO: 1124540 - RNA, 22 nt, Human
cacuucaauuaacuucagcauu

SEQ ID NO: 1124541 - RNA, 22 nt, Human
cauguacaaaaggcaaaugccu

SEQ ID NO: 1124542 - RNA, 22 nt, Human
gagcuggugaucagcuggagga

SEQ ID NO: 1124543 - RNA, 22 nt, Human
caagagcucccagaccugggca

SEQ ID NO: 1124544 - RNA, 22 nt, Human
ucugccuugagguccucagcuc

SEQ ID NO: 1124545 - RNA, 22 nt, Human
cugggcaguuuuacaucauugc

SEQ ID NO: 1124546 - RNA, 22 nt, Human
ucucagaguuuuuuuccaggac

SEQ ID NO: 1124547 - RNA, 22 nt, Human
agccacaggaaacagagacagc

SEQ ID NO: 1124548 - RNA, 19 nt, Human
uggcuuccaucucucucau

SEQ ID NO: 1124549 - RNA, 22 nt, Human
cugcccugacugaccuuuugaa

SEQ ID NO: 1124550 - RNA, 22 nt, Human
gguggccucucaugcaagguag

SEQ ID NO: 1124551 - RNA, 22 nt, Human
gagcagagacaguacaacuggc

SEQ ID NO: 1124552 - RNA, 17 nt, Human
uguuccauuugaccacc

SEQ ID NO: 1124553 - RNA, 22 nt, Human
agcuggaggggccagcaggugu

SEQ ID NO: 1124554 - RNA, 22 nt, Human
agggacacaugugauuauuuau

SEQ ID NO: 1124555 - RNA, 22 nt, Human
ccagggucuuggagaggagugc

SEQ ID NO: 1124556 - RNA, 22 nt, Human
acagggcagguggcuacugguc

SEQ ID NO: 1124557 - RNA, 22 nt, Human
ggggacccucaggacugcgucu

SEQ ID NO: 1124558 - RNA, 22 nt, Human
ccugggcaggaugggcccggug

SEQ ID NO: 1124559 - RNA, 22 nt, Human
cagcuggggcagccacgugcgg

SEQ ID NO: 1124560 - RNA, 22 nt, Human
ccugccagugaagcugacgggc

SEQ ID NO: 1124561 - RNA, 22 nt, Human
agcaccugcacaguggaggaaa

SEQ ID NO: 1124562 - RNA, 22 nt, Human
ugugccagccucuggcuguguc

SEQ ID NO: 1124563 - RNA, 22 nt, Human
uaaauucuacaacuucaaagau

SEQ ID NO: 1124564 - RNA, 22 nt, Human
uucaagaugcacaguggcauuc

SEQ ID NO: 1124565 - RNA, 22 nt, Human
ccagcccugaacccugcugcau

SEQ ID NO: 1124566 - RNA, 22 nt, Human
ugacuucaaaggcucuacuccu

SEQ ID NO: 1124567 - RNA, 22 nt, Human
cagaguguuucuuugggugggu

SEQ ID NO: 1124568 - RNA, 22 nt, Human
acuuucucccacccacccgucu

SEQ ID NO: 1124569 - RNA, 22 nt, Human
gcugccucugcgacucugggcg

SEQ ID NO: 1124570 - RNA, 17 nt, Human
ggcugcugugcuggugc

SEQ ID NO: 1124571 - RNA, 22 nt, Human
ccagggcaacgcugucucagag

SEQ ID NO: 1124572 - RNA, 22 nt, Human
gagcucagcacuaaaaucaugu

SEQ ID NO: 1124573 - RNA, 22 nt, Human
ggagagagaugccgccuugcuc

SEQ ID NO: 1124574 - RNA, 22 nt, Human
gcucugaggcugugaggugcug

SEQ ID NO: 1124575 - RNA, 22 nt, Human
ugcaggagcagagauggcugga

SEQ ID NO: 1124576 - RNA, 22 nt, Human
ucuggcagggguucugcacuug

SEQ ID NO: 1124577 - RNA, 22 nt, Human
cauuccuuaacguggggagucu

SEQ ID NO: 1124578 - RNA, 22 nt, Human
guccucuggaagaugaguucuu

SEQ ID NO: 1124579 - RNA, 22 nt, Human
acuggcucagaguuccuagaga

SEQ ID NO: 1124580 - RNA, 22 nt, Human
cugagcugggaguagagacucu

SEQ ID NO: 1124581 - RNA, 22 nt, Human
acucagaguuugcguuccauac

SEQ ID NO: 1124582 - RNA, 22 nt, Human
gagcagaacuacucacauaucg

SEQ ID NO: 1124583 - RNA, 22 nt, Human
aggugcugccccgagaaggaug

SEQ ID NO: 1124584 - RNA, 22 nt, Human
uucacagggccacuggcaggag

SEQ ID NO: 1124585 - RNA, 22 nt, Human
caguggccaugguggcaggggu

SEQ ID NO: 1124586 - RNA, 22 nt, Human
ggcaggugugagaucgaggcca

SEQ ID NO: 1124587 - RNA, 22 nt, Human
acagggucaagggugcuacaag

SEQ ID NO: 1124588 - RNA, 22 nt, Human
aggcugggaaauguagucuucc

SEQ ID NO: 1124589 - RNA, 22 nt, Human
uagcuuuaccauagaagaguau

SEQ ID NO: 1124590 - RNA, 22 nt, Human
acuuugcaaugggcagaaccca

SEQ ID NO: 1124591 - RNA, 22 nt, Human
caguaugagaguugaaucaagg

SEQ ID NO: 1124592 - RNA, 22 nt, Human
caaaugugguuucucagcauuc

SEQ ID NO: 1124593 - RNA, 22 nt, Human
uaugcacacaucgcagcaggaa

SEQ ID NO: 1124594 - RNA, 22 nt, Human
acugucuguccugcucuccgug

SEQ ID NO: 1124595 - RNA, 22 nt, Human
ucacugcucucuaagcaucgcc

SEQ ID NO: 1124596 - RNA, 22 nt, Human
agaaauguggaucguuuuaaaa

SEQ ID NO: 1124597 - RNA, 22 nt, Human
uuucagugcuucuguuuaccgg

SEQ ID NO: 1124598 - RNA, 22 nt, Human
gcccagcacagcuggaagaguc

SEQ ID NO: 1124599 - RNA, 22 nt, Human
gcuuccucgcugggcagaggca

SEQ ID NO: 1124600 - RNA, 22 nt, Human
uugcauguuauuuaaucuguau

SEQ ID NO: 1124601 - RNA, 22 nt, Human
caagaaauguuuacugagcauc

SEQ ID NO: 1124602 - RNA, 22 nt, Human
uccaggagguuuggaggaagca

SEQ ID NO: 1124603 - RNA, 22 nt, Human
gccugccuuugugaggaagcgg

SEQ ID NO: 1124604 - RNA, 22 nt, Human
ccuaagaauuaaugaauacacc

SEQ ID NO: 1124605 - RNA, 22 nt, Human
auaaacagcuccauuuagugcc

SEQ ID NO: 1124606 - RNA, 19 nt, Human
ucucacaucagcuccuagc

SEQ ID NO: 1124607 - RNA, 22 nt, Human
agcagcauucucugguaugggg

SEQ ID NO: 1124608 - RNA, 22 nt, Human
uugcucuguaauaaucuggggu

SEQ ID NO: 1124609 - RNA, 22 nt, Human
uccugagauucugcauuucuaa

SEQ ID NO: 1124610 - RNA, 22 nt, Human
gccugagagucugcauuucuaa

SEQ ID NO: 1124611 - RNA, 22 nt, Human
gguggagcuguggacaggaagg

SEQ ID NO: 1124612 - RNA, 22 nt, Human
ggcuuauauugcucuauucaca

SEQ ID NO: 1124613 - RNA, 22 nt, Human
ugcugccuuugggaccuggccu

SEQ ID NO: 1124614 - RNA, 18 nt, Human
ccuggcagccaugcgcgc

SEQ ID NO: 1124615 - RNA, 22 nt, Human
gagaggucaucucccaucagca

SEQ ID NO: 1124616 - RNA, 22 nt, Human
cuucuggggauggagcccagaa

SEQ ID NO: 1124617 - RNA, 22 nt, Human
cagaaauggaauuuuccaucac

SEQ ID NO: 1124618 - RNA, 22 nt, Human
agcugauuccacuuuuucccca

SEQ ID NO: 1124619 - RNA, 17 nt, Human
accagccucuccugggg

SEQ ID NO: 1124620 - RNA, 22 nt, Human
uggagaugaauauguguaccug

SEQ ID NO: 1124621 - RNA, 19 nt, Human
ugaagcaauaccauuuuug

SEQ ID NO: 1124622 - RNA, 19 nt, Human
cagcugccuuuucuuugca

SEQ ID NO: 1124623 - RNA, 20 nt, Human
cuucaggacccauccucccc

SEQ ID NO: 1124624 - RNA, 22 nt, Human
uaucuguuccaggcacucagcu

SEQ ID NO: 1124625 - RNA, 22 nt, Human
gcugucaguuuuacccacagac

SEQ ID NO: 1124626 - RNA, 22 nt, Human
aaggccaugaccacuugcugug

SEQ ID NO: 1124627 - RNA, 22 nt, Human
cagcuucucagaaagcugaggu

SEQ ID NO: 1124628 - RNA, 22 nt, Human
uucucuucaucucaguaaaugu

SEQ ID NO: 1124629 - RNA, 22 nt, Human
auauauuuuuugagacagaguc

SEQ ID NO: 1124630 - RNA, 22 nt, Human
cugagggcccugaagcuuggca

SEQ ID NO: 1124631 - RNA, 22 nt, Human
cuccugagcucugaggaagcuu

SEQ ID NO: 1124632 - RNA, 22 nt, Human
cucuccagccacagaagcugcu

SEQ ID NO: 1124633 - RNA, 21 nt, Human
gcucccuggcugugugaccug

SEQ ID NO: 1124634 - RNA, 22 nt, Human
ggcuucuguccucuggaucugu

SEQ ID NO: 1124635 - RNA, 22 nt, Human
guacucucuugaaggccuuucu

SEQ ID NO: 1124636 - RNA, 21 nt, Human
cacucaggguaugugccaggc

SEQ ID NO: 1124637 - RNA, 22 nt, Human
uguggcucucagauccuccaau

SEQ ID NO: 1124638 - RNA, 22 nt, Human
gggcugggauugcuugcuguga

SEQ ID NO: 1124639 - RNA, 22 nt, Human
uugggcugaaguagagggcaga

SEQ ID NO: 1124640 - RNA, 22 nt, Human
uuuuccucugcagagcaguuag

SEQ ID NO: 1124641 - RNA, 22 nt, Human
acugugugcccugacgccaggg

SEQ ID NO: 1124642 - RNA, 22 nt, Human
cucccuggaggugagcuggcac

SEQ ID NO: 1124643 - RNA, 22 nt, Human
uggcugcucaagggaggaggcu

SEQ ID NO: 1124644 - RNA, 22 nt, Human
ccugggagagccaucuguggcc

SEQ ID NO: 1124645 - RNA, 22 nt, Human
agcagcuuacauguggccuauc

SEQ ID NO: 1124646 - RNA, 22 nt, Human
cggcuggggcuguccccaugac

SEQ ID NO: 1124647 - RNA, 23 nt, Human
ggccuccuggucuaggcuagacu

SEQ ID NO: 1124648 - RNA, 22 nt, Human
gcaguggcuaggagucuggcgu

SEQ ID NO: 1124649 - RNA, 21 nt, Human
cacaggugggucagugaggcc

SEQ ID NO: 1124650 - RNA, 22 nt, Human
gacccugccaugagugacaggg

SEQ ID NO: 1124651 - RNA, 22 nt, Human
gcaaggcagcgcggaguagcua

SEQ ID NO: 1124652 - RNA, 22 nt, Human
ucuuccucucuaauugaucaga

SEQ ID NO: 1124653 - RNA, 22 nt, Human
gccucugcucggacuuugccuc

SEQ ID NO: 1124654 - RNA, 22 nt, Human
ggggccugcgagguucaacuuc

SEQ ID NO: 1124655 - RNA, 17 nt, Human
ccucacagggaccagac

SEQ ID NO: 1124656 - RNA, 19 nt, Human
guuuuucccagacgaggca

SEQ ID NO: 1124657 - RNA, 22 nt, Human
gauggguggucucagacuugcc

SEQ ID NO: 1124658 - RNA, 22 nt, Human
gcagccacuaguuuuccuguuu

SEQ ID NO: 1124659 - RNA, 22 nt, Human
cagggguggcugcagcagaggu

SEQ ID NO: 1124660 - RNA, 22 nt, Human
gagccagguuugaaucucaguc

SEQ ID NO: 1124661 - RNA, 22 nt, Human
gugucauggaaaauugcaaugg

SEQ ID NO: 1124662 - RNA, 22 nt, Human
uuguuuuggagaugagcuaaaa

SEQ ID NO: 1124663 - RNA, 22 nt, Human
uggaggagggcuggugucugua

SEQ ID NO: 1124664 - RNA, 22 nt, Human
uuuauuugucuugccauuuagu

SEQ ID NO: 1124665 - RNA, 22 nt, Human
aaggaaagacauauaaaugacu

SEQ ID NO: 1124666 - RNA, 19 nt, Human
ccugcagggaugagagguu

SEQ ID NO: 1124667 - RNA, 23 nt, Human
acuuuagauaaauuaugugcaca

SEQ ID NO: 1124668 - RNA, 22 nt, Human
uacauugugauguuucaauaca

SEQ ID NO: 1124669 - RNA, 22 nt, Human
caaaguuuaaaguagauuucag

SEQ ID NO: 1124670 - RNA, 22 nt, Human
ugcagcucauugcuggggucug

SEQ ID NO: 1124671 - RNA, 20 nt, Human
uaggcagagcugugcagccu

SEQ ID NO: 1124672 - RNA, 22 nt, Human
agcagggcaaagucaggcuaac

SEQ ID NO: 1124673 - RNA, 22 nt, Human
aguuucuaccgguacauucagg

SEQ ID NO: 1124674 - RNA, 22 nt, Human
ucaguuuucaauuucaucagag

SEQ ID NO: 1124675 - RNA, 22 nt, Human
ccaaaguccacaguuuacauua

SEQ ID NO: 1124676 - RNA, 22 nt, Human
aggcuggggaauugaauuugcu

SEQ ID NO: 1124677 - RNA, 21 nt, Human
cgggcuggccgggcccucacc

SEQ ID NO: 1124678 - RNA, 22 nt, Human
ucugagaggcagaccuuccuaa

SEQ ID NO: 1124679 - RNA, 22 nt, Human
gugcauuuggugacucucaccc

SEQ ID NO: 1124680 - RNA, 22 nt, Human
ggaugcuggggaccaaucucug

SEQ ID NO: 1124681 - RNA, 22 nt, Human
acccagaggcggagguugcagu

SEQ ID NO: 1124682 - RNA, 22 nt, Human
caguggcgugaucucugcucac

SEQ ID NO: 1124683 - RNA, 22 nt, Human
ugggcagcagcaaagccagacu

SEQ ID NO: 1124684 - RNA, 22 nt, Human
ugucaguguauacauacaguau

SEQ ID NO: 1124685 - RNA, 18 nt, Human
gagaggcccggcugugcc

SEQ ID NO: 1124686 - RNA, 22 nt, Human
aaaaguaauugcaauuuuguag

SEQ ID NO: 1124687 - RNA, 22 nt, Human
cacagaauuaagggagaaauau

SEQ ID NO: 1124688 - RNA, 22 nt, Human
ucuggcucccuggagcuccaca

SEQ ID NO: 1124689 - RNA, 22 nt, Human
gccuuuuuuguugcucugucac

SEQ ID NO: 1124690 - RNA, 22 nt, Human
ugcagcuucuccaucuccuugu

SEQ ID NO: 1124691 - RNA, 20 nt, Human
uccagggcuagggagcucau

SEQ ID NO: 1124692 - RNA, 22 nt, Human
ugcuuuuaagaacaaugcugcu

SEQ ID NO: 1124693 - RNA, 22 nt, Human
ugugacaucgcugugucuguuu

SEQ ID NO: 1124694 - RNA, 22 nt, Human
ugagcuuacgugggaacagacu

SEQ ID NO: 1124695 - RNA, 22 nt, Human
cagcucugugggagcguaugug

SEQ ID NO: 1124696 - RNA, 22 nt, Human
uggcagcuggagggcaauggcc

SEQ ID NO: 1124697 - RNA, 22 nt, Human
uuuccucugcugccauugcccc

SEQ ID NO: 1124698 - RNA, 22 nt, Human
agcuuccuacaaccaucucaga

SEQ ID NO: 1124699 - RNA, 21 nt, Human
gugucaugguugacuuuggca

SEQ ID NO: 1124700 - RNA, 22 nt, Human
agcaggugaauuccuggaugug

SEQ ID NO: 1124701 - RNA, 22 nt, Human
agaaaagggcaggagggauaca

SEQ ID NO: 1124702 - RNA, 22 nt, Human
ccagcugaggcagccacacagg

SEQ ID NO: 1124703 - RNA, 22 nt, Human
cagcugaguuuccaagucugcc

SEQ ID NO: 1124704 - RNA, 21 nt, Human
ugcaggcaggcagagaugcug

SEQ ID NO: 1124705 - RNA, 22 nt, Human
agucucugagguucagaugccu

SEQ ID NO: 1124706 - RNA, 22 nt, Human
agaaaugcucuuccugaccaga

SEQ ID NO: 1124707 - RNA, 17 nt, Human
ucagagggaugagcagg

SEQ ID NO: 1124708 - RNA, 22 nt, Human
gccagacacuccccugggcagg

SEQ ID NO: 1124709 - RNA, 20 nt, Human
accccagccccucuaucuga

SEQ ID NO: 1124710 - RNA, 22 nt, Human
acugcaggagacacagcugcug

SEQ ID NO: 1124711 - RNA, 22 nt, Human
uaugugaauacagcaguggaug

SEQ ID NO: 1124712 - RNA, 21 nt, Human
uccauuguuuucccaggguuu

SEQ ID NO: 1124713 - RNA, 20 nt, Human
cugccaugauugauagagug

SEQ ID NO: 1124714 - RNA, 19 nt, Human
uagucuuuauucuuaauuu

SEQ ID NO: 1124715 - RNA, 22 nt, Human
ugaagcaggugaauggaugucg

SEQ ID NO: 1124716 - RNA, 22 nt, Human
ugaaggagcucaaugaugaugc

SEQ ID NO: 1124717 - RNA, 19 nt, Human
augucccaccgccccugag

SEQ ID NO: 1124718 - RNA, 22 nt, Human
gggacuggaguagaggccggug

SEQ ID NO: 1124719 - RNA, 22 nt, Human
uaagauaugguaggaaguuugg

SEQ ID NO: 1124720 - RNA, 22 nt, Human
uauguacaaucagcaguucaua

SEQ ID NO: 1124721 - RNA, 22 nt, Human
gagagcuguaauagucaugucu

SEQ ID NO: 1124722 - RNA, 22 nt, Human
uguagaaagaauauguuucaua

SEQ ID NO: 1124723 - RNA, 21 nt, Human
aaauguguuccauaaugcuuu

SEQ ID NO: 1124724 - RNA, 22 nt, Human
agcucacaguguccuuccucaa

SEQ ID NO: 1124725 - RNA, 22 nt, Human
cugcccuggucccauggcugau

SEQ ID NO: 1124726 - RNA, 22 nt, Human
ugcuggcccaguauggacugca

SEQ ID NO: 1124727 - RNA, 20 nt, Human
ggcugugcccuuccguggcc

SEQ ID NO: 1124728 - RNA, 22 nt, Human
ucugcagcuugcacaggcaggc

SEQ ID NO: 1124729 - RNA, 22 nt, Human
auguaacaggugaagcucugag

SEQ ID NO: 1124730 - RNA, 22 nt, Human
ugggcacaaacaucugccuguu

SEQ ID NO: 1124731 - RNA, 22 nt, Human
agcagcauagaagcugggagga

SEQ ID NO: 1124732 - RNA, 21 nt, Human
gcugucucuggcuccugggaa

SEQ ID NO: 1124733 - RNA, 22 nt, Human
cagggccauuggcguggcuguc

SEQ ID NO: 1124734 - RNA, 20 nt, Human
cagcaguggaugagaguuuu

SEQ ID NO: 1124735 - RNA, 22 nt, Human
cugcagugcaagcccagaugga

SEQ ID NO: 1124736 - RNA, 22 nt, Human
auugucuucuggucuuaucuuu

SEQ ID NO: 1124737 - RNA, 22 nt, Human
uggcugcuuguuuuagugaggc

SEQ ID NO: 1124738 - RNA, 22 nt, Human
gcccugucggaacugcgaccuc

SEQ ID NO: 1124739 - RNA, 19 nt, Human
ucccuuccugucgggcucc

SEQ ID NO: 1124740 - RNA, 21 nt, Human
agcuggugucagagcucuggg

SEQ ID NO: 1124741 - RNA, 22 nt, Human
cuccuuccugccccagugauaa

SEQ ID NO: 1124742 - RNA, 22 nt, Human
aaggagagguuguccguguugu

SEQ ID NO: 1124743 - RNA, 22 nt, Human
uaagaacauuuucggaaagaua

SEQ ID NO: 1124744 - RNA, 22 nt, Human
ggagacaguauggcuuguagcu

SEQ ID NO: 1124745 - RNA, 22 nt, Human
ccaucuccacugucccugucaa

SEQ ID NO: 1124746 - RNA, 22 nt, Human
uagcugucaccagaaauggcca

SEQ ID NO: 1124747 - RNA, 22 nt, Human
acacccagagcgccagugccga

SEQ ID NO: 1124748 - RNA, 20 nt, Human
aaaauauguauaacucuucu

SEQ ID NO: 1124749 - RNA, 22 nt, Human
gaggcugcuuugaugacaggag

SEQ ID NO: 1124750 - RNA, 22 nt, Human
aaguuugucgaaauuaucagca

SEQ ID NO: 1124751 - RNA, 21 nt, Human
acaugucucuaaucucaguga

SEQ ID NO: 1124752 - RNA, 22 nt, Human
cccagcccugaccuauuggaaa

SEQ ID NO: 1124753 - RNA, 17 nt, Human
uuagcaaaauagcacuu

SEQ ID NO: 1124754 - RNA, 22 nt, Human
ucaguuuuuguuugccagauag

SEQ ID NO: 1124755 - RNA, 22 nt, Human
gagugugucggucagcguggcg

SEQ ID NO: 1124756 - RNA, 22 nt, Human
uaacagaaguuguucauugugg

SEQ ID NO: 1124757 - RNA, 22 nt, Human
gagucccaugaugauagccaca

SEQ ID NO: 1124758 - RNA, 22 nt, Human
cauuugaugacucaacucauaa

SEQ ID NO: 1124759 - RNA, 19 nt, Human
agccuggcuuugcucugcu

SEQ ID NO: 1124760 - RNA, 17 nt, Human
uuccuggaagucauucc

SEQ ID NO: 1124761 - RNA, 23 nt, Human
uggccucuccccaccuggcagaa

SEQ ID NO: 1124762 - RNA, 22 nt, Human
cagagccugcucacgucucugu

SEQ ID NO: 1124763 - RNA, 22 nt, Human
caggcagcugaggacuuugcua

SEQ ID NO: 1124764 - RNA, 22 nt, Human
gcacagggcugccaggcggcuu

SEQ ID NO: 1124765 - RNA, 22 nt, Human
ggugcccaccugucuuccugga

SEQ ID NO: 1124766 - RNA, 20 nt, Human
aagggcagagggaacagacu

SEQ ID NO: 1124767 - RNA, 22 nt, Human
ggagagaaauugagguagcaag

SEQ ID NO: 1124768 - RNA, 22 nt, Human
ucagcagucacauguuguccca

SEQ ID NO: 1124769 - RNA, 22 nt, Human
agcccuagagcuggaggucagu

SEQ ID NO: 1124770 - RNA, 22 nt, Human
uuccuguauuuugcgaauuuuc

SEQ ID NO: 1124771 - RNA, 22 nt, Human
cucucaggcuugggucguggca

SEQ ID NO: 1124772 - RNA, 22 nt, Human
gagggggagaugugcacacacu

SEQ ID NO: 1124773 - RNA, 22 nt, Human
ugaucagucccaugaucuucca

SEQ ID NO: 1124774 - RNA, 18 nt, Human
aaggcuucaaagaguaga

SEQ ID NO: 1124775 - RNA, 22 nt, Human
gcugcagcaagcccuccagggg

SEQ ID NO: 1124776 - RNA, 22 nt, Human
acagcuguggccacuugcaucc

SEQ ID NO: 1124777 - RNA, 23 nt, Human
agucucagcuggaaacauguguc

SEQ ID NO: 1124778 - RNA, 22 nt, Human
ccaggccuuccaguacgcagaa

SEQ ID NO: 1124779 - RNA, 22 nt, Human
gggcagaggggcgcuucccucu

SEQ ID NO: 1124780 - RNA, 22 nt, Human
cauucugugauucuaaaucccu

SEQ ID NO: 1124781 - RNA, 22 nt, Human
gccuugccucagccauggaaac

SEQ ID NO: 1124782 - RNA, 22 nt, Human
cugaggccucucuccugggcuu

SEQ ID NO: 1124783 - RNA, 22 nt, Human
gcagcguggggcugagucagcu

SEQ ID NO: 1124784 - RNA, 22 nt, Human
aggccugaaggaagaugagcug

SEQ ID NO: 1124785 - RNA, 22 nt, Human
uuaugcuaagugcaacaagcca

SEQ ID NO: 1124786 - RNA, 22 nt, Human
ucaggggaaaucucucagcgaa

SEQ ID NO: 1124787 - RNA, 22 nt, Human
gcuuccuaaaugcacagggcag

SEQ ID NO: 1124788 - RNA, 21 nt, Human
gagcucucaggcaagaagcag

SEQ ID NO: 1124789 - RNA, 22 nt, Human
cagcaggcugcgauugcucauu

SEQ ID NO: 1124790 - RNA, 22 nt, Human
agggugccuggaagccacucac

SEQ ID NO: 1124791 - RNA, 22 nt, Human
aguggcaggaaaguggaagaga

SEQ ID NO: 1124792 - RNA, 22 nt, Human
auguacaaaaugccacugaauu

SEQ ID NO: 1124793 - RNA, 22 nt, Human
ugcagcauucuuggccacuacu

SEQ ID NO: 1124794 - RNA, 22 nt, Human
gggaaauugucaacacucucaa

SEQ ID NO: 1124795 - RNA, 22 nt, Human
gguggguauaguuagggccucu

SEQ ID NO: 1124796 - RNA, 22 nt, Human
uggagggcaugcuguccauggg

SEQ ID NO: 1124797 - RNA, 22 nt, Human
gcucugggugaacuuggagcaa

SEQ ID NO: 1124798 - RNA, 22 nt, Human
agagugggugaucucuguuguc

SEQ ID NO: 1124799 - RNA, 22 nt, Human
ucugucuccugccagugccucu

SEQ ID NO: 1124800 - RNA, 18 nt, Human
uucagcagcagacacacu

SEQ ID NO: 1124801 - RNA, 22 nt, Human
uuagaaacccagacucuuaggu

SEQ ID NO: 1124802 - RNA, 22 nt, Human
cacugcauggaugauggcugua

SEQ ID NO: 1124803 - RNA, 22 nt, Human
uuaggaaauuaugguuucagau

SEQ ID NO: 1124804 - RNA, 22 nt, Human
ucagagcuuaucucuugcugga

SEQ ID NO: 1124805 - RNA, 22 nt, Human
gaaaaaugcuccaaaucugugg

SEQ ID NO: 1124806 - RNA, 22 nt, Human
ggucccaggaaucuguguucua

SEQ ID NO: 1124807 - RNA, 21 nt, Human
uccuuccuugagguccuuucc

SEQ ID NO: 1124808 - RNA, 22 nt, Human
uggccugguuguugcugccguu

SEQ ID NO: 1124809 - RNA, 22 nt, Human
gugcagggcuggcaccggaggc

SEQ ID NO: 1124810 - RNA, 22 nt, Human
uuuccuuccagguuccuaaggc

SEQ ID NO: 1124811 - RNA, 22 nt, Human
cugagcccaggcgggagcugag

SEQ ID NO: 1124812 - RNA, 20 nt, Human
cagaaggucuaagcuuuaga

SEQ ID NO: 1124813 - RNA, 22 nt, Human
cagcccagcagggucuggcccu

SEQ ID NO: 1124814 - RNA, 18 nt, Human
gguggccuugacuucucu

SEQ ID NO: 1124815 - RNA, 22 nt, Human
ugucauuuaguccucugugugu

SEQ ID NO: 1124816 - RNA, 22 nt, Human
gagagugagauccuccugggga

SEQ ID NO: 1124817 - RNA, 22 nt, Human
ugggaggcuuccagaccuugcu

SEQ ID NO: 1124818 - RNA, 22 nt, Human
ccagagccggcucccucagcuu

SEQ ID NO: 1124819 - RNA, 22 nt, Human
gcugccugguuucucagcugca

SEQ ID NO: 1124820 - RNA, 22 nt, Human
ucaggcacugcuuucugauaug

SEQ ID NO: 1124821 - RNA, 22 nt, Human
ggccagggccuggggacugucc

SEQ ID NO: 1124822 - RNA, 22 nt, Human
guuacacaggaaaacauuagca

SEQ ID NO: 1124823 - RNA, 22 nt, Human
aguagaaagaaggcacugggcc

SEQ ID NO: 1124824 - RNA, 22 nt, Human
auaauccaugucuagaguaaag

SEQ ID NO: 1124825 - RNA, 22 nt, Human
auguagcaucuauccugauaaa

SEQ ID NO: 1124826 - RNA, 22 nt, Human
ccccagcucagugcagggacau

SEQ ID NO: 1124827 - RNA, 22 nt, Human
ugcucuguaaggucagaaaagg

SEQ ID NO: 1124828 - RNA, 22 nt, Human
gcuggugcauuagcugcaguuc

SEQ ID NO: 1124829 - RNA, 22 nt, Human
ucucagagagaugaaacuucca

SEQ ID NO: 1124830 - RNA, 20 nt, Human
cccugagaccagagagcagc

SEQ ID NO: 1124831 - RNA, 22 nt, Human
ugugugcagccucugucuuugg

SEQ ID NO: 1124832 - RNA, 22 nt, Human
gguggcagucuuaagagaucuu

SEQ ID NO: 1124833 - RNA, 19 nt, Human
agggagaauuccaagagga

SEQ ID NO: 1124834 - RNA, 22 nt, Human
aagaaaagaaaccugaggcuuu

SEQ ID NO: 1124835 - RNA, 22 nt, Human
gcagagcaguacucucuugacu

SEQ ID NO: 1124836 - RNA, 16 nt, Human
ccuuucucugccuucc

SEQ ID NO: 1124837 - RNA, 22 nt, Human
uagggcaggggaggaaucugaa

SEQ ID NO: 1124838 - RNA, 22 nt, Human
cagagguagaaggcaugcagug

SEQ ID NO: 1124839 - RNA, 22 nt, Human
agagaaaacucauugagguguc

SEQ ID NO: 1124840 - RNA, 22 nt, Human
aguggcagaagucacuggguag

SEQ ID NO: 1124841 - RNA, 22 nt, Human
ccagggcagggaccacgugucu

SEQ ID NO: 1124842 - RNA, 22 nt, Human
cuggugugauugagcccaggug

SEQ ID NO: 1124843 - RNA, 22 nt, Human
cuggccuuuagccccagugucu

SEQ ID NO: 1124844 - RNA, 22 nt, Human
agcagccacagucugggacagg

SEQ ID NO: 1124845 - RNA, 22 nt, Human
caagagcauuuaguuagcuggu

SEQ ID NO: 1124846 - RNA, 22 nt, Human
agcugccaaguuucucaguuua

SEQ ID NO: 1124847 - RNA, 22 nt, Human
ggccucugguucacagggagga

SEQ ID NO: 1124848 - RNA, 22 nt, Human
ggcucuggaaaguguccuugau

SEQ ID NO: 1124849 - RNA, 22 nt, Human
aagauuucuuacuuauugaugc

SEQ ID NO: 1124850 - RNA, 22 nt, Human
uuuccucuuauacaguguuuau

SEQ ID NO: 1124851 - RNA, 22 nt, Human
ugcaauaaguuguguuaucacu

SEQ ID NO: 1124852 - RNA, 22 nt, Human
aagccagccagugccagucuua

SEQ ID NO: 1124853 - RNA, 22 nt, Human
ucugucuccucugaggugccag

SEQ ID NO: 1124854 - RNA, 22 nt, Human
gggcaugguggugcacaccugu

SEQ ID NO: 1124855 - RNA, 22 nt, Human
uaccuugggguuuuguugcucu

SEQ ID NO: 1124856 - RNA, 22 nt, Human
aggcuggaguacaguggcuauu

SEQ ID NO: 1124857 - RNA, 22 nt, Human
aaaugcauuuuuaauuagaccc

SEQ ID NO: 1124858 - RNA, 22 nt, Human
ggcccagcugugcuuccagccc

SEQ ID NO: 1124859 - RNA, 22 nt, Human
ccaccagcuuugccacccugcu

SEQ ID NO: 1124860 - RNA, 22 nt, Human
agcagagcgccugcucagaggg

SEQ ID NO: 1124861 - RNA, 19 nt, Human
uacauuuguguacacuugu

SEQ ID NO: 1124862 - RNA, 22 nt, Human
ucucuggccgagagucccuggg

SEQ ID NO: 1124863 - RNA, 22 nt, Human
agcugggaggugggcagugaga

SEQ ID NO: 1124864 - RNA, 22 nt, Human
uggcucaguuaggucagaaaca

SEQ ID NO: 1124865 - RNA, 22 nt, Human
cuccaggagcugugucuuucuu

SEQ ID NO: 1124866 - RNA, 22 nt, Human
agggauggaagcucgucugcaa

SEQ ID NO: 1124867 - RNA, 18 nt, Human
uggugaaggguggaggag

SEQ ID NO: 1124868 - RNA, 22 nt, Human
cuggcucuaucuccaaggcugg

SEQ ID NO: 1124869 - RNA, 22 nt, Human
ucucagagggaggauuacugcc

SEQ ID NO: 1124870 - RNA, 22 nt, Human
uguaggaguccaaucaggagac

SEQ ID NO: 1124871 - RNA, 22 nt, Human
agagcagagggcucugggacaa

SEQ ID NO: 1124872 - RNA, 22 nt, Human
caguacuuuucaaccaguauga

SEQ ID NO: 1124873 - RNA, 22 nt, Human
ucauugaauuucacagcuuuau

SEQ ID NO: 1124874 - RNA, 22 nt, Human
auucuccacacauccagaccuu

SEQ ID NO: 1124875 - RNA, 22 nt, Human
ggcuuccuggggccuccugcaa

SEQ ID NO: 1124876 - RNA, 22 nt, Human
ucacaucuuauuagaguaucuc

SEQ ID NO: 1124877 - RNA, 22 nt, Human
uccagcagguccgagacaaguu

SEQ ID NO: 1124878 - RNA, 22 nt, Human
cuuaacagagagaaguguugcu

SEQ ID NO: 1124879 - RNA, 22 nt, Human
gcugucccgaaccccugguaau

SEQ ID NO: 1124880 - RNA, 22 nt, Human
gcugucacacauggccccagcu

SEQ ID NO: 1124881 - RNA, 22 nt, Human
gcugggaggaauuuggggaaua

SEQ ID NO: 1124882 - RNA, 22 nt, Human
auguaguauuuggaaauguaaa

SEQ ID NO: 1124883 - RNA, 22 nt, Human
agugugaccuuauuuggaaaca

SEQ ID NO: 1124884 - RNA, 22 nt, Human
aucuggcuuucuuaaugacuua

SEQ ID NO: 1124885 - RNA, 22 nt, Human
uagaaagugaagguuaauuaau

SEQ ID NO: 1124886 - RNA, 22 nt, Human
gcuggccugggcagccugucgg

SEQ ID NO: 1124887 - RNA, 22 nt, Human
gggccucucccuucucacgcau

SEQ ID NO: 1124888 - RNA, 22 nt, Human
cagaggcucaccagccuuucac

SEQ ID NO: 1124889 - RNA, 22 nt, Human
gcugauccuuuuaugucuagcu

SEQ ID NO: 1124890 - RNA, 22 nt, Human
guguaaggccccagguucuuua

SEQ ID NO: 1124891 - RNA, 22 nt, Human
cgagaguggacagggcgcagcu

SEQ ID NO: 1124892 - RNA, 22 nt, Human
uccagucaucucccuucacauu

SEQ ID NO: 1124893 - RNA, 22 nt, Human
ucaagauaccaccauuauaugu

SEQ ID NO: 1124894 - RNA, 22 nt, Human
ucuuccucuagaucugaggccc

SEQ ID NO: 1124895 - RNA, 22 nt, Human
gguagcacauugcauuaggaga

SEQ ID NO: 1124896 - RNA, 19 nt, Human
cugcugggugcugagggag

SEQ ID NO: 1124897 - RNA, 20 nt, Human
cacguuuuuccacuagcaaa

SEQ ID NO: 1124898 - RNA, 22 nt, Human
auugacaauuagcccuuaggug

SEQ ID NO: 1124899 - RNA, 22 nt, Human
gccaggcagcugggagggugcc

SEQ ID NO: 1124900 - RNA, 22 nt, Human
cuuuggcaaugaaacacaagaa

SEQ ID NO: 1124901 - RNA, 22 nt, Human
ucacaggaaccaucagagaaau

SEQ ID NO: 1124902 - RNA, 20 nt, Human
uguugauuggugucaucuca

SEQ ID NO: 1124903 - RNA, 22 nt, Human
gggcuggaggaccggccucgga

SEQ ID NO: 1124904 - RNA, 22 nt, Human
ugcaggagcugugcggugaggg

SEQ ID NO: 1124905 - RNA, 22 nt, Human
uggaggaaucagggcuuaggcu

SEQ ID NO: 1124906 - RNA, 22 nt, Human
uagcagggaaggugugcugagc

SEQ ID NO: 1124907 - RNA, 22 nt, Human
uucaagaucgaguuuaaaguga

SEQ ID NO: 1124908 - RNA, 22 nt, Human
ugaaggaaugaguauacuguuu

SEQ ID NO: 1124909 - RNA, 22 nt, Human
uagaaacauguucuguucuguu

SEQ ID NO: 1124910 - RNA, 21 nt, Human
acaggcuuuagaaaaugacuc

SEQ ID NO: 1124911 - RNA, 22 nt, Human
cagccagggagcaaagaguuga

SEQ ID NO: 1124912 - RNA, 22 nt, Human
cccagagcugagucugauauau

SEQ ID NO: 1124913 - RNA, 22 nt, Human
cuggggcuucaaugcuucggug

SEQ ID NO: 1124914 - RNA, 22 nt, Human
ggcagggaggaggugaaaguga

SEQ ID NO: 1124915 - RNA, 22 nt, Human
ucccagaggcuccagucucuau

SEQ ID NO: 1124916 - RNA, 23 nt, Human
ggccucuguguucugcccacaug

SEQ ID NO: 1124917 - RNA, 22 nt, Human
gcugagagugagcacuggauau

SEQ ID NO: 1124918 - RNA, 22 nt, Human
cuuugaaaacuuaaauaacagc

SEQ ID NO: 1124919 - RNA, 22 nt, Human
ccagucugaggccuggugaggg

SEQ ID NO: 1124920 - RNA, 22 nt, Human
gccagguggucuggcuccagag

SEQ ID NO: 1124921 - RNA, 22 nt, Human
cucagaguucuccugggaggug

SEQ ID NO: 1124922 - RNA, 22 nt, Human
uguggcugcucaggugcagacc

SEQ ID NO: 1124923 - RNA, 22 nt, Human
ucuggcaggcaaucggcucugg

SEQ ID NO: 1124924 - RNA, 22 nt, Human
ccagcugcaggggagcagugga

SEQ ID NO: 1124925 - RNA, 22 nt, Human
ccacagaguuacaaaacaguca

SEQ ID NO: 1124926 - RNA, 22 nt, Human
aaggagaguacaggaguuggua

SEQ ID NO: 1124927 - RNA, 22 nt, Human
uaugugcaguuugcucuuaaca

SEQ ID NO: 1124928 - RNA, 22 nt, Human
gcagcaugagcuauacaaagua

SEQ ID NO: 1124929 - RNA, 22 nt, Human
aaugcacauauauguguauaca

SEQ ID NO: 1124930 - RNA, 22 nt, Human
acugggaggcaucuggagcuga

SEQ ID NO: 1124931 - RNA, 22 nt, Human
cuguuuauacgacagguggagg

SEQ ID NO: 1124932 - RNA, 22 nt, Human
ucagaacagaagcuggcuauaa

SEQ ID NO: 1124933 - RNA, 22 nt, Human
agcauggggcuccgcaaugaac

SEQ ID NO: 1124934 - RNA, 22 nt, Human
gcacccaggcuugggcagcaac

SEQ ID NO: 1124935 - RNA, 22 nt, Human
aauguguguauuucuaggcgag

SEQ ID NO: 1124936 - RNA, 22 nt, Human
aaauguguuucgaaaacuggug

SEQ ID NO: 1124937 - RNA, 22 nt, Human
auucaagagcccauguuuccug

SEQ ID NO: 1124938 - RNA, 22 nt, Human
ugggccacggggguggagagcu

SEQ ID NO: 1124939 - RNA, 22 nt, Human
gcagauggcugagccugcagau

SEQ ID NO: 1124940 - RNA, 22 nt, Human
aagccagguguugugguaagag

SEQ ID NO: 1124941 - RNA, 22 nt, Human
uauguacauaacaugaaaugca

SEQ ID NO: 1124942 - RNA, 20 nt, Human
cucaguguggccugaguguu

SEQ ID NO: 1124943 - RNA, 22 nt, Human
ugcuguuauacuuagcugguua

SEQ ID NO: 1124944 - RNA, 22 nt, Human
aaaguccagagggcacacugaa

SEQ ID NO: 1124945 - RNA, 18 nt, Human
cagucccaaaccuuagga

SEQ ID NO: 1124946 - RNA, 22 nt, Human
agcugccugggcuuguacaccu

SEQ ID NO: 1124947 - RNA, 22 nt, Human
augcacgccccacacuggugug

SEQ ID NO: 1124948 - RNA, 22 nt, Human
auuuuucucuccacuccauuaa

SEQ ID NO: 1124949 - RNA, 22 nt, Human
agcugcugagagucugccgggc

SEQ ID NO: 1124950 - RNA, 22 nt, Human
aacaaauguguggcaguguggg

SEQ ID NO: 1124951 - RNA, 22 nt, Human
agcauugccugccuauugcuaa

SEQ ID NO: 1124952 - RNA, 22 nt, Human
aagacagagggaagcaaugaug

SEQ ID NO: 1124953 - RNA, 22 nt, Human
gaaugcacucacccaucacuca

SEQ ID NO: 1124954 - RNA, 22 nt, Human
cugggcucagcccaugcugucc

SEQ ID NO: 1124955 - RNA, 22 nt, Human
cuggcaggucucgcugacgugu

SEQ ID NO: 1124956 - RNA, 20 nt, Human
caccacagaauuggggacag

SEQ ID NO: 1124957 - RNA, 22 nt, Human
aaauaauuauagcgagucuauc

SEQ ID NO: 1124958 - RNA, 22 nt, Human
caugcuuugggucagaaaugcc

SEQ ID NO: 1124959 - RNA, 22 nt, Human
ccugucuguccucucaugagcc

SEQ ID NO: 1124960 - RNA, 19 nt, Human
cugccuguuauggagagaa

SEQ ID NO: 1124961 - RNA, 22 nt, Human
uccauuuuguagguaugcuaca

SEQ ID NO: 1124962 - RNA, 23 nt, Human
ugcugguguuuuugggaccaggg

SEQ ID NO: 1124963 - RNA, 22 nt, Human
gggcaggaugcaguuucagaga

SEQ ID NO: 1124964 - RNA, 22 nt, Human
cgcugccaggauccccugccgg

SEQ ID NO: 1124965 - RNA, 22 nt, Human
cugaggaugguguggucuucuc

SEQ ID NO: 1124966 - RNA, 22 nt, Human
auguagcaugaggcacugugcc

SEQ ID NO: 1124967 - RNA, 22 nt, Human
gugucccaaagauuagaaauca

SEQ ID NO: 1124968 - RNA, 22 nt, Human
cacaggggcaaacuguagggga

SEQ ID NO: 1124969 - RNA, 22 nt, Human
cuggccuggggccucagcugcu

SEQ ID NO: 1124970 - RNA, 22 nt, Human
aacaaaugauuguugguuggag

SEQ ID NO: 1124971 - RNA, 22 nt, Human
ccuuccaggagucucugcaggu

SEQ ID NO: 1124972 - RNA, 22 nt, Human
gugcaugucggggugcauguca

SEQ ID NO: 1124973 - RNA, 22 nt, Human
aagcgccacgagaagcuggacc

SEQ ID NO: 1124974 - RNA, 22 nt, Human
gccaccucuuugucucugccgc

SEQ ID NO: 1124975 - RNA, 22 nt, Human
augcuauacucaaagaaauuca

SEQ ID NO: 1124976 - RNA, 22 nt, Human
auggccuggccagagcucugcu

SEQ ID NO: 1124977 - RNA, 22 nt, Human
uacauguaggugacauuuuaau

SEQ ID NO: 1124978 - RNA, 23 nt, Human
ccaggccucucagagggugugcc

SEQ ID NO: 1124979 - RNA, 22 nt, Human
aggucaaguuuagauagaguua

SEQ ID NO: 1124980 - RNA, 22 nt, Human
ucaggcugccuaucagacugug

SEQ ID NO: 1124981 - RNA, 22 nt, Human
agagccaggaugucuucugggg

SEQ ID NO: 1124982 - RNA, 22 nt, Human
uagcccagagucccaauuccag

SEQ ID NO: 1124983 - RNA, 22 nt, Human
ucugcugcugagcacacuccua

SEQ ID NO: 1124984 - RNA, 22 nt, Human
acacaguaugaaaagucuaguu

SEQ ID NO: 1124985 - RNA, 22 nt, Human
caggauaacagaaaauagcuga

SEQ ID NO: 1124986 - RNA, 22 nt, Human
gaggccuggcucugcccuccug

SEQ ID NO: 1124987 - RNA, 22 nt, Human
ugggccugccccaggcuucagc

SEQ ID NO: 1124988 - RNA, 22 nt, Human
auaucacaaacaagucuguacu

SEQ ID NO: 1124989 - RNA, 22 nt, Human
ccacagaggacaacugccuggc

SEQ ID NO: 1124990 - RNA, 22 nt, Human
agagcugcaccuaugcagaccu

SEQ ID NO: 1124991 - RNA, 22 nt, Human
agguuuucagcuguauccugag

SEQ ID NO: 1124992 - RNA, 22 nt, Human
uuuccucuccaccaggaggucu

SEQ ID NO: 1124993 - RNA, 22 nt, Human
uaugcacauauaaccugcacug

SEQ ID NO: 1124994 - RNA, 22 nt, Human
cagagcagaaaccugggugauu

SEQ ID NO: 1124995 - RNA, 22 nt, Human
gaaaugcaaauucucucucgcu

SEQ ID NO: 1124996 - RNA, 22 nt, Human
ggaggccaaggagggcggauca

SEQ ID NO: 1124997 - RNA, 22 nt, Human
caguacuuugcaucauuccacu

SEQ ID NO: 1124998 - RNA, 21 nt, Human
ggcagcccgcccucuccuggc

SEQ ID NO: 1124999 - RNA, 22 nt, Human
cuggaugcuuccucucugcuag

SEQ ID NO: 1125000 - RNA, 22 nt, Human
uggagccugagucagcggaggc

SEQ ID NO: 1125001 - RNA, 22 nt, Human
ugggccagcaauugcugcucag

SEQ ID NO: 1125002 - RNA, 22 nt, Human
cagcccucagguccucagcagc

SEQ ID NO: 1125003 - RNA, 22 nt, Human
acaggugaccugcucauaugaa

SEQ ID NO: 1125004 - RNA, 22 nt, Human
cagcccuguccagcagagggug

SEQ ID NO: 1125005 - RNA, 20 nt, Human
gccugagcuauugccaggau

SEQ ID NO: 1125006 - RNA, 22 nt, Human
aggagccaugagugacaucaca

SEQ ID NO: 1125007 - RNA, 22 nt, Human
agguggagacccagagaaggcg

SEQ ID NO: 1125008 - RNA, 22 nt, Human
ggcaaaaacagcaaugacuuuu

SEQ ID NO: 1125009 - RNA, 22 nt, Human
gcugccaauccagcugugggag

SEQ ID NO: 1125010 - RNA, 22 nt, Human
acuguguguuugucuagcacag

SEQ ID NO: 1125011 - RNA, 22 nt, Human
agcugccagggacugggcaugg

SEQ ID NO: 1125012 - RNA, 23 nt, Human
aggauccugguacaggagcagag

SEQ ID NO: 1125013 - RNA, 22 nt, Human
uauugaaauccauuacguucuu

SEQ ID NO: 1125014 - RNA, 22 nt, Human
aggugaaguugaggaggcagaa

SEQ ID NO: 1125015 - RNA, 19 nt, Human
ccugugugggguagagauc

SEQ ID NO: 1125016 - RNA, 22 nt, Human
uccagggagauggcagaggcug

SEQ ID NO: 1125017 - RNA, 22 nt, Human
agagaagagcaaugauaaauuu

SEQ ID NO: 1125018 - RNA, 22 nt, Human
ggacacagcugcagccacaccc

SEQ ID NO: 1125019 - RNA, 22 nt, Human
gcagggucugaggccacagagg

SEQ ID NO: 1125020 - RNA, 22 nt, Human
ucugguaaccuuuaucccuccu

SEQ ID NO: 1125021 - RNA, 22 nt, Human
aagauucucagagugaaagaau

SEQ ID NO: 1125022 - RNA, 22 nt, Human
ucccacucccaggcaggccucu

SEQ ID NO: 1125023 - RNA, 18 nt, Human
ucugagggugcgggagcu

SEQ ID NO: 1125024 - RNA, 22 nt, Human
acauuucuuagccuaguuccag

SEQ ID NO: 1125025 - RNA, 20 nt, Human
agugcaagaaagcacagcug

SEQ ID NO: 1125026 - RNA, 22 nt, Human
agggccagggaagcuguauuuu

SEQ ID NO: 1125027 - RNA, 22 nt, Human
cucucugggggccaugccaaga

SEQ ID NO: 1125028 - RNA, 23 nt, Human
ggcugagacuacaggcgcuugcc

SEQ ID NO: 1125029 - RNA, 22 nt, Human
agagcccuuucuccaggcaccu

SEQ ID NO: 1125030 - RNA, 22 nt, Human
caugugugaagacugcgggcca

SEQ ID NO: 1125031 - RNA, 22 nt, Human
aggagucacucagggcuucauc

SEQ ID NO: 1125032 - RNA, 22 nt, Human
acaaagucacaauaauuaaccu

SEQ ID NO: 1125033 - RNA, 22 nt, Human
gugccagcaguuauggugauuu

SEQ ID NO: 1125034 - RNA, 22 nt, Human
agggccagcacuccuggcagga

SEQ ID NO: 1125035 - RNA, 22 nt, Human
ucuggcucuccagugcucuuag

SEQ ID NO: 1125036 - RNA, 22 nt, Human
gccuggagggucccucucugga

SEQ ID NO: 1125037 - RNA, 22 nt, Human
aaugaacacagcccucuacuuu

SEQ ID NO: 1125038 - RNA, 22 nt, Human
cagaagcauugacuccuugcuc

SEQ ID NO: 1125039 - RNA, 21 nt, Human
acagcagacaggcuuaggacc

SEQ ID NO: 1125040 - RNA, 22 nt, Human
gagccuccuccuggugugccga

SEQ ID NO: 1125041 - RNA, 22 nt, Human
cagugucuuauuuguagcucag

SEQ ID NO: 1125042 - RNA, 22 nt, Human
uccagucauuuccauuguuccc

SEQ ID NO: 1125043 - RNA, 22 nt, Human
aagugagauuauauguacggga

SEQ ID NO: 1125044 - RNA, 22 nt, Human
cuggccacaugugugcugagca

SEQ ID NO: 1125045 - RNA, 22 nt, Human
caaauguguaaggaaguguuag

SEQ ID NO: 1125046 - RNA, 22 nt, Human
gugcaugugucuuuauaguaga

SEQ ID NO: 1125047 - RNA, 22 nt, Human
guggcugcagcccagcggcacg

SEQ ID NO: 1125048 - RNA, 22 nt, Human
uauuuguauuucaugcaguaaa

SEQ ID NO: 1125049 - RNA, 22 nt, Human
ggcugccauaacagaguaccac

SEQ ID NO: 1125050 - RNA, 22 nt, Human
cugccucucagccugaccgcca

SEQ ID NO: 1125051 - RNA, 22 nt, Human
ggccccaggaccuccacggucc

SEQ ID NO: 1125052 - RNA, 22 nt, Human
guggagcccugccuugcucaug

SEQ ID NO: 1125053 - RNA, 22 nt, Human
gccucugcaugcucagcaccca

SEQ ID NO: 1125054 - RNA, 22 nt, Human
uuggaggcaaugggaaggaggc

SEQ ID NO: 1125055 - RNA, 22 nt, Human
cuuacauugugugcaugagggg

SEQ ID NO: 1125056 - RNA, 20 nt, Human
aauaaaagaagccuucaccc

SEQ ID NO: 1125057 - RNA, 22 nt, Human
cugggcugcaguuccugguccu

SEQ ID NO: 1125058 - RNA, 22 nt, Human
ccaggacucaguggggaaaggg

SEQ ID NO: 1125059 - RNA, 23 nt, Human
aggcugcagaagaauagggucau

SEQ ID NO: 1125060 - RNA, 22 nt, Human
auggacaggaacucccuuggca

SEQ ID NO: 1125061 - RNA, 22 nt, Human
gcacugaaaauguuggauucca

SEQ ID NO: 1125062 - RNA, 22 nt, Human
ccucucuguaagggucccuccc

SEQ ID NO: 1125063 - RNA, 22 nt, Human
ugcucugguccucccucggcgc

SEQ ID NO: 1125064 - RNA, 22 nt, Human
cccaggccagaacuugguugcu

SEQ ID NO: 1125065 - RNA, 22 nt, Human
auauucuuccaaaacaucauuu

SEQ ID NO: 1125066 - RNA, 22 nt, Human
uauuucuggcuuugagggugau

SEQ ID NO: 1125067 - RNA, 22 nt, Human
aggagucauaaaugugaacaaa

SEQ ID NO: 1125068 - RNA, 22 nt, Human
agggcacaucugcugggaaugg

SEQ ID NO: 1125069 - RNA, 22 nt, Human
ugagcuuccucccugcauccau

SEQ ID NO: 1125070 - RNA, 22 nt, Human
ccugucuggaacauggccuguu

SEQ ID NO: 1125071 - RNA, 22 nt, Human
gaggcaggcagauugcuugagg

SEQ ID NO: 1125072 - RNA, 22 nt, Human
aacagcaauagcacuauucauu

SEQ ID NO: 1125073 - RNA, 22 nt, Human
gugugugcuccccaggagagcu

SEQ ID NO: 1125074 - RNA, 22 nt, Human
agggagaacaguugcagcagac

SEQ ID NO: 1125075 - RNA, 22 nt, Human
gagcugcugguugcuggugccu

SEQ ID NO: 1125076 - RNA, 22 nt, Human
cugugucccuugucccagagcc

SEQ ID NO: 1125077 - RNA, 22 nt, Human
agcugcucccuauccuuuccuu

SEQ ID NO: 1125078 - RNA, 22 nt, Human
gugccucagcaccgccugcagc

SEQ ID NO: 1125079 - RNA, 22 nt, Human
aggauaauaauaaucucguuua

SEQ ID NO: 1125080 - RNA, 22 nt, Human
aucaguuuaaaugggcuguugg

SEQ ID NO: 1125081 - RNA, 22 nt, Human
uaguccaguaaaacagcuaacg

SEQ ID NO: 1125082 - RNA, 22 nt, Human
guaagagcacugucuccugcug

SEQ ID NO: 1125083 - RNA, 22 nt, Human
ugaggcaggagguugagaacug

SEQ ID NO: 1125084 - RNA, 22 nt, Human
auugcacaaacacagucagacu

SEQ ID NO: 1125085 - RNA, 22 nt, Human
uuggccuuaaccucucugugcc

SEQ ID NO: 1125086 - RNA, 22 nt, Human
aggacaggauugagcugaacug

SEQ ID NO: 1125087 - RNA, 22 nt, Human
caggcuugggagcagagccacu

SEQ ID NO: 1125088 - RNA, 22 nt, Human
gucccuuggcucacaaacagcu

SEQ ID NO: 1125089 - RNA, 22 nt, Human
aggucccaggcauagcuggucu

SEQ ID NO: 1125090 - RNA, 22 nt, Human
ccucccaccguaucucaguggc

SEQ ID NO: 1125091 - RNA, 22 nt, Human
gaaaggagggaaacagagcggu

SEQ ID NO: 1125092 - RNA, 22 nt, Human
ugucucuggcccaugagcagag

SEQ ID NO: 1125093 - RNA, 22 nt, Human
ccuuaaaagaacuaucucuucu

SEQ ID NO: 1125094 - RNA, 22 nt, Human
gcuggagauaguaggauccaua

SEQ ID NO: 1125095 - RNA, 18 nt, Human
cagggcuguggggucacu

SEQ ID NO: 1125096 - RNA, 18 nt, Human
aucucccauuggccaagg

SEQ ID NO: 1125097 - RNA, 22 nt, Human
agaggccaucugcucugugggg

SEQ ID NO: 1125098 - RNA, 22 nt, Human
ucucugggauaaacugggccag

SEQ ID NO: 1125099 - RNA, 22 nt, Human
ugccagcacaaguuaagagauc

SEQ ID NO: 1125100 - RNA, 22 nt, Human
uagaaacucaggauacucuucc

SEQ ID NO: 1125101 - RNA, 22 nt, Human
aggcacugugcagucccaagca

SEQ ID NO: 1125102 - RNA, 22 nt, Human
uuagaaaauuugcuucuuugga

SEQ ID NO: 1125103 - RNA, 22 nt, Human
cccuggagucagguuggccugg

SEQ ID NO: 1125104 - RNA, 18 nt, Human
acauuucucucugcguga

SEQ ID NO: 1125105 - RNA, 19 nt, Human
cccagcuugaccaccugcu

SEQ ID NO: 1125106 - RNA, 22 nt, Human
ccugaagcaaggguaggcaggu

SEQ ID NO: 1125107 - RNA, 22 nt, Human
gagcagugacuggagcaugaga

SEQ ID NO: 1125108 - RNA, 22 nt, Human
uggcagagaacacggcugaucu

SEQ ID NO: 1125109 - RNA, 22 nt, Human
ugcucccaaacgaccuacugug

SEQ ID NO: 1125110 - RNA, 22 nt, Human
agugcagccgagaucaggugcu

SEQ ID NO: 1125111 - RNA, 22 nt, Human
agauuucagaugcucggcaguu

SEQ ID NO: 1125112 - RNA, 20 nt, Human
ccugucuggagacaaagaga

SEQ ID NO: 1125113 - RNA, 22 nt, Human
uugucugugaaauggaaauagu

SEQ ID NO: 1125114 - RNA, 22 nt, Human
ccugcuucagggaugauggcac

SEQ ID NO: 1125115 - RNA, 22 nt, Human
caggucccgccccgggcugacc

SEQ ID NO: 1125116 - RNA, 22 nt, Human
cuggcaggcagacuucugcaag

SEQ ID NO: 1125117 - RNA, 22 nt, Human
guggguggaucaccugagguca

SEQ ID NO: 1125118 - RNA, 22 nt, Human
cagagcucagagcagggcacuc

SEQ ID NO: 1125119 - RNA, 21 nt, Human
uucuuuccccagaggacuaaa

SEQ ID NO: 1125120 - RNA, 22 nt, Human
caaagugcugagauuacaggua

SEQ ID NO: 1125121 - RNA, 16 nt, Human
gggcugggggauucug

SEQ ID NO: 1125122 - RNA, 22 nt, Human
agggugcauguuugcaagagug

SEQ ID NO: 1125123 - RNA, 22 nt, Human
cucagagaagucuuugcuaaac

SEQ ID NO: 1125124 - RNA, 22 nt, Human
aucaguuuauacuuauaaaucu

SEQ ID NO: 1125125 - RNA, 18 nt, Human
gugagcagagagcaucac

SEQ ID NO: 1125126 - RNA, 22 nt, Human
aggggcuggcuuaucugagagu

SEQ ID NO: 1125127 - RNA, 22 nt, Human
aucagcaagacuaggggaauac

SEQ ID NO: 1125128 - RNA, 22 nt, Human
cccuggaguccggagcucaccu

SEQ ID NO: 1125129 - RNA, 22 nt, Human
acuucuggugucauacugcauu

SEQ ID NO: 1125130 - RNA, 22 nt, Human
agccccugggaguagcugcugc

SEQ ID NO: 1125131 - RNA, 22 nt, Human
guacauguugguuguuuccagu

SEQ ID NO: 1125132 - RNA, 22 nt, Human
ccugugugcugaugacgacaga

SEQ ID NO: 1125133 - RNA, 22 nt, Human
ggcuccuguggcaagacagcuu

SEQ ID NO: 1125134 - RNA, 22 nt, Human
cugcaguguucuggaaugcauu

SEQ ID NO: 1125135 - RNA, 22 nt, Human
aggcaggugggucacuugaguc

SEQ ID NO: 1125136 - RNA, 22 nt, Human
aagaguuaagcaacagauacca

SEQ ID NO: 1125137 - RNA, 20 nt, Human
cucuccuugccgacuuggca

SEQ ID NO: 1125138 - RNA, 22 nt, Human
ucugccuuuucacugccacuaa

SEQ ID NO: 1125139 - RNA, 22 nt, Human
ucagggcucaccagccucugcc

SEQ ID NO: 1125140 - RNA, 22 nt, Human
cugugccuuuguagcugugccu

SEQ ID NO: 1125141 - RNA, 22 nt, Human
cuggcugguuacuauuucuggu

SEQ ID NO: 1125142 - RNA, 22 nt, Human
aagagagagcauucuucuguua

SEQ ID NO: 1125143 - RNA, 22 nt, Human
acaaaguuugugguauuccaag

SEQ ID NO: 1125144 - RNA, 22 nt, Human
agacaaaggauuaaugaugaug

SEQ ID NO: 1125145 - RNA, 22 nt, Human
aggacccugagcgggcaugccg

SEQ ID NO: 1125146 - RNA, 22 nt, Human
cuggcucacaggugagaugcau

SEQ ID NO: 1125147 - RNA, 22 nt, Human
gcucccagacugaccagaggug

SEQ ID NO: 1125148 - RNA, 22 nt, Human
ucuggccacccgaggccccugc

SEQ ID NO: 1125149 - RNA, 22 nt, Human
gccucugcaacuccgccuuggu

SEQ ID NO: 1125150 - RNA, 17 nt, Human
cucugcagugcauggcu

SEQ ID NO: 1125151 - RNA, 22 nt, Human
agggcugcaccggggcuucgcg

SEQ ID NO: 1125152 - RNA, 20 nt, Human
uagaaaucuuauaaaagacu

SEQ ID NO: 1125153 - RNA, 22 nt, Human
ggcagaaggccucccagcuccu

SEQ ID NO: 1125154 - RNA, 22 nt, Human
uccuucagcucucuauuuagau

SEQ ID NO: 1125155 - RNA, 22 nt, Human
aaucagaauuuauugaaucuuu

SEQ ID NO: 1125156 - RNA, 22 nt, Human
caaggagauaaaauguugagcu

SEQ ID NO: 1125157 - RNA, 22 nt, Human
aaaguguggagauugaacuaaa

SEQ ID NO: 1125158 - RNA, 22 nt, Human
gcuggugccuuguuguuguuac

SEQ ID NO: 1125159 - RNA, 19 nt, Human
acagaaauguaagugagac

SEQ ID NO: 1125160 - RNA, 22 nt, Human
gagcugggacauggguccucuc

SEQ ID NO: 1125161 - RNA, 22 nt, Human
gucacacucagaaugacuagag

SEQ ID NO: 1125162 - RNA, 19 nt, Human
uggcucugucgaaggcaca

SEQ ID NO: 1125163 - RNA, 22 nt, Human
caagcuccuuacauccacaggg

SEQ ID NO: 1125164 - RNA, 22 nt, Human
cuggugcaggaaggagcuggca

SEQ ID NO: 1125165 - RNA, 22 nt, Human
ccuggaugauccaugucaugga

SEQ ID NO: 1125166 - RNA, 22 nt, Human
ugcaaacuauugguagagaugg

SEQ ID NO: 1125167 - RNA, 22 nt, Human
gccugccugcugugugcaaguu

SEQ ID NO: 1125168 - RNA, 22 nt, Human
gagagcuggguucaaguagcug

SEQ ID NO: 1125169 - RNA, 23 nt, Human
agagcuuagggaauucacaugag

SEQ ID NO: 1125170 - RNA, 19 nt, Human
guauauuuauauggcugua

SEQ ID NO: 1125171 - RNA, 20 nt, Human
uggggccuguuucugugguu

SEQ ID NO: 1125172 - RNA, 20 nt, Human
ggggcccaagcccucuugcc

SEQ ID NO: 1125173 - RNA, 20 nt, Human
uccaggagaacugggagccg

SEQ ID NO: 1125174 - RNA, 23 nt, Human
agaugaggcuucuccauguuggu

SEQ ID NO: 1125175 - RNA, 22 nt, Human
gcagggcaaugaucccgagagg

SEQ ID NO: 1125176 - RNA, 22 nt, Human
gugcagugacccuggagagcug

SEQ ID NO: 1125177 - RNA, 22 nt, Human
ggugggcaggucacucugccuc

SEQ ID NO: 1125178 - RNA, 22 nt, Human
ugucccuggaacuauggcucca

SEQ ID NO: 1125179 - RNA, 18 nt, Human
gggcuguguucaugccca

SEQ ID NO: 1125180 - RNA, 22 nt, Human
uuugggaacucuaucauggaaa

SEQ ID NO: 1125181 - RNA, 22 nt, Human
cucugagcuccuggaagcgugc

SEQ ID NO: 1125182 - RNA, 22 nt, Human
acucacauuucaucaggccaag

SEQ ID NO: 1125183 - RNA, 22 nt, Human
aggagucagauaugggaaaguu

SEQ ID NO: 1125184 - RNA, 22 nt, Human
ccugucagaugaaguaauugug

SEQ ID NO: 1125185 - RNA, 22 nt, Human
ugugugccagccuacgaggagc

SEQ ID NO: 1125186 - RNA, 22 nt, Human
ucuggagcuuccucauuuacag

SEQ ID NO: 1125187 - RNA, 22 nt, Human
aagugacacauggcacuucuau

SEQ ID NO: 1125188 - RNA, 22 nt, Human
gagauggggucagcugggacau

SEQ ID NO: 1125189 - RNA, 22 nt, Human
cuacauuuuucaccgagccucu

SEQ ID NO: 1125190 - RNA, 22 nt, Human
aauacaaucaaauucacuagca

SEQ ID NO: 1125191 - RNA, 22 nt, Human
ggcugcuggggacgugggagag

SEQ ID NO: 1125192 - RNA, 22 nt, Human
caagaacauugugaucacuuca

SEQ ID NO: 1125193 - RNA, 22 nt, Human
cuggcagcgugagcagcaucca

SEQ ID NO: 1125194 - RNA, 22 nt, Human
aguccaugcugucuacagaauc

SEQ ID NO: 1125195 - RNA, 22 nt, Human
uaaggcacgcauaagagggggc

SEQ ID NO: 1125196 - RNA, 22 nt, Human
ggggaugguagaccggugacgu

SEQ ID NO: 1125197 - RNA, 22 nt, Human
cuggaagggucuacuuagcaga

SEQ ID NO: 1125198 - RNA, 22 nt, Human
gcuggcuguguuccuucugcca

SEQ ID NO: 1125199 - RNA, 22 nt, Human
auacaugucaucauauguuugu

SEQ ID NO: 1125200 - RNA, 22 nt, Human
aaauguagaccuauagggaccu

SEQ ID NO: 1125201 - RNA, 22 nt, Human
agugcuguccaguuucacaggu

SEQ ID NO: 1125202 - RNA, 21 nt, Human
cucaggaucuuauauauuagu

SEQ ID NO: 1125203 - RNA, 22 nt, Human
aaguccauucuuccagccagcu

SEQ ID NO: 1125204 - RNA, 22 nt, Human
uaacagaaauagaaaugagagu

SEQ ID NO: 1125205 - RNA, 22 nt, Human
aauguguauaugaacauacagg

SEQ ID NO: 1125206 - RNA, 20 nt, Human
uucuggaggcuacaagucug

SEQ ID NO: 1125207 - RNA, 22 nt, Human
gcuuccugauauucauacuguu

SEQ ID NO: 1125208 - RNA, 22 nt, Human
cugagcugggacucaguagcaa

SEQ ID NO: 1125209 - RNA, 21 nt, Human
ugccagcauguaggcuaguug

SEQ ID NO: 1125210 - RNA, 22 nt, Human
cugaggaguuuggguuguucaa

SEQ ID NO: 1125211 - RNA, 22 nt, Human
ugugucagaaggcaauggggau

SEQ ID NO: 1125212 - RNA, 22 nt, Human
gccccagguugccugucccagg

SEQ ID NO: 1125213 - RNA, 22 nt, Human
caggcugccgugaagcaggccu

SEQ ID NO: 1125214 - RNA, 22 nt, Human
cuccuuccugguuagcaccuua

SEQ ID NO: 1125215 - RNA, 22 nt, Human
caauguuuucaacugacaagua

SEQ ID NO: 1125216 - RNA, 22 nt, Human
cuggcagcugcccgagaugccc

SEQ ID NO: 1125217 - RNA, 22 nt, Human
ggccucugguucguggugaccu

SEQ ID NO: 1125218 - RNA, 22 nt, Human
uucuuacagcccuauuacuaaa

SEQ ID NO: 1125219 - RNA, 22 nt, Human
aucugacaaccuauugacuuga

SEQ ID NO: 1125220 - RNA, 22 nt, Human
uggcucugcaccucaguguacc

SEQ ID NO: 1125221 - RNA, 22 nt, Human
caugaagcauguuuugucauga

SEQ ID NO: 1125222 - RNA, 22 nt, Human
gagcugccuguugcauagcaac

SEQ ID NO: 1125223 - RNA, 22 nt, Human
ggcccagccggcgagucucgcg

SEQ ID NO: 1125224 - RNA, 22 nt, Human
uggguggcggccugguucugag

SEQ ID NO: 1125225 - RNA, 22 nt, Human
ugcucacagcccagaacauaau

SEQ ID NO: 1125226 - RNA, 20 nt, Human
gaaaugugaccucuucugug

SEQ ID NO: 1125227 - RNA, 22 nt, Human
ucagcuccucaugcaggggaua

SEQ ID NO: 1125228 - RNA, 22 nt, Human
gcugagugagguccagagcuug

SEQ ID NO: 1125229 - RNA, 22 nt, Human
uaugcauaugaccccaagcuug

SEQ ID NO: 1125230 - RNA, 22 nt, Human
uggugugggcguggcaggcaag

SEQ ID NO: 1125231 - RNA, 21 nt, Human
uggcucugcucagagcagucc

SEQ ID NO: 1125232 - RNA, 22 nt, Human
cagcugcccaggccaccuggag

SEQ ID NO: 1125233 - RNA, 22 nt, Human
aucuuucagagcuccaucaggg

SEQ ID NO: 1125234 - RNA, 22 nt, Human
gcuguauuuaacaacuggcuca

SEQ ID NO: 1125235 - RNA, 22 nt, Human
ugaacauauucaccucuaaaua

SEQ ID NO: 1125236 - RNA, 22 nt, Human
caggucagaggcgcagccccca

SEQ ID NO: 1125237 - RNA, 22 nt, Human
uggcaggguuggccaccuuacc

SEQ ID NO: 1125238 - RNA, 22 nt, Human
ucugucacucuagagauggcag

SEQ ID NO: 1125239 - RNA, 22 nt, Human
uccuugaauccuagcauccuau

SEQ ID NO: 1125240 - RNA, 21 nt, Human
acagcaagccuuccuuucagg

SEQ ID NO: 1125241 - RNA, 19 nt, Human
gcuguauuaaagauacaug

SEQ ID NO: 1125242 - RNA, 22 nt, Human
acagggcaugugcaagagacau

SEQ ID NO: 1125243 - RNA, 22 nt, Human
gucucccaaccccugugcccag

SEQ ID NO: 1125244 - RNA, 22 nt, Human
ugagccaguggaagauggcagu

SEQ ID NO: 1125245 - RNA, 22 nt, Human
gugcccugguccccagcauaua

SEQ ID NO: 1125246 - RNA, 22 nt, Human
ccagcccuugagauggaaggga

SEQ ID NO: 1125247 - RNA, 18 nt, Human
gucaccuggaucagauua

SEQ ID NO: 1125248 - RNA, 22 nt, Human
uguaugugcaauguuuauaugu

SEQ ID NO: 1125249 - RNA, 22 nt, Human
uuugugaaaugaagucacaacu

SEQ ID NO: 1125250 - RNA, 22 nt, Human
gcucaggagcucuugguggcgc

SEQ ID NO: 1125251 - RNA, 22 nt, Human
gugcucacugugagacguccug

SEQ ID NO: 1125252 - RNA, 22 nt, Human
cccuuccucccaggcuucugug

SEQ ID NO: 1125253 - RNA, 22 nt, Human
uuccauauguauauagcuguua

SEQ ID NO: 1125254 - RNA, 22 nt, Human
ugcagcauuauucacaguagcc

SEQ ID NO: 1125255 - RNA, 22 nt, Human
accuuucauuaaagucuguagu

SEQ ID NO: 1125256 - RNA, 22 nt, Human
augcaguauaaaucauuucugg

SEQ ID NO: 1125257 - RNA, 22 nt, Human
ggcuccagggaguggagagaag

SEQ ID NO: 1125258 - RNA, 22 nt, Human
gcagcccagguguagcucuuug

SEQ ID NO: 1125259 - RNA, 22 nt, Human
cugugaggcccugggugcugga

SEQ ID NO: 1125260 - RNA, 22 nt, Human
cugucacacugauaucaggcuu

SEQ ID NO: 1125261 - RNA, 22 nt, Human
aacaugaagguaggaugguuuu

SEQ ID NO: 1125262 - RNA, 22 nt, Human
aaugauggucauggcaacuuuu

SEQ ID NO: 1125263 - RNA, 22 nt, Human
ccuuuuucccuggagggacagc

SEQ ID NO: 1125264 - RNA, 22 nt, Human
agcucccagggcugggcaaguu

SEQ ID NO: 1125265 - RNA, 22 nt, Human
uggcucagucauggaugaguaa

SEQ ID NO: 1125266 - RNA, 19 nt, Human
gcagccaggugcucuaccu

SEQ ID NO: 1125267 - RNA, 22 nt, Human
ucagaggaccuuacugagaacc

SEQ ID NO: 1125268 - RNA, 22 nt, Human
uccaucagauucccuccugaga

SEQ ID NO: 1125269 - RNA, 22 nt, Human
caggagcccguugcuccggcgg

SEQ ID NO: 1125270 - RNA, 22 nt, Human
uaaucacaucaggguaaauggg

SEQ ID NO: 1125271 - RNA, 22 nt, Human
uaauacuuaccuugcagagucu

SEQ ID NO: 1125272 - RNA, 22 nt, Human
gggagcuggagcuggaagacuc

SEQ ID NO: 1125273 - RNA, 21 nt, Human
agggagcuauuuauaguaagc

SEQ ID NO: 1125274 - RNA, 22 nt, Human
caggcaggagccagggauucca

SEQ ID NO: 1125275 - RNA, 22 nt, Human
ggcccuguccuggcugucuccg

SEQ ID NO: 1125276 - RNA, 22 nt, Human
aauguuuucccagugcagacga

SEQ ID NO: 1125277 - RNA, 22 nt, Human
cuuucacaguccugacugagcg

SEQ ID NO: 1125278 - RNA, 22 nt, Human
uugggguguuggauggagcaag

SEQ ID NO: 1125279 - RNA, 20 nt, Human
ugccaugguaacagagugug

SEQ ID NO: 1125280 - RNA, 22 nt, Human
cgcuggccauagccuccugugu

SEQ ID NO: 1125281 - RNA, 22 nt, Human
gacauucacaguuuccgauggu

SEQ ID NO: 1125282 - RNA, 22 nt, Human
agcaauauuuaaagguuugcaa

SEQ ID NO: 1125283 - RNA, 22 nt, Human
acguuuucuagagaauaugcag

SEQ ID NO: 1125284 - RNA, 22 nt, Human
cucuggaguucucaugaggaac

SEQ ID NO: 1125285 - RNA, 22 nt, Human
guucguauuuaugucgcagaag

SEQ ID NO: 1125286 - RNA, 23 nt, Human
uagagcagggaaaucugucagag

SEQ ID NO: 1125287 - RNA, 22 nt, Human
gcagauggcagcccaggcuggg

SEQ ID NO: 1125288 - RNA, 22 nt, Human
aaaugcacaaaguaaguguaau

SEQ ID NO: 1125289 - RNA, 22 nt, Human
ucccagcgcggggggaggaucc

SEQ ID NO: 1125290 - RNA, 22 nt, Human
cuuguauuccccuaucucuaaa

SEQ ID NO: 1125291 - RNA, 22 nt, Human
ggccagaaaguuaagcuguggc

SEQ ID NO: 1125292 - RNA, 22 nt, Human
ggucccaggaagugcggcggcg

SEQ ID NO: 1125293 - RNA, 22 nt, Human
uguuccuaaauaugaauggaga

SEQ ID NO: 1125294 - RNA, 22 nt, Human
ggaugcugcuaucaggcuucga

SEQ ID NO: 1125295 - RNA, 22 nt, Human
gagcugcccugagcuuugcaug

SEQ ID NO: 1125296 - RNA, 22 nt, Human
ugcucuggggagcuccucugcg

SEQ ID NO: 1125297 - RNA, 22 nt, Human
cagcugagucugagguucuuug

SEQ ID NO: 1125298 - RNA, 22 nt, Human
ugugacaugugucaucuuuucu

SEQ ID NO: 1125299 - RNA, 22 nt, Human
aagccucuggggccucaucugu

SEQ ID NO: 1125300 - RNA, 22 nt, Human
agcucugggccaggaacccuaa

SEQ ID NO: 1125301 - RNA, 22 nt, Human
gaggucaauaauaugugcuuua

SEQ ID NO: 1125302 - RNA, 22 nt, Human
ccaaagucagugcucagucguc

SEQ ID NO: 1125303 - RNA, 22 nt, Human
uggcugccuuucaccucaucuc

SEQ ID NO: 1125304 - RNA, 22 nt, Human
uugcuuuguggugguucuucca

SEQ ID NO: 1125305 - RNA, 22 nt, Human
caucugccuaaguggcccuguu

SEQ ID NO: 1125306 - RNA, 22 nt, Human
ugggccugggagggcagacgcu

SEQ ID NO: 1125307 - RNA, 22 nt, Human
ugaggcaguucuuacuuguauu

SEQ ID NO: 1125308 - RNA, 22 nt, Human
aagaugcagcuuccacuuuugc

SEQ ID NO: 1125309 - RNA, 21 nt, Human
ccugccaggaaacugaguguc

SEQ ID NO: 1125310 - RNA, 20 nt, Human
cugugcuuuggaaccuggaa

SEQ ID NO: 1125311 - RNA, 22 nt, Human
gagagaagaauguuccgaggcc

SEQ ID NO: 1125312 - RNA, 22 nt, Human
gguuugcacgauauuuccaugg

SEQ ID NO: 1125313 - RNA, 22 nt, Human
cacagcuuccauuagaaugaga

SEQ ID NO: 1125314 - RNA, 22 nt, Human
aagaauguucuuguagucauga

SEQ ID NO: 1125315 - RNA, 22 nt, Human
ggggagugacgcagggccauag

SEQ ID NO: 1125316 - RNA, 22 nt, Human
ugacacauuaaaugcucacaaa

SEQ ID NO: 1125317 - RNA, 22 nt, Human
gugugcgccgacacagccaggu

SEQ ID NO: 1125318 - RNA, 22 nt, Human
cuguggcuaggaagcuguggga

SEQ ID NO: 1125319 - RNA, 22 nt, Human
ggcccagcacagugcuuggggg

SEQ ID NO: 1125320 - RNA, 20 nt, Human
aggcugggguguuuugccca

SEQ ID NO: 1125321 - RNA, 23 nt, Human
aaccagauaaauggcuccagggc

SEQ ID NO: 1125322 - RNA, 22 nt, Human
cccucagcuccacccucagcag

SEQ ID NO: 1125323 - RNA, 22 nt, Human
auuuauguaucuguguagauca

SEQ ID NO: 1125324 - RNA, 22 nt, Human
ccaggcugggcggggaaccugg

SEQ ID NO: 1125325 - RNA, 22 nt, Human
cuggagcaggcuugucccagcu

SEQ ID NO: 1125326 - RNA, 22 nt, Human
gcugccuguccugaggaguccg

SEQ ID NO: 1125327 - RNA, 22 nt, Human
cuucaagaagacagcagagcau

SEQ ID NO: 1125328 - RNA, 22 nt, Human
aggguggcaguuacuggagcaa

SEQ ID NO: 1125329 - RNA, 22 nt, Human
gaggaggcuggcgccgccugcc

SEQ ID NO: 1125330 - RNA, 22 nt, Human
uggaggcauaggccugggcccu

SEQ ID NO: 1125331 - RNA, 22 nt, Human
ccuggaaggcaggcauggauug

SEQ ID NO: 1125332 - RNA, 22 nt, Human
gccuggcacauugcaguggauu

SEQ ID NO: 1125333 - RNA, 22 nt, Human
agaagccaacagggcaggagag

SEQ ID NO: 1125334 - RNA, 22 nt, Human
gaaaauguuuccuguuauuugc

SEQ ID NO: 1125335 - RNA, 21 nt, Human
uuuuuucuugcgugaggccug

SEQ ID NO: 1125336 - RNA, 22 nt, Human
uaugaagaaguucugugaaaug

SEQ ID NO: 1125337 - RNA, 22 nt, Human
gcucagagggaacaaggggcug

SEQ ID NO: 1125338 - RNA, 22 nt, Human
auagaaaacagauguccuuaaa

SEQ ID NO: 1125339 - RNA, 18 nt, Human
gcccugguggagcuggug

SEQ ID NO: 1125340 - RNA, 22 nt, Human
aguacuucagaggcugcccagg

SEQ ID NO: 1125341 - RNA, 18 nt, Human
agagcagcggcaucacac

SEQ ID NO: 1125342 - RNA, 22 nt, Human
gaggccuggcugucagucccca

SEQ ID NO: 1125343 - RNA, 22 nt, Human
auugcaccuuggguuuugaaag

SEQ ID NO: 1125344 - RNA, 22 nt, Human
ugcagauucaaaugaaaugcaa

SEQ ID NO: 1125345 - RNA, 22 nt, Human
cugucucucuaggacacugggg

SEQ ID NO: 1125346 - RNA, 22 nt, Human
ugcauuguuuagaacucuuugg

SEQ ID NO: 1125347 - RNA, 22 nt, Human
gcugccuugaacuuggccuggg

SEQ ID NO: 1125348 - RNA, 22 nt, Human
agggguggccugccuuacuccc

SEQ ID NO: 1125349 - RNA, 18 nt, Human
agagaugguguagaguuu

SEQ ID NO: 1125350 - RNA, 22 nt, Human
ugaaggcuguuggauggggaag

SEQ ID NO: 1125351 - RNA, 22 nt, Human
ugguugaauaagauaguuuuau

SEQ ID NO: 1125352 - RNA, 22 nt, Human
agccuggacagcuacggagaac

SEQ ID NO: 1125353 - RNA, 22 nt, Human
uuuuccucugagcuuugaauaa

SEQ ID NO: 1125354 - RNA, 22 nt, Human
ccagggcauguccaagacuuag

SEQ ID NO: 1125355 - RNA, 22 nt, Human
uagcaggguccaaugugaggca

SEQ ID NO: 1125356 - RNA, 22 nt, Human
caauaauauccugugcuguuug

SEQ ID NO: 1125357 - RNA, 22 nt, Human
cugggcugucccaaccccaucc

SEQ ID NO: 1125358 - RNA, 22 nt, Human
aauuucaagucuugaagaagua

SEQ ID NO: 1125359 - RNA, 22 nt, Human
uagggcagauucgguggaguuu

SEQ ID NO: 1125360 - RNA, 22 nt, Human
uaacagaauccuguuauugcca

SEQ ID NO: 1125361 - RNA, 22 nt, Human
ugggcagacuaaggucaaagcu

SEQ ID NO: 1125362 - RNA, 20 nt, Human
cugggcugcccagcuauggg

SEQ ID NO: 1125363 - RNA, 22 nt, Human
gcaggcugugaggcucagaugg

SEQ ID NO: 1125364 - RNA, 22 nt, Human
agacagcugcucgcagagcuau

SEQ ID NO: 1125365 - RNA, 22 nt, Human
ugcuccuuccucauccugugca

SEQ ID NO: 1125366 - RNA, 22 nt, Human
uggcagcuacagacagagguga

SEQ ID NO: 1125367 - RNA, 20 nt, Human
cuuggccuacuuagcuuugu

SEQ ID NO: 1125368 - RNA, 22 nt, Human
uugugucugggggagugacauc

SEQ ID NO: 1125369 - RNA, 22 nt, Human
agcaccugcuuaaugugcagug

SEQ ID NO: 1125370 - RNA, 22 nt, Human
ccagagccugcugagccccauu

SEQ ID NO: 1125371 - RNA, 22 nt, Human
agaaugcaguuugaaauaaggu

SEQ ID NO: 1125372 - RNA, 20 nt, Human
acugagcugcauggagagga

SEQ ID NO: 1125373 - RNA, 22 nt, Human
gaugcugaagugaagugaucuu

SEQ ID NO: 1125374 - RNA, 22 nt, Human
aggugcuuggcucgugcacaca

SEQ ID NO: 1125375 - RNA, 22 nt, Human
ugcuuccuugagcucuccaauc

SEQ ID NO: 1125376 - RNA, 22 nt, Human
gcccagcaccucucucaggguu

SEQ ID NO: 1125377 - RNA, 22 nt, Human
ucugggugaugaaaugcacugu

SEQ ID NO: 1125378 - RNA, 22 nt, Human
aauguacaaaagucagccaacu

SEQ ID NO: 1125379 - RNA, 18 nt, Human
cccagcuccacuucccuc

SEQ ID NO: 1125380 - RNA, 22 nt, Human
auguagcagauauuugugcaca

SEQ ID NO: 1125381 - RNA, 22 nt, Human
ucugcucagugcuuaucucuaa

SEQ ID NO: 1125382 - RNA, 22 nt, Human
ggcagugacuguucagacgucc

SEQ ID NO: 1125383 - RNA, 23 nt, Human
uugcauguagcccaugaguaacu

SEQ ID NO: 1125384 - RNA, 22 nt, Human
ucaggagucugugcaguuccac

SEQ ID NO: 1125385 - RNA, 22 nt, Human
aaucaguuaggguguuaaugag

SEQ ID NO: 1125386 - RNA, 22 nt, Human
acagggcauuuccucuaugugu

SEQ ID NO: 1125387 - RNA, 22 nt, Human
cugugcuggcagaccuggaguu

SEQ ID NO: 1125388 - RNA, 22 nt, Human
cccccuggcaggcuggccucuc

SEQ ID NO: 1125389 - RNA, 23 nt, Human
agacccagagacuggcucugcuc

SEQ ID NO: 1125390 - RNA, 22 nt, Human
cugugcaagcccaagauaaaac

SEQ ID NO: 1125391 - RNA, 22 nt, Human
agguaagggucacaguucauau

SEQ ID NO: 1125392 - RNA, 22 nt, Human
cagcucugaggaacacuccuuu

SEQ ID NO: 1125393 - RNA, 22 nt, Human
agccaaagaucagugugcaagu

SEQ ID NO: 1125394 - RNA, 22 nt, Human
ugcauuguuugauaggugaauu

SEQ ID NO: 1125395 - RNA, 22 nt, Human
ccagccagccuugaucugagua

SEQ ID NO: 1125396 - RNA, 22 nt, Human
gcagcugagagaagaacagggc

SEQ ID NO: 1125397 - RNA, 22 nt, Human
ggaggccacgguuuagcaccga

SEQ ID NO: 1125398 - RNA, 19 nt, Human
agacacacuugauaugugu

SEQ ID NO: 1125399 - RNA, 22 nt, Human
ggagagcugguagcuggcucca

SEQ ID NO: 1125400 - RNA, 21 nt, Human
ucugggcccaugcugccucac

SEQ ID NO: 1125401 - RNA, 22 nt, Human
ugggggagauuagagcuucuua

SEQ ID NO: 1125402 - RNA, 22 nt, Human
cucuggagcaccgggcuaucca

SEQ ID NO: 1125403 - RNA, 22 nt, Human
gcucuggaagcaucugagagga

SEQ ID NO: 1125404 - RNA, 22 nt, Human
gcagcugaauguccauugcugc

SEQ ID NO: 1125405 - RNA, 20 nt, Human
gugggcagaugugugcaugg

SEQ ID NO: 1125406 - RNA, 22 nt, Human
agcugucuccagauacaggauu

SEQ ID NO: 1125407 - RNA, 22 nt, Human
ucuuggagacucuuguauauuu

SEQ ID NO: 1125408 - RNA, 22 nt, Human
aaagcugcugccaaucaggcuu

SEQ ID NO: 1125409 - RNA, 22 nt, Human
uggcccuguguccugcugccag

SEQ ID NO: 1125410 - RNA, 17 nt, Human
aggugcuggagcaucag

SEQ ID NO: 1125411 - RNA, 22 nt, Human
agugaaaugacugaaucagaua

SEQ ID NO: 1125412 - RNA, 20 nt, Human
uaucaaucagaaagaagacu

SEQ ID NO: 1125413 - RNA, 22 nt, Human
aagauucuacaguagguacauu

SEQ ID NO: 1125414 - RNA, 22 nt, Human
gccuggagccucagcaaggagg

SEQ ID NO: 1125415 - RNA, 22 nt, Human
ugaaagaacuagcaucuucaag

SEQ ID NO: 1125416 - RNA, 22 nt, Human
gccagagcacaggcugguagua

SEQ ID NO: 1125417 - RNA, 22 nt, Human
agggcagcauugccuuucucca

SEQ ID NO: 1125418 - RNA, 22 nt, Human
auacaucuuccuuuuaaaaugc

SEQ ID NO: 1125419 - RNA, 22 nt, Human
aggugcagcugguggagucugg

SEQ ID NO: 1125420 - RNA, 22 nt, Human
gagcuggcuaauacugacuuau

SEQ ID NO: 1125421 - RNA, 22 nt, Human
ggagaggugaauggcugcucua

SEQ ID NO: 1125422 - RNA, 22 nt, Human
agcagggcagugaucagaaagg

SEQ ID NO: 1125423 - RNA, 20 nt, Human
ggccuuggccucuuugcagc

SEQ ID NO: 1125424 - RNA, 22 nt, Human
cagcccugcacgcugccuccgc

SEQ ID NO: 1125425 - RNA, 23 nt, Human
ugggccuggccucccaguccagc

SEQ ID NO: 1125426 - RNA, 22 nt, Human
gaugcacugcaguauauacugu

SEQ ID NO: 1125427 - RNA, 22 nt, Human
ggugcuggacacguggcacucc

SEQ ID NO: 1125428 - RNA, 22 nt, Human
acauuuacagugcuagacaauc

SEQ ID NO: 1125429 - RNA, 22 nt, Human
ggcgaggccgggacaggcugga

SEQ ID NO: 1125430 - RNA, 22 nt, Human
cggagcugccugccaagccugc

SEQ ID NO: 1125431 - RNA, 22 nt, Human
uggccuugggcagguggccugc

SEQ ID NO: 1125432 - RNA, 22 nt, Human
cccugggacccgcugcagaggc

SEQ ID NO: 1125433 - RNA, 22 nt, Human
aaguccugccaccuauaagccu

SEQ ID NO: 1125434 - RNA, 22 nt, Human
cagcaggguauacagggaauuu

SEQ ID NO: 1125435 - RNA, 22 nt, Human
uggcaguggcucagagugcaga

SEQ ID NO: 1125436 - RNA, 22 nt, Human
agaggccagcagugccuaucug

SEQ ID NO: 1125437 - RNA, 22 nt, Human
ucaguauccacaaaugcucaaa

SEQ ID NO: 1125438 - RNA, 22 nt, Human
ugccaggaggaggugggacaga

SEQ ID NO: 1125439 - RNA, 22 nt, Human
caguggugaagagcaggggcuc

SEQ ID NO: 1125440 - RNA, 20 nt, Human
cucuggcuccgcgugaccgc

SEQ ID NO: 1125441 - RNA, 22 nt, Human
cccaggagguagagguugcagu

SEQ ID NO: 1125442 - RNA, 22 nt, Human
acauuucuuccacaugcugcug

SEQ ID NO: 1125443 - RNA, 22 nt, Human
gccuggcccagggcucuuguug

SEQ ID NO: 1125444 - RNA, 22 nt, Human
ggagggcugccagguggagcgg

SEQ ID NO: 1125445 - RNA, 22 nt, Human
gcccagcagaucucagugucuc

SEQ ID NO: 1125446 - RNA, 19 nt, Human
cucugccucccuccugggu

SEQ ID NO: 1125447 - RNA, 22 nt, Human
ucucagaguuugaaucuggagu

SEQ ID NO: 1125448 - RNA, 22 nt, Human
gcugccuguggcccuucugggu

SEQ ID NO: 1125449 - RNA, 22 nt, Human
guguaugugccuuacauuuuau

SEQ ID NO: 1125450 - RNA, 22 nt, Human
cccagggucccugcucucugug

SEQ ID NO: 1125451 - RNA, 22 nt, Human
gagaaacuuggaguuauucugg

SEQ ID NO: 1125452 - RNA, 22 nt, Human
agcagugaugcaugacagccua

SEQ ID NO: 1125453 - RNA, 22 nt, Human
cuaaaugcccuacaaugacugg

SEQ ID NO: 1125454 - RNA, 22 nt, Human
gagcucugacugcugggugaca

SEQ ID NO: 1125455 - RNA, 22 nt, Human
agagcugggugaagugccauca

SEQ ID NO: 1125456 - RNA, 20 nt, Human
caggccagagguuugauggc

SEQ ID NO: 1125457 - RNA, 22 nt, Human
acauauuuccaugcagcauguc

SEQ ID NO: 1125458 - RNA, 22 nt, Human
guguggcugugggagauguuca

SEQ ID NO: 1125459 - RNA, 22 nt, Human
gaacagcugcuagagaucugug

SEQ ID NO: 1125460 - RNA, 22 nt, Human
augaugguaaauucaguauccg

SEQ ID NO: 1125461 - RNA, 22 nt, Human
aagagcuguaugccauaugauu

SEQ ID NO: 1125462 - RNA, 21 nt, Human
aagagcuggaucaaggauaag

SEQ ID NO: 1125463 - RNA, 22 nt, Human
gaggccuggugugucucccgcu

SEQ ID NO: 1125464 - RNA, 20 nt, Human
agguggcuccugcugggggu

SEQ ID NO: 1125465 - RNA, 22 nt, Human
gcugccuucaguucugauucau

SEQ ID NO: 1125466 - RNA, 22 nt, Human
cccaggcuggauuucgguggca

SEQ ID NO: 1125467 - RNA, 20 nt, Human
ggcugccuccuuccuuuccu

SEQ ID NO: 1125468 - RNA, 22 nt, Human
cucagcagcagggaagagguca

SEQ ID NO: 1125469 - RNA, 20 nt, Human
cugcucugcuuugcaggugg

SEQ ID NO: 1125470 - RNA, 22 nt, Human
aggcugcucugcgaagucagcu

SEQ ID NO: 1125471 - RNA, 22 nt, Human
acauuucugagcagggagcugu

SEQ ID NO: 1125472 - RNA, 22 nt, Human
ugccuggcaaugccagaagcca

SEQ ID NO: 1125473 - RNA, 22 nt, Human
uuugcaaauaccaugaaacuug

SEQ ID NO: 1125474 - RNA, 22 nt, Human
cuggcagggugggcuuugcuuu

SEQ ID NO: 1125475 - RNA, 22 nt, Human
uccucugcucagcauuccucac

SEQ ID NO: 1125476 - RNA, 22 nt, Human
ugucccagcacuuugggagucu

SEQ ID NO: 1125477 - RNA, 23 nt, Human
cccagcagauuguaaagugucca

SEQ ID NO: 1125478 - RNA, 22 nt, Human
ucuggccaacaaaaacuaaguc

SEQ ID NO: 1125479 - RNA, 20 nt, Human
caggcacacucauuccugcu

SEQ ID NO: 1125480 - RNA, 17 nt, Human
gagauggguggaucacc

SEQ ID NO: 1125481 - RNA, 22 nt, Human
cccugccugugggcaucaacau

SEQ ID NO: 1125482 - RNA, 22 nt, Human
cuggcagcucuacucagagccu

SEQ ID NO: 1125483 - RNA, 22 nt, Human
gccucugcucucagguagccuc

SEQ ID NO: 1125484 - RNA, 22 nt, Human
uccagagguauguagagaguau

SEQ ID NO: 1125485 - RNA, 22 nt, Human
gcucugggauuaccagccuuag

SEQ ID NO: 1125486 - RNA, 22 nt, Human
ugguccagacauuucugaggua

SEQ ID NO: 1125487 - RNA, 22 nt, Human
ccugcacuaccuggggcugcug

SEQ ID NO: 1125488 - RNA, 22 nt, Human
ggaggccauaguuugggaguca

SEQ ID NO: 1125489 - RNA, 22 nt, Human
acaugcauucucuaaaagcaaa

SEQ ID NO: 1125490 - RNA, 22 nt, Human
ugaagcaacuggacaaguuggc

SEQ ID NO: 1125491 - RNA, 22 nt, Human
uaccuuuugcuuauuaugacac

SEQ ID NO: 1125492 - RNA, 22 nt, Human
ccugccagucacuaugucaccu

SEQ ID NO: 1125493 - RNA, 22 nt, Human
gcucccuguucucagccaugau

SEQ ID NO: 1125494 - RNA, 22 nt, Human
cugcucuguuucuuagcugggu

SEQ ID NO: 1125495 - RNA, 22 nt, Human
gccuggagcucaugugggcauu

SEQ ID NO: 1125496 - RNA, 22 nt, Human
cauugaaauauggaaacugaug

SEQ ID NO: 1125497 - RNA, 22 nt, Human
ccagggcagcagaauuggggca

SEQ ID NO: 1125498 - RNA, 22 nt, Human
cagaggccuuucuacagugaua

SEQ ID NO: 1125499 - RNA, 22 nt, Human
ucucccacagccgugcuucaag

SEQ ID NO: 1125500 - RNA, 19 nt, Human
accucugcagagauguuua

SEQ ID NO: 1125501 - RNA, 22 nt, Human
gucugcugcagagcauggcuuu

SEQ ID NO: 1125502 - RNA, 22 nt, Human
ccugggcaacauagugagaccc

SEQ ID NO: 1125503 - RNA, 22 nt, Human
agaauucuuggugguuagaaua

SEQ ID NO: 1125504 - RNA, 19 nt, Human
cagagcagugguuccugaa

SEQ ID NO: 1125505 - RNA, 22 nt, Human
aaaagucagucucuccuagcuc

SEQ ID NO: 1125506 - RNA, 22 nt, Human
gacuuucucuccucccaggugu

SEQ ID NO: 1125507 - RNA, 22 nt, Human
gggcugagucugcugccuguca

SEQ ID NO: 1125508 - RNA, 21 nt, Human
uuagcaaagcaaacacaugcu

SEQ ID NO: 1125509 - RNA, 22 nt, Human
ggccugugucugugccuguccu

SEQ ID NO: 1125510 - RNA, 22 nt, Human
gcugggagugggcaagaugaga

SEQ ID NO: 1125511 - RNA, 22 nt, Human
gaugaggggucauuggcuggga

SEQ ID NO: 1125512 - RNA, 17 nt, Human
aggccucccuccaggcc

SEQ ID NO: 1125513 - RNA, 22 nt, Human
gcaggaugccagggcagcagcg

SEQ ID NO: 1125514 - RNA, 22 nt, Human
gggccuggggacaccaccauga

SEQ ID NO: 1125515 - RNA, 22 nt, Human
ugaggcucaaggucugguggag

SEQ ID NO: 1125516 - RNA, 22 nt, Human
auucccaucgucaacuucacug

SEQ ID NO: 1125517 - RNA, 21 nt, Human
ucuguacaucauugagucccc

SEQ ID NO: 1125518 - RNA, 22 nt, Human
ccugccaggagcuggugcugca

SEQ ID NO: 1125519 - RNA, 21 nt, Human
ugggagagggcucagcuaccc

SEQ ID NO: 1125520 - RNA, 20 nt, Human
ccagcugagccaaggggaga

SEQ ID NO: 1125521 - RNA, 22 nt, Human
ucagcaauccucccacaggugg

SEQ ID NO: 1125522 - RNA, 22 nt, Human
gagagcuguccggcugagcagc

SEQ ID NO: 1125523 - RNA, 22 nt, Human
cugguccuugacgcgugggagg

SEQ ID NO: 1125524 - RNA, 22 nt, Human
ugcugucuuccaggauggugaa

SEQ ID NO: 1125525 - RNA, 22 nt, Human
aggugauguccacagcuugcag

SEQ ID NO: 1125526 - RNA, 22 nt, Human
uuccauaaugagauucccagcc

SEQ ID NO: 1125527 - RNA, 22 nt, Human
uggccugggccugccggugcaa

SEQ ID NO: 1125528 - RNA, 22 nt, Human
ggcacugauuccauucaugaag

SEQ ID NO: 1125529 - RNA, 22 nt, Human
gugugcagugagcaaaagaucu

SEQ ID NO: 1125530 - RNA, 18 nt, Human
aaagaaggauuggagagc

SEQ ID NO: 1125531 - RNA, 22 nt, Human
aauuaguauugcgauucauuag

SEQ ID NO: 1125532 - RNA, 22 nt, Human
ccugccugcguccucugagggc

SEQ ID NO: 1125533 - RNA, 22 nt, Human
gccugagccgccugagcggcgg

SEQ ID NO: 1125534 - RNA, 22 nt, Human
ggccuguguccuccuugcccug

SEQ ID NO: 1125535 - RNA, 22 nt, Human
cuggggugagcagaaacagggg

SEQ ID NO: 1125536 - RNA, 22 nt, Human
acguuuucagccuuaauguaga

SEQ ID NO: 1125537 - RNA, 22 nt, Human
cccugccuuguuggagccuaug

SEQ ID NO: 1125538 - RNA, 22 nt, Human
gucucagaccacccucuuuggc

SEQ ID NO: 1125539 - RNA, 19 nt, Human
gcugugccucucuccugcu

SEQ ID NO: 1125540 - RNA, 22 nt, Human
ucucagagauguuagggaagag

SEQ ID NO: 1125541 - RNA, 22 nt, Human
gcagagcagugcuugcccagcg

SEQ ID NO: 1125542 - RNA, 22 nt, Human
aguguggguuuuauggagcccu

SEQ ID NO: 1125543 - RNA, 22 nt, Human
ucagcaguuuuauaugcagcuu

SEQ ID NO: 1125544 - RNA, 22 nt, Human
cuuacauuuaaucaugugucau

SEQ ID NO: 1125545 - RNA, 19 nt, Human
ucaggacugacuugaaguc

SEQ ID NO: 1125546 - RNA, 22 nt, Human
acucucucacagcuuggcugau

SEQ ID NO: 1125547 - RNA, 22 nt, Human
gggcugugagaguggggcugcu

SEQ ID NO: 1125548 - RNA, 22 nt, Human
cuacauuaaauuggcuuacuua

SEQ ID NO: 1125549 - RNA, 22 nt, Human
aggugccagcucucaggcagga

SEQ ID NO: 1125550 - RNA, 21 nt, Human
agcugagcccagaagacuggu

SEQ ID NO: 1125551 - RNA, 22 nt, Human
aaaaaugcuuggacuuaauaaa

SEQ ID NO: 1125552 - RNA, 22 nt, Human
cccagccugugacagccguccu

SEQ ID NO: 1125553 - RNA, 22 nt, Human
gggggcucugacucccucagcu

SEQ ID NO: 1125554 - RNA, 22 nt, Human
cugcagcuauauuuucccacag

SEQ ID NO: 1125555 - RNA, 21 nt, Human
aaaguucaugcuuuaauauuc

SEQ ID NO: 1125556 - RNA, 22 nt, Human
gcuggagcuugagaggacaggg

SEQ ID NO: 1125557 - RNA, 22 nt, Human
gcucugaggcugggagcacucu

SEQ ID NO: 1125558 - RNA, 22 nt, Human
ugucucugccagcuagcagaau

SEQ ID NO: 1125559 - RNA, 22 nt, Human
cuggggcucucuggaaugcuug

SEQ ID NO: 1125560 - RNA, 22 nt, Human
cuacauuuguucuauagcuuuu

SEQ ID NO: 1125561 - RNA, 22 nt, Human
gaguuguucaacgugugugaaa

SEQ ID NO: 1125562 - RNA, 23 nt, Human
ggcagcucucaucugaugacuga

SEQ ID NO: 1125563 - RNA, 22 nt, Human
aggucauuuccuuagaggcaga

SEQ ID NO: 1125564 - RNA, 23 nt, Human
ugggaguguugggaucucugcuc

SEQ ID NO: 1125565 - RNA, 22 nt, Human
caguggggaggccaggauagaa

SEQ ID NO: 1125566 - RNA, 22 nt, Human
aaucaguuaaauauugaguaca

SEQ ID NO: 1125567 - RNA, 22 nt, Human
ggcugcugguggaaugguaggc

SEQ ID NO: 1125568 - RNA, 22 nt, Human
uggagcaggugcucaggguaau

SEQ ID NO: 1125569 - RNA, 22 nt, Human
uggcugccuagucccucagccu

SEQ ID NO: 1125570 - RNA, 22 nt, Human
aggagcugcagauucugccuug

SEQ ID NO: 1125571 - RNA, 22 nt, Human
cugcccugucugcagccuggcu

SEQ ID NO: 1125572 - RNA, 23 nt, Human
gggauauggaccuuggaggaguc

SEQ ID NO: 1125573 - RNA, 23 nt, Human
cagaagcaccuguugacugcugc

SEQ ID NO: 1125574 - RNA, 23 nt, Human
uggaccugaaccagugccucugu

SEQ ID NO: 1125575 - RNA, 22 nt, Human
ugaaaucuuagccauucugccu

SEQ ID NO: 1125576 - RNA, 22 nt, Human
gccuggagggauagaaugcaag

SEQ ID NO: 1125577 - RNA, 22 nt, Human
aaggcaggaugggaaaagauuu

SEQ ID NO: 1125578 - RNA, 22 nt, Human
ggagggagucagcugauuagaa

SEQ ID NO: 1125579 - RNA, 20 nt, Human
gucaucgccggcagcaaaga

SEQ ID NO: 1125580 - RNA, 22 nt, Human
auauauaugcugauggcugcca

SEQ ID NO: 1125581 - RNA, 22 nt, Human
ccugccugacagagaagguuca

SEQ ID NO: 1125582 - RNA, 22 nt, Human
ggccuguccagccugccuggcu

SEQ ID NO: 1125583 - RNA, 22 nt, Human
augugugugugcgcgcgcagga

SEQ ID NO: 1125584 - RNA, 22 nt, Human
ccauggaguuccucuggucuau

SEQ ID NO: 1125585 - RNA, 22 nt, Human
agaugauggccauguccucucc

SEQ ID NO: 1125586 - RNA, 21 nt, Human
acccuggguucuccauacccu

SEQ ID NO: 1125587 - RNA, 22 nt, Human
gcucccagaaccaaggcugggg

SEQ ID NO: 1125588 - RNA, 18 nt, Human
uggcucugcagccagaug

SEQ ID NO: 1125589 - RNA, 22 nt, Human
cuggggugugcucagagcaggg

SEQ ID NO: 1125590 - RNA, 23 nt, Human
uguguguguauucuacgcaaggu

SEQ ID NO: 1125591 - RNA, 22 nt, Human
gcugcagccaaauucauuguca

SEQ ID NO: 1125592 - RNA, 20 nt, Human
ugggcagcacugcuggcugg

SEQ ID NO: 1125593 - RNA, 22 nt, Human
caggggcucccugggugccagu

SEQ ID NO: 1125594 - RNA, 21 nt, Human
ccagcuccaggaccuuggauc

SEQ ID NO: 1125595 - RNA, 22 nt, Human
aguggcagaucucuggucugga

SEQ ID NO: 1125596 - RNA, 22 nt, Human
agaggccacuuugccugugaug

SEQ ID NO: 1125597 - RNA, 22 nt, Human
agaauucucuuccauugaaaca

SEQ ID NO: 1125598 - RNA, 22 nt, Human
ugugcuucaucacuucucaguu

SEQ ID NO: 1125599 - RNA, 22 nt, Human
ucccccacucuaaaggagccuu

SEQ ID NO: 1125600 - RNA, 21 nt, Human
agagaagggacucuuccaguc

SEQ ID NO: 1125601 - RNA, 22 nt, Human
uucucuuauucuggauaugcag

SEQ ID NO: 1125602 - RNA, 22 nt, Human
gagcccucucuguaggcaagua

SEQ ID NO: 1125603 - RNA, 22 nt, Human
cccagccucugggcucacccaa

SEQ ID NO: 1125604 - RNA, 22 nt, Human
ugggcuccucgucacucgcugu

SEQ ID NO: 1125605 - RNA, 22 nt, Human
aauguuuuauagcucaagcaau

SEQ ID NO: 1125606 - RNA, 22 nt, Human
cagagccuaaaacgacuccacu

SEQ ID NO: 1125607 - RNA, 22 nt, Human
agagcugcaauuucauguggug

SEQ ID NO: 1125608 - RNA, 17 nt, Human
ugcauuguaggcuagcc

SEQ ID NO: 1125609 - RNA, 22 nt, Human
cuggcucaccuccgcuccagca

SEQ ID NO: 1125610 - RNA, 22 nt, Human
aauaauuuugagagccuggaaa

SEQ ID NO: 1125611 - RNA, 22 nt, Human
gucccugggaugcccuucuggg

SEQ ID NO: 1125612 - RNA, 22 nt, Human
auaaaaacugacccauccuuug

SEQ ID NO: 1125613 - RNA, 22 nt, Human
cacauuucucuaccucacacaa

SEQ ID NO: 1125614 - RNA, 22 nt, Human
cucagcagugacaagagaguau

SEQ ID NO: 1125615 - RNA, 22 nt, Human
uggcagcugaggggaggcuuug

SEQ ID NO: 1125616 - RNA, 18 nt, Human
acauuucuccuucugacc

SEQ ID NO: 1125617 - RNA, 22 nt, Human
ccuggagcaaaaaucuaaggag

SEQ ID NO: 1125618 - RNA, 22 nt, Human
gaguuauuuguagggauuauau

SEQ ID NO: 1125619 - RNA, 22 nt, Human
gggcuccaacggugagcaugga

SEQ ID NO: 1125620 - RNA, 18 nt, Human
aagccagagaccacugcc

SEQ ID NO: 1125621 - RNA, 22 nt, Human
ccuuuugcucucccauccagaa

SEQ ID NO: 1125622 - RNA, 22 nt, Human
aagcugccaaugguaagcugcu

SEQ ID NO: 1125623 - RNA, 22 nt, Human
agccucugauggcucccaagga

SEQ ID NO: 1125624 - RNA, 22 nt, Human
ugaaguccuagaacuccuggua

SEQ ID NO: 1125625 - RNA, 22 nt, Human
uccugagauguggagcuccaug

SEQ ID NO: 1125626 - RNA, 22 nt, Human
caccaggcuggagugcagaggu

SEQ ID NO: 1125627 - RNA, 22 nt, Human
gggagggaucugcuaggcaaug

SEQ ID NO: 1125628 - RNA, 22 nt, Human
cauaucccauuggccaggacau

SEQ ID NO: 1125629 - RNA, 22 nt, Human
agccagcagggcuuagaggaca

SEQ ID NO: 1125630 - RNA, 22 nt, Human
agauaugacuagaagcucauuu

SEQ ID NO: 1125631 - RNA, 22 nt, Human
agagcccucucauuggcuuauu

SEQ ID NO: 1125632 - RNA, 23 nt, Human
ucccuggaggcagguccagggcc

SEQ ID NO: 1125633 - RNA, 22 nt, Human
caggcagcugggucaccguccc

SEQ ID NO: 1125634 - RNA, 22 nt, Human
uccuuccucggggacccagauc

SEQ ID NO: 1125635 - RNA, 22 nt, Human
cagaaugagauaacccagauug

SEQ ID NO: 1125636 - RNA, 22 nt, Human
aaggcacucagccuugggacag

SEQ ID NO: 1125637 - RNA, 22 nt, Human
uuccucaucugugcaccucacu

SEQ ID NO: 1125638 - RNA, 23 nt, Human
cacugcagcguggucuggcagga

SEQ ID NO: 1125639 - RNA, 22 nt, Human
ggaugcugacuuuggagcaugg

SEQ ID NO: 1125640 - RNA, 22 nt, Human
caggaaagguagucacaaugua

SEQ ID NO: 1125641 - RNA, 22 nt, Human
gucccuggaauggacucugcgc

SEQ ID NO: 1125642 - RNA, 22 nt, Human
cuggcagcuuccuuugcaucug

SEQ ID NO: 1125643 - RNA, 22 nt, Human
uccugccuaccuugcggaggug

SEQ ID NO: 1125644 - RNA, 22 nt, Human
acauguuagaaaugcagaaucu

SEQ ID NO: 1125645 - RNA, 22 nt, Human
uuguuacagcagugauuucaga

SEQ ID NO: 1125646 - RNA, 22 nt, Human
cagaggcucuuccucacugccc

SEQ ID NO: 1125647 - RNA, 22 nt, Human
agucccagaugacccagcuacu

SEQ ID NO: 1125648 - RNA, 22 nt, Human
cagccagguaugggcgugcggg

SEQ ID NO: 1125649 - RNA, 22 nt, Human
caggguggcaggcaccauggcc

SEQ ID NO: 1125650 - RNA, 22 nt, Human
gucauuucuguuucuucagugc

SEQ ID NO: 1125651 - RNA, 22 nt, Human
ugucccauggacacaacuucuu

SEQ ID NO: 1125652 - RNA, 22 nt, Human
aucacaggugguaggaaaagaa

SEQ ID NO: 1125653 - RNA, 22 nt, Human
ggagccaguauuuaguggucuu

SEQ ID NO: 1125654 - RNA, 22 nt, Human
aaauaauguuaggccuuugcuc

SEQ ID NO: 1125655 - RNA, 22 nt, Human
uuucuuauauucugucauuguu

SEQ ID NO: 1125656 - RNA, 22 nt, Human
aagcugcccaagacugaagcau

SEQ ID NO: 1125657 - RNA, 22 nt, Human
aaguaugacauuuaagacaauu

SEQ ID NO: 1125658 - RNA, 22 nt, Human
agaauccugaugaaaaggagag

SEQ ID NO: 1125659 - RNA, 22 nt, Human
uccuuccuggggucucugcugc

SEQ ID NO: 1125660 - RNA, 22 nt, Human
ugggcuguccagcaccugggcu

SEQ ID NO: 1125661 - RNA, 19 nt, Human
ugagagugaggaaggcuuc

SEQ ID NO: 1125662 - RNA, 22 nt, Human
uugaagcaaauucugugcagua

SEQ ID NO: 1125663 - RNA, 22 nt, Human
cccuggcaaaacacucucuuga

SEQ ID NO: 1125664 - RNA, 22 nt, Human
cuuggcugucuauaggaaagag

SEQ ID NO: 1125665 - RNA, 22 nt, Human
gcucuggacccuggaguggcug

SEQ ID NO: 1125666 - RNA, 22 nt, Human
aagcacuuagaagagugccugc

SEQ ID NO: 1125667 - RNA, 22 nt, Human
agggucccgaaggagacagcaa

SEQ ID NO: 1125668 - RNA, 22 nt, Human
caggguccaucuuucaucacug

SEQ ID NO: 1125669 - RNA, 22 nt, Human
acugggccggugcagaguaguu

SEQ ID NO: 1125670 - RNA, 22 nt, Human
ggccucugccucaucugggcac

SEQ ID NO: 1125671 - RNA, 22 nt, Human
cagaaauucccauuucagauuc

SEQ ID NO: 1125672 - RNA, 22 nt, Human
uuauuaaugaguacaaguuauu

SEQ ID NO: 1125673 - RNA, 22 nt, Human
uucaagaugccagggacgcggc

SEQ ID NO: 1125674 - RNA, 22 nt, Human
gugugcgcgcgcgucccgggug

SEQ ID NO: 1125675 - RNA, 22 nt, Human
ggucccugguucccucugagcu

SEQ ID NO: 1125676 - RNA, 22 nt, Human
cacagaggcaaccuucuggggu

SEQ ID NO: 1125677 - RNA, 22 nt, Human
ugcagcugauuaaagggcagac

SEQ ID NO: 1125678 - RNA, 22 nt, Human
caugggcuuuggaggcuggagg

SEQ ID NO: 1125679 - RNA, 22 nt, Human
cuggccuuuuguuucuggagaa

SEQ ID NO: 1125680 - RNA, 22 nt, Human
gccagcaguccugcugugugcc

SEQ ID NO: 1125681 - RNA, 21 nt, Human
acaugcauagagagauuucug

SEQ ID NO: 1125682 - RNA, 22 nt, Human
cuggcagguuuggugucuggug

SEQ ID NO: 1125683 - RNA, 22 nt, Human
caggcagcucgaugccuuguug

SEQ ID NO: 1125684 - RNA, 22 nt, Human
gcccuuccuuagacagcaggau

SEQ ID NO: 1125685 - RNA, 22 nt, Human
gcuggcagagacaagaagacua

SEQ ID NO: 1125686 - RNA, 22 nt, Human
ucuggccugaaaguccaugcuu

SEQ ID NO: 1125687 - RNA, 22 nt, Human
aggaccaguaugagagcaucug

SEQ ID NO: 1125688 - RNA, 22 nt, Human
uuucacaaguuucaggauucug

SEQ ID NO: 1125689 - RNA, 22 nt, Human
cauuuagacauuugauuugggg

SEQ ID NO: 1125690 - RNA, 22 nt, Human
uuucucugaggcuggccucccu

SEQ ID NO: 1125691 - RNA, 22 nt, Human
ucaaaguuuuugagaauuacau

SEQ ID NO: 1125692 - RNA, 22 nt, Human
cagcagcuucuguugaucagaa

SEQ ID NO: 1125693 - RNA, 22 nt, Human
uuugcuauuuuucugugcagcu

SEQ ID NO: 1125694 - RNA, 22 nt, Human
gaggcagcuuggggcugugggu

SEQ ID NO: 1125695 - RNA, 22 nt, Human
auucugucuuuuuaaaauaaua

SEQ ID NO: 1125696 - RNA, 22 nt, Human
aggcacuguggaagacaugguu

SEQ ID NO: 1125697 - RNA, 22 nt, Human
gcucagaaaagugaggcucagu

SEQ ID NO: 1125698 - RNA, 22 nt, Human
ucagcugaaguggagaagcaga

SEQ ID NO: 1125699 - RNA, 22 nt, Human
aaauauguaagauuagcacuag

SEQ ID NO: 1125700 - RNA, 22 nt, Human
acuuuuuacaggguguauacca

SEQ ID NO: 1125701 - RNA, 22 nt, Human
uuucagaugcaauuaauuuuca

SEQ ID NO: 1125702 - RNA, 22 nt, Human
uggcagaguggaccauacucaa

SEQ ID NO: 1125703 - RNA, 22 nt, Human
cagcacuggggggauucggagc

SEQ ID NO: 1125704 - RNA, 22 nt, Human
aggaccagaggccagagucagc

SEQ ID NO: 1125705 - RNA, 22 nt, Human
aaacagaaggguagguaaacau

SEQ ID NO: 1125706 - RNA, 17 nt, Human
uuuguucguuaguccgg

SEQ ID NO: 1125707 - RNA, 19 nt, Human
agugucaucagcuacucag

SEQ ID NO: 1125708 - RNA, 22 nt, Human
gccugugcuuaacugacgugag

SEQ ID NO: 1125709 - RNA, 20 nt, Human
accucugcaucaauccuuug

SEQ ID NO: 1125710 - RNA, 22 nt, Human
aguauuucuaguugguucuacu

SEQ ID NO: 1125711 - RNA, 22 nt, Human
gcagggacaccuuugugaagcu

SEQ ID NO: 1125712 - RNA, 23 nt, Human
gcaggugguucgaacagaaguuu

SEQ ID NO: 1125713 - RNA, 19 nt, Human
uugcauuguaguuggacug

SEQ ID NO: 1125714 - RNA, 22 nt, Human
ucuagaaauuuugccuuguauu

SEQ ID NO: 1125715 - RNA, 20 nt, Human
cucugcagcaaggccugggu

SEQ ID NO: 1125716 - RNA, 22 nt, Human
acaugcuuucuagguccuucug

SEQ ID NO: 1125717 - RNA, 21 nt, Human
gcagacugcccugcugucccc

SEQ ID NO: 1125718 - RNA, 22 nt, Human
uauagaaguaagcauugugaug

SEQ ID NO: 1125719 - RNA, 22 nt, Human
agcuuccucaccucagaggucu

SEQ ID NO: 1125720 - RNA, 22 nt, Human
ucaaguauaucuagucauuagg

SEQ ID NO: 1125721 - RNA, 22 nt, Human
agagcucaagacgcucacagua

SEQ ID NO: 1125722 - RNA, 22 nt, Human
aggacuucaucaccuguauaaa

SEQ ID NO: 1125723 - RNA, 18 nt, Human
augggaggggccaagaga

SEQ ID NO: 1125724 - RNA, 20 nt, Human
gcaggcagggaaugggggug

SEQ ID NO: 1125725 - RNA, 22 nt, Human
cugcagaggguuugagcauccu

SEQ ID NO: 1125726 - RNA, 22 nt, Human
aaugcuguauaucuuagcuaau

SEQ ID NO: 1125727 - RNA, 19 nt, Human
ucaaaugccaaugucacag

SEQ ID NO: 1125728 - RNA, 22 nt, Human
ggcagcuggguuggccagaaac

SEQ ID NO: 1125729 - RNA, 22 nt, Human
agaaaucacaggaggcagaagg

SEQ ID NO: 1125730 - RNA, 22 nt, Human
accagagcuggcagaguaucaa

SEQ ID NO: 1125731 - RNA, 22 nt, Human
aagggaggaggauuuauuguac

SEQ ID NO: 1125732 - RNA, 22 nt, Human
uucaagaucuggguuuucagcu

SEQ ID NO: 1125733 - RNA, 22 nt, Human
agagccuggaccugagcuacaa

SEQ ID NO: 1125734 - RNA, 22 nt, Human
cccuggagggacagcugcucua

SEQ ID NO: 1125735 - RNA, 22 nt, Human
uuuaauacuauggggaugaaca

SEQ ID NO: 1125736 - RNA, 22 nt, Human
auuuccucaugaucauaaugca

SEQ ID NO: 1125737 - RNA, 22 nt, Human
gagggaaagguuaauacaugau

SEQ ID NO: 1125738 - RNA, 22 nt, Human
guacuuccagccaagugagaca

SEQ ID NO: 1125739 - RNA, 22 nt, Human
aggcagagcuggguuuugaaau

SEQ ID NO: 1125740 - RNA, 22 nt, Human
ccaggcccugcuccucacacca

SEQ ID NO: 1125741 - RNA, 22 nt, Human
caggccugggcuucggggcuga

SEQ ID NO: 1125742 - RNA, 22 nt, Human
gcaaaugaguuguaacauaaaa

SEQ ID NO: 1125743 - RNA, 22 nt, Human
uucacaggauauaugugcaggg

SEQ ID NO: 1125744 - RNA, 22 nt, Human
guguggcugccagccaagaggc

SEQ ID NO: 1125745 - RNA, 22 nt, Human
caugcuuuaccaaagcagugau

SEQ ID NO: 1125746 - RNA, 22 nt, Human
gccuggagggcucuagagaggc

SEQ ID NO: 1125747 - RNA, 22 nt, Human
auaaggcauauagucacuuuuu

SEQ ID NO: 1125748 - RNA, 22 nt, Human
uugauacaggcucuauuucauc

SEQ ID NO: 1125749 - RNA, 22 nt, Human
uccucugccaaagggaguugcc

SEQ ID NO: 1125750 - RNA, 22 nt, Human
cccaagcagggugcagaggcau

SEQ ID NO: 1125751 - RNA, 22 nt, Human
cauuauguucaguagcuuaaaa

SEQ ID NO: 1125752 - RNA, 22 nt, Human
acuuccuggcguagcugacauu

SEQ ID NO: 1125753 - RNA, 22 nt, Human
cagccaggccuggugaccaaag

SEQ ID NO: 1125754 - RNA, 22 nt, Human
ucugggagauccaagcagaacu

SEQ ID NO: 1125755 - RNA, 21 nt, Human
accaggcuugugggagggagc

SEQ ID NO: 1125756 - RNA, 22 nt, Human
accaaggagacaaagguguauu

SEQ ID NO: 1125757 - RNA, 19 nt, Human
ccuuugaaucaggacacuu

SEQ ID NO: 1125758 - RNA, 21 nt, Human
gagugcagcaagguagagucu

SEQ ID NO: 1125759 - RNA, 22 nt, Human
agccaaggagugcagguggcuu

SEQ ID NO: 1125760 - RNA, 22 nt, Human
cuguuuauuacacuggauagca

SEQ ID NO: 1125761 - RNA, 22 nt, Human
uccagugguuugaaaggggugu

SEQ ID NO: 1125762 - RNA, 22 nt, Human
ccuggagcacauggcaggaggc

SEQ ID NO: 1125763 - RNA, 22 nt, Human
uaagaacauaaauucauacggg

SEQ ID NO: 1125764 - RNA, 22 nt, Human
uggagcugggaguccugggcug

SEQ ID NO: 1125765 - RNA, 22 nt, Human
aggggccuggacauggacgcgc

SEQ ID NO: 1125766 - RNA, 21 nt, Human
uaagaacauuaucuucuuccu

SEQ ID NO: 1125767 - RNA, 22 nt, Human
ccagguggcuucugcccgaugu

SEQ ID NO: 1125768 - RNA, 22 nt, Human
uaacagaaaagaacugaguuug

SEQ ID NO: 1125769 - RNA, 22 nt, Human
uaagacacaugcguacaagaua

SEQ ID NO: 1125770 - RNA, 22 nt, Human
aauaguguuguucacucaggag

SEQ ID NO: 1125771 - RNA, 22 nt, Human
aacucaguuacauauuagaaua

SEQ ID NO: 1125772 - RNA, 22 nt, Human
aggccuggugugccggaugcag

SEQ ID NO: 1125773 - RNA, 22 nt, Human
ucuucucccaucuccaggcagg

SEQ ID NO: 1125774 - RNA, 22 nt, Human
cugcuuugauuagaagaguaca

SEQ ID NO: 1125775 - RNA, 21 nt, Human
uggcucuggguaggagagugc

SEQ ID NO: 1125776 - RNA, 22 nt, Human
uaauuuaauuccauggauucua

SEQ ID NO: 1125777 - RNA, 22 nt, Human
ccagggugggaggcugaaggcg

SEQ ID NO: 1125778 - RNA, 22 nt, Human
cucaggaucgcuugcccuaggg

SEQ ID NO: 1125779 - RNA, 22 nt, Human
ccuguggcucucuuuggagguc

SEQ ID NO: 1125780 - RNA, 18 nt, Human
cagaaguccuucaaggcc

SEQ ID NO: 1125781 - RNA, 22 nt, Human
uaaauguguguagccaucugug

SEQ ID NO: 1125782 - RNA, 22 nt, Human
gagcccuggcagucugggaugg

SEQ ID NO: 1125783 - RNA, 22 nt, Human
augaguaagaccauaauuuuug

SEQ ID NO: 1125784 - RNA, 22 nt, Human
aucuggcucauucagggaacgg

SEQ ID NO: 1125785 - RNA, 22 nt, Human
cugcuucuaagaaccugcagcu

SEQ ID NO: 1125786 - RNA, 22 nt, Human
ugccugaguuuaacccucagag

SEQ ID NO: 1125787 - RNA, 17 nt, Human
agugacuuggaaagagc

SEQ ID NO: 1125788 - RNA, 22 nt, Human
ccagccaggcauugcaaacuga

SEQ ID NO: 1125789 - RNA, 22 nt, Human
ccuggagcacagcccaguccca

SEQ ID NO: 1125790 - RNA, 22 nt, Human
ugucccauggauaccaggcuau

SEQ ID NO: 1125791 - RNA, 22 nt, Human
ccugcaggggagagacuucuag

SEQ ID NO: 1125792 - RNA, 22 nt, Human
acccucccauuuccauguagca

SEQ ID NO: 1125793 - RNA, 22 nt, Human
uggcucagagagggagugugga

SEQ ID NO: 1125794 - RNA, 20 nt, Human
cagggccacgcuccaaggca

SEQ ID NO: 1125795 - RNA, 21 nt, Human
ugggcacugagggugcugcuc

SEQ ID NO: 1125796 - RNA, 22 nt, Human
gcacagaacagagaaauagcca

SEQ ID NO: 1125797 - RNA, 22 nt, Human
ccugccugcggcccgcggggag

SEQ ID NO: 1125798 - RNA, 22 nt, Human
cuguccucuguccucagcagga

SEQ ID NO: 1125799 - RNA, 18 nt, Human
gagacacaagggccugga

SEQ ID NO: 1125800 - RNA, 22 nt, Human
uauauauaugcacacacaccua

SEQ ID NO: 1125801 - RNA, 20 nt, Human
ucacaucuggcagcugauga

SEQ ID NO: 1125802 - RNA, 22 nt, Human
aucuggcuuaccuagggugccu

SEQ ID NO: 1125803 - RNA, 22 nt, Human
gacagagugcagggcuagaaga

SEQ ID NO: 1125804 - RNA, 22 nt, Human
caggguagacaguaggugucug

SEQ ID NO: 1125805 - RNA, 22 nt, Human
ugcugccaccugguggcugaag

SEQ ID NO: 1125806 - RNA, 22 nt, Human
uguauuuuuaggaaugcgcuau

SEQ ID NO: 1125807 - RNA, 22 nt, Human
cagcagugugcaggugugcugg

SEQ ID NO: 1125808 - RNA, 22 nt, Human
cucaggauuuaaaggggcacuc

SEQ ID NO: 1125809 - RNA, 21 nt, Human
ggucuuccaaauaaggagaaa

SEQ ID NO: 1125810 - RNA, 19 nt, Human
ugucuuaauuaacucagag

SEQ ID NO: 1125811 - RNA, 22 nt, Human
guggcccugucccaggccuccu

SEQ ID NO: 1125812 - RNA, 22 nt, Human
aaaugcaauuguauguacucca

SEQ ID NO: 1125813 - RNA, 22 nt, Human
gcacugaaugcuuuuacuguaa

SEQ ID NO: 1125814 - RNA, 22 nt, Human
ccuggcagacugugagggcagg

SEQ ID NO: 1125815 - RNA, 22 nt, Human
uuugaauagggcuuugcaggga

SEQ ID NO: 1125816 - RNA, 22 nt, Human
aggcucugcagaccccagcugu

SEQ ID NO: 1125817 - RNA, 19 nt, Human
ugcuuccucaccaucuccc

SEQ ID NO: 1125818 - RNA, 22 nt, Human
uggccuggugcucaggcaguag

SEQ ID NO: 1125819 - RNA, 22 nt, Human
agagacaggguuuugccauguu

SEQ ID NO: 1125820 - RNA, 22 nt, Human
accacugcccauggugaaaacu

SEQ ID NO: 1125821 - RNA, 22 nt, Human
cugugcuugcggguguggagcc

SEQ ID NO: 1125822 - RNA, 22 nt, Human
gggcuggcaggaccugggcuga

SEQ ID NO: 1125823 - RNA, 22 nt, Human
uuaggcaaagcuggaauccagg

SEQ ID NO: 1125824 - RNA, 22 nt, Human
ggggauggugggaaggcaaucu

SEQ ID NO: 1125825 - RNA, 22 nt, Human
aaaaguauuggccaccauuucu

SEQ ID NO: 1125826 - RNA, 22 nt, Human
auuuguuccacacauauuuacu

SEQ ID NO: 1125827 - RNA, 22 nt, Human
caggggcuguggcacauggugu

SEQ ID NO: 1125828 - RNA, 22 nt, Human
auugacaagugagcugggcugc

SEQ ID NO: 1125829 - RNA, 22 nt, Human
cccucugaccuccugccacagu

SEQ ID NO: 1125830 - RNA, 22 nt, Human
caagaugaaacuacagggagga

SEQ ID NO: 1125831 - RNA, 22 nt, Human
cacauguacagaagcaggcugg

SEQ ID NO: 1125832 - RNA, 22 nt, Human
agcagggcagugcuucagcucu

SEQ ID NO: 1125833 - RNA, 22 nt, Human
augguugaaucaagguagacaa

SEQ ID NO: 1125834 - RNA, 22 nt, Human
aguggccagugcugcucugggg

SEQ ID NO: 1125835 - RNA, 22 nt, Human
caggcagaagaaguggaaggac

SEQ ID NO: 1125836 - RNA, 22 nt, Human
auguguccacaggugugagaga

SEQ ID NO: 1125837 - RNA, 22 nt, Human
gagggucccgagcccugucaga

SEQ ID NO: 1125838 - RNA, 22 nt, Human
uagcugccagaccauucuuacu

SEQ ID NO: 1125839 - RNA, 22 nt, Human
uuacauuuuaguuaaccuguga

SEQ ID NO: 1125840 - RNA, 22 nt, Human
cuggagcuggcuuccuuccacu

SEQ ID NO: 1125841 - RNA, 22 nt, Human
cugggagauugcuagagaugca

SEQ ID NO: 1125842 - RNA, 22 nt, Human
gccaggcucagcagucaaccug

SEQ ID NO: 1125843 - RNA, 22 nt, Human
cuaucuuucgauucuagcuuaa

SEQ ID NO: 1125844 - RNA, 22 nt, Human
gcagggcacagacagugccaag

SEQ ID NO: 1125845 - RNA, 22 nt, Human
gcaaugauauugaagugaugaa

SEQ ID NO: 1125846 - RNA, 20 nt, Human
uggagcuguaaucuugucug

SEQ ID NO: 1125847 - RNA, 22 nt, Human
ggcaggcugcuugggucauguc

SEQ ID NO: 1125848 - RNA, 22 nt, Human
uagauuucaggcuggcuugcgg

SEQ ID NO: 1125849 - RNA, 22 nt, Human
ggcaugggccgaggugccuccu

SEQ ID NO: 1125850 - RNA, 22 nt, Human
ucucccacagucucccauggcu

SEQ ID NO: 1125851 - RNA, 22 nt, Human
agggcugcugcuccgggcccag

SEQ ID NO: 1125852 - RNA, 22 nt, Human
cgucccaguuccagccgcgcug

SEQ ID NO: 1125853 - RNA, 22 nt, Human
cauacuuugggauaagagugga

SEQ ID NO: 1125854 - RNA, 22 nt, Human
cugacccauauaagaguggagg

SEQ ID NO: 1125855 - RNA, 22 nt, Human
ucagcugcucuguugagcugaa

SEQ ID NO: 1125856 - RNA, 18 nt, Human
agaguguucucagugaaa

SEQ ID NO: 1125857 - RNA, 22 nt, Human
auguuucugaguguauauacau

SEQ ID NO: 1125858 - RNA, 22 nt, Human
cagcuggcauaccugggcccgg

SEQ ID NO: 1125859 - RNA, 22 nt, Human
cugcuuuguaaaauagacauaa

SEQ ID NO: 1125860 - RNA, 20 nt, Human
cugugccuaaaccuccgggu

SEQ ID NO: 1125861 - RNA, 22 nt, Human
ugggccacuugaaaguggaugu

SEQ ID NO: 1125862 - RNA, 22 nt, Human
auaauguagguauguguauuua

SEQ ID NO: 1125863 - RNA, 22 nt, Human
cugggagcggcugucacugguu

SEQ ID NO: 1125864 - RNA, 22 nt, Human
gcagcugggccccagccucucc

SEQ ID NO: 1125865 - RNA, 22 nt, Human
ggccugagcagacagcaugaug

SEQ ID NO: 1125866 - RNA, 22 nt, Human
ugcuggggagugauugaccauc

SEQ ID NO: 1125867 - RNA, 22 nt, Human
uuuuaaucaugcuucuaugucc

SEQ ID NO: 1125868 - RNA, 22 nt, Human
ucucucagaggccaggguccug

SEQ ID NO: 1125869 - RNA, 21 nt, Human
uccaggaguggcugggcaggg

SEQ ID NO: 1125870 - RNA, 22 nt, Human
cagggagcuggcuggcgugagu

SEQ ID NO: 1125871 - RNA, 22 nt, Human
aauccagguggcggagguugug

SEQ ID NO: 1125872 - RNA, 22 nt, Human
uaggcaggugugcacugcccac

SEQ ID NO: 1125873 - RNA, 22 nt, Human
ggcucugggucuguggggagcg

SEQ ID NO: 1125874 - RNA, 22 nt, Human
ggcucccugccuguccucaguc

SEQ ID NO: 1125875 - RNA, 22 nt, Human
agggacagucuacuguucacug

SEQ ID NO: 1125876 - RNA, 22 nt, Human
gaagcccauuuguacagcacau

SEQ ID NO: 1125877 - RNA, 22 nt, Human
ccaggagucaauaaaggaagcu

SEQ ID NO: 1125878 - RNA, 22 nt, Human
acagaaauauucguggugcuug

SEQ ID NO: 1125879 - RNA, 22 nt, Human
cagccccucacagagcuguccu

SEQ ID NO: 1125880 - RNA, 22 nt, Human
auacaucucauguaagagauaa

SEQ ID NO: 1125881 - RNA, 22 nt, Human
ucuggccauggcaagccgagug

SEQ ID NO: 1125882 - RNA, 22 nt, Human
gaugcacagugacccugccagu

SEQ ID NO: 1125883 - RNA, 22 nt, Human
ucugccugcuaacuccugcacc

SEQ ID NO: 1125884 - RNA, 22 nt, Human
uugccaggagcucaucugaggg

SEQ ID NO: 1125885 - RNA, 21 nt, Human
uccuucaguucugcacuuucu

SEQ ID NO: 1125886 - RNA, 22 nt, Human
ccuggccugugaaucugagagc

SEQ ID NO: 1125887 - RNA, 22 nt, Human
ucucagagaaaugugucaccau

SEQ ID NO: 1125888 - RNA, 22 nt, Human
ucaggaucggccuuuuuuuaag

SEQ ID NO: 1125889 - RNA, 18 nt, Human
ccuggcuuccaucuuggu

SEQ ID NO: 1125890 - RNA, 22 nt, Human
uccaggagagguguggggacug

SEQ ID NO: 1125891 - RNA, 22 nt, Human
auauguguacgugcaguauaua

SEQ ID NO: 1125892 - RNA, 22 nt, Human
gccaggcuggaaagaacagaca

SEQ ID NO: 1125893 - RNA, 22 nt, Human
ggcagagcugcaugagcacuca

SEQ ID NO: 1125894 - RNA, 22 nt, Human
gcagcugccccgacugugaguc

SEQ ID NO: 1125895 - RNA, 22 nt, Human
agcagcagauccaaaaaaugug

SEQ ID NO: 1125896 - RNA, 22 nt, Human
ucaacagaagugauagcuauua

SEQ ID NO: 1125897 - RNA, 23 nt, Human
ucugucacuuucugcuguggagu

SEQ ID NO: 1125898 - RNA, 22 nt, Human
agaugcugccucuccucacaag

SEQ ID NO: 1125899 - RNA, 22 nt, Human
ggcacugggagaggugagacgg

SEQ ID NO: 1125900 - RNA, 22 nt, Human
accagguggccccagcgugguu

SEQ ID NO: 1125901 - RNA, 22 nt, Human
auuuuuccaauuaggauaaaga

SEQ ID NO: 1125902 - RNA, 22 nt, Human
auacaucuaugccuuucugaca

SEQ ID NO: 1125903 - RNA, 22 nt, Human
uuccucuccucccaccagguga

SEQ ID NO: 1125904 - RNA, 22 nt, Human
uggaaagaaaaacaggccauga

SEQ ID NO: 1125905 - RNA, 18 nt, Human
gggcaucauucacaaagu

SEQ ID NO: 1125906 - RNA, 22 nt, Human
aaaguuuguugcuuacaaagaa

SEQ ID NO: 1125907 - RNA, 21 nt, Human
guguuuccuguuuauggcuug

SEQ ID NO: 1125908 - RNA, 22 nt, Human
uccaauguguuuguggcaugga

SEQ ID NO: 1125909 - RNA, 21 nt, Human
gcaggggauagaaauggucug

SEQ ID NO: 1125910 - RNA, 22 nt, Human
ugaaaaggagccuuagguaggu

SEQ ID NO: 1125911 - RNA, 22 nt, Human
acagcagcuaaaggugucuccu

SEQ ID NO: 1125912 - RNA, 22 nt, Human
uauguguguuucaguggaaaug

SEQ ID NO: 1125913 - RNA, 22 nt, Human
agaagccacuggagguugagau

SEQ ID NO: 1125914 - RNA, 22 nt, Human
uggcuuccaaaggaaugggccu

SEQ ID NO: 1125915 - RNA, 22 nt, Human
agauaauuugaguaaauuaauu

SEQ ID NO: 1125916 - RNA, 16 nt, Human
gagccaggugccuuga

SEQ ID NO: 1125917 - RNA, 22 nt, Human
accaaggaagagauucucaguu

SEQ ID NO: 1125918 - RNA, 22 nt, Human
accccagaggcggaggcugcag

SEQ ID NO: 1125919 - RNA, 22 nt, Human
aaaugcagcagcuaauugaaaa

SEQ ID NO: 1125920 - RNA, 22 nt, Human
uaugagcuuccaguguugcaug

SEQ ID NO: 1125921 - RNA, 22 nt, Human
agccacaccuguccugccagcu

SEQ ID NO: 1125922 - RNA, 22 nt, Human
uuagauaauguuauuguaauuu

SEQ ID NO: 1125923 - RNA, 22 nt, Human
agcuggccuucggugucacugg

SEQ ID NO: 1125924 - RNA, 22 nt, Human
gcaggaagaugagcucagguaa

SEQ ID NO: 1125925 - RNA, 22 nt, Human
aguuucauauuaccaugucacc

SEQ ID NO: 1125926 - RNA, 20 nt, Human
gucagugucuucaguaguga

SEQ ID NO: 1125927 - RNA, 22 nt, Human
ggguguguuccuaaggaaacca

SEQ ID NO: 1125928 - RNA, 22 nt, Human
cagaggaggccaccgcauaggc

SEQ ID NO: 1125929 - RNA, 22 nt, Human
ugcauuguaggauguuuagcag

SEQ ID NO: 1125930 - RNA, 22 nt, Human
gaguuauuaauggcugaguuug

SEQ ID NO: 1125931 - RNA, 22 nt, Human
cagcugaauucuucagacucca

SEQ ID NO: 1125932 - RNA, 22 nt, Human
cugucaguaggcucccaucauu

SEQ ID NO: 1125933 - RNA, 22 nt, Human
gcugugugacugagagccuggc

SEQ ID NO: 1125934 - RNA, 22 nt, Human
uggcucagcuuuccccaucugg

SEQ ID NO: 1125935 - RNA, 22 nt, Human
gacagaggcaagaccagaagcc

SEQ ID NO: 1125936 - RNA, 22 nt, Human
cucagaguccauaguuuacagu

SEQ ID NO: 1125937 - RNA, 22 nt, Human
gcugccuuugugagccaagggg

SEQ ID NO: 1125938 - RNA, 22 nt, Human
ccagcacugcucucagacugag

SEQ ID NO: 1125939 - RNA, 22 nt, Human
ugcaagagguaaaaugaaagga

SEQ ID NO: 1125940 - RNA, 22 nt, Human
augggaugaacuugaucugcuu

SEQ ID NO: 1125941 - RNA, 22 nt, Human
caggcagagugagguggucuaa

SEQ ID NO: 1125942 - RNA, 22 nt, Human
cugaagaggacgcagcagcaag

SEQ ID NO: 1125943 - RNA, 22 nt, Human
gcagcaggcacggucucgacau

SEQ ID NO: 1125944 - RNA, 20 nt, Human
gucugaggagcagugggaaa

SEQ ID NO: 1125945 - RNA, 22 nt, Human
acagaauugauggaaaucucag

SEQ ID NO: 1125946 - RNA, 22 nt, Human
ggcaugggagugagcaaccuua

SEQ ID NO: 1125947 - RNA, 19 nt, Human
auuugaaagcugugcuugc

SEQ ID NO: 1125948 - RNA, 22 nt, Human
aggaaaugcugaugcuccugga

SEQ ID NO: 1125949 - RNA, 22 nt, Human
aaaauguguuuaugcauuucgu

SEQ ID NO: 1125950 - RNA, 22 nt, Human
aguauacauauauuagccuucg

SEQ ID NO: 1125951 - RNA, 22 nt, Human
aagggaaaucauauggugcagu

SEQ ID NO: 1125952 - RNA, 18 nt, Human
ucuggcucaggacugaac

SEQ ID NO: 1125953 - RNA, 22 nt, Human
uaaguaaauuuauaaugugauu

SEQ ID NO: 1125954 - RNA, 22 nt, Human
agcccuucaaccugccuacucc

SEQ ID NO: 1125955 - RNA, 22 nt, Human
gcagggacaacugugcaccuga

SEQ ID NO: 1125956 - RNA, 22 nt, Human
acagcuuuucaauucugcugag

SEQ ID NO: 1125957 - RNA, 22 nt, Human
gcucuguacgcaggaugagggg

SEQ ID NO: 1125958 - RNA, 22 nt, Human
ggcuggccuguguggccgccac

SEQ ID NO: 1125959 - RNA, 22 nt, Human
ggcugccuggaccuccucuuuc

SEQ ID NO: 1125960 - RNA, 22 nt, Human
cagggcaggaauuugacauugc

SEQ ID NO: 1125961 - RNA, 22 nt, Human
cucuggagcgcugcuucccgcg

SEQ ID NO: 1125962 - RNA, 22 nt, Human
aagggcugccagggggugccag

SEQ ID NO: 1125963 - RNA, 22 nt, Human
cagagggagcccuccaggagca

SEQ ID NO: 1125964 - RNA, 20 nt, Human
uaugaguauuacuuucagga

SEQ ID NO: 1125965 - RNA, 22 nt, Human
agagaaaagaguucaggcuuug

SEQ ID NO: 1125966 - RNA, 22 nt, Human
ccacagagacagagcccagggu

SEQ ID NO: 1125967 - RNA, 22 nt, Human
gagggauggugugagaggcuca

SEQ ID NO: 1125968 - RNA, 22 nt, Human
ugauggcuaucccuggaagggc

SEQ ID NO: 1125969 - RNA, 22 nt, Human
aggcucagagaugaguaagcac

SEQ ID NO: 1125970 - RNA, 22 nt, Human
cccagcuugcccaggacugagg

SEQ ID NO: 1125971 - RNA, 22 nt, Human
ggagcagagcugggcuuggcug

SEQ ID NO: 1125972 - RNA, 22 nt, Human
auguaucaacaaauuguacagu

SEQ ID NO: 1125973 - RNA, 22 nt, Human
guguauguguuuauagggaggu

SEQ ID NO: 1125974 - RNA, 22 nt, Human
aaaguccaggggcuggaggcgg

SEQ ID NO: 1125975 - RNA, 22 nt, Human
ccugucugaaggcagggggaug

SEQ ID NO: 1125976 - RNA, 22 nt, Human
cuugcuuuguccagaaauucag

SEQ ID NO: 1125977 - RNA, 20 nt, Human
cagcaggaaaagugccucag

SEQ ID NO: 1125978 - RNA, 23 nt, Human
agaggcaggaguggcuugcccgg

SEQ ID NO: 1125979 - RNA, 22 nt, Human
ucccagaguucaaugggaaggu

SEQ ID NO: 1125980 - RNA, 22 nt, Human
aguauguauuuuauacuuacag

SEQ ID NO: 1125981 - RNA, 22 nt, Human
cagaauuuagcacaauguaugg

SEQ ID NO: 1125982 - RNA, 22 nt, Human
ccuuucucuggcagcaggacag

SEQ ID NO: 1125983 - RNA, 22 nt, Human
aggcacugacaauucuggacug

SEQ ID NO: 1125984 - RNA, 22 nt, Human
agcuggugcugaagcucuugag

SEQ ID NO: 1125985 - RNA, 22 nt, Human
ggccucucuggcauggcugccc

SEQ ID NO: 1125986 - RNA, 22 nt, Human
cagccagagaaagggcacugcc

SEQ ID NO: 1125987 - RNA, 22 nt, Human
aaaugucuguuagucauaucau

SEQ ID NO: 1125988 - RNA, 22 nt, Human
cauugcacuccaucuugggcaa

SEQ ID NO: 1125989 - RNA, 22 nt, Human
agcuuuaugggagcuuagauaa

SEQ ID NO: 1125990 - RNA, 22 nt, Human
ugagggcugcuuccagagcuag

SEQ ID NO: 1125991 - RNA, 23 nt, Human
acuuaaaugguucuuuaucucag

SEQ ID NO: 1125992 - RNA, 22 nt, Human
ugucaccaguuccaggaaauaa

SEQ ID NO: 1125993 - RNA, 22 nt, Human
cugccucuccccagaguggccc

SEQ ID NO: 1125994 - RNA, 20 nt, Human
gcucccugguagaaauguuu

SEQ ID NO: 1125995 - RNA, 22 nt, Human
ugcagucuggauguccucagau

SEQ ID NO: 1125996 - RNA, 22 nt, Human
cucaguuucuucauauuguagg

SEQ ID NO: 1125997 - RNA, 22 nt, Human
cccaggcuggagugcaauggca

SEQ ID NO: 1125998 - RNA, 22 nt, Human
uggcuuccugcacagugucugc

SEQ ID NO: 1125999 - RNA, 22 nt, Human
uggcucugaccagguagaggag

SEQ ID NO: 1126000 - RNA, 22 nt, Human
cuuggcagauccaaaaaugaca

SEQ ID NO: 1126001 - RNA, 22 nt, Human
agacuucucaguuuuauuagua

SEQ ID NO: 1126002 - RNA, 22 nt, Human
gcagcccagagcgcaggacccc

SEQ ID NO: 1126003 - RNA, 22 nt, Human
ugcugucccccgugucugggcu

SEQ ID NO: 1126004 - RNA, 22 nt, Human
cugcucugaagccaggauucug

SEQ ID NO: 1126005 - RNA, 22 nt, Human
cacaguggcagguguggguugu

SEQ ID NO: 1126006 - RNA, 22 nt, Human
agccacagcccacaggacucuu

SEQ ID NO: 1126007 - RNA, 22 nt, Human
uggaugcuguaggacacgcucu

SEQ ID NO: 1126008 - RNA, 22 nt, Human
cagagcugagaauguugaugcu

SEQ ID NO: 1126009 - RNA, 22 nt, Human
gcauugucaaaagugguaugac

SEQ ID NO: 1126010 - RNA, 22 nt, Human
acccuggggguggccagugcca

SEQ ID NO: 1126011 - RNA, 22 nt, Human
cugugcuuccaggauggcagcu

SEQ ID NO: 1126012 - RNA, 22 nt, Human
uguaugugcuugagaagguggg

SEQ ID NO: 1126013 - RNA, 22 nt, Human
agcucacagaaauccugcagga

SEQ ID NO: 1126014 - RNA, 22 nt, Human
auggccuggggagcaugggaag

SEQ ID NO: 1126015 - RNA, 22 nt, Human
gccacaugcaauugcagcacgu

SEQ ID NO: 1126016 - RNA, 22 nt, Human
agcuuuauuugucauucacggc

SEQ ID NO: 1126017 - RNA, 22 nt, Human
gcuggccauagaagccaaagag

SEQ ID NO: 1126018 - RNA, 22 nt, Human
augggcugugagguccggcagg

SEQ ID NO: 1126019 - RNA, 22 nt, Human
aagauuucucuccuggaaagca

SEQ ID NO: 1126020 - RNA, 22 nt, Human
acagaccaaguuuccagcaggu

SEQ ID NO: 1126021 - RNA, 22 nt, Human
gugcauuugugcaugcacaugu

SEQ ID NO: 1126022 - RNA, 22 nt, Human
caggccugauacacugaacucu

SEQ ID NO: 1126023 - RNA, 22 nt, Human
accugagcaugccaggagagug

SEQ ID NO: 1126024 - RNA, 22 nt, Human
uguacaguaggaacuuguuauu

SEQ ID NO: 1126025 - RNA, 22 nt, Human
aaacagcugucauuguuuuaaa

SEQ ID NO: 1126026 - RNA, 22 nt, Human
ccugggaggcggagguugcagg

SEQ ID NO: 1126027 - RNA, 22 nt, Human
gcuggagguuucaccugaguuu

SEQ ID NO: 1126028 - RNA, 22 nt, Human
guucucucugcuuccaagaugg

SEQ ID NO: 1126029 - RNA, 19 nt, Human
uucacauuggaagaaguag

SEQ ID NO: 1126030 - RNA, 22 nt, Human
uaauguguugaauauuuguaca

SEQ ID NO: 1126031 - RNA, 22 nt, Human
ccugccaggcuuugggcuucug

SEQ ID NO: 1126032 - RNA, 22 nt, Human
cagagccuuccuagcagacucu

SEQ ID NO: 1126033 - RNA, 22 nt, Human
aacagugagaagguggacagga

SEQ ID NO: 1126034 - RNA, 22 nt, Human
agaggcugagaaacccucuucu

SEQ ID NO: 1126035 - RNA, 22 nt, Human
gaaauguguuguucauuucuaa

SEQ ID NO: 1126036 - RNA, 22 nt, Human
ucuuugcaucccuuccauaguu

SEQ ID NO: 1126037 - RNA, 22 nt, Human
ggccucagaccggagcuggcca

SEQ ID NO: 1126038 - RNA, 22 nt, Human
gaguuauucuagguccuuugua

SEQ ID NO: 1126039 - RNA, 20 nt, Human
ucagagucaucaaagauggu

SEQ ID NO: 1126040 - RNA, 22 nt, Human
cugccagcucgccacaaugaca

SEQ ID NO: 1126041 - RNA, 19 nt, Human
uuucaauggcuuagagaaa

SEQ ID NO: 1126042 - RNA, 22 nt, Human
ccugcugugaaacuggcauaug

SEQ ID NO: 1126043 - RNA, 22 nt, Human
uggcucuguugagguauggauu

SEQ ID NO: 1126044 - RNA, 22 nt, Human
uguuuuguuagcacucugggaa

SEQ ID NO: 1126045 - RNA, 22 nt, Human
aguggcagagguugacugcagu

SEQ ID NO: 1126046 - RNA, 22 nt, Human
agccaaggacacggagccuccu

SEQ ID NO: 1126047 - RNA, 22 nt, Human
aaagcaaugaugguagacacgu

SEQ ID NO: 1126048 - RNA, 22 nt, Human
cagagguagccgagugcaaucg

SEQ ID NO: 1126049 - RNA, 22 nt, Human
ccauuugucaccucugcacucc

SEQ ID NO: 1126050 - RNA, 17 nt, Human
cccagcuggcagugccg

SEQ ID NO: 1126051 - RNA, 22 nt, Human
cuggguggaucgcagccccagg

SEQ ID NO: 1126052 - RNA, 22 nt, Human
uucacaggaggguggaugcaug

SEQ ID NO: 1126053 - RNA, 22 nt, Human
ggaagagccuggggugucaggc

SEQ ID NO: 1126054 - RNA, 22 nt, Human
cuuauuauaaaauccuguuuga

SEQ ID NO: 1126055 - RNA, 22 nt, Human
gcagccagaagacucagaacaa

SEQ ID NO: 1126056 - RNA, 22 nt, Human
cccaccaguacagaugguagau

SEQ ID NO: 1126057 - RNA, 22 nt, Human
aagagcuggauggaaucuggga

SEQ ID NO: 1126058 - RNA, 22 nt, Human
agugcauuauauguuucaaugg

SEQ ID NO: 1126059 - RNA, 22 nt, Human
ccagagccuaagaucugauccu

SEQ ID NO: 1126060 - RNA, 22 nt, Human
uggccugcagcucucagggaag

SEQ ID NO: 1126061 - RNA, 22 nt, Human
cucugagagagcuggugagcac

SEQ ID NO: 1126062 - RNA, 22 nt, Human
uugaaaggcacaggcaccuggg

SEQ ID NO: 1126063 - RNA, 22 nt, Human
ccccuuccaggaagcagaaucg

SEQ ID NO: 1126064 - RNA, 22 nt, Human
agugaccaacaaugcugagaag

SEQ ID NO: 1126065 - RNA, 21 nt, Human
cucuggagucaagagcuucca

SEQ ID NO: 1126066 - RNA, 22 nt, Human
cagucccacaagaucuccacaa

SEQ ID NO: 1126067 - RNA, 22 nt, Human
uacuuaggugagauauuuucuu

SEQ ID NO: 1126068 - RNA, 18 nt, Human
cagaugagaugcaaucuc

SEQ ID NO: 1126069 - RNA, 22 nt, Human
cagaagcagugagagaugugca

SEQ ID NO: 1126070 - RNA, 22 nt, Human
aaggagugcaugacucagagua

SEQ ID NO: 1126071 - RNA, 22 nt, Human
aagcagccuggcaugaugcuuu

SEQ ID NO: 1126072 - RNA, 22 nt, Human
caaagguaguauauauauuguu

SEQ ID NO: 1126073 - RNA, 22 nt, Human
aagauuucagaguuugggggaa

SEQ ID NO: 1126074 - RNA, 22 nt, Human
agcagcuguggaaaaguaacua

SEQ ID NO: 1126075 - RNA, 22 nt, Human
caggcugaggcaguaggguuug

SEQ ID NO: 1126076 - RNA, 22 nt, Human
caggugggccgggguuuguucu

SEQ ID NO: 1126077 - RNA, 22 nt, Human
cucccuggaggcccagaccugg

SEQ ID NO: 1126078 - RNA, 22 nt, Human
ugggcagaauugugguaguuaa

SEQ ID NO: 1126079 - RNA, 22 nt, Human
cugcuuccaugcaauggcaguc

SEQ ID NO: 1126080 - RNA, 22 nt, Human
gcugcaggggggucuggacuug

SEQ ID NO: 1126081 - RNA, 22 nt, Human
gcuggagccuucugcucuguug

SEQ ID NO: 1126082 - RNA, 18 nt, Human
gcugagguggugucagag

SEQ ID NO: 1126083 - RNA, 22 nt, Human
ggagcuggcuacagagaacucc

SEQ ID NO: 1126084 - RNA, 22 nt, Human
gugccuggcacacagaaggcaa

SEQ ID NO: 1126085 - RNA, 22 nt, Human
gacaaaggaucagagguuggga

SEQ ID NO: 1126086 - RNA, 22 nt, Human
aaguuaugaaauuuggacagcu

SEQ ID NO: 1126087 - RNA, 22 nt, Human
uguaggacauguacuuguaaca

SEQ ID NO: 1126088 - RNA, 22 nt, Human
cagggacugagauccagacugu

SEQ ID NO: 1126089 - RNA, 22 nt, Human
cagcugccacaggacuuucuga

SEQ ID NO: 1126090 - RNA, 22 nt, Human
cagaggcugggaccucaggcau

SEQ ID NO: 1126091 - RNA, 22 nt, Human
guccugggaaggaagccaggga

SEQ ID NO: 1126092 - RNA, 22 nt, Human
ugucccagaucacaggagggga

SEQ ID NO: 1126093 - RNA, 22 nt, Human
gccuggagcagacgugucccgg

SEQ ID NO: 1126094 - RNA, 22 nt, Human
gaggccagaaugagcugaaugc

SEQ ID NO: 1126095 - RNA, 22 nt, Human
guaagcaucugucucuucugca

SEQ ID NO: 1126096 - RNA, 19 nt, Human
uguggccaugguucagcug

SEQ ID NO: 1126097 - RNA, 22 nt, Human
gagggcaguagccucguacccu

SEQ ID NO: 1126098 - RNA, 22 nt, Human
uccagggaugccagccauguug

SEQ ID NO: 1126099 - RNA, 20 nt, Human
gugccuggagaagaggcugu

SEQ ID NO: 1126100 - RNA, 22 nt, Human
uaguaucuuucuauauuuccca

SEQ ID NO: 1126101 - RNA, 22 nt, Human
aaguugaaugcguacgugacau

SEQ ID NO: 1126102 - RNA, 22 nt, Human
gcagcuuuguggagaggcccau

SEQ ID NO: 1126103 - RNA, 22 nt, Human
aggacuccauguguccuggaga

SEQ ID NO: 1126104 - RNA, 22 nt, Human
cccagcauccucagggagcggg

SEQ ID NO: 1126105 - RNA, 22 nt, Human
cagcugagcaucacuagucugg

SEQ ID NO: 1126106 - RNA, 22 nt, Human
agaauuuuugauuaucuacucg

SEQ ID NO: 1126107 - RNA, 22 nt, Human
ccucacuggccagccaggggug

SEQ ID NO: 1126108 - RNA, 22 nt, Human
gcugccaccguggagaugagug

SEQ ID NO: 1126109 - RNA, 22 nt, Human
gcagggagguuugcugaccugg

SEQ ID NO: 1126110 - RNA, 17 nt, Human
uauguaguacuuauaaa

SEQ ID NO: 1126111 - RNA, 22 nt, Human
aucuggcuuggguguggguagc

SEQ ID NO: 1126112 - RNA, 22 nt, Human
gcugcucuggcucugcaguguc

SEQ ID NO: 1126113 - RNA, 22 nt, Human
acagggccauuaucuguucuag

SEQ ID NO: 1126114 - RNA, 22 nt, Human
uaguaaaaguuuaguugaaagu

SEQ ID NO: 1126115 - RNA, 22 nt, Human
uacccaggagaaacagcagggc

SEQ ID NO: 1126116 - RNA, 22 nt, Human
gcagagcucuguucuuaucucc

SEQ ID NO: 1126117 - RNA, 22 nt, Human
gccuucaguagugucagcugua

SEQ ID NO: 1126118 - RNA, 22 nt, Human
ggaggccaguccuggccgggcu

SEQ ID NO: 1126119 - RNA, 22 nt, Human
aggcugagauagguggaucauu

SEQ ID NO: 1126120 - RNA, 22 nt, Human
uagucuuuugagaaguauaucu

SEQ ID NO: 1126121 - RNA, 22 nt, Human
cuccccagguucaggagguggg

SEQ ID NO: 1126122 - RNA, 22 nt, Human
cagggcacaguuauggaggugg

SEQ ID NO: 1126123 - RNA, 22 nt, Human
cuggcuucugggccagggcaga

SEQ ID NO: 1126124 - RNA, 22 nt, Human
guggggggacguuggucacuuu

SEQ ID NO: 1126125 - RNA, 22 nt, Human
aaaguguagagacuuuggaacc

SEQ ID NO: 1126126 - RNA, 22 nt, Human
aucuuccuucacuuucucccac

SEQ ID NO: 1126127 - RNA, 22 nt, Human
agcugcucucacuggacgccug

SEQ ID NO: 1126128 - RNA, 22 nt, Human
ucucuucuugauuuucacugga

SEQ ID NO: 1126129 - RNA, 22 nt, Human
uggcccugacagguccugggca

SEQ ID NO: 1126130 - RNA, 22 nt, Human
ggucuuccgagaggccugugcu

SEQ ID NO: 1126131 - RNA, 23 nt, Human
ugccucugccucccuagucugca

SEQ ID NO: 1126132 - RNA, 22 nt, Human
uacaaaguauauuucuagcugu

SEQ ID NO: 1126133 - RNA, 22 nt, Human
uaucuuuaacuugcaguauuua

SEQ ID NO: 1126134 - RNA, 22 nt, Human
gcagcuguguaaugagcccaca

SEQ ID NO: 1126135 - RNA, 22 nt, Human
uggagcugauacagcuggcuuu

SEQ ID NO: 1126136 - RNA, 22 nt, Human
uugaacagcuguuacauuguua

SEQ ID NO: 1126137 - RNA, 22 nt, Human
aaaugcacaauaaaguaaaggc

SEQ ID NO: 1126138 - RNA, 22 nt, Human
aauguuuuacagaucccauuag

SEQ ID NO: 1126139 - RNA, 19 nt, Human
uguuggugcggauguggag

SEQ ID NO: 1126140 - RNA, 22 nt, Human
gggccaugagagguucaucaac

SEQ ID NO: 1126141 - RNA, 22 nt, Human
caaaguccuagaacagugcuug

SEQ ID NO: 1126142 - RNA, 22 nt, Human
gcugggcuugguuucccugcuu

SEQ ID NO: 1126143 - RNA, 22 nt, Human
acugucaccaucagagcgggaa

SEQ ID NO: 1126144 - RNA, 22 nt, Human
gaauauauuauucagcuuuuca

SEQ ID NO: 1126145 - RNA, 22 nt, Human
guuuuuccuugcugaggacccg

SEQ ID NO: 1126146 - RNA, 22 nt, Human
cugggugaguugaugaaggaga

SEQ ID NO: 1126147 - RNA, 22 nt, Human
ugucucaguacacuccgauguu

SEQ ID NO: 1126148 - RNA, 22 nt, Human
gcugcagcagaaguucucagag

SEQ ID NO: 1126149 - RNA, 22 nt, Human
ugaggccaaugacccugggcag

SEQ ID NO: 1126150 - RNA, 22 nt, Human
gagcuggugugugcccgagcac

SEQ ID NO: 1126151 - RNA, 22 nt, Human
ggcagccagagggcagcuggau

SEQ ID NO: 1126152 - RNA, 22 nt, Human
ugugcccaucccucuggagugu

SEQ ID NO: 1126153 - RNA, 22 nt, Human
agcuucucaggagucugaggca

SEQ ID NO: 1126154 - RNA, 22 nt, Human
guucagggagggacagaugaag

SEQ ID NO: 1126155 - RNA, 22 nt, Human
uuccucagaaaauacuguccaa

SEQ ID NO: 1126156 - RNA, 22 nt, Human
acugucacuccaacugagucgu

SEQ ID NO: 1126157 - RNA, 22 nt, Human
ucccacacagcccgcucaccgg

SEQ ID NO: 1126158 - RNA, 22 nt, Human
uuuguucguucaugcacgguag

SEQ ID NO: 1126159 - RNA, 22 nt, Human
cacagggcagugauuguccaca

SEQ ID NO: 1126160 - RNA, 22 nt, Human
uuuuccucugcaauaaaagcag

SEQ ID NO: 1126161 - RNA, 22 nt, Human
ucagggacuuacaaaccagaag

SEQ ID NO: 1126162 - RNA, 22 nt, Human
agggcagcacagcugugcuccu

SEQ ID NO: 1126163 - RNA, 22 nt, Human
ucacaggcuccagggccuggau

SEQ ID NO: 1126164 - RNA, 22 nt, Human
guggcagcugguaugcagacag

SEQ ID NO: 1126165 - RNA, 22 nt, Human
gaguccaguuguucacagaggc

SEQ ID NO: 1126166 - RNA, 22 nt, Human
ucaaaaguuucacauagagaua

SEQ ID NO: 1126167 - RNA, 17 nt, Human
aggagucucagaugagc

SEQ ID NO: 1126168 - RNA, 22 nt, Human
uggcucugucacugugagcuau

SEQ ID NO: 1126169 - RNA, 19 nt, Human
ggcucagggcgcugccgcc

SEQ ID NO: 1126170 - RNA, 22 nt, Human
ugcaagaggaauucuagaagca

SEQ ID NO: 1126171 - RNA, 22 nt, Human
gcuggccucgcaggcaggaugu

SEQ ID NO: 1126172 - RNA, 22 nt, Human
gcugcagcccggcgcgccugag

SEQ ID NO: 1126173 - RNA, 22 nt, Human
ggcugccuucccugagccccgg

SEQ ID NO: 1126174 - RNA, 23 nt, Human
uccagcagagccuuccaggaggg

SEQ ID NO: 1126175 - RNA, 22 nt, Human
agggcuggagccacagcuggga

SEQ ID NO: 1126176 - RNA, 22 nt, Human
caggguuucaccauguuagcag

SEQ ID NO: 1126177 - RNA, 22 nt, Human
aggcagggucuugcuauguugc

SEQ ID NO: 1126178 - RNA, 22 nt, Human
uccuucaaagcuccuagugagc

SEQ ID NO: 1126179 - RNA, 22 nt, Human
aguccaugguuguaguucucuc

SEQ ID NO: 1126180 - RNA, 22 nt, Human
ggucagccuuggauuugguagc

SEQ ID NO: 1126181 - RNA, 22 nt, Human
cagucccagacauaguaaggga

SEQ ID NO: 1126182 - RNA, 22 nt, Human
aggcaggggagcuggaagggua

SEQ ID NO: 1126183 - RNA, 22 nt, Human
cuuuauguccuugaagaguugu

SEQ ID NO: 1126184 - RNA, 22 nt, Human
accaaggagaaggugcaagcuu

SEQ ID NO: 1126185 - RNA, 22 nt, Human
cagaacauuccaugugcccugc

SEQ ID NO: 1126186 - RNA, 22 nt, Human
gcucagggaacuuuuugcaggc

SEQ ID NO: 1126187 - RNA, 22 nt, Human
ucaaaguccuugcuuuuucugu

SEQ ID NO: 1126188 - RNA, 22 nt, Human
ugguugaaaaacauuggcuuuu

SEQ ID NO: 1126189 - RNA, 22 nt, Human
cccaggagauggagguugcagu

SEQ ID NO: 1126190 - RNA, 22 nt, Human
cacagggccuugugugacugca

SEQ ID NO: 1126191 - RNA, 22 nt, Human
gccggggcuggggagagacaug

SEQ ID NO: 1126192 - RNA, 22 nt, Human
cuucaagagaaugcagggaugu

SEQ ID NO: 1126193 - RNA, 21 nt, Human
ggcccugguuacgccuccucu

SEQ ID NO: 1126194 - RNA, 22 nt, Human
ccagccuucugagcugccugga

SEQ ID NO: 1126195 - RNA, 22 nt, Human
cucagcccagcccaggaccagg

SEQ ID NO: 1126196 - RNA, 22 nt, Human
cacccagcagcacuuaagacua

SEQ ID NO: 1126197 - RNA, 22 nt, Human
aguguuucccaguaggaugaaa

SEQ ID NO: 1126198 - RNA, 22 nt, Human
acaugcauacaagcacauguag

SEQ ID NO: 1126199 - RNA, 22 nt, Human
cugucccaggagcuguaagaca

SEQ ID NO: 1126200 - RNA, 22 nt, Human
ccugggcaucucaugcaccugc

SEQ ID NO: 1126201 - RNA, 22 nt, Human
acuuucuaggucucaguccuuu

SEQ ID NO: 1126202 - RNA, 22 nt, Human
ucugagagagggucagaugcua

SEQ ID NO: 1126203 - RNA, 22 nt, Human
gugcauauaugcacauaugugu

SEQ ID NO: 1126204 - RNA, 22 nt, Human
aggagcugagggagcgcccuug

SEQ ID NO: 1126205 - RNA, 22 nt, Human
uugacagcuauuuugcuuugau

SEQ ID NO: 1126206 - RNA, 22 nt, Human
gugucauuaaccaccaugcaaa

SEQ ID NO: 1126207 - RNA, 22 nt, Human
gugugccaggaacuggcugcug

SEQ ID NO: 1126208 - RNA, 22 nt, Human
gguccuggaaauugacggaaag

SEQ ID NO: 1126209 - RNA, 22 nt, Human
cugaaggauucaaaauggcagg

SEQ ID NO: 1126210 - RNA, 22 nt, Human
agacccagaaagcagcugcauu

SEQ ID NO: 1126211 - RNA, 22 nt, Human
ccuggcagaauauuaaagugca

SEQ ID NO: 1126212 - RNA, 22 nt, Human
uuguuucugaguuuucauguau

SEQ ID NO: 1126213 - RNA, 22 nt, Human
ucagagugugagacauauugga

SEQ ID NO: 1126214 - RNA, 22 nt, Human
uuuccucuuuguaccuugacua

SEQ ID NO: 1126215 - RNA, 22 nt, Human
agcaugaaagcauaggacaguc

SEQ ID NO: 1126216 - RNA, 22 nt, Human
uaggggugaggccaggcaucag

SEQ ID NO: 1126217 - RNA, 22 nt, Human
acagagcacauagauuggaguu

SEQ ID NO: 1126218 - RNA, 22 nt, Human
ugccuuggugcuucuucaugug

SEQ ID NO: 1126219 - RNA, 22 nt, Human
ggugaggggagagugaaagaaa

SEQ ID NO: 1126220 - RNA, 18 nt, Human
gaggccugagaaccaggu

SEQ ID NO: 1126221 - RNA, 22 nt, Human
ucagaagcaaacaucacucuag

SEQ ID NO: 1126222 - RNA, 22 nt, Human
ccacagggccuuuccugcuggc

SEQ ID NO: 1126223 - RNA, 22 nt, Human
gggugggccacugagcagcgug

SEQ ID NO: 1126224 - RNA, 18 nt, Human
cucucuggucuggauccc

SEQ ID NO: 1126225 - RNA, 21 nt, Human
aaggagccuaggaggcucagg

SEQ ID NO: 1126226 - RNA, 22 nt, Human
acugggaggcaaagagcaagga

SEQ ID NO: 1126227 - RNA, 22 nt, Human
ggauggagguucucagaugcuc

SEQ ID NO: 1126228 - RNA, 22 nt, Human
ucucagagcuucagaaagcacc

SEQ ID NO: 1126229 - RNA, 22 nt, Human
aggguccaucaaggacugcaca

SEQ ID NO: 1126230 - RNA, 22 nt, Human
cauuucuguacauguuuuggug

SEQ ID NO: 1126231 - RNA, 22 nt, Human
caggggcugugggcggagccuc

SEQ ID NO: 1126232 - RNA, 22 nt, Human
aagcugcagacccccugucuca

SEQ ID NO: 1126233 - RNA, 22 nt, Human
auaaaacuuauuagaauugugu

SEQ ID NO: 1126234 - RNA, 22 nt, Human
gcccagagagaugcuguagacc

SEQ ID NO: 1126235 - RNA, 22 nt, Human
ugggcugcuguuacaggggcug

SEQ ID NO: 1126236 - RNA, 21 nt, Human
aggggacagaguagcuccagg

SEQ ID NO: 1126237 - RNA, 22 nt, Human
ucucuccuuaucauuguguuua

SEQ ID NO: 1126238 - RNA, 22 nt, Human
gcauccagagguagccacugug

SEQ ID NO: 1126239 - RNA, 22 nt, Human
ucaguggagcuaagcaugagau

SEQ ID NO: 1126240 - RNA, 22 nt, Human
uaggaaaaauacagaauuauau

SEQ ID NO: 1126241 - RNA, 21 nt, Human
gcaggguccuuuccauuccua

SEQ ID NO: 1126242 - RNA, 22 nt, Human
aaaugcagauuuugaugcagca

SEQ ID NO: 1126243 - RNA, 22 nt, Human
gcucugcugagauaucugggag

SEQ ID NO: 1126244 - RNA, 22 nt, Human
ccacaggggucucuguagcuga

SEQ ID NO: 1126245 - RNA, 22 nt, Human
auagugguuggauaugucagag

SEQ ID NO: 1126246 - RNA, 22 nt, Human
ucucagggagggcgagucagcg

SEQ ID NO: 1126247 - RNA, 22 nt, Human
uugcauugugauuacagaggug

SEQ ID NO: 1126248 - RNA, 20 nt, Human
aagaaacuugaaaguacaag

SEQ ID NO: 1126249 - RNA, 22 nt, Human
agugacugacaccuguaauccc

SEQ ID NO: 1126250 - RNA, 19 nt, Human
ugcagcucagggcaggggc

SEQ ID NO: 1126251 - RNA, 22 nt, Human
ucucuuucuauugcaccaugcu

SEQ ID NO: 1126252 - RNA, 22 nt, Human
cugggugguuuugaugugaauu

SEQ ID NO: 1126253 - RNA, 22 nt, Human
cucuggaaaaccacuagcagga

SEQ ID NO: 1126254 - RNA, 22 nt, Human
ucaguuuucucaucuguaauuu

SEQ ID NO: 1126255 - RNA, 22 nt, Human
gagccuggauugucaccgacuu

SEQ ID NO: 1126256 - RNA, 22 nt, Human
cagagguaccagcagccucugg

SEQ ID NO: 1126257 - RNA, 22 nt, Human
ugugugugacucauacuagaac

SEQ ID NO: 1126258 - RNA, 22 nt, Human
agcagccaaaugaagauuuuac

SEQ ID NO: 1126259 - RNA, 21 nt, Human
aaagaacaggcagauguucuu

SEQ ID NO: 1126260 - RNA, 21 nt, Human
agccuggcccagggggaggcu

SEQ ID NO: 1126261 - RNA, 22 nt, Human
acauuugaggauguuaagaaug

SEQ ID NO: 1126262 - RNA, 22 nt, Human
uucugaggcacuggcucuccca

SEQ ID NO: 1126263 - RNA, 22 nt, Human
auuucacucuuaauugcuuccu

SEQ ID NO: 1126264 - RNA, 20 nt, Human
gccuggaggcagagauaaag

SEQ ID NO: 1126265 - RNA, 22 nt, Human
agcagccaauuggaggaugaag

SEQ ID NO: 1126266 - RNA, 22 nt, Human
cagccucucuguaucucaggau

SEQ ID NO: 1126267 - RNA, 22 nt, Human
cccccaaggccaggcugagacc

SEQ ID NO: 1126268 - RNA, 22 nt, Human
uuauguaccugaauuaguaaag

SEQ ID NO: 1126269 - RNA, 22 nt, Human
acauuucugcaucucagagcua

SEQ ID NO: 1126270 - RNA, 22 nt, Human
gagcagugagugaauguugccu

SEQ ID NO: 1126271 - RNA, 23 nt, Human
gacagagugagaccuugucuuac

SEQ ID NO: 1126272 - RNA, 22 nt, Human
uggcacugaccccaggccugug

SEQ ID NO: 1126273 - RNA, 22 nt, Human
ggagcugucuguagggcacagg

SEQ ID NO: 1126274 - RNA, 22 nt, Human
cauaacuagagugaaauguuga

SEQ ID NO: 1126275 - RNA, 21 nt, Human
ucuuugcaucaguuguuuucu

SEQ ID NO: 1126276 - RNA, 22 nt, Human
gugucccaaucuacuuuucccu

SEQ ID NO: 1126277 - RNA, 22 nt, Human
caugggcucuucuggacugcac

SEQ ID NO: 1126278 - RNA, 17 nt, Human
acagggcagaaacagcu

SEQ ID NO: 1126279 - RNA, 22 nt, Human
guguuuccuaguuuaaugaaug

SEQ ID NO: 1126280 - RNA, 22 nt, Human
gucauuguguggacauggagaa

SEQ ID NO: 1126281 - RNA, 22 nt, Human
ugggcagaggcucugaagucca

SEQ ID NO: 1126282 - RNA, 22 nt, Human
aaugaugguuaaacacuggagg

SEQ ID NO: 1126283 - RNA, 22 nt, Human
guccuggguccccgcaggucag

SEQ ID NO: 1126284 - RNA, 22 nt, Human
gagggguguggagccaucaguu

SEQ ID NO: 1126285 - RNA, 22 nt, Human
cuggcucccagcuuucagggag

SEQ ID NO: 1126286 - RNA, 22 nt, Human
agcagcugcagggagggucugc

SEQ ID NO: 1126287 - RNA, 20 nt, Human
ugcagggcugccucccagcu

SEQ ID NO: 1126288 - RNA, 22 nt, Human
ugccugaggagucagggcaggu

SEQ ID NO: 1126289 - RNA, 22 nt, Human
auaguaacuggcauguuuauga

SEQ ID NO: 1126290 - RNA, 21 nt, Human
ugggcagauggcaguguggcu

SEQ ID NO: 1126291 - RNA, 22 nt, Human
auacauacguacauacguaugu

SEQ ID NO: 1126292 - RNA, 22 nt, Human
ggguggcuccuaugggcauagc

SEQ ID NO: 1126293 - RNA, 22 nt, Human
gcucagaggagcaucauaagga

SEQ ID NO: 1126294 - RNA, 18 nt, Human
uggagccauugccaccau

SEQ ID NO: 1126295 - RNA, 22 nt, Human
agccugagccccauccagcuga

SEQ ID NO: 1126296 - RNA, 19 nt, Human
ccugggaggcggagguugc

SEQ ID NO: 1126297 - RNA, 22 nt, Human
gggcugcacagaucuucaaggg

SEQ ID NO: 1126298 - RNA, 23 nt, Human
cauguacagaguuugauaaagug

SEQ ID NO: 1126299 - RNA, 19 nt, Human
uggcagaggcaguuuguac

SEQ ID NO: 1126300 - RNA, 22 nt, Human
ggugcugguucaggguggcugu

SEQ ID NO: 1126301 - RNA, 22 nt, Human
cucagagcaaugaacaugcaaa

SEQ ID NO: 1126302 - RNA, 22 nt, Human
agggcagagacaugcuuccuga

SEQ ID NO: 1126303 - RNA, 22 nt, Human
cagucccagaagagccugggag

SEQ ID NO: 1126304 - RNA, 22 nt, Human
gcauuccuacaggcugcuauga

SEQ ID NO: 1126305 - RNA, 22 nt, Human
cccuggaggaaaaucugaggcu

SEQ ID NO: 1126306 - RNA, 22 nt, Human
ugaaagguagcuggccucauag

SEQ ID NO: 1126307 - RNA, 21 nt, Human
ccagagccugcugagcccccu

SEQ ID NO: 1126308 - RNA, 22 nt, Human
acagagcacugcccugugccgc

SEQ ID NO: 1126309 - RNA, 22 nt, Human
agcagcugucccuuaacaucag

SEQ ID NO: 1126310 - RNA, 22 nt, Human
uuaguaauguguuaauaugaau

SEQ ID NO: 1126311 - RNA, 22 nt, Human
guugaauaauucauagaagcua

SEQ ID NO: 1126312 - RNA, 22 nt, Human
uaauccaauggcacaauguaug

SEQ ID NO: 1126313 - RNA, 22 nt, Human
uugcacagaugagggugaugcu

SEQ ID NO: 1126314 - RNA, 22 nt, Human
uagggcaguuucauguuaucuu

SEQ ID NO: 1126315 - RNA, 22 nt, Human
agggaaaguaagcauuucauua

SEQ ID NO: 1126316 - RNA, 22 nt, Human
aggccuccugcagggaugagug

SEQ ID NO: 1126317 - RNA, 17 nt, Human
ggccuguguggcugcag

SEQ ID NO: 1126318 - RNA, 22 nt, Human
aucacaaaggcugcuucaugau

SEQ ID NO: 1126319 - RNA, 21 nt, Human
aggcucagagaucaaacagua

SEQ ID NO: 1126320 - RNA, 22 nt, Human
aggcacugaccugcuuccuuga

SEQ ID NO: 1126321 - RNA, 22 nt, Human
gggccccaaaaugccaggcucu

SEQ ID NO: 1126322 - RNA, 22 nt, Human
agcagggcuuugcagacuuggg

SEQ ID NO: 1126323 - RNA, 22 nt, Human
aagcagcugauuucacagcuca

SEQ ID NO: 1126324 - RNA, 20 nt, Human
uggagccacagucagguucc

SEQ ID NO: 1126325 - RNA, 19 nt, Human
ucaaagcaagcauguucug

SEQ ID NO: 1126326 - RNA, 22 nt, Human
uggcucaggguccccaaauggu

SEQ ID NO: 1126327 - RNA, 22 nt, Human
aagggcaggaaaagauggaugu

SEQ ID NO: 1126328 - RNA, 22 nt, Human
agcaggagcugugggaagaugg

SEQ ID NO: 1126329 - RNA, 22 nt, Human
agcagaagaaagccacaugacu

SEQ ID NO: 1126330 - RNA, 22 nt, Human
gccugggagagggauagugcag

SEQ ID NO: 1126331 - RNA, 22 nt, Human
agcagccacccagcugcucauu

SEQ ID NO: 1126332 - RNA, 22 nt, Human
uuucucaucuggaaacagugcu

SEQ ID NO: 1126333 - RNA, 22 nt, Human
uggaggcauuuuagguugucac

SEQ ID NO: 1126334 - RNA, 22 nt, Human
aggacugggugcagagggcauc

SEQ ID NO: 1126335 - RNA, 22 nt, Human
agcagacaacccagaugaccca

SEQ ID NO: 1126336 - RNA, 22 nt, Human
auguaucagauaaagcaugugg

SEQ ID NO: 1126337 - RNA, 22 nt, Human
uaguaucuauuaguaacaagag

SEQ ID NO: 1126338 - RNA, 22 nt, Human
cucugcuuggaacuggacagaa

SEQ ID NO: 1126339 - RNA, 22 nt, Human
cuccuuccccuacucagcaucc

SEQ ID NO: 1126340 - RNA, 23 nt, Human
agaugaaagcuucccaucacagu

SEQ ID NO: 1126341 - RNA, 22 nt, Human
agagguagagguugcagugagc

SEQ ID NO: 1126342 - RNA, 22 nt, Human
cugcugcauuccucuuuaugag

SEQ ID NO: 1126343 - RNA, 22 nt, Human
uaaugcacagaauugacauggg

SEQ ID NO: 1126344 - RNA, 22 nt, Human
aggccuggccuuuauguucaag

SEQ ID NO: 1126345 - RNA, 22 nt, Human
aaagaucagucugaagcaacau

SEQ ID NO: 1126346 - RNA, 22 nt, Human
cuuaggcaguuuaggaaagaga

SEQ ID NO: 1126347 - RNA, 22 nt, Human
auggggugaccaugagcauuua

SEQ ID NO: 1126348 - RNA, 22 nt, Human
cuguccuccggccaccuacagu

SEQ ID NO: 1126349 - RNA, 22 nt, Human
ugucagugaguuaguugcaagu

SEQ ID NO: 1126350 - RNA, 22 nt, Human
agcuggccuuagugagcaccug

SEQ ID NO: 1126351 - RNA, 19 nt, Human
caaggguugggucugucau

SEQ ID NO: 1126352 - RNA, 22 nt, Human
ugcugccagggcucugcccaca

SEQ ID NO: 1126353 - RNA, 22 nt, Human
cccaaggccucuccuuggcuug

SEQ ID NO: 1126354 - RNA, 22 nt, Human
ugcucuguugugcaugugggau

SEQ ID NO: 1126355 - RNA, 22 nt, Human
uuccugagggacuuuugagauu

SEQ ID NO: 1126356 - RNA, 22 nt, Human
aggugccagaugcacagcugaa

SEQ ID NO: 1126357 - RNA, 22 nt, Human
cagaguggcagucccaggccca

SEQ ID NO: 1126358 - RNA, 22 nt, Human
ccagcugcugugcagggaggcu

SEQ ID NO: 1126359 - RNA, 22 nt, Human
ucccagcagggccgaccagccu

SEQ ID NO: 1126360 - RNA, 22 nt, Human
acagcagcuggguucccaccau

SEQ ID NO: 1126361 - RNA, 22 nt, Human
auggaaaggcuguggaaacuua

SEQ ID NO: 1126362 - RNA, 19 nt, Human
uugaggggccaggggagau

SEQ ID NO: 1126363 - RNA, 22 nt, Human
uggcccugucccuggagccugg

SEQ ID NO: 1126364 - RNA, 22 nt, Human
uauuuauaaucugccaaagaga

SEQ ID NO: 1126365 - RNA, 22 nt, Human
ucccagccugacagugcaucaa

SEQ ID NO: 1126366 - RNA, 22 nt, Human
ugggcagaaaucaguaucagau

SEQ ID NO: 1126367 - RNA, 22 nt, Human
cccucccaagcacucugacaua

SEQ ID NO: 1126368 - RNA, 22 nt, Human
uuggaaggugagucccuggguu

SEQ ID NO: 1126369 - RNA, 22 nt, Human
cuguacaucucugaggacagua

SEQ ID NO: 1126370 - RNA, 22 nt, Human
ggagauuuauagcacacuucag

SEQ ID NO: 1126371 - RNA, 22 nt, Human
uggcucugccacuaacuuggua

SEQ ID NO: 1126372 - RNA, 22 nt, Human
uaugcauauagaugcacacaca

SEQ ID NO: 1126373 - RNA, 22 nt, Human
agcuucuggaaggcaaggcuug

SEQ ID NO: 1126374 - RNA, 22 nt, Human
gcucaggaaaacagucuaguaa

SEQ ID NO: 1126375 - RNA, 22 nt, Human
ucuggccuuaucuguccaagcc

SEQ ID NO: 1126376 - RNA, 23 nt, Human
aagccuuguggaggcucucauuu

SEQ ID NO: 1126377 - RNA, 22 nt, Human
agaauaaaucaaauguccugag

SEQ ID NO: 1126378 - RNA, 22 nt, Human
caggccucuccuuagucuggca

SEQ ID NO: 1126379 - RNA, 22 nt, Human
gccaggcucucagugacugccc

SEQ ID NO: 1126380 - RNA, 22 nt, Human
ugugccuuaugaauucuuucug

SEQ ID NO: 1126381 - RNA, 22 nt, Human
agagccaggaucuguuuugggg

SEQ ID NO: 1126382 - RNA, 22 nt, Human
aucaaaguucguaacugauaac

SEQ ID NO: 1126383 - RNA, 22 nt, Human
agcagccagaaauccagaggug

SEQ ID NO: 1126384 - RNA, 22 nt, Human
ugcucuggaguggcuugugcac

SEQ ID NO: 1126385 - RNA, 22 nt, Human
ggcacagggaggcccuggugug

SEQ ID NO: 1126386 - RNA, 22 nt, Human
uguauacauuuaacuagauaga

SEQ ID NO: 1126387 - RNA, 22 nt, Human
acagcagcaauagcagugacau

SEQ ID NO: 1126388 - RNA, 22 nt, Human
ucccagagugugggcaucaagg

SEQ ID NO: 1126389 - RNA, 22 nt, Human
uagaaaagauaacauucugugc

SEQ ID NO: 1126390 - RNA, 22 nt, Human
ucuguggccuguguccaagugc

SEQ ID NO: 1126391 - RNA, 22 nt, Human
ugugcugguacaugugaggaug

SEQ ID NO: 1126392 - RNA, 22 nt, Human
uucuuacuaguauguuucagca

SEQ ID NO: 1126393 - RNA, 22 nt, Human
caagaugccccugguagggauc

SEQ ID NO: 1126394 - RNA, 23 nt, Human
aggaacugaggccuagggaggua

SEQ ID NO: 1126395 - RNA, 22 nt, Human
cggcuggguucggcugcaggcc

SEQ ID NO: 1126396 - RNA, 22 nt, Human
aauguguacaugacagauagaa

SEQ ID NO: 1126397 - RNA, 22 nt, Human
cuguagccagaagcagaaggcc

SEQ ID NO: 1126398 - RNA, 22 nt, Human
gaauguaauagucaguagaaca

SEQ ID NO: 1126399 - RNA, 22 nt, Human
aggcucugaucagguggcugug

SEQ ID NO: 1126400 - RNA, 22 nt, Human
guugggaaggcaagaaguagaa

SEQ ID NO: 1126401 - RNA, 22 nt, Human
agauggggcucaguguggaggc

SEQ ID NO: 1126402 - RNA, 22 nt, Human
ccagcaugagacgaugaugaag

SEQ ID NO: 1126403 - RNA, 22 nt, Human
ucaguaacuuacuuauucaccu

SEQ ID NO: 1126404 - RNA, 22 nt, Human
agcucccaggcagucaugagga

SEQ ID NO: 1126405 - RNA, 22 nt, Human
caaauaucuuuggcaaagagaa

SEQ ID NO: 1126406 - RNA, 22 nt, Human
uuguggaaauacagacuccaag

SEQ ID NO: 1126407 - RNA, 21 nt, Human
ccagaggccucucuuggccac

SEQ ID NO: 1126408 - RNA, 22 nt, Human
acacagggcagagagcuggcuc

SEQ ID NO: 1126409 - RNA, 22 nt, Human
cugccgaguacagccauagaaa

SEQ ID NO: 1126410 - RNA, 22 nt, Human
gagcagcugagcuggaaugaga

SEQ ID NO: 1126411 - RNA, 22 nt, Human
ccugccuggcugucagcagagc

SEQ ID NO: 1126412 - RNA, 23 nt, Human
ccuggcuggauucucugcauuca

SEQ ID NO: 1126413 - RNA, 23 nt, Human
aggaggaaaaguuaucugcugag

SEQ ID NO: 1126414 - RNA, 22 nt, Human
ucaggauaccucaguuuuagcu

SEQ ID NO: 1126415 - RNA, 22 nt, Human
aucaguuuggaacauucaggcc

SEQ ID NO: 1126416 - RNA, 19 nt, Human
ugucccagacuccgugucu

SEQ ID NO: 1126417 - RNA, 19 nt, Human
acccagagcccuuugcagg

SEQ ID NO: 1126418 - RNA, 21 nt, Human
cugcuuuacuucagaggaucu

SEQ ID NO: 1126419 - RNA, 21 nt, Human
agcagaggcagaauguaugca

SEQ ID NO: 1126420 - RNA, 22 nt, Human
uggcagggucuugcuguguugc

SEQ ID NO: 1126421 - RNA, 22 nt, Human
acauuuaaauaugccuuauauu

SEQ ID NO: 1126422 - RNA, 22 nt, Human
cagagccucagaauccugugga

SEQ ID NO: 1126423 - RNA, 22 nt, Human
agcaguggagcgagauguuuaa

SEQ ID NO: 1126424 - RNA, 22 nt, Human
aaaguuagaaugauaucaacga

SEQ ID NO: 1126425 - RNA, 23 nt, Human
ggaaagagaggaguugugcauag

SEQ ID NO: 1126426 - RNA, 22 nt, Human
cugugggcugaaagugcucccg

SEQ ID NO: 1126427 - RNA, 22 nt, Human
aggcacugauucucagaguuac

SEQ ID NO: 1126428 - RNA, 22 nt, Human
ugaggccaggaucccaggcucu

SEQ ID NO: 1126429 - RNA, 22 nt, Human
gcuuucucuucacugauguuca

SEQ ID NO: 1126430 - RNA, 20 nt, Human
cccagccccuaccuguugcc

SEQ ID NO: 1126431 - RNA, 22 nt, Human
uauugaaauucuucauguccuc

SEQ ID NO: 1126432 - RNA, 22 nt, Human
aagggcagccugacucacgguc

SEQ ID NO: 1126433 - RNA, 22 nt, Human
agggucugacaaugugacuuag

SEQ ID NO: 1126434 - RNA, 22 nt, Human
auugacaaggaaacuauaccag

SEQ ID NO: 1126435 - RNA, 22 nt, Human
aagguacaguuuuaagaauaag

SEQ ID NO: 1126436 - RNA, 22 nt, Human
ggacagaggguugacagaguau

SEQ ID NO: 1126437 - RNA, 22 nt, Human
ccugcagacacuuguccagcaa

SEQ ID NO: 1126438 - RNA, 22 nt, Human
cagcugccuucugcgggaaguc

SEQ ID NO: 1126439 - RNA, 22 nt, Human
ucaggggacagccagcuggagg

SEQ ID NO: 1126440 - RNA, 22 nt, Human
cucaggauauugggcuggagca

SEQ ID NO: 1126441 - RNA, 22 nt, Human
gggacuggcacagggcugggag

SEQ ID NO: 1126442 - RNA, 22 nt, Human
aaggcccuggccccagcuucuu

SEQ ID NO: 1126443 - RNA, 22 nt, Human
uuuguuuucaaugugucauuca

SEQ ID NO: 1126444 - RNA, 22 nt, Human
ucugggcuuuacacugugcuua

SEQ ID NO: 1126445 - RNA, 21 nt, Human
uugaaggaucacuucuguacc

SEQ ID NO: 1126446 - RNA, 22 nt, Human
ggcucagguuuaaagugcuuua

SEQ ID NO: 1126447 - RNA, 22 nt, Human
cuauugaauuaacuauuaaagu

SEQ ID NO: 1126448 - RNA, 22 nt, Human
uggcucugaucagauguccagu

SEQ ID NO: 1126449 - RNA, 22 nt, Human
ggcuggguuauuuauggccaag

SEQ ID NO: 1126450 - RNA, 22 nt, Human
ccugucuguauugguuugcuau

SEQ ID NO: 1126451 - RNA, 22 nt, Human
agagcugugcuuugcaccacgu

SEQ ID NO: 1126452 - RNA, 22 nt, Human
agagcagccugugaugaugcac

SEQ ID NO: 1126453 - RNA, 22 nt, Human
auucuccaucaccacuggcacu

SEQ ID NO: 1126454 - RNA, 22 nt, Human
cccuggaagguucucuggcuca

SEQ ID NO: 1126455 - RNA, 22 nt, Human
ucugucacccagagugcagugg

SEQ ID NO: 1126456 - RNA, 22 nt, Human
aagggacuuugucagcuuucca

SEQ ID NO: 1126457 - RNA, 22 nt, Human
accagagcgcucaagccuuccc

SEQ ID NO: 1126458 - RNA, 22 nt, Human
gugaccaucagagaauaacaaa

SEQ ID NO: 1126459 - RNA, 22 nt, Human
cagugccaugucugagccccua

SEQ ID NO: 1126460 - RNA, 22 nt, Human
cagggccaagcugcagcaucug

SEQ ID NO: 1126461 - RNA, 22 nt, Human
acagagcuucccagccugagca

SEQ ID NO: 1126462 - RNA, 22 nt, Human
agccacgucccugucaggguca

SEQ ID NO: 1126463 - RNA, 22 nt, Human
ccagccaggcuggcuguggagg

SEQ ID NO: 1126464 - RNA, 22 nt, Human
gcugcaggcauuuuccugggca

SEQ ID NO: 1126465 - RNA, 23 nt, Human
ugucccagagggagggauaggcu

SEQ ID NO: 1126466 - RNA, 22 nt, Human
uuuaucuuuaggacuuugcaga

SEQ ID NO: 1126467 - RNA, 22 nt, Human
cauuacauuucaaaauguuucc

SEQ ID NO: 1126468 - RNA, 22 nt, Human
ugggccugaaggagcugcgccc

SEQ ID NO: 1126469 - RNA, 23 nt, Human
aguuuguaaagaaauauuugcac

SEQ ID NO: 1126470 - RNA, 22 nt, Human
agaaauuccuaagguacacaag

SEQ ID NO: 1126471 - RNA, 22 nt, Human
gagcugagccuggguggaccgc

SEQ ID NO: 1126472 - RNA, 22 nt, Human
auaaagucauggcagcuagaau

SEQ ID NO: 1126473 - RNA, 22 nt, Human
caauagcagcuucugaaugcaa

SEQ ID NO: 1126474 - RNA, 22 nt, Human
caaaugcauagaaagaugaaac

SEQ ID NO: 1126475 - RNA, 22 nt, Human
gagccuggauugaagugggugg

SEQ ID NO: 1126476 - RNA, 22 nt, Human
uccucagaaaccccugugaggu

SEQ ID NO: 1126477 - RNA, 22 nt, Human
ucaguuuuuacggucacaggga

SEQ ID NO: 1126478 - RNA, 22 nt, Human
aaggcugauuagacugauagcu

SEQ ID NO: 1126479 - RNA, 22 nt, Human
ggagcugggacccugucaucug

SEQ ID NO: 1126480 - RNA, 21 nt, Human
ucuuguccuugcucucccacu

SEQ ID NO: 1126481 - RNA, 22 nt, Human
uuguuuuuaugaacauccagga

SEQ ID NO: 1126482 - RNA, 22 nt, Human
aggagccaguuccaccccagga

SEQ ID NO: 1126483 - RNA, 22 nt, Human
guuagaaacacauucuuauuga

SEQ ID NO: 1126484 - RNA, 20 nt, Human
ucauugcacauaauggaagc

SEQ ID NO: 1126485 - RNA, 22 nt, Human
caggggcagucugugugcgugg

SEQ ID NO: 1126486 - RNA, 22 nt, Human
cacagcugcccuacuccaugug

SEQ ID NO: 1126487 - RNA, 22 nt, Human
cagcuggcuggucagugcacaa

SEQ ID NO: 1126488 - RNA, 22 nt, Human
agcagcucuuaacaaagcaugg

SEQ ID NO: 1126489 - RNA, 22 nt, Human
aggucacacaacugucagaggc

SEQ ID NO: 1126490 - RNA, 20 nt, Human
gcccuggagccuuguccugg

SEQ ID NO: 1126491 - RNA, 23 nt, Human
cagggcugggcuugguguuaggc

SEQ ID NO: 1126492 - RNA, 22 nt, Human
uuuccuuccuugcuagccugag

SEQ ID NO: 1126493 - RNA, 22 nt, Human
guuuuguucaugaacauugggu

SEQ ID NO: 1126494 - RNA, 22 nt, Human
aggguggccaugagggagagau

SEQ ID NO: 1126495 - RNA, 22 nt, Human
agguacaguagacagacaguua

SEQ ID NO: 1126496 - RNA, 22 nt, Human
agagcugugaaaaugagguuug

SEQ ID NO: 1126497 - RNA, 22 nt, Human
ggcugcaggcaggguauccacu

SEQ ID NO: 1126498 - RNA, 22 nt, Human
aaagucauguaaugauaugauu

SEQ ID NO: 1126499 - RNA, 22 nt, Human
ucacaggguaucugggauggau

SEQ ID NO: 1126500 - RNA, 20 nt, Human
gagccuuccccucaccacug

SEQ ID NO: 1126501 - RNA, 22 nt, Human
gggcuggcucugucuagaaagg

SEQ ID NO: 1126502 - RNA, 22 nt, Human
ccagucagccaagcugcagcgg

SEQ ID NO: 1126503 - RNA, 20 nt, Human
gccagcacagggagcaguuc

SEQ ID NO: 1126504 - RNA, 22 nt, Human
uaacagaaaggcucaggugcuc

SEQ ID NO: 1126505 - RNA, 21 nt, Human
cccagggaagccgcagucacc

SEQ ID NO: 1126506 - RNA, 22 nt, Human
gcagugugaccgagcuugcuuc

SEQ ID NO: 1126507 - RNA, 22 nt, Human
uugcauguguaauuuuucuaaa

SEQ ID NO: 1126508 - RNA, 19 nt, Human
gggcuucugggaucaagag

SEQ ID NO: 1126509 - RNA, 22 nt, Human
auuuuucucuuuccacugagau

SEQ ID NO: 1126510 - RNA, 22 nt, Human
gggaguguugagcgcccugcca

SEQ ID NO: 1126511 - RNA, 22 nt, Human
ccagacuguggaguuccuggug

SEQ ID NO: 1126512 - RNA, 22 nt, Human
auaugcacauacauacauaggu

SEQ ID NO: 1126513 - RNA, 22 nt, Human
agggccagaaucccucagucua

SEQ ID NO: 1126514 - RNA, 22 nt, Human
ucugagcuggagcccaucaccu

SEQ ID NO: 1126515 - RNA, 22 nt, Human
uacaaaguuugggguccucaaa

SEQ ID NO: 1126516 - RNA, 22 nt, Human
cacugaaggacaguaggaaggg

SEQ ID NO: 1126517 - RNA, 22 nt, Human
ucacacgugagguucuauccug

SEQ ID NO: 1126518 - RNA, 22 nt, Human
cugcucuguucccccaucaucu

SEQ ID NO: 1126519 - RNA, 22 nt, Human
acaggugugagaacaugccuug

SEQ ID NO: 1126520 - RNA, 22 nt, Human
gccuggugaaaggcagagagcg

SEQ ID NO: 1126521 - RNA, 23 nt, Human
ucagagaaguuguaggcugggga

SEQ ID NO: 1126522 - RNA, 22 nt, Human
uccugggcuugcuccuccagcu

SEQ ID NO: 1126523 - RNA, 22 nt, Human
ggcugccugaacuuuggggaaa

SEQ ID NO: 1126524 - RNA, 22 nt, Human
cucugggcaaguuucuucauga

SEQ ID NO: 1126525 - RNA, 22 nt, Human
aaucuggcucagaagaagauga

SEQ ID NO: 1126526 - RNA, 22 nt, Human
ggcagcagaacuggcccuguau

SEQ ID NO: 1126527 - RNA, 22 nt, Human
ugccugucagggggagugggaa

SEQ ID NO: 1126528 - RNA, 22 nt, Human
agugaccaaucaugguuagauu

SEQ ID NO: 1126529 - RNA, 22 nt, Human
agggaguguaaauggugcucag

SEQ ID NO: 1126530 - RNA, 22 nt, Human
ugucauguguucuuaaauacau

SEQ ID NO: 1126531 - RNA, 22 nt, Human
aggcucagauccuuguguccug

SEQ ID NO: 1126532 - RNA, 22 nt, Human
acauugaugaaaagguaucauu

SEQ ID NO: 1126533 - RNA, 22 nt, Human
uccuuuccaugcuucuagaggc

SEQ ID NO: 1126534 - RNA, 22 nt, Human
gagguacaugaggauacacagg

SEQ ID NO: 1126535 - RNA, 22 nt, Human
acagcagcauaaacugacuaag

SEQ ID NO: 1126536 - RNA, 22 nt, Human
agcugcaggccucuccugggga

SEQ ID NO: 1126537 - RNA, 22 nt, Human
aggcacugggaauaugcugagg

SEQ ID NO: 1126538 - RNA, 22 nt, Human
ugcccaggaucuggcgaugcuc

SEQ ID NO: 1126539 - RNA, 22 nt, Human
caaaugcuaacuucuuuccaaa

SEQ ID NO: 1126540 - RNA, 22 nt, Human
uggacaggugagugacucaggg

SEQ ID NO: 1126541 - RNA, 21 nt, Human
aaggccugcuuacugcuaguu

SEQ ID NO: 1126542 - RNA, 22 nt, Human
gccugaggaaugcuccugacuu

SEQ ID NO: 1126543 - RNA, 22 nt, Human
agaaaugugagccccuuaucaa

SEQ ID NO: 1126544 - RNA, 20 nt, Human
gacauucauaguuauuacca

SEQ ID NO: 1126545 - RNA, 22 nt, Human
ccuggcugcuauagcagcaugu

SEQ ID NO: 1126546 - RNA, 22 nt, Human
aaggcagcaccgccuccugaaa

SEQ ID NO: 1126547 - RNA, 22 nt, Human
gcauuuguguucuuccuagagc

SEQ ID NO: 1126548 - RNA, 22 nt, Human
aggcccaguagugcugccuuua

SEQ ID NO: 1126549 - RNA, 22 nt, Human
uuacugaaaauucuucaggauu

SEQ ID NO: 1126550 - RNA, 22 nt, Human
agggccuggaacugugggcagg

SEQ ID NO: 1126551 - RNA, 18 nt, Human
ugggcugccuggccucug

SEQ ID NO: 1126552 - RNA, 22 nt, Human
gguggccucgguggugcacagg

SEQ ID NO: 1126553 - RNA, 22 nt, Human
gagauuucuuuugaugccuguc

SEQ ID NO: 1126554 - RNA, 17 nt, Human
cugucugcgcaugaggu

SEQ ID NO: 1126555 - RNA, 22 nt, Human
caguggaggccuugggaccuuu

SEQ ID NO: 1126556 - RNA, 22 nt, Human
aggcucagcccaagguggagag

SEQ ID NO: 1126557 - RNA, 20 nt, Human
ccugucuccucuuaccuggc

SEQ ID NO: 1126558 - RNA, 23 nt, Human
agucaguguaaguuuggaaugca

SEQ ID NO: 1126559 - RNA, 22 nt, Human
uucaagguaugguagcugguca

SEQ ID NO: 1126560 - RNA, 22 nt, Human
uggcccugcagaacuagccugg

SEQ ID NO: 1126561 - RNA, 22 nt, Human
ccauggccgccgcugcucagga

SEQ ID NO: 1126562 - RNA, 22 nt, Human
gcuggcaucacuggcuucggug

SEQ ID NO: 1126563 - RNA, 22 nt, Human
cuggaagaggaagccagcugga

SEQ ID NO: 1126564 - RNA, 22 nt, Human
agggcagagaucugagugggca

SEQ ID NO: 1126565 - RNA, 22 nt, Human
aaguucaaguaguguuacaugg

SEQ ID NO: 1126566 - RNA, 22 nt, Human
auccagggauaaaaguaagguu

SEQ ID NO: 1126567 - RNA, 21 nt, Human
ucucugggcccuccugugggg

SEQ ID NO: 1126568 - RNA, 19 nt, Human
gcaggguguugacuguccc

SEQ ID NO: 1126569 - RNA, 22 nt, Human
uugaaaggaauacagaggccua

SEQ ID NO: 1126570 - RNA, 23 nt, Human
ggagccuggcauaugagacgcau

SEQ ID NO: 1126571 - RNA, 22 nt, Human
aggagcugacuuguaaagcauu

SEQ ID NO: 1126572 - RNA, 21 nt, Human
gacaggggaagaagcaaggag

SEQ ID NO: 1126573 - RNA, 22 nt, Human
agcuugaguuuuggaugaagug

SEQ ID NO: 1126574 - RNA, 22 nt, Human
uugggcaaaguguuucuggagc

SEQ ID NO: 1126575 - RNA, 22 nt, Human
gcugcccugugguccagcaggu

SEQ ID NO: 1126576 - RNA, 22 nt, Human
ccagcuccucuucccaguguca

SEQ ID NO: 1126577 - RNA, 22 nt, Human
aagaacaguguccugggacucg

SEQ ID NO: 1126578 - RNA, 22 nt, Human
ucucuuuuauguacacccugac

SEQ ID NO: 1126579 - RNA, 22 nt, Human
ggcugggcaaacaagacucuuc

SEQ ID NO: 1126580 - RNA, 18 nt, Human
aguaguggguuuagcuuc

SEQ ID NO: 1126581 - RNA, 22 nt, Human
gggcagcucuggcugugggaag

SEQ ID NO: 1126582 - RNA, 20 nt, Human
cccuggccuguuucaugccc

SEQ ID NO: 1126583 - RNA, 22 nt, Human
cacaggagcuguggggcagugu

SEQ ID NO: 1126584 - RNA, 22 nt, Human
uuaaguccuugguaauuuucuu

SEQ ID NO: 1126585 - RNA, 22 nt, Human
acugagcugcaagucagggagg

SEQ ID NO: 1126586 - RNA, 22 nt, Human
cugucaccuguucacugcagca

SEQ ID NO: 1126587 - RNA, 22 nt, Human
ucucagggugaggaaagaauuu

SEQ ID NO: 1126588 - RNA, 22 nt, Human
gccucuggggcagcugagucau

SEQ ID NO: 1126589 - RNA, 19 nt, Human
gccugggaugggcagaacu

SEQ ID NO: 1126590 - RNA, 21 nt, Human
gcucuuggaaggggcucagcu

SEQ ID NO: 1126591 - RNA, 22 nt, Human
agggcugagacuaaggccagau

SEQ ID NO: 1126592 - RNA, 22 nt, Human
caggcugcagcagcaguggccc

SEQ ID NO: 1126593 - RNA, 22 nt, Human
agaguguuuuucugucaaggac

SEQ ID NO: 1126594 - RNA, 22 nt, Human
auccuugagaaaauaaaugacc

SEQ ID NO: 1126595 - RNA, 23 nt, Human
aaguaacagggauaauagcaguu

SEQ ID NO: 1126596 - RNA, 22 nt, Human
ucuggagcgaggucccugucug

SEQ ID NO: 1126597 - RNA, 22 nt, Human
acuuccugcagcuucucagccc

SEQ ID NO: 1126598 - RNA, 22 nt, Human
gcugccaugguccaggcuccag

SEQ ID NO: 1126599 - RNA, 22 nt, Human
cagugucuccagaugcuccaau

SEQ ID NO: 1126600 - RNA, 22 nt, Human
agccagcaggugagugcagccu

SEQ ID NO: 1126601 - RNA, 22 nt, Human
ccugguguugugaaguagccgu

SEQ ID NO: 1126602 - RNA, 22 nt, Human
uggcagagcccagacuccaguc

SEQ ID NO: 1126603 - RNA, 22 nt, Human
ggcucaggacugcagcguagag

SEQ ID NO: 1126604 - RNA, 17 nt, Human
cuggagccaagagggcc

SEQ ID NO: 1126605 - RNA, 19 nt, Human
ugggccugcaucugggucu

SEQ ID NO: 1126606 - RNA, 22 nt, Human
gcugucagcgcccaaggagcuc

SEQ ID NO: 1126607 - RNA, 22 nt, Human
cccaggucuaugccagcucuga

SEQ ID NO: 1126608 - RNA, 22 nt, Human
uaauccacaauagagauuaucu

SEQ ID NO: 1126609 - RNA, 22 nt, Human
aaaucugggagcagcucggcca

SEQ ID NO: 1126610 - RNA, 22 nt, Human
ggggcagagaauaaaaaccuaa

SEQ ID NO: 1126611 - RNA, 22 nt, Human
ggcaaaaaccacaauuacuuuu

SEQ ID NO: 1126612 - RNA, 20 nt, Human
uacuugaauguugcagcagu

SEQ ID NO: 1126613 - RNA, 22 nt, Human
aaugcugcaagaggugaaaaga

SEQ ID NO: 1126614 - RNA, 22 nt, Human
gcuggccuugugucugaggaag

SEQ ID NO: 1126615 - RNA, 22 nt, Human
aguaaaaucuuaagcacagugg

SEQ ID NO: 1126616 - RNA, 22 nt, Human
acaggcucuggggcaggauggc

SEQ ID NO: 1126617 - RNA, 20 nt, Human
gcuuccuucccagcccccac

SEQ ID NO: 1126618 - RNA, 19 nt, Human
ccuggguccacucagacua

SEQ ID NO: 1126619 - RNA, 22 nt, Human
cagcaguggccaucuguguggu

SEQ ID NO: 1126620 - RNA, 22 nt, Human
cccucugccucugaguaggaca

SEQ ID NO: 1126621 - RNA, 22 nt, Human
uugcauugaaaauauauuuuaa

SEQ ID NO: 1126622 - RNA, 22 nt, Human
cucacugucuguacuagcugau

SEQ ID NO: 1126623 - RNA, 22 nt, Human
aagccuugcucuugaaaaaguu

SEQ ID NO: 1126624 - RNA, 22 nt, Human
gccagcucagugccaggccccu

SEQ ID NO: 1126625 - RNA, 22 nt, Human
agcugccagaugacagugcuau

SEQ ID NO: 1126626 - RNA, 22 nt, Human
gccucugcgccucagccgaccu

SEQ ID NO: 1126627 - RNA, 22 nt, Human
caggaugugaggaggccauuug

SEQ ID NO: 1126628 - RNA, 22 nt, Human
ucucagagaagugaugagcaau

SEQ ID NO: 1126629 - RNA, 22 nt, Human
ugggggagauugugcaucucua

SEQ ID NO: 1126630 - RNA, 22 nt, Human
cagccugacaccagcuuugggc

SEQ ID NO: 1126631 - RNA, 22 nt, Human
cagggcaggacagauacauuac

SEQ ID NO: 1126632 - RNA, 22 nt, Human
guggcugcuaagucuccuuccu

SEQ ID NO: 1126633 - RNA, 22 nt, Human
ugaggcuggcaaggcugguauu

SEQ ID NO: 1126634 - RNA, 18 nt, Human
ggagagugacagagucgu

SEQ ID NO: 1126635 - RNA, 22 nt, Human
ugcagaagaauguaggcauaag

SEQ ID NO: 1126636 - RNA, 22 nt, Human
auguauuugcgagguuaggaaa

SEQ ID NO: 1126637 - RNA, 22 nt, Human
gcugggcaccggagagacccca

SEQ ID NO: 1126638 - RNA, 22 nt, Human
uuauuuuuaaaaguucacacag

SEQ ID NO: 1126639 - RNA, 23 nt, Human
gugcaugugucuuuacaguagca

SEQ ID NO: 1126640 - RNA, 22 nt, Human
cagagccagcaguggggacagg

SEQ ID NO: 1126641 - RNA, 22 nt, Human
aauugugcuaugauuaugaaag

SEQ ID NO: 1126642 - RNA, 22 nt, Human
gcccaggcuagcguagagugca

SEQ ID NO: 1126643 - RNA, 22 nt, Human
auggaaagcuaagccauuuacc

SEQ ID NO: 1126644 - RNA, 22 nt, Human
gucccuggggaaucagcuggag

SEQ ID NO: 1126645 - RNA, 22 nt, Human
gagggacagcuaaagagaaauu

SEQ ID NO: 1126646 - RNA, 22 nt, Human
uaagaacagauaaaguuucccc

SEQ ID NO: 1126647 - RNA, 22 nt, Human
aacugcauuugcauaaguccau

SEQ ID NO: 1126648 - RNA, 22 nt, Human
ccuggaggagcgcugaccagcu

SEQ ID NO: 1126649 - RNA, 21 nt, Human
agucccaggggugagugaugu

SEQ ID NO: 1126650 - RNA, 22 nt, Human
acuuccugcaaucguccacucc

SEQ ID NO: 1126651 - RNA, 22 nt, Human
gggaucagcaagccacugcacc

SEQ ID NO: 1126652 - RNA, 22 nt, Human
gcaggagcuggaaagugauguu

SEQ ID NO: 1126653 - RNA, 22 nt, Human
ggaggcaggaaagacagguuca

SEQ ID NO: 1126654 - RNA, 22 nt, Human
ccuggcagacagcacugaagcu

SEQ ID NO: 1126655 - RNA, 22 nt, Human
ggucagggcucuuccaguggcu

SEQ ID NO: 1126656 - RNA, 22 nt, Human
ggccuggccuccagaugugggc

SEQ ID NO: 1126657 - RNA, 22 nt, Human
ggcuggcuggcugguagacaag

SEQ ID NO: 1126658 - RNA, 22 nt, Human
aucaguuuuguucacuacuaua

SEQ ID NO: 1126659 - RNA, 22 nt, Human
aggagcugagucagcccgacag

SEQ ID NO: 1126660 - RNA, 19 nt, Human
cugagcagcggcagcacuu

SEQ ID NO: 1126661 - RNA, 22 nt, Human
uuugcauuuuagauuuaggccu

SEQ ID NO: 1126662 - RNA, 22 nt, Human
ggaccagagcucgggcuucuca

SEQ ID NO: 1126663 - RNA, 23 nt, Human
acagagaucuugacuuguaugga

SEQ ID NO: 1126664 - RNA, 22 nt, Human
cgcuggggcuuuuugcuugaga

SEQ ID NO: 1126665 - RNA, 22 nt, Human
gcugcugcgcuugucuacuguu

SEQ ID NO: 1126666 - RNA, 22 nt, Human
acuugauuuugaaccuuucuac

SEQ ID NO: 1126667 - RNA, 22 nt, Human
agaggcaggagguugacuugag

SEQ ID NO: 1126668 - RNA, 22 nt, Human
cugucuguuuuaccuucuccag

SEQ ID NO: 1126669 - RNA, 22 nt, Human
ccgggccucgggacaccgggua

SEQ ID NO: 1126670 - RNA, 22 nt, Human
gcuggcagggacagcugcgugu

SEQ ID NO: 1126671 - RNA, 20 nt, Human
gcagcugcccccagucccug

SEQ ID NO: 1126672 - RNA, 20 nt, Human
cuccagggaacagacuggag

SEQ ID NO: 1126673 - RNA, 22 nt, Human
guuugcauuccaauuuagggga

SEQ ID NO: 1126674 - RNA, 22 nt, Human
gauuucaaguaucuugggcgag

SEQ ID NO: 1126675 - RNA, 22 nt, Human
gaugaagccugacuucucggug

SEQ ID NO: 1126676 - RNA, 22 nt, Human
cccuggcauaaaacuucuccag

SEQ ID NO: 1126677 - RNA, 22 nt, Human
gcucaggaaauaguuuaguguu

SEQ ID NO: 1126678 - RNA, 18 nt, Human
cugaggcuggcaggagcc

SEQ ID NO: 1126679 - RNA, 22 nt, Human
ccaggguggaggcuggauggag

SEQ ID NO: 1126680 - RNA, 22 nt, Human
agggcuggaggguacuaguuua

SEQ ID NO: 1126681 - RNA, 22 nt, Human
gcuccagaugaaaggccagagg

SEQ ID NO: 1126682 - RNA, 22 nt, Human
ucugaagaacugaguaaacaug

SEQ ID NO: 1126683 - RNA, 22 nt, Human
gccuucagcggccgcucgcugc

SEQ ID NO: 1126684 - RNA, 22 nt, Human
cagggugggcacccagccucca

SEQ ID NO: 1126685 - RNA, 22 nt, Human
ggguccagcgacagcaggcuca

SEQ ID NO: 1126686 - RNA, 22 nt, Human
guuuacaaauauuuuaaauggu

SEQ ID NO: 1126687 - RNA, 22 nt, Human
aaaucuaggcucauccuggucc

SEQ ID NO: 1126688 - RNA, 22 nt, Human
uugggcuggcagagguggucuu

SEQ ID NO: 1126689 - RNA, 22 nt, Human
aacagaaaagguagguggcuuu

SEQ ID NO: 1126690 - RNA, 22 nt, Human
aaugcacacauuugguacugaa

SEQ ID NO: 1126691 - RNA, 23 nt, Human
agaagcagcuucuggaguaucgg

SEQ ID NO: 1126692 - RNA, 22 nt, Human
aguuauucauuuauucuguaca

SEQ ID NO: 1126693 - RNA, 22 nt, Human
acacagggauauuucagguggu

SEQ ID NO: 1126694 - RNA, 22 nt, Human
aaggugucacugggacaggaaa

SEQ ID NO: 1126695 - RNA, 22 nt, Human
ugcagaggagucagccugggca

SEQ ID NO: 1126696 - RNA, 22 nt, Human
agccccacacucucucugagaa

SEQ ID NO: 1126697 - RNA, 22 nt, Human
gucugaggaagaugcaggggga

SEQ ID NO: 1126698 - RNA, 22 nt, Human
guguccacggcugagaaugauu

SEQ ID NO: 1126699 - RNA, 21 nt, Human
aacauuucugggagaacucac

SEQ ID NO: 1126700 - RNA, 22 nt, Human
uggccugguuauauugcuauca

SEQ ID NO: 1126701 - RNA, 22 nt, Human
uggcaggguggcaacuuuuggu

SEQ ID NO: 1126702 - RNA, 22 nt, Human
agucccagugacuuggccagaa

SEQ ID NO: 1126703 - RNA, 22 nt, Human
gcuguucccauguggggcucag

SEQ ID NO: 1126704 - RNA, 22 nt, Human
cauuuucucaaugaacccucuu

SEQ ID NO: 1126705 - RNA, 22 nt, Human
gaggaaugucagcacaggccuc

SEQ ID NO: 1126706 - RNA, 21 nt, Human
agauuguauggaggugagagg

SEQ ID NO: 1126707 - RNA, 22 nt, Human
uuuccuuccaaaugcccgggag

SEQ ID NO: 1126708 - RNA, 22 nt, Human
aggcugcuucagcugcagggag

SEQ ID NO: 1126709 - RNA, 22 nt, Human
ugggcucugcaucagugcccau

SEQ ID NO: 1126710 - RNA, 22 nt, Human
ggccucugcccucacuccuguc

SEQ ID NO: 1126711 - RNA, 22 nt, Human
uugaaggacaucuuguuucuag

SEQ ID NO: 1126712 - RNA, 22 nt, Human
ucacuuaaaaauucuaguuaug

SEQ ID NO: 1126713 - RNA, 22 nt, Human
uggcaggagguuuucuccagga

SEQ ID NO: 1126714 - RNA, 22 nt, Human
cuggcagcucugagucccuucu

SEQ ID NO: 1126715 - RNA, 22 nt, Human
gagcugccaguguaugaauucu

SEQ ID NO: 1126716 - RNA, 20 nt, Human
agugucuggugcagggccuc

SEQ ID NO: 1126717 - RNA, 22 nt, Human
cauggcaggugcagauucugug

SEQ ID NO: 1126718 - RNA, 22 nt, Human
acagcagcgucaacuuaaaauu

SEQ ID NO: 1126719 - RNA, 22 nt, Human
uccagggaaggugugaggcugg

SEQ ID NO: 1126720 - RNA, 22 nt, Human
ccagcucuuuuggcugagugag

SEQ ID NO: 1126721 - RNA, 22 nt, Human
uuugcauuucucguaaggaaac

SEQ ID NO: 1126722 - RNA, 22 nt, Human
caggaacacaaugagucucaaa

SEQ ID NO: 1126723 - RNA, 22 nt, Human
uucagagaugacaccugguguu

SEQ ID NO: 1126724 - RNA, 22 nt, Human
gagcaacaguuuaugguuuuuc

SEQ ID NO: 1126725 - RNA, 22 nt, Human
agaguggggaagguguugagaa

SEQ ID NO: 1126726 - RNA, 22 nt, Human
caagcccaggauuccccaguua

SEQ ID NO: 1126727 - RNA, 23 nt, Human
gccucugcagccuaguuaguguc

SEQ ID NO: 1126728 - RNA, 22 nt, Human
cacccaggcuggagugcagggg

SEQ ID NO: 1126729 - RNA, 22 nt, Human
cccacucuggcucccuucuagu

SEQ ID NO: 1126730 - RNA, 22 nt, Human
gaaaggugccccauaggcagga

SEQ ID NO: 1126731 - RNA, 22 nt, Human
ccagugcacagccaggcaggug

SEQ ID NO: 1126732 - RNA, 22 nt, Human
cagagccauuauggagacuugc

SEQ ID NO: 1126733 - RNA, 22 nt, Human
ucccagcagcauagcucagaau

SEQ ID NO: 1126734 - RNA, 22 nt, Human
aaucuggcauuugagaguagga

SEQ ID NO: 1126735 - RNA, 23 nt, Human
acaaaugcccauacaucuaguuc

SEQ ID NO: 1126736 - RNA, 22 nt, Human
uauuacugagguuuuauggagu

SEQ ID NO: 1126737 - RNA, 22 nt, Human
ccagggugagaaaaggcuggau

SEQ ID NO: 1126738 - RNA, 22 nt, Human
caggcagauuugcugcccucca

SEQ ID NO: 1126739 - RNA, 22 nt, Human
aaaugucuuucaauagagaaau

SEQ ID NO: 1126740 - RNA, 22 nt, Human
ggagggagcauccccuugcuga

SEQ ID NO: 1126741 - RNA, 22 nt, Human
auucaguaggucuagaauaaga

SEQ ID NO: 1126742 - RNA, 22 nt, Human
cagagcagagugauuguucugg

SEQ ID NO: 1126743 - RNA, 18 nt, Human
ccagguggugacagagau

SEQ ID NO: 1126744 - RNA, 22 nt, Human
gcagacuguaucaaugucagua

SEQ ID NO: 1126745 - RNA, 22 nt, Human
uagggcagccuuauagcuccca

SEQ ID NO: 1126746 - RNA, 22 nt, Human
uggaagcaucacuucuugccug

SEQ ID NO: 1126747 - RNA, 22 nt, Human
ccacugucugcaggccucagca

SEQ ID NO: 1126748 - RNA, 22 nt, Human
uugggcugaacccugcagcuga

SEQ ID NO: 1126749 - RNA, 22 nt, Human
cguguacagucuaucuuuuuuc

SEQ ID NO: 1126750 - RNA, 22 nt, Human
ggccagaggccacagcuguguc

SEQ ID NO: 1126751 - RNA, 22 nt, Human
ggcagcugaccuagcaccaucc

SEQ ID NO: 1126752 - RNA, 22 nt, Human
ccagucacuggaaaaugggaau

SEQ ID NO: 1126753 - RNA, 22 nt, Human
uuuuauuggagugauaccaagc

SEQ ID NO: 1126754 - RNA, 22 nt, Human
ugggcaagucacuucugucuuu

SEQ ID NO: 1126755 - RNA, 22 nt, Human
auuucuuccucugucaguaacu

SEQ ID NO: 1126756 - RNA, 22 nt, Human
aauguuuuaaaagagauugaga

SEQ ID NO: 1126757 - RNA, 22 nt, Human
uggagcuggaauuucugggccu

SEQ ID NO: 1126758 - RNA, 22 nt, Human
acauuucuaucauccuguaaug

SEQ ID NO: 1126759 - RNA, 22 nt, Human
cccuggagcaucucugcugucu

SEQ ID NO: 1126760 - RNA, 22 nt, Human
gcaaagcugggugugaaugcac

SEQ ID NO: 1126761 - RNA, 22 nt, Human
ccagggugaggaggcucccacg

SEQ ID NO: 1126762 - RNA, 22 nt, Human
accugagaaugggggcaugugu

SEQ ID NO: 1126763 - RNA, 22 nt, Human
cucucuggcuuggcacggagau

SEQ ID NO: 1126764 - RNA, 22 nt, Human
aggcugaggcagguggaucacc

SEQ ID NO: 1126765 - RNA, 22 nt, Human
uguaugcagcaaaacaauuagu

SEQ ID NO: 1126766 - RNA, 22 nt, Human
aggcuucccaagcagcugcaaa

SEQ ID NO: 1126767 - RNA, 22 nt, Human
ccuggcugggguagaagugagg

SEQ ID NO: 1126768 - RNA, 22 nt, Human
augaagcugaccuugucuugcu

SEQ ID NO: 1126769 - RNA, 22 nt, Human
ccagcuccugggucuuagucag

SEQ ID NO: 1126770 - RNA, 22 nt, Human
uuauacauguguuuugagauga

SEQ ID NO: 1126771 - RNA, 17 nt, Human
aggcuggcucacaggga

SEQ ID NO: 1126772 - RNA, 22 nt, Human
augugucaauuuucaaaugcuu

SEQ ID NO: 1126773 - RNA, 22 nt, Human
gccaggugcuaucccugcgcug

SEQ ID NO: 1126774 - RNA, 22 nt, Human
cagaagaaaguggggagacaag

SEQ ID NO: 1126775 - RNA, 22 nt, Human
aggggcuguggaaaccaacucu

SEQ ID NO: 1126776 - RNA, 22 nt, Human
agaaacugaauuauuucugagg

SEQ ID NO: 1126777 - RNA, 22 nt, Human
ucucagagaugucaagagucua

SEQ ID NO: 1126778 - RNA, 22 nt, Human
cuuguagaauugaaauggucuc

SEQ ID NO: 1126779 - RNA, 22 nt, Human
cacugugucaguuugguuagac

SEQ ID NO: 1126780 - RNA, 22 nt, Human
uccuuggcuuucuggagcuucu

SEQ ID NO: 1126781 - RNA, 21 nt, Human
ucagaacaauuccaugccucc

SEQ ID NO: 1126782 - RNA, 22 nt, Human
cagggcugagaauuuagagaca

SEQ ID NO: 1126783 - RNA, 22 nt, Human
ugcagcugcuugauucaucuug

SEQ ID NO: 1126784 - RNA, 16 nt, Human
gggagggaguuggugg

SEQ ID NO: 1126785 - RNA, 21 nt, Human
uccucagggccccagagcacu

SEQ ID NO: 1126786 - RNA, 22 nt, Human
ccucugggugggaggccgggcg

SEQ ID NO: 1126787 - RNA, 22 nt, Human
ggaggccaggguggguggaucg

SEQ ID NO: 1126788 - RNA, 22 nt, Human
auucuucacuguuucagaauga

SEQ ID NO: 1126789 - RNA, 22 nt, Human
cauuucugggagacaugcuaga

SEQ ID NO: 1126790 - RNA, 22 nt, Human
cuaauacucauuucuguaacuc

SEQ ID NO: 1126791 - RNA, 22 nt, Human
cccagagccucauucuguuggg

SEQ ID NO: 1126792 - RNA, 22 nt, Human
gcauacagagaggauguggcau

SEQ ID NO: 1126793 - RNA, 22 nt, Human
ugacagaaauaguucuuaauuu

SEQ ID NO: 1126794 - RNA, 22 nt, Human
augagcugugggauuccagagg

SEQ ID NO: 1126795 - RNA, 23 nt, Human
gccucagagaaacagcugcacac

SEQ ID NO: 1126796 - RNA, 22 nt, Human
cagguggggcgcccucaggcag

SEQ ID NO: 1126797 - RNA, 22 nt, Human
gcucaggacccaggugugaccu

SEQ ID NO: 1126798 - RNA, 22 nt, Human
caguagccacuagacacaugua

SEQ ID NO: 1126799 - RNA, 19 nt, Human
aggaaagguggccuuagca

SEQ ID NO: 1126800 - RNA, 22 nt, Human
aagcagcuuaaauuagagccug

SEQ ID NO: 1126801 - RNA, 22 nt, Human
cugggcacuugcucacagcucu

SEQ ID NO: 1126802 - RNA, 22 nt, Human
auauacuuggagacuaucauug

SEQ ID NO: 1126803 - RNA, 22 nt, Human
acagagcaauaacagggagagg

SEQ ID NO: 1126804 - RNA, 20 nt, Human
ggucccugcccucugucauc

SEQ ID NO: 1126805 - RNA, 22 nt, Human
uccaggcugggcugaagggugc

SEQ ID NO: 1126806 - RNA, 23 nt, Human
cagugcagggcaacucagacucc

SEQ ID NO: 1126807 - RNA, 22 nt, Human
cucaggauguacuacagaaggc

SEQ ID NO: 1126808 - RNA, 22 nt, Human
ugugcuucagguugucgccacg

SEQ ID NO: 1126809 - RNA, 22 nt, Human
gccugggugucgaucacuagug

SEQ ID NO: 1126810 - RNA, 22 nt, Human
cucugaacucuugggcagcaug

SEQ ID NO: 1126811 - RNA, 22 nt, Human
agagcagauggagcuggaagag

SEQ ID NO: 1126812 - RNA, 22 nt, Human
acugcagccuagggaccacagu

SEQ ID NO: 1126813 - RNA, 22 nt, Human
uugaagcaggaaaauuucuauu

SEQ ID NO: 1126814 - RNA, 22 nt, Human
aggcugcaggucugggucaugu

SEQ ID NO: 1126815 - RNA, 22 nt, Human
uuaugggagcaauuggggaggu

SEQ ID NO: 1126816 - RNA, 22 nt, Human
cacacagaugguaagggaggga

SEQ ID NO: 1126817 - RNA, 22 nt, Human
uaacaucuuuagcagcucgaac

SEQ ID NO: 1126818 - RNA, 22 nt, Human
aaguuauaucaucucauugacg

SEQ ID NO: 1126819 - RNA, 22 nt, Human
caaggccugccucuggcagaaa

SEQ ID NO: 1126820 - RNA, 22 nt, Human
gaaaagggcaagagagagggca

SEQ ID NO: 1126821 - RNA, 22 nt, Human
agagugaucagauaucaggugu

SEQ ID NO: 1126822 - RNA, 22 nt, Human
uagaaaucuacuuagacuuucu

SEQ ID NO: 1126823 - RNA, 20 nt, Human
cguaaggcaagugcugcauc

SEQ ID NO: 1126824 - RNA, 22 nt, Human
gggcucugcgcucagcuccagc

SEQ ID NO: 1126825 - RNA, 22 nt, Human
uaaguccacaggaguuguguuc

SEQ ID NO: 1126826 - RNA, 22 nt, Human
cagcccugagagaaccaucuau

SEQ ID NO: 1126827 - RNA, 22 nt, Human
aucagugcuaaagcaaaugccc

SEQ ID NO: 1126828 - RNA, 22 nt, Human
cccagcauggagugaggacuca

SEQ ID NO: 1126829 - RNA, 22 nt, Human
uccagggaucuuuagagucuuu

SEQ ID NO: 1126830 - RNA, 22 nt, Human
uaacacacugaaggugagaugg

SEQ ID NO: 1126831 - RNA, 22 nt, Human
cauugaaaaacguugacugagu

SEQ ID NO: 1126832 - RNA, 22 nt, Human
ccugucugcagauaucucaggu

SEQ ID NO: 1126833 - RNA, 22 nt, Human
agucuucccugugccagagugu

SEQ ID NO: 1126834 - RNA, 22 nt, Human
ccagggcaggggcuggaguuca

SEQ ID NO: 1126835 - RNA, 22 nt, Human
ugucacauaggcaaaauguuuu

SEQ ID NO: 1126836 - RNA, 23 nt, Human
aguacauucgaaaaauucuguga

SEQ ID NO: 1126837 - RNA, 22 nt, Human
cacugcuuaguugguaaaugug

SEQ ID NO: 1126838 - RNA, 18 nt, Human
cugaaggauccaggugua

SEQ ID NO: 1126839 - RNA, 22 nt, Human
cagcaauauacacagucuaugg

SEQ ID NO: 1126840 - RNA, 23 nt, Human
auaauaacgucugucuugucucu

SEQ ID NO: 1126841 - RNA, 22 nt, Human
gcccugcugucuucagaguaua

SEQ ID NO: 1126842 - RNA, 22 nt, Human
agcagccagagucugaacauua

SEQ ID NO: 1126843 - RNA, 22 nt, Human
augggagugacagggccacugg

SEQ ID NO: 1126844 - RNA, 22 nt, Human
ccuccugguccagcaucucuuu

SEQ ID NO: 1126845 - RNA, 21 nt, Human
gcuccuggugcugcguggcgc

SEQ ID NO: 1126846 - RNA, 22 nt, Human
gcagcaaucuucacagugucau

SEQ ID NO: 1126847 - RNA, 22 nt, Human
cucuggagcauuucaccuacau

SEQ ID NO: 1126848 - RNA, 20 nt, Human
ugcagagcuggcuggcuccu

SEQ ID NO: 1126849 - RNA, 17 nt, Human
gauuuccugaaguucuu

SEQ ID NO: 1126850 - RNA, 22 nt, Human
gcaggcuccaggccggccccuu

SEQ ID NO: 1126851 - RNA, 23 nt, Human
ggucccaguggagaggccucacc

SEQ ID NO: 1126852 - RNA, 22 nt, Human
cucagcagagaccagggaggaa

SEQ ID NO: 1126853 - RNA, 22 nt, Human
uagaaauccccagucucauagu

SEQ ID NO: 1126854 - RNA, 19 nt, Human
agucucaguguacagaggc

SEQ ID NO: 1126855 - RNA, 22 nt, Human
cauugcucaggcccagcaggaa

SEQ ID NO: 1126856 - RNA, 22 nt, Human
ugcaggcuuuagccccauggcu

SEQ ID NO: 1126857 - RNA, 22 nt, Human
ugggaggaucgcuugagcccag

SEQ ID NO: 1126858 - RNA, 22 nt, Human
caccagcuacagacuacugugu

SEQ ID NO: 1126859 - RNA, 22 nt, Human
cauacauugcucauucaguauc

SEQ ID NO: 1126860 - RNA, 22 nt, Human
auacagaagaacuauagccacu

SEQ ID NO: 1126861 - RNA, 22 nt, Human
agucccagugagaugaaccagg

SEQ ID NO: 1126862 - RNA, 22 nt, Human
uggcugaacuaaugugcuguuu

SEQ ID NO: 1126863 - RNA, 22 nt, Human
cacagcuucugagugaggauuu

SEQ ID NO: 1126864 - RNA, 22 nt, Human
uguggccuccccacuucugggg

SEQ ID NO: 1126865 - RNA, 22 nt, Human
cugagccaguagucagggacaa

SEQ ID NO: 1126866 - RNA, 22 nt, Human
cauugcuguuaauugucucuag

SEQ ID NO: 1126867 - RNA, 22 nt, Human
ucagaagagcuggugcugccug

SEQ ID NO: 1126868 - RNA, 22 nt, Human
uccuggguccauggcagccgaa

SEQ ID NO: 1126869 - RNA, 22 nt, Human
ugccucagucuaaagucucuca

SEQ ID NO: 1126870 - RNA, 20 nt, Human
ucacauccucucccaacaug

SEQ ID NO: 1126871 - RNA, 22 nt, Human
agugucugccagcugccaggug

SEQ ID NO: 1126872 - RNA, 22 nt, Human
uuucaauguaacauuuccaggc

SEQ ID NO: 1126873 - RNA, 22 nt, Human
agugucugccaacugcaugguc

SEQ ID NO: 1126874 - RNA, 22 nt, Human
ggggauggaauguaguagugau

SEQ ID NO: 1126875 - RNA, 22 nt, Human
uucauuccuucccuaagcaacu

SEQ ID NO: 1126876 - RNA, 22 nt, Human
acagcagcuaaccccugggcca

SEQ ID NO: 1126877 - RNA, 22 nt, Human
caaaagcaguucuaucugaguu

SEQ ID NO: 1126878 - RNA, 22 nt, Human
cggggcuguagcacagcugagc

SEQ ID NO: 1126879 - RNA, 22 nt, Human
cauguacauucuguagauggag

SEQ ID NO: 1126880 - RNA, 20 nt, Human
aagcagaagcugcucucagc

SEQ ID NO: 1126881 - RNA, 22 nt, Human
ccagcagcccucuuccaagacu

SEQ ID NO: 1126882 - RNA, 20 nt, Human
ccagcauguacacaugugga

SEQ ID NO: 1126883 - RNA, 21 nt, Human
uugcaccaugauaaauucaga

SEQ ID NO: 1126884 - RNA, 22 nt, Human
gacagaagaggaacuuggacag

SEQ ID NO: 1126885 - RNA, 22 nt, Human
auugagaauccauuugagauga

SEQ ID NO: 1126886 - RNA, 22 nt, Human
gaaaucugucuuuguuugaaua

SEQ ID NO: 1126887 - RNA, 22 nt, Human
cagcugcccauccugggaaaug

SEQ ID NO: 1126888 - RNA, 22 nt, Human
aauuagagaucaguucuuugac

SEQ ID NO: 1126889 - RNA, 22 nt, Human
cagggcccaggccacuggguug

SEQ ID NO: 1126890 - RNA, 22 nt, Human
gcugucuguucgagcguguguu

SEQ ID NO: 1126891 - RNA, 22 nt, Human
ugugcuucugcagagacuauuu

SEQ ID NO: 1126892 - RNA, 22 nt, Human
caggaacauuuaaccacagggu

SEQ ID NO: 1126893 - RNA, 22 nt, Human
ggagcugcacgcucugaagccu

SEQ ID NO: 1126894 - RNA, 22 nt, Human
ccugggagguggagguugcagu

SEQ ID NO: 1126895 - RNA, 22 nt, Human
ugcagaagauggucugagcacc

SEQ ID NO: 1126896 - RNA, 22 nt, Human
acucaagauagggaaaguacaa

SEQ ID NO: 1126897 - RNA, 20 nt, Human
cagcuuggaugagaggcuga

SEQ ID NO: 1126898 - RNA, 17 nt, Human
agguggguggaucaccu

SEQ ID NO: 1126899 - RNA, 22 nt, Human
cuggcucuucagugcuugguuc

SEQ ID NO: 1126900 - RNA, 22 nt, Human
ugagguguguccccagggaggu

SEQ ID NO: 1126901 - RNA, 22 nt, Human
uccagagcagguggucagaagg

SEQ ID NO: 1126902 - RNA, 22 nt, Human
gccaggcagcaggaagccagug

SEQ ID NO: 1126903 - RNA, 22 nt, Human
aggucauuggggacuaucuccg

SEQ ID NO: 1126904 - RNA, 21 nt, Human
cccuugccugcacuccucggc

SEQ ID NO: 1126905 - RNA, 22 nt, Human
ggugaggcagguggcugcugag

SEQ ID NO: 1126906 - RNA, 22 nt, Human
uggacagguugaguaggaggag

SEQ ID NO: 1126907 - RNA, 22 nt, Human
uggcccugacacgugguacugg

SEQ ID NO: 1126908 - RNA, 22 nt, Human
agucucagcaagcauggcuagu

SEQ ID NO: 1126909 - RNA, 22 nt, Human
cuggagggugagccucaucucu

SEQ ID NO: 1126910 - RNA, 22 nt, Human
ccauaagguugaaaacuguaca

SEQ ID NO: 1126911 - RNA, 22 nt, Human
uugcauugcuuggucuucaaga

SEQ ID NO: 1126912 - RNA, 22 nt, Human
acacagggucuagaguuaggcc

SEQ ID NO: 1126913 - RNA, 22 nt, Human
accaaggagccacauacaaccu

SEQ ID NO: 1126914 - RNA, 22 nt, Human
agggaggaucugcuccuugucu

SEQ ID NO: 1126915 - RNA, 22 nt, Human
ccugggcaaaugccagagacaa

SEQ ID NO: 1126916 - RNA, 21 nt, Human
aggcccagcuuuccucuugcu

SEQ ID NO: 1126917 - RNA, 22 nt, Human
gcucucugggugugucuagaua

SEQ ID NO: 1126918 - RNA, 22 nt, Human
aauaauuuccagccaacuggaa

SEQ ID NO: 1126919 - RNA, 22 nt, Human
uccuuuuuauaguuagagaaac

SEQ ID NO: 1126920 - RNA, 22 nt, Human
cccugccuucuuggccuuuaaa

SEQ ID NO: 1126921 - RNA, 22 nt, Human
aggcacuguucccaguuauccu

SEQ ID NO: 1126922 - RNA, 22 nt, Human
gccaggcagccacccucugcga

SEQ ID NO: 1126923 - RNA, 22 nt, Human
aagugguagacaaagauaauug

SEQ ID NO: 1126924 - RNA, 22 nt, Human
aagcgccaugguuccugcgcag

SEQ ID NO: 1126925 - RNA, 22 nt, Human
agcccuggcccggcugugcuuu

SEQ ID NO: 1126926 - RNA, 22 nt, Human
agaaggaguguacaggucaugc

SEQ ID NO: 1126927 - RNA, 22 nt, Human
caacagaagguguacuacugaa

SEQ ID NO: 1126928 - RNA, 22 nt, Human
uggcaguguauagguggcuccu

SEQ ID NO: 1126929 - RNA, 22 nt, Human
auugucgcuuauuuaggugcuu

SEQ ID NO: 1126930 - RNA, 22 nt, Human
gcucccagcuggagccucaaca

SEQ ID NO: 1126931 - RNA, 22 nt, Human
caggccuccacuccacgcagac

SEQ ID NO: 1126932 - RNA, 22 nt, Human
accucugcaaugcaaugucaug

SEQ ID NO: 1126933 - RNA, 19 nt, Human
ucccgcccacugagcgugc

SEQ ID NO: 1126934 - RNA, 22 nt, Human
uuccagaauuuuguucugcuug

SEQ ID NO: 1126935 - RNA, 22 nt, Human
caguggccugagccaggcuucc

SEQ ID NO: 1126936 - RNA, 22 nt, Human
gagccugaaauacaggucacug

SEQ ID NO: 1126937 - RNA, 22 nt, Human
uuaauacagucuccagaaguaa

SEQ ID NO: 1126938 - RNA, 22 nt, Human
aagccuugauucacucugugga

SEQ ID NO: 1126939 - RNA, 22 nt, Human
gcucccaggaugaggagccagg

SEQ ID NO: 1126940 - RNA, 22 nt, Human
acaagagacaagagguucuucu

SEQ ID NO: 1126941 - RNA, 22 nt, Human
cagucacauugcccugcauuua

SEQ ID NO: 1126942 - RNA, 22 nt, Human
acagccaggaauucuggagaag

SEQ ID NO: 1126943 - RNA, 22 nt, Human
cugagccagcuggcaugugcua

SEQ ID NO: 1126944 - RNA, 22 nt, Human
gagggcugccacguugggcgag

SEQ ID NO: 1126945 - RNA, 22 nt, Human
ggccucaguuucuccauggguu

SEQ ID NO: 1126946 - RNA, 22 nt, Human
uccucagacacccugcuggcuu

SEQ ID NO: 1126947 - RNA, 22 nt, Human
gcagugggaagguuggcacaug

SEQ ID NO: 1126948 - RNA, 22 nt, Human
gcauuguccugcuucugagugu

SEQ ID NO: 1126949 - RNA, 22 nt, Human
uugacaauugggagauauaaag

SEQ ID NO: 1126950 - RNA, 22 nt, Human
ugcagcugcuggcccaggugcu

SEQ ID NO: 1126951 - RNA, 22 nt, Human
ccugccuggcuuccagaagaga

SEQ ID NO: 1126952 - RNA, 22 nt, Human
accaucaguacuggaugcugac

SEQ ID NO: 1126953 - RNA, 22 nt, Human
ucacauuuguuccucugcacuu

SEQ ID NO: 1126954 - RNA, 22 nt, Human
ggcuucuuccugugaacauguu

SEQ ID NO: 1126955 - RNA, 22 nt, Human
ggccuugggaggagggucagaa

SEQ ID NO: 1126956 - RNA, 22 nt, Human
ucaggagauggucuuuauaggc

SEQ ID NO: 1126957 - RNA, 22 nt, Human
agcuccuccugugccaggccag

SEQ ID NO: 1126958 - RNA, 23 nt, Human
cuggggcuuucaaaucugggcag

SEQ ID NO: 1126959 - RNA, 22 nt, Human
gcagggcaugggcccugucugc

SEQ ID NO: 1126960 - RNA, 22 nt, Human
gcucuggcuacuguggcuaccg

SEQ ID NO: 1126961 - RNA, 22 nt, Human
aagaaauguagagccuaguaaa

SEQ ID NO: 1126962 - RNA, 22 nt, Human
aaguccauuaggccccugccug

SEQ ID NO: 1126963 - RNA, 22 nt, Human
aggcucuguuauucuagagggc

SEQ ID NO: 1126964 - RNA, 22 nt, Human
agcagccagaaagggcagucga

SEQ ID NO: 1126965 - RNA, 22 nt, Human
cagagcagggugcaccuugggc

SEQ ID NO: 1126966 - RNA, 22 nt, Human
uaagaaauuuaguuauagaaug

SEQ ID NO: 1126967 - RNA, 22 nt, Human
ggucccagaauugguuagcaca

SEQ ID NO: 1126968 - RNA, 22 nt, Human
cuugaaagauuuggccucugug

SEQ ID NO: 1126969 - RNA, 22 nt, Human
auguccuuccauuuugaucugu

SEQ ID NO: 1126970 - RNA, 22 nt, Human
acaugauuggacuccuuccccu

SEQ ID NO: 1126971 - RNA, 22 nt, Human
ucucuucugaaaccugucuuua

SEQ ID NO: 1126972 - RNA, 22 nt, Human
ucuccugugcacccucccugug

SEQ ID NO: 1126973 - RNA, 22 nt, Human
uuccaaaggaauggggagcuau

SEQ ID NO: 1126974 - RNA, 22 nt, Human
ugcaccauacccauuccccucu

SEQ ID NO: 1126975 - RNA, 22 nt, Human
ccucagggucugaggagaccgu

SEQ ID NO: 1126976 - RNA, 22 nt, Human
uguuaucugagcaacgucgacg

SEQ ID NO: 1126977 - RNA, 22 nt, Human
ccaguggguaggccauggugag

SEQ ID NO: 1126978 - RNA, 21 nt, Human
gagacagcccagugccagggc

SEQ ID NO: 1126979 - RNA, 22 nt, Human
caggggcucuaaugcaugauca

SEQ ID NO: 1126980 - RNA, 22 nt, Human
cagcuggcaaguggagcagggu

SEQ ID NO: 1126981 - RNA, 22 nt, Human
uccuauugguagacauuucugu

SEQ ID NO: 1126982 - RNA, 22 nt, Human
uugcauugauguuccuucuugc

SEQ ID NO: 1126983 - RNA, 22 nt, Human
agaugaagacucaggagcaggu

SEQ ID NO: 1126984 - RNA, 22 nt, Human
ggucaggggcugcucuacagag

SEQ ID NO: 1126985 - RNA, 22 nt, Human
cacuguaucuuuuccaaagucu

SEQ ID NO: 1126986 - RNA, 22 nt, Human
ucucucagcuuugagaccugcu

SEQ ID NO: 1126987 - RNA, 22 nt, Human
cugccucuauucacugaggcag

SEQ ID NO: 1126988 - RNA, 22 nt, Human
augugugccccuuuuacucuuu

SEQ ID NO: 1126989 - RNA, 22 nt, Human
cagccuguagaauacaguaaau

SEQ ID NO: 1126990 - RNA, 22 nt, Human
uugaaaggugcugugugcugau

SEQ ID NO: 1126991 - RNA, 22 nt, Human
uuugacagacauuuacuacauu

SEQ ID NO: 1126992 - RNA, 22 nt, Human
gcucagagaugucugcugccuu

SEQ ID NO: 1126993 - RNA, 22 nt, Human
aaacaaguguaaacuagucugu

SEQ ID NO: 1126994 - RNA, 22 nt, Human
uggcagucggacuucuaucuca

SEQ ID NO: 1126995 - RNA, 18 nt, Human
agccuggaggguugaagu

SEQ ID NO: 1126996 - RNA, 22 nt, Human
uuuagaguugaguauucauugg

SEQ ID NO: 1126997 - RNA, 22 nt, Human
ugcugccuugaccuccugggcu

SEQ ID NO: 1126998 - RNA, 22 nt, Human
cauggcagaaaccugagcugcu

SEQ ID NO: 1126999 - RNA, 22 nt, Human
uggaggccagagguacugggac

SEQ ID NO: 1127000 - RNA, 22 nt, Human
agguggccggugccagccgggc

SEQ ID NO: 1127001 - RNA, 22 nt, Human
gcuucauuacugacagucugug

SEQ ID NO: 1127002 - RNA, 22 nt, Human
uaaaugcaagugcuccugggag

SEQ ID NO: 1127003 - RNA, 22 nt, Human
gcucugcucuaacauuccugac

SEQ ID NO: 1127004 - RNA, 22 nt, Human
ucacugggagaugugggaaggg

SEQ ID NO: 1127005 - RNA, 22 nt, Human
ggcugugccucaaggcuacuca

SEQ ID NO: 1127006 - RNA, 20 nt, Human
gggugagauguaggagaggg

SEQ ID NO: 1127007 - RNA, 22 nt, Human
gcagugggagcuuaggcagugc

SEQ ID NO: 1127008 - RNA, 22 nt, Human
aauguacaauaagacaaagagg

SEQ ID NO: 1127009 - RNA, 22 nt, Human
aaaucaaaagacauguguuuua

SEQ ID NO: 1127010 - RNA, 22 nt, Human
ucuuggagaauggcagagaagc

SEQ ID NO: 1127011 - RNA, 22 nt, Human
agcagcuguacuuucaucuguu

SEQ ID NO: 1127012 - RNA, 22 nt, Human
guguauguucuacuuaauauua

SEQ ID NO: 1127013 - RNA, 22 nt, Human
uucugucacuuaggaggucaua

SEQ ID NO: 1127014 - RNA, 22 nt, Human
cugccugugugugccugcagaa

SEQ ID NO: 1127015 - RNA, 22 nt, Human
caguguggagggagagagccug

SEQ ID NO: 1127016 - RNA, 22 nt, Human
agccagacauggcuccugcucc

SEQ ID NO: 1127017 - RNA, 22 nt, Human
ggaaagaggauaguggguaggu

SEQ ID NO: 1127018 - RNA, 22 nt, Human
uccugccugagcguggaggagg

SEQ ID NO: 1127019 - RNA, 22 nt, Human
ggagaccagaaggaagcuucga

SEQ ID NO: 1127020 - RNA, 23 nt, Human
uggcucugagagguucagaugcu

SEQ ID NO: 1127021 - RNA, 22 nt, Human
cugcuuugaaaauaaacuuguc

SEQ ID NO: 1127022 - RNA, 22 nt, Human
ccugggaggcuguuuccagccu

SEQ ID NO: 1127023 - RNA, 22 nt, Human
agcuugccucuuaaucaccuca

SEQ ID NO: 1127024 - RNA, 22 nt, Human
agcugccaccucugccuuuggg

SEQ ID NO: 1127025 - RNA, 23 nt, Human
acugagccagggccugggucagc

SEQ ID NO: 1127026 - RNA, 22 nt, Human
auuauguauuugguauaguuug

SEQ ID NO: 1127027 - RNA, 22 nt, Human
acaaagguggaccauguggcuu

SEQ ID NO: 1127028 - RNA, 22 nt, Human
cccuggaggagcuuagagcuug

SEQ ID NO: 1127029 - RNA, 22 nt, Human
aagagagaacucccuucgccag

SEQ ID NO: 1127030 - RNA, 22 nt, Human
aaaguuuggauuagcaguuaga

SEQ ID NO: 1127031 - RNA, 22 nt, Human
ugucucagaggcaggaagagcc

SEQ ID NO: 1127032 - RNA, 23 nt, Human
gggaccagcuagggcugugaccu

SEQ ID NO: 1127033 - RNA, 22 nt, Human
gcaguggcaccgcuggcucugg

SEQ ID NO: 1127034 - RNA, 18 nt, Human
cagggccccagaauuauc

SEQ ID NO: 1127035 - RNA, 22 nt, Human
agcuuuauucaugauuucaggg

SEQ ID NO: 1127036 - RNA, 21 nt, Human
ucugucucuccacugcccugc

SEQ ID NO: 1127037 - RNA, 22 nt, Human
cuugggagacacaagaagacau

SEQ ID NO: 1127038 - RNA, 22 nt, Human
guccucaggaaagcagauaaca

SEQ ID NO: 1127039 - RNA, 22 nt, Human
ugggccugggcuccuguccucu

SEQ ID NO: 1127040 - RNA, 22 nt, Human
aagagguaaccauagcaaccac

SEQ ID NO: 1127041 - RNA, 22 nt, Human
ucacacguccuugcuacuccuc

SEQ ID NO: 1127042 - RNA, 22 nt, Human
guugaguggguuaggaugcuga

SEQ ID NO: 1127043 - RNA, 22 nt, Human
ugcaauaaggaguaauaguaaa

SEQ ID NO: 1127044 - RNA, 22 nt, Human
cagagcugugauaaauagauau

SEQ ID NO: 1127045 - RNA, 22 nt, Human
agcagggguaacagaaggaaag

SEQ ID NO: 1127046 - RNA, 22 nt, Human
gcuccuggucuggagcuucaag

SEQ ID NO: 1127047 - RNA, 22 nt, Human
ucuucuuccucauuuauacaua

SEQ ID NO: 1127048 - RNA, 22 nt, Human
agccacagcuccuugguggaga

SEQ ID NO: 1127049 - RNA, 17 nt, Human
ugagaaguaggcaucau

SEQ ID NO: 1127050 - RNA, 22 nt, Human
uccagggagauacuggcugcca

SEQ ID NO: 1127051 - RNA, 22 nt, Human
uggcucuguucgccaucaggag

SEQ ID NO: 1127052 - RNA, 22 nt, Human
uucagaaagugaaucuuguuau

SEQ ID NO: 1127053 - RNA, 22 nt, Human
aaaauguaaagcuugaguguag

SEQ ID NO: 1127054 - RNA, 18 nt, Human
ccucaggggaccuggcag

SEQ ID NO: 1127055 - RNA, 22 nt, Human
cugugucucuccuuacaagacu

SEQ ID NO: 1127056 - RNA, 22 nt, Human
uacauggguagguuaagucaua

SEQ ID NO: 1127057 - RNA, 22 nt, Human
gggucuggcaugcugagaugga

SEQ ID NO: 1127058 - RNA, 22 nt, Human
gagccaggguuugaaacuagac

SEQ ID NO: 1127059 - RNA, 22 nt, Human
auccaguuuaugucauauucuu

SEQ ID NO: 1127060 - RNA, 23 nt, Human
gccucuggagccccagugcucag

SEQ ID NO: 1127061 - RNA, 19 nt, Human
cugaggcccauguaccaug

SEQ ID NO: 1127062 - RNA, 22 nt, Human
ugcuggggucauggggcgcccg

SEQ ID NO: 1127063 - RNA, 22 nt, Human
uguguguguuccuccucagcua

SEQ ID NO: 1127064 - RNA, 22 nt, Human
cuuauguaaaacggaaagggaa

SEQ ID NO: 1127065 - RNA, 20 nt, Human
aucagcaacugccacucagu

SEQ ID NO: 1127066 - RNA, 22 nt, Human
cugccugcuucugagccagagg

SEQ ID NO: 1127067 - RNA, 22 nt, Human
gucugucucucuccagagugca

SEQ ID NO: 1127068 - RNA, 22 nt, Human
acaguggagaaggcaugaggcu

SEQ ID NO: 1127069 - RNA, 18 nt, Human
ccuggaccugucuccuuu

SEQ ID NO: 1127070 - RNA, 22 nt, Human
ugacaauacagagagagcaaaa

SEQ ID NO: 1127071 - RNA, 23 nt, Human
aucagucuugguagcugugccca

SEQ ID NO: 1127072 - RNA, 22 nt, Human
gaaaucugcggugaggccugag

SEQ ID NO: 1127073 - RNA, 22 nt, Human
ggggauggauuccgggucccug

SEQ ID NO: 1127074 - RNA, 22 nt, Human
gaagaacaccugcugcccagug

SEQ ID NO: 1127075 - RNA, 23 nt, Human
gagguacagcaccagugaauagg

SEQ ID NO: 1127076 - RNA, 22 nt, Human
aggcaugugacccuggacucag

SEQ ID NO: 1127077 - RNA, 22 nt, Human
uggcagagagagugcagucgac

SEQ ID NO: 1127078 - RNA, 23 nt, Human
ccagccucugggucuucauccag

SEQ ID NO: 1127079 - RNA, 22 nt, Human
auaauuuacaacugcuuuuaau

SEQ ID NO: 1127080 - RNA, 22 nt, Human
uugauacagcagccugugaucc

SEQ ID NO: 1127081 - RNA, 22 nt, Human
ugccugucuucaggagugucac

SEQ ID NO: 1127082 - RNA, 22 nt, Human
agucucugugagcucccaaugg

SEQ ID NO: 1127083 - RNA, 22 nt, Human
aggaaucccgcaccagcugcug

SEQ ID NO: 1127084 - RNA, 22 nt, Human
agcuccugaaaagcgcuugcuu

SEQ ID NO: 1127085 - RNA, 22 nt, Human
uuauguacucugcaauguuuga

SEQ ID NO: 1127086 - RNA, 22 nt, Human
cuccucugucuaccacgagggu

SEQ ID NO: 1127087 - RNA, 22 nt, Human
cugagauggaguuucgcucuuc

SEQ ID NO: 1127088 - RNA, 22 nt, Human
cagccagggagggcaaaugaga

SEQ ID NO: 1127089 - RNA, 22 nt, Human
ucagcaggcgguuccuuguggg

SEQ ID NO: 1127090 - RNA, 22 nt, Human
uguuuauaccuugguauaacca

SEQ ID NO: 1127091 - RNA, 22 nt, Human
caucugcuguuccuuggacuca

SEQ ID NO: 1127092 - RNA, 22 nt, Human
aacucagcauccugcacagaga

SEQ ID NO: 1127093 - RNA, 22 nt, Human
ugggcuggcccaccacaccucg

SEQ ID NO: 1127094 - RNA, 22 nt, Human
gaagaagcaggaguguguagca

SEQ ID NO: 1127095 - RNA, 22 nt, Human
ucuggcuccaccuccuuuacua

SEQ ID NO: 1127096 - RNA, 22 nt, Human
cugagcauggccgguccauggu

SEQ ID NO: 1127097 - RNA, 22 nt, Human
acagcuguauccccagagcuca

SEQ ID NO: 1127098 - RNA, 16 nt, Human
agaggccuugaggaag

SEQ ID NO: 1127099 - RNA, 22 nt, Human
auaauccauuaauuaaugacca

SEQ ID NO: 1127100 - RNA, 22 nt, Human
agccacagucugaugccugaga

SEQ ID NO: 1127101 - RNA, 22 nt, Human
cagcucucuaaggucuugcuuu

SEQ ID NO: 1127102 - RNA, 22 nt, Human
auuucauugaaguuaauucuuc

SEQ ID NO: 1127103 - RNA, 19 nt, Human
ugucacugucauggcccag

SEQ ID NO: 1127104 - RNA, 22 nt, Human
cuggaaugccucccugucagag

SEQ ID NO: 1127105 - RNA, 22 nt, Human
ugugugugaaccauugagggcu

SEQ ID NO: 1127106 - RNA, 22 nt, Human
ggcacugaaccaggacacaagc

SEQ ID NO: 1127107 - RNA, 22 nt, Human
ugucacaaacauacauuauaga

SEQ ID NO: 1127108 - RNA, 22 nt, Human
gccugcuggauguggccaggcc

SEQ ID NO: 1127109 - RNA, 23 nt, Human
gccuggagaaaagcugcaguuca

SEQ ID NO: 1127110 - RNA, 22 nt, Human
cagccagaaccuaggaugagcu

SEQ ID NO: 1127111 - RNA, 19 nt, Human
ggcugucuggcguguggau

SEQ ID NO: 1127112 - RNA, 22 nt, Human
uuauaaagguuugugcauauuu

SEQ ID NO: 1127113 - RNA, 22 nt, Human
aauguguagauguugcauuccu

SEQ ID NO: 1127114 - RNA, 22 nt, Human
acauuucuccuugcaggaguca

SEQ ID NO: 1127115 - RNA, 22 nt, Human
aggagagagcugagcuuugcug

SEQ ID NO: 1127116 - RNA, 22 nt, Human
uuuggaaaguugucacuuuaga

SEQ ID NO: 1127117 - RNA, 22 nt, Human
uucauguauuuaucauguaaau

SEQ ID NO: 1127118 - RNA, 22 nt, Human
accagcucagaagccagaaaga

SEQ ID NO: 1127119 - RNA, 22 nt, Human
agagccuggggauuggcaaggg

SEQ ID NO: 1127120 - RNA, 22 nt, Human
caggaaauaucuccuggcagag

SEQ ID NO: 1127121 - RNA, 22 nt, Human
acauuucucaucuaguagagua

SEQ ID NO: 1127122 - RNA, 22 nt, Human
aagugacaccucuucccuuucc

SEQ ID NO: 1127123 - RNA, 22 nt, Human
aucaguuugagugcugugucaa

SEQ ID NO: 1127124 - RNA, 22 nt, Human
ugggggacugcacuggcgucag

SEQ ID NO: 1127125 - RNA, 22 nt, Human
uccagugguaguaaagaggucu

SEQ ID NO: 1127126 - RNA, 22 nt, Human
ugguuuauuucucugaaagguu

SEQ ID NO: 1127127 - RNA, 22 nt, Human
ggccugucucacccccgggugc

SEQ ID NO: 1127128 - RNA, 22 nt, Human
cauugcacuuuggguccaggac

SEQ ID NO: 1127129 - RNA, 22 nt, Human
acagaguauuggaaaggcagug

SEQ ID NO: 1127130 - RNA, 22 nt, Human
caaaguuaucaacugcaacauu

SEQ ID NO: 1127131 - RNA, 22 nt, Human
ccaggggaaacagggagcacuc

SEQ ID NO: 1127132 - RNA, 17 nt, Human
aagacagaagccaugag

SEQ ID NO: 1127133 - RNA, 21 nt, Human
agcagcagaucuggugagggc

SEQ ID NO: 1127134 - RNA, 21 nt, Human
gccaccccuggcacaggugcu

SEQ ID NO: 1127135 - RNA, 22 nt, Human
ugugcgcguguauauauguaua

SEQ ID NO: 1127136 - RNA, 22 nt, Human
uucuuaaagaggcaaaacacag

SEQ ID NO: 1127137 - RNA, 22 nt, Human
caguggguccuaaguacaguuc

SEQ ID NO: 1127138 - RNA, 22 nt, Human
gccuggagaggaagccggugga

SEQ ID NO: 1127139 - RNA, 22 nt, Human
cagugggcugugauggauucac

SEQ ID NO: 1127140 - RNA, 22 nt, Human
gugccagcucuccccacaucug

SEQ ID NO: 1127141 - RNA, 18 nt, Human
acugugguuuauguguag

SEQ ID NO: 1127142 - RNA, 21 nt, Human
ugguuugcggccaaaguuaaa

SEQ ID NO: 1127143 - RNA, 22 nt, Human
cucuggaguucuucaagcuacu

SEQ ID NO: 1127144 - RNA, 22 nt, Human
ugcugugagguugagaaggaag

SEQ ID NO: 1127145 - RNA, 22 nt, Human
gggcagagacucagaaacagaa

SEQ ID NO: 1127146 - RNA, 22 nt, Human
ggcacugagcgggcucugagcg

SEQ ID NO: 1127147 - RNA, 22 nt, Human
aagccaggcugcacuugcuggg

SEQ ID NO: 1127148 - RNA, 18 nt, Human
gagcugccauauuuaguu

SEQ ID NO: 1127149 - RNA, 22 nt, Human
ucagagccccuccgcuguccca

SEQ ID NO: 1127150 - RNA, 22 nt, Human
ucccacugcuuugcucugcuca

SEQ ID NO: 1127151 - RNA, 22 nt, Human
gcugccacucugagcuugcuuc

SEQ ID NO: 1127152 - RNA, 22 nt, Human
uggagcugagaaguggagcucu

SEQ ID NO: 1127153 - RNA, 22 nt, Human
cagcagcugcgugcccaggccg

SEQ ID NO: 1127154 - RNA, 20 nt, Human
gugugaagcccucaggagga

SEQ ID NO: 1127155 - RNA, 22 nt, Human
cugcugcucagugucaucaugu

SEQ ID NO: 1127156 - RNA, 22 nt, Human
agaucucaccucuguguauuau

SEQ ID NO: 1127157 - RNA, 21 nt, Human
uggaaagauucaaagaccagg

SEQ ID NO: 1127158 - RNA, 22 nt, Human
agcugccagcaucccggaaggg

SEQ ID NO: 1127159 - RNA, 22 nt, Human
gccagcagguggagagaucaag

SEQ ID NO: 1127160 - RNA, 21 nt, Human
ccagacuggccuaugugguag

SEQ ID NO: 1127161 - RNA, 22 nt, Human
ccaggagucuggaugagguguc

SEQ ID NO: 1127162 - RNA, 22 nt, Human
gaggccugcuuuggcacucugg

SEQ ID NO: 1127163 - RNA, 23 nt, Human
ccugucugugcuggguggacaca

SEQ ID NO: 1127164 - RNA, 22 nt, Human
uggcagggccugcucaucaucc

SEQ ID NO: 1127165 - RNA, 22 nt, Human
ucagaggauugccucagcgagc

SEQ ID NO: 1127166 - RNA, 22 nt, Human
gcugucacaucaaggcacuaaa

SEQ ID NO: 1127167 - RNA, 22 nt, Human
gcucuccaaacccuguggcuuu

SEQ ID NO: 1127168 - RNA, 22 nt, Human
auugacaagacaauggcucuua

SEQ ID NO: 1127169 - RNA, 21 nt, Human
accagcaggagaucagaagga

SEQ ID NO: 1127170 - RNA, 22 nt, Human
aauguguagcauuuaaugcagu

SEQ ID NO: 1127171 - RNA, 22 nt, Human
ccagaggugccacagaaagagc

SEQ ID NO: 1127172 - RNA, 22 nt, Human
cagggcuguaaauuagugcuga

SEQ ID NO: 1127173 - RNA, 22 nt, Human
uccucacauggugagccacaca

SEQ ID NO: 1127174 - RNA, 22 nt, Human
auaaagucaaggcauuuuauga

SEQ ID NO: 1127175 - RNA, 22 nt, Human
gccuggagcucggcugagggcg

SEQ ID NO: 1127176 - RNA, 17 nt, Human
ugaggccugcaucagug

SEQ ID NO: 1127177 - RNA, 22 nt, Human
gccagagccggcuucacaggau

SEQ ID NO: 1127178 - RNA, 22 nt, Human
ggcucagguuaccagucccucc

SEQ ID NO: 1127179 - RNA, 20 nt, Human
ggccugagcauggcuggcag

SEQ ID NO: 1127180 - RNA, 22 nt, Human
augaacacauguacacauuucu

SEQ ID NO: 1127181 - RNA, 22 nt, Human
uugaggaguguuuagggugagg

SEQ ID NO: 1127182 - RNA, 22 nt, Human
aggucaaggccaaaagaguggu

SEQ ID NO: 1127183 - RNA, 22 nt, Human
gcagcugcuggaaguuccugcc

SEQ ID NO: 1127184 - RNA, 22 nt, Human
caugccaguuuugagaugcacc

SEQ ID NO: 1127185 - RNA, 22 nt, Human
acauuucucccugcaugccugc

SEQ ID NO: 1127186 - RNA, 22 nt, Human
ugggccugugaugcugggcuau

SEQ ID NO: 1127187 - RNA, 22 nt, Human
agcaguggcugaagauguuccu

SEQ ID NO: 1127188 - RNA, 22 nt, Human
gcuccuggcuccaggcagccaa

SEQ ID NO: 1127189 - RNA, 22 nt, Human
cgggcagauugggaagguucau

SEQ ID NO: 1127190 - RNA, 22 nt, Human
ugagaaagugggugccuagcaa

SEQ ID NO: 1127191 - RNA, 22 nt, Human
cagcagagacgguaagcagaac

SEQ ID NO: 1127192 - RNA, 22 nt, Human
cugcagcugucucuacugggca

SEQ ID NO: 1127193 - RNA, 22 nt, Human
aaacucuggagauguuuaugca

SEQ ID NO: 1127194 - RNA, 22 nt, Human
uggcuuccuccagagcaggagg

SEQ ID NO: 1127195 - RNA, 22 nt, Human
agaaggccuaacuugggggcaa

SEQ ID NO: 1127196 - RNA, 22 nt, Human
agccaaggcagcuagagcucug

SEQ ID NO: 1127197 - RNA, 22 nt, Human
guauauauuggauaaaccagag

SEQ ID NO: 1127198 - RNA, 22 nt, Human
gacagcauggugucuguucagg

SEQ ID NO: 1127199 - RNA, 22 nt, Human
gugucccaggagaggagacaau

SEQ ID NO: 1127200 - RNA, 22 nt, Human
uccugccuagcaggugaccuau

SEQ ID NO: 1127201 - RNA, 22 nt, Human
ugcagccaucuuucuuggagga

SEQ ID NO: 1127202 - RNA, 22 nt, Human
aggccugggcaagaaggggcgu

SEQ ID NO: 1127203 - RNA, 22 nt, Human
cucaggauugugccuagggaga

SEQ ID NO: 1127204 - RNA, 22 nt, Human
ugcccacauggugccauggcca

SEQ ID NO: 1127205 - RNA, 20 nt, Human
guaaaauauggucuuugggu

SEQ ID NO: 1127206 - RNA, 21 nt, Human
uggcucugaaagagugcugca

SEQ ID NO: 1127207 - RNA, 22 nt, Human
ccucauggccuugagcugaggg

SEQ ID NO: 1127208 - RNA, 22 nt, Human
cugccucuguugggcauggucu

SEQ ID NO: 1127209 - RNA, 22 nt, Human
uggcagcugauuagauggugcc

SEQ ID NO: 1127210 - RNA, 22 nt, Human
cagggcagagccaggauuucaa

SEQ ID NO: 1127211 - RNA, 22 nt, Human
guuauguaugagggaaugauua

SEQ ID NO: 1127212 - RNA, 22 nt, Human
uggagcagggcaucacugugcg

SEQ ID NO: 1127213 - RNA, 22 nt, Human
aaggcugagggcuguaccuggc

SEQ ID NO: 1127214 - RNA, 22 nt, Human
aucauguuccagaaacagugau

SEQ ID NO: 1127215 - RNA, 22 nt, Human
auaguggugagcugcauuuaug

SEQ ID NO: 1127216 - RNA, 22 nt, Human
ucuuccaguguagacaucugcc

SEQ ID NO: 1127217 - RNA, 22 nt, Human
auguuacacauaggcauaaaug

SEQ ID NO: 1127218 - RNA, 22 nt, Human
gagagugucgggggccccagga

SEQ ID NO: 1127219 - RNA, 22 nt, Human
uuauuuucagcuaggaaagcca

SEQ ID NO: 1127220 - RNA, 22 nt, Human
aggaguggaauuacuggguucu

SEQ ID NO: 1127221 - RNA, 19 nt, Human
gaaggagagcugaguuagg

SEQ ID NO: 1127222 - RNA, 22 nt, Human
gcugugugaaaacugggccugg

SEQ ID NO: 1127223 - RNA, 22 nt, Human
uccuuggcagcagggagcauga

SEQ ID NO: 1127224 - RNA, 22 nt, Human
agaaauguauagugaauuuuuc

SEQ ID NO: 1127225 - RNA, 22 nt, Human
auaauuuacuaagcucuaccuu

SEQ ID NO: 1127226 - RNA, 22 nt, Human
agagcagugcugaagaguaggg

SEQ ID NO: 1127227 - RNA, 22 nt, Human
cucuggaggccuaaggaagugg

SEQ ID NO: 1127228 - RNA, 22 nt, Human
ucaucuucuauuaauagggaga

SEQ ID NO: 1127229 - RNA, 22 nt, Human
ggcagcaguaggagcuaaucuu

SEQ ID NO: 1127230 - RNA, 22 nt, Human
agcaggcuaagggaccuguuua

SEQ ID NO: 1127231 - RNA, 22 nt, Human
ggcagagcuuguuccuucuguu

SEQ ID NO: 1127232 - RNA, 22 nt, Human
ccauuguuuauuuagacuuaau

SEQ ID NO: 1127233 - RNA, 22 nt, Human
agcaggcuccuuccuucucugg

SEQ ID NO: 1127234 - RNA, 22 nt, Human
caaagguaaagaucugcugugg

SEQ ID NO: 1127235 - RNA, 22 nt, Human
gagaagguggaccugaaggagc

SEQ ID NO: 1127236 - RNA, 16 nt, Human
ccaccugcagcucuca

SEQ ID NO: 1127237 - RNA, 22 nt, Human
acuggcaguggcagcagaaaga

SEQ ID NO: 1127238 - RNA, 17 nt, Human
gcagccagugcagcagg

SEQ ID NO: 1127239 - RNA, 22 nt, Human
ggccucucuccagucagugcag

SEQ ID NO: 1127240 - RNA, 22 nt, Human
cuuggccucuucucaggguggg

SEQ ID NO: 1127241 - RNA, 22 nt, Human
auggcccaggccuccuguggcu

SEQ ID NO: 1127242 - RNA, 22 nt, Human
gaaaucugcccagugcacuggu

SEQ ID NO: 1127243 - RNA, 22 nt, Human
ggguggggcccaggaaaucuau

SEQ ID NO: 1127244 - RNA, 21 nt, Human
augaagucuaugcuucugugu

SEQ ID NO: 1127245 - RNA, 22 nt, Human
acaggggauugauuggaagucu

SEQ ID NO: 1127246 - RNA, 22 nt, Human
ucugagaguagagcugccucuu

SEQ ID NO: 1127247 - RNA, 22 nt, Human
uaaggcacacaguugcugcaug

SEQ ID NO: 1127248 - RNA, 22 nt, Human
ccuggccuggcacucccucugc

SEQ ID NO: 1127249 - RNA, 22 nt, Human
gaaaaugugccuuuggguauug

SEQ ID NO: 1127250 - RNA, 22 nt, Human
uggcagcacuugaacuugagcc

SEQ ID NO: 1127251 - RNA, 22 nt, Human
guucauuuaugauguaacaugu

SEQ ID NO: 1127252 - RNA, 22 nt, Human
uuuuggucagguuggucucgaa

SEQ ID NO: 1127253 - RNA, 22 nt, Human
ggagcugaugacgucaccaugg

SEQ ID NO: 1127254 - RNA, 22 nt, Human
uuacaggggacauuggggacau

SEQ ID NO: 1127255 - RNA, 22 nt, Human
ggcuucugagugcucugcuguu

SEQ ID NO: 1127256 - RNA, 22 nt, Human
agccagcugccuuucacaucug

SEQ ID NO: 1127257 - RNA, 22 nt, Human
gggcugagggguaucucauggg

SEQ ID NO: 1127258 - RNA, 18 nt, Human
agcugcagaccaggaggu

SEQ ID NO: 1127259 - RNA, 22 nt, Human
auuuacagaugaugcuauuuga

SEQ ID NO: 1127260 - RNA, 22 nt, Human
uuucaaugacacaaaagagaaa

SEQ ID NO: 1127261 - RNA, 22 nt, Human
cagggacaauggcagagccuga

SEQ ID NO: 1127262 - RNA, 17 nt, Human
aagauuucauuagcuga

SEQ ID NO: 1127263 - RNA, 22 nt, Human
ucauacaucuuguauaucuauc

SEQ ID NO: 1127264 - RNA, 22 nt, Human
acugaaagauaaaucaguuagc

SEQ ID NO: 1127265 - RNA, 22 nt, Human
uuaacagagugccuggcaugua

SEQ ID NO: 1127266 - RNA, 22 nt, Human
gaaagagaaccugggccuagau

SEQ ID NO: 1127267 - RNA, 22 nt, Human
uguggccuugcagccuggaggu

SEQ ID NO: 1127268 - RNA, 22 nt, Human
ccuggcugccgagugugcagcg

SEQ ID NO: 1127269 - RNA, 22 nt, Human
agaggccaguggcugugcuguc

SEQ ID NO: 1127270 - RNA, 22 nt, Human
agcagccacagcagaucugagu

SEQ ID NO: 1127271 - RNA, 22 nt, Human
ggagccagggaagcugcuuccu

SEQ ID NO: 1127272 - RNA, 22 nt, Human
gcagagcugucuaagucacuuc

SEQ ID NO: 1127273 - RNA, 22 nt, Human
gagaggccaccugacgagcagu

SEQ ID NO: 1127274 - RNA, 22 nt, Human
uacagaaaucacaucgcuuuga

SEQ ID NO: 1127275 - RNA, 21 nt, Human
aaggaaaagcuuggucucuga

SEQ ID NO: 1127276 - RNA, 22 nt, Human
aaggcacuacgcugcuggggcg

SEQ ID NO: 1127277 - RNA, 22 nt, Human
uuacaucuaaacugugaacaau

SEQ ID NO: 1127278 - RNA, 22 nt, Human
ccuuucucuuugcugaucaugu

SEQ ID NO: 1127279 - RNA, 22 nt, Human
caggguccggcugccuggcugu

SEQ ID NO: 1127280 - RNA, 22 nt, Human
cugggccugucagggcuuuuug

SEQ ID NO: 1127281 - RNA, 22 nt, Human
uaugaagacaaugauagcauga

SEQ ID NO: 1127282 - RNA, 22 nt, Human
uccuccagugucuggggccuug

SEQ ID NO: 1127283 - RNA, 21 nt, Human
ccuccaggagcagagcccuga

SEQ ID NO: 1127284 - RNA, 22 nt, Human
ccugcagcuguaggagaaggcg

SEQ ID NO: 1127285 - RNA, 22 nt, Human
cugccucuauaggaguccacca

SEQ ID NO: 1127286 - RNA, 22 nt, Human
gcagcuuggugaaaggugaugg

SEQ ID NO: 1127287 - RNA, 22 nt, Human
ggagaaggugcuggucacugug

SEQ ID NO: 1127288 - RNA, 22 nt, Human
cuggcuccauccuugagcucug

SEQ ID NO: 1127289 - RNA, 22 nt, Human
ucaaguguaguggugucagguc

SEQ ID NO: 1127290 - RNA, 22 nt, Human
ucugugaacaucacauugacag

SEQ ID NO: 1127291 - RNA, 21 nt, Human
ugaggcuguuguaccagggag

SEQ ID NO: 1127292 - RNA, 22 nt, Human
uggccuguggcuuaaggucugu

SEQ ID NO: 1127293 - RNA, 22 nt, Human
ggcagcuccucaaaaaauuaaa

SEQ ID NO: 1127294 - RNA, 22 nt, Human
ccucagggccaucucugucccu

SEQ ID NO: 1127295 - RNA, 22 nt, Human
acagagguguuccagaccuagg

SEQ ID NO: 1127296 - RNA, 22 nt, Human
cuggggugucucgucugccauu

SEQ ID NO: 1127297 - RNA, 22 nt, Human
auguaacuguuauauuuuguug

SEQ ID NO: 1127298 - RNA, 22 nt, Human
uugggcucaggaguuugagacc

SEQ ID NO: 1127299 - RNA, 22 nt, Human
cuucuugcugggggccucagug

SEQ ID NO: 1127300 - RNA, 22 nt, Human
caggcagccaggggaccugucc

SEQ ID NO: 1127301 - RNA, 22 nt, Human
gaagagcuguagccugcucuuu

SEQ ID NO: 1127302 - RNA, 22 nt, Human
gcagagccagaauggccaggac

SEQ ID NO: 1127303 - RNA, 22 nt, Human
ccugucugagccagggugggca

SEQ ID NO: 1127304 - RNA, 22 nt, Human
caggcaccccaggugagcacug

SEQ ID NO: 1127305 - RNA, 22 nt, Human
agccaagcaccacuggcacucg

SEQ ID NO: 1127306 - RNA, 22 nt, Human
cacaagacuuauuuguguagaa

SEQ ID NO: 1127307 - RNA, 22 nt, Human
ggauaaucugggagaaaacuga

SEQ ID NO: 1127308 - RNA, 22 nt, Human
cauggggagacaccuagggaaa

SEQ ID NO: 1127309 - RNA, 22 nt, Human
accugccucuaagcagcaggug

SEQ ID NO: 1127310 - RNA, 22 nt, Human
gccugccuuuuggaggcacauu

SEQ ID NO: 1127311 - RNA, 22 nt, Human
ucacaacucuuuccauuuaaua

SEQ ID NO: 1127312 - RNA, 22 nt, Human
aagaagaugguuaacuuucagu

SEQ ID NO: 1127313 - RNA, 22 nt, Human
agggcucugggguggcagagau

SEQ ID NO: 1127314 - RNA, 22 nt, Human
auuguacuuuuauuacauguag

SEQ ID NO: 1127315 - RNA, 22 nt, Human
uccucacagucaacacuuugag

SEQ ID NO: 1127316 - RNA, 22 nt, Human
ugucccagucaaggcugucauc

SEQ ID NO: 1127317 - RNA, 22 nt, Human
ugcuggaggaguuuacuguggc

SEQ ID NO: 1127318 - RNA, 22 nt, Human
ugugccuggcauucugggcuuc

SEQ ID NO: 1127319 - RNA, 22 nt, Human
aggagcugucagagugccagag

SEQ ID NO: 1127320 - RNA, 22 nt, Human
guggagaccuccuaggaugugu

SEQ ID NO: 1127321 - RNA, 22 nt, Human
aagaacaacugcuuuaaaagca

SEQ ID NO: 1127322 - RNA, 22 nt, Human
agccuccuggaguuucugggau

SEQ ID NO: 1127323 - RNA, 22 nt, Human
uuagaaaggaaucuucauuuca

SEQ ID NO: 1127324 - RNA, 22 nt, Human
agagugaagguugacacuucac

SEQ ID NO: 1127325 - RNA, 22 nt, Human
acugagcucuugacugggaguu

SEQ ID NO: 1127326 - RNA, 22 nt, Human
uggccuggaagagaggucgagg

SEQ ID NO: 1127327 - RNA, 22 nt, Human
gaggcaugucuggccuguccca

SEQ ID NO: 1127328 - RNA, 22 nt, Human
aagaugauagaucugucaaugu

SEQ ID NO: 1127329 - RNA, 22 nt, Human
ccugccuguaagauggguacaa

SEQ ID NO: 1127330 - RNA, 22 nt, Human
auucuguauuucuaauaagauc

SEQ ID NO: 1127331 - RNA, 22 nt, Human
gccucccuguucuuccacaaua

SEQ ID NO: 1127332 - RNA, 22 nt, Human
gccuucaggaggguuccagaca

SEQ ID NO: 1127333 - RNA, 22 nt, Human
ggaagggccucgggcgugggac

SEQ ID NO: 1127334 - RNA, 22 nt, Human
augcucugggcaggagcccugg

SEQ ID NO: 1127335 - RNA, 22 nt, Human
agcuggguguguaucagauaaa

SEQ ID NO: 1127336 - RNA, 22 nt, Human
ggugacuggagggacccaggcc

SEQ ID NO: 1127337 - RNA, 22 nt, Human
cucaggaugcaauuccaucaag

SEQ ID NO: 1127338 - RNA, 22 nt, Human
gagagugaaggcuucccagcaa

SEQ ID NO: 1127339 - RNA, 20 nt, Human
gacaggagaguuagguaggu

SEQ ID NO: 1127340 - RNA, 22 nt, Human
caggaagagaacauggaggcug

SEQ ID NO: 1127341 - RNA, 22 nt, Human
aaaugcaucagcucauaagaga

SEQ ID NO: 1127342 - RNA, 22 nt, Human
uuugcauuugcaaauaaugaaa

SEQ ID NO: 1127343 - RNA, 22 nt, Human
uccugucagugaggcagaugaa

SEQ ID NO: 1127344 - RNA, 22 nt, Human
uaaauguguaaaccuccauuac

SEQ ID NO: 1127345 - RNA, 22 nt, Human
aaaguucagugccuucuauaca

SEQ ID NO: 1127346 - RNA, 22 nt, Human
ggaggaccugcuggcccugcaa

SEQ ID NO: 1127347 - RNA, 22 nt, Human
uucucucauucaaauuaaagug

SEQ ID NO: 1127348 - RNA, 22 nt, Human
gcugagagcggccagcugggaa

SEQ ID NO: 1127349 - RNA, 22 nt, Human
gcagcccaauggacugagacag

SEQ ID NO: 1127350 - RNA, 22 nt, Human
gacauuucaaucucauuauggg

SEQ ID NO: 1127351 - RNA, 22 nt, Human
gagccugaauuugaccugcuua

SEQ ID NO: 1127352 - RNA, 22 nt, Human
agcaauauaaauguuggguaga

SEQ ID NO: 1127353 - RNA, 22 nt, Human
uuauugccugauugaggucauu

SEQ ID NO: 1127354 - RNA, 23 nt, Human
cuuuccuuucuuugacacccagc

SEQ ID NO: 1127355 - RNA, 22 nt, Human
ucucagaggcccgacguucucc

SEQ ID NO: 1127356 - RNA, 22 nt, Human
uauaguaaaauuuucauuuaug

SEQ ID NO: 1127357 - RNA, 22 nt, Human
gcccauggcagaacugugagca

SEQ ID NO: 1127358 - RNA, 22 nt, Human
aaagcaguauauugguaguugu

SEQ ID NO: 1127359 - RNA, 22 nt, Human
uagucaaaccucagaauacccc

SEQ ID NO: 1127360 - RNA, 22 nt, Human
aaugauguauuaguacaacaca

SEQ ID NO: 1127361 - RNA, 22 nt, Human
cccugccucugaagcugcucag

SEQ ID NO: 1127362 - RNA, 22 nt, Human
cgggcagaucacacagggcuug

SEQ ID NO: 1127363 - RNA, 21 nt, Human
cugagggccgcagcugggcuc

SEQ ID NO: 1127364 - RNA, 22 nt, Human
gcugccugaucauacaccaggg

SEQ ID NO: 1127365 - RNA, 22 nt, Human
ucugccugaaauucacauguaa

SEQ ID NO: 1127366 - RNA, 21 nt, Human
acagacagggccagugucccc

SEQ ID NO: 1127367 - RNA, 22 nt, Human
ugauuucaaguagugacaugcu

SEQ ID NO: 1127368 - RNA, 22 nt, Human
ccccagccuuccaugggaauug

SEQ ID NO: 1127369 - RNA, 23 nt, Human
uggcuucugccccauucucucca

SEQ ID NO: 1127370 - RNA, 22 nt, Human
accauguuggccaagcuggucu

SEQ ID NO: 1127371 - RNA, 22 nt, Human
cuggccugaggccgccuucaga

SEQ ID NO: 1127372 - RNA, 22 nt, Human
gaugugagugguagcugggauu

SEQ ID NO: 1127373 - RNA, 22 nt, Human
uccucuggauauaagccucacc

SEQ ID NO: 1127374 - RNA, 22 nt, Human
ccugggcuggaguacagcagug

SEQ ID NO: 1127375 - RNA, 22 nt, Human
ucucacugcaaauauuauguau

SEQ ID NO: 1127376 - RNA, 22 nt, Human
ugaccaaaggugguuuauuugg

SEQ ID NO: 1127377 - RNA, 22 nt, Human
ugcuggggguucagaugaguaa

SEQ ID NO: 1127378 - RNA, 22 nt, Human
uggagcugggguuugaaucugg

SEQ ID NO: 1127379 - RNA, 22 nt, Human
ugagccuguggggugacaacca

SEQ ID NO: 1127380 - RNA, 22 nt, Human
uucugggacaucuggacaguuu

SEQ ID NO: 1127381 - RNA, 22 nt, Human
ccugugaggucaucugugguaa

SEQ ID NO: 1127382 - RNA, 17 nt, Human
ggagagugggaauggcc

SEQ ID NO: 1127383 - RNA, 22 nt, Human
cccagggagguagcaggagaaa

SEQ ID NO: 1127384 - RNA, 22 nt, Human
gccuggagagcacugugcgcuu

SEQ ID NO: 1127385 - RNA, 22 nt, Human
ucccagaggaaauggcagcuga

SEQ ID NO: 1127386 - RNA, 22 nt, Human
accaaggaguuugguauuuuag

SEQ ID NO: 1127387 - RNA, 22 nt, Human
ucugggcccuaaaccagcucua

SEQ ID NO: 1127388 - RNA, 22 nt, Human
ucuggcucauaggaaggccauu

SEQ ID NO: 1127389 - RNA, 22 nt, Human
caggcugggaacgccacccgcu

SEQ ID NO: 1127390 - RNA, 22 nt, Human
uggcagggaguugcaggauuuc

SEQ ID NO: 1127391 - RNA, 22 nt, Human
cugaaugucgaucagcuugggu

SEQ ID NO: 1127392 - RNA, 19 nt, Human
gccaggagggcucuggcug

SEQ ID NO: 1127393 - RNA, 20 nt, Human
cuuagaaauuuuuacccugg

SEQ ID NO: 1127394 - RNA, 21 nt, Human
agggccugugcucuccagguc

SEQ ID NO: 1127395 - RNA, 22 nt, Human
gcagggucgcucuaggagauca

SEQ ID NO: 1127396 - RNA, 22 nt, Human
caaugguucucaaacuaucaug

SEQ ID NO: 1127397 - RNA, 21 nt, Human
ccaggguccagcugccauggu

SEQ ID NO: 1127398 - RNA, 21 nt, Human
ucaggcaggcgcagagggaag

SEQ ID NO: 1127399 - RNA, 22 nt, Human
ggcaccuggagguuuacuggau

SEQ ID NO: 1127400 - RNA, 22 nt, Human
uggugcaagucucugaggaggg

SEQ ID NO: 1127401 - RNA, 22 nt, Human
gcgaaaaauguguaaauauguu

SEQ ID NO: 1127402 - RNA, 22 nt, Human
agccuggcacugaggcagggcg

SEQ ID NO: 1127403 - RNA, 22 nt, Human
cuagaaaaauacuuuauuguga

SEQ ID NO: 1127404 - RNA, 22 nt, Human
gugcagagaaaugagaagucga

SEQ ID NO: 1127405 - RNA, 22 nt, Human
aacaggagaguaaauauaugau

SEQ ID NO: 1127406 - RNA, 22 nt, Human
accaggcugugaagugagacua

SEQ ID NO: 1127407 - RNA, 22 nt, Human
agggagaaugaccaagguauau

SEQ ID NO: 1127408 - RNA, 22 nt, Human
aggagcugggcugcugcuggga

SEQ ID NO: 1127409 - RNA, 22 nt, Human
ggagccuggcaaugcugcgucc

SEQ ID NO: 1127410 - RNA, 22 nt, Human
gcuggcagaagagcugguucaa

SEQ ID NO: 1127411 - RNA, 20 nt, Human
aggagcugaauuagaggguu

SEQ ID NO: 1127412 - RNA, 22 nt, Human
caggcagccugcggucugcaca

SEQ ID NO: 1127413 - RNA, 20 nt, Human
cacugaagacuucuugcuca

SEQ ID NO: 1127414 - RNA, 18 nt, Human
ggagagugagaucaaaca

SEQ ID NO: 1127415 - RNA, 22 nt, Human
ccagggcagcgccccuccacgc

SEQ ID NO: 1127416 - RNA, 22 nt, Human
aauguacaaggguuccaguuuu

SEQ ID NO: 1127417 - RNA, 22 nt, Human
aaugcacagcuaaagugguucc

SEQ ID NO: 1127418 - RNA, 22 nt, Human
ccaggccucccuuuuccagcca

SEQ ID NO: 1127419 - RNA, 22 nt, Human
uuccucaugggguuccuucaga

SEQ ID NO: 1127420 - RNA, 19 nt, Human
acagaaauuaguuauuuuc

SEQ ID NO: 1127421 - RNA, 22 nt, Human
caguggcugugaccagggaccu

SEQ ID NO: 1127422 - RNA, 22 nt, Human
acaguaauuaaaauggaucugc

SEQ ID NO: 1127423 - RNA, 22 nt, Human
caauguuuguuagagcucuaga

SEQ ID NO: 1127424 - RNA, 21 nt, Human
aggugggagaccauguagguc

SEQ ID NO: 1127425 - RNA, 22 nt, Human
cagcauggagacaaagugggca

SEQ ID NO: 1127426 - RNA, 22 nt, Human
ugcaugcagcuggugauaagaa

SEQ ID NO: 1127427 - RNA, 22 nt, Human
uucagagccacuucaagucuaa

SEQ ID NO: 1127428 - RNA, 22 nt, Human
acauguguauagccuguauaga

SEQ ID NO: 1127429 - RNA, 22 nt, Human
agagccagcaacucuagcccug

SEQ ID NO: 1127430 - RNA, 22 nt, Human
caaauccagaucccagucguag

SEQ ID NO: 1127431 - RNA, 22 nt, Human
gcagggcagccacaggcccccu

SEQ ID NO: 1127432 - RNA, 23 nt, Human
uggcagcagaucuuaaagugacc

SEQ ID NO: 1127433 - RNA, 22 nt, Human
uggggcuggcacagucucuauu

SEQ ID NO: 1127434 - RNA, 19 nt, Human
ggaccagguccugggcagc

SEQ ID NO: 1127435 - RNA, 22 nt, Human
ggcugccucuggaagcuggaga

SEQ ID NO: 1127436 - RNA, 22 nt, Human
ccugacgaaaggcgugcuggag

SEQ ID NO: 1127437 - RNA, 21 nt, Human
cugugcuuuuuaagugugaug

SEQ ID NO: 1127438 - RNA, 22 nt, Human
ggcacugacugugcagcgcacc

SEQ ID NO: 1127439 - RNA, 22 nt, Human
ggcaguggcuccucucuacucc

SEQ ID NO: 1127440 - RNA, 22 nt, Human
ccuggcaggccccuccuggauu

SEQ ID NO: 1127441 - RNA, 22 nt, Human
aauauuuuaggcuuuccaggcu

SEQ ID NO: 1127442 - RNA, 22 nt, Human
aggcuuccucgugccuuagaua

SEQ ID NO: 1127443 - RNA, 22 nt, Human
caccuggcuggaagugcuccgg

SEQ ID NO: 1127444 - RNA, 22 nt, Human
ugcagggcuacaggacuacaac

SEQ ID NO: 1127445 - RNA, 23 nt, Human
agccuucaggcaaugucaguaga

SEQ ID NO: 1127446 - RNA, 20 nt, Human
aauguauauuuuaugccagg

SEQ ID NO: 1127447 - RNA, 22 nt, Human
cuacauuuuaauaagcugcuua

SEQ ID NO: 1127448 - RNA, 22 nt, Human
ugucucagaauggcucauaaua

SEQ ID NO: 1127449 - RNA, 22 nt, Human
agcaggaguuugaugcuuuuau

SEQ ID NO: 1127450 - RNA, 22 nt, Human
ggcaguggaggacccugugucu

SEQ ID NO: 1127451 - RNA, 22 nt, Human
agagccagcauuugacacuggc

SEQ ID NO: 1127452 - RNA, 22 nt, Human
ucccagcccagauuugugugac

SEQ ID NO: 1127453 - RNA, 22 nt, Human
aaaugaacucuuccugcauccc

SEQ ID NO: 1127454 - RNA, 22 nt, Human
uucaguuucagucuugcaaaaa

SEQ ID NO: 1127455 - RNA, 22 nt, Human
agucccagaucuccauucgguc

SEQ ID NO: 1127456 - RNA, 22 nt, Human
cacaggcuugucagcaugaggc

SEQ ID NO: 1127457 - RNA, 22 nt, Human
ccaggccuggccaggggaugcc

SEQ ID NO: 1127458 - RNA, 22 nt, Human
gcugucacaagcaucuggggca

SEQ ID NO: 1127459 - RNA, 19 nt, Human
cucuggagcagacacugga

SEQ ID NO: 1127460 - RNA, 22 nt, Human
cuuaagaauauugaaguugugg

SEQ ID NO: 1127461 - RNA, 22 nt, Human
caagagcuuuagaaaugcucau

SEQ ID NO: 1127462 - RNA, 22 nt, Human
ggcuggagugggcuccagaguu

SEQ ID NO: 1127463 - RNA, 22 nt, Human
uccucuggcucuuucccuagga

SEQ ID NO: 1127464 - RNA, 22 nt, Human
ucaaaugcuguauuguaguaau

SEQ ID NO: 1127465 - RNA, 22 nt, Human
uaacagaauuugcuaaacuccg

SEQ ID NO: 1127466 - RNA, 22 nt, Human
gccaccagguuagauccagccu

SEQ ID NO: 1127467 - RNA, 22 nt, Human
aagggcugcuguagaagcagag

SEQ ID NO: 1127468 - RNA, 22 nt, Human
cuggagccggaccagggacggu

SEQ ID NO: 1127469 - RNA, 22 nt, Human
ggcucugcccagguggacagca

SEQ ID NO: 1127470 - RNA, 22 nt, Human
guggcccucugauagggucagg

SEQ ID NO: 1127471 - RNA, 22 nt, Human
ggcaggagggcggacaaugacc

SEQ ID NO: 1127472 - RNA, 23 nt, Human
agggaaaguaguaauggccuuug

SEQ ID NO: 1127473 - RNA, 22 nt, Human
cacauggggcgcugcauuggcc

SEQ ID NO: 1127474 - RNA, 22 nt, Human
guggccuggaguuugauguagg

SEQ ID NO: 1127475 - RNA, 22 nt, Human
cuucugggcauucagcugcaca

SEQ ID NO: 1127476 - RNA, 22 nt, Human
uaugcacacaggcuuaauucau

SEQ ID NO: 1127477 - RNA, 22 nt, Human
caggaugggauguagugggccc

SEQ ID NO: 1127478 - RNA, 22 nt, Human
gcugggcagccuggccgcugcc

SEQ ID NO: 1127479 - RNA, 22 nt, Human
aaauauguauggaguucaugaa

SEQ ID NO: 1127480 - RNA, 22 nt, Human
aaugugguuaacccauuuaaga

SEQ ID NO: 1127481 - RNA, 22 nt, Human
augcugaggacaaagagaucaa

SEQ ID NO: 1127482 - RNA, 22 nt, Human
ccucugcaccauagccuucagc

SEQ ID NO: 1127483 - RNA, 20 nt, Human
ugggccuguggcagaagucu

SEQ ID NO: 1127484 - RNA, 22 nt, Human
cuggggaggcagggcugccccu

SEQ ID NO: 1127485 - RNA, 22 nt, Human
uggcugcugagaaggcagcugu

SEQ ID NO: 1127486 - RNA, 22 nt, Human
cugggcagcuaccaccacugcu

SEQ ID NO: 1127487 - RNA, 19 nt, Human
uuggaaggagccagagugg

SEQ ID NO: 1127488 - RNA, 22 nt, Human
cuccugaguaguagcauuguca

SEQ ID NO: 1127489 - RNA, 22 nt, Human
uguguccuucugggagucccag

SEQ ID NO: 1127490 - RNA, 22 nt, Human
uauguacagggauagaacuuga

SEQ ID NO: 1127491 - RNA, 22 nt, Human
ggugcagaaggaagggagcugg

SEQ ID NO: 1127492 - RNA, 22 nt, Human
gcugagagcaguguggccuuaa

SEQ ID NO: 1127493 - RNA, 22 nt, Human
agauacauugaguuuccuccug

SEQ ID NO: 1127494 - RNA, 22 nt, Human
ggccucugccccagccacaccu

SEQ ID NO: 1127495 - RNA, 21 nt, Human
gggccacaccuucugcagacc

SEQ ID NO: 1127496 - RNA, 22 nt, Human
gugcagcagggggaagacagug

SEQ ID NO: 1127497 - RNA, 22 nt, Human
uauuucaugugcaccauaauuc

SEQ ID NO: 1127498 - RNA, 23 nt, Human
auggagcugguacuagcuaccuc

SEQ ID NO: 1127499 - RNA, 22 nt, Human
gccaggcuggccagcaccuucu

SEQ ID NO: 1127500 - RNA, 22 nt, Human
aggugcuggagucugggcagga

SEQ ID NO: 1127501 - RNA, 18 nt, Human
aucuuuccauagcauguu

SEQ ID NO: 1127502 - RNA, 22 nt, Human
ccugggcucuauccugacccag

SEQ ID NO: 1127503 - RNA, 22 nt, Human
gcagcuuggauuucuguaguuu

SEQ ID NO: 1127504 - RNA, 22 nt, Human
gcucuggacuggggccugagaa

SEQ ID NO: 1127505 - RNA, 22 nt, Human
uggagugaaguaaagaggacaa

SEQ ID NO: 1127506 - RNA, 22 nt, Human
uuugaaaauuuaagugcuacac

SEQ ID NO: 1127507 - RNA, 19 nt, Human
agggaaggauucugucauu

SEQ ID NO: 1127508 - RNA, 22 nt, Human
uguguguguuuauaaaucuaaa

SEQ ID NO: 1127509 - RNA, 19 nt, Human
gagaggccugugcuugaag

SEQ ID NO: 1127510 - RNA, 22 nt, Human
gccaggcugaggcucuggaaga

SEQ ID NO: 1127511 - RNA, 22 nt, Human
cuggcucagacagcugugcagu

SEQ ID NO: 1127512 - RNA, 22 nt, Human
acauuucuggaguuucucaaca

SEQ ID NO: 1127513 - RNA, 22 nt, Human
ucagaggucccuagcaggagug

SEQ ID NO: 1127514 - RNA, 22 nt, Human
ucaauuaugccauugcaauauu

SEQ ID NO: 1127515 - RNA, 22 nt, Human
aaugcagugagccauuaaaugg

SEQ ID NO: 1127516 - RNA, 22 nt, Human
ugucucugugacuccuuccgcc

SEQ ID NO: 1127517 - RNA, 17 nt, Human
auuucacuuagcaugag

SEQ ID NO: 1127518 - RNA, 22 nt, Human
gcacccaggccggcgacugcag

SEQ ID NO: 1127519 - RNA, 22 nt, Human
acaguuucuccauuuacaccuu

SEQ ID NO: 1127520 - RNA, 20 nt, Human
gaggcugcggacugcuggac

SEQ ID NO: 1127521 - RNA, 19 nt, Human
ggacacagaaagcugcauu

SEQ ID NO: 1127522 - RNA, 22 nt, Human
gcuggccucuacaggccggcca

SEQ ID NO: 1127523 - RNA, 22 nt, Human
cccagcccagcguucgaggggu

SEQ ID NO: 1127524 - RNA, 22 nt, Human
ucuggccagugaaaugcagaau

SEQ ID NO: 1127525 - RNA, 22 nt, Human
acuggcagcuguaggaugcaug

SEQ ID NO: 1127526 - RNA, 22 nt, Human
gcugucacacaugggaucucag

SEQ ID NO: 1127527 - RNA, 22 nt, Human
gcuggccugaccugaggcuggg

SEQ ID NO: 1127528 - RNA, 22 nt, Human
gcaggagucacugacuuggucc

SEQ ID NO: 1127529 - RNA, 22 nt, Human
ucagggcaaugucccucagaag

SEQ ID NO: 1127530 - RNA, 22 nt, Human
cucuuccuacagucugcuaugc

SEQ ID NO: 1127531 - RNA, 22 nt, Human
gagagcugcaagguagggcggg

SEQ ID NO: 1127532 - RNA, 22 nt, Human
gccugagauucccggagccgug

SEQ ID NO: 1127533 - RNA, 22 nt, Human
acagaguaggugcugucgacug

SEQ ID NO: 1127534 - RNA, 17 nt, Human
gucugggcuuuagagac

SEQ ID NO: 1127535 - RNA, 22 nt, Human
cucugcagaggcccaaggcuga

SEQ ID NO: 1127536 - RNA, 22 nt, Human
agagucugaggcagcugcagcc

SEQ ID NO: 1127537 - RNA, 22 nt, Human
guguuccauguuugagguaguu

SEQ ID NO: 1127538 - RNA, 22 nt, Human
cuggccagacuacacaugugug

SEQ ID NO: 1127539 - RNA, 21 nt, Human
ugcuccuuagcugccccugcc

SEQ ID NO: 1127540 - RNA, 22 nt, Human
ggcucuggugcccuggcuccca

SEQ ID NO: 1127541 - RNA, 22 nt, Human
uggcucucagcucccagcagcc

SEQ ID NO: 1127542 - RNA, 22 nt, Human
auccuuggaugugucuuuuugu

SEQ ID NO: 1127543 - RNA, 22 nt, Human
gcagccacacuguuacagaaug

SEQ ID NO: 1127544 - RNA, 22 nt, Human
agagccagcaagugaauaguga

SEQ ID NO: 1127545 - RNA, 22 nt, Human
caaggaaaacagaugaucaaca

SEQ ID NO: 1127546 - RNA, 22 nt, Human
gcccagaaguugaggcugcagu

SEQ ID NO: 1127547 - RNA, 22 nt, Human
ccacugggggcugcaggcacuc

SEQ ID NO: 1127548 - RNA, 22 nt, Human
auugucuguacuuuaaaaaugu

SEQ ID NO: 1127549 - RNA, 18 nt, Human
ccauuucaugauuauuac

SEQ ID NO: 1127550 - RNA, 22 nt, Human
cuuauguauauuuggaacguac

SEQ ID NO: 1127551 - RNA, 22 nt, Human
gaggccuggguuggaggugcau

SEQ ID NO: 1127552 - RNA, 22 nt, Human
cagagcaguccuugucaaucag

SEQ ID NO: 1127553 - RNA, 22 nt, Human
ggcauggcuggguucuggugag

SEQ ID NO: 1127554 - RNA, 22 nt, Human
gguggcuggaggagcugaugga

SEQ ID NO: 1127555 - RNA, 22 nt, Human
gcacagguugcaaaaguucaca

SEQ ID NO: 1127556 - RNA, 22 nt, Human
ucugccuggauuccauucucca

SEQ ID NO: 1127557 - RNA, 22 nt, Human
acucugccccgaguucugggaa

SEQ ID NO: 1127558 - RNA, 22 nt, Human
uacuuucuagcucuccccaguu

SEQ ID NO: 1127559 - RNA, 22 nt, Human
agaggccuaaccaagauguccu

SEQ ID NO: 1127560 - RNA, 22 nt, Human
ccagcagcuuuauuggcucucc

SEQ ID NO: 1127561 - RNA, 22 nt, Human
ggaccugccagaacucaggcua

SEQ ID NO: 1127562 - RNA, 22 nt, Human
ugugaugguucacugggcauga

SEQ ID NO: 1127563 - RNA, 22 nt, Human
cuuugcaauagaggcacacaug

SEQ ID NO: 1127564 - RNA, 23 nt, Human
ugcugggcagagcuggugcugag

SEQ ID NO: 1127565 - RNA, 22 nt, Human
aaggcugagacagcacaggucc

SEQ ID NO: 1127566 - RNA, 22 nt, Human
gcaggauggugcccuuucugcc

SEQ ID NO: 1127567 - RNA, 22 nt, Human
uacauuuauaaggcuucucugu

SEQ ID NO: 1127568 - RNA, 22 nt, Human
ugacucuguaccugucugccuu

SEQ ID NO: 1127569 - RNA, 23 nt, Human
gaagcagaugucugaguaggcag

SEQ ID NO: 1127570 - RNA, 22 nt, Human
agggaauguagcaagaugccaa

SEQ ID NO: 1127571 - RNA, 22 nt, Human
gcagggcuaauggggcaaguag

SEQ ID NO: 1127572 - RNA, 22 nt, Human
cagcauugaucccaggcugugg

SEQ ID NO: 1127573 - RNA, 22 nt, Human
agcagccaguucucugugguag

SEQ ID NO: 1127574 - RNA, 22 nt, Human
ucagagaugcagugccaccuac

SEQ ID NO: 1127575 - RNA, 22 nt, Human
ccaaagagcuagaauuauaggc

SEQ ID NO: 1127576 - RNA, 22 nt, Human
ugcaggcuguaaucugaggcua

SEQ ID NO: 1127577 - RNA, 22 nt, Human
gcugccagcucacucuccugag

SEQ ID NO: 1127578 - RNA, 22 nt, Human
gagcccagguucugcuuccagc

SEQ ID NO: 1127579 - RNA, 22 nt, Human
uggugaagucagcggagcccgg

SEQ ID NO: 1127580 - RNA, 22 nt, Human
gccuggcaggggccugggagug

SEQ ID NO: 1127581 - RNA, 22 nt, Human
acagaacugcaggaggaaaagc

SEQ ID NO: 1127582 - RNA, 22 nt, Human
uggcuuccgccgcgggccucgg

SEQ ID NO: 1127583 - RNA, 20 nt, Human
gcaaauggaucccacaagcc

SEQ ID NO: 1127584 - RNA, 22 nt, Human
gcugccugcucggcuccuggga

SEQ ID NO: 1127585 - RNA, 22 nt, Human
agccagaggccagccugccuca

SEQ ID NO: 1127586 - RNA, 22 nt, Human
uggagcagagaugggagcccaa

SEQ ID NO: 1127587 - RNA, 22 nt, Human
aggcuggcuuggcucuccugug

SEQ ID NO: 1127588 - RNA, 22 nt, Human
gaugcagaaaguagacaccauc

SEQ ID NO: 1127589 - RNA, 20 nt, Human
gcacugaaauucaauguuug

SEQ ID NO: 1127590 - RNA, 22 nt, Human
agccacagggggugagggacaa

SEQ ID NO: 1127591 - RNA, 22 nt, Human
uuggcucaggaccccugugacu

SEQ ID NO: 1127592 - RNA, 20 nt, Human
gcugcucuccacggucugca

SEQ ID NO: 1127593 - RNA, 22 nt, Human
ugcaggagaaaguacggagcgu

SEQ ID NO: 1127594 - RNA, 17 nt, Human
ccagguggaaucgugga

SEQ ID NO: 1127595 - RNA, 22 nt, Human
cuuuauguuggggugucuuagu

SEQ ID NO: 1127596 - RNA, 22 nt, Human
ucucaggaguagugggauccau

SEQ ID NO: 1127597 - RNA, 22 nt, Human
uguguuccugccuggcucuggu

SEQ ID NO: 1127598 - RNA, 22 nt, Human
aagaacugugcuccaggcucca

SEQ ID NO: 1127599 - RNA, 22 nt, Human
agggcagaaguacagacacuua

SEQ ID NO: 1127600 - RNA, 22 nt, Human
ucugccuuggcaaccacagcuu

SEQ ID NO: 1127601 - RNA, 22 nt, Human
ucugucaccgagggcauccaaa

SEQ ID NO: 1127602 - RNA, 22 nt, Human
gugcagugagcagugcagcacc

SEQ ID NO: 1127603 - RNA, 23 nt, Human
gccucugcucugcguuggggacu

SEQ ID NO: 1127604 - RNA, 22 nt, Human
gcccacagcucguuccucuccu

SEQ ID NO: 1127605 - RNA, 20 nt, Human
gcaaggcacagugaggaggg

SEQ ID NO: 1127606 - RNA, 22 nt, Human
aguuuauagcccagauucaugg

SEQ ID NO: 1127607 - RNA, 22 nt, Human
ggagccuugggcgcucucccau

SEQ ID NO: 1127608 - RNA, 22 nt, Human
cagccagccucucaaccaugca

SEQ ID NO: 1127609 - RNA, 19 nt, Human
agaaaucucgagauuuguu

SEQ ID NO: 1127610 - RNA, 19 nt, Human
gaucuuugccaauuuaagc

SEQ ID NO: 1127611 - RNA, 22 nt, Human
agggcugcaucugccuggugaa

SEQ ID NO: 1127612 - RNA, 22 nt, Human
uuccaggaauucagcucucagu

SEQ ID NO: 1127613 - RNA, 19 nt, Human
acacagggcuagaguuaca

SEQ ID NO: 1127614 - RNA, 22 nt, Human
ccagagccccugagcuucccug

SEQ ID NO: 1127615 - RNA, 22 nt, Human
caauaugcaagcuauuaaguau

SEQ ID NO: 1127616 - RNA, 22 nt, Human
aaugcacaaaaauuguauguaa

SEQ ID NO: 1127617 - RNA, 22 nt, Human
uuagugucuucuucauccucug

SEQ ID NO: 1127618 - RNA, 22 nt, Human
gagggcagagacagugauucac

SEQ ID NO: 1127619 - RNA, 19 nt, Human
ugccuggcaccagcuccac

SEQ ID NO: 1127620 - RNA, 22 nt, Human
gcuggggaggcagcagagaaca

SEQ ID NO: 1127621 - RNA, 22 nt, Human
acugcuuuucuaagauucugug

SEQ ID NO: 1127622 - RNA, 22 nt, Human
auauauuugagaauauucauga

SEQ ID NO: 1127623 - RNA, 22 nt, Human
agaaauguuacaguuguuauuu

SEQ ID NO: 1127624 - RNA, 23 nt, Human
uggcagagacccagaaucuacau

SEQ ID NO: 1127625 - RNA, 21 nt, Human
ucuccaguauccuucucugag

SEQ ID NO: 1127626 - RNA, 22 nt, Human
aaaagacaucuauuucaggcag

SEQ ID NO: 1127627 - RNA, 22 nt, Human
ugcuauaagaauuauauuacuc

SEQ ID NO: 1127628 - RNA, 22 nt, Human
ccacagagacaggguccuugcu

SEQ ID NO: 1127629 - RNA, 22 nt, Human
cugagaggcacaaggcauuucg

SEQ ID NO: 1127630 - RNA, 22 nt, Human
ucccagggacucucugccuucc

SEQ ID NO: 1127631 - RNA, 22 nt, Human
ggcagcucaccucugguccagg

SEQ ID NO: 1127632 - RNA, 22 nt, Human
gggcucagccccauugaaccag

SEQ ID NO: 1127633 - RNA, 22 nt, Human
ggcagccaugcacgcugccugg

SEQ ID NO: 1127634 - RNA, 22 nt, Human
agaugaagauaucugcaggggc

SEQ ID NO: 1127635 - RNA, 22 nt, Human
cagccugggcuccagagucccu

SEQ ID NO: 1127636 - RNA, 22 nt, Human
acaaaaauuagcugggcauggu

SEQ ID NO: 1127637 - RNA, 22 nt, Human
augauggugagguugagcacag

SEQ ID NO: 1127638 - RNA, 21 nt, Human
ugucagaaauaagcaugugau

SEQ ID NO: 1127639 - RNA, 22 nt, Human
agugcauauaugaagaguauga

SEQ ID NO: 1127640 - RNA, 22 nt, Human
guucacaucacuucacugaacc

SEQ ID NO: 1127641 - RNA, 22 nt, Human
uggcagagucugggcuugggca

SEQ ID NO: 1127642 - RNA, 22 nt, Human
uagauaaauuagaaaguuuacu

SEQ ID NO: 1127643 - RNA, 19 nt, Human
auagucuuuccaauuauac

SEQ ID NO: 1127644 - RNA, 22 nt, Human
agggcugcccagugugagagcu

SEQ ID NO: 1127645 - RNA, 22 nt, Human
auccuugaaugacucugcccuc

SEQ ID NO: 1127646 - RNA, 22 nt, Human
ggccuggcucuugcccagccug

SEQ ID NO: 1127647 - RNA, 22 nt, Human
uuucaugugcaauuagcaauau

SEQ ID NO: 1127648 - RNA, 22 nt, Human
ugccugcuaggcccugcugggu

SEQ ID NO: 1127649 - RNA, 22 nt, Human
uuccuuguuuguagcucuggga

SEQ ID NO: 1127650 - RNA, 22 nt, Human
aagaaauauugggccuuauaaa

SEQ ID NO: 1127651 - RNA, 22 nt, Human
aaauuguugaucuacaguaagg

SEQ ID NO: 1127652 - RNA, 21 nt, Human
gagccuucccucugcccuuuc

SEQ ID NO: 1127653 - RNA, 22 nt, Human
augaagcugguuuuggcuuggg

SEQ ID NO: 1127654 - RNA, 18 nt, Human
ugucucugaauuccagug

SEQ ID NO: 1127655 - RNA, 22 nt, Human
uccucaggauguggaguagaau

SEQ ID NO: 1127656 - RNA, 22 nt, Human
gcugccuggcuuuaguccacuu

SEQ ID NO: 1127657 - RNA, 22 nt, Human
agggccucugacgcccccagcc

SEQ ID NO: 1127658 - RNA, 22 nt, Human
uuugcauuuguuuagaaccuga

SEQ ID NO: 1127659 - RNA, 22 nt, Human
ugcagcucugaacagucaugaa

SEQ ID NO: 1127660 - RNA, 22 nt, Human
cagguaagagacggauuggccc

SEQ ID NO: 1127661 - RNA, 22 nt, Human
ggagccuguggccgucacgacu

SEQ ID NO: 1127662 - RNA, 22 nt, Human
ggccugagcuugggcagcguau

SEQ ID NO: 1127663 - RNA, 22 nt, Human
ucccagggcagcuguccagaag

SEQ ID NO: 1127664 - RNA, 22 nt, Human
ucuggcucuauaacuccuagcu

SEQ ID NO: 1127665 - RNA, 22 nt, Human
uguaucaaaccaaauuaauucu

SEQ ID NO: 1127666 - RNA, 21 nt, Human
uauacaugugugcauacgugu

SEQ ID NO: 1127667 - RNA, 22 nt, Human
ugcugggcuugaaagcugcuaa

SEQ ID NO: 1127668 - RNA, 22 nt, Human
auaacagagagcuacugaacug

SEQ ID NO: 1127669 - RNA, 22 nt, Human
uugcauugaaugcacauuuuua

SEQ ID NO: 1127670 - RNA, 23 nt, Human
uugauacagaagaaucaguuugu

SEQ ID NO: 1127671 - RNA, 22 nt, Human
gguggggccugcuccagcggcc

SEQ ID NO: 1127672 - RNA, 22 nt, Human
ucuuuacaguccucugucaauc

SEQ ID NO: 1127673 - RNA, 22 nt, Human
ugcagagguguugcugagauaa

SEQ ID NO: 1127674 - RNA, 22 nt, Human
cugccagcucucuggaggcucu

SEQ ID NO: 1127675 - RNA, 22 nt, Human
ugauuuuuagcuauucugaaga

SEQ ID NO: 1127676 - RNA, 22 nt, Human
aagggcugaaugaaggguugaa

SEQ ID NO: 1127677 - RNA, 22 nt, Human
aggauaauaauagugcucacuc

SEQ ID NO: 1127678 - RNA, 18 nt, Human
gaaaugugauucuagggc

SEQ ID NO: 1127679 - RNA, 22 nt, Human
accuuaaaacugacacauggag

SEQ ID NO: 1127680 - RNA, 22 nt, Human
cagcugccuaugaccuagccuc

SEQ ID NO: 1127681 - RNA, 22 nt, Human
uuggccuucccuaccugggcca

SEQ ID NO: 1127682 - RNA, 22 nt, Human
gcccagccuccaagcuccaagg

SEQ ID NO: 1127683 - RNA, 22 nt, Human
acagaaauugggcaaauggaag

SEQ ID NO: 1127684 - RNA, 22 nt, Human
uggagcaggugggaugucguga

SEQ ID NO: 1127685 - RNA, 21 nt, Human
gcugcugccccuagugaggcc

SEQ ID NO: 1127686 - RNA, 22 nt, Human
aacaaauggaacacaaaucuuu

SEQ ID NO: 1127687 - RNA, 19 nt, Human
ucuaacagaagugucgucc

SEQ ID NO: 1127688 - RNA, 19 nt, Human
agccagggugagaaggagc

SEQ ID NO: 1127689 - RNA, 18 nt, Human
uccagagguguuggagcc

SEQ ID NO: 1127690 - RNA, 22 nt, Human
acugaaggaagcgggcaggggu

SEQ ID NO: 1127691 - RNA, 22 nt, Human
ccaccuccaccuauugccagcc

SEQ ID NO: 1127692 - RNA, 22 nt, Human
uuuacuuugugucaagucaaga

SEQ ID NO: 1127693 - RNA, 22 nt, Human
aaaauggucucagcuggcacca

SEQ ID NO: 1127694 - RNA, 22 nt, Human
aaguguguauuguuuaugcugc

SEQ ID NO: 1127695 - RNA, 22 nt, Human
gucacaggccuggaugaggggc

SEQ ID NO: 1127696 - RNA, 22 nt, Human
ggcagcugggucacaccgaucu

SEQ ID NO: 1127697 - RNA, 22 nt, Human
acugaaggaaagccuuugcaug

SEQ ID NO: 1127698 - RNA, 22 nt, Human
aggucauuuuugccuucuauuu

SEQ ID NO: 1127699 - RNA, 22 nt, Human
gcaggcuggaggcuguucuggg

SEQ ID NO: 1127700 - RNA, 22 nt, Human
aagauuuagggccaguuuacau

SEQ ID NO: 1127701 - RNA, 22 nt, Human
aaucaguuguccaaaguucaca

SEQ ID NO: 1127702 - RNA, 17 nt, Human
auuuccucagggcugag

SEQ ID NO: 1127703 - RNA, 22 nt, Human
acauuucuaauuuaauguaaca

SEQ ID NO: 1127704 - RNA, 22 nt, Human
cugccuggaaggagcaagggga

SEQ ID NO: 1127705 - RNA, 19 nt, Human
ccucugccagcccgccucu

SEQ ID NO: 1127706 - RNA, 22 nt, Human
ggcugugcgggcagccguggga

SEQ ID NO: 1127707 - RNA, 22 nt, Human
gaaaaugugucaucccuacugu

SEQ ID NO: 1127708 - RNA, 22 nt, Human
uagggcagcugcaucaggcacu

SEQ ID NO: 1127709 - RNA, 22 nt, Human
gccagccccuuagggcucuccc

SEQ ID NO: 1127710 - RNA, 18 nt, Human
ugacucacccugucagug

SEQ ID NO: 1127711 - RNA, 22 nt, Human
cagugcaguuucccagaugcug

SEQ ID NO: 1127712 - RNA, 22 nt, Human
uggcccugcuggccaaaggcua

SEQ ID NO: 1127713 - RNA, 19 nt, Human
gcugugugaccuugggcaa

SEQ ID NO: 1127714 - RNA, 22 nt, Human
agaaaguucacugguauauuuu

SEQ ID NO: 1127715 - RNA, 21 nt, Human
aggugccaaggagaagcaggc

SEQ ID NO: 1127716 - RNA, 22 nt, Human
auguuacauaguccuuauuugu

SEQ ID NO: 1127717 - RNA, 22 nt, Human
uggguggcacuucuggggucca

SEQ ID NO: 1127718 - RNA, 22 nt, Human
aaguuuguuuuagucuaaugau

SEQ ID NO: 1127719 - RNA, 22 nt, Human
auggccugggcccgcuucagau

SEQ ID NO: 1127720 - RNA, 22 nt, Human
gcaguaaaaaaggauaugugca

SEQ ID NO: 1127721 - RNA, 23 nt, Human
uccuuccuuugagaggcuccauc

SEQ ID NO: 1127722 - RNA, 22 nt, Human
uggcucagaguucaucuuuuag

SEQ ID NO: 1127723 - RNA, 22 nt, Human
gccucugcaggugcgguuaucc

SEQ ID NO: 1127724 - RNA, 22 nt, Human
cagcagcugggaaggaggcuga

SEQ ID NO: 1127725 - RNA, 22 nt, Human
acacaggagauauguaauggcu

SEQ ID NO: 1127726 - RNA, 22 nt, Human
aaguuauugcagcaauccaagu

SEQ ID NO: 1127727 - RNA, 22 nt, Human
aguuuauguagaauuggcaaua

SEQ ID NO: 1127728 - RNA, 22 nt, Human
gccuugcuuugcuucuggacag

SEQ ID NO: 1127729 - RNA, 22 nt, Human
aacaucuuuuuguuugcugaaa

SEQ ID NO: 1127730 - RNA, 22 nt, Human
gugacucacacaggccugggcu

SEQ ID NO: 1127731 - RNA, 19 nt, Human
agugaaauggaguauucaa

SEQ ID NO: 1127732 - RNA, 22 nt, Human
ggcugccacgucgaggguccaa

SEQ ID NO: 1127733 - RNA, 22 nt, Human
cguuggagacacuugaggacuu

SEQ ID NO: 1127734 - RNA, 22 nt, Human
cacugaagcuuucauucucuug

SEQ ID NO: 1127735 - RNA, 22 nt, Human
gcugucugcugggucgcucagg

SEQ ID NO: 1127736 - RNA, 22 nt, Human
cagcucucacacccuccuccca

SEQ ID NO: 1127737 - RNA, 22 nt, Human
aggcuggcccuacuggcugccu

SEQ ID NO: 1127738 - RNA, 22 nt, Human
uccucagggaagaugagccuca

SEQ ID NO: 1127739 - RNA, 22 nt, Human
cucaggauccaucuccugcccu

SEQ ID NO: 1127740 - RNA, 22 nt, Human
ugggcugcuucuauuggugguc

SEQ ID NO: 1127741 - RNA, 22 nt, Human
ugaaagguguccaauauuucuc

SEQ ID NO: 1127742 - RNA, 22 nt, Human
agguggguaucaugagagauua

SEQ ID NO: 1127743 - RNA, 22 nt, Human
ucugucacucccugaugaugaa

SEQ ID NO: 1127744 - RNA, 22 nt, Human
ccuccuggugggcgcuucuggc

SEQ ID NO: 1127745 - RNA, 22 nt, Human
ccugggaguggcacucacagca

SEQ ID NO: 1127746 - RNA, 22 nt, Human
aggccagcuguuacuagagcca

SEQ ID NO: 1127747 - RNA, 22 nt, Human
agcugccacagagccuggccag

SEQ ID NO: 1127748 - RNA, 23 nt, Human
aggugcagcccuggaccugcccc

SEQ ID NO: 1127749 - RNA, 22 nt, Human
uugaagcagcucaggaggcuua

SEQ ID NO: 1127750 - RNA, 22 nt, Human
cucacaggagaaagucaugguc

SEQ ID NO: 1127751 - RNA, 23 nt, Human
ucuggcuccauccuuggggaucc

SEQ ID NO: 1127752 - RNA, 22 nt, Human
gcuuuccuggcccugucccugc

SEQ ID NO: 1127753 - RNA, 22 nt, Human
gggcauggugaugugcaccugu

SEQ ID NO: 1127754 - RNA, 22 nt, Human
uauuucugaauccaaaagguca

SEQ ID NO: 1127755 - RNA, 18 nt, Human
gguggcucagucaugggg

SEQ ID NO: 1127756 - RNA, 22 nt, Human
agggccugcaucaggagcuugg

SEQ ID NO: 1127757 - RNA, 20 nt, Human
cacaagagaauacacacugg

SEQ ID NO: 1127758 - RNA, 22 nt, Human
uugacaagaaucguugccuugg

SEQ ID NO: 1127759 - RNA, 22 nt, Human
aaugucugagucucuguauccc

SEQ ID NO: 1127760 - RNA, 22 nt, Human
ucucaggaagauuagggcuaag

SEQ ID NO: 1127761 - RNA, 22 nt, Human
agcagaaccugcagaccugucu

SEQ ID NO: 1127762 - RNA, 22 nt, Human
uggcagagcuggcugcggauga

SEQ ID NO: 1127763 - RNA, 22 nt, Human
ggccucggcccacugcugcggu

SEQ ID NO: 1127764 - RNA, 22 nt, Human
uaaaugugucuuuuuaaggccu

SEQ ID NO: 1127765 - RNA, 22 nt, Human
uuccaggggcagcagugauggu

SEQ ID NO: 1127766 - RNA, 22 nt, Human
gaggugggagggcagucccuaa

SEQ ID NO: 1127767 - RNA, 22 nt, Human
ugauuuccccagucuugcugcu

SEQ ID NO: 1127768 - RNA, 22 nt, Human
cugcugggucuaugcaagugga

SEQ ID NO: 1127769 - RNA, 22 nt, Human
agcugagagguggcaagcugua

SEQ ID NO: 1127770 - RNA, 22 nt, Human
agcccccaaaagugcuuaugau

SEQ ID NO: 1127771 - RNA, 22 nt, Human
ugacagcugagccccaggcaag

SEQ ID NO: 1127772 - RNA, 20 nt, Human
gucucaaguaucucacaguc

SEQ ID NO: 1127773 - RNA, 22 nt, Human
aggcagaauguuggaaaggaag

SEQ ID NO: 1127774 - RNA, 22 nt, Human
aggaaaaagaguugcugccuuc

SEQ ID NO: 1127775 - RNA, 22 nt, Human
guuauugcaguauagaggucua

SEQ ID NO: 1127776 - RNA, 22 nt, Human
gggcuccagcccgggaccaggu

SEQ ID NO: 1127777 - RNA, 22 nt, Human
agggaaagguagugaggucaca

SEQ ID NO: 1127778 - RNA, 22 nt, Human
gggcuguggagccgcgagggcu

SEQ ID NO: 1127779 - RNA, 22 nt, Human
cucuggccugcuuccucaggua

SEQ ID NO: 1127780 - RNA, 22 nt, Human
ggaugcugggagacagcaggca

SEQ ID NO: 1127781 - RNA, 18 nt, Human
agggaucaucacugcagc

SEQ ID NO: 1127782 - RNA, 22 nt, Human
uguuccauaaguggugcuuugu

SEQ ID NO: 1127783 - RNA, 22 nt, Human
cccuguccuuggcugugaggcu

SEQ ID NO: 1127784 - RNA, 18 nt, Human
ccugagcccugcuuacuu

SEQ ID NO: 1127785 - RNA, 22 nt, Human
gcucacuggccugaagaggacg

SEQ ID NO: 1127786 - RNA, 22 nt, Human
ccagguggaaggucugugcucu

SEQ ID NO: 1127787 - RNA, 21 nt, Human
ccuccaggugauuccgugcuc

SEQ ID NO: 1127788 - RNA, 22 nt, Human
gcugucacaaauauuucucagc

SEQ ID NO: 1127789 - RNA, 22 nt, Human
cagauaaaggcuuacuaguagu

SEQ ID NO: 1127790 - RNA, 22 nt, Human
cuguguccucccgcugcaccca

SEQ ID NO: 1127791 - RNA, 22 nt, Human
agggggaggcugugcugcgucu

SEQ ID NO: 1127792 - RNA, 22 nt, Human
ggcugccugaggcugaggcccg

SEQ ID NO: 1127793 - RNA, 22 nt, Human
cugggcugcagcgggagcgacg

SEQ ID NO: 1127794 - RNA, 22 nt, Human
acagggcccuugccagcacaag

SEQ ID NO: 1127795 - RNA, 20 nt, Human
gcagagcuguucugugggga

SEQ ID NO: 1127796 - RNA, 22 nt, Human
acuuccuggcugggugaccugg

SEQ ID NO: 1127797 - RNA, 22 nt, Human
ugagaggcagaauggugccugc

SEQ ID NO: 1127798 - RNA, 22 nt, Human
ucacugcagacaaccucaguca

SEQ ID NO: 1127799 - RNA, 20 nt, Human
ugugcccaauguccagguuc

SEQ ID NO: 1127800 - RNA, 21 nt, Human
agaaaaaccagcauguuuuca

SEQ ID NO: 1127801 - RNA, 18 nt, Human
gaggauggaaggagaugc

SEQ ID NO: 1127802 - RNA, 22 nt, Human
cugggcagccucacacaauguu

SEQ ID NO: 1127803 - RNA, 22 nt, Human
acacugaauguuuaagaacuug

SEQ ID NO: 1127804 - RNA, 22 nt, Human
ugcuggaggccugacuguguuu

SEQ ID NO: 1127805 - RNA, 22 nt, Human
gcuggcuguguuucaucucuga

SEQ ID NO: 1127806 - RNA, 22 nt, Human
ucagaagcauguggggagccug

SEQ ID NO: 1127807 - RNA, 22 nt, Human
uggcacugccaaccugcuaggu

SEQ ID NO: 1127808 - RNA, 22 nt, Human
cagagagcuuagugugcugcau

SEQ ID NO: 1127809 - RNA, 22 nt, Human
agagcugaggauccagcugagc

SEQ ID NO: 1127810 - RNA, 21 nt, Human
uuugaauagaaauagugcuua

SEQ ID NO: 1127811 - RNA, 22 nt, Human
ccuggguggcagagguugcagu

SEQ ID NO: 1127812 - RNA, 22 nt, Human
ucugagggcuugaggggaagua

SEQ ID NO: 1127813 - RNA, 22 nt, Human
ucucucuucaacccuuaacuag

SEQ ID NO: 1127814 - RNA, 20 nt, Human
ccagucccugagcaccaggg

SEQ ID NO: 1127815 - RNA, 22 nt, Human
gaggacagcuuagggcuuccug

SEQ ID NO: 1127816 - RNA, 22 nt, Human
auucagcaguuccugcuucagu

SEQ ID NO: 1127817 - RNA, 19 nt, Human
cucuggccucuggaugcug

SEQ ID NO: 1127818 - RNA, 22 nt, Human
ccugcccuagagaugacacaau

SEQ ID NO: 1127819 - RNA, 22 nt, Human
uucacauuaucaggauuguuuc

SEQ ID NO: 1127820 - RNA, 22 nt, Human
aaaguguugauaugugacaucc

SEQ ID NO: 1127821 - RNA, 22 nt, Human
cacugaaggcuaggauuagaug

SEQ ID NO: 1127822 - RNA, 22 nt, Human
acagaauauugguuacuguugc

SEQ ID NO: 1127823 - RNA, 22 nt, Human
acagagauguggaugagggauu

SEQ ID NO: 1127824 - RNA, 22 nt, Human
aggagcagaacuguuguggagg

SEQ ID NO: 1127825 - RNA, 22 nt, Human
agaaagaacguugguuaucuua

SEQ ID NO: 1127826 - RNA, 22 nt, Human
uguuuuaugagccauauaaccu

SEQ ID NO: 1127827 - RNA, 22 nt, Human
ggcagccaugucccagggcuuc

SEQ ID NO: 1127828 - RNA, 22 nt, Human
cuccuucccuucaaguguuccu

SEQ ID NO: 1127829 - RNA, 22 nt, Human
acccagagcugggcuuggcaaa

SEQ ID NO: 1127830 - RNA, 22 nt, Human
cucuggcuucuaccuugcaguu

SEQ ID NO: 1127831 - RNA, 22 nt, Human
cuccucacacccacugcaacca

SEQ ID NO: 1127832 - RNA, 19 nt, Human
cuugguuaugguaugaugc

SEQ ID NO: 1127833 - RNA, 23 nt, Human
cauggcagcaagagcucauggcc

SEQ ID NO: 1127834 - RNA, 22 nt, Human
ucuacuuuucccuauacaguuu

SEQ ID NO: 1127835 - RNA, 22 nt, Human
gggagccaugcuggucuucuuu

SEQ ID NO: 1127836 - RNA, 22 nt, Human
ccaaggagcucauauucuuguu

SEQ ID NO: 1127837 - RNA, 22 nt, Human
ucagggcaggacaguguaggcc

SEQ ID NO: 1127838 - RNA, 22 nt, Human
guguauaacuaucuaucuagua

SEQ ID NO: 1127839 - RNA, 22 nt, Human
agagugaaggccagguuacagu

SEQ ID NO: 1127840 - RNA, 19 nt, Human
uauauauuuugggguugug

SEQ ID NO: 1127841 - RNA, 22 nt, Human
gacagggcaagacucugucuaa

SEQ ID NO: 1127842 - RNA, 22 nt, Human
ucugggcucuuaguguacccuc

SEQ ID NO: 1127843 - RNA, 22 nt, Human
ggcugcagcggauuggggauug

SEQ ID NO: 1127844 - RNA, 22 nt, Human
ucagagucucccccaguuuggg

SEQ ID NO: 1127845 - RNA, 22 nt, Human
uaacacugguauuucauuuagu

SEQ ID NO: 1127846 - RNA, 22 nt, Human
cauuaugugggaaaauguucuu

SEQ ID NO: 1127847 - RNA, 20 nt, Human
aggaacuggaagggaggaaa

SEQ ID NO: 1127848 - RNA, 17 nt, Human
ucaugcccaacuauuac

SEQ ID NO: 1127849 - RNA, 22 nt, Human
ugugccugucacccucagagag

SEQ ID NO: 1127850 - RNA, 22 nt, Human
ugccugggagugaccaagacuc

SEQ ID NO: 1127851 - RNA, 22 nt, Human
ucagggcauccauugccuguug

SEQ ID NO: 1127852 - RNA, 22 nt, Human
gcucacugccauucucuagaug

SEQ ID NO: 1127853 - RNA, 22 nt, Human
ugcugcacucaccaacagauaa

SEQ ID NO: 1127854 - RNA, 22 nt, Human
agagccuggcucccagcuaccg

SEQ ID NO: 1127855 - RNA, 22 nt, Human
aggccagggucccacacucgca

SEQ ID NO: 1127856 - RNA, 22 nt, Human
gucccaggugggcuccaccucu

SEQ ID NO: 1127857 - RNA, 22 nt, Human
agaacuuaggaacaacagcuua

SEQ ID NO: 1127858 - RNA, 21 nt, Human
acagaacuguauagugauaaa

SEQ ID NO: 1127859 - RNA, 22 nt, Human
uaggccagaggagcagcuuugg

SEQ ID NO: 1127860 - RNA, 22 nt, Human
gggccuggggugacguaccccu

SEQ ID NO: 1127861 - RNA, 22 nt, Human
gggcagugguccaggcuacagc

SEQ ID NO: 1127862 - RNA, 22 nt, Human
augcacccagugucuggacuau

SEQ ID NO: 1127863 - RNA, 22 nt, Human
aaggagcucccggcagaccagg

SEQ ID NO: 1127864 - RNA, 22 nt, Human
cuucccacuaguaucacagagc

SEQ ID NO: 1127865 - RNA, 22 nt, Human
aggcccugaagucggccccuca

SEQ ID NO: 1127866 - RNA, 22 nt, Human
aucucagacauguuguccauga

SEQ ID NO: 1127867 - RNA, 22 nt, Human
gugccugggguugagcuaugaa

SEQ ID NO: 1127868 - RNA, 22 nt, Human
acuuccugggcaugcagagucc

SEQ ID NO: 1127869 - RNA, 22 nt, Human
aggacuucuccgauaagucaga

SEQ ID NO: 1127870 - RNA, 22 nt, Human
ggcacugagaggcucuuccuaa

SEQ ID NO: 1127871 - RNA, 22 nt, Human
auaugcacacucugcccacaga

SEQ ID NO: 1127872 - RNA, 21 nt, Human
ugcaggaaagugcugcgaccc

SEQ ID NO: 1127873 - RNA, 22 nt, Human
cuccucuggcuuccuggaggca

SEQ ID NO: 1127874 - RNA, 22 nt, Human
uggcucugucaaacugcacaca

SEQ ID NO: 1127875 - RNA, 22 nt, Human
cacugggcaauucugagccuaa

SEQ ID NO: 1127876 - RNA, 22 nt, Human
ccucaugguacuuacuguagcu

SEQ ID NO: 1127877 - RNA, 22 nt, Human
ggcccugggaugcucagcagug

SEQ ID NO: 1127878 - RNA, 22 nt, Human
agauggguaacuggagucugcu

SEQ ID NO: 1127879 - RNA, 22 nt, Human
cccugagaugccucacccuagu

SEQ ID NO: 1127880 - RNA, 19 nt, Human
uuacaucugcaacacuggu

SEQ ID NO: 1127881 - RNA, 22 nt, Human
acaacaggguaaggcaggccau

SEQ ID NO: 1127882 - RNA, 22 nt, Human
gaugguuuggaaugaaguagcu

SEQ ID NO: 1127883 - RNA, 22 nt, Human
aguaaaaauugaggugcaaaau

SEQ ID NO: 1127884 - RNA, 22 nt, Human
agcuggcuccagaaggagucgu

SEQ ID NO: 1127885 - RNA, 22 nt, Human
cuugccuucuguuccuauagaa

SEQ ID NO: 1127886 - RNA, 22 nt, Human
aaccaggacaauuugaauagaa

SEQ ID NO: 1127887 - RNA, 22 nt, Human
ucuugggauugcccugcaguuc

SEQ ID NO: 1127888 - RNA, 22 nt, Human
ccuguggcacaugcagggauuc

SEQ ID NO: 1127889 - RNA, 22 nt, Human
gggcacugugcuaggugcugag

SEQ ID NO: 1127890 - RNA, 22 nt, Human
gguggccucugcaggccucgac

SEQ ID NO: 1127891 - RNA, 22 nt, Human
ggcaguggugggaggcucgcuc

SEQ ID NO: 1127892 - RNA, 22 nt, Human
auuguauuuccagcuugaaugu

SEQ ID NO: 1127893 - RNA, 22 nt, Human
ugugccuggaucucugugacaa

SEQ ID NO: 1127894 - RNA, 22 nt, Human
agcuccugcacccagccuugag

SEQ ID NO: 1127895 - RNA, 22 nt, Human
aucaaaguggaaguuuacuagg

SEQ ID NO: 1127896 - RNA, 22 nt, Human
ugguuugcccacucgagugauu

SEQ ID NO: 1127897 - RNA, 22 nt, Human
cucugagcugaaacaugagcau

SEQ ID NO: 1127898 - RNA, 22 nt, Human
gcacagggaggcuggccuggcc

SEQ ID NO: 1127899 - RNA, 22 nt, Human
aaaugcagguucuugagccaag

SEQ ID NO: 1127900 - RNA, 22 nt, Human
ggugggugagcccugggagcug

SEQ ID NO: 1127901 - RNA, 22 nt, Human
uaagaacaagcuggggguucca

SEQ ID NO: 1127902 - RNA, 22 nt, Human
agggcagcuagcuguagaaaga

SEQ ID NO: 1127903 - RNA, 17 nt, Human
ucagcaaagacaaagga

SEQ ID NO: 1127904 - RNA, 22 nt, Human
uucucuggaacugaaacaagau

SEQ ID NO: 1127905 - RNA, 23 nt, Human
uuguuuuuagagguggcaugaga

SEQ ID NO: 1127906 - RNA, 22 nt, Human
ggcugcuguuucagagacuguu

SEQ ID NO: 1127907 - RNA, 22 nt, Human
ccagcuucucucugaugcagcu

SEQ ID NO: 1127908 - RNA, 22 nt, Human
agcaggguuccaggaguugcag

SEQ ID NO: 1127909 - RNA, 23 nt, Human
uuacuuuugcaccaaccuaauau

SEQ ID NO: 1127910 - RNA, 22 nt, Human
acccugggucauauacagugug

SEQ ID NO: 1127911 - RNA, 22 nt, Human
ugagcccuaagggucaagcagg

SEQ ID NO: 1127912 - RNA, 22 nt, Human
agccaggauggucucgaucggc

SEQ ID NO: 1127913 - RNA, 22 nt, Human
auuaggcauauaugcuuuuaau

SEQ ID NO: 1127914 - RNA, 22 nt, Human
uucaagauaauaggaaugaaaa

SEQ ID NO: 1127915 - RNA, 22 nt, Human
aucaaaguccaucagaagguag

SEQ ID NO: 1127916 - RNA, 22 nt, Human
ccuccaaguuugacucaggaca

SEQ ID NO: 1127917 - RNA, 21 nt, Human
gcagggacaaagcuucaggag

SEQ ID NO: 1127918 - RNA, 22 nt, Human
gcugucagugaggugagacaug

SEQ ID NO: 1127919 - RNA, 22 nt, Human
aggggccucgcaggaccgcucc

SEQ ID NO: 1127920 - RNA, 22 nt, Human
uuucuaauaguugagucagcua

SEQ ID NO: 1127921 - RNA, 22 nt, Human
ugccaaggguaugggcaagaua

SEQ ID NO: 1127922 - RNA, 22 nt, Human
caucacuguccaaaguucaguu

SEQ ID NO: 1127923 - RNA, 22 nt, Human
cagccagcuggcacugugagua

SEQ ID NO: 1127924 - RNA, 22 nt, Human
uggccugggugcugcugacauc

SEQ ID NO: 1127925 - RNA, 22 nt, Human
guguggcugauugacaugguca

SEQ ID NO: 1127926 - RNA, 22 nt, Human
uugugcauuucucugagugugu

SEQ ID NO: 1127927 - RNA, 22 nt, Human
ucuggagagucacagugccaga

SEQ ID NO: 1127928 - RNA, 22 nt, Human
ugaaagguuauuuaggucugcu

SEQ ID NO: 1127929 - RNA, 22 nt, Human
ggcagccuccagggcacuggug

SEQ ID NO: 1127930 - RNA, 20 nt, Human
acauugauuauguuuguaga

SEQ ID NO: 1127931 - RNA, 22 nt, Human
ccucugcagcagagagccagag

SEQ ID NO: 1127932 - RNA, 22 nt, Human
aacagaauaguugauguacagu

SEQ ID NO: 1127933 - RNA, 22 nt, Human
ggcugcugguagggguaggaag

SEQ ID NO: 1127934 - RNA, 21 nt, Human
uggagcugaauuuuuggcauc

SEQ ID NO: 1127935 - RNA, 22 nt, Human
cauugcacucuggcuggaacgg

SEQ ID NO: 1127936 - RNA, 22 nt, Human
guuugcauguguacuuaauugg

SEQ ID NO: 1127937 - RNA, 22 nt, Human
uacacauguuuggcaaguaugu

SEQ ID NO: 1127938 - RNA, 22 nt, Human
ccugggucacucaggcaggcgg

SEQ ID NO: 1127939 - RNA, 22 nt, Human
acagagguguguguaggacagu

SEQ ID NO: 1127940 - RNA, 22 nt, Human
agccugcaggaugggcagcacc

SEQ ID NO: 1127941 - RNA, 22 nt, Human
ugauuucccucaucauaacaga

SEQ ID NO: 1127942 - RNA, 22 nt, Human
ccugcagguaaggcuaacugcc

SEQ ID NO: 1127943 - RNA, 22 nt, Human
cccaugccuucugacucacagg

SEQ ID NO: 1127944 - RNA, 22 nt, Human
gaaugugucacccugucccaug

SEQ ID NO: 1127945 - RNA, 19 nt, Human
ccuggcccugcugcgcggg

SEQ ID NO: 1127946 - RNA, 22 nt, Human
ucuaaaaaagucuguucacuug

SEQ ID NO: 1127947 - RNA, 22 nt, Human
aucuacaggcugaggugggagg

SEQ ID NO: 1127948 - RNA, 22 nt, Human
ucccagagucuucuccuguaau

SEQ ID NO: 1127949 - RNA, 22 nt, Human
cauuuguauguuccuccuuagg

SEQ ID NO: 1127950 - RNA, 22 nt, Human
gagcugccugaacaagcagcag

SEQ ID NO: 1127951 - RNA, 22 nt, Human
acagccuguguaccagcuggga

SEQ ID NO: 1127952 - RNA, 22 nt, Human
uuaggcaaugcucucaaauuug

SEQ ID NO: 1127953 - RNA, 22 nt, Human
ucagggcagguuaacuugggug

SEQ ID NO: 1127954 - RNA, 22 nt, Human
augaaaacggaccagagcuauu

SEQ ID NO: 1127955 - RNA, 22 nt, Human
auaagagcuagucuuuuccuug

SEQ ID NO: 1127956 - RNA, 22 nt, Human
cacuuaagcaguuaauuuaucu

SEQ ID NO: 1127957 - RNA, 22 nt, Human
caaggaaacaugaaaugcauug

SEQ ID NO: 1127958 - RNA, 22 nt, Human
gggagcugguuccugcccucca

SEQ ID NO: 1127959 - RNA, 22 nt, Human
augucuuuggcuuugacauggc

SEQ ID NO: 1127960 - RNA, 22 nt, Human
acagccagaggugguccugggu

SEQ ID NO: 1127961 - RNA, 22 nt, Human
uuauuauaaugagggauaaaaa

SEQ ID NO: 1127962 - RNA, 22 nt, Human
caggaccccauauucacugaac

SEQ ID NO: 1127963 - RNA, 23 nt, Human
auacauacagucuuacugacuuu

SEQ ID NO: 1127964 - RNA, 22 nt, Human
cacaugggugugccuggaggaa

SEQ ID NO: 1127965 - RNA, 18 nt, Human
cucucuuuccacucuuug

SEQ ID NO: 1127966 - RNA, 22 nt, Human
ccagagccucuuaugaagaucg

SEQ ID NO: 1127967 - RNA, 22 nt, Human
agccccaggcccggacgccucu

SEQ ID NO: 1127968 - RNA, 19 nt, Human
gcuuuuuguugucaaaggu

SEQ ID NO: 1127969 - RNA, 22 nt, Human
aggcuucccagcugagcucagc

SEQ ID NO: 1127970 - RNA, 22 nt, Human
aaaucagugcucauuugaaagg

SEQ ID NO: 1127971 - RNA, 20 nt, Human
agggucaguagcacagagcu

SEQ ID NO: 1127972 - RNA, 22 nt, Human
agcugcuguggggcucggccug

SEQ ID NO: 1127973 - RNA, 22 nt, Human
ucuggcuccguguccgcuccca

SEQ ID NO: 1127974 - RNA, 22 nt, Human
ugugaggagaggcccagcuccc

SEQ ID NO: 1127975 - RNA, 22 nt, Human
guccugggcccaggggcugccu

SEQ ID NO: 1127976 - RNA, 22 nt, Human
caugugucaaaugauguagcug

SEQ ID NO: 1127977 - RNA, 22 nt, Human
ggcagcuccuccuagucugccc

SEQ ID NO: 1127978 - RNA, 20 nt, Human
cuuuggcaaugagaacaggg

SEQ ID NO: 1127979 - RNA, 22 nt, Human
caguauuuauggcuugaguauu

SEQ ID NO: 1127980 - RNA, 22 nt, Human
uuagucuucuuccuuauauguu

SEQ ID NO: 1127981 - RNA, 22 nt, Human
ugguaaagaaggcuagaucuga

SEQ ID NO: 1127982 - RNA, 22 nt, Human
uacaguagaauuuuuaguaacu

SEQ ID NO: 1127983 - RNA, 22 nt, Human
gaaaugcagaaccugagaccau

SEQ ID NO: 1127984 - RNA, 22 nt, Human
cugcugucuuuauuucacugcu

SEQ ID NO: 1127985 - RNA, 22 nt, Human
ucuuuggauaucgcuagaccgu

SEQ ID NO: 1127986 - RNA, 22 nt, Human
gggcuggcgggaaaggcaauuc

SEQ ID NO: 1127987 - RNA, 22 nt, Human
ucauugcagacuaacaaucuca

SEQ ID NO: 1127988 - RNA, 22 nt, Human
ccccuuccuuccucagacagcc

SEQ ID NO: 1127989 - RNA, 22 nt, Human
uuagaaaugauuucaccucuuu

SEQ ID NO: 1127990 - RNA, 22 nt, Human
ucuggcuccacaccucacugca

SEQ ID NO: 1127991 - RNA, 22 nt, Human
ugagggaguuggguguauagga

SEQ ID NO: 1127992 - RNA, 22 nt, Human
ccaggcugcuuagccuuaucuu

SEQ ID NO: 1127993 - RNA, 22 nt, Human
gaggccacagcuaucagggaca

SEQ ID NO: 1127994 - RNA, 22 nt, Human
aaauguguguauguacauauau

SEQ ID NO: 1127995 - RNA, 22 nt, Human
gcccucagcuccuggacacaug

SEQ ID NO: 1127996 - RNA, 22 nt, Human
uuaauuuauguccaaaccagau

SEQ ID NO: 1127997 - RNA, 22 nt, Human
gggcuugcugauuugggcagga

SEQ ID NO: 1127998 - RNA, 22 nt, Human
cuuccuguugucacagucugcg

SEQ ID NO: 1127999 - RNA, 22 nt, Human
gacucagugauuugacaugccu

SEQ ID NO: 1128000 - RNA, 22 nt, Human
cagcuccagcccaggcagcucc

SEQ ID NO: 1128001 - RNA, 22 nt, Human
ggccugaggcaauagucagaca

SEQ ID NO: 1128002 - RNA, 22 nt, Human
auguccuuugcuucucuggucc

SEQ ID NO: 1128003 - RNA, 22 nt, Human
acaauguuucucuuuagucauu

SEQ ID NO: 1128004 - RNA, 22 nt, Human
agagcuggggccagagucaagg

SEQ ID NO: 1128005 - RNA, 22 nt, Human
aaggcacuuuucuaaagaccuu

SEQ ID NO: 1128006 - RNA, 20 nt, Human
aggaaaaggguggugguaga

SEQ ID NO: 1128007 - RNA, 22 nt, Human
caaagcaaggcucaguuugaac

SEQ ID NO: 1128008 - RNA, 22 nt, Human
aagcagcacaguaauauuggug

SEQ ID NO: 1128009 - RNA, 22 nt, Human
aucuaggauuugaaugcacagu

SEQ ID NO: 1128010 - RNA, 22 nt, Human
cuuccaaacccaggguaugggc

SEQ ID NO: 1128011 - RNA, 22 nt, Human
guaucuuuuacaccaggaaauu

SEQ ID NO: 1128012 - RNA, 22 nt, Human
ccacugucuuuuccaggcugaa

SEQ ID NO: 1128013 - RNA, 19 nt, Human
ggcugcugguuacagaggc

SEQ ID NO: 1128014 - RNA, 22 nt, Human
gaaggagagggucaaggauaau

SEQ ID NO: 1128015 - RNA, 18 nt, Human
caauguuuuagaucucua

SEQ ID NO: 1128016 - RNA, 22 nt, Human
gcagcuggucuggccuagagua

SEQ ID NO: 1128017 - RNA, 22 nt, Human
cuggccuuggugcuugcagaca

SEQ ID NO: 1128018 - RNA, 22 nt, Human
gcacacagauuaggaaacagaa

SEQ ID NO: 1128019 - RNA, 22 nt, Human
aggcucagagagcuguguccau

SEQ ID NO: 1128020 - RNA, 23 nt, Human
ggcucugugcugggccugcagga

SEQ ID NO: 1128021 - RNA, 22 nt, Human
agcagcugguaggaguggccac

SEQ ID NO: 1128022 - RNA, 20 nt, Human
ugaaaggugggaauuguggg

SEQ ID NO: 1128023 - RNA, 22 nt, Human
uucacaggugacuggggauaac

SEQ ID NO: 1128024 - RNA, 22 nt, Human
ggguggaggagaacaggcccca

SEQ ID NO: 1128025 - RNA, 22 nt, Human
agagccuggacuuuucugagcc

SEQ ID NO: 1128026 - RNA, 22 nt, Human
cuuguacauagagaagaagccu

SEQ ID NO: 1128027 - RNA, 22 nt, Human
ugcucuggguccugggccuccu

SEQ ID NO: 1128028 - RNA, 22 nt, Human
cagagcugauuggauccagaga

SEQ ID NO: 1128029 - RNA, 22 nt, Human
uugaggagcacuagucagguau

SEQ ID NO: 1128030 - RNA, 22 nt, Human
cuucuugcaauuuucaucuuau

SEQ ID NO: 1128031 - RNA, 22 nt, Human
uuugcauuccugccugcauuca

SEQ ID NO: 1128032 - RNA, 22 nt, Human
cugggccagucucggccgcucu

SEQ ID NO: 1128033 - RNA, 22 nt, Human
ccucacagggccaggccccuca

SEQ ID NO: 1128034 - RNA, 22 nt, Human
gagcccaggcagagguugcagu

SEQ ID NO: 1128035 - RNA, 22 nt, Human
uggcucagugcauucacaguaa

SEQ ID NO: 1128036 - RNA, 22 nt, Human
ugaagcaggaaacuucuuguuu

SEQ ID NO: 1128037 - RNA, 22 nt, Human
gagauucuguagucaggcaucu

SEQ ID NO: 1128038 - RNA, 22 nt, Human
auaacagauacucucugugagg

SEQ ID NO: 1128039 - RNA, 22 nt, Human
ccacagggacuguuaaaacccu

SEQ ID NO: 1128040 - RNA, 22 nt, Human
ggcugccugcuccuccugcacg

SEQ ID NO: 1128041 - RNA, 22 nt, Human
uugaacaguuuugucagguuca

SEQ ID NO: 1128042 - RNA, 22 nt, Human
aagcugccagauucagucugcu

SEQ ID NO: 1128043 - RNA, 22 nt, Human
ugaacgcagguccacauggcuc

SEQ ID NO: 1128044 - RNA, 22 nt, Human
gaggaccacagaugagccugca

SEQ ID NO: 1128045 - RNA, 22 nt, Human
uuugucagucaugucugcuuuu

SEQ ID NO: 1128046 - RNA, 22 nt, Human
ucucagagggaaacaugaguga

SEQ ID NO: 1128047 - RNA, 22 nt, Human
gcuccugggcucuaccuugcua

SEQ ID NO: 1128048 - RNA, 22 nt, Human
gagcucuguguagccugagggu

SEQ ID NO: 1128049 - RNA, 22 nt, Human
ugucuuuucuacuguaagcaua

SEQ ID NO: 1128050 - RNA, 22 nt, Human
accugagccuagggagguugag

SEQ ID NO: 1128051 - RNA, 22 nt, Human
ccugucugaggaggugcucuuu

SEQ ID NO: 1128052 - RNA, 22 nt, Human
gcuggccaggugcuuugguucu

SEQ ID NO: 1128053 - RNA, 22 nt, Human
ucaggaguccugccugcagccu

SEQ ID NO: 1128054 - RNA, 22 nt, Human
ugacagaaagaauaugucaauc

SEQ ID NO: 1128055 - RNA, 22 nt, Human
gccagccugugcuuggccaggc

SEQ ID NO: 1128056 - RNA, 22 nt, Human
agucccagcccaguccuguaag

SEQ ID NO: 1128057 - RNA, 22 nt, Human
ucaaaguagggguaagccaggc

SEQ ID NO: 1128058 - RNA, 22 nt, Human
guggguggaggcgucgagggca

SEQ ID NO: 1128059 - RNA, 22 nt, Human
uugaaaggugacauuguuagag

SEQ ID NO: 1128060 - RNA, 22 nt, Human
ccagcuggucugugcucauguu

SEQ ID NO: 1128061 - RNA, 22 nt, Human
cuccucccugcgauugcucugc

SEQ ID NO: 1128062 - RNA, 22 nt, Human
gcagugcugaucccauggcaga

SEQ ID NO: 1128063 - RNA, 22 nt, Human
gcagcaggcuuuucauaccuug

SEQ ID NO: 1128064 - RNA, 22 nt, Human
ugucuuccucuuggcuugagcu

SEQ ID NO: 1128065 - RNA, 22 nt, Human
agggaucaaaaaauguacaugc

SEQ ID NO: 1128066 - RNA, 22 nt, Human
uccagccaagggagguuacuag

SEQ ID NO: 1128067 - RNA, 22 nt, Human
gggcucugguacuuccuggcuc

SEQ ID NO: 1128068 - RNA, 22 nt, Human
agagaacaaauuaaaggugguu

SEQ ID NO: 1128069 - RNA, 22 nt, Human
cacugcaguuccccagugcgca

SEQ ID NO: 1128070 - RNA, 22 nt, Human
auaaggcagaaaugauucuagu

SEQ ID NO: 1128071 - RNA, 22 nt, Human
ugggggugacuaucucgggaau

SEQ ID NO: 1128072 - RNA, 22 nt, Human
cugggccugggaggccaggucu

SEQ ID NO: 1128073 - RNA, 22 nt, Human
guuuuguugcugcagagcucaa

SEQ ID NO: 1128074 - RNA, 22 nt, Human
caggauaaauaguaaauguaag

SEQ ID NO: 1128075 - RNA, 22 nt, Human
ggcccugagcugaaguacugug

SEQ ID NO: 1128076 - RNA, 22 nt, Human
aauuaacagagggcuuauuacu

SEQ ID NO: 1128077 - RNA, 22 nt, Human
agggauguaaauucuucuucuu

SEQ ID NO: 1128078 - RNA, 22 nt, Human
ggccucucauguccugggcuuc

SEQ ID NO: 1128079 - RNA, 19 nt, Human
gccugcagaaaaggcaggg

SEQ ID NO: 1128080 - RNA, 22 nt, Human
cacugcuucuggaggaauuugg

SEQ ID NO: 1128081 - RNA, 22 nt, Human
uuauuauuuuguguacagcaaa

SEQ ID NO: 1128082 - RNA, 22 nt, Human
cuggcaggaaguuagaugguaa

SEQ ID NO: 1128083 - RNA, 22 nt, Human
uuaauacuauaauuugaaguac

SEQ ID NO: 1128084 - RNA, 22 nt, Human
gcaugugucuccccaguggagg

SEQ ID NO: 1128085 - RNA, 22 nt, Human
auucuaggcuugaaacaugaag

SEQ ID NO: 1128086 - RNA, 21 nt, Human
cucacaggaugcaguguuacu

SEQ ID NO: 1128087 - RNA, 20 nt, Human
uggcuccucuuggcuguggc

SEQ ID NO: 1128088 - RNA, 22 nt, Human
gcugcccuaauaucacauguua

SEQ ID NO: 1128089 - RNA, 22 nt, Human
ucauaauacaaagaguucugca

SEQ ID NO: 1128090 - RNA, 22 nt, Human
gggcucucaugaguguguggua

SEQ ID NO: 1128091 - RNA, 22 nt, Human
auauaaagagcuuaguauagug

SEQ ID NO: 1128092 - RNA, 22 nt, Human
aaacuguaagagaauaaacuac

SEQ ID NO: 1128093 - RNA, 22 nt, Human
gcaggcagucaucuuucauauu

SEQ ID NO: 1128094 - RNA, 22 nt, Human
ucucccaggugggugccuggag

SEQ ID NO: 1128095 - RNA, 22 nt, Human
cagcuggcuccaccucugggcu

SEQ ID NO: 1128096 - RNA, 20 nt, Human
cuguggcucaugcaucugcc

SEQ ID NO: 1128097 - RNA, 22 nt, Human
cugcucugagaggcucuuccua

SEQ ID NO: 1128098 - RNA, 23 nt, Human
ugucauugugacuacagaaccag

SEQ ID NO: 1128099 - RNA, 22 nt, Human
aucaguuucacuugcuugcaaa

SEQ ID NO: 1128100 - RNA, 22 nt, Human
caagauggacauaaggagagaa

SEQ ID NO: 1128101 - RNA, 22 nt, Human
auaaagucucauggguaaaugu

SEQ ID NO: 1128102 - RNA, 22 nt, Human
cacaaaaguaggaggcaggcgg

SEQ ID NO: 1128103 - RNA, 22 nt, Human
ugaggaggucagagucuggcug

SEQ ID NO: 1128104 - RNA, 22 nt, Human
aaggcacucauucaaggagaua

SEQ ID NO: 1128105 - RNA, 22 nt, Human
ugcaaucucggcacuuugggag

SEQ ID NO: 1128106 - RNA, 22 nt, Human
gggugggguucaggaaucuuca

SEQ ID NO: 1128107 - RNA, 22 nt, Human
caggaacaauguaagucucauu

SEQ ID NO: 1128108 - RNA, 20 nt, Human
aggagaaauucgggacaccu

SEQ ID NO: 1128109 - RNA, 22 nt, Human
ggucauuguucuuuucugugau

SEQ ID NO: 1128110 - RNA, 22 nt, Human
uugaagcacaaugucuuuuauc

SEQ ID NO: 1128111 - RNA, 22 nt, Human
ugaaaaggaguccuuguuuuca

SEQ ID NO: 1128112 - RNA, 22 nt, Human
gucagugucuuaacagagauua

SEQ ID NO: 1128113 - RNA, 22 nt, Human
aauguguacuuuuucaugcuca

SEQ ID NO: 1128114 - RNA, 23 nt, Human
ucacaggggccagcgcucugugg

SEQ ID NO: 1128115 - RNA, 23 nt, Human
gcagauggccccagagugcugcc

SEQ ID NO: 1128116 - RNA, 22 nt, Human
gugugcgcuggugcuuggucaa

SEQ ID NO: 1128117 - RNA, 22 nt, Human
gaagcccaggcuuccuuggcuu

SEQ ID NO: 1128118 - RNA, 22 nt, Human
agucaguguagaaagcccaggc

SEQ ID NO: 1128119 - RNA, 22 nt, Human
ggcagggcuugucucugugaug

SEQ ID NO: 1128120 - RNA, 22 nt, Human
gacugucauucuagugcccaug

SEQ ID NO: 1128121 - RNA, 22 nt, Human
cagcccaaagccccaggcuaga

SEQ ID NO: 1128122 - RNA, 22 nt, Human
cccucugcucaggugcauaggc

SEQ ID NO: 1128123 - RNA, 22 nt, Human
gcugagugauugauauuuuagu

SEQ ID NO: 1128124 - RNA, 22 nt, Human
uggccuggggaagaccaugggc

SEQ ID NO: 1128125 - RNA, 22 nt, Human
gccuggcaggccugggccagca

SEQ ID NO: 1128126 - RNA, 16 nt, Human
uaugugugugggagug

SEQ ID NO: 1128127 - RNA, 22 nt, Human
ggguacaaagauuucauaagau

SEQ ID NO: 1128128 - RNA, 22 nt, Human
ggacacaguggaagacagcuug

SEQ ID NO: 1128129 - RNA, 22 nt, Human
ggauggagaugaccauggugac

SEQ ID NO: 1128130 - RNA, 22 nt, Human
aaaucagucccucuuggaauuu

SEQ ID NO: 1128131 - RNA, 22 nt, Human
cacacaugucucuccaugcucu

SEQ ID NO: 1128132 - RNA, 22 nt, Human
acagggucauuuuaugaucugu

SEQ ID NO: 1128133 - RNA, 22 nt, Human
ggagucaggagcaggcugggcu

SEQ ID NO: 1128134 - RNA, 22 nt, Human
caggaaaaaugccaggagucag

SEQ ID NO: 1128135 - RNA, 22 nt, Human
acagacauuuucuguauugccu

SEQ ID NO: 1128136 - RNA, 22 nt, Human
gagguggguguaucacagguca

SEQ ID NO: 1128137 - RNA, 22 nt, Human
augggaggguggaaaggcucug

SEQ ID NO: 1128138 - RNA, 22 nt, Human
agaugcuucaguguuuaauuua

SEQ ID NO: 1128139 - RNA, 22 nt, Human
uuuaagaugguauuuuauaaag

SEQ ID NO: 1128140 - RNA, 22 nt, Human
cugggagcccgcguccuggugg

SEQ ID NO: 1128141 - RNA, 22 nt, Human
uaagaacagugucugucucaca

SEQ ID NO: 1128142 - RNA, 22 nt, Human
uuuuuccuagcgauuugucagc

SEQ ID NO: 1128143 - RNA, 22 nt, Human
cugggcugcaucaaagaggcau

SEQ ID NO: 1128144 - RNA, 22 nt, Human
ccucugaggucauggacuuggc

SEQ ID NO: 1128145 - RNA, 22 nt, Human
ccugggcauaaaucacuccaag

SEQ ID NO: 1128146 - RNA, 22 nt, Human
ccucagcucuucccugugcaca

SEQ ID NO: 1128147 - RNA, 22 nt, Human
caaugguugauuaaaauuuagc

SEQ ID NO: 1128148 - RNA, 20 nt, Human
uuugagaccagucugcccaa

SEQ ID NO: 1128149 - RNA, 22 nt, Human
cccaggcuggagugcaauggug

SEQ ID NO: 1128150 - RNA, 22 nt, Human
caggugggccaugaaaaaugac

SEQ ID NO: 1128151 - RNA, 22 nt, Human
ucacugaauacuugucucaucc

SEQ ID NO: 1128152 - RNA, 22 nt, Human
gaacagcccuguuaagucuguu

SEQ ID NO: 1128153 - RNA, 22 nt, Human
uauugacaauuugugaaacuau

SEQ ID NO: 1128154 - RNA, 22 nt, Human
caggggcaagaaugcugucagc

SEQ ID NO: 1128155 - RNA, 22 nt, Human
caguuuuucaaaauuacaugau

SEQ ID NO: 1128156 - RNA, 22 nt, Human
agacagagauacuauguuguca

SEQ ID NO: 1128157 - RNA, 22 nt, Human
ugccugucuuuccucccucgua

SEQ ID NO: 1128158 - RNA, 22 nt, Human
cugaaggagguagagugacaua

SEQ ID NO: 1128159 - RNA, 22 nt, Human
aaugcuagugugauauguaagg

SEQ ID NO: 1128160 - RNA, 22 nt, Human
uauuuugacuauuaaaccaaca

SEQ ID NO: 1128161 - RNA, 22 nt, Human
aguguccccuccaagggccugg

SEQ ID NO: 1128162 - RNA, 22 nt, Human
aguauuuccuggcuuaucugcu

SEQ ID NO: 1128163 - RNA, 22 nt, Human
ugagcuggucuugaguguagcu

SEQ ID NO: 1128164 - RNA, 22 nt, Human
aagcugccaccagcccagggca

SEQ ID NO: 1128165 - RNA, 22 nt, Human
ucccaaggcacagggcagggac

SEQ ID NO: 1128166 - RNA, 22 nt, Human
aaaugguaagacaacacauuau

SEQ ID NO: 1128167 - RNA, 22 nt, Human
cagccaucccagccugugguuc

SEQ ID NO: 1128168 - RNA, 22 nt, Human
uuacuuugaugaucaaugagcg

SEQ ID NO: 1128169 - RNA, 22 nt, Human
cugugagcuggguggccaggac

SEQ ID NO: 1128170 - RNA, 22 nt, Human
cccugcagccggccagcucauu

SEQ ID NO: 1128171 - RNA, 22 nt, Human
cugcucugaguauuaacggagg

SEQ ID NO: 1128172 - RNA, 22 nt, Human
ugggccuguugccugaguccau

SEQ ID NO: 1128173 - RNA, 19 nt, Human
guggccugcgcugggugcg

SEQ ID NO: 1128174 - RNA, 21 nt, Human
aggaaguggccagauugggaa

SEQ ID NO: 1128175 - RNA, 22 nt, Human
cagguggcaugacugccuacaa

SEQ ID NO: 1128176 - RNA, 22 nt, Human
ccaggguggggcaggcccacug

SEQ ID NO: 1128177 - RNA, 22 nt, Human
gaggcugcuguuagcccugggc

SEQ ID NO: 1128178 - RNA, 22 nt, Human
acagagcugggaucugaaccca

SEQ ID NO: 1128179 - RNA, 22 nt, Human
cacucugcgcugggcgccagcg

SEQ ID NO: 1128180 - RNA, 18 nt, Human
ggcugccuguuccugaag

SEQ ID NO: 1128181 - RNA, 23 nt, Human
uugucugugcuuuuccaguugcu

SEQ ID NO: 1128182 - RNA, 22 nt, Human
ccucagaggugaacaucagugc

SEQ ID NO: 1128183 - RNA, 22 nt, Human
ucagaacagaagaaggaacacg

SEQ ID NO: 1128184 - RNA, 22 nt, Human
agagaacacgugcaucugcaau

SEQ ID NO: 1128185 - RNA, 22 nt, Human
cucugagcagaggccguggcua

SEQ ID NO: 1128186 - RNA, 22 nt, Human
agggagcuguggucagcucagu

SEQ ID NO: 1128187 - RNA, 22 nt, Human
ccucccacauugaggacaugcu

SEQ ID NO: 1128188 - RNA, 22 nt, Human
uccagcagguuggucaggugca

SEQ ID NO: 1128189 - RNA, 22 nt, Human
uuuguaaaaggaggaagcaugg

SEQ ID NO: 1128190 - RNA, 22 nt, Human
ccacaggaccagaggagaucac

SEQ ID NO: 1128191 - RNA, 22 nt, Human
ugauuuccucuacuagcaauua

SEQ ID NO: 1128192 - RNA, 22 nt, Human
auaaaaguaggaccaacuuaca

SEQ ID NO: 1128193 - RNA, 19 nt, Human
cuggggcuuugguacugcc

SEQ ID NO: 1128194 - RNA, 22 nt, Human
aaagccuuggucaucugguucc

SEQ ID NO: 1128195 - RNA, 22 nt, Human
ggucccaggcucccucuugucc

SEQ ID NO: 1128196 - RNA, 22 nt, Human
uggcuuucucccccagcuucuc

SEQ ID NO: 1128197 - RNA, 22 nt, Human
cacuggcaugugaggcgguggc

SEQ ID NO: 1128198 - RNA, 22 nt, Human
agacagcaugauacaugaugcu

SEQ ID NO: 1128199 - RNA, 22 nt, Human
gugugugcaagagguuuauuga

SEQ ID NO: 1128200 - RNA, 22 nt, Human
agggggcaggagagaccugcug

SEQ ID NO: 1128201 - RNA, 21 nt, Human
uccucugcucucauaccacaa

SEQ ID NO: 1128202 - RNA, 22 nt, Human
auguacaguuucuagacucaaa

SEQ ID NO: 1128203 - RNA, 22 nt, Human
acaugucaauuuaguacucuua

SEQ ID NO: 1128204 - RNA, 17 nt, Human
ucagcaggggccaagcu

SEQ ID NO: 1128205 - RNA, 22 nt, Human
auggauaagaacaaauaucuga

SEQ ID NO: 1128206 - RNA, 22 nt, Human
agggaagagcuugcaagaaacc

SEQ ID NO: 1128207 - RNA, 22 nt, Human
gagacaaaaguuggagugcaag

SEQ ID NO: 1128208 - RNA, 22 nt, Human
gggccugggaacuugcauuuag

SEQ ID NO: 1128209 - RNA, 19 nt, Human
auuuacugccuaaaaucuc

SEQ ID NO: 1128210 - RNA, 22 nt, Human
uucauuccuucuguaccuugcc

SEQ ID NO: 1128211 - RNA, 22 nt, Human
cuggagcuaauaauccaucuga

SEQ ID NO: 1128212 - RNA, 22 nt, Human
ugagacaguucugcagcugggu

SEQ ID NO: 1128213 - RNA, 23 nt, Human
agggguggucaguacccgcagug

SEQ ID NO: 1128214 - RNA, 19 nt, Human
uagcagcugccaaaggaga

SEQ ID NO: 1128215 - RNA, 22 nt, Human
gugcugucaauugcuuucagua

SEQ ID NO: 1128216 - RNA, 22 nt, Human
gaugauggacaaagcauuggug

SEQ ID NO: 1128217 - RNA, 22 nt, Human
caggcacuagcagaaugaggcu

SEQ ID NO: 1128218 - RNA, 22 nt, Human
accagcagaguugaggaggaca

SEQ ID NO: 1128219 - RNA, 22 nt, Human
accuggcaugaagcaugccuua

SEQ ID NO: 1128220 - RNA, 22 nt, Human
cagcaggggaacugugggccag

SEQ ID NO: 1128221 - RNA, 22 nt, Human
augggugugaaaauggucaucu

SEQ ID NO: 1128222 - RNA, 22 nt, Human
augucccagcugagagacaacu

SEQ ID NO: 1128223 - RNA, 19 nt, Human
uggcugggugccaauggcc

SEQ ID NO: 1128224 - RNA, 20 nt, Human
acugccuugguucaguaggu

SEQ ID NO: 1128225 - RNA, 22 nt, Human
cagagcuggagcuugaauggag

SEQ ID NO: 1128226 - RNA, 21 nt, Human
agcuggcagauauggugucug

SEQ ID NO: 1128227 - RNA, 22 nt, Human
aaggcucucugauggcagcagu

SEQ ID NO: 1128228 - RNA, 18 nt, Human
cauuguacaaugcuuuau

SEQ ID NO: 1128229 - RNA, 22 nt, Human
acagcuggaggccccauugucc

SEQ ID NO: 1128230 - RNA, 22 nt, Human
gagcucagauucuggugucaga

SEQ ID NO: 1128231 - RNA, 23 nt, Human
gucagggcuggggucagagugac

SEQ ID NO: 1128232 - RNA, 22 nt, Human
uggcucaguuuagcagcucagu

SEQ ID NO: 1128233 - RNA, 18 nt, Human
cagcugccagcucaugga

SEQ ID NO: 1128234 - RNA, 22 nt, Human
uauuucuguaacucagggucug

SEQ ID NO: 1128235 - RNA, 22 nt, Human
cugaggcaugaaugugggcuuu

SEQ ID NO: 1128236 - RNA, 17 nt, Human
agaugcuggccacaugu

SEQ ID NO: 1128237 - RNA, 22 nt, Human
gcugguuagaaaacagagcuca

SEQ ID NO: 1128238 - RNA, 22 nt, Human
ucaggaucaggggccuuuccuu

SEQ ID NO: 1128239 - RNA, 22 nt, Human
gccugucugcgucacgcuuauu

SEQ ID NO: 1128240 - RNA, 22 nt, Human
uggcuccuaucaaggagugggu

SEQ ID NO: 1128241 - RNA, 22 nt, Human
ucagcugagcuccagcucauag

SEQ ID NO: 1128242 - RNA, 22 nt, Human
gauaccagacagggagggagaa

SEQ ID NO: 1128243 - RNA, 22 nt, Human
agcagcugcagagggcuccccc

SEQ ID NO: 1128244 - RNA, 22 nt, Human
ggaaaaggccacagggacacau

SEQ ID NO: 1128245 - RNA, 22 nt, Human
ccuggugcuuaccagagcuuuu

SEQ ID NO: 1128246 - RNA, 22 nt, Human
aauacuuaugugaccucauuuu

SEQ ID NO: 1128247 - RNA, 22 nt, Human
gugggcuggacccuccugcucc

SEQ ID NO: 1128248 - RNA, 19 nt, Human
ccagucccauacaggagau

SEQ ID NO: 1128249 - RNA, 22 nt, Human
acugcagccuuugggcucauaa

SEQ ID NO: 1128250 - RNA, 22 nt, Human
caggcacugugcaagggucucg

SEQ ID NO: 1128251 - RNA, 22 nt, Human
ugagcuggucacuccuucugaa

SEQ ID NO: 1128252 - RNA, 22 nt, Human
ucagagugugacuuggucauga

SEQ ID NO: 1128253 - RNA, 22 nt, Human
ccuggagguggagguugcagug

SEQ ID NO: 1128254 - RNA, 22 nt, Human
caaagguauaaguuaauauaca

SEQ ID NO: 1128255 - RNA, 22 nt, Human
uggcuucugcuuucaguggagg

SEQ ID NO: 1128256 - RNA, 22 nt, Human
ugaagcagauggucuggucauu

SEQ ID NO: 1128257 - RNA, 22 nt, Human
gcuggcagguccaagauagagc

SEQ ID NO: 1128258 - RNA, 22 nt, Human
auuguaauuuuagagaaagugg

SEQ ID NO: 1128259 - RNA, 22 nt, Human
uuccuguccgcaauggccuggg

SEQ ID NO: 1128260 - RNA, 22 nt, Human
cagcagcccacgcgugcugucc

SEQ ID NO: 1128261 - RNA, 17 nt, Human
aaaauucuguaaagagg

SEQ ID NO: 1128262 - RNA, 22 nt, Human
agccuucaaccuagcuagagca

SEQ ID NO: 1128263 - RNA, 22 nt, Human
auaaauuuauaauuguuuccug

SEQ ID NO: 1128264 - RNA, 22 nt, Human
ucaaaugcacguagagaaaaua

SEQ ID NO: 1128265 - RNA, 22 nt, Human
augccacugacauggacaauuu

SEQ ID NO: 1128266 - RNA, 22 nt, Human
gaguggggcguggauccagcgu

SEQ ID NO: 1128267 - RNA, 22 nt, Human
aaaacucugcaguuaguuucua

SEQ ID NO: 1128268 - RNA, 22 nt, Human
aggcucugguuggcaaguaaag

SEQ ID NO: 1128269 - RNA, 22 nt, Human
ucacugcagagaccucuaguca

SEQ ID NO: 1128270 - RNA, 22 nt, Human
aucagcaaggcaaucacugcag

SEQ ID NO: 1128271 - RNA, 22 nt, Human
uggugcugauaauggcaggauu

SEQ ID NO: 1128272 - RNA, 22 nt, Human
cauacauaugcauguguguaua

SEQ ID NO: 1128273 - RNA, 22 nt, Human
aggcuggguaccugucauaugc

SEQ ID NO: 1128274 - RNA, 22 nt, Human
gcagaggcauuucugacgcugc

SEQ ID NO: 1128275 - RNA, 22 nt, Human
uggcucaggggucuggcucugu

SEQ ID NO: 1128276 - RNA, 22 nt, Human
gcucuccacugaccacggggca

SEQ ID NO: 1128277 - RNA, 22 nt, Human
aggggugaaagagggcccucaa

SEQ ID NO: 1128278 - RNA, 22 nt, Human
aaugcaguuucauuuguagaau

SEQ ID NO: 1128279 - RNA, 22 nt, Human
gcugcuccgucugagcucuggu

SEQ ID NO: 1128280 - RNA, 23 nt, Human
uccuccuuuugcuugugcuuccc

SEQ ID NO: 1128281 - RNA, 22 nt, Human
gacacagagauaggccuguguu

SEQ ID NO: 1128282 - RNA, 18 nt, Human
aggcacuggaauuaaggg

SEQ ID NO: 1128283 - RNA, 19 nt, Human
gaguuauugccagggcaug

SEQ ID NO: 1128284 - RNA, 22 nt, Human
cagcugccccuccagggcuggg

SEQ ID NO: 1128285 - RNA, 22 nt, Human
cagcugaggucaaagaagcagg

SEQ ID NO: 1128286 - RNA, 20 nt, Human
ccagguggugccuggagagg

SEQ ID NO: 1128287 - RNA, 22 nt, Human
acugccaggauggcacuagagg

SEQ ID NO: 1128288 - RNA, 22 nt, Human
ggggcagcucccgagggcagga

SEQ ID NO: 1128289 - RNA, 22 nt, Human
acuccagggcuccaucccuugu

SEQ ID NO: 1128290 - RNA, 22 nt, Human
uuaggcaauuuugucauugugu

SEQ ID NO: 1128291 - RNA, 17 nt, Human
aggcagcucagaacauc

SEQ ID NO: 1128292 - RNA, 22 nt, Human
uauucacaaaaugagguccuca

SEQ ID NO: 1128293 - RNA, 19 nt, Human
cagcaauaaugccagaugg

SEQ ID NO: 1128294 - RNA, 19 nt, Human
ggccaggcugacugugguc

SEQ ID NO: 1128295 - RNA, 19 nt, Human
ugaggccaaggucacagau

SEQ ID NO: 1128296 - RNA, 22 nt, Human
cugaggcuuugugugcaugccu

SEQ ID NO: 1128297 - RNA, 22 nt, Human
acagaauucucucugcagaggc

SEQ ID NO: 1128298 - RNA, 18 nt, Human
uuaagagcugaaagggga

SEQ ID NO: 1128299 - RNA, 22 nt, Human
aaugcacagcguuccaugcuug

SEQ ID NO: 1128300 - RNA, 22 nt, Human
ugguccugagcaccagccugac

SEQ ID NO: 1128301 - RNA, 22 nt, Human
caggccugugacaccgugucug

SEQ ID NO: 1128302 - RNA, 22 nt, Human
caguggucugugcuucuguaca

SEQ ID NO: 1128303 - RNA, 19 nt, Human
aggccugggguuuugcacu

SEQ ID NO: 1128304 - RNA, 22 nt, Human
cagcuugcuaauuuugacuuca

SEQ ID NO: 1128305 - RNA, 22 nt, Human
ugggcagacugagcccuguccc

SEQ ID NO: 1128306 - RNA, 22 nt, Human
cucagagucccuucccucgugg

SEQ ID NO: 1128307 - RNA, 22 nt, Human
gucaaguuuauccgcucauuca

SEQ ID NO: 1128308 - RNA, 22 nt, Human
ugacaccacaacuagccauuga

SEQ ID NO: 1128309 - RNA, 22 nt, Human
uccuuucccuuuccauccuggc

SEQ ID NO: 1128310 - RNA, 22 nt, Human
ccaggcucaggugcgagagaca

SEQ ID NO: 1128311 - RNA, 22 nt, Human
aggugagguuugggagguguca

SEQ ID NO: 1128312 - RNA, 22 nt, Human
acuccuggggauccauuccuuu

SEQ ID NO: 1128313 - RNA, 22 nt, Human
ucaggcaggcagagggcaaaug

SEQ ID NO: 1128314 - RNA, 22 nt, Human
uuucacauaaauauuaugccua

SEQ ID NO: 1128315 - RNA, 20 nt, Human
uauaacaguguugggugugu

SEQ ID NO: 1128316 - RNA, 20 nt, Human
agacccuguguccuguggcc

SEQ ID NO: 1128317 - RNA, 22 nt, Human
acauuucugcuagaauagguga

SEQ ID NO: 1128318 - RNA, 22 nt, Human
cagggcugguuugucgaagaaa

SEQ ID NO: 1128319 - RNA, 22 nt, Human
aggcagagaaaaaccagauaug

SEQ ID NO: 1128320 - RNA, 22 nt, Human
cgcagcagccccgugguaggug

SEQ ID NO: 1128321 - RNA, 21 nt, Human
gccuggcagguggaagggcuc

SEQ ID NO: 1128322 - RNA, 22 nt, Human
ucuggagccuuggaugggaaag

SEQ ID NO: 1128323 - RNA, 22 nt, Human
auggaagguccuacagagcgca

SEQ ID NO: 1128324 - RNA, 22 nt, Human
uguguguggggaggcagcagau

SEQ ID NO: 1128325 - RNA, 22 nt, Human
agauacaugucaagagacuuau

SEQ ID NO: 1128326 - RNA, 22 nt, Human
gacagcaggagaucaugauaga

SEQ ID NO: 1128327 - RNA, 22 nt, Human
cugaggcucaagggcagguggg

SEQ ID NO: 1128328 - RNA, 22 nt, Human
ccaggcauccauugcuuccucu

SEQ ID NO: 1128329 - RNA, 22 nt, Human
gugggcuucuguuagggaggcu

SEQ ID NO: 1128330 - RNA, 22 nt, Human
cagggcugugcccaucuucccc

SEQ ID NO: 1128331 - RNA, 22 nt, Human
ccugugugcacacgaggccaug

SEQ ID NO: 1128332 - RNA, 22 nt, Human
auuugucucugcacuuuacuca

SEQ ID NO: 1128333 - RNA, 22 nt, Human
caggcugcagaggccuuucaug

SEQ ID NO: 1128334 - RNA, 22 nt, Human
ccccuuccacagugcuuccuaa

SEQ ID NO: 1128335 - RNA, 22 nt, Human
cagagcugcaaaugccccuccg

SEQ ID NO: 1128336 - RNA, 22 nt, Human
gcugucugggaugucacugcug

SEQ ID NO: 1128337 - RNA, 22 nt, Human
cugagcugggcucucuugaggg

SEQ ID NO: 1128338 - RNA, 22 nt, Human
ucaccacugaacagaccuuugg

SEQ ID NO: 1128339 - RNA, 22 nt, Human
cugagggcaugaacauuccaua

SEQ ID NO: 1128340 - RNA, 22 nt, Human
gagccaggcaccuucuguguug

SEQ ID NO: 1128341 - RNA, 22 nt, Human
uugacagcaaagauugugccua

SEQ ID NO: 1128342 - RNA, 22 nt, Human
gcugcucucagagcucaugcug

SEQ ID NO: 1128343 - RNA, 22 nt, Human
agagugauucuaguuagggaau

SEQ ID NO: 1128344 - RNA, 22 nt, Human
gggugcugacuggggccugaaa

SEQ ID NO: 1128345 - RNA, 22 nt, Human
ucuggccugggccugccggugc

SEQ ID NO: 1128346 - RNA, 20 nt, Human
ggcagagcuaugucuguugc

SEQ ID NO: 1128347 - RNA, 22 nt, Human
caaaugcuggcccugcuacuua

SEQ ID NO: 1128348 - RNA, 22 nt, Human
ugcacagagagaugagacacgu

SEQ ID NO: 1128349 - RNA, 18 nt, Human
uucaccagugugaugggu

SEQ ID NO: 1128350 - RNA, 22 nt, Human
aggccucacucucagagcuucu

SEQ ID NO: 1128351 - RNA, 22 nt, Human
uuuugaaagaguccugcuacag

SEQ ID NO: 1128352 - RNA, 22 nt, Human
gcaggccuuggcaaugagccug

SEQ ID NO: 1128353 - RNA, 22 nt, Human
gcucaggauuucauccaugugu

SEQ ID NO: 1128354 - RNA, 22 nt, Human
uguacauugucacucaucaagu

SEQ ID NO: 1128355 - RNA, 22 nt, Human
uggcucagccuggcccuuucau

SEQ ID NO: 1128356 - RNA, 22 nt, Human
cugaagcacagcauauaaauaa

SEQ ID NO: 1128357 - RNA, 22 nt, Human
uucuuucccagaagauauguuu

SEQ ID NO: 1128358 - RNA, 22 nt, Human
gcucagagcacucagacucagc

SEQ ID NO: 1128359 - RNA, 22 nt, Human
uacauuccacuagugacuggcg

SEQ ID NO: 1128360 - RNA, 22 nt, Human
ggagugacucucggggccacua

SEQ ID NO: 1128361 - RNA, 18 nt, Human
acauacauucugucugca

SEQ ID NO: 1128362 - RNA, 22 nt, Human
aagacauuacuggaaucugacu

SEQ ID NO: 1128363 - RNA, 17 nt, Human
uucaaugauuaaugcau

SEQ ID NO: 1128364 - RNA, 22 nt, Human
aaagaggaaccaagagcacgug

SEQ ID NO: 1128365 - RNA, 22 nt, Human
cauggccugccuccuccuggug

SEQ ID NO: 1128366 - RNA, 22 nt, Human
cuggugguucaggagaauggcu

SEQ ID NO: 1128367 - RNA, 22 nt, Human
cagucccaaggaggaagcaguc

SEQ ID NO: 1128368 - RNA, 22 nt, Human
uccagggacagcgcuggagcua

SEQ ID NO: 1128369 - RNA, 22 nt, Human
acauuucuauagugcaucuguu

SEQ ID NO: 1128370 - RNA, 22 nt, Human
gcugucacauuuggagcacugg

SEQ ID NO: 1128371 - RNA, 22 nt, Human
ucuuugcaugcauuuucccuua

SEQ ID NO: 1128372 - RNA, 22 nt, Human
ugcuagaaaucugaaacuagca

SEQ ID NO: 1128373 - RNA, 20 nt, Human
cagagaccugucuucacaga

SEQ ID NO: 1128374 - RNA, 23 nt, Human
ccugggcauuggcugcagcuucu

SEQ ID NO: 1128375 - RNA, 22 nt, Human
uccagggccaagucauggaacc

SEQ ID NO: 1128376 - RNA, 22 nt, Human
cagagccagcccacuguucccg

SEQ ID NO: 1128377 - RNA, 22 nt, Human
auacaucuugucagauucaugu

SEQ ID NO: 1128378 - RNA, 22 nt, Human
cccagcucaagcagagagcuaa

SEQ ID NO: 1128379 - RNA, 22 nt, Human
agucagugaaggcauugcucaa

SEQ ID NO: 1128380 - RNA, 22 nt, Human
ugggcagagaguagaggcaacg

SEQ ID NO: 1128381 - RNA, 22 nt, Human
uccucagggggccaacccagcc

SEQ ID NO: 1128382 - RNA, 22 nt, Human
gcccagcuccucugcagacccu

SEQ ID NO: 1128383 - RNA, 22 nt, Human
cuguacaucccgagagccagua

SEQ ID NO: 1128384 - RNA, 22 nt, Human
accccagcccugcuucugggag

SEQ ID NO: 1128385 - RNA, 22 nt, Human
uggagcaggcaucuuucucucu

SEQ ID NO: 1128386 - RNA, 22 nt, Human
uccaugugccaaggggcagagg

SEQ ID NO: 1128387 - RNA, 22 nt, Human
ugggcugcccaagguggccaug

SEQ ID NO: 1128388 - RNA, 22 nt, Human
aauucauccaugaacaauucca

SEQ ID NO: 1128389 - RNA, 22 nt, Human
uauuuugagguauuuuugagcu

SEQ ID NO: 1128390 - RNA, 22 nt, Human
caugggcuacagaagcaugcug

SEQ ID NO: 1128391 - RNA, 22 nt, Human
acaggagugaaucuggcacuua

SEQ ID NO: 1128392 - RNA, 22 nt, Human
aaauguauccuacuuccugagu

SEQ ID NO: 1128393 - RNA, 17 nt, Human
uuccaguuuaguauugu

SEQ ID NO: 1128394 - RNA, 22 nt, Human
cucugcugcccaggccugcuag

SEQ ID NO: 1128395 - RNA, 22 nt, Human
augguguagcaugugauaugac

SEQ ID NO: 1128396 - RNA, 22 nt, Human
agaauuguugggguaauaaaag

SEQ ID NO: 1128397 - RNA, 18 nt, Human
uccagcgugcuccagggc

SEQ ID NO: 1128398 - RNA, 22 nt, Human
gcuggcccagggucaccuagga

SEQ ID NO: 1128399 - RNA, 22 nt, Human
agucuccuuggccucaaugccu

SEQ ID NO: 1128400 - RNA, 22 nt, Human
gcagcuuuuuggaugucaguua

SEQ ID NO: 1128401 - RNA, 19 nt, Human
agagaggcugugugaggga

SEQ ID NO: 1128402 - RNA, 22 nt, Human
cuggagccagccagggcccucu

SEQ ID NO: 1128403 - RNA, 22 nt, Human
gcagagugauggaaugugggug

SEQ ID NO: 1128404 - RNA, 18 nt, Human
cugagggcagccccuggg

SEQ ID NO: 1128405 - RNA, 22 nt, Human
ggucccugcugaagccuuggug

SEQ ID NO: 1128406 - RNA, 22 nt, Human
ugggggagccuucacaguagcu

SEQ ID NO: 1128407 - RNA, 22 nt, Human
augccuggacugacaugcacug

SEQ ID NO: 1128408 - RNA, 22 nt, Human
gggccagagcuuggcagcuggg

SEQ ID NO: 1128409 - RNA, 22 nt, Human
uuaguaaauaaagucuacuuuc

SEQ ID NO: 1128410 - RNA, 22 nt, Human
aaagauuuaagaauaauuugug

SEQ ID NO: 1128411 - RNA, 22 nt, Human
ucccagaggucucugcugguuc

SEQ ID NO: 1128412 - RNA, 22 nt, Human
gcucaagagagaugcaguucuu

SEQ ID NO: 1128413 - RNA, 22 nt, Human
ggcagcuggccuccucgcccac

SEQ ID NO: 1128414 - RNA, 22 nt, Human
ccccaccugugcgucugccgca

SEQ ID NO: 1128415 - RNA, 19 nt, Human
gcuccugggccucacucau

SEQ ID NO: 1128416 - RNA, 22 nt, Human
uggagcagcaucacuuugagcu

SEQ ID NO: 1128417 - RNA, 19 nt, Human
gcucugugaugcugagggg

SEQ ID NO: 1128418 - RNA, 22 nt, Human
gcagggaggaagagaugcuucc

SEQ ID NO: 1128419 - RNA, 19 nt, Human
aggcugcaagguggugggc

SEQ ID NO: 1128420 - RNA, 22 nt, Human
acaguaccugcucucaagcaaa

SEQ ID NO: 1128421 - RNA, 22 nt, Human
uucuuuccacagaggggaugau

SEQ ID NO: 1128422 - RNA, 22 nt, Human
gaagcagcuggugagauggagc

SEQ ID NO: 1128423 - RNA, 22 nt, Human
guaugugugcaaauguaaauau

SEQ ID NO: 1128424 - RNA, 22 nt, Human
uuuuucaugagacuagaaguca

SEQ ID NO: 1128425 - RNA, 22 nt, Human
caggcuggagugaguguagugg

SEQ ID NO: 1128426 - RNA, 22 nt, Human
auguacauuuuccuaauguuuu

SEQ ID NO: 1128427 - RNA, 22 nt, Human
cucucuggaagggggagcugau

SEQ ID NO: 1128428 - RNA, 22 nt, Human
ugggaauggaugcuaagugcua

SEQ ID NO: 1128429 - RNA, 22 nt, Human
uggaaagaauuccuaugguuca

SEQ ID NO: 1128430 - RNA, 22 nt, Human
auccaaaucaugucagaagaac

SEQ ID NO: 1128431 - RNA, 22 nt, Human
uugcaccaaaugaguuaaaauu

SEQ ID NO: 1128432 - RNA, 22 nt, Human
gcagggccuuagcagcggcugc

SEQ ID NO: 1128433 - RNA, 22 nt, Human
uggcccugcuaugauccugcaa

SEQ ID NO: 1128434 - RNA, 22 nt, Human
caagagcuagaaauugguuaga

SEQ ID NO: 1128435 - RNA, 22 nt, Human
auguguguacacacgugacucu

SEQ ID NO: 1128436 - RNA, 22 nt, Human
ggggugggguuacucauugugc

SEQ ID NO: 1128437 - RNA, 22 nt, Human
gaggggcuggcuguggucccau

SEQ ID NO: 1128438 - RNA, 19 nt, Human
uagcugccuguuaccucca

SEQ ID NO: 1128439 - RNA, 22 nt, Human
agugggcaugaucuggugucug

SEQ ID NO: 1128440 - RNA, 22 nt, Human
cucccugguguccccuccagga

SEQ ID NO: 1128441 - RNA, 19 nt, Human
uagaaugcccacuuaaaaa

SEQ ID NO: 1128442 - RNA, 22 nt, Human
uugaccauaccuccaggcaguu

SEQ ID NO: 1128443 - RNA, 22 nt, Human
cugaagcaaaugaaacagcucu

SEQ ID NO: 1128444 - RNA, 23 nt, Human
gcugucugucaucucugcgggag

SEQ ID NO: 1128445 - RNA, 22 nt, Human
cagguacacucccuugugcuga

SEQ ID NO: 1128446 - RNA, 22 nt, Human
ccaaaguccauaguuuacuuua

SEQ ID NO: 1128447 - RNA, 22 nt, Human
ccuccugggcuccugucugcac

SEQ ID NO: 1128448 - RNA, 22 nt, Human
ccagucccagcucugccaugcu

SEQ ID NO: 1128449 - RNA, 22 nt, Human
cacucugacuggcccugcagga

SEQ ID NO: 1128450 - RNA, 22 nt, Human
uagcagagcagggaucagagcc

SEQ ID NO: 1128451 - RNA, 22 nt, Human
agaggcagcagucauacuacag

SEQ ID NO: 1128452 - RNA, 22 nt, Human
ucucagaguuuagagcugagcc

SEQ ID NO: 1128453 - RNA, 22 nt, Human
ggcagcagcaagguuggagcug

SEQ ID NO: 1128454 - RNA, 22 nt, Human
ucaaaugcugccuuugugugcc

SEQ ID NO: 1128455 - RNA, 22 nt, Human
uggccugcagaggcuguggggc

SEQ ID NO: 1128456 - RNA, 22 nt, Human
agcaggaggguuuuguagaguc

SEQ ID NO: 1128457 - RNA, 22 nt, Human
uccucugcuccaggcuggacuu

SEQ ID NO: 1128458 - RNA, 22 nt, Human
ccaucagcuccaguaucuucug

SEQ ID NO: 1128459 - RNA, 21 nt, Human
gggugggaggacacagcaggc

SEQ ID NO: 1128460 - RNA, 20 nt, Human
ugcagcugcaggaggguggg

SEQ ID NO: 1128461 - RNA, 23 nt, Human
cagggcugguagggaagagcgug

SEQ ID NO: 1128462 - RNA, 22 nt, Human
augaaggauggcuggcugcccu

SEQ ID NO: 1128463 - RNA, 22 nt, Human
caagggaguuacugagggcggg

SEQ ID NO: 1128464 - RNA, 22 nt, Human
ugauuuccaaaaggcuucuaag

SEQ ID NO: 1128465 - RNA, 22 nt, Human
guggccugggguuuguucugag

SEQ ID NO: 1128466 - RNA, 19 nt, Human
uguagcaguuuaaaacaac

SEQ ID NO: 1128467 - RNA, 22 nt, Human
guuugcauggaagacagugagu

SEQ ID NO: 1128468 - RNA, 22 nt, Human
caggguggcacucagcgcaucu

SEQ ID NO: 1128469 - RNA, 22 nt, Human
uuugcauucuagaaaaauuucu

SEQ ID NO: 1128470 - RNA, 22 nt, Human
cuuaacagcaagaucuguguca

SEQ ID NO: 1128471 - RNA, 22 nt, Human
aaguuacuggcaagggcugcag

SEQ ID NO: 1128472 - RNA, 22 nt, Human
uacuuuaaaaacugauaauuca

SEQ ID NO: 1128473 - RNA, 22 nt, Human
uguauagaguuggaagaugacu

SEQ ID NO: 1128474 - RNA, 22 nt, Human
gaguuauuggguggaaagguag

SEQ ID NO: 1128475 - RNA, 22 nt, Human
cugggccauggaagucucugcc

SEQ ID NO: 1128476 - RNA, 22 nt, Human
auguguaaaaagugcuuaauau

SEQ ID NO: 1128477 - RNA, 22 nt, Human
cagggcagaaggcacucuacuc

SEQ ID NO: 1128478 - RNA, 20 nt, Human
aggaaaaauggaaacuggag

SEQ ID NO: 1128479 - RNA, 22 nt, Human
aggugcagcugacaccaugugg

SEQ ID NO: 1128480 - RNA, 22 nt, Human
uccuggcccacuaugccagcau

SEQ ID NO: 1128481 - RNA, 22 nt, Human
caauguguuugcauauuaaaau

SEQ ID NO: 1128482 - RNA, 22 nt, Human
aagacauuuauuugaaucaauu

SEQ ID NO: 1128483 - RNA, 22 nt, Human
ggcugccuugacccuggcuccg

SEQ ID NO: 1128484 - RNA, 23 nt, Human
aggagccaggaaccagcuucccc

SEQ ID NO: 1128485 - RNA, 22 nt, Human
aggcugcuuucauggccgcccc

SEQ ID NO: 1128486 - RNA, 22 nt, Human
auguguaggugaaucgaggcug

SEQ ID NO: 1128487 - RNA, 22 nt, Human
acaggggaauuuacugucauua

SEQ ID NO: 1128488 - RNA, 22 nt, Human
ugucucagggcagcagcagggg

SEQ ID NO: 1128489 - RNA, 22 nt, Human
gaaggagggugcggaucugagc

SEQ ID NO: 1128490 - RNA, 22 nt, Human
aaugcacauguuguaauaaaua

SEQ ID NO: 1128491 - RNA, 22 nt, Human
gaagagcuuaguuguccuagaa

SEQ ID NO: 1128492 - RNA, 22 nt, Human
ugagaauuacaaaugagucaca

SEQ ID NO: 1128493 - RNA, 22 nt, Human
gugcagguguuuuggcugccag

SEQ ID NO: 1128494 - RNA, 22 nt, Human
cuggcuuccaugcuguaguggc

SEQ ID NO: 1128495 - RNA, 20 nt, Human
uguuccaugacuauuuggau

SEQ ID NO: 1128496 - RNA, 22 nt, Human
cucugggcaaagaugccucauc

SEQ ID NO: 1128497 - RNA, 22 nt, Human
cugcuggggucagagcacuggg

SEQ ID NO: 1128498 - RNA, 22 nt, Human
ccucuggggguccucagagucu

SEQ ID NO: 1128499 - RNA, 22 nt, Human
gggcuucucuuuagugagcuga

SEQ ID NO: 1128500 - RNA, 22 nt, Human
cuggaggcugaguugggucucc

SEQ ID NO: 1128501 - RNA, 22 nt, Human
uagaaaugcaguguacuguguc

SEQ ID NO: 1128502 - RNA, 22 nt, Human
ggccucuggcaggcaggcccuc

SEQ ID NO: 1128503 - RNA, 22 nt, Human
ccaggugguucaggucaccaua

SEQ ID NO: 1128504 - RNA, 22 nt, Human
guaugugucuuagaacuuggga

SEQ ID NO: 1128505 - RNA, 22 nt, Human
gaggccugaggcugccuggagc

SEQ ID NO: 1128506 - RNA, 19 nt, Human
ugcagccacgugagagacu

SEQ ID NO: 1128507 - RNA, 17 nt, Human
cauguguaugugggagu

SEQ ID NO: 1128508 - RNA, 22 nt, Human
gggaaggagccugcuugcuaga

SEQ ID NO: 1128509 - RNA, 22 nt, Human
aaaguguugggauuacaggugu

SEQ ID NO: 1128510 - RNA, 22 nt, Human
uguagcacagagcuuugacacu

SEQ ID NO: 1128511 - RNA, 22 nt, Human
aaggcugaggagggccugcagg

SEQ ID NO: 1128512 - RNA, 22 nt, Human
ggcagcucugugucugggaagc

SEQ ID NO: 1128513 - RNA, 22 nt, Human
cagaauuuuucgaauguacugu

SEQ ID NO: 1128514 - RNA, 22 nt, Human
ugugucccuuggaaccucagcu

SEQ ID NO: 1128515 - RNA, 22 nt, Human
caggaggaaaugugacccugcu

SEQ ID NO: 1128516 - RNA, 22 nt, Human
gucucagauucagacaucuaca

SEQ ID NO: 1128517 - RNA, 22 nt, Human
agggcccaggacagcaucaggg

SEQ ID NO: 1128518 - RNA, 22 nt, Human
cagccuucugaaugaacguacu

SEQ ID NO: 1128519 - RNA, 22 nt, Human
ugcacacaaguuggagaaugaa

SEQ ID NO: 1128520 - RNA, 18 nt, Human
ccaauguuggccccaagg

SEQ ID NO: 1128521 - RNA, 22 nt, Human
uacaguuuguuacauuguuagu

SEQ ID NO: 1128522 - RNA, 22 nt, Human
aaguaaaagcuuuaccaugcgc

SEQ ID NO: 1128523 - RNA, 22 nt, Human
cagaaguaagauuacugugaga

SEQ ID NO: 1128524 - RNA, 22 nt, Human
uucuuuccaaccagauauuggu

SEQ ID NO: 1128525 - RNA, 19 nt, Human
ucaguuuuagucaucaguu

SEQ ID NO: 1128526 - RNA, 22 nt, Human
uguacacugcaggaugcauugc

SEQ ID NO: 1128527 - RNA, 22 nt, Human
gagacagcagggccagggccug

SEQ ID NO: 1128528 - RNA, 22 nt, Human
ucuguaucuaauuuuacaguag

SEQ ID NO: 1128529 - RNA, 20 nt, Human
ccugaggguuuguguucuuu

SEQ ID NO: 1128530 - RNA, 18 nt, Human
ucuuggaguaaugaucaa

SEQ ID NO: 1128531 - RNA, 21 nt, Human
uccucugcagugagguggccu

SEQ ID NO: 1128532 - RNA, 22 nt, Human
agcucccagucuccucuccaug

SEQ ID NO: 1128533 - RNA, 22 nt, Human
aguccuucaagaaaucuggaaa

SEQ ID NO: 1128534 - RNA, 22 nt, Human
cugugugugucugcagcauacu

SEQ ID NO: 1128535 - RNA, 22 nt, Human
cagcagagcugugugggaaggg

SEQ ID NO: 1128536 - RNA, 22 nt, Human
acaggcugcccgcuccccaccu

SEQ ID NO: 1128537 - RNA, 21 nt, Human
agcagaggggacauguuugau

SEQ ID NO: 1128538 - RNA, 22 nt, Human
cagagccaggccugcccucuuu

SEQ ID NO: 1128539 - RNA, 22 nt, Human
ggccucuguucugcauuccucc

SEQ ID NO: 1128540 - RNA, 22 nt, Human
ucucugauguauaucagagaac

SEQ ID NO: 1128541 - RNA, 19 nt, Human
ugagaaggcaguggggagc

SEQ ID NO: 1128542 - RNA, 21 nt, Human
uggcucaguugcugggcacag

SEQ ID NO: 1128543 - RNA, 22 nt, Human
ccuggaaguuggagguugcagu

SEQ ID NO: 1128544 - RNA, 22 nt, Human
ccagagacgucggucagggcgc

SEQ ID NO: 1128545 - RNA, 22 nt, Human
cuggcugggagcgagcugcuca

SEQ ID NO: 1128546 - RNA, 22 nt, Human
ccugggugacccgugagcgucc

SEQ ID NO: 1128547 - RNA, 22 nt, Human
uggcuaggcuccaagagcugga

SEQ ID NO: 1128548 - RNA, 22 nt, Human
uuucaguggguuuauuucaugu

SEQ ID NO: 1128549 - RNA, 22 nt, Human
cagcaguggaacuacccaggga

SEQ ID NO: 1128550 - RNA, 22 nt, Human
gcucaggaaacagcagggcuug

SEQ ID NO: 1128551 - RNA, 22 nt, Human
gggcugcugccaaucacagccu

SEQ ID NO: 1128552 - RNA, 22 nt, Human
aagccuugccuauuugaugaca

SEQ ID NO: 1128553 - RNA, 22 nt, Human
uaugcacauucacacaaaaaug

SEQ ID NO: 1128554 - RNA, 22 nt, Human
caauguuuacuggggacccaga

SEQ ID NO: 1128555 - RNA, 23 nt, Human
ugcucugggaggcccuggagagc

SEQ ID NO: 1128556 - RNA, 22 nt, Human
auguucaaacuuuuuacacacc

SEQ ID NO: 1128557 - RNA, 22 nt, Human
uggagcugagagccaggcuggc

SEQ ID NO: 1128558 - RNA, 23 nt, Human
cuugcagggcuggaggcuuagaa

SEQ ID NO: 1128559 - RNA, 22 nt, Human
gugagcaggauuucauggugua

SEQ ID NO: 1128560 - RNA, 22 nt, Human
agggccagcccauaaugccaaa

SEQ ID NO: 1128561 - RNA, 22 nt, Human
ugcuuccugaggccgucuucuc

SEQ ID NO: 1128562 - RNA, 22 nt, Human
agugaaauccuggucaacaggu

SEQ ID NO: 1128563 - RNA, 22 nt, Human
cuggagccaugucuugacugcu

SEQ ID NO: 1128564 - RNA, 21 nt, Human
ucacuuauaauguauuugcug

SEQ ID NO: 1128565 - RNA, 19 nt, Human
acaaagcugugagcagcuu

SEQ ID NO: 1128566 - RNA, 22 nt, Human
ggaggaugccaagcugugcaca

SEQ ID NO: 1128567 - RNA, 22 nt, Human
agccucucugaugugacagcua

SEQ ID NO: 1128568 - RNA, 22 nt, Human
uuaaacagacaguaaaugaaac

SEQ ID NO: 1128569 - RNA, 22 nt, Human
gggagggaaagcuugaucuguc

SEQ ID NO: 1128570 - RNA, 22 nt, Human
ccugggcaacauagugagaccu

SEQ ID NO: 1128571 - RNA, 22 nt, Human
gcucccagcaauugaggcagcc

SEQ ID NO: 1128572 - RNA, 21 nt, Human
gggcuggacaugguggcucau

SEQ ID NO: 1128573 - RNA, 20 nt, Human
cccugagacaaaggaggggc

SEQ ID NO: 1128574 - RNA, 22 nt, Human
uggagcucaaaggccuguggga

SEQ ID NO: 1128575 - RNA, 22 nt, Human
aagagcuggcucuugcagcagc

SEQ ID NO: 1128576 - RNA, 22 nt, Human
gcagaacauuucacaguaucuu

SEQ ID NO: 1128577 - RNA, 22 nt, Human
ucccagagcucugacaccagcu

SEQ ID NO: 1128578 - RNA, 22 nt, Human
aucauuccacauguaccacuag

SEQ ID NO: 1128579 - RNA, 22 nt, Human
ugggacaguuguccuccacucu

SEQ ID NO: 1128580 - RNA, 22 nt, Human
ggcagcaguccauggcccaagg

SEQ ID NO: 1128581 - RNA, 22 nt, Human
ccucugagagaaggccuucagc

SEQ ID NO: 1128582 - RNA, 22 nt, Human
ggagccaguuuagaccucaguu

SEQ ID NO: 1128583 - RNA, 22 nt, Human
uauguagaagcugcucaaagaa

SEQ ID NO: 1128584 - RNA, 22 nt, Human
gcagagguggcaucugggcucu

SEQ ID NO: 1128585 - RNA, 22 nt, Human
aggucauuguuaagucaccaua

SEQ ID NO: 1128586 - RNA, 22 nt, Human
ucacauuuucuacuacuguacg

SEQ ID NO: 1128587 - RNA, 22 nt, Human
cgcaccacugaauuccagccug

SEQ ID NO: 1128588 - RNA, 22 nt, Human
ucagugcagaauagugaugcau

SEQ ID NO: 1128589 - RNA, 22 nt, Human
agugucauuuuguccaucuucu

SEQ ID NO: 1128590 - RNA, 22 nt, Human
ccuggccucgugcucacggcuc

SEQ ID NO: 1128591 - RNA, 22 nt, Human
gagagcugauagaugagcuacu

SEQ ID NO: 1128592 - RNA, 22 nt, Human
auaugcauaugucaaaacuuau

SEQ ID NO: 1128593 - RNA, 22 nt, Human
agcccagccggauucccaguuc

SEQ ID NO: 1128594 - RNA, 19 nt, Human
gcauuucucuuuacagcca

SEQ ID NO: 1128595 - RNA, 22 nt, Human
ucauccuuuugcaugggaaggc

SEQ ID NO: 1128596 - RNA, 20 nt, Human
cucugcugcccgccggcugc

SEQ ID NO: 1128597 - RNA, 22 nt, Human
auguguauacuugugcuuacuc

SEQ ID NO: 1128598 - RNA, 22 nt, Human
uggagccagcccaggccccucu

SEQ ID NO: 1128599 - RNA, 22 nt, Human
uugucugaaagaucauuacauu

SEQ ID NO: 1128600 - RNA, 22 nt, Human
uguuccaugucuuuguaggacu

SEQ ID NO: 1128601 - RNA, 22 nt, Human
acuuuauuuccuauugcaucca

SEQ ID NO: 1128602 - RNA, 22 nt, Human
agcagccaaccuuacauucauc

SEQ ID NO: 1128603 - RNA, 22 nt, Human
cccaggcucccaggugggacaa

SEQ ID NO: 1128604 - RNA, 22 nt, Human
ccaggccaaauucagucagcag

SEQ ID NO: 1128605 - RNA, 22 nt, Human
guucacauccuugugaggauuu

SEQ ID NO: 1128606 - RNA, 22 nt, Human
ugaagacagaccaaggagaaug

SEQ ID NO: 1128607 - RNA, 22 nt, Human
gccugagcccaggugugcagag

SEQ ID NO: 1128608 - RNA, 22 nt, Human
cugcccugggauggucugugcg

SEQ ID NO: 1128609 - RNA, 22 nt, Human
ugggcuggagcuuguugcuucc

SEQ ID NO: 1128610 - RNA, 22 nt, Human
uccuccuucgggacugcuugac

SEQ ID NO: 1128611 - RNA, 22 nt, Human
ugcugggcuagaagcugaggcc

SEQ ID NO: 1128612 - RNA, 22 nt, Human
uaaugcacauagaaguacuuag

SEQ ID NO: 1128613 - RNA, 22 nt, Human
uccuucagcuacucaguuucca

SEQ ID NO: 1128614 - RNA, 22 nt, Human
cagggcagugaagaacacacgu

SEQ ID NO: 1128615 - RNA, 19 nt, Human
ugucucagugucccuuccu

SEQ ID NO: 1128616 - RNA, 22 nt, Human
caagagcuggguggcaagcuag

SEQ ID NO: 1128617 - RNA, 22 nt, Human
ucaaggaggugcuuggcuucac

SEQ ID NO: 1128618 - RNA, 22 nt, Human
gaagcagcagcuggggacaguu

SEQ ID NO: 1128619 - RNA, 20 nt, Human
ugcuguaagauuagagagcu

SEQ ID NO: 1128620 - RNA, 22 nt, Human
cacugcaguaacucuaggacug

SEQ ID NO: 1128621 - RNA, 22 nt, Human
ugugugugugcgcgcacgcaua

SEQ ID NO: 1128622 - RNA, 22 nt, Human
ugcugcuccugccuggcuccca

SEQ ID NO: 1128623 - RNA, 22 nt, Human
uggccugaauuauggcagaucu

SEQ ID NO: 1128624 - RNA, 22 nt, Human
uguauguaaaguuuguaauaga

SEQ ID NO: 1128625 - RNA, 22 nt, Human
gaacaguaaauuuaugcagcac

SEQ ID NO: 1128626 - RNA, 22 nt, Human
gcugcucuugaggggcucacug

SEQ ID NO: 1128627 - RNA, 22 nt, Human
aggaggccgggauucuggagau

SEQ ID NO: 1128628 - RNA, 22 nt, Human
cccagcacaggcaauuccauac

SEQ ID NO: 1128629 - RNA, 22 nt, Human
aagauacauaaagguagagucu

SEQ ID NO: 1128630 - RNA, 22 nt, Human
gagcugccaagauuacaaucag

SEQ ID NO: 1128631 - RNA, 22 nt, Human
acagcagccuuguugguuucga

SEQ ID NO: 1128632 - RNA, 22 nt, Human
caguugaugggacucauguggg

SEQ ID NO: 1128633 - RNA, 22 nt, Human
agaggagguggugaugcuuuaa

SEQ ID NO: 1128634 - RNA, 19 nt, Human
ggcugucucggcccagcca

SEQ ID NO: 1128635 - RNA, 22 nt, Human
caggagccccaggcugacaaua

SEQ ID NO: 1128636 - RNA, 22 nt, Human
aggcuggcgacaucuggcgggc

SEQ ID NO: 1128637 - RNA, 22 nt, Human
caaugauucugcaacugugugc

SEQ ID NO: 1128638 - RNA, 22 nt, Human
ggcugagggccagggcuagucu

SEQ ID NO: 1128639 - RNA, 22 nt, Human
ggucucaggagacuggagagca

SEQ ID NO: 1128640 - RNA, 22 nt, Human
aacaugaaaguugcuaagugca

SEQ ID NO: 1128641 - RNA, 22 nt, Human
gggcugccaagccugccugccu

SEQ ID NO: 1128642 - RNA, 22 nt, Human
ucagaguggugguuuugccuuc

SEQ ID NO: 1128643 - RNA, 22 nt, Human
auguguguaaacaaguauaauu

SEQ ID NO: 1128644 - RNA, 22 nt, Human
aaggcagcccuggcucagccug

SEQ ID NO: 1128645 - RNA, 20 nt, Human
uuguuucugcuauuuucuaa

SEQ ID NO: 1128646 - RNA, 22 nt, Human
ugcucuggagggugaagcuuuu

SEQ ID NO: 1128647 - RNA, 22 nt, Human
cugcucuggggaagccagaugu

SEQ ID NO: 1128648 - RNA, 22 nt, Human
ucuucuccagugcuucugcaca

SEQ ID NO: 1128649 - RNA, 22 nt, Human
uagagugguuaacaguuuagaa

SEQ ID NO: 1128650 - RNA, 22 nt, Human
cugcucuggcguacucggcauc

SEQ ID NO: 1128651 - RNA, 23 nt, Human
cuguggcugaguccuguuggagu

SEQ ID NO: 1128652 - RNA, 22 nt, Human
gugccugcagcaauccauggca

SEQ ID NO: 1128653 - RNA, 22 nt, Human
ucugucacaauuugcuuacucu

SEQ ID NO: 1128654 - RNA, 21 nt, Human
cugugcuucuuccuaagccag

SEQ ID NO: 1128655 - RNA, 22 nt, Human
aaguuuguuguacauguuagua

SEQ ID NO: 1128656 - RNA, 22 nt, Human
gucaaacaaauuaacauaucca

SEQ ID NO: 1128657 - RNA, 22 nt, Human
aagagcugcaucuaagccauga

SEQ ID NO: 1128658 - RNA, 22 nt, Human
agaaauguauucuguauguuuu

SEQ ID NO: 1128659 - RNA, 22 nt, Human
gccuuggccuuccuaggccuga

SEQ ID NO: 1128660 - RNA, 22 nt, Human
ugccucagagugggcuugcuau

SEQ ID NO: 1128661 - RNA, 22 nt, Human
aaagguaguacuucuagaaggg

SEQ ID NO: 1128662 - RNA, 22 nt, Human
augaaaacuuuagccucauuag

SEQ ID NO: 1128663 - RNA, 22 nt, Human
aggccagagaggggaccagccu

SEQ ID NO: 1128664 - RNA, 22 nt, Human
gccagcucccaagugagccccu

SEQ ID NO: 1128665 - RNA, 22 nt, Human
ccagcugacgaugccuggucuc

SEQ ID NO: 1128666 - RNA, 22 nt, Human
gccagcagguugucaaggagcu

SEQ ID NO: 1128667 - RNA, 22 nt, Human
accucccagcucugagcuuggg

SEQ ID NO: 1128668 - RNA, 22 nt, Human
ugcugaggucaccuugcugcua

SEQ ID NO: 1128669 - RNA, 22 nt, Human
agagugauggguugugcugacc

SEQ ID NO: 1128670 - RNA, 22 nt, Human
cugagcuuccaguuccuccagg

SEQ ID NO: 1128671 - RNA, 21 nt, Human
gccugccugcgugacccucuu

SEQ ID NO: 1128672 - RNA, 22 nt, Human
uggccuggaaccuggcagggac

SEQ ID NO: 1128673 - RNA, 22 nt, Human
cuguccauuuucgugccuccuu

SEQ ID NO: 1128674 - RNA, 22 nt, Human
caggccuggcccccggcacacc

SEQ ID NO: 1128675 - RNA, 22 nt, Human
agcagccaagguaaccugugcu

SEQ ID NO: 1128676 - RNA, 22 nt, Human
ccagcaccuugaucuuggaguu

SEQ ID NO: 1128677 - RNA, 22 nt, Human
ugcuaucucuauauccauuuau

SEQ ID NO: 1128678 - RNA, 22 nt, Human
gccaggcuggucuugaacuccu

SEQ ID NO: 1128679 - RNA, 22 nt, Human
caggaaagaaaugagaacacca

SEQ ID NO: 1128680 - RNA, 22 nt, Human
cugugcuggagaugggccagag

SEQ ID NO: 1128681 - RNA, 22 nt, Human
caugucuguguacacaugcaca

SEQ ID NO: 1128682 - RNA, 22 nt, Human
agggcuggcaagggauugaaau

SEQ ID NO: 1128683 - RNA, 22 nt, Human
cucuguccuaugcuugauagaa

SEQ ID NO: 1128684 - RNA, 22 nt, Human
guauccuuugcggaaauuucua

SEQ ID NO: 1128685 - RNA, 21 nt, Human
agugaaaugaaguguaugcuc

SEQ ID NO: 1128686 - RNA, 22 nt, Human
gcugccucuguagcuuuggacc

SEQ ID NO: 1128687 - RNA, 22 nt, Human
gccaccagccccaugcgcugug

SEQ ID NO: 1128688 - RNA, 22 nt, Human
cuucacauguuggaguccuuug

SEQ ID NO: 1128689 - RNA, 22 nt, Human
uccugccucacaguugaaguuu

SEQ ID NO: 1128690 - RNA, 22 nt, Human
ccuucugcucccuggccagggc

SEQ ID NO: 1128691 - RNA, 22 nt, Human
aaaucaguuguuauauuaaaga

SEQ ID NO: 1128692 - RNA, 22 nt, Human
uguuuugucuaaucuaaauucu

SEQ ID NO: 1128693 - RNA, 20 nt, Human
aggcacuggauuucuuauau

SEQ ID NO: 1128694 - RNA, 22 nt, Human
augguuuguguggcccagauga

SEQ ID NO: 1128695 - RNA, 22 nt, Human
agccacagcaacaagugcaauu

SEQ ID NO: 1128696 - RNA, 22 nt, Human
ucagggcagaauccaaagaauu

SEQ ID NO: 1128697 - RNA, 22 nt, Human
ucucaggccccugaguuucucu

SEQ ID NO: 1128698 - RNA, 20 nt, Human
uccaagcccuccuuccauuc

SEQ ID NO: 1128699 - RNA, 22 nt, Human
caggugccucaggaugagacaa

SEQ ID NO: 1128700 - RNA, 22 nt, Human
gcugccuguguggccacucacu

SEQ ID NO: 1128701 - RNA, 23 nt, Human
ugcucugugaauaguuggugacu

SEQ ID NO: 1128702 - RNA, 22 nt, Human
auauucguggucaaguaaggcc

SEQ ID NO: 1128703 - RNA, 22 nt, Human
agcugagccagcagcaacagga

SEQ ID NO: 1128704 - RNA, 22 nt, Human
gcagcagcccagggcucucaga

SEQ ID NO: 1128705 - RNA, 22 nt, Human
agcugguggauuaugcuguaca

SEQ ID NO: 1128706 - RNA, 22 nt, Human
gccugagcaggcguggaccaug

SEQ ID NO: 1128707 - RNA, 22 nt, Human
aacagaacccgagugugaaucu

SEQ ID NO: 1128708 - RNA, 22 nt, Human
gcugagcucccagcaguaucug

SEQ ID NO: 1128709 - RNA, 22 nt, Human
cuuacauugucuuaguuuucaa

SEQ ID NO: 1128710 - RNA, 22 nt, Human
gccugcagaacugugaggcaau

SEQ ID NO: 1128711 - RNA, 22 nt, Human
ucuggagcaacagagcaggaca

SEQ ID NO: 1128712 - RNA, 22 nt, Human
cccaggcagggacgugcucugg

SEQ ID NO: 1128713 - RNA, 22 nt, Human
ugcccaaguguuuggcugaguc

SEQ ID NO: 1128714 - RNA, 22 nt, Human
gggauggggucaacauguaccu

SEQ ID NO: 1128715 - RNA, 23 nt, Human
aggauguaggauguauggcagag

SEQ ID NO: 1128716 - RNA, 22 nt, Human
ggugaggcccagugaucugugu

SEQ ID NO: 1128717 - RNA, 22 nt, Human
cagccugcauuuguaucuguau

SEQ ID NO: 1128718 - RNA, 22 nt, Human
cagugcagaacacauggaaaau

SEQ ID NO: 1128719 - RNA, 22 nt, Human
cugcugagcaucagggcugccc

SEQ ID NO: 1128720 - RNA, 23 nt, Human
aagcugccagucugaagccuggg

SEQ ID NO: 1128721 - RNA, 22 nt, Human
cagggguguuuuuggccaggag

SEQ ID NO: 1128722 - RNA, 22 nt, Human
uucuuuccccauggaguucgga

SEQ ID NO: 1128723 - RNA, 22 nt, Human
agccaggcugcaguuggcuggc

SEQ ID NO: 1128724 - RNA, 22 nt, Human
uuauguauggauggcugaaagu

SEQ ID NO: 1128725 - RNA, 22 nt, Human
ugcucucucaggccuggcccac

SEQ ID NO: 1128726 - RNA, 22 nt, Human
gugcauugcgaugcagacgacc

SEQ ID NO: 1128727 - RNA, 17 nt, Human
aguggcaggcagauggg

SEQ ID NO: 1128728 - RNA, 22 nt, Human
gcucucuguuauuaagaucuuu

SEQ ID NO: 1128729 - RNA, 22 nt, Human
cagcugagcucccaggccauca

SEQ ID NO: 1128730 - RNA, 22 nt, Human
ucuggcucaaaauacguacucu

SEQ ID NO: 1128731 - RNA, 22 nt, Human
agugugcugcuuaaacaguugu

SEQ ID NO: 1128732 - RNA, 22 nt, Human
ucccagaggcaguugguaacuu

SEQ ID NO: 1128733 - RNA, 22 nt, Human
aggagguggccugagcgugccc

SEQ ID NO: 1128734 - RNA, 22 nt, Human
gccucacugcagccccaggaag

SEQ ID NO: 1128735 - RNA, 22 nt, Human
cagggaguuuuuguuccucuag

SEQ ID NO: 1128736 - RNA, 22 nt, Human
uagugaaauuuaugcacagcua

SEQ ID NO: 1128737 - RNA, 22 nt, Human
cauugcacaucugagaagagau

SEQ ID NO: 1128738 - RNA, 18 nt, Human
gggcauggaugcagcauc

SEQ ID NO: 1128739 - RNA, 22 nt, Human
gugcuuccugccuggugccuuu

SEQ ID NO: 1128740 - RNA, 22 nt, Human
acaaagcuagagaagagaauug

SEQ ID NO: 1128741 - RNA, 21 nt, Human
ccaggcuccugaggcugguca

SEQ ID NO: 1128742 - RNA, 22 nt, Human
uagauuuccucuuccucauucc

SEQ ID NO: 1128743 - RNA, 22 nt, Human
cuggcagcuuagcacucugguu

SEQ ID NO: 1128744 - RNA, 23 nt, Human
ucaugcccaggcuccagauguca

SEQ ID NO: 1128745 - RNA, 22 nt, Human
ugcauuguugaccaguugugca

SEQ ID NO: 1128746 - RNA, 22 nt, Human
caaaugcaaaauauaacccugu

SEQ ID NO: 1128747 - RNA, 22 nt, Human
aaaagagguuaaccaggugugu

SEQ ID NO: 1128748 - RNA, 22 nt, Human
aggccagcucacccuggcuccu

SEQ ID NO: 1128749 - RNA, 19 nt, Human
ggugaccaccuggucagug

SEQ ID NO: 1128750 - RNA, 22 nt, Human
uaacagaauagcagaaacagaa

SEQ ID NO: 1128751 - RNA, 22 nt, Human
uguccugcaacugaaggagaag

SEQ ID NO: 1128752 - RNA, 22 nt, Human
gaagaacaagcagugcuuuccu

SEQ ID NO: 1128753 - RNA, 22 nt, Human
uggcucagcagguuagaaacua

SEQ ID NO: 1128754 - RNA, 22 nt, Human
ucuuugcagaauuuaacuuugc

SEQ ID NO: 1128755 - RNA, 22 nt, Human
auacauguucguguacauguuc

SEQ ID NO: 1128756 - RNA, 22 nt, Human
cauugcacuucugcuuuuccuc

SEQ ID NO: 1128757 - RNA, 22 nt, Human
acaggcuucucacagaaaaggg

SEQ ID NO: 1128758 - RNA, 22 nt, Human
aaaugucuuugaguauuucugc

SEQ ID NO: 1128759 - RNA, 22 nt, Human
gccugggaagacuaagugggag

SEQ ID NO: 1128760 - RNA, 23 nt, Human
aaagacugcugagaauuuuagga

SEQ ID NO: 1128761 - RNA, 22 nt, Human
ggcagaagaaaggcuaagucuc

SEQ ID NO: 1128762 - RNA, 22 nt, Human
ugccucugugugcaggugagca

SEQ ID NO: 1128763 - RNA, 22 nt, Human
cucuuuccaggguaccccaggu

SEQ ID NO: 1128764 - RNA, 22 nt, Human
acaggcugccuaccaaguauca

SEQ ID NO: 1128765 - RNA, 22 nt, Human
ugcaggccucacaccuggcacc

SEQ ID NO: 1128766 - RNA, 22 nt, Human
uugucuguaaagacggccacca

SEQ ID NO: 1128767 - RNA, 22 nt, Human
uaguacuuaucucugucauugu

SEQ ID NO: 1128768 - RNA, 22 nt, Human
ccugggagcuguggaaaggcug

SEQ ID NO: 1128769 - RNA, 22 nt, Human
agcuucuugaccaagccuguaa

SEQ ID NO: 1128770 - RNA, 22 nt, Human
ccccuuccgucucuugaguguc

SEQ ID NO: 1128771 - RNA, 22 nt, Human
gcccucucggcauagcaggggc

SEQ ID NO: 1128772 - RNA, 22 nt, Human
gaagagcuaaaggcacaggcuu

SEQ ID NO: 1128773 - RNA, 22 nt, Human
cugccuuggaaaaugugguaau

SEQ ID NO: 1128774 - RNA, 22 nt, Human
auuauguaacugugguucagca

SEQ ID NO: 1128775 - RNA, 22 nt, Human
cucagggggaaucaggucacag

SEQ ID NO: 1128776 - RNA, 22 nt, Human
gcuguuccugcuuagaggucgg

SEQ ID NO: 1128777 - RNA, 17 nt, Human
cucuccuuccucugagg

SEQ ID NO: 1128778 - RNA, 22 nt, Human
ucacagaaauaagauaguuauu

SEQ ID NO: 1128779 - RNA, 22 nt, Human
ccugccugcaaaaugggacaag

SEQ ID NO: 1128780 - RNA, 22 nt, Human
gcaggaugaaggcagaggcuga

SEQ ID NO: 1128781 - RNA, 22 nt, Human
agccaagcacucaacuccugga

SEQ ID NO: 1128782 - RNA, 22 nt, Human
cuccaggccagggaaguggaca

SEQ ID NO: 1128783 - RNA, 22 nt, Human
gaagccaacauuccaaguagaa

SEQ ID NO: 1128784 - RNA, 22 nt, Human
aguguccaacucagcuugucaa

SEQ ID NO: 1128785 - RNA, 22 nt, Human
agaagcagacucugaggcaagg

SEQ ID NO: 1128786 - RNA, 22 nt, Human
caugcuuucuguccaaauguua

SEQ ID NO: 1128787 - RNA, 22 nt, Human
cucaggaugucggugacuauug

SEQ ID NO: 1128788 - RNA, 22 nt, Human
ggcugccugggagcccuccucu

SEQ ID NO: 1128789 - RNA, 22 nt, Human
guuugcauguauuaagucaaua

SEQ ID NO: 1128790 - RNA, 22 nt, Human
uuucuaaaugguggcugcauug

SEQ ID NO: 1128791 - RNA, 22 nt, Human
guugaauaucguguucuuguuu

SEQ ID NO: 1128792 - RNA, 22 nt, Human
cagguggggcagcugugggagc

SEQ ID NO: 1128793 - RNA, 22 nt, Human
ggcuucugguaaagaccacacc

SEQ ID NO: 1128794 - RNA, 22 nt, Human
ccaggaggcggaagguacagug

SEQ ID NO: 1128795 - RNA, 22 nt, Human
gcacccagccagcaucucagag

SEQ ID NO: 1128796 - RNA, 18 nt, Human
caggagcaggaguugaac

SEQ ID NO: 1128797 - RNA, 22 nt, Human
uggcuucaucugcagcacugcc

SEQ ID NO: 1128798 - RNA, 22 nt, Human
aucuggcuauugacauguuaua

SEQ ID NO: 1128799 - RNA, 22 nt, Human
ugucacauugaauaugauuuau

SEQ ID NO: 1128800 - RNA, 22 nt, Human
acacugaauaauugagaguuga

SEQ ID NO: 1128801 - RNA, 22 nt, Human
aaagcucacaguaauacaaggc

SEQ ID NO: 1128802 - RNA, 22 nt, Human
ucugccagaaguucugagagua

SEQ ID NO: 1128803 - RNA, 22 nt, Human
gucccagagagcacuaguccau

SEQ ID NO: 1128804 - RNA, 22 nt, Human
uuuucauuuacauuagggaaga

SEQ ID NO: 1128805 - RNA, 21 nt, Human
aagccucaagcagaagacaga

SEQ ID NO: 1128806 - RNA, 22 nt, Human
ccacaaguuucagcacccagag

SEQ ID NO: 1128807 - RNA, 18 nt, Human
guccauggccuccaccca

SEQ ID NO: 1128808 - RNA, 21 nt, Human
uaaaugugagcagggcugggc

SEQ ID NO: 1128809 - RNA, 22 nt, Human
agaggcugucccuugcuauucc

SEQ ID NO: 1128810 - RNA, 22 nt, Human
gauuucuguaacacuucagaua

SEQ ID NO: 1128811 - RNA, 22 nt, Human
gcucuguguccacagcuggaaa

SEQ ID NO: 1128812 - RNA, 22 nt, Human
ccagggccaagagaccucgagg

SEQ ID NO: 1128813 - RNA, 22 nt, Human
uccaggacuagcauuucugaua

SEQ ID NO: 1128814 - RNA, 22 nt, Human
gaaggagagagacaucgucccu

SEQ ID NO: 1128815 - RNA, 22 nt, Human
gggugacauuucccaaugagcc

SEQ ID NO: 1128816 - RNA, 22 nt, Human
uugcagagaucagcagguuuga

SEQ ID NO: 1128817 - RNA, 22 nt, Human
acagugucaugucguguucccc

SEQ ID NO: 1128818 - RNA, 19 nt, Human
gcagcugugggaagagcca

SEQ ID NO: 1128819 - RNA, 20 nt, Human
cugagcugagcuccaugggu

SEQ ID NO: 1128820 - RNA, 22 nt, Human
aguacuuuacuucuuacaguuu

SEQ ID NO: 1128821 - RNA, 22 nt, Human
acagccagaggagccaggcugg

SEQ ID NO: 1128822 - RNA, 20 nt, Human
cagcccuccaguggaggcag

SEQ ID NO: 1128823 - RNA, 22 nt, Human
gaggggcuugaggcccugaugg

SEQ ID NO: 1128824 - RNA, 22 nt, Human
cugggcagagcuaacaccugag

SEQ ID NO: 1128825 - RNA, 22 nt, Human
cugucaggggcggguggagcgg

SEQ ID NO: 1128826 - RNA, 22 nt, Human
guugaauauaccugcauuugug

SEQ ID NO: 1128827 - RNA, 22 nt, Human
aauguuuuuuggucugaugaau

SEQ ID NO: 1128828 - RNA, 23 nt, Human
aagcuuccuucacgucuccuggg

SEQ ID NO: 1128829 - RNA, 21 nt, Human
ccagcagcucaaggaucucuu

SEQ ID NO: 1128830 - RNA, 22 nt, Human
ccucucuguguggccucuccau

SEQ ID NO: 1128831 - RNA, 22 nt, Human
uacagucuuuggaaagagauag

SEQ ID NO: 1128832 - RNA, 20 nt, Human
ugggccugagccugugggcu

SEQ ID NO: 1128833 - RNA, 22 nt, Human
acagggccucagcugauucugg

SEQ ID NO: 1128834 - RNA, 22 nt, Human
uauucacauucucaggccuggu

SEQ ID NO: 1128835 - RNA, 22 nt, Human
cccaggaggcagagguugcagu

SEQ ID NO: 1128836 - RNA, 22 nt, Human
uuuaauacagaacuugucaggg

SEQ ID NO: 1128837 - RNA, 22 nt, Human
uugcauuguugcaaugaaguau

SEQ ID NO: 1128838 - RNA, 22 nt, Human
uguacaguauauuucaaagcca

SEQ ID NO: 1128839 - RNA, 22 nt, Human
gaggugaguggaucacgagguc

SEQ ID NO: 1128840 - RNA, 22 nt, Human
agcugguaugaacaggauagga

SEQ ID NO: 1128841 - RNA, 22 nt, Human
aaggcagagggcuggaucagag

SEQ ID NO: 1128842 - RNA, 22 nt, Human
uggccuuggacagagcgcuccu

SEQ ID NO: 1128843 - RNA, 22 nt, Human
gggguugguuuaaaugcuugag

SEQ ID NO: 1128844 - RNA, 22 nt, Human
gcucaggaaggcucaaccagga

SEQ ID NO: 1128845 - RNA, 20 nt, Human
ccuccuggucaggugugcag

SEQ ID NO: 1128846 - RNA, 22 nt, Human
uauccaauucaccauugauggg

SEQ ID NO: 1128847 - RNA, 22 nt, Human
gccuucaggaaaucaguccuug

SEQ ID NO: 1128848 - RNA, 19 nt, Human
gguaaaagugagcuucagg

SEQ ID NO: 1128849 - RNA, 22 nt, Human
ccaggaagcggugagggcugcc

SEQ ID NO: 1128850 - RNA, 22 nt, Human
agaguguuauuugcucuguauu

SEQ ID NO: 1128851 - RNA, 22 nt, Human
gucuggagccacccuaagcauu

SEQ ID NO: 1128852 - RNA, 22 nt, Human
ugcagaaguauuccaggcccca

SEQ ID NO: 1128853 - RNA, 22 nt, Human
caguuucuucaucaguuaagca

SEQ ID NO: 1128854 - RNA, 22 nt, Human
uccugagggcgauucagcaggu

SEQ ID NO: 1128855 - RNA, 22 nt, Human
ucccuggaacagagagacaacg

SEQ ID NO: 1128856 - RNA, 22 nt, Human
gcucuguguugucagaggcacc

SEQ ID NO: 1128857 - RNA, 22 nt, Human
uugagggucuggaucugcugcu

SEQ ID NO: 1128858 - RNA, 22 nt, Human
cccagggacagaugggcagcua

SEQ ID NO: 1128859 - RNA, 22 nt, Human
ggugcagugguguggcaaaggg

SEQ ID NO: 1128860 - RNA, 22 nt, Human
ggggacaguuaaagaccaagac

SEQ ID NO: 1128861 - RNA, 22 nt, Human
uguguuuuacaaauucucuuaa

SEQ ID NO: 1128862 - RNA, 22 nt, Human
auagaacagaaacagaugcaca

SEQ ID NO: 1128863 - RNA, 22 nt, Human
gucuuucuuaauucaagugcuu

SEQ ID NO: 1128864 - RNA, 22 nt, Human
ccauggcauuuuaugugucuua

SEQ ID NO: 1128865 - RNA, 21 nt, Human
acaggcucuggggaugcuggg

SEQ ID NO: 1128866 - RNA, 22 nt, Human
caggugggagcgaggagcuacu

SEQ ID NO: 1128867 - RNA, 22 nt, Human
uagaggugacacugagaccaua

SEQ ID NO: 1128868 - RNA, 23 nt, Human
gccugggacugguagugugaccu

SEQ ID NO: 1128869 - RNA, 19 nt, Human
ugcagaagacacaguggug

SEQ ID NO: 1128870 - RNA, 22 nt, Human
gccuggaggggccaggguggua

SEQ ID NO: 1128871 - RNA, 22 nt, Human
aguucacauuccgagguacugg

SEQ ID NO: 1128872 - RNA, 22 nt, Human
acagggccaggugagaggugcu

SEQ ID NO: 1128873 - RNA, 22 nt, Human
ggccugugagcccuugcaugua

SEQ ID NO: 1128874 - RNA, 22 nt, Human
ucagguggcuucggggaguggc

SEQ ID NO: 1128875 - RNA, 16 nt, Human
ugggcagaugagaaga

SEQ ID NO: 1128876 - RNA, 20 nt, Human
ccucucugaagaggucaucu

SEQ ID NO: 1128877 - RNA, 22 nt, Human
aaaggcuccuucucccaugacc

SEQ ID NO: 1128878 - RNA, 22 nt, Human
caggcagcugcuggguucagcc

SEQ ID NO: 1128879 - RNA, 22 nt, Human
ucacgagaggcacagaauagag

SEQ ID NO: 1128880 - RNA, 20 nt, Human
gcugccuguuucuguaagua

SEQ ID NO: 1128881 - RNA, 22 nt, Human
ccuuugggugaauuccucucuu

SEQ ID NO: 1128882 - RNA, 22 nt, Human
cacagcagagggagccauugaa

SEQ ID NO: 1128883 - RNA, 21 nt, Human
aggcucagcagguguauaaag

SEQ ID NO: 1128884 - RNA, 22 nt, Human
aggcugggaagguaaaguugua

SEQ ID NO: 1128885 - RNA, 22 nt, Human
uggagcaggacugcugcccuca

SEQ ID NO: 1128886 - RNA, 22 nt, Human
cucuggacacuggcaugggguc

SEQ ID NO: 1128887 - RNA, 22 nt, Human
cagggcuguggcuuugugcugu

SEQ ID NO: 1128888 - RNA, 22 nt, Human
uggcagagaacacacaugauuc

SEQ ID NO: 1128889 - RNA, 22 nt, Human
ggugccaggcuguagucagggu

SEQ ID NO: 1128890 - RNA, 22 nt, Human
caaugauguuuagauaaaaucc

SEQ ID NO: 1128891 - RNA, 22 nt, Human
aggggccauuguucugcccgcu

SEQ ID NO: 1128892 - RNA, 22 nt, Human
ccuuccuggagcccaugcagau

SEQ ID NO: 1128893 - RNA, 22 nt, Human
gcuggaccaggugugcacaggc

SEQ ID NO: 1128894 - RNA, 22 nt, Human
uguauuuucuucuggaagcuua

SEQ ID NO: 1128895 - RNA, 22 nt, Human
ccucugcugcuguugagcaccg

SEQ ID NO: 1128896 - RNA, 22 nt, Human
cuggagcuaggaaguccaagau

SEQ ID NO: 1128897 - RNA, 22 nt, Human
cuguaauucacuagggucagcg

SEQ ID NO: 1128898 - RNA, 22 nt, Human
agggaaauuaaugugagcaaug

SEQ ID NO: 1128899 - RNA, 22 nt, Human
guggcugcuguccucucugguu

SEQ ID NO: 1128900 - RNA, 22 nt, Human
uagcugccaaaagggugggcua

SEQ ID NO: 1128901 - RNA, 22 nt, Human
uuuuaaguuaauauaauugagg

SEQ ID NO: 1128902 - RNA, 22 nt, Human
auucuguauggaaaagcacuau

SEQ ID NO: 1128903 - RNA, 22 nt, Human
uucaagucaaggaaagaggucu

SEQ ID NO: 1128904 - RNA, 22 nt, Human
cgucuuccucuuacgaugcgcu

SEQ ID NO: 1128905 - RNA, 22 nt, Human
gggugaggagcugccagucaug

SEQ ID NO: 1128906 - RNA, 22 nt, Human
uuucuguuaggcaucauuuuaa

SEQ ID NO: 1128907 - RNA, 22 nt, Human
acauuucuaguuguucaucucc

SEQ ID NO: 1128908 - RNA, 19 nt, Human
ccugggagucagcugaagg

SEQ ID NO: 1128909 - RNA, 22 nt, Human
cugggguggauggguccaaguu

SEQ ID NO: 1128910 - RNA, 22 nt, Human
gccugccuguuggcugaggugc

SEQ ID NO: 1128911 - RNA, 22 nt, Human
uuccuccacgugacaggagcca

SEQ ID NO: 1128912 - RNA, 22 nt, Human
uaaagguaguuuuaaaggugcu

SEQ ID NO: 1128913 - RNA, 22 nt, Human
ucaugcaaggcugaaacauggu

SEQ ID NO: 1128914 - RNA, 22 nt, Human
aaaguuacuaucacaaugaaau

SEQ ID NO: 1128915 - RNA, 20 nt, Human
agugucugggccucaggccc

SEQ ID NO: 1128916 - RNA, 22 nt, Human
ggcagcuccaaaaggaaacacu

SEQ ID NO: 1128917 - RNA, 22 nt, Human
ggcagggagagcaugcugauaa

SEQ ID NO: 1128918 - RNA, 22 nt, Human
aagcagaaguugaucuaccaua

SEQ ID NO: 1128919 - RNA, 22 nt, Human
uaggagaggugaauggcacacu

SEQ ID NO: 1128920 - RNA, 22 nt, Human
gggcugggcaugguguucccuc

SEQ ID NO: 1128921 - RNA, 22 nt, Human
ucagggcacaggccuguggguu

SEQ ID NO: 1128922 - RNA, 22 nt, Human
uacaaaugaaccaacuuugaug

SEQ ID NO: 1128923 - RNA, 22 nt, Human
agauaacuuuuggguauucaug

SEQ ID NO: 1128924 - RNA, 22 nt, Human
uggcuggcaaggcuggagucag

SEQ ID NO: 1128925 - RNA, 20 nt, Human
gcuuuuucuaauagcagucc

SEQ ID NO: 1128926 - RNA, 22 nt, Human
gaagcagcuuucuggugaggag

SEQ ID NO: 1128927 - RNA, 22 nt, Human
caugcacaacauacucaagagg

SEQ ID NO: 1128928 - RNA, 18 nt, Human
cugccuguugcugagagg

SEQ ID NO: 1128929 - RNA, 22 nt, Human
uuugcauugcauuaaguauucu

SEQ ID NO: 1128930 - RNA, 22 nt, Human
gagcagugggaaggaacagggu

SEQ ID NO: 1128931 - RNA, 22 nt, Human
uauguuaaauguuugauguuua

SEQ ID NO: 1128932 - RNA, 22 nt, Human
cuuccugcauugugccagaguu

SEQ ID NO: 1128933 - RNA, 22 nt, Human
cuggccuucagacucggacuga

SEQ ID NO: 1128934 - RNA, 22 nt, Human
ugaaaucuuuaguuucuguccc

SEQ ID NO: 1128935 - RNA, 22 nt, Human
gucccacaccuugaggggucuu

SEQ ID NO: 1128936 - RNA, 22 nt, Human
ucucagagaacaguuggugcuu

SEQ ID NO: 1128937 - RNA, 22 nt, Human
guggcuucugcggugugcgcag

SEQ ID NO: 1128938 - RNA, 22 nt, Human
ugggcucucuggcaggaaggcu

SEQ ID NO: 1128939 - RNA, 22 nt, Human
ggcugggcuccgggagcaugcg

SEQ ID NO: 1128940 - RNA, 22 nt, Human
uugucccaggacuugcauagau

SEQ ID NO: 1128941 - RNA, 22 nt, Human
agguaacacuacuuaguauacu

SEQ ID NO: 1128942 - RNA, 22 nt, Human
ggcagcagggcugucucccuac

SEQ ID NO: 1128943 - RNA, 22 nt, Human
ucuaggagcaugaagggaaggc

SEQ ID NO: 1128944 - RNA, 22 nt, Human
caggagugagaugcgaucacuu

SEQ ID NO: 1128945 - RNA, 22 nt, Human
acaaagugcacaagaugagaac

SEQ ID NO: 1128946 - RNA, 22 nt, Human
ugucucugugagaucugacgau

SEQ ID NO: 1128947 - RNA, 22 nt, Human
ugaccaaagaguugcuuguauu

SEQ ID NO: 1128948 - RNA, 22 nt, Human
cauugcacagcccuguggugau

SEQ ID NO: 1128949 - RNA, 22 nt, Human
aguuauauuccauagauucaga

SEQ ID NO: 1128950 - RNA, 22 nt, Human
gcaguggcaugaugugggcuca

SEQ ID NO: 1128951 - RNA, 22 nt, Human
agcugccauccuguucagcacc

SEQ ID NO: 1128952 - RNA, 22 nt, Human
uauugacaauaggcaacugagg

SEQ ID NO: 1128953 - RNA, 22 nt, Human
ugguccagaugccuuggcuuua

SEQ ID NO: 1128954 - RNA, 22 nt, Human
ggaggcuccacugcucuuccug

SEQ ID NO: 1128955 - RNA, 21 nt, Human
ugcugccauagaccugaggga

SEQ ID NO: 1128956 - RNA, 22 nt, Human
ccggggacuuaaagugaaggaa

SEQ ID NO: 1128957 - RNA, 22 nt, Human
gucagcaggguccccuugagug

SEQ ID NO: 1128958 - RNA, 22 nt, Human
cagcagagguuggaacaguucu

SEQ ID NO: 1128959 - RNA, 22 nt, Human
uuccagaaaucuuucagcucaa

SEQ ID NO: 1128960 - RNA, 22 nt, Human
cccacaggcuagggguagggca

SEQ ID NO: 1128961 - RNA, 22 nt, Human
aaguccaucucugccccacaca

SEQ ID NO: 1128962 - RNA, 22 nt, Human
auaacagaugugaagugcuaau

SEQ ID NO: 1128963 - RNA, 22 nt, Human
guccucugggcuuugagcaguc

SEQ ID NO: 1128964 - RNA, 19 nt, Human
ucugaggguccagaugcau

SEQ ID NO: 1128965 - RNA, 22 nt, Human
aaugcacauaaauauggucuua

SEQ ID NO: 1128966 - RNA, 22 nt, Human
ugcagcucauugguguccuggu

SEQ ID NO: 1128967 - RNA, 22 nt, Human
gccuguguggaugcgccggugc

SEQ ID NO: 1128968 - RNA, 22 nt, Human
acauuucuucccuuuagcagaa

SEQ ID NO: 1128969 - RNA, 18 nt, Human
cuuguucuucucuuggcg

SEQ ID NO: 1128970 - RNA, 22 nt, Human
uuuauucuugagagugagaaga

SEQ ID NO: 1128971 - RNA, 22 nt, Human
gccaggcuccaggcccuccuga

SEQ ID NO: 1128972 - RNA, 22 nt, Human
aaaaauagcuucucuugucccu

SEQ ID NO: 1128973 - RNA, 22 nt, Human
caugcacaaagguaagaugcgu

SEQ ID NO: 1128974 - RNA, 22 nt, Human
cagacaggcuagccagacucac

SEQ ID NO: 1128975 - RNA, 22 nt, Human
uccucagggcggccuccgucuu

SEQ ID NO: 1128976 - RNA, 22 nt, Human
gggcuggcaucgguugcugaga

SEQ ID NO: 1128977 - RNA, 22 nt, Human
gaaggccuagggaugcucugcg

SEQ ID NO: 1128978 - RNA, 19 nt, Human
aggcagaggcuuggcuagc

SEQ ID NO: 1128979 - RNA, 22 nt, Human
cacucaggcugugucaggagga

SEQ ID NO: 1128980 - RNA, 22 nt, Human
gugccugguuuggggaauguuc

SEQ ID NO: 1128981 - RNA, 22 nt, Human
aggcacuguggguguggccgga

SEQ ID NO: 1128982 - RNA, 22 nt, Human
ugggcagacauugaguuuguuc

SEQ ID NO: 1128983 - RNA, 22 nt, Human
cacauaaguggguuccauugca

SEQ ID NO: 1128984 - RNA, 22 nt, Human
ucagaccauccugcuguuagug

SEQ ID NO: 1128985 - RNA, 22 nt, Human
caggggcucugagauugucuaa

SEQ ID NO: 1128986 - RNA, 22 nt, Human
auaaaaguuuccaaucaugccu

SEQ ID NO: 1128987 - RNA, 22 nt, Human
ugcagcugaggccagcuaugcc

SEQ ID NO: 1128988 - RNA, 22 nt, Human
aggccugggacgggagccguga

SEQ ID NO: 1128989 - RNA, 22 nt, Human
ccucugccugcacaucauccug

SEQ ID NO: 1128990 - RNA, 22 nt, Human
augcacagacccaaaggccauc

SEQ ID NO: 1128991 - RNA, 19 nt, Human
gcucagagggcccugugcu

SEQ ID NO: 1128992 - RNA, 22 nt, Human
uggcagggugccaguugcgagu

SEQ ID NO: 1128993 - RNA, 22 nt, Human
aucauaaagugcuaucugauug

SEQ ID NO: 1128994 - RNA, 22 nt, Human
agagugaaguucaucgugcagc

SEQ ID NO: 1128995 - RNA, 17 nt, Human
gagaguguauuggaugc

SEQ ID NO: 1128996 - RNA, 19 nt, Human
uuuggcacucugaaguguu

SEQ ID NO: 1128997 - RNA, 22 nt, Human
acacugaaugcuguuuagaaau

SEQ ID NO: 1128998 - RNA, 22 nt, Human
aggcucagauucacauuugguu

SEQ ID NO: 1128999 - RNA, 22 nt, Human
uggcccugugugcaggcugcac

SEQ ID NO: 1129000 - RNA, 22 nt, Human
aaaguccagggaaagagcgucu

SEQ ID NO: 1129001 - RNA, 19 nt, Human
agcauccagucaugggauc

SEQ ID NO: 1129002 - RNA, 22 nt, Human
uuaauccauggcaguuauuaaa

SEQ ID NO: 1129003 - RNA, 22 nt, Human
cagccagguucaaguccuuaua

SEQ ID NO: 1129004 - RNA, 22 nt, Human
agggccugucagcgguguccug

SEQ ID NO: 1129005 - RNA, 22 nt, Human
gccagagcugagacacgagucc

SEQ ID NO: 1129006 - RNA, 22 nt, Human
aaucuggcauguaagcuuagag

SEQ ID NO: 1129007 - RNA, 22 nt, Human
agccucucuuuauucccagcua

SEQ ID NO: 1129008 - RNA, 20 nt, Human
ugccagggccagcagaggcu

SEQ ID NO: 1129009 - RNA, 22 nt, Human
agagcuggccagggaucacucu

SEQ ID NO: 1129010 - RNA, 22 nt, Human
cuuuauguccaccagacugcaa

SEQ ID NO: 1129011 - RNA, 22 nt, Human
uaagcauucaaugcuuagcacu

SEQ ID NO: 1129012 - RNA, 22 nt, Human
auauauaucgaguucaugucuc

SEQ ID NO: 1129013 - RNA, 22 nt, Human
uccagggcugacuugggagagg

SEQ ID NO: 1129014 - RNA, 22 nt, Human
ugugccauuucuauucugcagc

SEQ ID NO: 1129015 - RNA, 22 nt, Human
ugaagguggcauaggagagaug

SEQ ID NO: 1129016 - RNA, 22 nt, Human
guauuuauaggggaaugagagu

SEQ ID NO: 1129017 - RNA, 22 nt, Human
caaaagauacuugcaucuaacu

SEQ ID NO: 1129018 - RNA, 22 nt, Human
augugcaugcacuuacaugugu

SEQ ID NO: 1129019 - RNA, 22 nt, Human
cugggcuacguguugacagcau

SEQ ID NO: 1129020 - RNA, 22 nt, Human
aagacagaccacgugacagggc

SEQ ID NO: 1129021 - RNA, 22 nt, Human
cccagcucucgcacuuacuagc

SEQ ID NO: 1129022 - RNA, 22 nt, Human
ggucccugaagaggccuggggu

SEQ ID NO: 1129023 - RNA, 22 nt, Human
gcugggcuucucaaugcugccu

SEQ ID NO: 1129024 - RNA, 17 nt, Human
gggcagggacuccuggg

SEQ ID NO: 1129025 - RNA, 22 nt, Human
caagccugucucaccagugcua

SEQ ID NO: 1129026 - RNA, 22 nt, Human
ugcagggcacacgcacgggugu

SEQ ID NO: 1129027 - RNA, 22 nt, Human
guccugggccugcugaggcuga

SEQ ID NO: 1129028 - RNA, 22 nt, Human
ucugggagguaaccaugcugau

SEQ ID NO: 1129029 - RNA, 22 nt, Human
aaaaguucccugguuagaaaag

SEQ ID NO: 1129030 - RNA, 22 nt, Human
uaaaauguuugcaagagaccag

SEQ ID NO: 1129031 - RNA, 22 nt, Human
gggcuucucccuaaggacucug

SEQ ID NO: 1129032 - RNA, 22 nt, Human
guccugucccccaaggcugugg

SEQ ID NO: 1129033 - RNA, 22 nt, Human
gcucaagggaugggagugggug

SEQ ID NO: 1129034 - RNA, 22 nt, Human
uacaaagugugcccaugcugag

SEQ ID NO: 1129035 - RNA, 22 nt, Human
ccucuccuugcacccgucccgc

SEQ ID NO: 1129036 - RNA, 22 nt, Human
gagagcugucagcguagcaccg

SEQ ID NO: 1129037 - RNA, 22 nt, Human
auuuaugacuggugaauagaac

SEQ ID NO: 1129038 - RNA, 19 nt, Human
aggacucuggaggcaugag

SEQ ID NO: 1129039 - RNA, 22 nt, Human
uccucaggaucuaggagugcuu

SEQ ID NO: 1129040 - RNA, 21 nt, Human
gucagcagauccagcacuugu

SEQ ID NO: 1129041 - RNA, 22 nt, Human
uggacucagugcugccauuccc

SEQ ID NO: 1129042 - RNA, 20 nt, Human
agcaggaaugaugcuuucau

SEQ ID NO: 1129043 - RNA, 22 nt, Human
cugugccaggcccagcugacuu

SEQ ID NO: 1129044 - RNA, 22 nt, Human
augcaguacagauaauucuaca

SEQ ID NO: 1129045 - RNA, 22 nt, Human
agcaugcacaugacuggcuuaa

SEQ ID NO: 1129046 - RNA, 22 nt, Human
cagacagaaggcuccuugaggu

SEQ ID NO: 1129047 - RNA, 22 nt, Human
ugcaguggaaagacucagacuu

SEQ ID NO: 1129048 - RNA, 22 nt, Human
uggggcuggcuauugucucccu

SEQ ID NO: 1129049 - RNA, 22 nt, Human
uagagcuguaucaaagagccuu

SEQ ID NO: 1129050 - RNA, 19 nt, Human
ggcugccuuuccuuaccag

SEQ ID NO: 1129051 - RNA, 22 nt, Human
cacguuuuaugacagaagaagc

SEQ ID NO: 1129052 - RNA, 22 nt, Human
cagcugccacuugcucucggcu

SEQ ID NO: 1129053 - RNA, 22 nt, Human
gcaggccuccccugcuggagcu

SEQ ID NO: 1129054 - RNA, 22 nt, Human
uguucuuucaguuagacacagu

SEQ ID NO: 1129055 - RNA, 22 nt, Human
cagagcaguaaaucuggggcac

SEQ ID NO: 1129056 - RNA, 22 nt, Human
aaaggugacugcagcagcuauu

SEQ ID NO: 1129057 - RNA, 20 nt, Human
cuguccccgaggucaccagg

SEQ ID NO: 1129058 - RNA, 22 nt, Human
ucugaggcccugcaggcagugu

SEQ ID NO: 1129059 - RNA, 22 nt, Human
uaagaacagugacagccaacau

SEQ ID NO: 1129060 - RNA, 18 nt, Human
acaaauguagugucuuaa

SEQ ID NO: 1129061 - RNA, 22 nt, Human
uggccuggcccugaggcccugu

SEQ ID NO: 1129062 - RNA, 22 nt, Human
auuguacaaugccuggaacauu

SEQ ID NO: 1129063 - RNA, 22 nt, Human
agggcugccugacuccagagcc

SEQ ID NO: 1129064 - RNA, 22 nt, Human
gcugggaggaucucucccuguc

SEQ ID NO: 1129065 - RNA, 23 nt, Human
acacaaggguaacugccagccau

SEQ ID NO: 1129066 - RNA, 21 nt, Human
cugguguagcacucaggugcu

SEQ ID NO: 1129067 - RNA, 20 nt, Human
gccuggcacccggggcuggc

SEQ ID NO: 1129068 - RNA, 23 nt, Human
cccagcgcugagcccugcaggca

SEQ ID NO: 1129069 - RNA, 22 nt, Human
ccuggcagguggcgcccucggc

SEQ ID NO: 1129070 - RNA, 22 nt, Human
ugcagcaggagccaggccuggu

SEQ ID NO: 1129071 - RNA, 23 nt, Human
gaguguucauagcaggcucuugc

SEQ ID NO: 1129072 - RNA, 22 nt, Human
caaaguuuggcucucaugacau

SEQ ID NO: 1129073 - RNA, 22 nt, Human
aagagggaggugcgggugcaga

SEQ ID NO: 1129074 - RNA, 22 nt, Human
ugugcccauuacacagaggcau

SEQ ID NO: 1129075 - RNA, 23 nt, Human
ggcagagagcauggcuggggccc

SEQ ID NO: 1129076 - RNA, 22 nt, Human
aauggacaggagagcauaguca

SEQ ID NO: 1129077 - RNA, 22 nt, Human
cuguggcuaugguguacauacu

SEQ ID NO: 1129078 - RNA, 22 nt, Human
ucucuggagcugcagauccagg

SEQ ID NO: 1129079 - RNA, 22 nt, Human
aaauguguuugauaggaauauu

SEQ ID NO: 1129080 - RNA, 22 nt, Human
aaaaacuguaauuacuuuugca

SEQ ID NO: 1129081 - RNA, 22 nt, Human
cccagaggugcuucagaggugc

SEQ ID NO: 1129082 - RNA, 22 nt, Human
aagcagaaaaacugagcuccaa

SEQ ID NO: 1129083 - RNA, 22 nt, Human
acagguggaggcuuuaggaggu

SEQ ID NO: 1129084 - RNA, 22 nt, Human
uccugcagagacagaggccuca

SEQ ID NO: 1129085 - RNA, 22 nt, Human
agcugagcugcagaugacugua

SEQ ID NO: 1129086 - RNA, 22 nt, Human
uggcagcaauuugugauguuga

SEQ ID NO: 1129087 - RNA, 19 nt, Human
ggaagagaggaaaggugga

SEQ ID NO: 1129088 - RNA, 22 nt, Human
gagccugaugaaacaggcagac

SEQ ID NO: 1129089 - RNA, 22 nt, Human
ucagggcauggcugcacuuggc

SEQ ID NO: 1129090 - RNA, 22 nt, Human
uggcagagucaucacaucugga

SEQ ID NO: 1129091 - RNA, 23 nt, Human
uccugagaugagacagugcugcc

SEQ ID NO: 1129092 - RNA, 22 nt, Human
ugguaaaguguacugaauauga

SEQ ID NO: 1129093 - RNA, 22 nt, Human
ugggcaaguaucggacucugag

SEQ ID NO: 1129094 - RNA, 18 nt, Human
gucuggaggucaggagcu

SEQ ID NO: 1129095 - RNA, 22 nt, Human
ccaggaggcagagguuacagug

SEQ ID NO: 1129096 - RNA, 22 nt, Human
gaggaguguauuccacaccacu

SEQ ID NO: 1129097 - RNA, 20 nt, Human
gcugccuuguccugcuuggu

SEQ ID NO: 1129098 - RNA, 22 nt, Human
agagccugggaauuugcauguu

SEQ ID NO: 1129099 - RNA, 17 nt, Human
agaaagaggauccacag

SEQ ID NO: 1129100 - RNA, 22 nt, Human
ucucccagaggaucccagugga

SEQ ID NO: 1129101 - RNA, 22 nt, Human
auuuccauacacccauuucuga

SEQ ID NO: 1129102 - RNA, 21 nt, Human
uucaagauauuuaaaaggugg

SEQ ID NO: 1129103 - RNA, 21 nt, Human
aagcaggacauaugaugcccu

SEQ ID NO: 1129104 - RNA, 22 nt, Human
uggagggaacccaggcugcucu

SEQ ID NO: 1129105 - RNA, 22 nt, Human
ccuuggcccuagccucaggcaa

SEQ ID NO: 1129106 - RNA, 22 nt, Human
gcacagggccuggcacauaaga

SEQ ID NO: 1129107 - RNA, 22 nt, Human
uuucuucucacccaggacagag

SEQ ID NO: 1129108 - RNA, 22 nt, Human
cauugacaucaggcuuggccaa

SEQ ID NO: 1129109 - RNA, 22 nt, Human
ugucucugagaugacucccacc

SEQ ID NO: 1129110 - RNA, 22 nt, Human
aagcugcccucauucccagugc

SEQ ID NO: 1129111 - RNA, 23 nt, Human
gggggcugguugacucucugcag

SEQ ID NO: 1129112 - RNA, 22 nt, Human
ccucuuccacugggccccaucc

SEQ ID NO: 1129113 - RNA, 21 nt, Human
acagaguaguugaaacagaga

SEQ ID NO: 1129114 - RNA, 22 nt, Human
cugggaugucuauagaacacuu

SEQ ID NO: 1129115 - RNA, 22 nt, Human
cagagacagaaaauggaucuag

SEQ ID NO: 1129116 - RNA, 22 nt, Human
ggcucaggaugagccuucucau

SEQ ID NO: 1129117 - RNA, 22 nt, Human
gcugagcugcuguucauccugc

SEQ ID NO: 1129118 - RNA, 22 nt, Human
gggcuggugaggcugcccugca

SEQ ID NO: 1129119 - RNA, 22 nt, Human
ggaggcccagagaggugaagug

SEQ ID NO: 1129120 - RNA, 22 nt, Human
augggguggaguccgggcagcg

SEQ ID NO: 1129121 - RNA, 22 nt, Human
ggcacucagagauucaggcugu

SEQ ID NO: 1129122 - RNA, 22 nt, Human
cauacuuuugcccugacauucu

SEQ ID NO: 1129123 - RNA, 21 nt, Human
ccagccucagaucagggagcu

SEQ ID NO: 1129124 - RNA, 22 nt, Human
uccauggggcccaggaugagag

SEQ ID NO: 1129125 - RNA, 23 nt, Human
aacaccaaggcucagagagauaa

SEQ ID NO: 1129126 - RNA, 22 nt, Human
uugugugguagcuucauugaac

SEQ ID NO: 1129127 - RNA, 22 nt, Human
caggugcuguccugcacauguc

SEQ ID NO: 1129128 - RNA, 22 nt, Human
uagagaaaagcagggaucagga

SEQ ID NO: 1129129 - RNA, 22 nt, Human
cccagcucucugcucuuagccu

SEQ ID NO: 1129130 - RNA, 21 nt, Human
ugaaaguuggagucaaaugua

SEQ ID NO: 1129131 - RNA, 22 nt, Human
ugcuuuauguuaucagaagggu

SEQ ID NO: 1129132 - RNA, 22 nt, Human
cucuggcuuugcucaugcaucc

SEQ ID NO: 1129133 - RNA, 22 nt, Human
uggccugucuuguugugcuaga

SEQ ID NO: 1129134 - RNA, 22 nt, Human
cccaagaucuuucgugcacuaa

SEQ ID NO: 1129135 - RNA, 22 nt, Human
ugcuggcucaguuugcagacuc

SEQ ID NO: 1129136 - RNA, 22 nt, Human
augguugacccaugugaguuag

SEQ ID NO: 1129137 - RNA, 22 nt, Human
ccaccaggacagcccugagggg

SEQ ID NO: 1129138 - RNA, 22 nt, Human
cagacagaccugcaagggcaca

SEQ ID NO: 1129139 - RNA, 22 nt, Human
ucuggagcuggagggcaaggca

SEQ ID NO: 1129140 - RNA, 22 nt, Human
auaguauuuaauaguuagcuca

SEQ ID NO: 1129141 - RNA, 22 nt, Human
ucaugucaguuucuucuauaaa

SEQ ID NO: 1129142 - RNA, 22 nt, Human
caggcagcugacugucagauau

SEQ ID NO: 1129143 - RNA, 22 nt, Human
caaaugcaugagaaauaagagg

SEQ ID NO: 1129144 - RNA, 22 nt, Human
agggcagagcugucuaaauggc

SEQ ID NO: 1129145 - RNA, 22 nt, Human
gggccuggugcuucugacuccu

SEQ ID NO: 1129146 - RNA, 22 nt, Human
aggacucaucccugcuugucag

SEQ ID NO: 1129147 - RNA, 22 nt, Human
gagguagcaugcuggaagggac

SEQ ID NO: 1129148 - RNA, 22 nt, Human
acccagcuggaugcauggaggc

SEQ ID NO: 1129149 - RNA, 22 nt, Human
gcagagccaggagcccaggauc

SEQ ID NO: 1129150 - RNA, 22 nt, Human
cccaggagguggagguugcagu

SEQ ID NO: 1129151 - RNA, 22 nt, Human
ccugucauacuaacguaguggg

SEQ ID NO: 1129152 - RNA, 22 nt, Human
gcucugugccacaugcaguguu

SEQ ID NO: 1129153 - RNA, 20 nt, Human
uccaagggcagcagaaucag

SEQ ID NO: 1129154 - RNA, 22 nt, Human
ugcucccagggacucuggcugg

SEQ ID NO: 1129155 - RNA, 22 nt, Human
ggccugccucacagucagcacc

SEQ ID NO: 1129156 - RNA, 22 nt, Human
cauaagaaauaaugaugaugac

SEQ ID NO: 1129157 - RNA, 22 nt, Human
ccagagcccagcacacggugcu

SEQ ID NO: 1129158 - RNA, 22 nt, Human
aagggaggccagagguuuugca

SEQ ID NO: 1129159 - RNA, 22 nt, Human
cacugcagaucagaggcugaga

SEQ ID NO: 1129160 - RNA, 22 nt, Human
ugccugagugauguggcagcca

SEQ ID NO: 1129161 - RNA, 22 nt, Human
gcccagaguucaaggcugcagu

SEQ ID NO: 1129162 - RNA, 18 nt, Human
agcuggcccuggcugccg

SEQ ID NO: 1129163 - RNA, 22 nt, Human
uagcugcccaucuuuccuuuag

SEQ ID NO: 1129164 - RNA, 22 nt, Human
agggaagaagcugguaguaggu

SEQ ID NO: 1129165 - RNA, 22 nt, Human
uaguccauuuucacacugcuga

SEQ ID NO: 1129166 - RNA, 22 nt, Human
ucccagccuuucuuuucugcug

SEQ ID NO: 1129167 - RNA, 22 nt, Human
ggcuucccaaggagccaggaug

SEQ ID NO: 1129168 - RNA, 22 nt, Human
ggcucuggcguccaauggagcg

SEQ ID NO: 1129169 - RNA, 19 nt, Human
guggccucggagcgcgcgg

SEQ ID NO: 1129170 - RNA, 22 nt, Human
agccucugugacucacagguca

SEQ ID NO: 1129171 - RNA, 22 nt, Human
aacagcuuugcuucuggagaca

SEQ ID NO: 1129172 - RNA, 22 nt, Human
gacccagcuuaagucacauguu

SEQ ID NO: 1129173 - RNA, 22 nt, Human
gaggugagaagggggucagaug

SEQ ID NO: 1129174 - RNA, 20 nt, Human
ugcuccaucuaaagugauua

SEQ ID NO: 1129175 - RNA, 22 nt, Human
ucaaugauaguacaaucagccu

SEQ ID NO: 1129176 - RNA, 22 nt, Human
gagaggcuaugagguucugugu

SEQ ID NO: 1129177 - RNA, 22 nt, Human
uguguauuucuggaacagacua

SEQ ID NO: 1129178 - RNA, 22 nt, Human
cagaaauggagcccaggaaucu

SEQ ID NO: 1129179 - RNA, 22 nt, Human
ucagcuuggacagcuugguuga

SEQ ID NO: 1129180 - RNA, 22 nt, Human
ugaggggagaagcagcagccug

SEQ ID NO: 1129181 - RNA, 22 nt, Human
cauaccuuucucaagcacaugu

SEQ ID NO: 1129182 - RNA, 22 nt, Human
ggcucuggugugaagcagccuc

SEQ ID NO: 1129183 - RNA, 22 nt, Human
agucccagacuccaguuuucug

SEQ ID NO: 1129184 - RNA, 22 nt, Human
uugucugucccagcuugugcau

SEQ ID NO: 1129185 - RNA, 22 nt, Human
uguguuccuucgucuucccuuc

SEQ ID NO: 1129186 - RNA, 22 nt, Human
cuuccaaagcacuuuauggacc

SEQ ID NO: 1129187 - RNA, 20 nt, Human
cuuccacacaagaagcacag

SEQ ID NO: 1129188 - RNA, 22 nt, Human
agucauaauuauaaacaucagu

SEQ ID NO: 1129189 - RNA, 22 nt, Human
cagaauuugaaguaauauucca

SEQ ID NO: 1129190 - RNA, 22 nt, Human
caauguguguguuuuucucaac

SEQ ID NO: 1129191 - RNA, 22 nt, Human
cccagccaaggugcugguguug

SEQ ID NO: 1129192 - RNA, 22 nt, Human
ugugccugaguuggcugaguac

SEQ ID NO: 1129193 - RNA, 22 nt, Human
ccugccuggagcugagugugga

SEQ ID NO: 1129194 - RNA, 22 nt, Human
agcagccauagauagcaugcaa

SEQ ID NO: 1129195 - RNA, 22 nt, Human
gcuggccugaccagccacaggc

SEQ ID NO: 1129196 - RNA, 22 nt, Human
gucucccaucguuugugaggaa

SEQ ID NO: 1129197 - RNA, 18 nt, Human
gcuggcugcacuucugcu

SEQ ID NO: 1129198 - RNA, 22 nt, Human
aaguucaaguguaaucuuuauu

SEQ ID NO: 1129199 - RNA, 21 nt, Human
uguaugcacgcacaugcacac

SEQ ID NO: 1129200 - RNA, 19 nt, Human
ccuuccuccccagggccau

SEQ ID NO: 1129201 - RNA, 22 nt, Human
aagcaggcauuccagagacaau

SEQ ID NO: 1129202 - RNA, 22 nt, Human
gaggggcucuuuaauaguaaca

SEQ ID NO: 1129203 - RNA, 22 nt, Human
ggggcagagucuggacuguugu

SEQ ID NO: 1129204 - RNA, 19 nt, Human
gggaugggcccucacccuc

SEQ ID NO: 1129205 - RNA, 22 nt, Human
uucagucagugacuaagcaguu

SEQ ID NO: 1129206 - RNA, 22 nt, Human
acagcuggaggucugugagcac

SEQ ID NO: 1129207 - RNA, 22 nt, Human
ugugugugcaggagagcaggug

SEQ ID NO: 1129208 - RNA, 22 nt, Human
cuggagaggccccaagauauuu

SEQ ID NO: 1129209 - RNA, 22 nt, Human
acugaguguaggacuuugaguu

SEQ ID NO: 1129210 - RNA, 22 nt, Human
uggcagaguaggauggcccugu

SEQ ID NO: 1129211 - RNA, 22 nt, Human
cugugcugauucagcacaggcc

SEQ ID NO: 1129212 - RNA, 22 nt, Human
ugcaaacaggagaguaaguaua

SEQ ID NO: 1129213 - RNA, 22 nt, Human
uccugagaugagacagugcugc

SEQ ID NO: 1129214 - RNA, 22 nt, Human
aucccugcccucauggagcuua

SEQ ID NO: 1129215 - RNA, 22 nt, Human
aggcacugaaagguggccagag

SEQ ID NO: 1129216 - RNA, 21 nt, Human
gggcagaggggccuccugggu

SEQ ID NO: 1129217 - RNA, 22 nt, Human
acacagccaggguaguaaggcu

SEQ ID NO: 1129218 - RNA, 22 nt, Human
uccuggagagugggcgagcaca

SEQ ID NO: 1129219 - RNA, 22 nt, Human
augcaguacauacaaacacuga

SEQ ID NO: 1129220 - RNA, 22 nt, Human
aauaacaggcucaucagaugcu

SEQ ID NO: 1129221 - RNA, 22 nt, Human
gaaggaaaucugugauuuaugc

SEQ ID NO: 1129222 - RNA, 22 nt, Human
gcuggcuccucuguccucacgg

SEQ ID NO: 1129223 - RNA, 22 nt, Human
aggcugaggcagguggaucacu

SEQ ID NO: 1129224 - RNA, 22 nt, Human
gcuucccacagcuggacugggg

SEQ ID NO: 1129225 - RNA, 22 nt, Human
augauacaucuucaugucagug

SEQ ID NO: 1129226 - RNA, 22 nt, Human
aaggcgacacaggcagcaggcc

SEQ ID NO: 1129227 - RNA, 22 nt, Human
gcaggcagagagggguuuccag

SEQ ID NO: 1129228 - RNA, 22 nt, Human
gcaggagagucugugccagguu

SEQ ID NO: 1129229 - RNA, 22 nt, Human
gcugaguguaaugauggcagag

SEQ ID NO: 1129230 - RNA, 22 nt, Human
uggggacacagagccaaacuau

SEQ ID NO: 1129231 - RNA, 22 nt, Human
auguacauuuagaucauuucug

SEQ ID NO: 1129232 - RNA, 22 nt, Human
acuggacagaggaaauauggag

SEQ ID NO: 1129233 - RNA, 22 nt, Human
agaauucuccuucagggcagga

SEQ ID NO: 1129234 - RNA, 22 nt, Human
auugacaaucuacuauguucug

SEQ ID NO: 1129235 - RNA, 22 nt, Human
ccacagcugaccgcaggugagc

SEQ ID NO: 1129236 - RNA, 20 nt, Human
aagagcauaguacaggaaga

SEQ ID NO: 1129237 - RNA, 21 nt, Human
cugaggcagcacagcuaguca

SEQ ID NO: 1129238 - RNA, 22 nt, Human
gaggcagagugcaccccaggag

SEQ ID NO: 1129239 - RNA, 18 nt, Human
cagaagcaggcagugcag

SEQ ID NO: 1129240 - RNA, 22 nt, Human
gugaggugguacaauauuaacu

SEQ ID NO: 1129241 - RNA, 22 nt, Human
gggcuggcaucaguugccgaga

SEQ ID NO: 1129242 - RNA, 21 nt, Human
aaacugaccuugccugagaca

SEQ ID NO: 1129243 - RNA, 22 nt, Human
aggggcugacuggaaagugcca

SEQ ID NO: 1129244 - RNA, 19 nt, Human
uccucaggggcucacagac

SEQ ID NO: 1129245 - RNA, 22 nt, Human
cuggaagguucuuugugugccu

SEQ ID NO: 1129246 - RNA, 20 nt, Human
gucucagaauggauuugcau

SEQ ID NO: 1129247 - RNA, 20 nt, Human
cucucccagcacagcuuccu

SEQ ID NO: 1129248 - RNA, 22 nt, Human
uggcagcuguguccagguagaa

SEQ ID NO: 1129249 - RNA, 22 nt, Human
gcugcucuacccaugcaucugu

SEQ ID NO: 1129250 - RNA, 17 nt, Human
aggcugcugggccaggg

SEQ ID NO: 1129251 - RNA, 22 nt, Human
aaugagcugcugcuguuccacc

SEQ ID NO: 1129252 - RNA, 22 nt, Human
agagcccugaagcagagcuaaa

SEQ ID NO: 1129253 - RNA, 20 nt, Human
ugucaugcauuagaugaaga

SEQ ID NO: 1129254 - RNA, 22 nt, Human
ucucagaggucuucagccucug

SEQ ID NO: 1129255 - RNA, 22 nt, Human
cagucacacaaguggacuuggg

SEQ ID NO: 1129256 - RNA, 22 nt, Human
cugcccugcuugaugacagcga

SEQ ID NO: 1129257 - RNA, 22 nt, Human
uccagccacucagcagggauug

SEQ ID NO: 1129258 - RNA, 22 nt, Human
aggcuucuuagauuggcuggag

SEQ ID NO: 1129259 - RNA, 22 nt, Human
ugcugccagccaggccauggag

SEQ ID NO: 1129260 - RNA, 22 nt, Human
aguuuauguaaaauuaguaaug

SEQ ID NO: 1129261 - RNA, 22 nt, Human
ucugucacccgagcaggcgaga

SEQ ID NO: 1129262 - RNA, 22 nt, Human
aaacuuuaagacaguccucaag

SEQ ID NO: 1129263 - RNA, 22 nt, Human
ggagcuguugcgcaugcgcucg

SEQ ID NO: 1129264 - RNA, 22 nt, Human
aggcacugauucuguuuuccau

SEQ ID NO: 1129265 - RNA, 22 nt, Human
uuccaaagaaauugaccaagac

SEQ ID NO: 1129266 - RNA, 22 nt, Human
uuuagaaauugcagagugggug

SEQ ID NO: 1129267 - RNA, 21 nt, Human
gcagccacugccuucaacaau

SEQ ID NO: 1129268 - RNA, 22 nt, Human
gagcucccaggccccagcaagg

SEQ ID NO: 1129269 - RNA, 20 nt, Human
agucucuguagugccugaga

SEQ ID NO: 1129270 - RNA, 22 nt, Human
gagugcagaugaacagaagauu

SEQ ID NO: 1129271 - RNA, 18 nt, Human
cguuuuuccgggauugca

SEQ ID NO: 1129272 - RNA, 22 nt, Human
aggaagccuggggcugcccucg

SEQ ID NO: 1129273 - RNA, 22 nt, Human
gggagagagagcucauguugaa

SEQ ID NO: 1129274 - RNA, 20 nt, Human
aggcagacaaggagucuguu

SEQ ID NO: 1129275 - RNA, 22 nt, Human
gaggagagggcugcgggcccac

SEQ ID NO: 1129276 - RNA, 22 nt, Human
ccagcuggagcucgcagauagg

SEQ ID NO: 1129277 - RNA, 22 nt, Human
ggcuuucuagaucuagcucugu

SEQ ID NO: 1129278 - RNA, 22 nt, Human
cagcugccagcuucucuccauc

SEQ ID NO: 1129279 - RNA, 22 nt, Human
ugggauaguggccaggaccccc

SEQ ID NO: 1129280 - RNA, 22 nt, Human
uagcaguggaaucuuuugucca

SEQ ID NO: 1129281 - RNA, 22 nt, Human
uccagucaagcuugagaauuuc

SEQ ID NO: 1129282 - RNA, 22 nt, Human
gcaggccagcugugcagauggg

SEQ ID NO: 1129283 - RNA, 22 nt, Human
gcaagcaagcagguagagcuga

SEQ ID NO: 1129284 - RNA, 23 nt, Human
acagcaagaggaccagaugugag

SEQ ID NO: 1129285 - RNA, 23 nt, Human
ccuccugggcacaggccugaugg

SEQ ID NO: 1129286 - RNA, 22 nt, Human
uguguacaagaguguuuacugu

SEQ ID NO: 1129287 - RNA, 22 nt, Human
ucuggcucggauuugucuagca

SEQ ID NO: 1129288 - RNA, 20 nt, Human
gcccacucuaauccacuguc

SEQ ID NO: 1129289 - RNA, 22 nt, Human
ccacaggggcccacgagccgcu

SEQ ID NO: 1129290 - RNA, 22 nt, Human
uccaguggcacuggagacuaga

SEQ ID NO: 1129291 - RNA, 22 nt, Human
uagggcagagcuuguacacgau

SEQ ID NO: 1129292 - RNA, 22 nt, Human
uggaaggcaugggaacuguucu

SEQ ID NO: 1129293 - RNA, 22 nt, Human
ccucugcucugguccaugugcu

SEQ ID NO: 1129294 - RNA, 22 nt, Human
cagagaccccgcugcccuucug

SEQ ID NO: 1129295 - RNA, 22 nt, Human
aggcagagcugauguucuguga

SEQ ID NO: 1129296 - RNA, 22 nt, Human
cugcccuguggcucugagucau

SEQ ID NO: 1129297 - RNA, 22 nt, Human
aucuacagugcacaggacagcc

SEQ ID NO: 1129298 - RNA, 22 nt, Human
ugggcagagucguggggaauag

SEQ ID NO: 1129299 - RNA, 22 nt, Human
cugaggugagcuucccugggcu

SEQ ID NO: 1129300 - RNA, 22 nt, Human
ucugggcacugcugagccugua

SEQ ID NO: 1129301 - RNA, 22 nt, Human
aauuucaaacuaauaggaacca

SEQ ID NO: 1129302 - RNA, 20 nt, Human
ggcucugcuugugagcagcc

SEQ ID NO: 1129303 - RNA, 23 nt, Human
gccagccuugcucuccugcagcc

SEQ ID NO: 1129304 - RNA, 22 nt, Human
ucugagaguccaucuccaagcc

SEQ ID NO: 1129305 - RNA, 22 nt, Human
ccaaaguccauaguuuacauaa

SEQ ID NO: 1129306 - RNA, 22 nt, Human
caaggaaaaagcgagcucgggg

SEQ ID NO: 1129307 - RNA, 22 nt, Human
ggcucugcagugacuugagggg

SEQ ID NO: 1129308 - RNA, 22 nt, Human
uggcagaguuggagguggaaga

SEQ ID NO: 1129309 - RNA, 22 nt, Human
ggcaggagcucuccaguuugcc

SEQ ID NO: 1129310 - RNA, 22 nt, Human
uccuggaguauuucuguggugu

SEQ ID NO: 1129311 - RNA, 22 nt, Human
ggcucaggagaggggcuaaaag

SEQ ID NO: 1129312 - RNA, 22 nt, Human
ggccucacccaucggugccuuu

SEQ ID NO: 1129313 - RNA, 22 nt, Human
gccuggaguucagccaaguccc

SEQ ID NO: 1129314 - RNA, 19 nt, Human
uccuucagucagaucuggg

SEQ ID NO: 1129315 - RNA, 22 nt, Human
auacuuacuuuucuucagacua

SEQ ID NO: 1129316 - RNA, 22 nt, Human
ggcacugggcaccggcugaggg

SEQ ID NO: 1129317 - RNA, 21 nt, Human
ggagucauuagucauuuccuu

SEQ ID NO: 1129318 - RNA, 22 nt, Human
aguacagaccugucucuuccug

SEQ ID NO: 1129319 - RNA, 22 nt, Human
agagcagauggccagggggccu

SEQ ID NO: 1129320 - RNA, 22 nt, Human
aggagaaguaaggcuagaugau

SEQ ID NO: 1129321 - RNA, 22 nt, Human
uggccugcuuucauuugaugcu

SEQ ID NO: 1129322 - RNA, 23 nt, Human
cuggcucuguagguggcauccuu

SEQ ID NO: 1129323 - RNA, 22 nt, Human
agugaaauaaagcugccuaugg

SEQ ID NO: 1129324 - RNA, 22 nt, Human
gccagguggcugagugacugag

SEQ ID NO: 1129325 - RNA, 19 nt, Human
gugauuucuuuccacaagc

SEQ ID NO: 1129326 - RNA, 22 nt, Human
aacaucagaauauccauguugg

SEQ ID NO: 1129327 - RNA, 20 nt, Human
uaagaacaagacuaggaagc

SEQ ID NO: 1129328 - RNA, 22 nt, Human
acccugagucagacagccugac

SEQ ID NO: 1129329 - RNA, 21 nt, Human
gccagggaagagaguuggcug

SEQ ID NO: 1129330 - RNA, 22 nt, Human
aagccgggccugagaaaugaca

SEQ ID NO: 1129331 - RNA, 22 nt, Human
ugugcgcgugcacgcauacuug

SEQ ID NO: 1129332 - RNA, 22 nt, Human
ggugggcagcucuuggcaggca

SEQ ID NO: 1129333 - RNA, 23 nt, Human
gcucagagguuuuucucuggaug

SEQ ID NO: 1129334 - RNA, 19 nt, Human
cugggagguguucagagaa

SEQ ID NO: 1129335 - RNA, 19 nt, Human
gccucugcuggggacaggc

SEQ ID NO: 1129336 - RNA, 22 nt, Human
gcuccaggagagggaagcagau

SEQ ID NO: 1129337 - RNA, 22 nt, Human
ccugcccagcuucaccucaggc

SEQ ID NO: 1129338 - RNA, 22 nt, Human
gggggcuguccugugcauugua

SEQ ID NO: 1129339 - RNA, 22 nt, Human
auccaggguguggagagagcuc

SEQ ID NO: 1129340 - RNA, 22 nt, Human
uccaggaggaggaaggcugcca

SEQ ID NO: 1129341 - RNA, 22 nt, Human
aaauacagaguugcuuaaaagc

SEQ ID NO: 1129342 - RNA, 22 nt, Human
ccuggagcgcgggucaagcugg

SEQ ID NO: 1129343 - RNA, 22 nt, Human
uacauauagacaguuacucuag

SEQ ID NO: 1129344 - RNA, 22 nt, Human
aacucagucauaaagcgaaugc

SEQ ID NO: 1129345 - RNA, 22 nt, Human
uucauuccugagcccauauuua

SEQ ID NO: 1129346 - RNA, 18 nt, Human
acccucuggcuucugagc

SEQ ID NO: 1129347 - RNA, 22 nt, Human
uccauaagcagguucuuccuga

SEQ ID NO: 1129348 - RNA, 22 nt, Human
ugcugucaguuggcaggaugag

SEQ ID NO: 1129349 - RNA, 22 nt, Human
uggcugcugcuuggucuucuuc

SEQ ID NO: 1129350 - RNA, 22 nt, Human
ucccagaguuuccuguguccca

SEQ ID NO: 1129351 - RNA, 22 nt, Human
ugagaguauuuuggcauuauca

SEQ ID NO: 1129352 - RNA, 22 nt, Human
gcaagcaguuguggcuucugag

SEQ ID NO: 1129353 - RNA, 22 nt, Human
aaaggugacacucugccagcug

SEQ ID NO: 1129354 - RNA, 22 nt, Human
aaggcacuuaacgugggaggau

SEQ ID NO: 1129355 - RNA, 22 nt, Human
ccgggcgggggcucucgucacc

SEQ ID NO: 1129356 - RNA, 22 nt, Human
ugcauuauuugcaugugccugu

SEQ ID NO: 1129357 - RNA, 22 nt, Human
uauucacaguugauuuacaguu

SEQ ID NO: 1129358 - RNA, 22 nt, Human
uguauauucugccuaaaagcuu

SEQ ID NO: 1129359 - RNA, 22 nt, Human
uccuucagauuccugcuucugg

SEQ ID NO: 1129360 - RNA, 22 nt, Human
ggggauggaggcgugugguccu

SEQ ID NO: 1129361 - RNA, 22 nt, Human
ucacagaauagcacuguaagcg

SEQ ID NO: 1129362 - RNA, 22 nt, Human
ccaaagucuggagcagcagagc

SEQ ID NO: 1129363 - RNA, 23 nt, Human
acucacaaagcaggaucauguug

SEQ ID NO: 1129364 - RNA, 17 nt, Human
agcugccagggagugug

SEQ ID NO: 1129365 - RNA, 22 nt, Human
ucaggcugugggcacuggccau

SEQ ID NO: 1129366 - RNA, 22 nt, Human
ggcuucugaaaucucugugcgu

SEQ ID NO: 1129367 - RNA, 20 nt, Human
uugcauuggaugugcaggug

SEQ ID NO: 1129368 - RNA, 22 nt, Human
gaggcagcagggcugguuccuu

SEQ ID NO: 1129369 - RNA, 22 nt, Human
acguguucaauuuccaucugac

SEQ ID NO: 1129370 - RNA, 22 nt, Human
agcauuuaugacuaauguaaaa

SEQ ID NO: 1129371 - RNA, 22 nt, Human
gggcugccuuucuucugggagc

SEQ ID NO: 1129372 - RNA, 22 nt, Human
ugcugcucuguaaagugaugag

SEQ ID NO: 1129373 - RNA, 22 nt, Human
ccugagcugaacuaagcaguuu

SEQ ID NO: 1129374 - RNA, 22 nt, Human
cagggugccucccgcucgccgg

SEQ ID NO: 1129375 - RNA, 22 nt, Human
agcuguguguuuccacugagcu

SEQ ID NO: 1129376 - RNA, 22 nt, Human
gcugggagcaaguacucaucuu

SEQ ID NO: 1129377 - RNA, 23 nt, Human
ggaguuggauuguacuugcugcu

SEQ ID NO: 1129378 - RNA, 22 nt, Human
uuguaacaaucugucauaaaug

SEQ ID NO: 1129379 - RNA, 23 nt, Human
cugcagccgcguggggacgugga

SEQ ID NO: 1129380 - RNA, 22 nt, Human
uggcucugugucucccagcagc

SEQ ID NO: 1129381 - RNA, 22 nt, Human
guggcagcaaaauccugcauuc

SEQ ID NO: 1129382 - RNA, 22 nt, Human
accagcuguguccuggcugcag

SEQ ID NO: 1129383 - RNA, 22 nt, Human
cuguggcugcagccuugguccu

SEQ ID NO: 1129384 - RNA, 22 nt, Human
ggcagcaggcgacuucccuauu

SEQ ID NO: 1129385 - RNA, 21 nt, Human
aggcugcuggcucaggguccu

SEQ ID NO: 1129386 - RNA, 22 nt, Human
agcugucuaccugcagaguccu

SEQ ID NO: 1129387 - RNA, 22 nt, Human
ugggcugcugagaaugagagag

SEQ ID NO: 1129388 - RNA, 22 nt, Human
cagcugccaugacauguccugc

SEQ ID NO: 1129389 - RNA, 22 nt, Human
acagacagggcaccugccuccu

SEQ ID NO: 1129390 - RNA, 22 nt, Human
gcagcuggggaggucgugggga

SEQ ID NO: 1129391 - RNA, 22 nt, Human
uagcagggucucaggagucagg

SEQ ID NO: 1129392 - RNA, 22 nt, Human
aaugaugguauugaugagcuaa

SEQ ID NO: 1129393 - RNA, 22 nt, Human
cugagcugguggaagcaugcag

SEQ ID NO: 1129394 - RNA, 22 nt, Human
agugaguggacccugcaaggaa

SEQ ID NO: 1129395 - RNA, 19 nt, Human
cugguccugacugaggggu

SEQ ID NO: 1129396 - RNA, 22 nt, Human
gcccaucaucacuguggaggcu

SEQ ID NO: 1129397 - RNA, 22 nt, Human
uccugccuuagagcaaggaaaa

SEQ ID NO: 1129398 - RNA, 22 nt, Human
guggccagaagacugcaaugcu

SEQ ID NO: 1129399 - RNA, 22 nt, Human
uauauauucuuaaguaguguag

SEQ ID NO: 1129400 - RNA, 22 nt, Human
gaggaaaagagacagguuauug

SEQ ID NO: 1129401 - RNA, 22 nt, Human
uuuccucugaugcugacuugga

SEQ ID NO: 1129402 - RNA, 22 nt, Human
ugggcagauuaaugcaguggcu

SEQ ID NO: 1129403 - RNA, 17 nt, Human
agcugagcuggccaggg

SEQ ID NO: 1129404 - RNA, 22 nt, Human
gagguucacaggcuaucacagu

SEQ ID NO: 1129405 - RNA, 22 nt, Human
uagucccauuuugagguauuug

SEQ ID NO: 1129406 - RNA, 22 nt, Human
ucagagugaccuuacauggucu

SEQ ID NO: 1129407 - RNA, 22 nt, Human
gugucaugggagucagaaguga

SEQ ID NO: 1129408 - RNA, 22 nt, Human
ugagcccaggaguaugaggcug

SEQ ID NO: 1129409 - RNA, 22 nt, Human
gagcugccagacaugggaauga

SEQ ID NO: 1129410 - RNA, 22 nt, Human
ucuggcucucucaucacccaau

SEQ ID NO: 1129411 - RNA, 20 nt, Human
agaagcugauacugauggaa

SEQ ID NO: 1129412 - RNA, 22 nt, Human
agaaaucucaguaucucaggga

SEQ ID NO: 1129413 - RNA, 22 nt, Human
gcacugaaauuauaugcauuug

SEQ ID NO: 1129414 - RNA, 22 nt, Human
agcaguggccuggggcucugug

SEQ ID NO: 1129415 - RNA, 17 nt, Human
ccuuucucuuucaucuc

SEQ ID NO: 1129416 - RNA, 22 nt, Human
gcaggagccaggccgagcuggu

SEQ ID NO: 1129417 - RNA, 22 nt, Human
gaaccaaguaggauacaaggag

SEQ ID NO: 1129418 - RNA, 22 nt, Human
aggucauuccagccauuccccu

SEQ ID NO: 1129419 - RNA, 20 nt, Human
uuccuguauacaaagaguuc

SEQ ID NO: 1129420 - RNA, 22 nt, Human
gccugagauucugcauuucuaa

SEQ ID NO: 1129421 - RNA, 21 nt, Human
ugcugccaucaugcagagaug

SEQ ID NO: 1129422 - RNA, 22 nt, Human
agcucccagagcucgagaguaa

SEQ ID NO: 1129423 - RNA, 22 nt, Human
auaaggcaagcugucaguuugu

SEQ ID NO: 1129424 - RNA, 23 nt, Human
agcuggguggccugcgugaagcu

SEQ ID NO: 1129425 - RNA, 22 nt, Human
uuuguaaauagcaguacucaug

SEQ ID NO: 1129426 - RNA, 22 nt, Human
acagauauaaacuauaguagug

SEQ ID NO: 1129427 - RNA, 22 nt, Human
caaggcaggaagccugucuuau

SEQ ID NO: 1129428 - RNA, 21 nt, Human
ugcuggccucaagggugacuu

SEQ ID NO: 1129429 - RNA, 22 nt, Human
ggcgcuggccacgguggcucug

SEQ ID NO: 1129430 - RNA, 22 nt, Human
accagagcagacuacuggaggu

SEQ ID NO: 1129431 - RNA, 22 nt, Human
ccugucagcugauggcuaugua

SEQ ID NO: 1129432 - RNA, 23 nt, Human
ccuucagaagaaguaacaggggc

SEQ ID NO: 1129433 - RNA, 16 nt, Human
gccuggaguggcaggg

SEQ ID NO: 1129434 - RNA, 19 nt, Human
cugaggugcaguaagaggc

SEQ ID NO: 1129435 - RNA, 22 nt, Human
cccuucagcugagugggacagc

SEQ ID NO: 1129436 - RNA, 22 nt, Human
agcagaacauuuucagggcugu

SEQ ID NO: 1129437 - RNA, 22 nt, Human
accauuuaauaaguauuuccau

SEQ ID NO: 1129438 - RNA, 22 nt, Human
ugggcagaggacagggaagauc

SEQ ID NO: 1129439 - RNA, 22 nt, Human
ggcccacacugacagcugagcu

SEQ ID NO: 1129440 - RNA, 22 nt, Human
ugcccagcacugugccagucac

SEQ ID NO: 1129441 - RNA, 22 nt, Human
gcagguggcagaggugggaucu

SEQ ID NO: 1129442 - RNA, 18 nt, Human
uaaaugcauguuaauaac

SEQ ID NO: 1129443 - RNA, 22 nt, Human
aauaugcauguauacaugugua

SEQ ID NO: 1129444 - RNA, 22 nt, Human
gcuggcucccauugguccuucc

SEQ ID NO: 1129445 - RNA, 22 nt, Human
agcuggguggagggcccacggu

SEQ ID NO: 1129446 - RNA, 16 nt, Human
uggaaggggucuccgg

SEQ ID NO: 1129447 - RNA, 22 nt, Human
ugcucugcaagcaggagcaaga

SEQ ID NO: 1129448 - RNA, 21 nt, Human
agcagaacagucgagcacugc

SEQ ID NO: 1129449 - RNA, 19 nt, Human
ucaaugcaugaaaucagcc

SEQ ID NO: 1129450 - RNA, 22 nt, Human
cuuagaaauuguuacucauuca

SEQ ID NO: 1129451 - RNA, 22 nt, Human
cacucugcagcugaagggcugg

SEQ ID NO: 1129452 - RNA, 22 nt, Human
uccugccuguuuaccuguacuu

SEQ ID NO: 1129453 - RNA, 22 nt, Human
uuauccaaacuggugaaucauu

SEQ ID NO: 1129454 - RNA, 21 nt, Human
ucucuggaguuagcagagaga

SEQ ID NO: 1129455 - RNA, 22 nt, Human
aguaaacauaauuuaccuguag

SEQ ID NO: 1129456 - RNA, 22 nt, Human
cagggccaguucucgcagcagu

SEQ ID NO: 1129457 - RNA, 22 nt, Human
gcagcugcuguggcaucaagcu

SEQ ID NO: 1129458 - RNA, 22 nt, Human
uggggcugugagacuacaggau

SEQ ID NO: 1129459 - RNA, 22 nt, Human
cugcuuuguggaaucacacugg

SEQ ID NO: 1129460 - RNA, 22 nt, Human
ugccugaugcaggaguaucaga

SEQ ID NO: 1129461 - RNA, 22 nt, Human
cuggcccauggugagcucuggg

SEQ ID NO: 1129462 - RNA, 23 nt, Human
uggccuggagagaaaagaugagu

SEQ ID NO: 1129463 - RNA, 22 nt, Human
cgggcuggcugcagcugcugga

SEQ ID NO: 1129464 - RNA, 22 nt, Human
acccaggagcaggcugggcagu

SEQ ID NO: 1129465 - RNA, 22 nt, Human
auauaaaguguuuagaaagcug

SEQ ID NO: 1129466 - RNA, 22 nt, Human
uguggccuggaaggggcugcuc

SEQ ID NO: 1129467 - RNA, 22 nt, Human
aaagagcuaacauugccgagau

SEQ ID NO: 1129468 - RNA, 22 nt, Human
ucuggaaguuagaggaggaaag

SEQ ID NO: 1129469 - RNA, 22 nt, Human
agaaaugugaauuucauuuccu

SEQ ID NO: 1129470 - RNA, 22 nt, Human
uguuuugugcauuuacaacaug

SEQ ID NO: 1129471 - RNA, 22 nt, Human
cacacaugagucuccccauugg

SEQ ID NO: 1129472 - RNA, 22 nt, Human
acugaaauacugcucuuggauu

SEQ ID NO: 1129473 - RNA, 21 nt, Human
agugaaauugcaucagaggga

SEQ ID NO: 1129474 - RNA, 22 nt, Human
aggcagcuggcagcacccaggg

SEQ ID NO: 1129475 - RNA, 22 nt, Human
agggacaguuacaucaucagac

SEQ ID NO: 1129476 - RNA, 22 nt, Human
gccaggccugcaagugcuggug

SEQ ID NO: 1129477 - RNA, 22 nt, Human
ucacaccuguaaucccaggccu

SEQ ID NO: 1129478 - RNA, 22 nt, Human
cccagccuggugcacugugggg

SEQ ID NO: 1129479 - RNA, 22 nt, Human
acccugagggguauagcagaag

SEQ ID NO: 1129480 - RNA, 22 nt, Human
ggggcacacuuuugguagauau

SEQ ID NO: 1129481 - RNA, 22 nt, Human
ggcugccucugaugugcagacg

SEQ ID NO: 1129482 - RNA, 22 nt, Human
caggcagcagccacucugguau

SEQ ID NO: 1129483 - RNA, 22 nt, Human
cauucauuagaauagauaugua

SEQ ID NO: 1129484 - RNA, 22 nt, Human
aaggcagccgugugacugcaug

SEQ ID NO: 1129485 - RNA, 22 nt, Human
cugggagcccugacuagccugg

SEQ ID NO: 1129486 - RNA, 22 nt, Human
uggagaagucaaagugaacagg

SEQ ID NO: 1129487 - RNA, 22 nt, Human
cuuucucugugugguaaagggc

SEQ ID NO: 1129488 - RNA, 22 nt, Human
uccuucagaggacggcagccag

SEQ ID NO: 1129489 - RNA, 22 nt, Human
ugaugcugagccugggacugac

SEQ ID NO: 1129490 - RNA, 22 nt, Human
ggccccugcggacugccuagag

SEQ ID NO: 1129491 - RNA, 22 nt, Human
caguggguggcuaaguggcuga

SEQ ID NO: 1129492 - RNA, 21 nt, Human
gggagcuggaaacugggugac

SEQ ID NO: 1129493 - RNA, 22 nt, Human
agggcugccugcucugcauuga

SEQ ID NO: 1129494 - RNA, 22 nt, Human
caguggcuguuucuggaaggca

SEQ ID NO: 1129495 - RNA, 22 nt, Human
ccucuucugagugagacucccu

SEQ ID NO: 1129496 - RNA, 22 nt, Human
cacaagucuguggucuccaaca

SEQ ID NO: 1129497 - RNA, 22 nt, Human
gcagggaccugccacugcuguc

SEQ ID NO: 1129498 - RNA, 23 nt, Human
gcagaggagcaagcuggacacca

SEQ ID NO: 1129499 - RNA, 22 nt, Human
gcaggcugauagaggauuccau

SEQ ID NO: 1129500 - RNA, 22 nt, Human
uggacagcgaaagugccuggga

SEQ ID NO: 1129501 - RNA, 22 nt, Human
uggugccuugggccuacagcgc

SEQ ID NO: 1129502 - RNA, 22 nt, Human
cagugcauaaucuaaauggggg

SEQ ID NO: 1129503 - RNA, 22 nt, Human
gggcagcugccaagugcaucgc

SEQ ID NO: 1129504 - RNA, 22 nt, Human
gcagacagccagacugcacugg

SEQ ID NO: 1129505 - RNA, 22 nt, Human
gggcagugguuacacagcugag

SEQ ID NO: 1129506 - RNA, 22 nt, Human
cucacagaugcugugggucagg

SEQ ID NO: 1129507 - RNA, 22 nt, Human
ccuggagcuuuuccauccugga

SEQ ID NO: 1129508 - RNA, 22 nt, Human
cagucccaguuugagacucugg

SEQ ID NO: 1129509 - RNA, 22 nt, Human
aaagguuaagguguucaagaaa

SEQ ID NO: 1129510 - RNA, 22 nt, Human
cucacugcaaguuccaccuacc

SEQ ID NO: 1129511 - RNA, 22 nt, Human
gagccuggagcuggaacgaagc

SEQ ID NO: 1129512 - RNA, 17 nt, Human
gcucccugaggacagcu

SEQ ID NO: 1129513 - RNA, 21 nt, Human
ccccugggagcccugucagua

SEQ ID NO: 1129514 - RNA, 22 nt, Human
gcagcuguggguuccaagucua

SEQ ID NO: 1129515 - RNA, 22 nt, Human
cugaaggaagcagaagcgaggu

SEQ ID NO: 1129516 - RNA, 22 nt, Human
cuggggccacaacggcgcacgc

SEQ ID NO: 1129517 - RNA, 22 nt, Human
cugaaggagcauagucaguuuu

SEQ ID NO: 1129518 - RNA, 22 nt, Human
uccucaggagagcuccuaugcc

SEQ ID NO: 1129519 - RNA, 19 nt, Human
uaaaaugucuguggucagu

SEQ ID NO: 1129520 - RNA, 22 nt, Human
gccuuggccaacaccuugcaaa

SEQ ID NO: 1129521 - RNA, 23 nt, Human
ugcuguccaacagacuggccaug

SEQ ID NO: 1129522 - RNA, 22 nt, Human
acagagcuuaauucaggagcuu

SEQ ID NO: 1129523 - RNA, 22 nt, Human
uaggcagcugcaaacuucgguc

SEQ ID NO: 1129524 - RNA, 22 nt, Human
cagcagggggcagcgcagauca

SEQ ID NO: 1129525 - RNA, 22 nt, Human
ugcuggaggggccugaccagga

SEQ ID NO: 1129526 - RNA, 22 nt, Human
agcugccacaugcccaagggca

SEQ ID NO: 1129527 - RNA, 22 nt, Human
cagcagguauguuuguucagca

SEQ ID NO: 1129528 - RNA, 22 nt, Human
cacugaaggcugcagcucagcc

SEQ ID NO: 1129529 - RNA, 22 nt, Human
gagcagcuguccccaaagcuuc

SEQ ID NO: 1129530 - RNA, 19 nt, Human
aucagcaagguaggaugug

SEQ ID NO: 1129531 - RNA, 21 nt, Human
aggcagaaagagcccaggcug

SEQ ID NO: 1129532 - RNA, 22 nt, Human
aaucaguuguucacucugaaaa

SEQ ID NO: 1129533 - RNA, 19 nt, Human
cugcucaggucagucuguc

SEQ ID NO: 1129534 - RNA, 22 nt, Human
agaaaucugacugcugugcaca

SEQ ID NO: 1129535 - RNA, 22 nt, Human
uuugacagauccuuaacucagc

SEQ ID NO: 1129536 - RNA, 20 nt, Human
cccaggagugagcagcuuua

SEQ ID NO: 1129537 - RNA, 22 nt, Human
uauuucuugaguggucaguuuc

SEQ ID NO: 1129538 - RNA, 22 nt, Human
gccugaugagcuuccagcugag

SEQ ID NO: 1129539 - RNA, 20 nt, Human
acaaaugcauucugugacau

SEQ ID NO: 1129540 - RNA, 22 nt, Human
ugaaccagagucuccagugguu

SEQ ID NO: 1129541 - RNA, 22 nt, Human
gagaccaggaaguacagcagcc

SEQ ID NO: 1129542 - RNA, 22 nt, Human
cagcugccacaccucuuucucu

SEQ ID NO: 1129543 - RNA, 22 nt, Human
auaccuuuuagacauguaguug

SEQ ID NO: 1129544 - RNA, 23 nt, Human
ccugcagcugcuggggcuccacc

SEQ ID NO: 1129545 - RNA, 20 nt, Human
accuugaacccgccagccau

SEQ ID NO: 1129546 - RNA, 23 nt, Human
acagggcauugcuggccucgagg

SEQ ID NO: 1129547 - RNA, 22 nt, Human
ugcaguggaagagguggagauc

SEQ ID NO: 1129548 - RNA, 23 nt, Human
uggggcugauggagacggaccag

SEQ ID NO: 1129549 - RNA, 22 nt, Human
cuucccagaccuuagagugcag

SEQ ID NO: 1129550 - RNA, 22 nt, Human
gugccuggcaugcgccggugcu

SEQ ID NO: 1129551 - RNA, 19 nt, Human
guguauguaaguugugagg

SEQ ID NO: 1129552 - RNA, 22 nt, Human
cccuggagguggagguugcagg

SEQ ID NO: 1129553 - RNA, 22 nt, Human
aaggcucuuggagugaaugcag

SEQ ID NO: 1129554 - RNA, 22 nt, Human
gcaaggaccuuugagcgugcca

SEQ ID NO: 1129555 - RNA, 22 nt, Human
auacauauaugguacuuccugg

SEQ ID NO: 1129556 - RNA, 22 nt, Human
ccuggcagcgugccgagcugcg

SEQ ID NO: 1129557 - RNA, 22 nt, Human
uaaggcagaaauaugagcaggg

SEQ ID NO: 1129558 - RNA, 22 nt, Human
cugaaggauuuaguucuuugcu

SEQ ID NO: 1129559 - RNA, 22 nt, Human
agcaccuggucuccuggcgcug

SEQ ID NO: 1129560 - RNA, 22 nt, Human
agagcuggaaucagaccucagg

SEQ ID NO: 1129561 - RNA, 22 nt, Human
cccuggggcugagggauggccg

SEQ ID NO: 1129562 - RNA, 22 nt, Human
gcuugcucaacccccgucucuc

SEQ ID NO: 1129563 - RNA, 22 nt, Human
gcagcccaaaaaagagguagau

SEQ ID NO: 1129564 - RNA, 22 nt, Human
ucugaggcuaagagacagaggc

SEQ ID NO: 1129565 - RNA, 22 nt, Human
guuauaaaggugauaaugguca

SEQ ID NO: 1129566 - RNA, 22 nt, Human
aagcccagcugaaagcauuuuu

SEQ ID NO: 1129567 - RNA, 22 nt, Human
ucugagcauugaauuuucuucc

SEQ ID NO: 1129568 - RNA, 22 nt, Human
ugccagcuccgaggagcugcag

SEQ ID NO: 1129569 - RNA, 22 nt, Human
ucacugcaaggaggcuucucaa

SEQ ID NO: 1129570 - RNA, 22 nt, Human
ucagaagcaggagugugcacaa

SEQ ID NO: 1129571 - RNA, 22 nt, Human
cuacauuuggagaguauaggaa

SEQ ID NO: 1129572 - RNA, 22 nt, Human
uccauguugagaaugcuauaau

SEQ ID NO: 1129573 - RNA, 22 nt, Human
aagcacaaugaacaucuuagau

SEQ ID NO: 1129574 - RNA, 22 nt, Human
cuguagcaaguuauucaauaaa

SEQ ID NO: 1129575 - RNA, 22 nt, Human
cagugcaugaaacaauaugcag

SEQ ID NO: 1129576 - RNA, 22 nt, Human
gcagaggcuccauuuuacagau

SEQ ID NO: 1129577 - RNA, 22 nt, Human
aaaaucugguaauuugaaugug

SEQ ID NO: 1129578 - RNA, 19 nt, Human
ucccuggcgccucucgggc

SEQ ID NO: 1129579 - RNA, 22 nt, Human
agcauuuauuucuuagaaauug

SEQ ID NO: 1129580 - RNA, 22 nt, Human
aggacuuagaacauuauguacu

SEQ ID NO: 1129581 - RNA, 22 nt, Human
aaagaacaaauuagcuguuuua

SEQ ID NO: 1129582 - RNA, 22 nt, Human
cuggagccgcauggagcaggga

SEQ ID NO: 1129583 - RNA, 22 nt, Human
ccaaggagcaaggcucaacaag

SEQ ID NO: 1129584 - RNA, 20 nt, Human
ccuaggcaugcugagucucc

SEQ ID NO: 1129585 - RNA, 20 nt, Human
gagccugggaagucuaaggu

SEQ ID NO: 1129586 - RNA, 22 nt, Human
uugaagcauuucuuugagcuuc

SEQ ID NO: 1129587 - RNA, 23 nt, Human
ugcugggguaguuuguggcacag

SEQ ID NO: 1129588 - RNA, 22 nt, Human
gauaauccaagauugccucacu

SEQ ID NO: 1129589 - RNA, 22 nt, Human
ggauccuuaacuaucacaguga

SEQ ID NO: 1129590 - RNA, 22 nt, Human
cuggcuggccggagcgaggcgg

SEQ ID NO: 1129591 - RNA, 22 nt, Human
ugcccuguuaucuuggaagagu

SEQ ID NO: 1129592 - RNA, 22 nt, Human
ggcuuccuuucacuacccucag

SEQ ID NO: 1129593 - RNA, 23 nt, Human
cuggccuccgacacuggccaaga

SEQ ID NO: 1129594 - RNA, 22 nt, Human
uggcuuccugcauggauccucu

SEQ ID NO: 1129595 - RNA, 22 nt, Human
cacagcuugggcucugacaaua

SEQ ID NO: 1129596 - RNA, 22 nt, Human
ggccccuggcaccaggcugauu

SEQ ID NO: 1129597 - RNA, 20 nt, Human
ccugggguacacuggcaugu

SEQ ID NO: 1129598 - RNA, 22 nt, Human
gcuggccuccugcuagauggaa

SEQ ID NO: 1129599 - RNA, 22 nt, Human
ggcaggugcaccugagccaucu

SEQ ID NO: 1129600 - RNA, 22 nt, Human
uaguccagccuuggguguagcc

SEQ ID NO: 1129601 - RNA, 22 nt, Human
uuguuacacauaauaacauuuu

SEQ ID NO: 1129602 - RNA, 19 nt, Human
uggcuccugccugccuucu

SEQ ID NO: 1129603 - RNA, 22 nt, Human
aaaguuuggauccagcaaaaga

SEQ ID NO: 1129604 - RNA, 21 nt, Human
ccucuggcuugugcugugccc

SEQ ID NO: 1129605 - RNA, 22 nt, Human
ggcugccaggagggaggccagu

SEQ ID NO: 1129606 - RNA, 19 nt, Human
cccaaggcccugggcaggc

SEQ ID NO: 1129607 - RNA, 22 nt, Human
gcagagcauguccucaggacag

SEQ ID NO: 1129608 - RNA, 22 nt, Human
aauguguagggugccuguuuuu

SEQ ID NO: 1129609 - RNA, 22 nt, Human
agagcuguagcuuccuagagcc

SEQ ID NO: 1129610 - RNA, 22 nt, Human
uugucuguccaggcaccccaag

SEQ ID NO: 1129611 - RNA, 22 nt, Human
ugggacacccucacgccugcac

SEQ ID NO: 1129612 - RNA, 22 nt, Human
ccagcuccaaguuugggcauca

SEQ ID NO: 1129613 - RNA, 22 nt, Human
aggccagguggucaugcuugcu

SEQ ID NO: 1129614 - RNA, 22 nt, Human
cccagcuaccucugcuaggaga

SEQ ID NO: 1129615 - RNA, 22 nt, Human
uccuuuuuaagucguuguggua

SEQ ID NO: 1129616 - RNA, 22 nt, Human
ugauuuccacgugcacccaggu

SEQ ID NO: 1129617 - RNA, 22 nt, Human
cacaggagagcugggaggugcc

SEQ ID NO: 1129618 - RNA, 22 nt, Human
aacaacugaaaagcuuuuucug

SEQ ID NO: 1129619 - RNA, 22 nt, Human
ggcugcucuucuuggcgaccuc

SEQ ID NO: 1129620 - RNA, 22 nt, Human
agcagcugccagagagaguucc

SEQ ID NO: 1129621 - RNA, 22 nt, Human
ccuggccuccuggccuucucau

SEQ ID NO: 1129622 - RNA, 22 nt, Human
ucaaugauaucagcaggaugug

SEQ ID NO: 1129623 - RNA, 22 nt, Human
cucagggacguuagaggacagg

SEQ ID NO: 1129624 - RNA, 22 nt, Human
acuuccuguguuggucuugcug

SEQ ID NO: 1129625 - RNA, 22 nt, Human
agccagccaguucacuaggaaa

SEQ ID NO: 1129626 - RNA, 22 nt, Human
uucauucccaagaguaaacaua

SEQ ID NO: 1129627 - RNA, 22 nt, Human
aaauguguauaugaaacaugau

SEQ ID NO: 1129628 - RNA, 22 nt, Human
cugagagucagcuucuccuccu

SEQ ID NO: 1129629 - RNA, 22 nt, Human
aaaugugucaguuucauucucu

SEQ ID NO: 1129630 - RNA, 22 nt, Human
uccagcagaaaagagguaggga

SEQ ID NO: 1129631 - RNA, 22 nt, Human
ccuggcuggcaagaucgugaag

SEQ ID NO: 1129632 - RNA, 22 nt, Human
ugggcagaguugugaugaacug

SEQ ID NO: 1129633 - RNA, 22 nt, Human
ugagccuggggccugggcagcg

SEQ ID NO: 1129634 - RNA, 22 nt, Human
auguuuuauauuuugcagcagu

SEQ ID NO: 1129635 - RNA, 22 nt, Human
aguuuuuccguggcuacgauaa

SEQ ID NO: 1129636 - RNA, 22 nt, Human
ggcccugggcagaggagugggc

SEQ ID NO: 1129637 - RNA, 22 nt, Human
aguggggaagagcaugggcccu

SEQ ID NO: 1129638 - RNA, 19 nt, Human
ggcugggucuggcagguuc

SEQ ID NO: 1129639 - RNA, 22 nt, Human
cugcuuugaggggcucuguaua

SEQ ID NO: 1129640 - RNA, 22 nt, Human
uaauaucuacuucauagaguuu

SEQ ID NO: 1129641 - RNA, 22 nt, Human
agcuucuguucaucuuccaggc

SEQ ID NO: 1129642 - RNA, 19 nt, Human
auaaggcagugacuuuuuu

SEQ ID NO: 1129643 - RNA, 22 nt, Human
ggcuccucucuggccgcucccg

SEQ ID NO: 1129644 - RNA, 22 nt, Human
cauuacaugguccaggauauau

SEQ ID NO: 1129645 - RNA, 18 nt, Human
ucaagacaucaugaaaua

SEQ ID NO: 1129646 - RNA, 22 nt, Human
aagccaggaagagagccuucac

SEQ ID NO: 1129647 - RNA, 22 nt, Human
gcagggcuguggacacuuuggu

SEQ ID NO: 1129648 - RNA, 22 nt, Human
cacugcaggucugagauggggg

SEQ ID NO: 1129649 - RNA, 21 nt, Human
agaaaauggcguuuuagauuu

SEQ ID NO: 1129650 - RNA, 22 nt, Human
auacaaagacaaaucucaaucu

SEQ ID NO: 1129651 - RNA, 22 nt, Human
cggggacacacuggcagcuccu

SEQ ID NO: 1129652 - RNA, 22 nt, Human
augcuuuacaguuuuccaaaca

SEQ ID NO: 1129653 - RNA, 22 nt, Human
ggcaguggguuccccaaggcac

SEQ ID NO: 1129654 - RNA, 22 nt, Human
uccucaggugacuagguaucuu

SEQ ID NO: 1129655 - RNA, 22 nt, Human
cacaggcugcccgcagcuggga

SEQ ID NO: 1129656 - RNA, 22 nt, Human
uaugcacaccuggguccuuguc

SEQ ID NO: 1129657 - RNA, 22 nt, Human
ugggcagaguagcucagaagaa

SEQ ID NO: 1129658 - RNA, 22 nt, Human
aguuuagaguucaaauuaguuc

SEQ ID NO: 1129659 - RNA, 22 nt, Human
cagaggugcauacaggucauua

SEQ ID NO: 1129660 - RNA, 22 nt, Human
ugggcugcugcggugcucuugg

SEQ ID NO: 1129661 - RNA, 22 nt, Human
uauguguggcagcugggagugu

SEQ ID NO: 1129662 - RNA, 19 nt, Human
gagguggguccccgcagcc

SEQ ID NO: 1129663 - RNA, 22 nt, Human
ggagcagacauaaccuuacaga

SEQ ID NO: 1129664 - RNA, 22 nt, Human
cagggcagagggaaacuccuuu

SEQ ID NO: 1129665 - RNA, 17 nt, Human
agauggcaggaggcaga

SEQ ID NO: 1129666 - RNA, 22 nt, Human
aaagaacaaaugauauaugguu

SEQ ID NO: 1129667 - RNA, 22 nt, Human
gaggcaggcccugaaugaguca

SEQ ID NO: 1129668 - RNA, 22 nt, Human
ugcaucuguucagagcugucga

SEQ ID NO: 1129669 - RNA, 22 nt, Human
ccagcagaggggcggagugcag

SEQ ID NO: 1129670 - RNA, 22 nt, Human
ucaagagaaggggaaauagacu

SEQ ID NO: 1129671 - RNA, 22 nt, Human
ggccuagggaguggccaugccu

SEQ ID NO: 1129672 - RNA, 22 nt, Human
auagaaauggcagcuggugcua

SEQ ID NO: 1129673 - RNA, 20 nt, Human
ccuggaagagcuccccaggc

SEQ ID NO: 1129674 - RNA, 22 nt, Human
agcuguguggugucugacagcu

SEQ ID NO: 1129675 - RNA, 19 nt, Human
aggucauugauagugcagg

SEQ ID NO: 1129676 - RNA, 22 nt, Human
ugaaaucuccucuuuauauauc

SEQ ID NO: 1129677 - RNA, 22 nt, Human
ccucuguccuggggaguggagc

SEQ ID NO: 1129678 - RNA, 22 nt, Human
aggccugaggaccuucuggagg

SEQ ID NO: 1129679 - RNA, 22 nt, Human
uauuucugaggcccaggaagug

SEQ ID NO: 1129680 - RNA, 22 nt, Human
uaugaagugaguuaugguugcu

SEQ ID NO: 1129681 - RNA, 22 nt, Human
cacagagagcuacgugcagcgu

SEQ ID NO: 1129682 - RNA, 22 nt, Human
cagacaugauguaagcagaggc

SEQ ID NO: 1129683 - RNA, 22 nt, Human
ggcuggcuugccaagcucaggg

SEQ ID NO: 1129684 - RNA, 22 nt, Human
gguuggaggugggaauagcuag

SEQ ID NO: 1129685 - RNA, 22 nt, Human
ccacucugauuuuggcuccacu

SEQ ID NO: 1129686 - RNA, 20 nt, Human
gccuggaggcaaugggaaga

SEQ ID NO: 1129687 - RNA, 22 nt, Human
aaaaugugcaguuuuuaagcug

SEQ ID NO: 1129688 - RNA, 22 nt, Human
agccuucagcaguucaggugcc

SEQ ID NO: 1129689 - RNA, 22 nt, Human
caguguccucagccagcagcua

SEQ ID NO: 1129690 - RNA, 23 nt, Human
agccacuucuaucuugcuccugg

SEQ ID NO: 1129691 - RNA, 22 nt, Human
acaaagucaaauugcagccgcc

SEQ ID NO: 1129692 - RNA, 22 nt, Human
ucaggccacuucacaggugauu

SEQ ID NO: 1129693 - RNA, 22 nt, Human
acugucucucuagcaguucagg

SEQ ID NO: 1129694 - RNA, 22 nt, Human
gaacaauagugguaacaaagcc

SEQ ID NO: 1129695 - RNA, 22 nt, Human
cagagcugcgcuuuuuccuggu

SEQ ID NO: 1129696 - RNA, 22 nt, Human
auuugagaugguaaauaacuuu

SEQ ID NO: 1129697 - RNA, 22 nt, Human
ugcugcauuuaucuucucaaac

SEQ ID NO: 1129698 - RNA, 22 nt, Human
uacuuagagcgauaauuuauac

SEQ ID NO: 1129699 - RNA, 19 nt, Human
ccauggcaaugaucugaug

SEQ ID NO: 1129700 - RNA, 22 nt, Human
uacauguauugauuucucuucu

SEQ ID NO: 1129701 - RNA, 22 nt, Human
acagggccucagccagggcaga

SEQ ID NO: 1129702 - RNA, 22 nt, Human
agagccugugggagaugcagcu

SEQ ID NO: 1129703 - RNA, 22 nt, Human
ugcuggcuacugauggcaggcc

SEQ ID NO: 1129704 - RNA, 22 nt, Human
ucucaggggauucacuggcacc

SEQ ID NO: 1129705 - RNA, 22 nt, Human
ggcagcuuuuaucccugacaga

SEQ ID NO: 1129706 - RNA, 22 nt, Human
cagcaggcccaggugcugguga

SEQ ID NO: 1129707 - RNA, 22 nt, Human
gcagggccagguacaagaagca

SEQ ID NO: 1129708 - RNA, 22 nt, Human
ucccaggaucugagggcagaga

SEQ ID NO: 1129709 - RNA, 22 nt, Human
gccucugcccuccugggacugc

SEQ ID NO: 1129710 - RNA, 22 nt, Human
ucccagccuuccuuguggugaa

SEQ ID NO: 1129711 - RNA, 18 nt, Human
agugugugcccuuucagg

SEQ ID NO: 1129712 - RNA, 21 nt, Human
ugcucacagaugugcucagug

SEQ ID NO: 1129713 - RNA, 22 nt, Human
guagcccaccuggggagggcga

SEQ ID NO: 1129714 - RNA, 22 nt, Human
gcacagccacugagugagaacc

SEQ ID NO: 1129715 - RNA, 22 nt, Human
ucagcagcagcucagcauguuu

SEQ ID NO: 1129716 - RNA, 22 nt, Human
gaggagggagcuggaagcucuu

SEQ ID NO: 1129717 - RNA, 22 nt, Human
gguggccuccagggcauaggug

SEQ ID NO: 1129718 - RNA, 22 nt, Human
uugcauaaagauuuuauugcau

SEQ ID NO: 1129719 - RNA, 22 nt, Human
cugggguggaggagcuccccug

SEQ ID NO: 1129720 - RNA, 22 nt, Human
aggcugcagaacagucaggugc

SEQ ID NO: 1129721 - RNA, 19 nt, Human
auacacauacguaaacuga

SEQ ID NO: 1129722 - RNA, 22 nt, Human
auccugggaagcugacauugaa

SEQ ID NO: 1129723 - RNA, 22 nt, Human
aggcccuguccauggugcugaa

SEQ ID NO: 1129724 - RNA, 22 nt, Human
augggaugcauggcuguggcca

SEQ ID NO: 1129725 - RNA, 22 nt, Human
agccuggaguucccaggagaag

SEQ ID NO: 1129726 - RNA, 22 nt, Human
agaggucagaacaggaaagugu

SEQ ID NO: 1129727 - RNA, 22 nt, Human
ggcuucaccgcgggguugcagg

SEQ ID NO: 1129728 - RNA, 22 nt, Human
cagcuggguuuaguggggugug

SEQ ID NO: 1129729 - RNA, 22 nt, Human
ggcaggugcucugugggccugg

SEQ ID NO: 1129730 - RNA, 21 nt, Human
ugaaaucugaugggacaaaug

SEQ ID NO: 1129731 - RNA, 22 nt, Human
uggggacauagccagucuggcu

SEQ ID NO: 1129732 - RNA, 22 nt, Human
gagaggccaaaaucccugcccc

SEQ ID NO: 1129733 - RNA, 22 nt, Human
gacagccucaugaggagcaaaa

SEQ ID NO: 1129734 - RNA, 22 nt, Human
auggauaauggugauaguugca

SEQ ID NO: 1129735 - RNA, 22 nt, Human
ccaaaugcuccacugacuuugg

SEQ ID NO: 1129736 - RNA, 22 nt, Human
ucuccucaccaccagcagcaga

SEQ ID NO: 1129737 - RNA, 22 nt, Human
uccugaggaaaguucaugaaug

SEQ ID NO: 1129738 - RNA, 22 nt, Human
ucuuuacaucacaauuguaugg

SEQ ID NO: 1129739 - RNA, 22 nt, Human
uuaaaaccaucagcuguaagau

SEQ ID NO: 1129740 - RNA, 22 nt, Human
uggcucagccauucguguugcc

SEQ ID NO: 1129741 - RNA, 22 nt, Human
gauuuccucacuaacauccauc

SEQ ID NO: 1129742 - RNA, 22 nt, Human
gaguguggugaacaggagcacc

SEQ ID NO: 1129743 - RNA, 22 nt, Human
ugggcuggcugaggcauucacu

SEQ ID NO: 1129744 - RNA, 22 nt, Human
aagagcugauuaagucaugagg

SEQ ID NO: 1129745 - RNA, 22 nt, Human
agcucagcuuccucuccaugcu

SEQ ID NO: 1129746 - RNA, 22 nt, Human
gggcagauggggcacaggcuga

SEQ ID NO: 1129747 - RNA, 22 nt, Human
ucuggcuccacuuucuucauuu

SEQ ID NO: 1129748 - RNA, 20 nt, Human
ggagagcagggaagacagua

SEQ ID NO: 1129749 - RNA, 22 nt, Human
gccaccagugggggccugggca

SEQ ID NO: 1129750 - RNA, 22 nt, Human
caguuauuaugaggucauuagg

SEQ ID NO: 1129751 - RNA, 22 nt, Human
ccagagccggauugugaagugc

SEQ ID NO: 1129752 - RNA, 22 nt, Human
aggccagguuccucaaucuuga

SEQ ID NO: 1129753 - RNA, 22 nt, Human
aaugcacaugccacauguggua

SEQ ID NO: 1129754 - RNA, 22 nt, Human
gccagcucagaugcaggaagga

SEQ ID NO: 1129755 - RNA, 22 nt, Human
gagggcaggggucuugcacggu

SEQ ID NO: 1129756 - RNA, 22 nt, Human
ugcccugcagugagugcgucug

SEQ ID NO: 1129757 - RNA, 22 nt, Human
cacagaauaaauugguaucaga

SEQ ID NO: 1129758 - RNA, 22 nt, Human
ucauugucuugauaugauuguc

SEQ ID NO: 1129759 - RNA, 22 nt, Human
guccucuguguaggcugcagac

SEQ ID NO: 1129760 - RNA, 22 nt, Human
aauguguguucggggcccagag

SEQ ID NO: 1129761 - RNA, 20 nt, Human
cacagcuugccuuuuaugac

SEQ ID NO: 1129762 - RNA, 22 nt, Human
gcacagaagagcuuuggaauga

SEQ ID NO: 1129763 - RNA, 23 nt, Human
gugagcagcccacuaggaaugcc

SEQ ID NO: 1129764 - RNA, 22 nt, Human
ucccagagguugagucacuuau

SEQ ID NO: 1129765 - RNA, 22 nt, Human
aauuucaaugcacucaugguug

SEQ ID NO: 1129766 - RNA, 22 nt, Human
gcagcuggacccacacggcuua

SEQ ID NO: 1129767 - RNA, 22 nt, Human
agagaauuacagaagaauguca

SEQ ID NO: 1129768 - RNA, 22 nt, Human
ggcugggagcuggacaggccgg

SEQ ID NO: 1129769 - RNA, 22 nt, Human
gccugaagaacagcugugagga

SEQ ID NO: 1129770 - RNA, 22 nt, Human
ucaaagcaucagucaauuuagg

SEQ ID NO: 1129771 - RNA, 22 nt, Human
ucuggcuccuggcuccacugcc

SEQ ID NO: 1129772 - RNA, 22 nt, Human
ggcuucuccagguacugagcau

SEQ ID NO: 1129773 - RNA, 20 nt, Human
gaggcucugggcauggcgcc

SEQ ID NO: 1129774 - RNA, 22 nt, Human
cauggcccucuucuggagcaau

SEQ ID NO: 1129775 - RNA, 22 nt, Human
gcccugggauuggguggaggcu

SEQ ID NO: 1129776 - RNA, 22 nt, Human
acauuucuuccuaauuaucccu

SEQ ID NO: 1129777 - RNA, 22 nt, Human
uggcccugcuuaugucucucuu

SEQ ID NO: 1129778 - RNA, 22 nt, Human
cagcagcuggugagacacagcc

SEQ ID NO: 1129779 - RNA, 22 nt, Human
ggagccagaggcugcugcugug

SEQ ID NO: 1129780 - RNA, 22 nt, Human
gcagagccuugcgucaugugcc

SEQ ID NO: 1129781 - RNA, 22 nt, Human
cuuaggcaaccaggucaaugcu

SEQ ID NO: 1129782 - RNA, 22 nt, Human
aaggagagagcuuugcuggaac

SEQ ID NO: 1129783 - RNA, 22 nt, Human
cuuugcauacaauuuuuagaaa

SEQ ID NO: 1129784 - RNA, 22 nt, Human
ucaagagauugaauaauaacug

SEQ ID NO: 1129785 - RNA, 22 nt, Human
agggccagagucuguguagaua

SEQ ID NO: 1129786 - RNA, 22 nt, Human
cuguguccugcgucaagccaau

SEQ ID NO: 1129787 - RNA, 22 nt, Human
caggccugugaguugaggcccc

SEQ ID NO: 1129788 - RNA, 22 nt, Human
ugagugaggaagcgguggagga

SEQ ID NO: 1129789 - RNA, 22 nt, Human
cugggcaggagggcucuaugga

SEQ ID NO: 1129790 - RNA, 22 nt, Human
cugccuugaaaaugaagcuuua

SEQ ID NO: 1129791 - RNA, 22 nt, Human
agccugccuugggcugcuugag

SEQ ID NO: 1129792 - RNA, 22 nt, Human
cugagcuuggccaggaaugaau

SEQ ID NO: 1129793 - RNA, 22 nt, Human
uuuagaaauucaucuauggccu

SEQ ID NO: 1129794 - RNA, 22 nt, Human
ggagaguggauuccagcuguau

SEQ ID NO: 1129795 - RNA, 22 nt, Human
ggcuccugauaggagaaugcgg

SEQ ID NO: 1129796 - RNA, 22 nt, Human
ucagagcugcccaugcaagggg

SEQ ID NO: 1129797 - RNA, 22 nt, Human
cggggcugcucguccuccugug

SEQ ID NO: 1129798 - RNA, 22 nt, Human
ggggggugcugaucaguggagc

SEQ ID NO: 1129799 - RNA, 22 nt, Human
uggcaccugaacuuagaggugu

SEQ ID NO: 1129800 - RNA, 22 nt, Human
ugggcuacucugggagccuaac

SEQ ID NO: 1129801 - RNA, 22 nt, Human
ggacuggccggcgcugaggccc

SEQ ID NO: 1129802 - RNA, 18 nt, Human
agaaggagcuaugggcag

SEQ ID NO: 1129803 - RNA, 22 nt, Human
caggagacaauggcuguggggc

SEQ ID NO: 1129804 - RNA, 21 nt, Human
agcagccauuucacagagacu

SEQ ID NO: 1129805 - RNA, 22 nt, Human
gggcguggauggucagugcagg

SEQ ID NO: 1129806 - RNA, 22 nt, Human
gaggcaggcacuguuaucagca

SEQ ID NO: 1129807 - RNA, 22 nt, Human
aacagacagaaaaaugugaucu

SEQ ID NO: 1129808 - RNA, 22 nt, Human
uauguuuuuaagagaaugcauu

SEQ ID NO: 1129809 - RNA, 20 nt, Human
agcccaggccugugugaguc

SEQ ID NO: 1129810 - RNA, 22 nt, Human
aagaggaacugggggcugaguc

SEQ ID NO: 1129811 - RNA, 22 nt, Human
cagagaaacucagauagcugau

SEQ ID NO: 1129812 - RNA, 22 nt, Human
agggcccucuggcaggccaggc

SEQ ID NO: 1129813 - RNA, 22 nt, Human
gccaggcuccccggaucccugg

SEQ ID NO: 1129814 - RNA, 22 nt, Human
caggaccuggaaugcuugugaa

SEQ ID NO: 1129815 - RNA, 22 nt, Human
cagugguggaaugaggaauugu

SEQ ID NO: 1129816 - RNA, 22 nt, Human
agccucucuguuagucacuggg

SEQ ID NO: 1129817 - RNA, 22 nt, Human
cacagguguucuugcagugaaa

SEQ ID NO: 1129818 - RNA, 22 nt, Human
aggucauugaaguuauuuucuu

SEQ ID NO: 1129819 - RNA, 22 nt, Human
gcucaggacuggaggagcgggg

SEQ ID NO: 1129820 - RNA, 22 nt, Human
aguggcaggcggagauguagga

SEQ ID NO: 1129821 - RNA, 22 nt, Human
uuccucuccucacaugagucac

SEQ ID NO: 1129822 - RNA, 22 nt, Human
gugugccaccagucaaggugaa

SEQ ID NO: 1129823 - RNA, 22 nt, Human
uuccauaaaggugauaguauac

SEQ ID NO: 1129824 - RNA, 22 nt, Human
ucauccaguuguggagagggaa

SEQ ID NO: 1129825 - RNA, 22 nt, Human
gcugcccauuccacuggauggu

SEQ ID NO: 1129826 - RNA, 22 nt, Human
ccuccagggcagacggggagca

SEQ ID NO: 1129827 - RNA, 22 nt, Human
ugcagggcuaagucagagccug

SEQ ID NO: 1129828 - RNA, 22 nt, Human
cagagcagcagagcuuccaugg

SEQ ID NO: 1129829 - RNA, 22 nt, Human
gcacccagggacuuggcuggcc

SEQ ID NO: 1129830 - RNA, 21 nt, Human
uccauaagagaccaucuccua

SEQ ID NO: 1129831 - RNA, 22 nt, Human
ggaaccaguggaaugauaugcu

SEQ ID NO: 1129832 - RNA, 22 nt, Human
uggccuggcucacagugagauu

SEQ ID NO: 1129833 - RNA, 22 nt, Human
cugggcagugguggcccuuccc

SEQ ID NO: 1129834 - RNA, 22 nt, Human
agccucugcacgggcacgggug

SEQ ID NO: 1129835 - RNA, 22 nt, Human
uggguggaauaaaucaguucug

SEQ ID NO: 1129836 - RNA, 22 nt, Human
aggggacacggcuucuccaggg

SEQ ID NO: 1129837 - RNA, 22 nt, Human
aggagcugcauggauaccuggu

SEQ ID NO: 1129838 - RNA, 22 nt, Human
ggcuucccagcagagggcgcac

SEQ ID NO: 1129839 - RNA, 22 nt, Human
aggagggugauccgggcugguc

SEQ ID NO: 1129840 - RNA, 19 nt, Human
augauacaggugaaaauug

SEQ ID NO: 1129841 - RNA, 22 nt, Human
acagccauagaugcuuauguaa

SEQ ID NO: 1129842 - RNA, 21 nt, Human
ggucagggggugccuccaggu

SEQ ID NO: 1129843 - RNA, 22 nt, Human
auacuuaguuuuaauccauuag

SEQ ID NO: 1129844 - RNA, 22 nt, Human
agcagccagugggagugauaca

SEQ ID NO: 1129845 - RNA, 22 nt, Human
cucaggaugcaggucacaggac

SEQ ID NO: 1129846 - RNA, 22 nt, Human
cagcuggcguggagugauugca

SEQ ID NO: 1129847 - RNA, 22 nt, Human
ugaaggugucuuugugaacauc

SEQ ID NO: 1129848 - RNA, 22 nt, Human
cugucugucaaguucaucucca

SEQ ID NO: 1129849 - RNA, 18 nt, Human
cucagggcaucagucugg

SEQ ID NO: 1129850 - RNA, 22 nt, Human
cugggccuagaggaagcugaca

SEQ ID NO: 1129851 - RNA, 22 nt, Human
ugacagaaugugacucucagau

SEQ ID NO: 1129852 - RNA, 22 nt, Human
caggggacauuaaagcuccaua

SEQ ID NO: 1129853 - RNA, 22 nt, Human
aaaucuggccccuugccuauuu

SEQ ID NO: 1129854 - RNA, 22 nt, Human
gggaccaggugggugcauuccg

SEQ ID NO: 1129855 - RNA, 22 nt, Human
uuccuucucagcccucgaggau

SEQ ID NO: 1129856 - RNA, 22 nt, Human
gcaagcuggcuguuagaggaug

SEQ ID NO: 1129857 - RNA, 22 nt, Human
ccuggggcucaagauggcgccg

SEQ ID NO: 1129858 - RNA, 20 nt, Human
agcuggccuguccuaggccu

SEQ ID NO: 1129859 - RNA, 22 nt, Human
cugcugcugagagcucagccug

SEQ ID NO: 1129860 - RNA, 22 nt, Human
ucuuguccuaagagcuggauuc

SEQ ID NO: 1129861 - RNA, 22 nt, Human
gggaguggauuauguggaccca

SEQ ID NO: 1129862 - RNA, 22 nt, Human
guggugcauccuugaguaagcu

SEQ ID NO: 1129863 - RNA, 22 nt, Human
cagagagagugggguguggauu

SEQ ID NO: 1129864 - RNA, 21 nt, Human
agagccugagaucuuccagca

SEQ ID NO: 1129865 - RNA, 22 nt, Human
gacaggggucccucugggcugu

SEQ ID NO: 1129866 - RNA, 20 nt, Human
gaggccucagccucagcucc

SEQ ID NO: 1129867 - RNA, 22 nt, Human
cagcaaaagccagcauaagcuc

SEQ ID NO: 1129868 - RNA, 22 nt, Human
gccuggcuccuaaggacuggcu

SEQ ID NO: 1129869 - RNA, 22 nt, Human
cagcuucugagcaagccagggg

SEQ ID NO: 1129870 - RNA, 22 nt, Human
aucuggcugagcgaggcccaca

SEQ ID NO: 1129871 - RNA, 22 nt, Human
cccugggcaagcccuauuuucc

SEQ ID NO: 1129872 - RNA, 22 nt, Human
augguugaacuuaaagggaaug

SEQ ID NO: 1129873 - RNA, 22 nt, Human
ucuggcugcugcgugagugcuu

SEQ ID NO: 1129874 - RNA, 21 nt, Human
guggcccugguguggcugcac

SEQ ID NO: 1129875 - RNA, 22 nt, Human
acaaaguccugguguauggcca

SEQ ID NO: 1129876 - RNA, 22 nt, Human
uuugggaaacuuaggggucaga

SEQ ID NO: 1129877 - RNA, 22 nt, Human
ggcagcugauuagcaucaagga

SEQ ID NO: 1129878 - RNA, 22 nt, Human
agggcagcagcccauggcucug

SEQ ID NO: 1129879 - RNA, 22 nt, Human
cuuccucccccacacacucacu

SEQ ID NO: 1129880 - RNA, 22 nt, Human
uagcagugccaggauuuugcug

SEQ ID NO: 1129881 - RNA, 17 nt, Human
gcuggcugacccaugcc

SEQ ID NO: 1129882 - RNA, 22 nt, Human
ucuuuccucugagcuccuguag

SEQ ID NO: 1129883 - RNA, 22 nt, Human
uuugggaagaggaaucucugga

SEQ ID NO: 1129884 - RNA, 22 nt, Human
uacuuuagaaggaaauaaguuc

SEQ ID NO: 1129885 - RNA, 22 nt, Human
cuacugaguccuucagcugcca

SEQ ID NO: 1129886 - RNA, 22 nt, Human
ccugccuguacuagagacccag

SEQ ID NO: 1129887 - RNA, 22 nt, Human
cucuugaagcaggggccaguuc

SEQ ID NO: 1129888 - RNA, 22 nt, Human
gccagaaacauacacaucacuu

SEQ ID NO: 1129889 - RNA, 22 nt, Human
gaauuguagagggaacagaagc

SEQ ID NO: 1129890 - RNA, 22 nt, Human
ccagccucacuggcaucaccua

SEQ ID NO: 1129891 - RNA, 22 nt, Human
gcugggagcccuggucugcucc

SEQ ID NO: 1129892 - RNA, 19 nt, Human
acaagggcaggcaagguga

SEQ ID NO: 1129893 - RNA, 22 nt, Human
cugccacuuucacccagugcuc

SEQ ID NO: 1129894 - RNA, 22 nt, Human
cccacagguccccaugaacucg

SEQ ID NO: 1129895 - RNA, 20 nt, Human
uccagcugucuuucagagac

SEQ ID NO: 1129896 - RNA, 23 nt, Human
ugacacauuuccuuuccacugca

SEQ ID NO: 1129897 - RNA, 22 nt, Human
cugccaggacugacgucuucag

SEQ ID NO: 1129898 - RNA, 22 nt, Human
ucccacugugaauccaaggccu

SEQ ID NO: 1129899 - RNA, 22 nt, Human
gcagcagagaacacaaugaugg

SEQ ID NO: 1129900 - RNA, 22 nt, Human
uggggugggcaugcgcuguccu

SEQ ID NO: 1129901 - RNA, 22 nt, Human
gccauuuagggaggcaagguga

SEQ ID NO: 1129902 - RNA, 22 nt, Human
uggcuggcgccgggcuagccac

SEQ ID NO: 1129903 - RNA, 22 nt, Human
guggcugggcuccgagcggcuu

SEQ ID NO: 1129904 - RNA, 22 nt, Human
agccuguccagaggacagggcu

SEQ ID NO: 1129905 - RNA, 22 nt, Human
agggcagaaaucgauuacaccu

SEQ ID NO: 1129906 - RNA, 22 nt, Human
uuaaugcagaaaucaaacugac

SEQ ID NO: 1129907 - RNA, 22 nt, Human
ucagaggucacacagcaaguuu

SEQ ID NO: 1129908 - RNA, 22 nt, Human
uuaugacaggaaaaucacagaa

SEQ ID NO: 1129909 - RNA, 22 nt, Human
ugaaaucugcaugcaaaguccu

SEQ ID NO: 1129910 - RNA, 21 nt, Human
ugugucacuaacuagaggcua

SEQ ID NO: 1129911 - RNA, 22 nt, Human
caggcagcaucagucugcugua

SEQ ID NO: 1129912 - RNA, 22 nt, Human
agcucccugagaugccacagca

SEQ ID NO: 1129913 - RNA, 22 nt, Human
uccuugaauggacauuacacug

SEQ ID NO: 1129914 - RNA, 22 nt, Human
gaugauuuuaugucuugucauu

SEQ ID NO: 1129915 - RNA, 22 nt, Human
ggcuucauggaggaggugaguc

SEQ ID NO: 1129916 - RNA, 22 nt, Human
aaagauuugaguucugcuuaua

SEQ ID NO: 1129917 - RNA, 22 nt, Human
caggagcagaggguggucagca

SEQ ID NO: 1129918 - RNA, 23 nt, Human
agggcccaagccuggacagcagg

SEQ ID NO: 1129919 - RNA, 22 nt, Human
agguaaagacagugaaagaggg

SEQ ID NO: 1129920 - RNA, 22 nt, Human
ggcagaggaagcuggaaguggg

SEQ ID NO: 1129921 - RNA, 22 nt, Human
augcacuugcguguuugcaaau

SEQ ID NO: 1129922 - RNA, 20 nt, Human
cccagggaccugagcuccau

SEQ ID NO: 1129923 - RNA, 22 nt, Human
uauuucugggaguucagaaauu

SEQ ID NO: 1129924 - RNA, 22 nt, Human
cucucuuucugaaugaggacua

SEQ ID NO: 1129925 - RNA, 22 nt, Human
agguacagaugaaagucuaguu

SEQ ID NO: 1129926 - RNA, 21 nt, Human
ugauuuccaucuuaaaauaaa

SEQ ID NO: 1129927 - RNA, 22 nt, Human
ccugugcauccgguggucauug

SEQ ID NO: 1129928 - RNA, 22 nt, Human
ugcauauugugaaaauguagau

SEQ ID NO: 1129929 - RNA, 18 nt, Human
ggaaaaggagugucuagc

SEQ ID NO: 1129930 - RNA, 22 nt, Human
ccaguugguuucaaugggacag

SEQ ID NO: 1129931 - RNA, 22 nt, Human
ggaggcucccacgcagcucaca

SEQ ID NO: 1129932 - RNA, 22 nt, Human
uggucucuucuuccaagauggc

SEQ ID NO: 1129933 - RNA, 22 nt, Human
caaaguuaugaaugauaagauu

SEQ ID NO: 1129934 - RNA, 22 nt, Human
cagucccacuagugccaauacc

SEQ ID NO: 1129935 - RNA, 22 nt, Human
aagguacagaaauuaacaagga

SEQ ID NO: 1129936 - RNA, 22 nt, Human
acuguacacgugucauuuacag

SEQ ID NO: 1129937 - RNA, 19 nt, Human
ugccugucaguagaucuca

SEQ ID NO: 1129938 - RNA, 22 nt, Human
cccaggaggcagaaguugcagu

SEQ ID NO: 1129939 - RNA, 22 nt, Human
gagcuucccucugcagucccug

SEQ ID NO: 1129940 - RNA, 22 nt, Human
ccauuguaaagaguauacuuug

SEQ ID NO: 1129941 - RNA, 22 nt, Human
agauguaguagugggucuuuua

SEQ ID NO: 1129942 - RNA, 22 nt, Human
ucuuugcaggagcccuuugaac

SEQ ID NO: 1129943 - RNA, 22 nt, Human
uaauaaaugaaagugcuggcau

SEQ ID NO: 1129944 - RNA, 21 nt, Human
gagugucuaauccaggcuguc

SEQ ID NO: 1129945 - RNA, 22 nt, Human
cagucccagacccagaaggugg

SEQ ID NO: 1129946 - RNA, 22 nt, Human
uauugaguuacagaaaauacuu

SEQ ID NO: 1129947 - RNA, 22 nt, Human
agaacagaggccuuauguuuca

SEQ ID NO: 1129948 - RNA, 22 nt, Human
ugaggccacuuccccacagccc

SEQ ID NO: 1129949 - RNA, 22 nt, Human
gcaaagucugcaucuggaucag

SEQ ID NO: 1129950 - RNA, 23 nt, Human
aggaggccugaaacugaggcuga

SEQ ID NO: 1129951 - RNA, 22 nt, Human
aaagccuugggauuugugauca

SEQ ID NO: 1129952 - RNA, 22 nt, Human
ucaaugauagacaagaucuaag

SEQ ID NO: 1129953 - RNA, 20 nt, Human
uagauuucauacuucucuuu

SEQ ID NO: 1129954 - RNA, 20 nt, Human
ccacaggaguccagucgacc

SEQ ID NO: 1129955 - RNA, 22 nt, Human
ccuuuccuuuuuagugugggag

SEQ ID NO: 1129956 - RNA, 22 nt, Human
auuaaaagcuucccaagaguua

SEQ ID NO: 1129957 - RNA, 22 nt, Human
uacagaguggugagaucuuuug

SEQ ID NO: 1129958 - RNA, 22 nt, Human
ugggugcuucgucagcucugag

SEQ ID NO: 1129959 - RNA, 22 nt, Human
uggcugucagcugccuggugcg

SEQ ID NO: 1129960 - RNA, 22 nt, Human
augcugcacaagccacauguag

SEQ ID NO: 1129961 - RNA, 20 nt, Human
uauuucugggcaaccauuua

SEQ ID NO: 1129962 - RNA, 22 nt, Human
cagcagugcuucagugugagau

SEQ ID NO: 1129963 - RNA, 22 nt, Human
gguuggggcgagcuggaggccc

SEQ ID NO: 1129964 - RNA, 22 nt, Human
cuggcagcaguuaugaaacaau

SEQ ID NO: 1129965 - RNA, 22 nt, Human
gcugccugauuuacauagugaa

SEQ ID NO: 1129966 - RNA, 22 nt, Human
cccagccagccucuucccauau

SEQ ID NO: 1129967 - RNA, 22 nt, Human
ggucacugcucuaaacaaaagu

SEQ ID NO: 1129968 - RNA, 22 nt, Human
uuuuccuauaugcaaagaaugc

SEQ ID NO: 1129969 - RNA, 22 nt, Human
ucagaaauuuucucaguaguuc

SEQ ID NO: 1129970 - RNA, 22 nt, Human
guggcccaggcuuggcgcuggc

SEQ ID NO: 1129971 - RNA, 22 nt, Human
ggcagugguuagaaacaugagc

SEQ ID NO: 1129972 - RNA, 22 nt, Human
gcugcagcuuuaggauccagug

SEQ ID NO: 1129973 - RNA, 22 nt, Human
ugccaggcuaaguggaggacuu

SEQ ID NO: 1129974 - RNA, 22 nt, Human
uccugucugcucacagagcugg

SEQ ID NO: 1129975 - RNA, 20 nt, Human
ugugugcacacaugacauuc

SEQ ID NO: 1129976 - RNA, 22 nt, Human
auuguauuagcacaauacaauu

SEQ ID NO: 1129977 - RNA, 22 nt, Human
ucccagaguauuagcaauugcu

SEQ ID NO: 1129978 - RNA, 22 nt, Human
ccugccuggaucagccauccug

SEQ ID NO: 1129979 - RNA, 22 nt, Human
gugccugguuuggggaguguuc

SEQ ID NO: 1129980 - RNA, 22 nt, Human
cucugugccucaguuuucuucu

SEQ ID NO: 1129981 - RNA, 22 nt, Human
aucuagaaaguguugaagauca

SEQ ID NO: 1129982 - RNA, 21 nt, Human
uuacuuuugcaccaaccuaau

SEQ ID NO: 1129983 - RNA, 22 nt, Human
caggcauaaguaauguuuuaug

SEQ ID NO: 1129984 - RNA, 20 nt, Human
uggagcuccagcguccaugu

SEQ ID NO: 1129985 - RNA, 22 nt, Human
auguaucaauuaucugucugca

SEQ ID NO: 1129986 - RNA, 22 nt, Human
ucaaagucuaucuguaauuacu

SEQ ID NO: 1129987 - RNA, 22 nt, Human
gugcugcagagucucgugccgc

SEQ ID NO: 1129988 - RNA, 22 nt, Human
ccagagcaauucucacagaacu

SEQ ID NO: 1129989 - RNA, 19 nt, Human
gggcuccuugggccucucu

SEQ ID NO: 1129990 - RNA, 22 nt, Human
caguuucuacgacuuaagcaca

SEQ ID NO: 1129991 - RNA, 22 nt, Human
guuuuuccugcugacuuggguc

SEQ ID NO: 1129992 - RNA, 22 nt, Human
gccugccuuuguaugacccuga

SEQ ID NO: 1129993 - RNA, 22 nt, Human
agggcacagccuaaagccuaug

SEQ ID NO: 1129994 - RNA, 22 nt, Human
ccaggcucugcgcuggacaugg

SEQ ID NO: 1129995 - RNA, 20 nt, Human
agagccuugaggaagaugau

SEQ ID NO: 1129996 - RNA, 22 nt, Human
ccugucuggccuuccacggggg

SEQ ID NO: 1129997 - RNA, 22 nt, Human
ucaccuuagcuagaggaagaga

SEQ ID NO: 1129998 - RNA, 22 nt, Human
uuugacaggacuaacauauggc

SEQ ID NO: 1129999 - RNA, 22 nt, Human
gcugcucucucccuaaguuggg

SEQ ID NO: 1130000 - RNA, 22 nt, Human
agaaacauuuagauuauauguc

SEQ ID NO: 1130001 - RNA, 22 nt, Human
ccucacuuuccuuucuccuggg

SEQ ID NO: 1130002 - RNA, 22 nt, Human
gagguauguaugcuacauucuu

SEQ ID NO: 1130003 - RNA, 22 nt, Human
cacagguguaugaauaugucca

SEQ ID NO: 1130004 - RNA, 22 nt, Human
gccucugcaauuacauugugcc

SEQ ID NO: 1130005 - RNA, 22 nt, Human
agaggccuaauugcuacccuuu

SEQ ID NO: 1130006 - RNA, 22 nt, Human
cagcucuggcgucagggagcga

SEQ ID NO: 1130007 - RNA, 22 nt, Human
gcugguccacucccuggaggcu

SEQ ID NO: 1130008 - RNA, 22 nt, Human
gggcuggaggugagcaggacag

SEQ ID NO: 1130009 - RNA, 20 nt, Human
aguagcagugugacauugac

SEQ ID NO: 1130010 - RNA, 22 nt, Human
gggccuggcaugcagccccguu

SEQ ID NO: 1130011 - RNA, 22 nt, Human
gccagcaguauguccuggcagu

SEQ ID NO: 1130012 - RNA, 22 nt, Human
guagaagugaugucauguuaua

SEQ ID NO: 1130013 - RNA, 22 nt, Human
cucagaaucugccaaguucagg

SEQ ID NO: 1130014 - RNA, 22 nt, Human
gcucccaggaagagaagggcca

SEQ ID NO: 1130015 - RNA, 22 nt, Human
gcucugcuggagggaaagagaa

SEQ ID NO: 1130016 - RNA, 22 nt, Human
gcuguucugcgucccaggcugg

SEQ ID NO: 1130017 - RNA, 22 nt, Human
gggcacagcugcuacccagugc

SEQ ID NO: 1130018 - RNA, 21 nt, Human
gccauuguuuucuaccuggag

SEQ ID NO: 1130019 - RNA, 19 nt, Human
ucaaggcucccugagggau

SEQ ID NO: 1130020 - RNA, 22 nt, Human
gcucccuccaugaggcagaccg

SEQ ID NO: 1130021 - RNA, 22 nt, Human
ucagaggguggcugggagcauc

SEQ ID NO: 1130022 - RNA, 18 nt, Human
gggcccuggcguccgccc

SEQ ID NO: 1130023 - RNA, 22 nt, Human
gaggccuggucuaugagauguu

SEQ ID NO: 1130024 - RNA, 22 nt, Human
uggcucugggcaccguguccac

SEQ ID NO: 1130025 - RNA, 22 nt, Human
auuuccuagccucucuugcagu

SEQ ID NO: 1130026 - RNA, 22 nt, Human
uaguuacagcaggcaggauaua

SEQ ID NO: 1130027 - RNA, 22 nt, Human
cugaggcuggggaagggaagug

SEQ ID NO: 1130028 - RNA, 22 nt, Human
aggcucauucuugccucugagc

SEQ ID NO: 1130029 - RNA, 21 nt, Human
aaagugguaaggauuauuuug

SEQ ID NO: 1130030 - RNA, 22 nt, Human
uccucuggggucagggcacuac

SEQ ID NO: 1130031 - RNA, 22 nt, Human
augaagcuaaacccugcagcca

SEQ ID NO: 1130032 - RNA, 20 nt, Human
uggcuccugcgguggaacca

SEQ ID NO: 1130033 - RNA, 22 nt, Human
ggagugaaucacuagaugcaga

SEQ ID NO: 1130034 - RNA, 22 nt, Human
agguaaggcuguaagcuaagcc

SEQ ID NO: 1130035 - RNA, 22 nt, Human
uuuuaagaugcuaguauuucag

SEQ ID NO: 1130036 - RNA, 22 nt, Human
ucagggcaaaagggaaaccauu

SEQ ID NO: 1130037 - RNA, 22 nt, Human
ccaggcugcucacaagcugccc

SEQ ID NO: 1130038 - RNA, 22 nt, Human
aagcucugcucagcagacuagg

SEQ ID NO: 1130039 - RNA, 22 nt, Human
uggaagcagugauucuugucug

SEQ ID NO: 1130040 - RNA, 22 nt, Human
aggccucagugaucaucaucag

SEQ ID NO: 1130041 - RNA, 22 nt, Human
acagagauggcacagagaaggu

SEQ ID NO: 1130042 - RNA, 22 nt, Human
gccuggccgcuccgagcuccgc

SEQ ID NO: 1130043 - RNA, 22 nt, Human
aguguauugauuggaacagccu

SEQ ID NO: 1130044 - RNA, 22 nt, Human
gggcaguggguggcugcagccu

SEQ ID NO: 1130045 - RNA, 22 nt, Human
uguucaauccccagguccugaa

SEQ ID NO: 1130046 - RNA, 22 nt, Human
ccucccagugccuccagagcag

SEQ ID NO: 1130047 - RNA, 22 nt, Human
ggucccaggauugguugcgcag

SEQ ID NO: 1130048 - RNA, 19 nt, Human
ugcucauggggacuucucc

SEQ ID NO: 1130049 - RNA, 22 nt, Human
agugaaauuccuggucuuuguu

SEQ ID NO: 1130050 - RNA, 22 nt, Human
uaaauguguuguggaugaaguu

SEQ ID NO: 1130051 - RNA, 22 nt, Human
agucucagccacacagaccuau

SEQ ID NO: 1130052 - RNA, 22 nt, Human
uuauguacaauguuaauguaaa

SEQ ID NO: 1130053 - RNA, 22 nt, Human
ucccagagcugauaagccuuua

SEQ ID NO: 1130054 - RNA, 22 nt, Human
ccucaggcuuacgggcaaugga

SEQ ID NO: 1130055 - RNA, 22 nt, Human
uuguaacacuuuucuauuaaua

SEQ ID NO: 1130056 - RNA, 22 nt, Human
cuguccugcaguugggggcagg

SEQ ID NO: 1130057 - RNA, 22 nt, Human
ugagguaggugguaagagauac

SEQ ID NO: 1130058 - RNA, 22 nt, Human
cugggcuccuaaccauccaggu

SEQ ID NO: 1130059 - RNA, 22 nt, Human
auuugcagagcucugaauuuug

SEQ ID NO: 1130060 - RNA, 22 nt, Human
aguccaggaguugggugacauu

SEQ ID NO: 1130061 - RNA, 22 nt, Human
accucugccacuuucuaacucu

SEQ ID NO: 1130062 - RNA, 22 nt, Human
caggcacugugcuagauccuug

SEQ ID NO: 1130063 - RNA, 20 nt, Human
uccucagaagacauuugggg

SEQ ID NO: 1130064 - RNA, 22 nt, Human
uuucaaauaccauaaaccuaau

SEQ ID NO: 1130065 - RNA, 22 nt, Human
cugugucccaguaccuugggua

SEQ ID NO: 1130066 - RNA, 22 nt, Human
acagaauuaaaguguuugugga

SEQ ID NO: 1130067 - RNA, 23 nt, Human
cccuguagcccaggacaggcuuu

SEQ ID NO: 1130068 - RNA, 22 nt, Human
cccaggucugugccagcucuga

SEQ ID NO: 1130069 - RNA, 22 nt, Human
cugcacagagcagggcagacac

SEQ ID NO: 1130070 - RNA, 22 nt, Human
uagggcaggugaagaaaagcua

SEQ ID NO: 1130071 - RNA, 22 nt, Human
caaggcaggcaguucacuugag

SEQ ID NO: 1130072 - RNA, 22 nt, Human
acucacuuuccauucaagcacc

SEQ ID NO: 1130073 - RNA, 22 nt, Human
uuucauaugggcauuggcaaua

SEQ ID NO: 1130074 - RNA, 22 nt, Human
cuggagagaaaugacaaagcua

SEQ ID NO: 1130075 - RNA, 22 nt, Human
gccaccaggagcccaguccaaa

SEQ ID NO: 1130076 - RNA, 23 nt, Human
cucugcaggagagugggcagggc

SEQ ID NO: 1130077 - RNA, 22 nt, Human
cugccucuggccucaggcccag

SEQ ID NO: 1130078 - RNA, 22 nt, Human
aauccaauccuacucagaaagu

SEQ ID NO: 1130079 - RNA, 22 nt, Human
caaggcugcugcgggucgcacc

SEQ ID NO: 1130080 - RNA, 18 nt, Human
caugucugcgccacaagg

SEQ ID NO: 1130081 - RNA, 22 nt, Human
ugccagggugucaggagagcua

SEQ ID NO: 1130082 - RNA, 22 nt, Human
uggugcuguggaggggcagaag

SEQ ID NO: 1130083 - RNA, 22 nt, Human
cucauggauauaagaacuguuu

SEQ ID NO: 1130084 - RNA, 18 nt, Human
uggcagcaggaagccauu

SEQ ID NO: 1130085 - RNA, 22 nt, Human
ggagccugcgggagcucccauu

SEQ ID NO: 1130086 - RNA, 22 nt, Human
uucagcagugcagacacccagu

SEQ ID NO: 1130087 - RNA, 22 nt, Human
ugcauuaugcuugugcuguaua

SEQ ID NO: 1130088 - RNA, 22 nt, Human
ugaugauguuuaucuugguauu

SEQ ID NO: 1130089 - RNA, 22 nt, Human
ccagagccuggcaucugcauaa

SEQ ID NO: 1130090 - RNA, 20 nt, Human
uguauauuuucugguguaaa

SEQ ID NO: 1130091 - RNA, 19 nt, Human
ucucuggggacacuuucac

SEQ ID NO: 1130092 - RNA, 20 nt, Human
gccugcagguuggaugggau

SEQ ID NO: 1130093 - RNA, 19 nt, Human
aguguguacugaaagcacu

SEQ ID NO: 1130094 - RNA, 22 nt, Human
cagaggccucacuuccagccag

SEQ ID NO: 1130095 - RNA, 22 nt, Human
uagagcuagcuucaaaaugcga

SEQ ID NO: 1130096 - RNA, 22 nt, Human
gugugcagaagacacaagacau

SEQ ID NO: 1130097 - RNA, 22 nt, Human
cuucuuuccuuccuccaguggc

SEQ ID NO: 1130098 - RNA, 22 nt, Human
uggccucaagucugagggccuu

SEQ ID NO: 1130099 - RNA, 22 nt, Human
uccagggagagccgcugcucca

SEQ ID NO: 1130100 - RNA, 22 nt, Human
aaaaagguugauccagauuagg

SEQ ID NO: 1130101 - RNA, 22 nt, Human
cuuucacauaauugaccuugaa

SEQ ID NO: 1130102 - RNA, 22 nt, Human
uaugcacagaaguuugcugaau

SEQ ID NO: 1130103 - RNA, 22 nt, Human
gcuuccuagaucugugguacuc

SEQ ID NO: 1130104 - RNA, 22 nt, Human
ggcuccugaaagacuaugggaa

SEQ ID NO: 1130105 - RNA, 22 nt, Human
uagaaacauauaggauggcagg

SEQ ID NO: 1130106 - RNA, 22 nt, Human
ugggcuccagcaccugugcucu

SEQ ID NO: 1130107 - RNA, 22 nt, Human
guggccuuuccugaagaaauga

SEQ ID NO: 1130108 - RNA, 19 nt, Human
ggcuggcaagugacagugu

SEQ ID NO: 1130109 - RNA, 22 nt, Human
gccuggcaggccucaugagggg

SEQ ID NO: 1130110 - RNA, 22 nt, Human
aucuaagauguauugagcacuu

SEQ ID NO: 1130111 - RNA, 22 nt, Human
cugucagguuggucucagagcu

SEQ ID NO: 1130112 - RNA, 22 nt, Human
cagcauggugccagugagucca

SEQ ID NO: 1130113 - RNA, 22 nt, Human
ggcaccugcucaucuggacuca

SEQ ID NO: 1130114 - RNA, 22 nt, Human
uggagcccagacacuggcauug

SEQ ID NO: 1130115 - RNA, 19 nt, Human
agcagagcccugaagaucc

SEQ ID NO: 1130116 - RNA, 22 nt, Human
gcagagugagccgaggcugcuc

SEQ ID NO: 1130117 - RNA, 22 nt, Human
ccagcucucagcgggagacuca

SEQ ID NO: 1130118 - RNA, 22 nt, Human
ugcucugggcaacagccucccu

SEQ ID NO: 1130119 - RNA, 22 nt, Human
ucccagccacagguguagcccu

SEQ ID NO: 1130120 - RNA, 22 nt, Human
uggccucugggaaagcagauuc

SEQ ID NO: 1130121 - RNA, 22 nt, Human
gccugggagugcacagugaggu

SEQ ID NO: 1130122 - RNA, 22 nt, Human
ccagugcaggugagcaccaggu

SEQ ID NO: 1130123 - RNA, 22 nt, Human
gcugcugguccucagagcucau

SEQ ID NO: 1130124 - RNA, 22 nt, Human
aucaaaaugcuccagugauggu

SEQ ID NO: 1130125 - RNA, 22 nt, Human
ucuucagagacucugagccccu

SEQ ID NO: 1130126 - RNA, 22 nt, Human
cugcuuuguguggucccuccag

SEQ ID NO: 1130127 - RNA, 22 nt, Human
cacauguuuggcaugucaccaa

SEQ ID NO: 1130128 - RNA, 22 nt, Human
cagcugccuguauuguccucau

SEQ ID NO: 1130129 - RNA, 22 nt, Human
uuuucucuacaaaauaaccagc

SEQ ID NO: 1130130 - RNA, 22 nt, Human
gggcugcuuuuuucuuagcaga

SEQ ID NO: 1130131 - RNA, 22 nt, Human
uggccugccuucgcugagcuga

SEQ ID NO: 1130132 - RNA, 22 nt, Human
ugguugaacaaguuggguauau

SEQ ID NO: 1130133 - RNA, 22 nt, Human
gucugcccucacgccagcuggg

SEQ ID NO: 1130134 - RNA, 22 nt, Human
ggcugccucaaagcucaagcuc

SEQ ID NO: 1130135 - RNA, 22 nt, Human
uuccaguugguagaauguaagg

SEQ ID NO: 1130136 - RNA, 20 nt, Human
gucagaggacccuagagcga

SEQ ID NO: 1130137 - RNA, 22 nt, Human
ggcaguagccagggacuggcag

SEQ ID NO: 1130138 - RNA, 22 nt, Human
cugggcacacagugacucugca

SEQ ID NO: 1130139 - RNA, 22 nt, Human
ucagggcauucaagaggccugg

SEQ ID NO: 1130140 - RNA, 22 nt, Human
agaugggcgcccuggacugagg

SEQ ID NO: 1130141 - RNA, 22 nt, Human
cugcagaguggagccucggcug

SEQ ID NO: 1130142 - RNA, 22 nt, Human
ccuggcagucaggggaguccuu

SEQ ID NO: 1130143 - RNA, 22 nt, Human
cccagggcccuggacagcuaca

SEQ ID NO: 1130144 - RNA, 22 nt, Human
cauuuacagugagaguuuuuac

SEQ ID NO: 1130145 - RNA, 22 nt, Human
agagccagagaccuggguucac

SEQ ID NO: 1130146 - RNA, 22 nt, Human
gagccagcugagcugcacuguc

SEQ ID NO: 1130147 - RNA, 23 nt, Human
cuggcuccgaagacuccaggauc

SEQ ID NO: 1130148 - RNA, 22 nt, Human
acacugaagagcacuuucaaag

SEQ ID NO: 1130149 - RNA, 22 nt, Human
cagagcugguaagugguagagg

SEQ ID NO: 1130150 - RNA, 23 nt, Human
agcagggccagaauacuugcugu

SEQ ID NO: 1130151 - RNA, 22 nt, Human
gaagcagcugccagagaugucu

SEQ ID NO: 1130152 - RNA, 22 nt, Human
uucuggaggccccuuccuucuc

SEQ ID NO: 1130153 - RNA, 22 nt, Human
caagugucuauaucagugcuug

SEQ ID NO: 1130154 - RNA, 22 nt, Human
gcugagguggagauugcaguga

SEQ ID NO: 1130155 - RNA, 22 nt, Human
cuggcugccacuucagggucuu

SEQ ID NO: 1130156 - RNA, 20 nt, Human
acccagcucugugcccuggg

SEQ ID NO: 1130157 - RNA, 22 nt, Human
ccaggcugcuguugguguccgc

SEQ ID NO: 1130158 - RNA, 22 nt, Human
uagaaacugauagucuugugcu

SEQ ID NO: 1130159 - RNA, 22 nt, Human
uugaaaggccuguuuauccagc

SEQ ID NO: 1130160 - RNA, 22 nt, Human
gggcuggggcucaauaauuugu

SEQ ID NO: 1130161 - RNA, 22 nt, Human
aguggcagagcugugucuugaa

SEQ ID NO: 1130162 - RNA, 22 nt, Human
acuuaggcuugguucagcuaga

SEQ ID NO: 1130163 - RNA, 22 nt, Human
uggacagguuugggugccuguu

SEQ ID NO: 1130164 - RNA, 22 nt, Human
gggaguggagagcaauggauga

SEQ ID NO: 1130165 - RNA, 20 nt, Human
uucaggauucuagaccacac

SEQ ID NO: 1130166 - RNA, 22 nt, Human
guuauguauugggaaauccaag

SEQ ID NO: 1130167 - RNA, 22 nt, Human
gaggccugguuugcaugagaau

SEQ ID NO: 1130168 - RNA, 22 nt, Human
ucugcucuaguugcuuccugcc

SEQ ID NO: 1130169 - RNA, 22 nt, Human
cucagggccaaggaugcuguug

SEQ ID NO: 1130170 - RNA, 22 nt, Human
ggcugccugaggcagugagaga

SEQ ID NO: 1130171 - RNA, 22 nt, Human
cugggccaucagaggggcugga

SEQ ID NO: 1130172 - RNA, 22 nt, Human
auugacaagcaguaugucuuag

SEQ ID NO: 1130173 - RNA, 22 nt, Human
auacauguuguaccauauguuu

SEQ ID NO: 1130174 - RNA, 22 nt, Human
ucucagagugacaaugagaauu

SEQ ID NO: 1130175 - RNA, 22 nt, Human
uccucugccccagaugaaauuu

SEQ ID NO: 1130176 - RNA, 17 nt, Human
cagugcagagcccuuuc

SEQ ID NO: 1130177 - RNA, 22 nt, Human
ugaagcagagugaaggugaauu

SEQ ID NO: 1130178 - RNA, 22 nt, Human
aguguuccacacaucuggggaa

SEQ ID NO: 1130179 - RNA, 22 nt, Human
uaugagaaaauaaauaucuguu

SEQ ID NO: 1130180 - RNA, 22 nt, Human
cccagggcuuuucucacuagac

SEQ ID NO: 1130181 - RNA, 22 nt, Human
aggggcugccuggcuuggcacu

SEQ ID NO: 1130182 - RNA, 22 nt, Human
uuuaucuuuggaucuucagaaa

SEQ ID NO: 1130183 - RNA, 22 nt, Human
cagagccccccuucugaucaca

SEQ ID NO: 1130184 - RNA, 22 nt, Human
gcugccugcacagagcugcuuu

SEQ ID NO: 1130185 - RNA, 22 nt, Human
ugggccuguggcuuggcucuag

SEQ ID NO: 1130186 - RNA, 20 nt, Human
agagaauucccuuuggagau

SEQ ID NO: 1130187 - RNA, 22 nt, Human
uuucauguuuauggaaaaugag

SEQ ID NO: 1130188 - RNA, 22 nt, Human
gcccucagaugggaaaggaggg

SEQ ID NO: 1130189 - RNA, 18 nt, Human
uggcagccagcugcuccu

SEQ ID NO: 1130190 - RNA, 22 nt, Human
agucccuguacuuuccacugcc

SEQ ID NO: 1130191 - RNA, 21 nt, Human
aaugugugcuauuuaucuuuu

SEQ ID NO: 1130192 - RNA, 22 nt, Human
cagcucccuauggugaggcgac

SEQ ID NO: 1130193 - RNA, 22 nt, Human
gaggcugggaaguccaagacca

SEQ ID NO: 1130194 - RNA, 22 nt, Human
agcagccauccuuagagaaaga

SEQ ID NO: 1130195 - RNA, 22 nt, Human
aucucccagccacagcauucuu

SEQ ID NO: 1130196 - RNA, 22 nt, Human
cugggccuggcguuccaggcug

SEQ ID NO: 1130197 - RNA, 22 nt, Human
agaggagcugggaggcccucgu

SEQ ID NO: 1130198 - RNA, 22 nt, Human
cugccugugcaugcagucagaa

SEQ ID NO: 1130199 - RNA, 22 nt, Human
gcagccacugggagugcuuaua

SEQ ID NO: 1130200 - RNA, 22 nt, Human
cuuguggcccauggcuuccugc

SEQ ID NO: 1130201 - RNA, 23 nt, Human
gggcugcuccaggccaaggcugg

SEQ ID NO: 1130202 - RNA, 22 nt, Human
cagggccuuuuagcaucuucuc

SEQ ID NO: 1130203 - RNA, 22 nt, Human
uccuucaggguugaggccgacu

SEQ ID NO: 1130204 - RNA, 22 nt, Human
ugcucauuggcgaucugaggga

SEQ ID NO: 1130205 - RNA, 22 nt, Human
uguccacaucacucacuuguca

SEQ ID NO: 1130206 - RNA, 22 nt, Human
uuggaaggcccugccuagcagg

SEQ ID NO: 1130207 - RNA, 22 nt, Human
aagccagguguuuaggccagcg

SEQ ID NO: 1130208 - RNA, 22 nt, Human
ucuggcccagccccugagguca

SEQ ID NO: 1130209 - RNA, 22 nt, Human
ugagccaggcucaagugauccu

SEQ ID NO: 1130210 - RNA, 22 nt, Human
ugucccaguuuugcagguuaga

SEQ ID NO: 1130211 - RNA, 22 nt, Human
agaggccuuucuguugagugaa

SEQ ID NO: 1130212 - RNA, 22 nt, Human
ugucaugccaccguuucccaga

SEQ ID NO: 1130213 - RNA, 22 nt, Human
ggcacugaaguggguguugggu

SEQ ID NO: 1130214 - RNA, 22 nt, Human
caggcacuucugcugcuugucu

SEQ ID NO: 1130215 - RNA, 22 nt, Human
acagaaggcggggacaaggcgg

SEQ ID NO: 1130216 - RNA, 22 nt, Human
ugugugugcacgugcgcgcgag

SEQ ID NO: 1130217 - RNA, 22 nt, Human
ucugucugcaccuaagcacagu

SEQ ID NO: 1130218 - RNA, 22 nt, Human
auuuuucucucacacuuaccag

SEQ ID NO: 1130219 - RNA, 20 nt, Human
ccaagagcaugcaugaggaa

SEQ ID NO: 1130220 - RNA, 22 nt, Human
gcugggcagccccuacagagag

SEQ ID NO: 1130221 - RNA, 22 nt, Human
uuauaaagugagaagugcuaug

SEQ ID NO: 1130222 - RNA, 22 nt, Human
gggagccaaggagagaggccuu

SEQ ID NO: 1130223 - RNA, 22 nt, Human
cucaggauagcugcgcagccug

SEQ ID NO: 1130224 - RNA, 22 nt, Human
uccaggcuggacaugaggcggg

SEQ ID NO: 1130225 - RNA, 22 nt, Human
guuuuuaucuaauagcaguuau

SEQ ID NO: 1130226 - RNA, 21 nt, Human
acagggcaugcagcuggcugu

SEQ ID NO: 1130227 - RNA, 22 nt, Human
uacuacauuaauaaaacauuca

SEQ ID NO: 1130228 - RNA, 22 nt, Human
aguuuaugaaacacagauuuga

SEQ ID NO: 1130229 - RNA, 22 nt, Human
auugacaaauggauguugacau

SEQ ID NO: 1130230 - RNA, 22 nt, Human
ccagggcugcugugggacucca

SEQ ID NO: 1130231 - RNA, 22 nt, Human
caggcugcagugcaguggcuau

SEQ ID NO: 1130232 - RNA, 22 nt, Human
acaaugcaccagcaucuucacc

SEQ ID NO: 1130233 - RNA, 20 nt, Human
auauguguacguguauacau

SEQ ID NO: 1130234 - RNA, 18 nt, Human
ggagccagucugucucug

SEQ ID NO: 1130235 - RNA, 18 nt, Human
aagaggaggagcagguug

SEQ ID NO: 1130236 - RNA, 22 nt, Human
aagaauucacugguagagucaa

SEQ ID NO: 1130237 - RNA, 22 nt, Human
uccuuuuugguccaaggugacc

SEQ ID NO: 1130238 - RNA, 22 nt, Human
auguuuauguugggcuauauuu

SEQ ID NO: 1130239 - RNA, 22 nt, Human
cucucucuaugcguuguuccua

SEQ ID NO: 1130240 - RNA, 22 nt, Human
ggucaggguuccagguaucuuc

SEQ ID NO: 1130241 - RNA, 22 nt, Human
auaaggcacacauagauagggu

SEQ ID NO: 1130242 - RNA, 22 nt, Human
gggucucucucggcuccacgcg

SEQ ID NO: 1130243 - RNA, 22 nt, Human
uucaaagugcauguuccucaga

SEQ ID NO: 1130244 - RNA, 19 nt, Human
ucucagaggaaaaauugcu

SEQ ID NO: 1130245 - RNA, 22 nt, Human
gggugggagucuggcccucaaa

SEQ ID NO: 1130246 - RNA, 22 nt, Human
gacccaggguuucugcacaggg

SEQ ID NO: 1130247 - RNA, 22 nt, Human
gccuaauaugcaaaauugauac

SEQ ID NO: 1130248 - RNA, 22 nt, Human
cugggccuagcaacagaggagu

SEQ ID NO: 1130249 - RNA, 21 nt, Human
ugcaggagucugugagucagg

SEQ ID NO: 1130250 - RNA, 22 nt, Human
uuaacagauguuuauggagcau

SEQ ID NO: 1130251 - RNA, 22 nt, Human
gcagaggccaucaacuuugcca

SEQ ID NO: 1130252 - RNA, 22 nt, Human
acagaggaaggcugagcugccc

SEQ ID NO: 1130253 - RNA, 23 nt, Human
agcagccagagauccucggcccu

SEQ ID NO: 1130254 - RNA, 22 nt, Human
cacugcuuucacaguuuguucc

SEQ ID NO: 1130255 - RNA, 22 nt, Human
acaggcuuuuuuagaaugacau

SEQ ID NO: 1130256 - RNA, 22 nt, Human
uucuccgcuaaguucucugcag

SEQ ID NO: 1130257 - RNA, 22 nt, Human
uucacaggaauguaggggucuu

SEQ ID NO: 1130258 - RNA, 22 nt, Human
aggcuuccgaguagcugggacu

SEQ ID NO: 1130259 - RNA, 22 nt, Human
uacaaaguagaaauucaguaaa

SEQ ID NO: 1130260 - RNA, 22 nt, Human
cuccaggggccagaagccuggc

SEQ ID NO: 1130261 - RNA, 22 nt, Human
uaaaucccuacaucuguguuuu

SEQ ID NO: 1130262 - RNA, 22 nt, Human
agagcugaaaaagcugacccgg

SEQ ID NO: 1130263 - RNA, 22 nt, Human
aagaaugucguugguauuuuaa

SEQ ID NO: 1130264 - RNA, 22 nt, Human
agguuauaugucauacugaagu

SEQ ID NO: 1130265 - RNA, 22 nt, Human
ggcuucccuuuccgagaggaga

SEQ ID NO: 1130266 - RNA, 22 nt, Human
gagcuuugcuggaagccugggg

SEQ ID NO: 1130267 - RNA, 22 nt, Human
gggcucugggauucagagcaag

SEQ ID NO: 1130268 - RNA, 22 nt, Human
gccugcaguucugugcuaggca

SEQ ID NO: 1130269 - RNA, 22 nt, Human
cagcugccccgcuggcugacca

SEQ ID NO: 1130270 - RNA, 22 nt, Human
ccugggugaugugcugcccucg

SEQ ID NO: 1130271 - RNA, 22 nt, Human
uccaaagggaagcgcuuucugu

SEQ ID NO: 1130272 - RNA, 22 nt, Human
auuuaguguguauugcuauuau

SEQ ID NO: 1130273 - RNA, 22 nt, Human
cccuggaggaccccaauguggc

SEQ ID NO: 1130274 - RNA, 22 nt, Human
uccauguuagguaaaggcacug

SEQ ID NO: 1130275 - RNA, 20 nt, Human
cucaggauugucuagccccu

SEQ ID NO: 1130276 - RNA, 22 nt, Human
cuuccugcaggacagccaucug

SEQ ID NO: 1130277 - RNA, 22 nt, Human
ggacucuguuuuccugaucacu

SEQ ID NO: 1130278 - RNA, 22 nt, Human
gucccagggaagaaggcagcac

SEQ ID NO: 1130279 - RNA, 22 nt, Human
gcaggaugagugaguacauuua

SEQ ID NO: 1130280 - RNA, 22 nt, Human
aggccuggccugggcggcauug

SEQ ID NO: 1130281 - RNA, 22 nt, Human
cagggcaguaacgggaacaucu

SEQ ID NO: 1130282 - RNA, 22 nt, Human
aaagaaggaccuggaggaggau

SEQ ID NO: 1130283 - RNA, 22 nt, Human
guaaaucccauccuuucucugg

SEQ ID NO: 1130284 - RNA, 22 nt, Human
ucagccugcgucauggugacac

SEQ ID NO: 1130285 - RNA, 22 nt, Human
uuccauaauaaccugagagaaa

SEQ ID NO: 1130286 - RNA, 22 nt, Human
ugaagcagcaccauuuuagagc

SEQ ID NO: 1130287 - RNA, 22 nt, Human
cugauuccugauucaugcucuu

SEQ ID NO: 1130288 - RNA, 22 nt, Human
cugccuggaccggcagcccucc

SEQ ID NO: 1130289 - RNA, 22 nt, Human
auugaauagaugcauuauacua

SEQ ID NO: 1130290 - RNA, 22 nt, Human
guuaauaaagguauagaaucag

SEQ ID NO: 1130291 - RNA, 22 nt, Human
ucccuggcugggggcugccuug

SEQ ID NO: 1130292 - RNA, 22 nt, Human
uuguuuugcuaaagggucauca

SEQ ID NO: 1130293 - RNA, 22 nt, Human
cauugcuuugugcauauuuaaa

SEQ ID NO: 1130294 - RNA, 22 nt, Human
uugaagcauuugcuauagcauu

SEQ ID NO: 1130295 - RNA, 18 nt, Human
guccugagcucugcugua

SEQ ID NO: 1130296 - RNA, 22 nt, Human
uugccuugauucuucucaugug

SEQ ID NO: 1130297 - RNA, 22 nt, Human
gcucccacugcagcccugagcc

SEQ ID NO: 1130298 - RNA, 22 nt, Human
gauuucaaagguucugcaugcc

SEQ ID NO: 1130299 - RNA, 22 nt, Human
ucaggcagcuccaggaauggua

SEQ ID NO: 1130300 - RNA, 22 nt, Human
agcagcucaaagccugcaagga

SEQ ID NO: 1130301 - RNA, 17 nt, Human
ugccagccugucccagg

SEQ ID NO: 1130302 - RNA, 22 nt, Human
auaaagucauuucaaaaguuga

SEQ ID NO: 1130303 - RNA, 22 nt, Human
guggccucaugucuauaaagag

SEQ ID NO: 1130304 - RNA, 22 nt, Human
cugagccaaccacagcaggagc

SEQ ID NO: 1130305 - RNA, 22 nt, Human
ucagaagcugguguccuuugaa

SEQ ID NO: 1130306 - RNA, 22 nt, Human
cuccuguauguugggcuucaca

SEQ ID NO: 1130307 - RNA, 22 nt, Human
auaucuuuguuuuugccaagau

SEQ ID NO: 1130308 - RNA, 22 nt, Human
acagaaauauagaagguaggaa

SEQ ID NO: 1130309 - RNA, 22 nt, Human
aagaaauuaaugugccauuacu

SEQ ID NO: 1130310 - RNA, 22 nt, Human
ggcaggaggugaguggcgggug

SEQ ID NO: 1130311 - RNA, 22 nt, Human
ugaguagcggcuauguguaacu

SEQ ID NO: 1130312 - RNA, 22 nt, Human
aaaguuugagugauuugacaca

SEQ ID NO: 1130313 - RNA, 22 nt, Human
gcagacagcauguugggcuauu

SEQ ID NO: 1130314 - RNA, 22 nt, Human
aagaaucauccugcaagagucu

SEQ ID NO: 1130315 - RNA, 22 nt, Human
uggcagcaguggagguagaaag

SEQ ID NO: 1130316 - RNA, 22 nt, Human
cggcuggguagaggugccgggu

SEQ ID NO: 1130317 - RNA, 22 nt, Human
gccucugccaagggggcugcgg

SEQ ID NO: 1130318 - RNA, 22 nt, Human
agauuucccaaauacuuguuau

SEQ ID NO: 1130319 - RNA, 22 nt, Human
gaagcccacguuuggugaugua

SEQ ID NO: 1130320 - RNA, 22 nt, Human
gcaggcaguugcaguuuucuag

SEQ ID NO: 1130321 - RNA, 22 nt, Human
cugcuggagguuggagcaugca

SEQ ID NO: 1130322 - RNA, 22 nt, Human
uugaggagcaggaugggaggcu

SEQ ID NO: 1130323 - RNA, 22 nt, Human
ugggacagugugccuugcuccu

SEQ ID NO: 1130324 - RNA, 22 nt, Human
uuuauguaauuucauaggugug

SEQ ID NO: 1130325 - RNA, 22 nt, Human
aagggaggggauguaagccugg

SEQ ID NO: 1130326 - RNA, 22 nt, Human
gcagugacagggcugcugccuu

SEQ ID NO: 1130327 - RNA, 22 nt, Human
gcuggccuucugcagaguucug

SEQ ID NO: 1130328 - RNA, 22 nt, Human
ugaagccaucaggaagccagca

SEQ ID NO: 1130329 - RNA, 22 nt, Human
uccugcugagcgucugucauuu

SEQ ID NO: 1130330 - RNA, 22 nt, Human
uggccucugugggagcugagca

SEQ ID NO: 1130331 - RNA, 22 nt, Human
cagcaugcaaguccagaugugg

SEQ ID NO: 1130332 - RNA, 22 nt, Human
auguguacaaccaagcacuaaa

SEQ ID NO: 1130333 - RNA, 22 nt, Human
agagccuguuuugugggagaug

SEQ ID NO: 1130334 - RNA, 22 nt, Human
uggaagggggaagacagcucug

SEQ ID NO: 1130335 - RNA, 22 nt, Human
cuuaggcagacugcugaugcag

SEQ ID NO: 1130336 - RNA, 22 nt, Human
agucagcagccuggccaggaga

SEQ ID NO: 1130337 - RNA, 22 nt, Human
uuuauguacauauccacaagga

SEQ ID NO: 1130338 - RNA, 22 nt, Human
ucuuuccuacuuuauugugaac

SEQ ID NO: 1130339 - RNA, 22 nt, Human
ugaaagcacucacuucugcucu

SEQ ID NO: 1130340 - RNA, 22 nt, Human
ccauuguaguaucuguuuuagu

SEQ ID NO: 1130341 - RNA, 22 nt, Human
gcuucucuggccugcagggcau

SEQ ID NO: 1130342 - RNA, 19 nt, Human
ggccccucucacaggaguu

SEQ ID NO: 1130343 - RNA, 22 nt, Human
gcuggucacucugggagcugcu

SEQ ID NO: 1130344 - RNA, 22 nt, Human
gacagaguuguugauguaugcu

SEQ ID NO: 1130345 - RNA, 22 nt, Human
ccucugggagacugcuacugag

SEQ ID NO: 1130346 - RNA, 22 nt, Human
gaauucuuuucuuucugaaagu

SEQ ID NO: 1130347 - RNA, 17 nt, Human
uccuucagugccucugc

SEQ ID NO: 1130348 - RNA, 22 nt, Human
agaugagggguagaaaggacuu

SEQ ID NO: 1130349 - RNA, 22 nt, Human
gaccugccugagcugccucugc

SEQ ID NO: 1130350 - RNA, 22 nt, Human
guuccuauauagccuuaaggau

SEQ ID NO: 1130351 - RNA, 22 nt, Human
aucuggcucgcuaggcucuggg

SEQ ID NO: 1130352 - RNA, 22 nt, Human
ugccaggcccagcuccagagcu

SEQ ID NO: 1130353 - RNA, 22 nt, Human
agcuggggcugcagagaacagg

SEQ ID NO: 1130354 - RNA, 22 nt, Human
augcaguaaaauaggagguaau

SEQ ID NO: 1130355 - RNA, 22 nt, Human
gagaagccgagucagcugagcc

SEQ ID NO: 1130356 - RNA, 22 nt, Human
ucuguuccaguagaaaggugca

SEQ ID NO: 1130357 - RNA, 22 nt, Human
ucuguaucacccguucccagaa

SEQ ID NO: 1130358 - RNA, 22 nt, Human
gcuggcucuucaguggagauag

SEQ ID NO: 1130359 - RNA, 22 nt, Human
ugggccugauucuugaauccug

SEQ ID NO: 1130360 - RNA, 22 nt, Human
gccuggucucuuucaugucagu

SEQ ID NO: 1130361 - RNA, 22 nt, Human
aggucaccauggcaugcuccac

SEQ ID NO: 1130362 - RNA, 22 nt, Human
uauaagaaacaaggcaaauuuu

SEQ ID NO: 1130363 - RNA, 22 nt, Human
augauggugggagaugacccag

SEQ ID NO: 1130364 - RNA, 22 nt, Human
caaaauguucuggcaccuuuaa

SEQ ID NO: 1130365 - RNA, 22 nt, Human
agguauagaauugaaaggguuu

SEQ ID NO: 1130366 - RNA, 22 nt, Human
cagggccucuccuccaggaacu

SEQ ID NO: 1130367 - RNA, 20 nt, Human
gccugccucagcuagcugag

SEQ ID NO: 1130368 - RNA, 22 nt, Human
aagaauguuaguuucugauaca

SEQ ID NO: 1130369 - RNA, 22 nt, Human
augcaucauggaaaacucaguu

SEQ ID NO: 1130370 - RNA, 22 nt, Human
aggaggccccuccuggguugcu

SEQ ID NO: 1130371 - RNA, 22 nt, Human
cguggccuuugagugagcuccc

SEQ ID NO: 1130372 - RNA, 22 nt, Human
guucccauacaguaucagugcu

SEQ ID NO: 1130373 - RNA, 22 nt, Human
cagggugcgccacucagaugua

SEQ ID NO: 1130374 - RNA, 22 nt, Human
ugccugucucugacugccauua

SEQ ID NO: 1130375 - RNA, 22 nt, Human
aaaguuuuagaacuaggaagca

SEQ ID NO: 1130376 - RNA, 22 nt, Human
cucaaggacuuauucaugccug

SEQ ID NO: 1130377 - RNA, 22 nt, Human
ugccaggccucaggagucucca

SEQ ID NO: 1130378 - RNA, 22 nt, Human
gcugagaguguaggauguuuac

SEQ ID NO: 1130379 - RNA, 22 nt, Human
ggcuuccuaauacucccuacac

SEQ ID NO: 1130380 - RNA, 22 nt, Human
uguguuuugaacucaucuacug

SEQ ID NO: 1130381 - RNA, 22 nt, Human
cugagauggccacugggucuca

SEQ ID NO: 1130382 - RNA, 22 nt, Human
ccuggcugaaccaaugaagugg

SEQ ID NO: 1130383 - RNA, 22 nt, Human
agagccugucugccuuucuacc

SEQ ID NO: 1130384 - RNA, 22 nt, Human
agcaaagucaguggaaccaucc

SEQ ID NO: 1130385 - RNA, 22 nt, Human
uuguuuuggaagaacuuacucu

SEQ ID NO: 1130386 - RNA, 22 nt, Human
augccaggccccacgcugggca

SEQ ID NO: 1130387 - RNA, 22 nt, Human
cagggagggacaauugucaccu

SEQ ID NO: 1130388 - RNA, 22 nt, Human
ggcucuggucagugaggggccu

SEQ ID NO: 1130389 - RNA, 22 nt, Human
cugcccugucuuuuucugauga

SEQ ID NO: 1130390 - RNA, 19 nt, Human
ggucucagugcagcugcag

SEQ ID NO: 1130391 - RNA, 22 nt, Human
ugcuggggauccguaccaaccc

SEQ ID NO: 1130392 - RNA, 22 nt, Human
aaauguaguauguugcauguau

SEQ ID NO: 1130393 - RNA, 22 nt, Human
agagaugaaaaguggagacugg

SEQ ID NO: 1130394 - RNA, 22 nt, Human
gaacccaguccaggugcagccu

SEQ ID NO: 1130395 - RNA, 22 nt, Human
ugcucugucaagaaaagaugcc

SEQ ID NO: 1130396 - RNA, 22 nt, Human
gccuucaguaguauccucauga

SEQ ID NO: 1130397 - RNA, 19 nt, Human
gagcugccuuuugaagacc

SEQ ID NO: 1130398 - RNA, 22 nt, Human
cuggggcucacuuuggucaggc

SEQ ID NO: 1130399 - RNA, 22 nt, Human
agggagguaggagcuucuagcu

SEQ ID NO: 1130400 - RNA, 22 nt, Human
uaagaagcuucugcuaaugccu

SEQ ID NO: 1130401 - RNA, 22 nt, Human
uugcagcagggugaauucacuc

SEQ ID NO: 1130402 - RNA, 22 nt, Human
uggcucugcugaaccuagugca

SEQ ID NO: 1130403 - RNA, 22 nt, Human
caggcagcaggagcccugcucg

SEQ ID NO: 1130404 - RNA, 22 nt, Human
ucucagagggaaaggccaauuu

SEQ ID NO: 1130405 - RNA, 22 nt, Human
gcuggccauucucuuugagaug

SEQ ID NO: 1130406 - RNA, 22 nt, Human
aggaaagcucccaguagggcuc

SEQ ID NO: 1130407 - RNA, 22 nt, Human
cucaggccauucuuccagcugc

SEQ ID NO: 1130408 - RNA, 22 nt, Human
agggcagccaugagccuucagg

SEQ ID NO: 1130409 - RNA, 22 nt, Human
gagcugccggcccacaguacua

SEQ ID NO: 1130410 - RNA, 22 nt, Human
cugggcugucaauggcccucug

SEQ ID NO: 1130411 - RNA, 22 nt, Human
agccaacuaggagauuaaggua

SEQ ID NO: 1130412 - RNA, 22 nt, Human
ucugggagacguguguugucag

SEQ ID NO: 1130413 - RNA, 22 nt, Human
ucagugucuugggcuugaaugc

SEQ ID NO: 1130414 - RNA, 22 nt, Human
cagcagcuuugccaagucagcc

SEQ ID NO: 1130415 - RNA, 22 nt, Human
cuggagcucuguguguuccuga

SEQ ID NO: 1130416 - RNA, 20 nt, Human
uccagcugggaacagcugau

SEQ ID NO: 1130417 - RNA, 22 nt, Human
ugaaggaaagagggaacauccc

SEQ ID NO: 1130418 - RNA, 21 nt, Human
ccuucuccacagggucuccgg

SEQ ID NO: 1130419 - RNA, 22 nt, Human
uggggaggacgggcgccuuccu

SEQ ID NO: 1130420 - RNA, 22 nt, Human
gggcacuggaaggcucucaggc

SEQ ID NO: 1130421 - RNA, 22 nt, Human
uucucuagguuuuagaugaaga

SEQ ID NO: 1130422 - RNA, 22 nt, Human
cccaggcugaugggaugggcca

SEQ ID NO: 1130423 - RNA, 22 nt, Human
agagcccucuucacugccccuu

SEQ ID NO: 1130424 - RNA, 22 nt, Human
guuuagaauucuaacuuuaagg

SEQ ID NO: 1130425 - RNA, 22 nt, Human
ggggccuguagagcuucaggga

SEQ ID NO: 1130426 - RNA, 22 nt, Human
ucaggggacuuaggagagaagu

SEQ ID NO: 1130427 - RNA, 20 nt, Human
gggguuggcuggcacaggga

SEQ ID NO: 1130428 - RNA, 23 nt, Human
uccaagggcuacaaacacagacc

SEQ ID NO: 1130429 - RNA, 22 nt, Human
uauguuuuucagacguccuaca

SEQ ID NO: 1130430 - RNA, 22 nt, Human
ggccugagucccaccuggcugu

SEQ ID NO: 1130431 - RNA, 22 nt, Human
ucaagcaucuuggucuacgauc

SEQ ID NO: 1130432 - RNA, 22 nt, Human
auuuguacaaauuuauguuagu

SEQ ID NO: 1130433 - RNA, 22 nt, Human
ccuuccuggcuguccgccugau

SEQ ID NO: 1130434 - RNA, 22 nt, Human
ugauuuccugugcgcccuuagg

SEQ ID NO: 1130435 - RNA, 22 nt, Human
gggcucuguccauuccuucaua

SEQ ID NO: 1130436 - RNA, 23 nt, Human
gcauugucuccccacuucugggc

SEQ ID NO: 1130437 - RNA, 22 nt, Human
caguacuuugaagauauuuuag

SEQ ID NO: 1130438 - RNA, 22 nt, Human
cagagugaaaacugagcucaaa

SEQ ID NO: 1130439 - RNA, 19 nt, Human
acacugaauguagaauugg

SEQ ID NO: 1130440 - RNA, 23 nt, Human
uaguuauuuucucuguaauuugc

SEQ ID NO: 1130441 - RNA, 23 nt, Human
cccagcuuucccacugccgagag

SEQ ID NO: 1130442 - RNA, 22 nt, Human
cuguguggccucaagccagccu

SEQ ID NO: 1130443 - RNA, 22 nt, Human
acauuucuuucuauucaguagc

SEQ ID NO: 1130444 - RNA, 22 nt, Human
uccaguggagugugggggugaa

SEQ ID NO: 1130445 - RNA, 22 nt, Human
ugaugguugauuauaaaucagu

SEQ ID NO: 1130446 - RNA, 22 nt, Human
aagucacagcuaaauagcuaag

SEQ ID NO: 1130447 - RNA, 22 nt, Human
ugguacacauguccaaggucag

SEQ ID NO: 1130448 - RNA, 22 nt, Human
uuguuaaaaugcauauucuggu

SEQ ID NO: 1130449 - RNA, 22 nt, Human
uggcucuguuuuaugaguacca

SEQ ID NO: 1130450 - RNA, 22 nt, Human
cccugcagcuuuugcauaguca

SEQ ID NO: 1130451 - RNA, 22 nt, Human
ugccucugcugcuguggcauca

SEQ ID NO: 1130452 - RNA, 22 nt, Human
cugggagagaagcgaagcuggg

SEQ ID NO: 1130453 - RNA, 22 nt, Human
uggcucaggugugagcugaaga

SEQ ID NO: 1130454 - RNA, 22 nt, Human
ggaggugaggccguagggugug

SEQ ID NO: 1130455 - RNA, 22 nt, Human
cugggagaugacucagagcagg

SEQ ID NO: 1130456 - RNA, 22 nt, Human
auaaacaguagagaaagguggu

SEQ ID NO: 1130457 - RNA, 17 nt, Human
uggcuucccugggccac

SEQ ID NO: 1130458 - RNA, 22 nt, Human
ccugaggcccuggcugugcuga

SEQ ID NO: 1130459 - RNA, 22 nt, Human
ccaaggaggccccaggucagcu

SEQ ID NO: 1130460 - RNA, 20 nt, Human
cagagacccaggcuucagcu

SEQ ID NO: 1130461 - RNA, 22 nt, Human
cauuucugugacacuuccaucu

SEQ ID NO: 1130462 - RNA, 22 nt, Human
ucuccucuauuucuguauguau

SEQ ID NO: 1130463 - RNA, 20 nt, Human
agcugaggcaccugagguua

SEQ ID NO: 1130464 - RNA, 22 nt, Human
agggccagcugaugagaaugag

SEQ ID NO: 1130465 - RNA, 22 nt, Human
uagcagggguagauagagugug

SEQ ID NO: 1130466 - RNA, 22 nt, Human
uccagggauguccuguagcacu

SEQ ID NO: 1130467 - RNA, 20 nt, Human
ucagccagcuaacaugggga

SEQ ID NO: 1130468 - RNA, 15 nt, Human
aaucuggcggcaagu
